United States Patent 9,782,462 (MODIFIED POLYNUCLEOTIDES FOR THE PRODUCTION OF PROTEINS ASSOCIATED WITH HUMAN DISEASE) - sequence listing, part 100

SEQ ID NO: 195813 - DNA, 1149 bp, Artificial Sequence
  Description of Artificial Sequence: Synthetic coding sequence
atggccgtgagcgtgacccccatccgggacaccaagtggctgaccctggaagtctgccgtgagttccagcgcggcacctgcagccggcccgataccgagtgcaaattcgcccacccttctaaatcttgccaggtggagaacggtagagtgatagcctgcttcgattcgttgaaaggccggtgctctagggagaattgcaagtacctgcacccgcctccgcacctgaagactcagctggagatcaatggaaggaacaaccttattcagcagaaaaacatggctatgttggcgcagcagatgcagctggcaaatgcaatgatgccaggggccccgcttcagcctgtgccaatgttctctgtggccccatcattggctaccaatgcaagcgctgctgcctttaatccttacctgggccccgtatcaccaagccttgttccagccgagatcctcccaactgcgcctatgcttgtgaccggcaatcctggagtgccagttccggctgccgcagccgccgccgctcagaaactaatgagaacagaccgcctcgaggtctgtcgtgagtaccaacgagggaattgcaatcgaggtgagaatgactgccgcttcgcgcatccagccgacagtaccatgatagacacgaatgataatacagtgactgtatgcatggattatatcaagggcagatgttcgagagaaaagtgtaaatacttccatccaccagcacacttacaggccaagatcaaggcagcacagtatcaggtgaaccaagccgccgctgcccaggccgccgccactgccgctgctatggggattccccaagccgttctgccccctctccctaagagacctgcccttgaaaaaactaatggggccaccgcagtctttaacaccggcatttttcagtaccagcaggcgttggccaatatgcaactgcagcaacataccgcatttctgccccctggttctatcctttgtatgacccctgcgacgtccgtcgtccctatggtccacggcgccacaccggcaacggtgtccgcggcaactactagtgctacatccgttccctttgccgccacagccactgcaaatcagatcccaatcatctctgccgagcacctgacctcccacaagtacgtgacccagatgtag

SEQ ID NO: 195814 - DNA, 1113 bp, Artificial Sequence
  Description of Artificial Sequence: Synthetic coding sequence
atggccgtgagcgtgacccccatccgggacaccaagtggctgacccttgaagtttgtagagagttccagcgtgggacttgtagccgccccgatactgagtgtaagttcgcccatccctcaaagagctgtcaggtagaaaatggacgcgtaattgcctgctttgactctctcaaaggaagatgttctcgagagaattgcaaatatcttcaccctcccccccacttgaagacgcaacttgagatcaacggtcgaaacaacctgatacagcagaagaacatggctatgcttgcacagcagatgcagctcgctaacgcaatgatgcccggagctcccttgcaaccagtgccaatgttttccgtggccccctcccttgccacaaatgcttccgcagccgcatttaacccttacctcggccctgtgagcccctccctcgtgcccgcagagatcctgcccaccgcaccgatgttggtcaccggcaaccccggcgtgccagtcccagctgccgcagctgcagccgcgcagaagctcatgcggaccgataggctagaggtttgtcgagaatatcaacgcggaaactgtaacaggggggagaatgactgtcgcttcgcacatccagccgactccactatgatcgacactaacgataacaccgttactgtctgcatggactacattaagggacggtgctctcgtgaaaaatgtaagtacttccatcctccagctcatcttcaggctaaaatcaaggcagctcagtaccaggtgaaccaagcggccgccgcccaggccgccgccacggctgctgcgatgggcatccctcaggccgtgctgcccccccttccaaaaaggcccgcactggagaagactaacggcgcaacagctgtgttcaacaccggtatcttccaatatcagcaggctttggccaacatgcagctgcagcagcacaccgcattcctgcccccagtaccaatggttcacggcgctacacccgccactgtgagcgctgctactacatccgccacatccgtgccctttgccgccacggccactgccaatcagattccgatcatctctgccgaacacctgacgagtcacaagtacgttacccagatgtag

SEQ ID NO: 195815 - DNA, 1029 bp, Artificial Sequence
  Description of Artificial Sequence: Synthetic coding sequence
atggccgtgagcgtgacccccatccgggacaccaagtggctgaccttggaggtgtgcagagaattccagcgcggcacctgttcccgaccagacactgaatgtaaatttgctcatcctagtaaaagttgtcaggtcgagaatgggcgcgtaattgcgtgcttcgactcactgaagggaaggtgttcaagagagaattgcaagtacctgcaccctccaccacacctgaagacccagctagaaattaatggtaggaacaacctcattcagcagaaaaatatggccatgcttgctcagcagatgcaactggctaatgcgatgatgcctggcgccccccttcaacctgtacccatgttcagcgttgcgccaagccttgcaactaatgcaagcgcagccgcatttaatccttacctcggtcccgtgagcccgagcctagtaccagcagagattctgcctaccgccccgatgctggtgaccggcaacccaggcgtgccagtgccggccgctgcagcagcagcagctcagaagctgatgaggaccgatcgcctagaagtctgcagagaatatcagagagggaactgcaatcgcggcgagaacgattgtcggtttgcccatccggcagattcaaccatgattgataccaacgacaacacggtaactgtctgcatggattatataaagggcaggtgttctcgggagaaatgtaaatacttccatccacctgcccacctgcaggcaaagatcaaagccgcccagtaccaggtgaatcaggcagctgcggcccaggccgctgccacagcagcggccatgggtatcccgcaggccgtgcttccacccctgcccaaaaggcccgcattggaaaagaccaatggggctaccgccgtctttaacactggcatattccagtaccagcaggcgctcgccaacatgcaattgcaacaacacactgccttcctgccgccaggaagtatactgtgcatgacaccagcaactagcgtcgacacacataatatctgccgtactagtgattag

SEQ ID NO: 195816 - DNA, 1167 bp, Artificial Sequence
  Description of Artificial Sequence: Synthetic coding sequence
atggccgtgagcgtgacccccatccgggacaccaagtggctgaccttggaagtttgccgggagttccagagaggcacatgttcccggcctgatacggaatgtaagtttgctcacccctcaaagtcttgtcaggtagagaatgggagagtgatcgcatgcttcgatagcctcaagggccgatgctcccgggaaaactgtaagtacctgcatcctcctcctcatcttaagactcagctcgagatcaatggccgcaataacctgatacagcaaaagaacatggcaatgctcgcacagcagatgcaactggctaacgctatgatgcctggggctcccctgcagccggtacctatgtttagcgtcgctcccagtctggccacaaatgctagcgccgctgctttcaatccatacctgggaccagtctctcctagtttggttcctgccgagattctgcccaccgccccaatgctggtaacagggaacccgggcgttcccgtaccggccgcagcggcggctgcggcacagaaattgatgaggacagataggctggaggtgtgcagggagtaccagcgagggaactgtaatcgtggagagaatgactgtaggtttgcccacccggcagacagcacaatgatcgacacgaatgacaataccgtcaccgtttgcatggactatataaagggaaggtgctcccgggagaaatgcaagtatttccacccgcccgcccacttgcaggccaagatcaaggccgcgcagtaccaggtcaatcaagctgccgcggctcaggccgccgctacagcagccgcgatgacacagtcagccgtgaagagcctaaagcgcccattggaggctacctttgacctgggcattccccaggccgtgctgcccccattacctaagcggccggctttggagaagactaatggcgccaccgcggtttttaacaccggcattttccagtaccagcaagccctggccaacatgcagctgcagcagcacaccgctttcctgcctcccgtgccaatggttcacggggctacaccagccactgtgtccgcagctacgacgtctgcaacctccgtgcctttcgctgccacagccacggccaatcagattcccattattagcgccgaacacctcactagtcacaagtatgtgacccaaatgtag

SEQ ID NO: 195817 - DNA, 1023 bp, Artificial Sequence
  Description of Artificial Sequence: Synthetic coding sequence
atggccgtgagcgtgacccccatccgggacaccaagtggctgaccctggaggtgtgcagagagtttcagcgaggaacttgtagtcgtccagataccgaatgcaaattcgctcatccgtctaaaagttgccaggtcgagaatggcagggtaatcgcatgtttcgactccctaaagggaaggtgttcacgagaaaactgcaagtatctacaccccccgccccaccttaagactcagctggagattaacgggaggaacaatctcatccagcaaaaaaatatggccatgctggcacagcagatgcagctagcgaatgctatgatgccaggcgccccactgcagcccgtcccaatgttctccgtggccccatcattggcaaccaacgccagcgctgcggctttcaatccctacctaggtcctgtgagcccatctctcgtccccgcagagatcctgccaacagccccaatgctggtaaccggaaatcctggtgtgccagttccagcggctgctgctgcagcggcccagaaactgatgaggactgaccggctcgaagtgtgcagggagtaccaacgagggaattgcaacaggggagagaatgactgtcgcttcgcccaccccgccgattcaacaatgatcgacaccaacgacaacacagtgacagtctgtatggattatattaaaggccggtgcagcagagaaaagtgtaagtacttccaccctccagctcatctccaggctaaaattaaggctgcccaatatcaggtgaaccaagcggctgcagcacaggcagccgccactgccgccgctatgttcccatggtgcacagtgctgaggcagccgctttgtccacagcaacagcatctgcctcaagtcttccctagtctccagcagccacaacctacttcccctatactggacgcgtccacactactaggtgccaccagttgtccagccgcggccggcaaaatgattccgatcatctcggccgagcatctgaccagtcataagtatgtgacacaaatgtag

SEQ ID NO: 195818 - DNA, 909 bp, Artificial Sequence
  Description of Artificial Sequence: Synthetic coding sequence
atggccgtgagcgtgacccccatccgggacaccaagtggctgaccttagaagtatgtagggaattccagagggggacctgctccaggcccgacacagaatgcaaatttgcccatccgagcaagtcctgtcaggttgagaatggtcgcgtgatcgcatgcttcgattccctgaaaggcagatgcagccgtgaaaactgcaagtatctgcacccaccccctcatctgaagactcagctggaaatcaatggaaggaataacctcattcagcagaagaatatggcaatgctcgcccagcagatgcagctagcgaatgccatgatgcccggtgctcctcttcagccagtggtctgtagagagtatcagcggggaaattgcaataggggagagaatgactgccgctttgcacaccccgccgattctacaatgatcgacactaacgacaacacagttaccgtgtgcatggattacattaaaggtcgctgtagcagagagaaatgcaaatacttccacccgcctgcccatttgcaggcgaaaatcaaggcagctcagtatcaagttaatcaagcggccgcagcgcaggcagcagccaccgcggccgcgatgggaattccacaggccgtgctgccgccccttcctaaacgccccgccctcgagaagacgaatggcgctaccgcagttttcaataccggaatttttcagtaccagcaggccttagcaaacatgcaactccaacaacataccgcttttctgccgcccgtgcctatggtgcacggcgccactcccgcgaccgtgtctgccgctacgacgtctgcaacgtcagtgcctttcgctgctaccgctaccgccaatcaaatacccattatttcagcagagcacttaacaagccataagtacgtcacccagatgtag

SEQ ID NO: 195819 - DNA, 1029 bp, Artificial Sequence
  Description of Artificial Sequence: Synthetic coding sequence
atggccgtgagcgtgacccccatccgggacaccaagtggctgaccctggaagtgtgccgggagtttcagcgcggcacctgctctcgcccagacacagagtgcaagtttgctcacccaagtaaaagttgtcaggtcgagaacgggcgagttatcgcgtgctttgactcactcaaaggccggtgcagcagggagaactgcaagtacctgcatcccccccctcacctcaaaactcagctggaaatcaacggccgtaacaacctgatccagcagaagaatatggctatgctggctcagcaaatgcaactggccaacgcgatgatgcctggagcccctctgcagccggtgcctatgttttcagtcgcaccatctttagcaacaaacgcaagcgcggccgcctttaatccataccttggccctgtatctccaagtttggtgccagcagagattctgcccaccgccccaatgctggtgacagggaatcctggagtccctgtcccggctgcagccgccgccgcagcacagaaacttatgcggaccgaccgcttggaggtgtgcagagagtatcagcgaggaaactgtaatcggggagaaaacgattgtaggtttgcccaccccgcggattccacgatgattgatacgaacgataatactgtgactgtttgcatggactacatcaaagggaggtgctcaagggagaaatgcaaatattttcaccctccggcccatctgcaggcgaagattaaggcagcccaataccaggttaatcaagccgccgccgcccaggccgcagctaccgcagctgccatgggaataccacaagccgtcctgccccccctccctaagcgccctgcccttgagaaaacgaatggcgcgaccgccgtgttcaacactgggatctttcaataccaacaggctttagccaacatgcagttacagcaacacactgcctttctgccccctgggtctattctgtgtatgacccctgcgactagtgtcgatacacacaacatttgccgaacctctgattag

SEQ ID NO: 195820 - DNA, 1032 bp, Artificial Sequence
  Description of Artificial Sequence: Synthetic coding sequence
atgggccggtgcagccgggagaactgcaagtacctgcacccccccccacacttgaaaacccagctggagataaatgggaggaataacctgattcagcagaaaaatatggctatgctggcacagcaaatgcagcttgccaacgctatgatgcctggcgcaccactacagcccgtgccaatgttttcagtcgccccctccctagctactaatgcttccgccgccgcatttaacccctatctggggcctgtgtccccatccctggttcccgcagagatcctgcccaccgcccccatgctcgtgaccgggaaccctggcgtgcccgtaccagccgccgccgccgccgcagctcagaaactgatgcggactgatcgtctggaggtgtgtcgggagtatcagcgtgggaattgcaatagaggggagaacgactgtcgctttgcccaccctgccgacagtaccatgatcgatactaatgataataccgttaccgtttgtatggattacatcaaaggcaggtgtagtagagaaaagtgcaagtatttccatcctccggcacatctacaggcaaagatcaaagcagctcaatatcaggtcaaccaggccgctgctgcccaagccgccgcgaccgccgcagctatgacccagagtgctgtgaaaagcctgaagcgccccctggaggccactttcgatcttgggatcccacaggcagtgcttccaccactacctaagcggccagctctagagaagactaatggggctactgcggttttcaacacaggcatcttccaataccagcaggcacttgccaatatgcagttgcagcaacataccgcgtttttaccgcccggaagcatcctgtgtatgaccccggccacatctgtggtccctatggtgcacggcgctacccctgctactgtttcagctgctaccaccagcgcaacctcagtgccttttgcagcaactgccaccgcaaatcagatccccataatctccgcagagcacttgacatcacacaagtacgtaactcagatgtag

SEQ ID NO: 195821 - DNA, 945 bp, Artificial Sequence
  Description of Artificial Sequence: Synthetic coding sequence
atggccgtgagcgtgacccccatccgggacaccaagtggctgaccttagaagtgtgccgagaatttcagcgcggcacatgcagtagacctgatacagagtgtaagtttgcccacccgagcaagtcttgtcaggtagagaacgggagagtcatagcttgttttgattctctgaaaggccgctgctcgagggaaaactgcaagtaccttcatcctccccctcacttgaaaacccaactggagatcaacgggcgtaataacttgatccagcagaagaatatggccatgctagcacaacagatgcaattggctaacgccatgatgcccggggcccctttgcagcccgttgtgtgccgggagtatcagaggggaaactgcaaccggggggaaaacgactgtagatttgctcatccggcagatagtacgatgattgatacaaacgacaacacagtgacagtgtgtatggactatataaaagggcggtgcagtcgagaaaagtgtaaatattttcaccctccggctcatctgcaggccaagatcaaagctgctcagtaccaggtgaaccaagctgccgccgcacaggctgctgccacagcagctgccatgggcattccgcaagccgtcctacccccactgccaaaacgtcccgctctggaaaagacaaacggcgccaccgccgtgttcaacacaggcattttccagtaccaacaggccctggcaaacatgcagttgcagcagcacaccgcgtttctgccacctggttctattttatgcatgacccctgctacttccgtggtccccatggtccatggcgctacccccgccaccgtgagcgcagccacgacaagtgccacctcagtccctttcgccgcgacagctactgctaaccaaatccctatcatatcagccgaacatctgacatcccacaaatatgtaacacaaatgtag

SEQ ID NO: 195822 - DNA, 1005 bp, Artificial Sequence
  Description of Artificial Sequence: Synthetic coding sequence
atgaccgccgtgaacgtggccctgatccgggacaccaagtggctgacactggaggtttgccgtgaatttcagcgaggcacctgttcaagagcggacgcagactgcaagtttgctcacccaccccgggtgtgccatgtggagaatggtcgagtggtggcttgcttcgattctctgaaagggcgctgcactcgcgagaactgcaaatacttacatccccccccacacctcaagacgcagctagaaattaatgggcgtaacaacctcatccagcagaagaccgctgcggccatgtttgcccagcagatgcagctcatgttgcagaacgcccagatgtcttctttggggagttttcccatgactccgtcaataccagctaaccccccaatggcatttaacccatatattccccatcccggcatgggacttgtcccagccgaactggtgccgaacacccccgtgctgatcccgggaaaccctcctctggccatgccgggagctgtgggccccaagttgatgagatccgataaattagaggtctgcagagaattccagcgcggtaactgcactagaggcgagaacgactgtcgctacgcccacccgactgatgcctcaatgatcgaggctagtgataatactgtgaccatttgcatggattacattaaaggacgatgctcccgcgaaaaatgcaagtatttccacccacccgcacacctgcaggctaggttgaaagccgcccaccatcaaatgaaccactccgctgcctccgccatggccctgacaaacctgcaacttccccaacctgcatttatccctgctggccccatactctgcatggcaccggccagcaacatagtacctatgatgcatggagcaacacccacaacggtcagcgctgctaccacccctgcaacatcggtcccctttgctgcaccaactacaggaaatcagattcctcagttgagcattgacgagctgaactctagtatgtttgtgagccaaatgtag

SEQ ID NO: 195823 - DNA, 777 bp, Artificial Sequence
  Description of Artificial Sequence: Synthetic coding sequence
atgttcgcccagcagatgcagctgatgctgcagaacgcccagatgtcctcgctgggaagctttcccatgacgcctagcatcccagccaatcctccaatggccttcaatccctatattcctcaccctgggatgggactcgtgcctgccgaactcgtgccaaacacacccgtcctcataccgggcaacccaccactggccatgcccggcgccgtggggcctaagctgatgagatctgacaaactggaggtttgtagagagttccagaggggaaattgcacccgcggagagaatgactgccgctatgctcatcccaccgatgcaagcatgattgaggcaagcgataacaccgtcaccatttgcatggactacatcaaaggccggtgctcgagagagaagtgcaagtactttcaccccccagcacatctccaggccagactgaaagccgctcaccatcagatgaatcacagcgccgcttctgccatggccttgcagccaggaactctccagctcatcccaaagaggagtgcgcttgagaaaccaaatggagcaactcctgtgtttaatcctaccgtgttccactgtcagcaggccctcaccaatcttcagttacctcagcctgcttttatccccgcaggtccaatcctctgcatggccccagcctctaatattgtgccaatgatgcatggtgcaacacctactacagtgtcagccgcaacaacgccagctacttcagtgcctttcgctgcgcctactaccgggaaccaacttaaattctag

SEQ ID NO: 195824 - DNA, 915 bp, Artificial Sequence
  Description of Artificial Sequence: Synthetic coding sequence
atggagcgggccagcaagaacctgaagggccggtgcacccgggagaattgcaagtatctccatccacccccccaccttaaaacccagctggagattaacgggcgcaacaacttgatacagcaaaagaccgctgccgccatgttcgcccagcagatgcagttgatgctccaaaacgcccagatgtcatcactggggtccttcccaatgacacctagtatcccagccaatcctccgatggcttttaatccatatataccccatcctgggatgggactcgtccccgctgagctcgtccccaatacaccagtcctgatacctggaaaccctccactcgccatgcccggtgcagtgggcccaaagctgatgcgctctgacaagctggaggtgtgccgcgaattccaaagggggaactgcacgcgaggtgagaatgattgtcgttatgcccatcccactgacgccagcatgatcgaggcatccgacaataccgtgactatttgtatggattacatcaagggcagatgctctcgtgagaaatgcaaatacttccacccgcccgctcacctccaggccaggctaaaggccgcccatcaccagatgaatcattctgcagcatcagctatggccctgcagcccggcaccctgcagctgatacctaagcgctctgcactggagaaacctaatggggccacgccagtattcaaccccacagtgtttcactgccaacaggcgcttacaaacctccagctgcctcaacctgcatttatccccgccggacccatcttgtgcatggcacctgcctcaaacatcgtgccaatgatgcacggggctacccccacaacagtctcagccgccacaacgcccgctacttccgtccctttcgccgctcccacgaccggaaatcaactgaagttctag

SEQ ID NO: 195825 - DNA, 1065 bp, Artificial Sequence
  Description of Artificial Sequence: Synthetic coding sequence
atgaccgccgtgaacgtggccctgatccgggacaccaagtggctgaccttagaggtgtgtagggagttccagagagggacatgcagtagggccgacgccgactgtaagttcgcacatcctccccgcgtctgtcacgtggagaatgggcgcgttgttgcctgttttgactctttgaaggggaggtgtacacgggagaattgtaagtacctgcatcctcctccacacttaaagacacagctggaaatcaatgggcgtaacaacctaatccagcagaaaacggcagctgcaatgtttgcacagcagatgcaactcatgttgcagaatgcgcagatgagttcgttgggcagctttcccatgactcccagtattccggccaacccccctatggcgttcaacccatatatcccccatccaggaatgggacttgtgcctgccgaacttgtcccgaatacgccggttctgattcctggcaatccacctttggccatgcctggcgccgtaggcccaaagctgatgcgctccgataagctggaggtgtgtagagagtttcagcgcggcaattgtacccgcggagaaaacgattgtagatatgctcatccaactgacgcaagcatgattgaggcctccgataatactgtgaccatatgtatggattatattaaagggcgctgttccagggaaaagtgcaaatatttccacccccctgcgcacctccaagcgcggctgaaagctgcccatcatcagatgaatcactccgccgcatcggcaatggcactgcagcccgggacactgcaactcattccaaagaggtcggcactcgagaaaccaaacggcgccaccccagtgtttaatccgacagttttccactgtcagcaggcattaactaacttacagctgcctcagccagcctttattcccgcagggcctattctttgcatggcccccgcttcaaacatcgtgccgatgatgcatggagcaacccccaccaccgtctctgcagccactaccccggccacatccgtgccctttgctgcccccactacaggcaatcaactgaagttctag

SEQ ID NO: 195826 - DNA, 1029 bp, Artificial Sequence
  Description of Artificial Sequence: Synthetic coding sequence
atgaccgccgtgaacgtggccctgatccgggacaccaagtggctgacgttagaggtgtgtcgcgagtttcagcgtggaacatgttctcgcgcagatgcagactgcaagtttgcacatccgccacgcgtctgccatgtggaaaacggtcgcgtggtggcatgtttcgactctctgaaaggcagatgcacgagagagaactgcaagtatctgcacccgcccccacatctcaaaacacagctggaaattaatggacgcaacaatctgattcaacaaaagaccgctgccgctatgtttgctcagcagatgcagttgatgctccagaacgcccagatgagctctttggggagttttccgatgacacctagcatacctgctaacccacctatggcatttaatccctatatacctcatccgggcatgggattagtaccagctgagctcgtacctaataccccagtactcatccccgggaacccacccctcgccatgcccggtgccgtgggacctaaacttatgcgctccgacaaactggaggtctgtcgcgagttccaaaggggtaattgcacaagaggcgaaaatgactgcagatacgctcaccctactgacgcttctatgattgaagcctctgacaacacggttaccatttgtatggattacatcaaaggcagatgctccagagagaaatgcaaatacttccacccaccagcacatctgcaggccaggttgaaggccgcccaccaccagatgaaccacagcgccgcctctgcaatggcactgcagcctgggacattgcaacttatacctaagcggtcagcccttgaaaaacccaacggcgctacacctgtcttcaaccccaccgtgttccactgccagcaagcgctgaccaacctccagctgccccagcccgccttcatacctgcggtgcccatgatgcacggcgccacccccactactgtttccgccgcaaccacccctgcaacgtccgtgccctttgccgcacctactaccgggaaccaactcaagttctag

SEQ ID NO: 195827 - DNA, 777 bp, Artificial Sequence
  Description of Artificial Sequence: Synthetic coding sequence
atgttcgcccagcagatgcagctgatgctgcagaacgcccagatgtcatcactaggaagctttcctatgaccccctctatccccgccaaccccccaatggccttcaacccctacattccgcaccccggtatgggcctcgttccagccgaacttgtgcccaataccccggttttaatccctgggaatcctccactagctatgccgggggctgtcgggcctaagttgatgcgtagcgacaagctcgaagtgtgtcgcgagttccagaggggcaactgcactcgtggagagaatgattgtcgctatgctcatcccaccgacgccagcatgatagaagctagtgacaatacagttaccatttgtatggactatatcaaaggccggtgctcaagagagaaatgtaagtattttcatccgcctgctcaccttcaggcgaggctgaaggcagctcaccatcagatgaaccacagcgccgcctctgctatggcattgcagcccggtactctgcagctaattccaaagaggtccgcactggaaaagcctaacggggccacgcccgtcttcaatcccactgtgttccactgtcagcaagctcttactaacctccagctcccccaaccagcctttatccccgctgggcccatcctctgtatggcccccgcatctaacattgtgccaatgatgcacggagcaaccccaaccaccgtttcagccgctacgactcccgcgacaagtgtcccatttgcagcaccgacgacggggaatcagctcaagttctag

SEQ ID NO: 195828 - DNA, 672 bp, Artificial Sequence
  Description of Artificial Sequence: Synthetic coding sequence
atgttcgcccagcagatgcagctgatgctgcagaacgcccagatgtcttccctgggaagcttccctatgaccccaagtatacctgccaatcccccaatggcattcaacccctacatcccccatcctggaatgggattagtgcctgctgagctggtaccgaatactcctgtcctcattcccgggaacccacccctggccatgcctggggcagtggggcctaaactgatgagaagtgacaagctggaagtatgtagagagtttcaacgtggcaattgcacccgtggcgagaacgactgccggtatgcccacccaaccgacgcctcgatgatagaagccagtgataacaccgtcaccatctgtatggattatattaaaggccgatgcagcagagaaaagtgcaagtatttccacccccccgcccacctgcaggctagactcaaggcagcgcaccatcagatgaatcattcagctgcctccgccatggcgctgcagcctggaaccctgcagttgataccaaaacgctccgccctggaaaaacccaacggggccaccccggtcttcaatcccaccgtgtttcactgccagcaggcccttaccaatcttcagttaccccagccagctttcattccagccggaccgatactgtgtatggctcccgcctccaacatctag

SEQ ID NO: 195829 - DNA, 729 bp, Artificial Sequence
  Description of Artificial Sequence: Synthetic coding sequence
atgttcgcccagcagatgcagctgatgctgcagaacgcccagatgagctccttaggaagcttcccaatgaccccaagcattcctgctaaccctcccatggcctttaatccatacatcccccacccagggatgggccttgttcccgccgaactagtgcccaacacacctgtattgatcccaggcaacccaccccttgctatgcccggtgccgtggggccaaagctgatgcggtctgacaagttggaagtctgccgcgaattccagcgaggaaattgcacaagaggggagaacgattgccgatacgctcacccaacagatgccagcatgatagaagccagtgacaacactgttacaatatgcatggactatattaagggacgatgttctcgcgagaagtgtaagtactttcacccccccgcgcacctgcaggcccggctgaaagcagcgcatcaccagatgaatcactccgccgccagcgccatggcactccagccgggtactctgcagctcatccccaaacggtctgctttagaaaaaccaaatggagccacaccagtcttcaatcctactgtgttccattgtcagcaggcactgactaatctccagctccctcagcctgcattcatcccagcaggacctatactgtgtatggctccggcaagcaacattgtgccaatgatgcacggagcgacccccaccacagtaagtgccgccaccactccggcatag

SEQ ID NO: 195830 - DNA, 453 bp, Artificial Sequence
  Description of Artificial Sequence: Synthetic coding sequence
atcaagggccggtgcagccgggagaagtgcaagtacttccacccccccgcacatctgcaggctcgattgaaggccgcccatcatcagatgaaccactctgccgcgtctgccatggccctccagccggggactctgcagttgattcccaaaagatctgcactggagaagcctaacggcgcgacacccgtgttcaaccccacagtgtttcactgccagcaagccctgaccaatctgcagctgcctcagccagcctttatccccgcaggacctatcctctgcatggccccagcttcaaatattgtccccatgatgcatggcgcaacgcccaccacggtgtccgccgcaactacacctgcaaccagcgtgcccttcgctgcccccacaactggaaaccagatcccccaactatccatcgatgagctgaatagttcaatgtttgttagtcagatgtag

SEQ ID NO: 195831 - DNA, 879 bp, Artificial Sequence
  Description of Artificial Sequence: Synthetic coding sequence
atggagcgggccagcaagaacctgaagggccggtgcacccgggagaattgcaagtacctacaccctccaccccatctgaagacacaattggagatcaatggccgcaataatcttattcagcagaagactgctgccgcgatgtttgcacagcagatgcagctgatgctgcagaacgcccagatgagcagcctggggtccttcccaatgaccccaagcatccccgctaatccacccatggctttcaatccctatatccctcatccggggatggggctcgtgcccgcagaactcgtccctaacacacccgttctcatcccaggtaatcctcctctcgcaatgcccggggccgtgggacccaagctaatgcggtccgataagctggaagtttgccgcgaattccaacggggcaattgcacccgaggagaaaacgattgcagatatgctcatcccaccgacgcatccatgatcgaagcatccgataacacagtgacaatctgtatggactacattaagggtcgctgttccagagaaaagtgtaaatactttcatccacccgcccatcttcaggcccgtttgaaagcagcccatcatcagatgaatcactccgcagcatcagctatggccttacagcctggcacgcttcagctcattcctaagaggagtgcactcgagaaacccaacggagcgacaccagtcttcaacccgaccgtgttccactgccaacaggcactcaccaatctgcaactcccacaaccagcgttcattccagctgtccctatgatgcacggagctaccccaacgaccgtgtcggccgctaccacaccagcaacaagcgttccttttgccgcgcctacgaccgggaatcagttgaaattttag

SEQ ID NO: 195832 - DNA, 1377 bp, Artificial Sequence
  Description of Artificial Sequence: Synthetic coding sequence
atggagctggagaagcgggagaagcggagcctgctgaacaagaacctcgaggagaagctgaccgtttcggccgggggatccgaggctaagccgttgatcttcaccttcgtgcctaccgtccgacggctgccaactcacactcaacttgccgacacttccaagtttctcgtcaagatccccgaggagtcctccgacaagtctcccgaaaccgttaatcgctccaagtccaacgactacctgaccctgaacgcaggctcgcagcaggagcgggatcaggctaagctgacctgtcctagcgaagtgagcggcaccatccttcaggaacgggagttcgaggcaaacaagctccagggaatgcagcagagtgatttgtttaaggccgaatatgtccttatcgtggattctgagggcgaggatgaggccgctagccggaaagttgaacagggaccacccggcggcattgggactgctgcagtccggcccaaaagccttgccatcagcagtagcttggtttccgacgtagttcgacctaagacgcagggtaccgacctcaagaccagctctcacccagagatgttacacgggatggccccacaacagaagcacggacagcaatataaaaccaagagctcttacaaggccttcgctgctatccccactaataccctcttactcgagcagaaggctctagacgaacccgcgaaaactgagagtgtttcaaaggacaacactctggagccacccgtggagttgtactttcccgctcagctgagacagcagacagaagagctgtgcgccactattgacaaagtcctgcaggatagcctcagcatgcactctagcgatagcccctcaagatccccgaagaccctgttgggaagtgacacagtcaagacccccacaaccctgcctagagcggcaggcagggagacaaagtacgccaacctgtccagcccttctagtaccgtgtccgagagtcagctgaccaagcctggcgtgattaggccggtgcctgtgaagagcaggatcttattgaagaaggaagaagaagtatacgaacccaaccccttctcaaaatatctggaggataactcggacttgttcagcgaacaagacgtaacagtgcctcccaagcccgtcagcttacatcctctgtaccagaccaagttatacccccccgctaagtcacttctgcacccccaaacactatctcacgctgattgtctggccccaggccctttctcacacctcagtttctcgttaagtgacgaacaggagaattctcacaccctgttaagccacaacgcatgtaataagctctctcaccccatggtcgctatcccagagcatgaggctctcgactccaaggagcagtag

SEQ ID NO: 195833 - DNA, 873 bp, Artificial Sequence
  Description of Artificial Sequence: Synthetic coding sequence
atgaccagctgcatcctgagcggcagcatccagaccaccccccaggtgagcgcaggaggcagcgaggcgaagcccctaatttttacgtttgttcccacagtcagacggctcccaactcatacccaactggccgatacatctaaattcctggtgaaaattcctgaggagtccagtgacaagagcccagagactgttaatcgcagtaaaagcaacgattatctcaccctcaatgctggatcccaacaggagagagaccaggccaagctcacgtgcccatccgaggttagcggaacgattctgcaagaacgggagttcgaggcaaacaaactgcaggggatgcagcagtcagacctatttaaggccgagtacgttctcatagttgattccgagggcgaggacgaggccgcttcaaggaaagtggagcaagggcctcccggcggcattggtaccgccgccgtgaggccgaaatcactggccatttcctcatccctggtctcggatgtagtgcgcccaaaaacccagggtacagatctgaagacgagcagccatcctgaaatgctgcatggcatggcccctcagcagaagcatggccagacccctactacgctgccccgggccgccggacgggaaacaaaatatgcaaacttatcctccccctcttccacggtttcagaatctcagctcacgaagccaggcgttatccggcctgttccagtgaaatcccggattctgctaaagaaagaagaagaggtttatgagcctaaccctttttccaagtacctggaggataatagcgatcttttcagcgagcagttatcgcatcccatggtggccatccccgaacacgaggcactggattctaaagaacagtag

SEQ ID NO: 195834 - DNA, 705 bp, Artificial Sequence
  Description of Artificial Sequence: Synthetic coding sequence
atgtgcagctggtacctgggcttcgagtgcagcagcaagagcaacgattacctgacgcttaacgccgggtcccagcaggagcgggatcaagcaaaattgacttgcccctctgaggtaagtggtaccattctgcaggagagggagttcgaggctaacaagctgcaagggatgcagcagtcagacctatttaaggcagagtacgttctgatcgtggatagcgagggcgaggatgaagccgccagcaggaaagtcgagcagggccctcccgggggcataggcactgccgcagtgaggcccaaaagcctcgcaatttccagcagcttagtgagcgacgtcgtgcgcccgaaaacccagggcactgatttgaaaacaagttcccaccccgaaatgttacacgggatggctccacagcaaaaacatggccaaacccccacgacactgccccgggccgccggaagagagaccaagtacgcaaatttgtcttcaccgtcctctaccgtgagcgagtctcagctgacaaaacccggcgtaattaggcctgtacctgtgaaaagccgaatcctgctcaagaaggaggaagaggtttacgagcctaatccattttccaagtatctcgaggacaacagcgatcttttttcagagcagttgtctcaccccatggtggctatacccgagcacgaagctctggattccaaagagcagtag

SEQ ID NO: 195835 - DNA, 489 bp, Artificial Sequence
  Description of Artificial Sequence: Synthetic coding sequence
atgcagcagagcgacctgttcaaggccgagtacgtgctgatcgtggactcagaaggcgaggatgaagccgcaagtcgcaaagtagagcagggaccaccaggtggcatcggtaccgcggccgtccgacctaagtctctggctatatcctcaagcctggtgagcgacgtggtccgtcctaaaacacagggaaccgacctgaaaacttcctctcacccggagatgctgcatggtatggcacctcagcagaaacacggccagcagtataagaccaaatcttcctacaaggcatttgctgctattcccacaaacaccctgctcttagagcagaaagccctcgacgaacctgctaaaacagagagtgttagtaaggacaacacccttgagccccctgtggagacccctaccacactacctcgggcagccggtcgagaaacaaaatacgcaaacttgtcttccccaagcagcacagtctcggagtcacaactatag

SEQ ID NO: 195836 - DNA, 2208 bp, Artificial Sequence
  Description of Artificial Sequence: Synthetic coding sequence
atggccgccggcggcgccgtggccgccgcccccgagtgccggctgttgccctatgcactgcacaaatggagctcgttcagctcgacctatctgcccgaaaacatcttagtggataagccaaacgaccagtcctccaggtggtccagtgagagcaactacccgcctcaatatcttatcttgaagctagagcggccagctattgtgcagaacatcacctttggaaagtatgaaaaaacccacgtgtgcaacctgaagaagttcaaggtattcggaggaatgaacgaagagaatatgacggagttgctttcctcaggcctcaaaaacgactacaacaaggagactttcacactgaaacataaaatcgatgagcagatgtttccctgcaggtttatcaagattgtcccactgctcagttgggggccaagtttcaactttagcatttggtatgtcgagctctccggcattgacgatcccgatattgtccaaccctgtctgaattggtatagcaagtacagggagcaggaggccatccgcctctgcctcaaacatttccgtcagcacaattatacagaggcattcgagtcactacagaaaaagacaaagatcgctctcgagcatcccatgcttactgacatacacgacaaactagtgctgaaaggggattttgacgcctgcgaggaacttatcgagaaggctgttaacgacggtcttttcaaccagtatatctcacaacaagagtacaagccgcggtggtcccagatcatccccaaaagcaccaaaggcgatggggaggataatcgcccaggcatgagggggggccaccaaatggtgatcgacgttcaaacagaaaccgtatacctttttggtggttgggatggtacacaggacttggcagatttctgggcctattccgtgaaggagaaccagtggacctgcatttcccgtgacacagaaaaggagaatggaccctctgctcggagctgccataagatgtgtatagacatccagaggcgacagatctacactctgggtagatatctggatagctccgtccgcaactcaaagagtctcaaatccgacttttacagatatgacatcgataccaacacatggatgttgctgtcagaggacacagctgccgatggcggtcctaaactcgttttcgatcatcaaatgtgtatggattccgaaaagcacatgatctacacatttggggggagaatactgacatgtaacggatcagttgatgacagccgggcaagtgagccgcagttttccgggctctttgctttcaactgccagtgccagacatggaagctgttgcgagaggatagctgtaacgccggtcctgaagacattcaatcacgtatcggccattgtatgctgtttcactcgaagaacaggtgtctgtacgtatttgggggccagcgcagcaagacctacctgaacgactttttttcatatgacgttgatagtgaccatgttgacataatttctgatggtaccaagaaagactcaggtatggtcccgatgacaggatttactcagcgagccaccatagaccctgaactcaacgagatccatgtgctgagtgggctcagcaaggacaaagagaagcgcgaggaaaacgtgagaaattctttctggatctacgacatagtgcggaacagctggtcctgcgtgtacaaaaacgatcaggctgctaaggacaatccgacaaagtcactacaggaagaagaaccttgcccaagatttgctcaccagctagtatacgatgagctgcacaaggtgcactacctgtttggcggcaaccccggtaagagctgcagccctaagatgcgtttagatgacttttggtccttgaagctgtgtcgaccaagcaaagattatctgctgcgtcattgtaagtatttgatccgcaagcatcgtttcgaagagaaggcacaggtagatccgctatccgcactgaagtacctgcagaacgatctgtatataacagttgatcatagtgacccggaggagacaaaggagttccagctactggcttccgccctgttcaaatcggggtcagatttcaccgctctgggattttcagatgtcgatcacacctatgctcagcgtacccaactattcgataccctggtgaatttctttcctgactcaatgaccccacccaagggtaacctggtggacttaataactctttag

SEQ ID NO: 195837 - DNA, 558 bp, Artificial Sequence
  Description of Artificial Sequence: Synthetic coding sequence
atgaccggcttcacccagcgggccaccatcgaccccgagctgaacgagattcatgtgttgtccggcctgagcaaggacaaggagaagagggaagagaacgtacgcaactccttctggatctatgatattgtgagaaactcctggtcatgtgtgtataagaatgatcaggccgcaaaggacaaccccaccaagagcctccaagaagaggagccttgcccccggttcgctcaccagctggtatacgatgaattgcataaagtgcactatctgttcggcgggaaccctggcaaaagctgttccccgaaaatgcgtttggatgacttctggagcctgaaactgtgtagaccatcaaaggattacctactacggcattgtaagtacctgatcagaaaacatcgattcgaggagaaggcccaagtcgaccctctcagcgctcttaagtacttgcaaaatgacctttacattactgtggatcactctgacccggaggagaccaaggaagccttccttatgtggatcacacccatgctgaaggaactcagctccctgactccttag

SEQ ID NO: 195838 - DNA, 3060 bp, Artificial Sequence
  Description of Artificial Sequence: Synthetic coding sequence
atgatggccgccgccgccgccgccgccgccggcagcagcagcagcggaggcggcggcggcggaagcggctctagcagctcatcttctgatactagcagtacaggtgaagaggaacgaatgcgccggttattccagacctgtgatggggacggcgacggctacatttcccgcaacgatctgctcatggtgtgtaggcagctaaacatggaagaatctgttgcggagattatgaaccagttaggagcagatgagaacggcaagatcagtttccaggactttacgcgatgtcgtatgcagctggtgcgtgaaatcagaaaggaggaggttgacttgtctgctaagtctgacaacagttgtacaaagaagctacgggaccggatagccagctggcctacttcatctgataactccctgggagctttatctgctgccagggagagctgggaatacgacagcggcgcaagggatctccaatccccagatgtgcagagtcagagcgccctccaaaaattgcttgaatacggagggtctagcctccaccagcaggctgcactgcataagctactgacacagtcgccccacatcggcaactccgtgggagggtcctatctggagctggccaatactctgcacagcgctgctcttgcaagcttgaagggggatatcgtggaattaaacaaaagactacagcaaacagagagagagcgggatctgctcgagaaaaagttagcgaaggcccagtgcgagcagtcgcatcttatgagagagcacgaagacgtacaggaaagaaccactcttagatatgaggagcgcatcactgagctgcatagtgttatcgcggagttgaataagaagatcgatcggctgcaaggcaccactattcgcgaagaggacgagtactcggagctaagatccgaattgtctcagtcacagcatgaagtgaacgaagatagtcgctcgatggaccaggaccagacctctgtatccattccagaaaaccagagtaccatggtcacagccgacatggacaactgtagtgacctcaactcagagctgcagcgcgtgctcaccggtcttgagaacgtagtgtgcggtagaaagaaatccagctgctcgctgtccgtcgctgaagtcgacaagcacatcgaacagctgacaactgcctcagaacactgcgatctggccatcaagaccgtggaagaaatcgaaggagtactcggacgcgacctgtaccccaatcttgccgaggagcggtcacgctgggaaaaggagcttgcaggactgcgtgaagagaatgaaagcctgacagcgatgctgtgcagtaaggaggaagagctgaatcggacgaaggccactatgaatgctatcagagaggaacgcgatcgtctgagacgccgcgtaagggagctccaaacccgtctccagtccgtccaggccacaggaccatcgagtccagggagactaaccagcacgaatcggccaatcaatccttccaccggagaactttccacatcgtcttcatccaatgacatccccattgcaaaaattgcagagagagtgaaactgagtaagactcgctcggaatccagttctagcgaccgtcctgtcctcgggagtgaaatttctagcattggggtctcttcttccgttgctgaacatctggcgcactccctgcaggattgtagtaatattcaagaaatcttccagactctgtattcacacggaagtgccatatctgaaagtaagatccgcgaatttgaggtggagaccgagcgcctcaactcacgtattgaacacctgaagtctcagaatgacctgttaaccatcacccttgaggaatgcaaaagcaacgctgaacggatgtctatgctggtcggcaagtatgagagcaatgccaccgctctccgcctggccctgcagtatagtgaacagtgcattgaggcctacgagctgcttctcgcccttgccgaatctgaacaatctctcatcttggggcagttcagggccgctggcgttggctcctcgccaggcgaccagtccggagacgagaacattacccagatgttgaagagagctcacgactgccggaagacggcggagaatgccgctaaggcattgctcatgaagctggacggctcatgtgggggagccttcgctgttgccggttgttcagtgcagccgtgggagtcgctgagctccaactcacacacatctacgactagctcaacggctagcagctgtgacacagaattcactaaggaggatgaacagagactgaaagactacatccagcaactgaaaaacgacagagccgcagtaaagcttacaatgctggagctggagtccattcacatcgacccactgagctacgatgtaaagccacgcggagactcccaaaggctagacttggagaacgccgtgttgatgcaggagcttatggcaatgaaggaagagatggctgaactgaaggcgcagctgtatctccttgagaaggaaaagaaagccctcgagctgaagctgtccacgagggaagcccaggagcaggcctatctggttcatattgaacatctaaagagcgaggttgaggaacagaaagagcagcggatgcggtctctgtctagtacaagcagcggatccaaagacaagcccggaaaggagtgtgcagatgctgccagcccagcccttagtctcgctgagcttagaactacatgcagcgaaaacgaactcgcagcagaattcactaacgcaattcgtcgagagaagaagctaaaagcccgagtgcaagaactggtttcggctctggagaggctcaccaaatccagtgaaatacgacatcagcaatcagcagagttcgtgaacgacttgaaaagggctaactccaatcttgttgccgcatatgaaaaggccaaaaagaaacatcaaaacaagttaaagaaacttgagtcccagatgatggcgatggttgaaaggcacgaaacacaggtgaggatgctgaaacagagaattgcccttcttgaagaggaaaattccaggccccatacaaatgagacctctctatag

SEQ ID NO: 195839 - DNA, 564 bp, Artificial Sequence
  Description of Artificial Sequence: Synthetic coding sequence
atgagcggcggcggcaccgagacccccgtgggctgcgaggccgcccctggtggcggctccaaaaagcgcgacagtctgggcacagcaggcagtgcccacctgatcatcaaagatctgggcgagatacatagcaggcttcttgaccaccggcctgtaatccagggtgagacaaggtactttgtgaaagagtttgaagagaagaggggactccgggagatgagggtacttgagaacttaaagaatatgattcatgagacaaacgagcatacactgcctaagtgccgggacactatgagagatagcctgagccaggtattgcagcgcctgcaggctgcaaacgattccgtttgccgattgcaacaacgtgaacaggaacgtaaaaaaattcattcagaccacttggttgccagcgagaaacagcacatgttgcagtgggataatttcatgaaagagcagcctaataaacgcgccgaggtggatgaagaacaccgtaaagctatggagaggcttaaggagcagtacgcggagatggagaaagacctcgccaaattttccaccttctag

SEQ ID NO: 195840 - DNA, 372 bp, Artificial Sequence
  Description of Artificial Sequence: Synthetic coding sequence
atggagaagcggggcctgcgggagatgcgggtgctggagaacctgaagaacatgatacacgaaaccaatgaacacaccctccccaagtgtcgggataccatgcgagacagtctgagccaggtcctgcaacggctacaggcagcgaatgacagcgtctgtagattacagcagcgcgagcaagaaagaaagaagatccattcagatcatctggtagcttctgagaaacagcacatgctgcaatgggacaactttatgaaggaacagcccaacaagcgtgccgaagttgacgaggagcataggaaagcaatggagcgtctcaaggagcagtacgccgaaatggaaaaggacctggcaaaattcagtactttttag

SEQ ID NO: 195841 - DNA, 3987 bp, Artificial Sequence
  Description of Artificial Sequence: Synthetic coding sequence
atggagagccgggaccccgcccagcccatgagccccggcgaggccacccaatctggcgccaggccggccgatcgctatggacttctcaagcacagtcgagagtttttggactttttttgggacatagcgaagcccgaacaagagacaagattggcagccaccgagaagctcttagaatatctgcgcggccgccccaaaggatccgaaatgaaatacgcactgaaacgactcattaccggccttggagtgggccgcgaaaccgcccgtccttgctattctctggctctggctcagctgctgcagtcattcgaagacctgccgctgtgttcgatactgcaacagatacaggagaaatatgacctgcatcaggtgaagaaagcaatgcttcggcccgcactgttcgccaacttgttcggcgtgctcgccttgtttcagtcaggaagactcgttaaggaccaggaggcccttatgaaatcggtcaaattactccaagcactggcccaataccagaatcacctacaagaacaaccaagaaaggctctcgtagacatcctatccgaagttagcaaggccaccctgcaggaaattctgcccgaggtgttaaaagcagacctgaacattatcctgtcttcccctgaacagttggagctctttcttcttgcccagcagaaagtgccatcaaaactgaagaagttggtaggctcagtaaacctgttctcagacgaaaatgtccctaggttagtcaatgttctcaagatggctgcttcaagtgtgaagaaggaccgtaaactccctgcaatcgctcttgacctccttaggttagccctaaaggaagataaatttccgcgtttttggaaagaagttgttgaacagggccttttgaaaatgcagttctggcccgctagctacctgtgtttcaggctcctaggcgcggccctgcccctgcttaccaaagagcaattgcacctggtcatgcagggagatgtaatacggcattacggtgaacacgtctgtacggcgaagctgccaaagcaatttaaatttgcgcctgagatggatgattacgtcggtacttttctcgagggatgtcaagacgaccctgagcgacagctagcggtcttagtggccttcagctcagttaccaaccaggggctgcctgtaacccctacattctggcgcgttgtgaggtttctatcccctccagccttacagggttacgtcgcgtggctccgcgccatgttcctgcaaccggacctggattctctggtagattttagcactaacaatcagaaaaaagcacaagacagctctctgcatatgcctgagcgcgctgtgtttcggctgcggaagtggatcatcttcaggctggttagtatagtggacagcctgcatttggagatggaggaagccctcacagagcaggttgccaggttctgcctgtttcattcctttttcgtcactaagaagcccacttcccagattccggaaaccaagcacccttttagctttcctctggagaaccaggccagggaggccgttagcagtgcctttttctccctgcttcagacactgagtacacaatttaaacaggcaccaggccaaacacaggggggacagccctggacctaccacctcgtgcagtttgccgacctcctgctcaaccatagtcacaatgtgacaaccgtgactccattcacagcccaacaaagacaagcctgggaccggatgctacagacactcaaggagcttgaagctcatagcgcggaagctcgcgccgccgcctttcagcaccttctgctgctagtgggaatccatcttctgaaatcccctgcagaatcatgtgatttactcggggacatccagacatgtataaggaaatctctcggagaaaagccacggcgctcacgtactaagaccattgatcctcaggagcctccctgggtcgaagttctagtggaaattctcctggcactcctggcacagccttcccacctcatgagacaggtggcaaggagcgtgttcggccacatttgctcccatttgactccaagagcactccaactgatcttggatgtgcttaaccctgagaccagtgaggatgaaaatgaccgtgttgtggtgacagatgacagcgacgaacgcagactgaagggagctgaggacaaatccgaagaaggtgaggacaaccgaagtagtgagagcgaggaggagtccgaaggggaagaaagcgaggaagaagaaagggatggggatgtagaccagggctttcgggagcagctcatgactgtgctgcaggctgggaaagccctgggaggggaggatagcgaaaatgaagaggagctcggcgacgaagccatgatggctctggatcagtctctggcctctctgttcgccgagcagaagctgaggatccaggcgcgacgcgatgaaaagaacaaactccaaaaggagaaagccctgaggagagatttccagattagggtgttagatctggtggaggttctggtcaccaagcagccggagaatgctctggtactggagttgctggaacctttgctgtctattatcaggcgatccctgagatcttcgtcttctaagcaagagcaggacctcctgcacaagactgccagaattttcactcaccacctttgccgtgccagaaggtactgccacgatttgggcgagcgcgcgggcgccctgcatgcccaggttgaacggctcgttcagcaagccggacgccaacccgactcccctaccgctctctaccatttcaatgccagcctctacttgctgcgagtgctgaaggggaacaccgcggaaggatgtgttcacgagactcaagagaagcaaaaggctgggactgatcctagccacatgccaacaggcccacaggctgcaagttgtctagacctgaacctcgtcacacgcgtgtattcaactgccttgagctctttcctaactaagaggaattcacctctcaccgtacccatgttcctgagcttattttccaggcacccagtgctgtgtcagtccctcctacctatccttgtgcagcatatcactggccctgttcgacccaggcatcaggcatgtctgttgctgcaaaaaacattaagtatgagggaggtgcgaagctgctttgaggaccccgagtggaaacagctgatggggcaagtcttggccaaggttactgagaatctgcgcgttctcggcgaggcccagactaaagcccaacaccaacaggcattgtcatcactcgagctgctgaacgtgctgttccgcacctgtaaacacgagaagttaacgctcgacctcacagtgctgctcggcgtgctgcaggggcaacaacagtctttgcaacagggtgcccactcaactggctcatctcgacttcatgacctctattggcaagctatgaagaccctcggggtccagcgcccaaagcttgagaagaaggacgccaaggagattccctcagccacacagagccccatctctaaaaagcgtaagaagaaagggttcctccccgagaccaagaaaaggaagaagcgcaagtctgaagacggaacccctgcggaagacgggacaccagcggccacaggcggatcccaaccgccatccatgggccgaaagaagaggaaccgaacaaaggccaaagttcctgcccaggccaatggcaccccaacaacgaagagcccagctcccggagcccccacacggagcccttcaaccccggccaagagcccaaagctgcagaaaaaaaaccaaaagccttcccaagtgaacggcgctccgggcagccctaccgaacccgccggccagaagcaacatcagaaagccctgccgaagaaaggggtgctagggaagtcgcctctcagcgcactcgcccgcaaaaaggcaagactgagcttggtcataaggtcccctagcctcctacagagcggtgctaaaaagaaggcccaagtgagaaaagccgggaagccttag

SEQ ID NO: 195842 - DNA, 3999 bp, Artificial Sequence
  Description of Artificial Sequence: Synthetic coding sequence
atggagagccgggaccccgcccagcccatgagccccggcgaggccacccagtccggcgcaagaccagccgatcgctatggtctactaaaacatagccgagaatttctcgacttcttctgggatattgcaaagcccgaacaggaaacacgcttggccgctaccgagaagctattagagtacctgcgcggccggccgaaaggatccgaaatgaagtacgcgcttaagcgcctgatcacaggattgggagttggacgggagaccgctaggccctgttactcccttgctctagcacagttgcttcaatccttcgaggacctcccactctgtagtatactgcaacagatccaggagaagtacgacctgcaccaggttaagaaagcgatgctaagacccgccctgtttgccaacttgttcggagtgctcgctctgttccaatccgggcggctggtgaaagatcaggaagcactgatgaagtcagttaagttgttgcaggccttagcccaataccagaaccatctgcaagagcaacctcgtaaagccttggtggatatcctcagcgaggtatcaaaagctaccttgcaggagatcctgccagaggtgctcaaggcggacttgaacattatcctttctagccccgagcagctggagctctttctgctggcacagcagaaggtgccatcgaagctgaaaaagctggtgggctcagtgaacctgttctccgacgagaacgttcctaggttagtgaacgtgctcaagatggccgccagcagcgtgaaaaaggatagaaagctgcctgccatcgctctggatctgctgcgtttagccctgaaagaggataagttcccccgtttttggaaggaagtcgtggagcaaggactgctcaagatgcagttctggccagctagttacctttgcttcaggctccttggtgctgctctgcctttactcaccaaggaacaactacacctggtcatgcagggcgacgtgattcgccactacggggaacacgtctgtaccgcgaagcttccaaagcagtttaagtttgctcctgagatggacgactatgtgggcacattcttggaggggtgccaggatgatcctgaacgacaactggccgtgcttgtggccttttcaagcgtgacaaatcagggccttccagttacgccgacgttctggcgcgttgtgcgatttctctcccctcccgctctgcagggctatgtggcctggttacgagcaatgtttttacaaccagacctggacagtttggtagatttctcaacgaacaaccaaaaaaaggcccaggactcaagtctccatatgcctgagcgcgccgtcttcaggcttcgcaagtggatcatctttagactggtgtctatcgtagacagcctccacctggagatggaggaagccctgacggagcaggtggccagattttgtctctttcattccttctttgtcaccaaaaagccaactagccagatacctgaaactaagcacccttttagctttccgctggaaaaccaggcccgggaggccgtgagctctgcattcttctcactcctccagactctgtccacccagttcaagcaggccccagggcagacccaggggggccaaccctggacgtatcatttggtccagttcgccgacctgttgctgaaccattcccacaatgtaactacagtgaccccattcactgcccagcagagacaggcgtgggatcggatgcttcagaccctcaaagagttagaagcccactcagcggaggctagggctgctgctttccaacatctgctcctactagtcggaatacatttgttaaagtcgccagcagagtcatgcgacctgttaggcgacatacagacctgtattagaaaaagcttaggggagaagccccgtaggagtcggacgaaaaccatcgatcctcaggagccgccctgggtagaggtgctcgtcgaaatattattggcgctcttggcacagcctagccacctaatgcggcaggtggctcgctcggtgtttggtcacatttgtagccacctgacccccagggcacttcagctgattctcgatgtgctgaatcctgaaacatcagaggatgagaatgatcgagtcgttgtgacagacgactccgatgaaagacgtctaaagggagccgaggacaaatccgaggagggagaggacaatcgttcttccgagtccgaggaggaatcggagggagaggagagtgaggaagaagaaagagacggcgatgttgaccagggctttcgagagcaacttatgacagtcctgcaagcaggcaaggccctggggggggaggacagtgaaaacgaggaggaactaggagatgaggccatgatggccctcgaccagtcactagctagtctattcgctgaacagaagttacgaattcaggcgagaagagacgaaaaaaacaagctccagaaggagaaggcactacggcgtgattttcagattcgagtccttgatctcgtcgaggtgttggtgactaagcagccggaaaacgccctggtgctggagcttctggaacctctgctctcaattatcaggcgctctctcaggtcgagtagcagcaaacaagagcaggatttgctgcacaagacggctaggatcttcactcaccatctctgtcgggcgcggagatattgccacgatcttggggaaagggcgggcgctctccacgcccaagtcgagcgcctggtccagcaggcaggacgtcagcctgattctcctactgccctttaccactttaacgccagcttgtacttactcagggtcctgaaaggtaacacagccgaagggtgtgtgcacgagacccaggaaaagcagaaagctggcaccgacccgagtcacatgcccacaggaccccaagctgcctcctgcctggacctcaacctggtgaccagggtctacagtaccgccctttcctcctttctgaccaagcggaattccccccttactgtaccaatgtttctctccttgttctctaggcaccctgtgctgtgtcagtccctgctgcccatactggtgcagcacatcaccgggccagtgagacctcgccaccaggcatgtctgttgctgcagaaaacattatcaatgcgcgaggtgcgtagctgtttcgaggaccctgaatggaaacagctgatgggccaggtcctggccaaggtcacagaaaacttacgtgtcctgggggaagcccaaaccaaggctcaacaccagcaggccctctcgtcacttgaacttctgaacgtattgtttagaacttgcaagcacgaaaagcttactttggacctaacagtgttgcttggtgtgttgcaaggacagcagcagtcactgcagcagggcgcacactcaaccgggtcttcccggctccatgacctgtattggcaggccatgaagacactgggggtacagcgtcctaagctggaaaagaaagatgccaaagagataccttcagcaactcagtctcccatctccaagaaaagaaaaaagaaaggattcctgcccgagaccaaaaaacgaaaaaaacgcaaaagtgaagatggaactcctgctgaagatgggactccggcagcaacgggaggcagtcaaccaccgagcatgggtcgcaaaaagagaaacaggaccaaggctaaggtgcctgctcaggccaacgggacccctactaccaaatcacctgccccaggggcccccacacgatcgccatccacccccgctaaatccccaaaattacagaaaaagaaccagaaaccttcacaagtaaacggtgcgcccggttctcccactgagcccgctggccagaagcagcaccaaaaagccctacccaagaaaggggtcctgggtaagagcccactaagcgcactagccagaaagaaggcacgtctgtctctggttatcagatcgccttcactgctccagtcgggagcaaagaagaaggctcagacccttcggttcaccatctccagcagtaaaaagtag

SEQ ID NO: 195843 - DNA, 1812 bp, Artificial Sequence
  Description of Artificial Sequence: Synthetic coding sequence
atggagagccgggaccccgcccagcccatgagccccggcgaggccactcagtctggcgcccggcccgctgaccgttatggcttgctaaaacatagtcgggaattcctggatttcttctgggatatcgccaaacctgaacaggagaccaggttagccgcaacggagaaactcctggaatacctgcgcggcaggccaaaggggtctgagatgaaatacgctctcaagcgactcatcaccggactgggggtggggcgcgagacggcccgaccctgttactccctcgccctggcgcagctgctccagtccttcgaagatctgcccctgtgtagtatactacagcaaattcaggagaagtatgacctgcatcaagtcaagaaagcaatgttgagaccagccctgtttgccaaccttttcggagtcctggccctattccagtctggacggctggtcaaggaccaggaggccctgatgaaatccgtaaagctcctgcaggctctggcacagtaccaaaaccacctccaagaacagcccagaaaagccctggttgatattcttagtgaggtgtccaaagcgactctacaggagattcttcccgaagtgctgaaggccgacctcaacatcatcctgtcctctccggagcaactagagcttttcctcttagcccagcagaaagtcccttccaagctgaaaaagctggtgggctcagtcaacctgttctcagacgagaatgtccctcgactggtaaacgtcttgaagatggcagccagtagcgtgaagaaagatcggaaattacctgcaattgccctggatctcctgcgactggccctgaaagaagacaaattccccagattctggaaggaagtggtggaacaaggccttctcaagatgcagttttggcctgcctcgtacctgtgcttccgtctgctgggcgcagccctcccgttgctcacaaaggagcagttacacttggtcatgcagggagacgtgatacggcactacggtgaacatgtgtgcaccgccaagctgcccaagcagtttaaatttgcgcccgagatggatgactacgtgggtacattcctggaaggctgccaggacgaccccgaaagacagcttgctgtgctggtggccttttctagcgttacgaatcagggcttaccagtgacgccaacattctggcgcgttgtgcggttcttaagtcctccagcactccaagggtatgtcgcctggctccgcgccatgtttcttcagcccgatcttgattccttggtggatttttccaccaacaaccagaagaaggcccaggatagcagtctccacatgccagaaagggctgtattccgtctgaggaagtggattatcttccgccttgtgtcaatagtggattcactgcacctcgagatggaggaagccttaaccgaacaggtggcacgcttctgcctgttccattcgttctttgtaaccaagaagcccacatcgcagattccagaaacaaagcctcaggagaggtccgaggggcccgcacaaccaccccacgcacccggagggccggagcggccaaaactagaaaagaaggatgcgaaggagatcccttcagccgaagatggcacccctgcagccacaggcggaagccagcctccgtctatgggtcggaaaaagagaaacagaaccaaggcaaaggtgccggcccaggcgaacgggacaccgaccaccaaatcaccagcgcctggggctcctaccagatccccatctacccccgccaagtcaccgaaacttcagaaaaaagcccaggttcgtaaagctggcaaaccctag

SEQ ID NO: 195844 - DNA, 2487 bp, Artificial Sequence
  Description of Artificial Sequence: Synthetic coding sequence
atggccgccgaggaggccgacgtggacatcgagggcgacgtggtggccgccgctggcgcacagccaggttccggcgagaacaccgcctctgttctgcaaaaggatcactacttggactccagctggcgcactgagaacggactgatcccctggacactggacaacacaattagtgaggagaatcgggccgtgattgaaaagatgctgctggaagaagagtactatctcagcaagaaatcccaaccagaaaaagtatggttggaccagaaagaagatgataaaaaatacatgaagtccctgcagaagaccgccaagatcatggtccactctcccacaaaacctgcttcgtacagtgtgaagtggaccatcgaggaaaaggagcttttcgaacagggtctggcaaaattcggaaggagatggaccaaaatcagcaagctgatcggcagccgcacagtcctgcaagtcaagtcctatgcccggcagtattttaagaataaggtgaaatgtggattggataaagagacccctaaccaaaaaaccggacataatttgcaggtcaagaacgaggataaaggcactaaagcttggactcccagttgcctacgaggcagagccgatccaaacttgaacgctgtcaagattgagaagttgagcgacgacgaggaggtggatattacagacgaggtagatgagctttcctcccagaccccgcagaagaacagtagctcagacctattactggactttcccaattccaaaatgcatgaaaccaatcaaggggaatttatcacgtctgattcgcaggaagccttgtttagtaagagctctaggggatgtctgcagaacgaaaaacaggatgagacactgtccagtagcgagatcactctctggactgagaaacagtccaacggagacaagaagagtatagaactcaacgaccagaagtttaacgaactaattaaaaactgcaacaagcacgatggaaggggtattattgttgatgcaaggcagctaccgagtcccgagccttgcgagatccagaaaaacctcaacgataacgaaatgctattccattcatgtcaaatggtggaggaaagccacgaggaggaggagctgaagccgccggaacaagagatcgagattgaccggaatattattcaggaggaagagaagcaggcaattcctgagttttttgagggcagacaagccaagacgcccgagagatatctgaagatcaggaactatatcctggaccagtgggagatctgcaagcccaagtacctcaataaaacctcggtccggccaggtctgaaaaactgcggcgatgtcaattgtattgggagaatccatacttacctcgagctgataggtgccattaactttggctgtgagcaggcagtgtacaatcgtccacagactgtggataaggtgcgcattcgtgacaggaaggatgccgtggaagcctatcagctggctcagcgactgcagtcaatgaggacccggagaagaagagtgcgtgatccttggggaaattggtgtgatgccaaggatctcgaaggacagacatttgagcacctttccgcagaagagctggccaaaaggagagaggaagaaaaagggcgccctgtgaagtcactgaaagttccacggcctaccaagtccagcttcgacccttttcagcttatcccttgtaactttttttcggaggaaaagcaagagccatttcaggtgaaggtagcttccgaggccctgcttattatggacctgcacgcccacgtatctatggctgaggtgattgggcttctcgggggacgatactccgaagtggataaagtcgtagaagtgtgtgccgccgagccctgcaatagcctcagtacaggcctgcaatgcgagatggatcccgttagtcaaacacaggcttcagagacactggccgtcagggggttttccgtgatcggctggtatcatagccacccagcttttgacccaaatccgagtctgagggatatagatacccaggccaagtaccagtcttacttctccagaggcggcgctaagttcattggaatgattgtttccccttacaatcggaataaccctctcccttactcacagattacatgcttggtgattagtgaagaaatctcgccagatgggtcttacaggttgccatacaagtttgaagtgcaacagatgttggaggaaccccagtgggggctggttttcgagaagacacggtggattattgagaagtatcgactcagccattcatccgtgcccatggacaaaatattcagacgtgacagtgatctcacgtgtctgcagaagcttttagaatgcatgagaaaaaccttgagcaaagtgactaactgcttcatggcggaggagtttctaaccgagattgagaatctgtttctgagcaactacaaaagcaaccaggagaacggtgtcacagaggagaactgcacaaaggagctcctgatgtag

SEQ ID NO: 195845 - DNA, 843 bp, Artificial Sequence
  Description of Artificial Sequence: Synthetic coding sequence
atgcccaagaaggccaagcccaccggcagcggcaaggaggagggccccgccccatgcaaacagatgaagctggaagccgcggggggcccatctgccctgaacttcgactccccgtcgtccttgttcgaatcactgatttcccctatcaagaccgagaccttcttcaaagagttctgggagcagaaaccactgttaattcagagagatgaccctgctcttgccacatactacggctccctctttaagctgaccgatctgaaaagtctatgctctagaggcatgtattatggcagggacgtgaatgtttgcaggtgtgtgaacgggaagaagaaagtattgaataaggatggcaaggcccacttcctacagcttcgcaaagattttgatcagaaacgagcaaccatccagtttcatcagccacagcgtttcaaggatgagctatggcgcatacaggaaaaacttgagtgctacttcggctccttggtgggctctaatgtgtacataaccccagctgggtctcagggtctacccccccactacgatgacgtggaggtattcattttgcaattggaaggggagaagcattggagactgtatcatcctacagttcctctggctcgggaatacagcgtggaagcggaggagaggatcgggcggcctgttcacgagttcatgctgaaacctggcgacttactatactttcctagagggacaatccatcaggccgataccccagccgggctcgcccactctacacacgtgaccataagcacttaccagaataacgatgcgggcgcgagaatgagaaggtgtgacctgcgcgctatcgcaccccagaagtag

SEQ ID NO: 195846 - DNA, 1398 bp, Artificial Sequence
  Description of Artificial Sequence: Synthetic coding sequence
atgcccaagaaggccaagcccaccggcagcggcaaggaggagggccctgccccctgcaagcaaatgaaattggaggctgctggaggcccgtccgctctcaactttgactccccgtcttccctcttcgagagcctcatatccccaattaaaactgaaaccttttttaaggaattttgggagcagaaacctttgctgattcagcgcgacgaccctgctttagcgacatactacggaagcttgttcaaactgaccgacctgaaaagtctgtgcagtcgcggaatgtactatggacgtgacgttaatgtgtgcagatgtgtcaacggaaagaagaaggtcctgaacaaggatgggaaagcgcacttcctgcaattgaggaaggacttcgatcagaagagagcaacaattcagttccatcagccacagagatttaaagacgaattatggaggatacaagagaagctggaatgttacttcgggtcacttgttggcagcaacgtgtacattacacccgctggaagtcagggcctcccaccccactatgatgacgtggaagtcttcatactacagctggagggcgaaaaacactggcgcttgtaccacccaactgtgccactcgctcgcgaatattctgtggaggccgaagaaaggatagggcgccctgtgcacgagtttatgcttaagcccggagatctgctgtacttcccaagggggaccattcaccaagcagacactcccgcaggtctggcacattcaacgcacgtgacaattagcacctaccagaacaactcttggggagacttcctgcttgataccatctcaggcctagtgttcgacacagccaaggaggatgtggagttaaggactgggattcccagacagcttttactgcaggtcgagtctacgactgttgccactcggcggctgagtgggttccttaggaccctcgccgacaggctggaaggcactaaagaactcctgtcaagtgatatgaaaaaggacttcataatgcatcggctccccccgtacagtgccggggacggcgctgaactgagcacgcctggagggaagttacccaggttggactctgtagttaggctccaatttaaagatcatatcgtcctcacggtgttgcccgatcaggaccagagtgacgaagcgcaggaaaaaatggtgtatatctaccacagtctgaaaaattccagggaaactcacatgatgggtaatgaggaggagacagagttccatggcctcaggtttcccctcagccatctggacgctctgaagcagatctggaacagcccagctatcagtgttaaggatctcaaactgacaacagacgaggagaaagagagtctggtactcagtctctggacggagtgtctaattcaggtggtctag

SEQ ID NO: 195847 - DNA, 1395 bp, Artificial Sequence
  Description of Artificial Sequence: Synthetic coding sequence
atgcccaagaaggccaagcccaccggcagcggcaaggaggagggccctgcaccttgtaaacagatgaagctggaagcagctggcggcccctcagcgcttaatttcgacagccctagctctctattcgagtcgttgatttcaccaattaaaacggaaaccttcttcaaagaattttgggagcagaagcctttgctcatacaaagggacgacccagcgttggctacttactacgggtccctctttaaactgaccgatttgaaatccctgtgctctcgggggatgtattatggaagagacgtgaacgtttgcaggtgtgtgaacgggaagaaaaaagtgctcaacaaagatgggaaagcacatttcttgcagctgagaaaagattttgatcaaaagcgggcaactattcagtttcaccagcctcaacggttcaaagacgagctctggagaatccaggagaaactggaatgttatttcgggagcctggtcggcagcaacgtgtacatcaccccggctggtagccagggactccccccccactatgatgatgttgaagtgtttattctgcagttggagggcgagaaacattggcggctgtaccatccaacagtgcccctggccagagaatactcagtagaggctgaagaacgaatcggcagacccgtgcatgagtttatgcttaagccaggcgatctgctatactttccacgaggcacaattcatcaggctgacactcccgcaggtctagctcatagcacccacgttaccatctcaacgtaccagaataattcctggggcgacttcctgctggatacgataagcggcctggtgtttgacactgctaaggaggacgtggagttaaggactgggatcccgcggcagctgctgttggtggaaagtactacagtagcgactaggaggctcagcggatttcttaggactttagccgatcgactcgaaggaacaaaagaattactttcttccgacatgaaaaaggatttcatcatgcatcgcctgcccccttactcagctggagacggcgcggagttgtctaccccagggggtaaattaccccggctggacagcgtagttagactccagtttaaagaccacatcgtgctcacggtgctcccagaccaggaccaatcagacgaagcgcaggaaaagatggtctatatttaccatagtttaaaaaattcgagggaaactcatatgatgggtaatgaggaggagaccgagtttcacggcctgcggtttcccctgtctcacctggacgctttaaaacagatctggaacagccccgccatctcggtcaaagacctcaaattgacaactgacgaagagaaagaaagtctcgtactgagtctgtggaccgaatgcttgatccaagtagtgtag

SEQ ID NO: 195848 - DNA, 1398 bp, Artificial Sequence
  Description of Artificial Sequence: Synthetic coding sequence
atgcccaagaaggccaagcccaccggcagcggcaaggaggagggccccgccccatgcaaacagatgaagctcgaggccgctggaggtcctagcgcactcaactttgattccccatcatctcttttcgaatcactgattagccctatcaagacagagacgttttttaaggagttctgggaacaaaaaccgcttctgattcagcgggacgatcctgcattagccacctattacggctcgctgtttaaactcaccgatttaaaatctttgtgctcccgcgggatgtactatggaagagacgtcaacgtgtgccggtgtgttaacggcaagaagaaagtgctcaacaaagacgggaaagcacattttctgcagctgagaaaggattttgatcagaagcgcgctaccattcagtttcaccaaccacagcgcttcaaggatgagttatggcgtattcaagagaaactggaatgctactttggaagcctggtcgggagcaacgtgtacatcaccccggcagggagccagggtctgccgccacattatgacgatgttgaagtctttatcctccagttggagggcgaaaagcactggcgcctttatcaccccaccgtgcctctcgcacgtgagtacagcgttgaagccgaagaacggatagggagacctgtccacgagttcatgttaaagcccggcgacctgctgtacttccctcgtggaaccattcaccaggccgacaccccggccggcttggcccacagtacccacgtaacaattagcacctatcagaataactcctggggtgatttcctcctcgatactatatccggcctcgtatttgatactgccaaggaggatgtggaactgaggactggcatccctaggcagctgttactgcaggtggagtccactacagtcgctacccgtagattgtcgggtttcctgcggaccctggcagacaggctggagggcactaaagagctcctgtccagtgacatgaagaaggattttatcatgcacagactccccccatacagcgctggcgacggggcagagttatctacacccgggggcaaactcccccgcctcgattctgtagtgaggctgcaatttaaagaccatattgttctgactgtacttccggaccaggaccagagcgacgaagctcaggagaaaatggtttatatttaccattctctaaagaactccagggaaacacacatgatgggaaacgaggaggaaaccgaattccacggcctgaggttccctctgagccacttagacgccctgaagcaaatttggaatagccccgctatttccgtcaaggatctgaaattgacaactgacgaggagaaagaaagtctagttttaagtctctggacggagtgtctaatacaagtggtctag

SEQ ID NO: 195849 - DNA, 636 bp, Artificial Sequence
  Description of Artificial Sequence: Synthetic coding sequence
atgctgctgcaggtgccctgcaacagctggggcgacttcctgctggacaccattagtgggcttgtgttcgacaccgccaaagaagacgttgaattgcgaacagggattccacgccagttgttgcttcaggtagaatctaccacggtggcgacccgccgcctgtctgggttcctaaggactctggctgacagactggagggcactaaggagctgctgagtagcgatatgaagaaagattttattatgcatagactgccaccctactccgctggcgatggtgcagagctgagtactcctggcggaaagttaccacggctggactctgtggtgcgactgcagttcaaagatcacattgttctgactgtcttacctgaccaagatcagtcagatgaagcccaggaaaaaatggtttatatatatcactctttaaaaaatagtcgagagacccatatgatggggaatgaggaggagaccgaattccatggactgaggtttcctctgagccatctggatgccctgaaacagatctggaacagcccggcgatcagcgtgaaggacttaaaactgaccacggacgaggaaaaggagtctttggtgctctcactgtggacggaatgtttgattcaggtggtttag

SEQ ID NO: 195850 - DNA, 339 bp, Artificial Sequence
  Description of Artificial Sequence: Synthetic coding sequence
atgcccaagaaggccaagcccaccggcagcggcaaggaggagggccctgccccctgcaagcagatgaagctggaagccgctggcgggcctagcgctctcaactttgattctccatcgtctcttttcgagtctcttatctctcccataaaaacagagacattctttaaggaattttgggaacagaaacctctgttgattcagcgggatgacccggccctagcaacatactacggctctctttttaagctaacagatctgaagtcgctttgcagcaggggaatgtactacggccgagacgtgaatgtctgtagatgcgtgaatggaaagaaaaaagtatag

SEQ ID NO: 195851 - DNA, 459 bp, Artificial Sequence
  Description of Artificial Sequence: Synthetic coding sequence
atgggcccccccagcctgcacagccccacccccagcctgggccccctgggcgctctagtgctaagtagtcagcacactagccccgacagctgcaagtccccttggactttgaaggctgttagggctgcccgccaggctgcagactttacactaaaagttgaggttgagtgtagtagcctgcaggaagccgttcaggcggccgaagctggcgcggatctggtactgctggacaattttaagcccgaagaattacatcctactgccaccgtacttaaagcgcagtttccgagcgtggcagttgaggccagcgggggaatcactctcgataatctgcctcaattctgtggacctcatatcgacgttattagcatgggcatgctaacacaggctgcccctgctctcgatttctctcttaaacttttcgcaaaggaggtggcccctgtgcccaagatacactag

SEQ ID NO: 195852 - DNA, 1434 bp, Artificial Sequence
  Description of Artificial Sequence: Synthetic coding sequence
atgttccccgtgttcccctgcaccctgctggccccccccttccccgtgctggggttagatagtcgcggagttggcggactgatgaatagcttccctcctcctcaggggcacgcgcaaaatcccctgcaagtgggcgccgagctgcagtcaagatttttcgcaagtcagggttgtgcccagtcgccgttccaggccgctccagcccccccacctactccacaggcacccgccgcagagcctctgcaggtggacctactgccagtgctcgctgcagcccaggagagcgccgctgccgccgccgctgcagcagccgcagcagccgccgtggcggctgctcctccagctccagctgcagcctctaccgtggataccgctgccctcaagcagccccctgccccgcccccacccccacctccggtatccgccccagccgccgaggccgctccccccgcaagcgcagctaccatagccgccgccgctgcaacagccgtcgtcgccccaacttcaactgtggccgttgcccctgtagcctccgcacttgagaaaaagaccaagtctaaggggccttatatttgcgccctgtgcgccaaagagttcaaaaatggatacaatctgagacgccatgaagcaattcacaccggggcaaaagccggccgcgttccctcaggcgcaatgaaaatgcccaccatggtgcccctgagtctgctgtctgttccacagttgagcggtgccggagggggcggtggtgaggcaggagccggtggaggtgctgcagccgttgccgccggtggtgtcgtgactactactgccagcggaaaacgaattagaaaaaatcacgcatgtgaaatgtgcgggaaagcattccgggatgtctaccacttgaaccgccacaagctcagtcactcagacgagaagccataccaatgtccagtatgccaacaaagattcaagcggaaggacaggatgtcctatcacgtgagaagtcacgatggagctgttcacaagccctacaactgtagccattgtggtaagagtttctcacgccctgaccacctaaacagccacgtcaggcaggtgcattcaacagaaagaccctttaagtgtgagaaatgcgaagcggccttcgctactaaggatcgcttacgcgcccatactgttcggcacgaggagaaagtgccatgccacgtttgtggaaagatgctgtcatcagcgtatatctctgaccacatgaaagtccattctcaggggcctcatcatgtctgtgaactttgtaacaaaggcaccggcgaagtgtgtcccatggctgcggcagccgcagcggccgcggcagctgcggccgctgccgtggcagccccccctacggctgtgggatcactgagcggagcagaaggagtgcccgtgtcatctcagcctctgcccagccagccctggtag

SEQ ID NO: 195853 - DNA, 759 bp, Artificial Sequence
  Description of Artificial Sequence: Synthetic coding sequence
atgaagatgcccaccatggtgcccctgagcctgctgagcgtgccccagctttccggtgccggcggaggaggcggagaagctggagccggggggggagctgcagctgtggcagctggcggcgttgttactaccaccgcttctggcaaacggatccggaaaaatcacgcgtgtgagatgtgcggaaaggccttcagggacgtgtaccacctgaatcgtcacaagctgtctcatagcgacgaaaagccttatcaatgccccgtgtgccaacaaagattcaagaggaaagataggatgagctatcacgtgcggagccataggcggtgtgcgaaaccgtacaattgctcccattgtggcaaatccttttccagaccagaccatctgaatagccacgtgcgccaggtccacagtacagagcgaccctttaagtgcgagaagtgcgaggccgccttcgccacaaaagatagactgcgcgcgcatactgtgcgccatgaggaaaaagtgccgtgccatgtttgcggcaaaatgcttagtagtgcttacatcagcgaccatatgaaagtccacagtcagggaccccatcacgtgtgtgagctatgcaataaaggtacgggggaggtatgtcccatggcagcggctgccgcagctgccgcagcagccgccgctgcagcagtggctgccccaccgaccgccgtcggcagcctgagcggagccgaaggcgtgcccgtcagttctcagcctctgccttcgcaaccatggtag

SEQ ID NO: 195854 - DNA, 1365 bp, Artificial Sequence
  Description of Artificial Sequence: Synthetic coding sequence
atggaccccagcaactggagcagcttcatcttccagggccacgcccagaatccgttgcaggtgggagccgagctgcagtcacgattttttgcgagccaaggctgtgctcaatccccttttcaggccgcgcccgccccccctcctaccccccaggcgcccgctgccgagccgctgcaggttgatcttcttccggtgttagccgctgctcaggagtccgcggccgctgctgccgcagcagccgctgctgctgctgcagttgccgccgccccgcccgcacctgcggcggcttccacggtggacacagccgcactaaagcagcctcccgcgcctccacctccccctcctcccgtgtccgcccctgccgccgaagctgcaccccccgcctcagctgccaccattgccgcagctgctgctactgcagtagtggcgccaacctctacagtagcagtggcccctgtcgcctcagctcttgaaaaaaaaactaagtccaaaggtccgtatatctgcgcgctttgcgcaaaggaattcaagaatggttataatctccgccgacacgaggccatacacaccggagcgaaggcaggccgggttccatcaggcgctatgaaaatgccgacaatggtgcctctgtcacttctgtccgtcccccaactgtcgggcgctggcggcggagggggtgaggcgggcgccgggggcggagccgccgctgtggccgctggcggggtggtgaccacaaccgcctcgggcaagagaattagaaagaaccatgcctgcgaaatgtgcgggaaggcgttcagagatgtctaccatctgaaccgccacaagctgtcccactcagacgagaaaccataccagtgcccggtctgtcagcagcggttcaaaagaaaagatcggatgagctaccacgtcagatcacatgatggggccgtgcacaaaccctataattgctcacattgcggcaagtcattcagtagacctgatcacctgaactcccatgttcgtcaagtacacagcacagagcgcccgtttaaatgcgagaagtgcgaggccgcgttcgctacaaaggaccgcctgcgtgcccacacggtgagacatgaagagaaagtgccttgtcatgtatgcgggaagatgttgtcatccgcatatatctcagatcacatgaaagtgcattcacaggggccacaccatgtgtgtgagctatgtaataagggcacgggcgaggtctgtcctatggcggctgccgcagcagcagccgcagctgcagcagcggctgcagtcgcagccccacccactgccgtgggctcgttgtccggcgctgaaggtgtgcctgtgtcctcccagcctcttcccagccagccttggtag

SEQ ID NO: 195855 - DNA, 2955 bp, Artificial Sequence
  Description of Artificial Sequence: Synthetic coding sequence
atgcgggcccccgcccggggcaccggctgctgcggccggagcggcggccggtggttggccggcgccgcacagccccgctgcttatgggccggtggtgcaggccaacgcttcatggtgcccggtggaacaatgaaatctcttaaaaaggattcccggcttcggataacccccacaaggctgctggaagctagcgagaatgtaaaggagaagaaaagagcgaaaggtccggagcagcccacgccaaccatacaggaagagcccgaacccgttagtaacgtgttgcagggcgatgacatactggcgcttgccataaaaaaggaggatctgaaagaacaacacattcccagactgacggagaaagaggacaaacgcgtgatcacacaaaagttcattatccgcaagctgaaaccaatggatccacggcggaaggtgtgtcatctggtcgcccggcccgctaatcccgacgaagcaactaaaccactcgattattccgggccaggagactcctttgacggctctgatcagattctcccccatcatatccttggcagcttgcaggattttaaacggatcgctctcgccagaggtaatacgcaactggcagagagaatccccacaagcccctgcctcatgaccctgatctccgccgaaggcgagagcaaacaaaaggcccctaaggaagaaaagcgccctccatgggccccaccgccccagcacaatttcctcaagaactggcagaggaatactgcattgagaaaaaagcaacaggaggccctgagcgagcacttgaagaagcctgtgagtgaacttctgatgcacacaggcgaaacttatcggcggattcaagaggaaagagaactaatcgactgcactttaccaacacgcagagatagaaagtcctgggaaaacagtggtttttggtccagactggaataccttggagacgaaatgactggcttagtcatgacaaaaacgaaaacccagcgtgggttgatggagccaataacacacatccgaaaacctcacagtattagagtggaaacgggcctgccagctcagagggatgcaagctaccggtacacctgggacaggagtttgtttttgatttataggcgcaaggaactccagcgtatcatggaggaactagacttctcacagcaagacatcgatggcctcgaggtggttggcaaagggtggccgttcagtgccgtaaccgtcgaagactatacagtcttcgaaagatcacaaggtagctcctcagaggacacggcctatctcggcactttagctagctcctctgatgtctcaatgcctatcttgggcccttccctcctattctgtggcaagcctgcctgctggatccgaggtagtaacccacaggacaaaagacaggtagggattgccgcacatcttacattcgagacgctggaaggcgagaagacgagcagtgaattgaccgtagtgaacaacggcaccgtggccatctggtatgactggcgtagacagcatcaacctgatacatttcaggacctgaagaaaaacaggatgcagaggttctattttgataaccgagaaggagtcatcctgccaggtgagatcaagactttcactttctttttcaagtcactcaccgccggtgtcttccgcgaattctgggaatttagaacacaccccacccttctgggaggggccatcttacaggtcaacctccatgccgtgtcactgactcaggacgtgtttgaggacgaacggaaggtacttgagagcaaacttacagctcacgaagccgtaactgtagtgcgggaagtgctgcaggagctgcttatgggcgttctcacaccggagaggactccttctccagtggacgcctacctgacggaggaggatcttttcaggcacagaaaccccccactccactatgaacatcaggtcgtccagagcttgcaccagctttggcgccaatatatgacactcccagcaaaagctgaagaagcccgcccgggcgacaaggaacacgtttcccccatcgctaccgagaaggcgagtgtgaacgccgaacttctgccgaggttccggtcgccaatctctgagactcaggttccacgaccagagaacgaggctcttcgggagagtggctcacagaaagcccgcgtgggtacaaaaagtccccagcgcaaaagcatcatggaagagattcttgtcgaggaatcacccgatgttgactctactaagtccccttgggaaccggacgggctacccttattggaatggaacctgtgtctggaagacttcagaaaagcagttatggtgctacccgacgaaaaccatagggaagatgccctcatgcgattgaataaagccgccctggagctgtgccagaaacccagaccacttcaatcgaacctccttcaccagatgtgcctacagttatggagagatgtgatcgacagcctggtgggacactccatgtggctgagatctgtcttggggctgccagagaaggagacaatttacctgaacgtgcccgaggaacaggaccaaaagtcccctccaattatggaggtgaaagtgccggttgggaaggctgggaaggaagagagaaagggcgcagcccaggagaaaaaacagctagggatcaaagacaaggaagataaaaaaggcgctaagctgctgggaaaggaggatagacccaatagtaagaagcacaaggccaaggatgacaaaaaggtcataaagagcgcaagtcaggatcggttttcactggaagatccaaccccagacattatcctttcttcccaggaacccattgatcccctcgtgatgggaaagtatacgcagtcactgcattccgaagtgaggggcctgttggacacactggttactgacctgatggtgttggccgatgagctgtccccaattaagaatgtcgaggaagccctgcgattgtgtcggtag

SEQ ID NO: 195856 - DNA, 2829 bp, Artificial Sequence
  Description of Artificial Sequence: Synthetic coding sequence
atggtgcccggcggcaccatgaagagcctgaagaaggacagccggctgagaataactccaacaaggctgctggaagcatcggagaacgtcaaagaaaaaaaacgcgccaaaggaccggaacagcccacacctaccatacaggaagagcctgagccggtgtccaatgttcttcaaggcgacgacatcctggctctggccatcaagaaagaggacctgaaggaacagcacattcctaggctgacagagaaagaggacaagcgagtcattacccagaaattcataattcggaagctaaaacccatggatccgcgacgcaaagtgtgccacctggttgcgagacctgcgaaccctgatgaggctaccaagcccctcgactactccggaccgggagattccttcgatggttctgatcagatcctgcctcatcatatcctgggatcgctccaggactttaaaaggatcgccctggctagggggaatacccaactcgcagaacggattcccacaagcccctgtctgatgactctgatttctgcggagggggaaagcaaacaaaaggcccccaaagaggagaagcgtcctccttgggctcccccaccccagcacaactttcttaagaattggcagcggaatacagcactgaggaagaagcaacaggaagctctatccgagcacttaaaaaagcctgtgtctgagctgcttatgcatacaggggaaacgtaccgtaggatccaggaagagagagaactgatcgactgcaccctccctacccggagagatcgaaagagttgggagaattccggcttctggagcaggttggaatatctcggagatgagatgaccggcttggtgatgacaaagactaagacacagagaggcctgatggagcccatcacccatatccggaagccacactccattagagtggagacgggcctgccggctcagagggacgccagttatagatatacctgggaccgctcactgttcttgatatatcgcagaaaagagcttcagaggattatggaagaacttgacttttcgcagcaggacatagatggacttgaggtcgtcggcaaaggttggcccttctctgccgtgaccgtcgaggactataccgtctttgaacgtagccaggggagcagtagtgaggacactgcctacctgggcacactggcaagcagtagcgacgtgtccatgccaatcctaggcccgtccctcctcttctgcgggaaacccgcatgttggatccgggggagtaatccacaggataagcgacaggtgggaatagccgcacatctaacattcgagacactggagggggaaaaaacttcctctgaactgactgtggttaacaatgggaccgttgcgatatggtatgattggcgcagacagcatcaacctgacactttccaggaccttaaaaagaacagaatgcagagattctatttcgacaatcgggagggcgttatcctgccaggcgaaattaagacatttaccttcttctttaaaagtctgacagccggcgtgtttcgggaattctgggagttccggacccaccccactcttttgggcggtgctatcctgcaggtcaatcttcacgccgtttcacttacacaggatgtgtttgaggatgagcggaaagtgcttgagagcaagctgactgcacatgaggccgttaccgtggttcgcgaggtgcttcaggagttactcatgggcgtgctcacccctgagaggacccctagcccagtggatgcatatctgacagaagaggacctgttccgccaccggaatccaccgctgcactacgaacaccaggtcgttcagtcgttacatcagctttggaggcagtacatgaccttacctgccaaggccgaagaagctcgacctggagacaaagagcacgtttccccaatcgccacggaaaaggcctctgttaatgctgagttactgcctaggtttaggagccccatttcagaaacacaggtccctcggcccgaaaacgaggctctgcgcgagagcggctctcaaaaagccagggttggcactaagtccccccaacgcaaaagtatcatggaagagattctagtggaggagtcaccggatgtggacagtacaaagagcccctgggaaccagatggtttgcctctcctggaatggaatctttgtctagaggattttcgtaaagctgtaatggtcctacccgatgagaaccacagggaagacgctctgatgaggctcaacaaagccgctcttgagctgtgtcagaagccgcggcctctgcagagcaacctgttgcaccagatgtgccttcagctgtggagagatgttattgattcattagtcgggcactctatgtggttacgtagtgttttggggctgccggaaaaagaaacaatttacctgaatgtgcccgaagagcaggaccagaagagcccaccaatcatggaggtgaaggtgcctgttggcaaggccggaaaggaggaacgtaagggggctgcccaggaaaaaaaacagctcgggatcaaggacaaggaggacaagaagggtgcgaagttattgggtaaggaagacagacctaactctaagaagcacaaggccaaggacgataagaaggttatcaaaagcgcttctcaggaccggttctcacttgaagaccccacccctgacatcattttgtcttcccaggaacccatcgatcccctggtcatgggaaagtatacacaatccctacactctgaggtccacccagggcgctgcgtaccttgggaaaatacaatgcagggcgcctttccttctaccacacggtgcggtggctcatgcctgtag

SEQ ID NO: 195857 - DNA, 1992 bp, Artificial Sequence
  Description of Artificial Sequence: Synthetic coding sequence
cggagccggggcgccgaggccaccgagagcaagctgagcggcggctttcggtggacccagaagacgtcccctacacagggggacagtgccatcactcactcgctgtaccggatgatcttcctaactgcactgcctctgttctggatcatgatttctgcctcacgaggagggcactggggagcctggatgccctcatccatttctgctttcgagggcacctgtgtcagcattccttgcagattcgactttcccgacgagctgcggcctgctgtggtgcatggggtatggtacttcaacagtccttaccctaaaaactaccccccagtggtcttcaagagccggacccaggttgtgcacgagagcttccagggtaggtccaggctgctgggcgatttgggcttgcgcaattgtactcttctcttatctaatgtctccccagaactgggcggaaagtattattttagaggcgacctcggaggatacaatcagtataccttcagcgaacatagcgtgttagacatagtgaatacccctaatattgtggttcctcctgaagtggttgccgggaccgaggtggaggtgtcttgtatggtgcccgataactgtccggagctgagacctgagctatcctggctcgggcatgagggccttggagaaccggccgtgctgggccgcctgagggaagacgagggcacctgggtccaggtctcgctgctgcattttgttcctacccgcgaagcaaatggacataggctggggtgccaagcttctttcccgaataccactcttcaattcgagggttatgcaagtatggacgtgaaatatccacccgtgattgtggagatgaacagctcagtggaagccattgagggatcacatgtgagtctactctgtggcgccgactccaaccctccaccgctcctcacctggatgagagatgggacagtgctgagggaagctgtggccgaatccttgctcctggagctagaagaagttactcccgcggaagacggggtctatgcttgcctcgcagaaaacgcctatggccaggataaccgaactgtgggactctcagtgatgtacgcaccatggaagcctacagtaaacggaactatggttgccgtggagggcgagaccgtgagcattctgtgttcgacacaatccaacccagaccccatactgaccatcttcaaagagaagcaaattctgtcaacggttatctacgagtcagaactgcagctggaactacccgcagtgtcgcccgaggacgacggagagtactggtgtgtcgccgaaaatcagtatggtcagcgcgcaacagcgtttaacctgtcagtagagttcgccccagtcctactactggagagccactgcgctgctgcaagggatactgtgcagtgcctgtgcgtggtcaagagtaacccagaaccctctgtggccttcgaattgccatccaggaatgttacagtgaatgaaagcgaacgagaatttgtatactccgagcgatccggactcgtcctgacttccatcctgactttgcgcggtcaggctcaggcgcctccgcgcgttatatgcacagcaaggaacctgtacggcgccaaatccctcgaactcccctttcaaggtgcccataggcttatgtgggccaagatcgggcccgttggcgcagtggttgcttttgctattctgatagctatcgtttgttacatcacccagacacggcgcaaaaagaacgtcactgagagtccatccttttctgctggcgataaccctccggtactgttctcaagcgactttcggattagcggcgctcccgaaaaatacgagtccgaaagacgcctgggaagcgaacgacggctcctgggccttagaggtgaacctccagaactggatctgtcatatagccacagcgatctggggaagcgcccaactaaagactcttacacactcaccgaggagcttgcagaatacgctgagataagggtgaagtag

SEQ ID NO: 195858 - DNA, 1749 bp, Artificial Sequence
  Description of Artificial Sequence: Synthetic coding sequence
atgatcttcctgaccgccctgcccctgttctggatcatgatcagcgcatcgaggggagggcattggggggcttggatgccaagcagcatctccgccttcgagggtacctgtgtctccattccctgccggtttgatttcccagatgaattgcgacccgccgtggtccacggggtgtggtactttaattctccttatccgaaaaattatccccccgtggtattcaagagccgaacgcaggtggtgcacgagtctttccagggcaggagccggttgctgggggatctgggccttagaaattgcacattgctcctgtctaatgtttcacctgagttgggggggaaatattactttaggggggacttgggggggtacaaccaatacacattttccgaacactcagtcctggatattgtcaacacacccaatatcgtggttccgcctgaggtggtggcaggaaccgaggttgaggtgagttgtatggtcccggacaactgtcctgagttgaggcccgagctcagctggctcggacacgaagggcttggcgagcctgcggtcttgggccgtttgagagaggatgaaggcacatgggtacaggtatcactgctgcatttcgtccctaccagagaggctaacggccaccgacttggctgtcaagcctcattcccgaatacaacccttcaatttgaggggtatgctagcatggatgtgaaataccccccagtgatcgtggaaatgaatagttcagttgaggctatagagggttcacacgtgtcactgctgtgtggtgcagattctaatcctccccccctactgacttggatgcgcgacgggacagtcttgagagaggcagtggctgagtcccttctgcttgagctagaggaggtcacacccgccgaggacggcgtctacgcttgtctggccgaaaacgcgtacggccaggacaacagaacagttgggctcagcgtgatgtatgcaccatggaaacccaccgttaacgggactatggtggcagtcgagggagagactgtttccatcctttgctctacacaatccaaccccgacccaattttgacgatattcaaggagaagcagatcttgtctaccgtcatctatgaatccgagctgcagctggagcttcctgccgtgtcccccgaggatgatggtgaatactggtgtgtcgctgaaaatcagtacgggcaaagggctaccgctttcaacttgtccgtcgagtttgccccggtgctcctcctcgagtcacattgcgccgctgcgagagacacggtgcagtgcctctgcgttgtgaagagtaacccagagcctagcgtggccttcgaactcccttccagaaacgtcacagtgaatgagtctgagagagaattcgtctacagtgagagaagcggactggttctgaccagcattcttactctgagggggcaggctcaggcaccgccccgtgtaatctgcacggccagaaacctttatggtgctaagtcactggaactgccattccagggcgcgcatcgcctgatgtgggccaaaattggccctgtgggtgctgtagtcgcctttgccattctgattgccatcgtgtgttacatcacacagacccgccgcaaaaagaacgtcacagaaagtccgagtttttcagcgggagataacccgccagtgctgttttccagcgattttcggatttccggagcacccgagaaatacgaaagcaaagaggtctctaccctggaaagtcattag

SEQ ID NO: 195859 - DNA, 1881 bp, Artificial Sequence
  Description of Artificial Sequence: Synthetic coding sequence
atgatcttcctgaccgccctgcccctgttctggatcatgatcagcgctagtcgaggaggacattggggagcctggatgccatcatccatttctgcgtttgagggcacatgcgttagcattccttgtaggttcgacttccccgacgagctgagacctgccgtggtgcacggtgtgtggtactttaacagcccttatcctaaaaactacccccctgtggtgttcaaaagtcgaacacaggtcgtgcacgagtcttttcagggacggtctcgcctcctcggcgacttgggattgaggaactgcacactgttacttagtaatgtcagtcctgagcttggcggaaagtactattttcgcggggatctcggcgggtataatcagtatactttttccgagcatagcgtgttggatatcgtcaatacccctaacatcgtggtgcctcccgaggtcgtggccggaaccgaggtggaagtctcctgtatggttcctgacaattgcccagagttaagacccgaactcagttggttgggtcacgagggccttggcgaaccggctgtgctggggaggctgcgagaagatgaaggaacttgggtgcaggtcagccttttacatttcgtgcctacaagggaagccaatgggcatagactggggtgtcaagcctcctttccgaacacaacactgcagttcgagggttacgcgtctatggatgtaaagtatcctccggttattgtcgagatgaattcctctgtggaagcgatagagggctctcatgtcagtctcctttgtggggcggactcaaacccaccgccactcttgacgtggatgagagatggtaccgtgctgcgggaagcggtggctgaatccctgctgctcgaactggaggaagtaacaccagcagaagacggagtttacgcctgtctcgccgaaaatgcttacggacaagacaatcggaccgtgggcctatctgtgatgtatgccccatggaagcccactgtcaatgggacaatggtggcagttgagggtgagaccgtgtccatcttatgctcgacacagagcaatcccgacccaatattgacgattttcaaggaaaaacagatactcagtactgtcatttatgagtctgagttgcagctggaactaccagccgtgtcccccgaggacgacggagagtattggtgcgtggccgagaatcaatatggacagcgcgctactgccttcaacttaagtgttgaattcgctccagtactgttgttggagagccactgtgccgccgctagggacactgtgcaatgcctttgcgtggtgaagtctaaccccgaaccctcagtggcatttgagctcccaagccggaatgttacagtaaatgaatcagaaagagagtttgtgtactcagaacgatccggcctcgtcctgacgtcgatactgaccctgcgcggtcaggctcaagctccccctcgcgttatctgcaccgcgaggaatctatacggagccaagtcactggaacttccatttcagggcgcccatcgcctgatgtgggccaagataggtccggtgggggcagttgtggcctttgcaatccttatcgctattgtatgctatattacacagacccgcaggaagaagaatgttactgagtctccaagcttttccgccggtgataatcccccagtgctcttttcctccgatttccggataagtggagcacctgaaaagtatgagtctgaacgaaggctcggttcggagcgcaggctgttgggactgcgtggcgagcctccagagttagacctgtcctatagccactccgacttgggcaagcggccgacaaaggatagttacacgctgaccgaggaattagcagagtacgccgagatccgggtgaagtag

SEQ ID NO: 195860 - DNA, 1806 bp, Artificial Sequence
  Description of Artificial Sequence: Synthetic coding sequence
atgcccagcagcatcagcgccttcgagggcacctgcgtgagcatcccttgtaggtttgattttcctgacgagctccggcccgctgtcgtgcacggcgtctggtattttaacagcccctacccaaaaaattacccccccgtggtctttaaatcaagaactcaggttgtccatgagagcttccaggggcggtccagattattaggcgacctaggcttgcgaaattgcacactgctcctgtctaatgtgagccctgaactcggaggcaaatactactttaggggagatctgggcggttataatcaatataccttctcagagcactctgtactggatatcgtcaatactcccaatatcgtcgtgccgccagaagtcgtggccggcactgaagtcgaagtttcctgcatggtaccagataactgccccgagctgcgaccagaactaagctggctaggccatgaaggattgggtgaacccgccgtgttggggcggctccgagaagatgagggtacgtgggtccaggtcagcctacttcatttcgtgccaacccgagaggcgaacgggcaccgcctaggctgccaggcctcctttcccaatactactctgcagttcgagggttacgcctcaatggacgtgaagtaccccccagtgattgtggagatgaattcttcagtcgaagccattgaggggagccatgtgtctctactctgcggcgctgactctaatcccccacccctactaacctggatgagggatggaacggtcctgagagaagctgtagcagagtctttgttactggagctggaagaggtgaccccagcagaggacggcgtgtatgcctgcctggcggagaacgcctacggacaagacaatcgcacagtcgggctaagtgtgatgtacgctccctggaagcccacagtgaatggcaccatggtagccgtggagggagaaaccgtgagtattctttgcagtactcagtcaaaccccgaccccattctgactatcttcaaagaaaaacagattttgagcaccgtgatctatgagagtgagctacagttagagttgccagccgtcagtcctgaggatgacggcgaatattggtgcgtggctgaaaatcaatatggtcagcgggccaccgcttttaacttgagcgtggaattcgccccagtgctcctgctcgagtctcactgtgctgctgcccgcgacaccgtgcaatgcctatgtgtcgtgaaatcgaatccggaaccctccgtcgccttcgaattaccctcacggaacgtgacggtgaatgaaagtgagcgagaattcgtgtactcagagcggagtggactcgtcctcacgtctatccttaccttgagaggacaggcccaagctccccccagggtcatctgcactgcgcggaacctgtatggcgcgaagagcctggaactcccgtttcaaggcgcacacagacttatgtgggcgaagattggcccggtgggtgcagtggtcgccttcgcaattcttatcgctatcgtgtgctatattacccaaactcgcaggaaaaaaaatgtgactgagagccctagtttttctgctggcgataaccctccggtgctgttttcctcagatttccgtattagtggggcccccgagaagtatgaaagtgagcggcgcctggggtcggagcgcaggttgctgggcttgagaggcgaaccgcctgagttagatctttcctatagccattccgatctgggtaagaggcctaccaaagattcctacaccctgacagaggagctggcggaatacgccgagatcagagtgaaatag

SEQ ID NO: 195861 - DNA, 915 bp, Artificial Sequence
  Description of Artificial Sequence: Synthetic coding sequence
atgggcaaccacgccggcaagcgggagctgaacgccgagaaggccagcactaactcagagacaaatcgcggcgagagcgagaaaaaaagaaacctgggggaactgtccagaacaacttcagaggacaatgaagtcttcggcgaggccgatgcaaaccagaacaacggcacaagtagtcaggatacagcagtgactgattcaaaacggacagccgaccccaaaaacgcatggcaggacgcccaccctgcagatcccggaagccgaccgcacttgatcaggcttttttcacgggacgctcctggaagggaggataatacatttaaggatcgccccagcgaaagcgacgagttgcagactatacaggaggattccgctgctacatctgagtcactagatgtgatggcctcgcagaagagaccttcacagcggcacggctccaaatatctagccaccgccagcacgatggatcatgctcggcatggctttctccctagacatagagacacagggattttagacagcatcggacgtttttttggaggggaccgtggggcccctaagagggggagtggcaaggactcccatcatcccgcaaggaccgcacattatggctccttgcctcagaagagtcacggacgtacccaagacgagaaccctgtggtccactttttcaagaacatcgtcacccccaggaccccaccgcctagtcaggggaagggacgggggctcagtctttcacgcttcagttggggggccgagggacagcgacccggctttggctatgggggacgggctagcgactacaaatccgcacacaagggttttaagggcgtggatgctcagggaaccctttctaaaatcttcaagcttggcggacgcgactctcggagcgggtcacctatggccagacgttag

SEQ ID NO: 195862 - DNA, 561 bp, Artificial Sequence
  Description of Artificial Sequence: Synthetic coding sequence
atggccagccagaagcggcccagccagcggcacggcagcaagtacctggctacagcaagtacgatggaccacgcccgccatggtttcctgccaaggcacagagacacaggcatcctggacagtatcggcaggttttttggtggagatagaggcgccccaaagcgcggctctggcaaggtgccatggttgaagcccggacgcagtcctttgccatcacatgccagatcacagccgggcctatgtaatatgtacaaagactcgcaccacccggcacgaacagctcactatgggtctctgccccaaaaaagtcatggtcgtacccaggacgaaaatcctgtagttcacttcttcaagaacatagtaactcccaggacccccccaccatctcagggaaaaggcgccgagggccagcgtcccggatttggatacgggggaagagcctccgattacaagtcggcccacaagggtttcaaaggcgtggacgctcagggtaccttgtccaagatcttcaaactgggcggaagagattccaggtccgggtctcccatggcccggcggtag

SEQ ID NO: 195863 - DNA, 594 bp, Artificial Sequence
  Description of Artificial Sequence: Synthetic coding sequence
atggccagccagaagcggcccagccagcggcacggcagcaagtacctggctacagcttccacaatggatcacgcaagacacggttttcttccacgacatcgggatacaggcatactagattctatagggagattctttggaggagacaggggcgctcctaaacggggctccggcaaggttccttggctaaaaccagggcggtccccgctcccttctcatgccagatcccaacctgggttgtgtaacatgtacaaggactcccatcaccctgctaggacagctcactacgggtcattgccacagaaatcgcacggaagaacacaggacgagaacccagtagttcatttctttaagaacattgttaccccgcgcactccgccgccatcgcaaggtaagggacgcggcctgtcactgagcagattctcctggggggccgagggccaaaggccaggtttcgggtacggaggccgggcaagcgattacaaatccgcccacaagggcttcaaaggggtggatgcccaggggaccttgagcaagatttttaagttagggggaagagattccaggagcggaagtccgatggctcggcgatag

SEQ ID NO: 195864 - DNA, 594 bp, Artificial Sequence
  Description of Artificial Sequence: Synthetic coding sequence
atgggcaaccacgccggcaagcgggagctgaacgccgagaaggccagcaccaattcggaaacaaaccggggtgagagcgagaagaagaggaaccttggggaactctctcggactacaagcgaggacaacgaagtgttcggcgaggctgatgctaatcagaacaacggtacttcttcccaagataccgccgtcacagatagtaagaggaccgccgatcctaagaatgcctggcaagatgcccacccagccgatccaggttctcggccgcacctgattcggctgttctctcgagatgcgcccgggcgcgaggataataccttcaaagataggccttccgagtcagacgagcttcagaccatacaggaggatagcgctgccacgtctgagagcctggacgtcatggcgagccagaaacggccttctcaaagacatggatcaaagtacctcgcaaccgcctccactatggaccacgccaggcacggtttcctaccccgtcatcgtgacactgggatactggatagcataggacgcttcttcggaggcgatcgcggagctccaaaaagagggtcagggaaggtctctagcgaggagtag

SEQ ID NO: 195865 - DNA, 594 bp, Artificial Sequence
  Description of Artificial Sequence: Synthetic coding sequence
atgggcaaccacgccggcaagcgggagctgaacgccgagaaggcctctacaaattctgagaccaatcgaggggaaagcgagaagaagagaaacctgggcgagctgtcccggaccacctctgaagacaatgaagtgtttggcgaagcagacgctaaccagaataacggaacttcttcacaggatacagccgtgacagactccaagcgcacagccgacccaaaaaatgcttggcaagacgcgcaccctgccgatccagggtctcgcccgcatctgattaggctgttcagtcgagacgcccccggcagagaagataacacctttaaggaccgacctagtgaaagtgacgaactgcagacaatacaggaggactcagcggccactagtgagtccctggatgttatggcctctcagaagcgaccatctcagaggcatggtagtaaatacctggcaacagcgtctactatggaccatgcccggcatgggttcctccctcggcaccgggatacgggtatcttagatagcattggtagatttttcggaggggaccggggtgcacccaagcgcggatctggtaaagtgtctagcgaagaatag

SEQ ID NO: 195866 - DNA, 483 bp, Artificial Sequence
  Description of Artificial Sequence: Synthetic coding sequence
atggccagccagaagcggcccagccagcggcacggcagcaagtacctggccacagccagcacaatggaccacgctaggcacggcttcttgcccagacatagagacacagggattctagacagcatcggtagattttttggaggggaccgcggtgcccccaaacgcggatccggaaaagattcccatcacccggcacgcacagcccactatggttctttgcctcaaaaaagccatggccgcacgcaggacgagaatcctgttgtgcacttctttaagaatatagttacaccacgaaccccgcctcccagccagggaaaaggtgcagagggccagcgaccgggattcggttatggaggtagggcatccgactataaatctgcccataaaggctttaagggggttgacgcgcaaggcaccctcagcaagatattcaagctcggtggccgggactcccgttcggggtcaccgatggcccgcaggtag

SEQ ID NO: 195867 - DNA, 516 bp, Artificial Sequence
  Description of Artificial Sequence: Synthetic coding sequence
atggccagccagaagcggcccagccagcggcacggcagcaagtacctcgctactgcatctacgatggaccacgccaggcacggctttcttccacgccacagagataccggcattctcgattcaatcggacggttcttcggaggagatagaggggctcctaaacggggctccgggaaggacagccatcaccccgcccggactgcccactacggatcactacctcagaagtcacacggacgcacccaggatgagaatcctgtggttcacttcttcaaaaatattgtaaccccacgcactccaccccccagtcaggggaaaggcagggggcttagtctgagccggttttcctggggcgccgagggtcagaggccggggtttgggtatggaggccgggccagcgactacaagtcagcacacaagggtttcaagggagtggatgcccaggggactttgtctaaaatctttaagttagggggacgggattctcgttccggatcccccatggcaagaaggtag

SEQ ID NO: 195868 - DNA, 261 bp, Artificial Sequence
  Description of Artificial Sequence: Synthetic coding sequence
atggccagccagaagcggcccagccagcggcacggcagcaagtacctggccactgcctccactatggatcatgctcgacatgggtttctgcctagacaccgggatacagggattcttgattccattggcagatttttcggcggggatcgcggcgctccaaagcgtggctccggaaaggacagtcatcatccagcacgcaccgcccattatggctccctcccacaaaagtcccatggacgcactcaggacgagaatccctag

SEQ ID NO: 195869 - DNA, 888 bp, Artificial Sequence
  Description of Artificial Sequence: Synthetic coding sequence
atggccagcctgagccggcccagcctgcccagctgcctgtgcagcttcctgctgctgctcctcctgcaggtgtcatcatcatacgccgggcagttcagagtgatcgggccaagacaccctatacgcgctttggttggcgatgaggtggaattaccgtgcaggatatctccaggcaagaatgctactgggatggaggtaggctggtatcgcccacctttctctcgtgttgtgcacctctatagaaatggtaaagaccaagacggcgaccaagcccctgagtacaggggaaggactgagttgctgaaagacgccatcggggagggcaaggtcaccctaagaatccgcaacgtcaggttttccgacgaggggggatttacatgcttcttccgggaccattcataccaagaagaagccgctatggaattgaaggttgaggaccccttctattgggtttcgccgggagtgctcgtgctgctcgctgtgttgcccgtacttctcctccagataactgtgggcctcgtgtttctgtgtctgcaataccgccttaggggaaaattgcgagccgagatcgaaaatttgcaccggacctttgatccgcattttcttcgcgtgccttgctggaagatcacactgttcgtgattgtgcccgtcctgggtccattagtggctctgattatctgctacaactggctccatcgtcgcctcgccgggcagttcctggaagagctccgaaaattttcaagcctatgctataagcagcgtattaagtcacaggaacgggaaactgaggccacccgcggacgaggaggactgctccgggatcacattccacgcgggaaggaggagctggagtccctgggaggaggcaagactcccccaggtaggtag

SEQ ID NO: 195870 - DNA, 642 bp, Artificial Sequence
  Description of Artificial Sequence: Synthetic coding sequence
atggccagcctgagccggcccagcctgcccagctgcctgtgcagctttctgctattattactactgcaagtgagttcgagctacgccggacagtttcgagtcatcgggcccaggcacccaatccgggccttggtgggcgacgaggtcgagcttccttgccgaatcagccctgggaagaacgccacgggcatggaggtcggttggtatcggccacccttctccagagttgttcatctataccggaatggcaaggaccaggacggcgaccaggcgcctgagtatagggggaggactgagctactcaaggacgctatcggagagggtaaagtgactcttaggattcgaaacgttcgcttctcagacgaagggggttttacatgcttcttcagggatcattcataccaagaggaggccgccatggaattgaaggtggaagatccattctattgggtgtcacctggagtgctggttctgttggctgtgcttccagtgctgctcctccagatcacagttggcctcgtgttcctgtgcctccagtaccggctccgaggtaagttacgcgcagaaattgagaacctccataggacatttggacaatttctagaggaacttctcttccatctcgaggccctgtccggttag

SEQ ID NO: 195871 - DNA, 396 bp, Artificial Sequence
  Description of Artificial Sequence: Synthetic coding sequence
atggccagcctgagccggcccagcctgcccagctgcctgtgcagctttctactgctgctgctactccaggttagttctagctacgctgatcccttctactgggtttctcctggagtgctcgtcctactcgcggtcctgcccgtgctgcttctccaaattacagtgggcctgatcttcttgtgccttcagtatcggttgagggggaaactgcgggctgaaatcgagaatctgcatagaacattcgatccccatttcctgcgggtcccctgctggaagatcaccctgtttgtgatagtgccagtcctggggccactcgttgctttaattatctgctacaactggctgcatagacgtttagccgggcagtttctggaagagctgagaaatcctttctag

SEQ ID NO: 195872 - DNA, 621 bp, Artificial Sequence
  Description of Artificial Sequence: Synthetic coding sequence
atggccagcctgagccggcccagcctgcccagctgcctgtgcagcttcctcctgttacttttactgcaagtttccagctcctatgcgggacagttccgcgtaatagggcctaggcacccaatccgtgcgctggtgggcgacgaagtcgaactcccttgtaggatcagccctggaaagaacgcaactggtatggaggtggggtggtatcggccccctttttctagggtggtacacctttacaggaacggtaaggatcaggacggggatcaagcccctgaatatagggggcggacagagctgctcaaagatgccatcggtgagggcaaagtcactctgcggatccgaaatgttagattttctgacgaaggagggtttacttgcttctttcgcgatcacagttatcaggaggaggctgccatggagttgaaggtggaggatcctttctactgggtgtctcccggagttctcgtactgctggctgtgctccccgtccttctgctccagataaccgtggggcttatcttcctgtgtctgcagtacaggttaaggggcaagcttagggccgaaattgaaaatctccaccgcacctttgtctttcatctcgaggccctctccggttag

SEQ ID NO: 195873 - DNA, 759 bp, Artificial Sequence
  Description of Artificial Sequence: Synthetic coding sequence
atggccagcctgagccggcccagcctgcccagctgcctgtgcagctttttgttgttactcctgctgcaggtgtcctcctcttacgctgggcagtttcgggttatcggcccgcgccacccgatcagagctctagtgggtgatgaggtggagctgccgtgcaggataagccccgggaagaatgcgaccgggatggaggtggggtggtaccgcccccccttttccagagtcgtgcatctttatcgcaacggtaaggatcaagacggcgaccaggcccctgagtatagagggcgcacagaacttctgaaagacgccattggggaggggaaggtcaccctacgtatccgaaacgtgcgatttagcgacgaaggcggctttacctgtttctttcgcgaccacagttaccaggaggaagcagccatggagctgaaagtcgaagaccccttttactgggttagccctggtgtgctggttcttctggcagtactgcctgtgttattacttcagatcaccgttggcttgatattcctctgccttcaataccgactgcgcgggaagctcagagctgagatcgagaacctgcatcgcacctttgatccacatttcctcagagtgccatgctggaagatcacactctttgtgatagttcccgttttaggccctctcgtggcgcttattatctgctacaattggctgcatcgtaggctcgccggccagttcctcgaagaactactattccacctcgaagccttgagcggctag

SEQ ID NO: 195874 - DNA, 516 bp, Artificial Sequence
  Description of Artificial Sequence: Synthetic coding sequence
atggccagcctgagccggcccagcctgcccagctgcctgtgcagcttccttctgttgctcctcctgcaagtgagcagcagttacgccggtcaattcagagtcatcggacccagacaccccattagggccctggtaggggacgaggtagaattaccgtgcagaatttctcccggtaagaacgctacaggcatggaggttggctggtaccggcccccctttagccgggtcgtgcatttgtatcgtaacgggaaggaccaggatggcgaccaggcaccggagtaccggggcagaacagaactgctgaaggatgcaataggagaaggaaaggttacactccggatccgcaacgtgagattctccgatgaaggaggtttcacgtgtttcttccgcgaccactcttaccaagaggaagctgccatggagttaaaggtagaagtgagtcactctgtgacacaagactggctgcagtggcacgaccatggatcactgcaacctccccctccccgactgaaatag

SEQ ID NO: 195875 - DNA, 744 bp, Artificial Sequence
  Description of Artificial Sequence: Synthetic coding sequence
atggccagcctgagccggcccagcctgcccagctgcctgtgcagcttcctgctgttgttattgcttcaggtgtcttcctcctatgccggacaattcagagtcatcggcccgcgccacccaattcgagctctggtgggcgacgaagtggagcttccgtgcagaataagtccgggtaagaatgctacagggatggaggttgggtggtatcgccctccgttcagtagagtggtccacctctaccggaacgggaaagaccaggacggggatcaggcgcccgaatatcgcggccgaacagagctgctgaaggacgcaattggggagggaaaagttaccttgaggattcgtaacgtgcgcttttccgacgaaggcgggtttacttgtttcttccgagatcactcataccaggaggaagcggccatggagcttaaggtggaggatcctttctattgggtttcccctggcgtcctggttctgctggccgttctgcctgtattgctactccagatcacagtcgggctgattttcctgtgtctgcaatacaggctgagaggaaagcttagagcagaaatcgagaaccttcacaggacattcgatccacacttcctgagggttccctgctggaagatcactctgtttgtgatcgtacccgtactggggcctctcgtagctctgatcatatgttacaattggctgcacagaagactggcagggcaatttctggaggagttacgaaatcctttttag

SEQ ID NO: 195876 - DNA, 396 bp, Artificial Sequence
  Description of Artificial Sequence: Synthetic coding sequence
atggccagcctgagccggcccagcctgcccagctgcctgtgcagcttcctattactgctcttactacaggtctcatccagttacgccgatcctttttactgggtgagcccaggcgtgctggtcttgctcgccgtgctgccggtgcttctcctgcagattaccgtaggattggtcttcctgtgcctgcagtaccggctgcgcggaaagctgcgggctgagattgaaaacctacacagaaccttcgatccacacttcttaagggtcccctgttggaagatcacacttttcgtcatcgtccccgtcctcgggcctctggtcgcacttataatctgctacaattggctccaccggcgactggcaggccaatttctcgaggagctgcgtaatccattttag

SEQ ID NO: 195877 - DNA, 744 bp, Artificial Sequence
  Description of Artificial Sequence: Synthetic coding sequence
atggccagcctgagccggcccagcctgcccagctgcctgtgcagcttccttcttctgcttttgttacaggtcagctcaagctatgccggtcagttccgggtgatcggtcctaggcatcccatccgagctcttgttggagacgaagtcgagcttccttgtagaatctcacctggcaagaatgccacgggaatggaggtggggtggtatcggcctcctttctcacgggttgtgcatctgtaccgcaatggaaaggatcaagacggagatcaggcgccagaatatcgtggccgaacggaacttttaaaagatgccatcggggagggaaaggtgactctcagaatccgcaacgtgcgattctccgatgagggaggctttacctgcttcttcagggatcatagctaccaggaggaggccgcaatggaactgaaagtggaggaccccttttattgggtgagtccaggcgtgctagttctgctggccgtccttccagtgcttcttctgcaaatcaccgtgggactggtgtttctgtgcctgcaatataggttgcgaggtaagctgcgagcagagatcgagaatctgcatcgcacatttgacccacactttctccgcgtgccttgctggaaaattaccctgtttgttatagtcccagtgctcggacccttggtggctttgatcatttgctacaactggctgcatcgcagactggcaggtcagttcctggaagagctgcgcaatcctttctag

SEQ ID NO: 195878 - DNA, 744 bp, Artificial Sequence
  Description of Artificial Sequence: Synthetic coding sequence
atggccagcctgagccggcccagcctgcccagctgcctgtgcagctttctgctgctcctgctgcttcaggtttctagcagttacgcaggtcagtttagggtaatcggccctcgtcatccgataagagcgctggtaggtgacgaagtcgagctgccatgcagaatcagtccggggaaaaacgcaacaggaatggaggtcggatggtacagaccccccttttcccgggtcgtgcacttgtaccggaatggaaaagatcaggacggagatcaggcccccgaatatcgcggacggacagagctgttaaaggatgcaattggcgaaggaaaggtaactcttaggattcggaacgtgcgcttctctgacgagggcgggttcacatgcttctttagagatcatagttaccaggaagaagccgccatggaattgaaagttgaagatccgttctattgggtgagcccaggagtcctggtgctgctggccgtcctgcctgtgctcctccttcagataacagtgggactcgtgttcctgtgtttgcagtaccgactgcgcgggaaactgagggccgagatcgagaacctacaccgtaccttcgatccccacttcctccgcgtgccgtgctggaagatcaccttatttgtcattgtccctgtgttgggcccactggttgccctaattatctgttacaattggctacataggcgtctggcgggccaattcctggaggaactcaggaatccgttctag

SEQ ID NO: 195879 - DNA, 690 bp, Artificial Sequence
  Description of Artificial Sequence: Synthetic coding sequence
atggccagcctgagccggcccagcctgcccagctgcctgtgcagctttctccttcttcttttgctgcaggtaagtagctcatacgctggccagttccgcgtgattggccctcggcacccaattcgagcactggtgggggacgaagttgaactgccttgtaggatttcacccggaaagaatgcaacggggatggaggtcggctggtatcgccctcctttctctcgagttgtgcatttatatcgaaatgggaaggaccaggacggggaccaggctccggagtaccgcggacggaccgagttgttaaaggacgccattggcgaaggtaaggttaccttacggattcggaatgtgagattcagcgatgagggaggcttcacctgcttttttcgcgaccattcttaccaagaagaagcagccatggaattaaaagtggaagaccccttttattgggtcagccccggcgtcctggtgctgctggccgtgctcccagtgctgcttctgcagattacggtcggattggtgttcctttgtctgcagtaccgtctgagaggcaagctccgtgcggagattgagaacctgcaccgtactttcgagtctttcggagtgctggggccacaggtaaaagagccaaagaagaccgggcagtttcttgaagaactgctgttccatctagaagcactctccggctag

SEQ ID NO: 195880 - DNA, 642 bp, Artificial Sequence
  Description of Artificial Sequence: Synthetic coding sequence
atggccagcctgagccggcccagcctgcccagctgcctgtgcagctttctgttgctcctgctgctacaagtgtcaagttcatacgccggccagttccgtgtcatcggtccgcgacaccccattcgggcgttggttggagatgaggtggagctgccttgtcggatcagcccaggcaaaaacgctaccggtatggaggtaggctggtacaggcctcccttctcccgcgtggtgcatctttaccgaaacggtaaagatcaggacggcgaccaagctccagagtacagaggcagaactgagctgctcaaagatgccattggcgaggggaaggttaccctgaggatccggaacgttcgattttcagacgaaggcggtttcacatgtttctttcgtgaccattcttatcaggaagaggccgccatggagctgaaagtggaggacccattttattgggtttcacccggggtgctcgtactattagcagtgctccccgtcctgctgttgcagattacagtcggcctgatcttcctgtgtctgcagtacaggctgcgtgggaaactgagggccgagatcgaaaatctacatagaacctttgggcagttccttgaggaactgttgttccatctggaggccctttccgggtag

SEQ ID NO: 195881 - DNA, 675 bp, Artificial Sequence
  Description of Artificial Sequence: Synthetic coding sequence
atggccagcctgagccggcccagcctgcccagctgcctgtgcagcttcctgctgttgctgttgctgcaggtgagtagttcctacgccggacagtttagggtgatcgggcctcggcatccaattcgtgctcttgtcggagatgaagtggagctcccttgccggatttctcccgggaagaatgccactggtatggaagtgggatggtatagaccgccatttagtagagtggtgcacttgtaccgtaacggaaaagaccaggacggagaccaggcgccagagtacagagggaggactgagctcttaaaggacgctataggggagggcaaggttaccctgagaattcggaatgtgagattcagtgacgagggaggcttcacatgcttcttcagggaccactcttaccaggaggaagcggccatggaactgaaggtcgaagatccgttttattgggttagcccgggagtgctcgttctgttagccgtgctgccggtcctgttgttgcagataactgtcggacttatttttctgtgccttcagtaccgccttcgcggtaagctgcgagctgaaatcgagaaccttcatcggacatttgagtccttcggcgtgctcggcccacaggtgaaggagccgaagaagactggacagttcttggaagaactgcggaatcctttctag

SEQ ID NO: 195882 - DNA, 675 bp, Artificial Sequence
  Description of Artificial Sequence: Synthetic coding sequence
atggccagcctgagccggcccagcctgcccagctgcctgtgcagcttccttcttcttctcctgctccaagtcagctccagctatgcaggtcaattccgcgtgataggtccaaggcatcccattcgagccctggttggcgatgaagttgaattaccgtgccggatctctcctgggaagaatgccaccgggatggaggtagggtggtaccgccccccattttcccgtgtggtgcacctgtatcggaatggaaaggatcaggatggggatcaggcccccgagtaccgtgggcgaaccgaactccttaaggacgctatcggggaggggaaagtgacattgcgcattcgcaacgtcagattttccgatgaggggggatttacctgttttttcagggaccatagttatcaagaagaggccgccatggaactgaaggtggaagatccattctattgggtctctccaggggtcttggtattgctggctgttctccctgtcctactcctacagattacactcgggcttgtgtttctgtgcttacagtacagattaagaggaaagcttcgagcagaaattgagaacttacaccggacattcgaatcctttggcgttctcggtccccaggtgaaagagcctaaaaagacggggcagttcctcgaagagctgagaaaccccttctag

SEQ ID NO: 195883 - DNA, 690 bp, Artificial Sequence
  Description of Artificial Sequence: Synthetic coding sequence
atggccagcctgagccggcccagcctgcccagctgcctgtgcagcttccttttacttcttctcttacaagtgagctcttcctatgcaggacagtttcgagttatcggtccccggcatcccataagagctctcgtcggggacgaggtggaactcccatgtagaatcagccccggtaaaaacgctaccgggatggaagtcgggtggtaccgaccacccttctccagggtcgtgcacctatatagaaatggaaaggaccaggatggcgaccaggctcctgaatatcgggggcgaaccgagttgctgaaggatgcaattggtgagggtaaggtgacgttgaggattcgcaacgtcagattcagtgatgaaggtggcttcacttgcttcttccgggaccacagctaccaagaagaagcagccatggaacttaaggtcgaggacccattttattgggtatcccctggcgtcctggtgcttcttgcggtcctacctgtactccttctgcaaattaccgttggattagtgttcctgtgcctgcagtatcgactgagaggaaagttgcgcgccgaaatagagaaccttcaccgcacattcgagagctttggcgtcctgggacctcaagttaaagaacccaagaaaaccggacagtttttggaggaacttttgttccacctggaggccttatccggctag

SEQ ID NO: 195884 - DNA, 642 bp, Artificial Sequence
  Description of Artificial Sequence: Synthetic coding sequence
atggccagcctgagccggcccagcctgcccagctgcctgtgcagcttcctcctgcttttactgctccaggtttccagttcgtacgctgggcagtttagggtgatcggccccaggcatcctatcagagctttggtgggggatgaggtagaattgccctgtcgaatttcaccaggcaaaaacgcaactgggatggaggtcggctggtataggccccctttttctcgcgtggtgcatctttaccgcaacgggaaggaccaggatggagaccaggctcccgaatacaggggacgcaccgaactgctgaaagacgcaatcggggagggcaaagtgactctgcgaattcgcaacgttcgtttcagcgacgaagggggcttcacatgtttcttcagggaccacagttaccaggaagaagcagcaatggaattgaaagtagaagatcccttttactgggtgagtccaggggtgctggtcctactggctgttctgcccgtgctcctcttacagatcacggtgggactggtgtttttatgtcttcagtatcggctgagagggaaactgagggccgaaatcgagaatctgcacaggactttcggtcagtttctcgaggagttgctgttccatctggaggccctctccggatag

SEQ ID NO: 195885 - DNA, 540 bp, Artificial Sequence
  Description of Artificial Sequence: Synthetic coding sequence
tgacagttccgggtgatcggcccccggcaccccatccgggccctggtcggagacgaggtcgaactgccttgcaggatctctcctgggaaaaatgctactggtatggaggtggggtggtacagacctccgttctctcgtgtggtacacctgtatagaaatgggaaggaccaggatggcgaccaagccccggagtatcgaggccgaaccgagttgctgaaggatgccattggagagggtaaagtcacactgcgcatccggaatgttcggtttagcgacgaaggcggcttcacctgtttcttccgagaccacagctaccaggaggaggccgcaatggagctcaaagtcgaagatcctttctattgggttagccctggtgtactcgtcttgttggcggtcctgccagttctgctcctgcaaatcacagtcgggctcgtgtttctgtgtctccagtacagactcagggggaaactgagggccgagatagaaaatttacatagaactttcgggcagttccttgaagagctccgaaatccgttttag

SEQ ID NO: 195886 - DNA, 396 bp, Artificial Sequence
  Description of Artificial Sequence: Synthetic coding sequence
atggccagcctgagccggcccagcctgcccagctgcctgtgcagcttcttgctgctcctgctgctgcaggtaagctcctcttatgccgaccccttctactgggtctctccaggcgtacttgtgctccttgcggtgctaccggtgcttctgcttcagatcacagttggcctggtgttcctgtgtcttcagtaccgactcagaggcaaattaagagctgaaatcgagaatctgcaccgtacatttgatccgcacttcctgcgcgtaccctgttggaaaatcactctcttcgtgatcgtccccgtgttaggaccgctggttgcactgattatctgctacaactggctgcatagacgtttggcgggccaattcttggaggagttacggaatcccttttag

SEQ ID NO: 195887 - DNA, 615 bp, Artificial Sequence
  Description of Artificial Sequence: Synthetic coding sequence
agcctgagccggcccagcctgcccagctgcctgtgcagcttcctgctgctgctgttgctgcaggtgtcatcatcctacgcgggccagttcagggtgatcgggccccgacaccctattcgggctctcgtcggcgacgaagtggagctcccatgtcgaattagtcccggcaagaacgccaccggaatggaggttggctggtaccggccaccattctcaagagtggttcacctgtatcggaatgggaaagatcaggacggtgaccaagctcctgagtataggggccgaaccgaacttctcaaagatgccatcggggaagggaaagtgactcttcgaattcgcaacgttcggttctccgatgaaggcggctttacctgttttttcagagaccactcctaccaagaagaggccgcgatggagctgaaagtggaagaccccttctattgggtctcgccaggcgtgctggtgttactggccgtgctgccagtcctcctgctgcagattacggtggggctggtgtttttgtgcctgcagtataggttgcgcgggaaactgcgcgcagaaattgagaatctgcatcggacattcgtattccacctcgaagctctgtcgggatag

SEQ ID NO: 195888 - DNA, 396 bp, Artificial Sequence
  Description of Artificial Sequence: Synthetic coding sequence
atggccagcctgagccggcccagcctgcccagctgcctgtgcagctttcttctccttctgctattgcaggtttcttcttcgtatgccgaccctttttactgggtgagccccggcgtgctagtcctactggccgtgttacctgttcttctgctgcagatcactctgggactggtgttcctctgtctccagtaccgattgcgaggaaaattaagggccgaaatagaaaacctgcatcggacatttgacccccattttctcagagtaccttgctggaaaattacattgttcgtgatagtgcccgtgctaggacctcttgtggccttgatcatatgctataattggctgcaccgaaggctcgccggccaattcctggaagagctgagaaatcctttctag

SEQ ID NO: 195889 - DNA, 675 bp, Artificial Sequence
  Description of Artificial Sequence: Synthetic coding sequence
atggccagcctgagccggcccagcctgcccagctgcctgtgcagcttcctccttctgctcttgctgcaggtttctagcagttacgctggccaatttagggtgattgggcctcggcaccccattcgtgctctggtgggagacgaggtggaattaccctgccgcatctctcctgggaagaatgcaacggggatggaggtcggttggtatcgcccacctttcagcagggtggtgcatctgtataggaatggaaaggaccaggatggggatcaagccccagagtaccgcggccgcactgagctgctgaaagatgccattggcgagggcaaagtgacacttagaattcgcaacgtgcgattctctgacgagggggggttcacctgcttctttcgggaccactcctaccaggaagaagcggcaatggaactcaaagtagaagatcctttctattgggtgtcacctggcgttctggttctgcttgccgtgttgccagtgctactcctgcaaataactgttggactggtgttcctatgtctccagtacagattgagagggaagctgcgcgccgaaatagagaatctccatcgcacctttgaatctttcggagtcctcggtcctcaagttaaggagcccaagaaaacgggacagttcttggaggagttacggaatcccttctag

SEQ ID NO: 195890 - DNA, 675 bp, Artificial Sequence
  Description of Artificial Sequence: Synthetic coding sequence
atggccagcctgagccggcccagcctgcccagctgcctgtgcagctttctgctgctcttattactgcaggtgagtagcagttacgcgggtcagtttcgtgtgatcggacctagacatcccatacgtgctctggttggagatgaagtagagctcccttgccgaatttccccaggtaaaaacgccacaggaatggaagtggggtggtacagaccccctttttcaagagttgttcacctgtatagaaacgggaaagatcaggacggggaccaggcccctgagtaccgcggtagaacggaactccttaaggacgccatcggggagggcaaagtgacattaagaatccggaacgtccgattctcagatgagggaggatttacctgcttttttagagatcactcctaccaggaagaagccgcaatggagctgaaggtggaagacccgttttattgggtctctcctggcgtcctggtactcctcgcggttctccccgtacttttgttgcagattactgtcggactagtgttcttatgtttgcagtacaggctccggggaaagttgcgcgcagagatcgagaatctccaccggacatttgaaagtttcggggtgctaggcccccaggtgaaggagccaaagaagactgggcagtttctggaagaactcagaaatccattctag

SEQ ID NO: 195891 - DNA, 675 bp, Artificial Sequence
  Description of Artificial Sequence: Synthetic coding sequence
atggccagcctgagccggcccagcctgcccagctgcctgtgcagctttctcctacttctgctgctccaagtatcaagctcatatgccggacaattcagagtaattggaccgaggcaccctattagggctctggtaggcgatgaagtggagctaccttgtaggataagtccaggcaagaacgccacgggcatggaagtggggtggtaccgcccccccttctcccgagtggtgcacctgtacagaaatggcaaggaccaagacggtgaccaggcccccgagtatcgtggtcgcaccgagctgctgaaggacgctattggtgagggaaaggtcacactaagaattcggaacgtcagattttctgacgagggcggattcacatgctttttccgagatcattcctatcaggaggaggcagccatggagctgaaggttgaggatcccttctactgggtcagtccgggggtgctggtactcctggcagtacttcctgtgttgctcctgcaaatcaccgtggggctggttttcttgtgcctgcagtacagattacgcggaaagctgcgcgcggagatcgagaaccttcatcgaacattcgagtccttcggcgtgctggggcctcaggtgaaagaaccaaagaagaccggccagtttctggaagagctgaggaatcccttttag

SEQ ID NO: 195892 - DNA, 759 bp, Artificial Sequence
  Description of Artificial Sequence: Synthetic coding sequence
atggccagcctgagccggcccagcctgcccagctgcctgtgcagctttctgctgctgctgctcctccaggtgtcttcctcctacgctggccagtttcgcgtcattggtcctaggcatcctatacgcgcattagttggggacgaagtcgaactgccttgtcggatcagtccaggaaaaaatgccacgggcatggaggtcggctggtaccgaccccccttcagccgagtggtgcacctgtataggaacggaaaagatcaggatggagatcaggcccctgagtaccgaggacggactgaattgctgaaagatgctatcggcgagggaaaagtcaccctgagaatacgcaacgtgcgttttagtgatgagggagggtttacttgtttttttcgggaccactcatatcaggaggaggcggctatggagctgaaagtggaagaccctttctattgggtgtctccaggggttctggtgttgctggctgtcctacccgttctcttgctgcaaatcaccgtagggttagtcttcctgtgcctgcagtatcgtttgcgggggaaactgcgagcggagatcgagaacctgcataggacatttgacccccacttccttcgggtcccatgttggaagattaccctattcgttattgttccggtgctcggaccactcgtcgccttaatcatctgctataattggctccaccgacggctggccggacagtttctggaggaactcctattccatctcgaggctctgagcggttag

SEQ ID NO: 195893 - DNA, 744 bp, Artificial Sequence
  Description of Artificial Sequence: Synthetic coding sequence
atggccagcctgagccggcccagcctgcccagctgcctgtgcagctttcttttactcctgctcctgcaagttagctcgtcttatgctgggcaattcagggttatcggcccacgtcatccaattcgggcacttgttggcgatgaagtagagttgccttgcaggattagccctgggaagaatgcgaccggcatggaggttggctggtaccgcccaccattttcacgcgtggtccacctctaccgtaacggaaaggaccaagatggcgaccaagcgcccgaatatcgtggtcggacggagctgctcaaagatgctatcggtgagggaaaggtgactctgagaatcagaaacgtgaggttttctgacgagggcgggtttacctgtttttttagggaccacagttatcaggaggaagctgcaatggagctgaaggttgaggacccattttattgggtgagcccaggagtgttggtgctgctagccgtcctccccgttctgttgttacagatcacagtagggctggtgttcctttgcctacagtaccggctgagagggaagttgcgggctgaaatcgaaaatctccatcgtaccttcgatcctcatttcttgcgcgtaccgtgctggaagatcacactcttcgtgattgttcccgtgctggggcccctcgtggcactcattatttgctataactggctgcaccggcgtctggccggtcagtttttagaggagctgcggaaccccttttag

SEQ ID NO: 195894 - DNA, 540 bp, Artificial Sequence
  Description of Artificial Sequence: Synthetic coding sequence
tgacagttccgggtgatcggcccccggcaccccatccgggccctggtgggggatgaagtcgaactcccgtgtcgtatctccccgggcaaaaatgcaaccggaatggaggtgggctggtaccggcctccatttagcagggtcgtccacctgtatagaaacgggaaggatcaggacggagaccaggctccagaatatagggggaggaccgaactgttaaaagacgcaattggggagggcaaggtgaccctgcgaatcagaaatgtccgtttttccgacgaaggcgggttcacctgtttctttagagatcattcttaccaggaggaggccgctatggaactgaaagtggaggaccctttctactgggtgagtcccggcgtgctggtgcttctggcggtacttccagtgttgctgctccaaatcaccgtaggtctggtgtttctttgtctgcagtataggcttcgggggaaactcagagctgagattgagaacttgcacagaacattcggccaattcctggaggaactcaggaatcccttctag

SEQ ID NO: 195895 - DNA, 540 bp, Artificial Sequence
  Description of Artificial Sequence: Synthetic coding sequence
tgacagttccgggtgatcggcccccggcaccccatccgggccctggtcggcgacgaagtggagctgccttgtaggataagccccggtaagaacgcaacagggatggaggtggggtggtacaggcctcccttcagcagggtggttcatctatatcgaaatggtaaggaccaggacggagatcaggctcctgaataccgaggacgtactgaattactcaaggacgctatcggcgaaggcaaggtgactcttagaatccggaatgttagatttagcgatgaaggcgggttcacatgtttctttagagatcacagctaccaggaagaggccgctatggagttgaaggtagaggatccgttctactgggtttccccgggggttctggtcctcctggccgtgctccctgtcctgctgctgcagatcacggttggtcttgtatttttgtgccttcagtacaggttgcgaggcaaactgcgggcagagatcgaaaacttgcaccgcacatttggtcagtttctggaggaactacgtaatcccttttag

SEQ ID NO: 195896 - DNA, 759 bp, Artificial Sequence
  Description of Artificial Sequence: Synthetic coding sequence
atggccagcctgagccggcccagcctgcccagctgcctgtgcagcttcctgctgctgctgctgctccaggtgagctcttcatatgcaggacagttcagagtgattgggccaagacacccgattcgggcgctggtgggcgatgaggttgaactgccatgtcgtatctctccggggaaaaacgcaaccgggatggaggtggggtggtaccgtccccctttttctcgggtggtacacttgtatagaaatggtaaggatcaggatggcgatcaggcgcccgagtaccggggacggacagagctccttaaagatgctattggcgaaggaaaggtgaccctgcgcatccggaatgtcagatttagcgacgagggcggctttacatgcttcttccgtgaccacagctatcaggaagaggccgcaatggagctaaaagtagaggacccattttactgggtgtcgcctggagtgttggttctgttggccgtgttacccgttctgctcctgcaaatcacagtgggcctcgttttcctgtgccttcagtatcgcctgaggggtaaactgagagccgagattgagaacctccacaggacgttcgacccgcactttctgagggtgccctgttggaagatcactctgtttgttatcgtgccagtcctgggtccgctggtagccctgataatatgttacaattggcttcaccgcagactggcaggacaattcttggaggaactcctgtttcatttggaggccttgagcggttag

SEQ ID NO: 195897 - DNA, 690 bp, Artificial Sequence
  Description of Artificial Sequence: Synthetic coding sequence
atggccagcctgagccggcccagcctgcccagctgcctgtgcagcttcttgctactgttattgctccaggtgagctcttcatatgcaggtcaattcagagtgatcggcccgcgacatcccattagagcactggtcggagatgaggtggaacttccgtgcaggataagcccgggcaagaacgccacgggaatggaagtaggttggtaccgacctccgttcagcagagttgtgcatttatatcgaaacggcaaggaccaagatggtgatcaagcccctgagtacagagggagaactgaacttctaaaggatgccataggggaagggaaagtgacgctgagaattcgaaatgtccgattctcggacgaaggcggatttacatgtttttttcgcgatcattcgtatcaggaggaggccgctatggaactgaaggttgaagaccctttttattgggtctctcctggggtacttgtgctgctcgctgttttgcctgtgctgctactgcagatcaccgtgggcttagtcttcctttgccttcagtaccgcctcagaggaaaactgagggccgagattgagaaccttcatcggacgtttgaatcatttggagtgctagggccacaggtgaaagaaccaaagaagacgggtcagttcctcgaagaactactgttccacttggaggctttatctgggtag

SEQ ID NO: 195898 - DNA, 888 bp, Artificial Sequence
  Description of Artificial Sequence: Synthetic coding sequence
atggccagcctgagccggcccagcctgcccagctgcctgtgcagcttccttctcctactgctgctgcaggtttcctcaagttacgcagggcagttccgcgttatagggcctagacaccctattcgtgcccttgtgggcgatgaagtagaactaccttgtaggatttcccccgggaaaaatgccactggcatggaggtggggtggtatcgtccgcctttttctcgagtcgtgcatctttaccggaacggaaaggaccaagatggcgatcaggcacctgagtacagaggtcgcacagagctgcttaaggacgctattggggagggcaaggtgaccctcaggatccgaaatgtacgtttttccgatgaaggagggtttacctgcttctttagagatcacagctatcaggaagaagccgcgatggagctcaaggtggaggacccattctactgggtatctcccggagtcctggtcttgctcgccgtgctacccgtactgctacttcagattaccgtcggcctcgtcttcttgtgtctgcagtacaggctgcggggcaagctcagagctgagattgaaaatctgcaccgcactttcgaccctcattttctccgagtgccatgttggaagatcacactgttcgtgattgttcctgtgcttggtccgctcgtcgccttgattatctgctacaactggttacaccgcaggctggcaggccagtttctggaggagcttcggaaattcagttctctctgctacaagcagcgaattaagagccaggagagagaaaccgaagccactagggggcgcggcgggctgttgagggatcacatccccagaggaaaggaggagctggagagccttggaggagggaaaaccccccccggaaggtag

SEQ ID NO: 195899 - DNA, 642 bp, Artificial Sequence
  Description of Artificial Sequence: Synthetic coding sequence
atggccagcctgagccggcccagcctgcccagctgcctgtgcagctttctgctgcttctcttactgcaggttagctcctcatatgcaggacagtttagagttatcggcccacgacacccgattagagccttggtaggcgacgaagtggagctgccttgtcgaatcagtccagggaagaacgctactgggatggaggttgggtggtaccgccccccattctcacgggtggtgcatttgtatagaaacggcaaggaccaagatggagatcaggcaccagagtataggggtcggacagagttgcttaaggacgccatcggcgaaggcaaggtgacgttgagaatccgcaacgtgcgcttttccgacgaaggggggtttacgtgtttcttcagggatcacagttaccaggaggaggctgctatggagttgaaggtcgaggacccgttttattgggtgagcccaggagtgctggtgctattggccgttttgcccgtgctcctcctacagatcactgtagggctcgtgtttctgtgtttgcagtatagattgcgggggaaattacgagccgaaatcgagaatctgcatcggacttttgggcaattcctcgaggaactcctcttccatctggaggcactcagtggatag

SEQ ID NO: 195900 - DNA, 759 bp, Artificial Sequence
  Description of Artificial Sequence: Synthetic coding sequence
atggccagcctgagccggcccagcctgcccagctgcctgtgcagcttccttcttttgctcctgttgcaggtcagtagtagctatgcaggacagttccgagttataggcccacggcaccccattcgtgccctggtgggagacgaggtcgagctgccctgcaggatcagccccggcaagaatgcaacagggatggaggtgggatggtataggcctccttttagtagagttgtccacctgtataggaatgggaaagaccaagatggggatcaggcccccgagtatcgcggcagaacagaactacttaaagatgctataggtgaaggaaaggtaactctcagaattcggaatgtgcgcttttcagatgagggcggcttcacctgttttttccgagatcacagctatcaggaggaggcagcaatggaactgaaggttgaagacccattctactgggtctcaccaggggtgctcgtcctgctggcagtgttacccgtgctacttctgcagatcacagtcgggctcgtattcctatgtctgcagtatcgccttcgagggaagctccgtgctgagatcgagaatctgcatcgcacctttgaccctcacttcctgagggtgccctgttggaagattactctctttgtgatcgtgccagtgttggggccccttgtcgcccttattatttgctacaattggctgcaccgacgtctagcaggccagttcctggaagaattgctgtttcacctggaggcgctctccggttag

SEQ ID NO: 195901 - DNA, 540 bp, Artificial Sequence
  Description of Artificial Sequence: Synthetic coding sequence
tgacagttccgggtgatcggcccccggcaccccatccgggccctggtgggagacgaagtggagctgccctgccgcataagccctgggaagaacgctactggtatggaggtgggctggtaccggccccccttcagtcgcgttgttcacctgtataggaacggcaaggatcaggacggggatcaagcaccggagtatagaggcagaaccgaactgcttaaggacgcaattggggagggcaaagtgacgcttcgaattcggaatgtacggttttcggacgaggggggttttacctgtttcttcagagaccactcctatcaggaggaggcagctatggaactaaaagtagaagatcccttctactgggtttctccaggagttcttgtgctgctcgcagttctccccgtgctgttgcttcaaatcactgttgggctcgtttttttgtgcctgcagtaccgtctccgaggcaaattacgtgctgagatcgagaacctccataggacttttgggcaattccttgaggagctccgaaatcccttctag

SEQ ID NO: 195902 - DNA, 888 bp, Artificial Sequence
  Description of Artificial Sequence: Synthetic coding sequence
atggccagcctgagccggcccagcctgcccagctgcctgtgcagctttctgcttctcctactgcttcaggtgtccagcagctatgccgggcagtttcgagtgatcggcccaagacacccgataagggcacttgtgggcgacgaggtggagttgccgtgccgaatcagcccgggtaagaacgccacagggatggaagtgggctggtacaggccacccttttcacgggtggttcatctctacagaaatggcaaagaccaggacggcgaccaggcccctgagtacagagggagaacggaacttttaaaggatgcgataggggagggaaaagtgactcttagaatccgcaacgtgcggttcagcgatgaaggcggattcacatgcttcttcagggaccacagctatcaggaagaggctgccatggagctgaaggtcgaggacccattctactgggtctcgcccggggtcctggtcctccttgccgtgctccctgtgctattattacagatcactgtgggactggtatttctatgcctgcagtacagattaaggggcaagcttcgagccgagattgaaaaccttcaccggacctttgacccgcacttccttcgggttccctgctggaaaataaccttgttcgttattgtccctgtgctgggcccactggtggcgctgatcatctgttataactggttacaccggcgtctggctgggcagtttctagaagagctgagaaagttctcctctttatgttataagcagcgaatcaagtcgcaagaacgagaaactgaagctactaggggaagggggggactcttgcgcgatcacatccccaggggcaaagaggagctggagtccctgggtgggggcaaaacacccccaggtagatag

SEQ ID NO: 195903 - DNA, 888 bp, Artificial Sequence
  Description of Artificial Sequence: Synthetic coding sequence
atggccagcctgagccggcccagcctgcccagctgcctgtgcagctttctgttgcttcttctcctacaagtgtcctcttcgtacgctggccagttccgagtgatcggacctcggcacccgatccgggcattggttggcgacgaagtggagctgccttgtaggattagccccggaaagaacgcaactgggatggaagtgggctggtatcggcctcccttttccagagtggtgcatttgtataggaatgggaaagaccaggacggggaccaagccccagagtacagaggaagaactgagctgttgaaggacgccattggtgagggaaaggtcacgctgagaattagaaatgtaagattctctgatgagggcggattcacttgtttcttccgcgaccatagctaccaggaggaggccgctatggaactgaaagtcgaagacccgttctattgggtgagtccgggcgtgctggttctcctggccgtgttgccggtattgctgctgcagataaccgtgggccttgttttcctctgtctgcagtatcggttgagaggaaaattgcgcgctgaaattgaaaacctgcatcggacattcgacccacattttttacgggtcccttgttggaaaataactctctttgtcatagtacctgttctggggcccctggtggctcttatcatttgctataactggctgcatagacgcctggccggtcaattcctcgaagagctgcggaagttctcttccctctgttacaagcagcggattaagagtcaggaaagagagactgaagcaaccagaggaagggggggcttgctgcgcgaccatattccacgtgggaaggaagagttggagtccctggggggcgggaaaacccccccagggcgttag

SEQ ID NO: 195904 - DNA, 396 bp, Artificial Sequence
  Description of Artificial Sequence: Synthetic coding sequence
atggccagcctgagccggcccagcctgcccagctgcctgtgcagcttcctgttgttgctgctccttcaggtctcaagtagctacgccgatcctttctactgggtgtcgcccggggtgctggtactgttagctgtgctaccagttctgctcctacaaatcacagtgggcctagtcttcctctgcctacagtatcgcttgcggggtaagctcagggcagagatcgagaacctccacagaacctttgacccccatttcctgagagtgccctgctggaagattactctgttcgtgatagtccctgtgctgggcccactggtcgctctcattatctgttacaactggctccacagacgccttgccggccagtttctggaagagttacgtaacccgttctag

SEQ ID NO: 195905 - DNA, 759 bp, Artificial Sequence
  Description of Artificial Sequence: Synthetic coding sequence
atggccagcctgagccggcccagcctgcccagctgcctgtgcagcttcttgttgctgttgctgctgcaggtgtcgagtagctatgccgggcagttccgggttattggaccacgccaccccatacgcgccctcgtaggtgatgaggtggagcttccgtgccgcattagccccggaaaaaatgccacaggcatggaagtggggtggtaccggccgccattttcccgagtggttcacttgtatcgcaacggaaaggaccaagatggtgaccaggcaccggaataccgcggacgaactgagctcctcaaagacgccatcggagaaggcaaggtcacattgcggattcgcaatgtgcgtttcagtgatgaaggtgggttcacttgtttctttcgggatcatagttatcaggaggaggcggctatggagttgaaagtggaggatcccttctattgggtgtcacctggggtgttggtactgctggctgtcctgcctgtccttctgctccagattacggtgggattggtgtttttgtgcttgcaatacaggttgagaggcaaactgcgggcagagatcgagaacctccacaggacatttgacccccattttttgcgggttccatgttggaaaatcaccctgtttgtgatcgttcctgttctcggtccactggttgcgctgattatctgttacaactggcttcatcgccgacttgcaggccagttcctggaagagctgctcttccatttggaggctcttagcggctag

SEQ ID NO: 195906 - DNA, 744 bp, Artificial Sequence
  Description of Artificial Sequence: Synthetic coding sequence
atggccagcctgagccggcccagcctgcccagctgcctgtgcagcttccttctgctcctccttttgcaggtgtctagttcatatgctggccagttccgcgtcataggtccccgccacccgattagagcactcgtcggggacgaggtagaactgccttgtcgaatttcacccggtaagaatgccaccggaatggaagtgggctggtacaggcctcccttttcacgcgtcgttcacttgtatcgcaatggcaaggatcaggacggtgaccaggcccccgaatacagaggacggaccgaacttcttaaggatgcgattggggaaggaaaggtcactcttaggattcgaaatgtgcgattttccgatgaggggggattcacgtgtttcttcagagatcactcataccaggaggaggccgcgatggaactcaaggttgaggatccattctactgggtcagtcctggtgtattggtcctgttggccgtgttacccgtgttgctgctgcagataacagtcgggttagttttcctgtgtctgcagtatcggttgaggggaaagctgagagcagaaattgagaacctgcaccgcaccttcgatccgcactttttacgggtgccttgctggaaaataaccctgtttgtgattgtgccggtcttggggcctctagttgcactgatcatctgctataactggctgcacagacgccttgctggccagtttctggaagagctccgtaatccgttctag

SEQ ID NO: 195907 - DNA, 615 bp, Artificial Sequence
  Description of Artificial Sequence: Synthetic coding sequence
agcctgagccggcccagcctgcccagctgcctgtgcagcttcctgctgttgctactgctgcaagtttcatcctcctacgctggacagttccgcgtaatcggacctcgccaccctatccgtgcgttagtgggagacgaggtagagttgccctgtcggatttccccgggaaagaacgccactggtatggaagtaggttggtatcgtcctcccttcagccgagtagtgcatctttaccgtaatggaaaggatcaggacggagaccaggcccccgagtatcggggtcgaacggagctgctgaaagacgcaatcggggaggggaaagttactctccggattcgaaacgtccggttttccgacgagggggggttcacatgcttcttcagagatcactcttatcaggaggaagctgccatggagctgaaagtcgaggaccccttttactgggtcagtcctggcgttttggtgctgctagccgtactcccagtccttttgctgcaaattacagttggccttgtattcttatgcctgcaatatcggttgaggggaaaattgcgcgccgagatagaaaacctccaccgcacttttgtgtttcacctcgaggcacttagcggttag

SEQ ID NO: 195908 - DNA, 888 bp, Artificial Sequence
  Description of Artificial Sequence: Synthetic coding sequence
atggccagcctgagccggcccagcctgcccagctgcctgtgcagcttcttactcttattattgcttcaggtgagctcaagctatgccggacaatttcgcgtcatcggaccgcgtcatccgatcagagctttagtgggagatgaggtggaactgccgtgtcgaattagccccggcaaaaatgccaccggcatggaggtggggtggtataggccacctttcagcagggttgtccacctttacaggaacggaaaggatcaggacggggatcaagcacccgagtaccgaggccgaaccgaactgcttaaggatgcgatcggcgagggaaaggtgacactccgcatccgcaatgtgcgtttctcagatgagggcggctttacgtgtttcttccgcgatcatagctatcaagaggaggctgccatggaacttaaagtagaggatccgttctattgggtctcccccggcgtgctagtgctgctggcggtgcttccagttctgctcctccagatcactttgggtctggtatttctctgcctgcagtatcgtctgcgcggcaagctgagggccgaaattgagaacctacaccggactttcgatcctcactttcttcgggtgccctgctggaagattacgttgtttgtgatcgtccctgtgctggggccactcgtagctctgatcatctgttacaattggctgcatcgcaggctggctggccagttcctggaggagttgcgtaaattttctagtctctgttataaacaaaggattaaatctcaggagcgggaaacagaggcaactcgaggccggggagggttgctgcgcgatcatatccctagagggaaagaggagctcgagagtctggggggagggaagactccacctggaagatag

SEQ ID NO: 195909 - DNA, 690 bp, Artificial Sequence
  Description of Artificial Sequence: Synthetic coding sequence
atggccagcctgagccggcccagcctgcccagctgcctgtgcagcttcctgctgctgctcctgctgcaggtctctagctcctacgctggccagttccgcgttatcggaccacgccacccaatccgcgcactagttggcgacgaagtggaactgccttgcagaataagccctggcaagaacgccacaggtatggaggtcggctggtatcgacctccttttagcagagtcgtgcatctgtacagaaatgggaaagaccaagatggcgatcaggcccccgagtacagaggtcgcactgagctgctcaaggacgcgattggcgagggcaaagtgactctaaggattaggaatgttaggttttccgacgaaggcgggtttacttgtttcttccgggaccattcatatcaggaagaggcagcgatggaactaaaagttgaagatcctttctactgggtatcccctggcgtactcgtcctgctcgcagtcttgcccgtgctactgttacagatcactgttggtctggtctttttatgcctccagtatcggctgagaggaaagctacgcgccgagattgaaaatctacataggaccttcgagtcttttggagtgttagggcctcaggtaaaagaacccaagaagaccggccaatttctcgaagagctgctgttccacctggaggccctgtcgggctag

SEQ ID NO: 195910 - DNA, 396 bp, Artificial Sequence
  Description of Artificial Sequence: Synthetic coding sequence
atggccagcctgagccggcccagcctgcccagctgcctgtgcagcttcctgctgcttcttctgttgcaggtcagttcttcatacgctgaccccttttattgggtgtctccaggggtgcttgtgctgctggcagtcctcccagtgctgctgctccagatcaccgtgggcctggtctttctgtgtctgcagtatcgcctgagaggaaagttgcgagcagagattgagaatctgcaccgcacctttgatcctcactttttgagagtgccatgctggaaaatcactctattcgtgattgtgcctgttctgggacctctggtggcactcattatttgctacaactggctccaccgaagactcgcaggccagttcctcgaggagctgcggaacccattctag

SEQ ID NO: 195911 - DNA, 540 bp, Artificial Sequence
  Description of Artificial Sequence: Synthetic coding sequence
tgacagttccgggtgatcggcccccggcaccccatccgggccctggtgggagatgaggtggaactgccttgtagaatcagtcccggcaagaacgccacagggatggaagtgggatggtataggccacctttctccagggtcgtccatctttatcgcaacggaaaggatcaggacggcgatcaggctcccgagtatcgcgggcgcacagaactcctcaaggacgctattggcgagggtaaggtcacgctgcgcatcagaaatgtcagattctctgatgagggtggttttacctgcttctttcgagaccacagttatcaggaagaagctgctatggagctcaaggtagaggacccattctactgggtctcaccgggtgtcctggtgctgctggcagtgttacccgtactgctactgcagattacccttggtttagtgttcctgtgcttacagtacagacttagaggcaagctgagggccgaaatcgagaacctccatcgaacattcggacagtttctggaagagctgcgcaaccctttctag

SEQ ID NO: 195912 - DNA, 627 bp, Artificial Sequence
  Description of Artificial Sequence: Synthetic coding sequence
atggccagcctgagccggcccagcctgcccagctgcctgtgcagctttcttctgctgttactactgcaggttagctcttcctacgctggtcagtttagagttatcggtcctcggcatcctatcagagccctggtaggcgacgaggtggaactcccatgcaggatcagtccagggaaaaatgccactggaatggaggtgggctggtacaggcccccgttctcccgcgttgtacatctgtatagaaatgggaaggatcaggacggcgatcaggcccctgaatacaggggtcgtacagagctgttgaaagacgccatcggggagggaaaggttaccctccgcatacggaacgtgcgtttttctgatgaaggggggttcacctgcttctttcgcgaccatagctaccaagaagaagctgcaatggaactgaaggttgaggatccattctattgggtctcccccggagtgctggtcctgcttgccgtgctgcccgtcctgcttctccagatcaccgtaggactcatctttctgtgcttacagtaccggctgcggggcaagcttagagccgaaatagagaatctgcacagaactttcggccagttcctcgaggagctcaggaatcctttctag

SEQ ID NO: 195913 - DNA, 744 bp, Artificial Sequence
  Description of Artificial Sequence: Synthetic coding sequence
atggccagcctgagccggcccagcctgcccagctgcctgtgcagcttcctgcttttactcttgcttcaggtatcctcgtcatatgccggtcagtttagagtgatcggtccacgccatccaatccgcgctttagtgggcgatgaagtcgaactgccctgtagaatatctcccggcaagaacgccactggaatggaggtcggctggtaccgcccacctttctctcgggttgtccatctctatcgtaacggcaaagatcaggatggcgaccaggcgccagaatatcgaggacgaacagaattgcttaaggacgccatcggagagggtaaagtgactctgcgcatacggaacgtgagattctctgatgaaggggggttcacgtgtttctttcgagaccattcttatcaggaggaagcagccatggagctcaaggtggaggatccattctactgggtgagccccggcgttctggtcctgctggctgtgctacccgtccttctcctacagatcacggtgggactggtgttcctgtgtctccagtataggctcagaggaaaattgagagccgaaatcgaaaacttacacaggacatttgacccacacttcctccgcgtgccttgttggaaaatcacactttttgtcatagttcctgtgctggggccactggttgcccttatcatctgttataattggctgcaccgccgtcttgccggtcagtttctggaggaactgaggaatccattttag

SEQ ID NO: 195914 - DNA, 396 bp, Artificial Sequence
  Description of Artificial Sequence: Synthetic coding sequence
atggccagcctgagccggcccagcctgcccagctgcctgtgcagcttccttctgctgctgctgctgcaggtgtcatctagttacgccgacccattctactgggtgagtccgggcgtgctcgttctgctggctgtgcttccggtcttgctgttacaaattacagtcggcctggtgttcttgtgtctccagtaccgtctgaggggaaagttacgggctgagatcgaaaacctacatcgaacattcgacccacacttcctaagggtaccatgttggaagataacactgtttgtcattgtgcctgtgctgggacccctagtggcgctcatcatttgttacaactggttacacagacggctggcagggcagttcctggaggaattgaggaatcccttttag

SEQ ID NO: 195915 - DNA, 642 bp, Artificial Sequence
  Description of Artificial Sequence: Synthetic coding sequence
atggccagcctgagccggcccagcctgcccagctgcctgtgcagcttccttctcctgctcttactgcaggtgagctcctcatatgcagggcagttccgggtcattggcccccgtcatcccattcgcgcccttgtgggcgacgaagtcgagctcccctgtagaatatcacctggcaagaatgccactggaatggaggtgggatggtacaggccacctttcagccgtgtcgtgcatctctataggaatggaaaagatcaggacggagatcaggcaccagaataccgaggtcgcaccgagttgctgaaggatgcgataggcgagggcaaagttactctacggatacgcaacgtgcgcttctcagacgagggtgggtttacttgtttttttcgagaccattcatatcaggaagaagcagctatggaactgaaggttgaagatcccttttactgggtcagccccggtgtgctggttcttctggcagtgctgcccgttctgctcctgcagatcacagtcggactcgtttttttgtgtctgcagtataggttgcgcggcaaattacgagcagagattgaaaatctgcacagaacttttggccaattcttagaggagctgctgtttcacctagaggctctgtccggatag

SEQ ID NO: 195916 - DNA, 615 bp, Artificial Sequence
  Description of Artificial Sequence: Synthetic coding sequence
agcctgagccggcccagcctgcccagctgcctgtgcagcttcctgctgctgctgcttctccaggtttcatcatcctacgctggccagtttcgcgttatcggcccccggcatcccatccgagctctggtcggggacgaggttgagctgccatgccgcatcagtccagggaagaacgcaacggggatggaggtgggttggtaccggcccccctttagtagagtggttcatctgtacaggaatggcaaggaccaagatggtgatcaggccccagagtacagaggtcggacagaactcctgaaggatgctatcggggaggggaaagtcacactgcgtatccggaatgtcagattttccgacgaggggggcttcacctgttttttcagggaccactcttaccaggaagaagctgctatggaactgaaggttgaggatccgttttattgggtgtccccaggcgtgctcgtcctgttggctgtgctgcctgtactcttactacagattacccttggcttggtctttctctgtctgcagtacaggctgcgcggcaaactccgagccgagatagaaaatttgcacagaacgtttgtgtttcatcttgaggccctgtcaggatag

SEQ ID NO: 195917 - DNA, 675 bp, Artificial Sequence
  Description of Artificial Sequence: Synthetic coding sequence
atggccagcctgagccggcccagcctgcccagctgcctgtgcagcttcctgcttttgttactccttcaggtctcaagttcctatgcgggacagtttagggttatcggcccccgacaccccattcgggcactcgttggcgatgaggtggagctgccatgccggatttcccctgggaaaaacgccactggaatggaggtggggtggtatcgcccccccttttctagagttgtgcacttgtatcgtaatgggaaggaccaagacggggaccaggcccccgaataccgggggagaactgaactgttgaaggatgctattggcgaaggaaaggtcacccttcgaatccgaaacgttcggttctcagacgaagggggattcacgtgctttttcagagaccattcctaccaagaggaggcagctatggagctgaaagtcgaagatcccttttactgggttagtcccggggttctggtcctgctggcagtactgcccgtcttgctgctgcagatcacagtaggactggtttttctttgtctgcagtacaggctgcggggaaaactgcgcgctgaaatagagaatctgcatagaactttcgaatccttcggggtactcggaccccaggtgaaagagcctaagaagacagggcaattcctcgaggaactgcggaatcctttctag

SEQ ID NO: 195918 - DNA, 690 bp, Artificial Sequence
  Description of Artificial Sequence: Synthetic coding sequence
atggccagcctgagccggcccagcctgcccagctgcctgtgcagctttctgctccttctcctccttcaggtgtcttcctcatacgcagggcagttcagggtcatcggaccccgccacccaatcagggccctggtaggagatgaggtggaacttccctgtaggatatctccagggaagaatgcaaccggaatggaagtaggctggtacaggcctcccttctcacgcgtggtccacctgtacagaaatggcaaggatcaagatggcgaccaggcccccgagtatcgagggagaacagagcttctgaaggatgcgatcggggaggggaaggtaaccctgcgaataaggaacgtcaggttctccgatgagggcggcttcacctgtttttttcgcgatcactcgtatcaggaggaggcagcaatggagctgaaggttgaagatcctttctattgggttagcccaggcgtgctggtgctgctggcagtgctccccgtcctgctattgcagatcaccgtcgggctcgtttttttatgcttgcagtatcgtttgcgtgggaaactgcgcgctgaaatcgagaacctgcatcgtacgtttgaaagcttcggggtgcttggcccacaagtcaaagaaccgaagaaaaccgggcagtttcttgaagaacttctttttcacttggaggcgctgagcggctag

SEQ ID NO: 195919 - DNA, 888 bp, Artificial Sequence
  Description of Artificial Sequence: Synthetic coding sequence
atggccagcctgagccggcccagcctgcccagctgcctgtgcagctttttgctgctgctgctgcttcaggtgtcatcttcttacgccggccagtttcgtgtgatcggtccgaggcatccgatacgggccctggtgggtgatgaggttgaactgccttgcagaatatctccaggcaaaaacgcgaccgggatggaagtgggatggtatcgtcctccttttagcagggtagtccatctttacaggaacggtaaagatcaagatggtgaccaggccccagagtaccgtgggcgtactgagctgctcaaagacgctatcggcgaaggcaaggtgaccctgcgcatcagaaacgtcaggtttagcgatgaaggaggttttacctgcttcttccgggaccacagctatcaggaagaggccgcaatggaattgaaggtggaagacccattttactgggtatccccgggagtacttgtgctgctggctgtgctcccagtactgttactgcagatcacggtcggactcgtgtttctctgcctgcagtacagacttcggggaaaactgcgtgccgagatcgaaaatctgcaccggacattcgatccccatttcctgcgggttccttgttggaaaattacactctttgtgattgtgccggtcctgggacccctggtagctttaattatctgttacaactggctgcataggaggttagctggtcagtttctggaggagctgcggaagttctcctcattgtgctataaacagaggattaagtctcaggaacgggagacagaagccacccgcggccgcggcggcttactgagggatcatatccctcgggggaaggaagaactggagtctctgggaggaggaaaaacccctccaggccgctag

SEQ ID NO: 195920 - DNA, 540 bp, Artificial Sequence
  Description of Artificial Sequence: Synthetic coding sequence
tgacagttccgggtgatcggcccccggcaccccatccgggccctggtaggggacgaagttgaactcccttgccgcatcagcccaggcaagaatgctaccgggatggaggtgggctggtacaggcctcctttcagccgcgtggtgcacctttatagaaatggaaaagatcaggacggcgaccaagctcccgaataccgtggaagaacagaactgctgaaggatgcgataggcgaagggaaggtcactttaaggatccgtaacgtccgcttcagtgacgagggaggattcacttgtttcttccgcgatcattcttaccaggaagaagcagcgatggagcttaaagtggaggaccccttttactgggtgtctcctggagtgctcgtcctgcttgccgtgctgccagtcctgctgctgcagatcactgtgggattagtcttcctgtgtttacagtatcggctgcgtggaaagctccgggcggaaatcgaaaatttgcaccggacttttggacagttcctcgaggagctccgaaatcccttttag

SEQ ID NO: 195921 - DNA, 642 bp, Artificial Sequence
  Description of Artificial Sequence: Synthetic coding sequence
atggccagcctgagccggcccagcctgcccagctgcctgtgcagctttttgctcttgctactgttgcaggttagttcttcatacgcgggacagttccgggtgatcgggcccagacatccaattcgagctcttgtaggagacgaggtggaacttccatgcaggatttcccctggaaaaaacgcaacagggatggaagtggggtggtataggcctccatttagtcgagtcgtgcacctctacagaaatggaaaagatcaggacggcgatcaggccccagagtatagaggcaggacagagctgttgaaagacgctatcggcgagggaaaagtcaccttacgcattcggaacgtgaggttcagcgatgaaggcggcttcacgtgtttttttcgagatcactcctaccaggaggaggccgcgatggagctcaaagtggaggatcccttttactgggtgtcccctggagtactcgtccttttggccgtacttcccgtgctccttctgcagattaccgtgggcctagtgtttctgtgtctgcagtaccggttgcggggaaagctgagagctgaaatcgaaaatctccacagaaccttcggccagttccttgaggagttgcttttccatcttgaagcgctttcaggctag

SEQ ID NO: 195922 - DNA, 759 bp, Artificial Sequence
  Description of Artificial Sequence: Synthetic coding sequence
atggccagcctgagccggcccagcctgcccagctgcctgtgcagctttttattgttactgcttctgcaggtatcctcctcatatgcgggccaatttagagtgatcgggccgagacaccctattagagccctggttggagacgaggtggagctgccttgccggatatcaccaggcaaaaacgccactggcatggaggtaggctggtatagaccacctttctcacgtgtggtgcacctgtatagaaatgggaaagaccaggatggagaccaggcccccgagtaccgtggtcgaactgagctcctgaaggacgctataggtgaaggaaaagtgaccctacgtatcaggaacgtcagattcagcgatgaaggaggtttcacttgtttttttcgcgaccacagctaccaggaagaggctgcgatggaactcaaggtcgaggaccccttctattgggtgagcccgggcgttttggttctcctagctgtattgcctgtgctgctgctgcagatcacagtaggtctggtttttctgtgcctccagtataggctccgagggaaacttagggccgaaatcgaaaatctgcacagaacttttgatccccactttctgagagtcccatgttggaagatcaccttgtttgttatcgtgcctgtcctaggaccgctggtggccctgatcatctgctacaattggctgcatagacgcctggcaggccagtttctcgaagagttgctctttcatctggaagcactctcaggctag

SEQ ID NO: 195923 - DNA, 642 bp, Artificial Sequence
  Description of Artificial Sequence: Synthetic coding sequence
atggccagcctgagccggcccagcctgcccagctgcctgtgcagcttcctgctgctgctactgctgcaggtctctagctcgtacgcgggacaatttcgtgtgattgggccacgacaccccattagagcccttgtgggggatgaggtggaactgccttgtaggatcagtcccggcaaaaacgcgaccggcatggaagttggatggtaccgacctcccttctcccgggtggtgcacctgtatcgaaacggtaaggaccaggacggtgaccaggcccctgaataccgtggcaggactgagcttctaaaggacgccattggcgaaggaaaggttaccctgcgaatcagaaatgtgagattctctgatgagggcggctttacatgtttttttagagaccactcttaccaggaagaggccgctatggagctcaaagtggaggaccctttttattgggtgtcccccggagtgctagtgctacttgccgtgctgccagtgctattgcttcagatcaccgttgggctagtgtttctctgcttgcaatataggctccggggcaagctcagagccgaaatcgaaaacctccaccgaacattcgggcagttcctggaagaactgctgtttcatcttgaagctctgagcggctag

SEQ ID NO: 195924 - DNA, 675 bp, Artificial Sequence
  Description of Artificial Sequence: Synthetic coding sequence
atggccagcctgagccggcccagcctgcccagctgcctgtgcagcttcctgctgctgctgctgcttcaagtgagtagctcatatgctgggcagtttagggtgattgggccccggcatccgatccgagccctcgtgggcgacgaggtggaactaccatgccgaatatctccgggaaagaatgctaccggaatggaggtgggttggtataggcccccgttcagtagagtcgtgcatctgtatagaaacggaaaagaccaggatggagaccaagcacctgagtaccgaggccgcacagagttactgaaggatgcaatcggagaaggtaaagtcaccctccgtattagaaatgtaagattctctgatgagggaggatttacctgcttttttagagatcactcctaccaggaggaggccgccatggagctgaaagtcgaagaccctttttactgggtcagccccggcgtactggtcttgctggctgttttgccagtactcttattacagattaccgtaggtctggtttttttatgtctgcagtataggttgaggggtaagctgagggccgagatcgagaatctccaccgaaccttcgaatccttcggggtgttggggccccaggtgaaggagccgaagaagactggccagttcctggaggaacttcggaaccccttttag

SEQ ID NO: 195925 - DNA, 615 bp, Artificial Sequence
  Description of Artificial Sequence: Synthetic coding sequence
agcctgagccggcccagcctgcccagctgcctgtgcagcttcctgctcttactcttgctccaagtcagcagctcttatgctggacaatttagggtcatcgggcccagacatcccatccgggcactggtcggagacgaggtagagctgccctgtaggatctctccaggtaagaatgccactggcatggaagttgggtggtatcggccaccgttcagtcgggtcgtgcacctatatcggaacggcaaggaccaggacggtgaccaagcacccgagtaccgaggacggactgagctcctcaaggacgctataggagaggggaaggttaccctgaggatcagaaatgtgcggttttccgatgaaggcgggttcacctgcttctttagggatcacagttaccaagaggaggctgcgatggagcttaaagtggaggatcctttctattgggtgtcgcctggcgtgctggtgctcctcgccgtattgccagtgctgctgctgcagatcaccgttgggttggtgttcctatgcttgcagtacagactccgggggaaattaagagctgaaatcgagaacctgcaccggacatttgtatttcatttggaggccttaagcggctag

SEQ ID NO: 195926 - DNA, 675 bp, Artificial Sequence
  Description of Artificial Sequence: Synthetic coding sequence
atggccagcctgagccggcccagcctgcccagctgcctgtgcagctttttactgttactgctgctgcaggtatcatcttcatacgctgggcagtttcgcgtcatcggtccacggcatccaattcgggcccttgtcggcgatgaggtggagttaccatgccgaatctcgccgggtaagaatgcgacagggatggaagtaggatggtaccggccaccattctcacgcgtggtccacctgtatcgaaatggaaaagaccaggatggtgaccaggcacccgagtataggggccgcacggagctgttaaaggacgccattggcgagggaaaggttactctgaggatccgaaacgtcagattttccgacgaaggcggattcacttgttttttcagagaccactcttaccaggaggaagccgctatggagctgaaagtcgaggatccattttactgggtgagcccgggagtgctagttctgcttgccgttttgcccgtgctgctgctgcagattacggtcgggctggtgtttctatgcctccagtaccggttgcggggtaaactgcgcgccgaaatagaaaatctgcaccgcacattcgagtcattcggggtgctgggcccgcaagtaaaggaaccaaagaagactggccaattcctggaggaactgcgtaaccctttctag

SEQ ID NO: 195927 - DNA, 759 bp, Artificial Sequence
  Description of Artificial Sequence: Synthetic coding sequence
atggccagcctgagccggcccagcctgcccagctgcctgtgcagcttcctgctcctgctgctgctgcaggtcagctcttcatatgcaggacagtttcgagtgatcggccctagacatcccatccgcgccctcgtgggggacgaagtggaactgccttgccgcatatcccccggaaaaaatgctaccggaatggaggtgggatggtatcggccaccattttcacgcgtggttcacttgtacaggaacggcaaagaccaggacggtgaccaggcccctgagtaccggggacggacggagctgctcaaagatgcgataggagaggggaaggtcacactgcgaatccggaatgtgagattcagtgatgagggagggtttacgtgctttttccgggatcacagctatcaggaagaggcggcaatggaactgaaagtggaggatcctttttactgggtgagcccaggtgtcttggtactcctagccgtgttgcctgtcctgctccttcagatcactgtagggttagtcttcctctgcttgcagtataggctcaggggcaaactaagagccgaaattgaaaacctacatagaaccttcgatccgcattttcttcgagtcccctgctggaagattacccttttcgttatcgtgcccgtgctgggccctctggttgcactgattatctgctataactggttgcacaggaggctggccgggcaattcctggaagaactcttgtttcacctagaggcactgtccggatag

SEQ ID NO: 195928 - DNA, 744 bp, Artificial Sequence
  Description of Artificial Sequence: Synthetic coding sequence
atggccagcctgagccggcccagcctgcccagctgcctgtgcagcttcttgttgctcctgctcctgcaggtgtcttccagttacgctgggcagttccgagttattggcccgcggcaccccatccgcgcactcgtcggagacgaagtggaattgccatgtcgaattagccccggcaaaaacgctaccggcatggaggttggatggtaccgcccacctttttctagggtggtccacctgtatcgaaacgggaaagatcaggacggtgaccaggcccccgagtatcgcggtagaaccgagctcctgaaagatgccatcggggagggcaaggtgacactgcgcatccgcaacgtgcgcttttcagacgaagggggcttcacatgcttcttccgcgaccactcctatcaagaagaggctgccatggaactcaaggtagaagaccctttttattgggtctcacccggagtgttggtgctgctggccgtgcttccagtgctgttgttgcaaatcacggtaggcctagtatttctgtgcctccagtaccgcttacgagggaaactacgggcggaaattgaaaacttgcataggacattcgatcctcatttcctgagagtgccctgctggaagataaccctttttgtcatcgttccagtgctcggacccctcgtggcactgattatttgttacaactggttgcacaggcgcctggcagggcaatttctggaggaactcaggaatccattctag

SEQ ID NO: 195929 - DNA, 615 bp, Artificial Sequence
  Description of Artificial Sequence: Synthetic coding sequence
agcctgagccggcccagcctgcccagctgcctgtgcagcttcctgcttttgctgctgctgcaggtgtcgagcagctacgcgggccagtttagggtgatagggccgaggcatcctattagggccttggtgggagacgaggtcgagctgccgtgtaggatttcacctggcaaaaatgcaacgggaatggaggtgggttggtaccgtccaccattcagccgagtagttcacctctatcgaaatggaaaggatcaggacggcgaccaggcccccgaatatagaggtcgtactgagctactgaaggacgctattggtgaggggaaagtcaccctcagaattaggaatgtgcgtttttctgacgagggcggatttacctgtttctttcgggaccacagctatcaggaagaggccgcaatggagctcaaagttgaagaccccttttattgggtgtcccccggggtcctagtgctacttgccgtgttgcctgtactgctcctgcagattactgtgggcttggtgttcctgtgcctgcagtaccgcctaaggggcaaattaagagcagagatcgaaaatttacaccgcaccttcgtattccatttagaggccctgagtggatag

SEQ ID NO: 195930 - DNA, 888 bp, Artificial Sequence
  Description of Artificial Sequence: Synthetic coding sequence
atggccagcctgagccggcccagcctgcccagctgcctgtgcagctttttattattgctgcttctccaagtctcctctagctatgctggacagttcagggtcattggcccccggcatcccatacgtgccctagtaggcgatgaagtcgagctcccttgcaggatctcccctggaaagaacgccaccggcatggaggtcggctggtaccgtccaccctttagtagggttgtccacttatacagaaatggaaaagaccaggatggcgaccaggcccccgaatacaggggccgcacagagctgctaaaagacgcaatcggtgaagggaaagtgaccctgagaatcagaaacgtgagattttctgatgagggtggatttacctgcttctttagggatcactcctaccaagaagaagccgcgatggaactgaaagtggaagatcctttttactgggtgagccccggagttctggtgctgcttgctgtcctgccagtgctcttactgcaaattacggtgggattggtgtttctgtgcctgcaataccggcttcggggtaagctccgtgccgagatcgagaacctacaccgcaccttcgacccccatttcctgagggtgccatgctggaaaattactcttttcgttatcgtaccggtactgggcccattagttgcccttataatctgttacaactggctgcaccggcgtctggccggtcaatttttggaagaattacggaaattctctagcctttgctacaaacagcgcatcaagtctcaggaacgcgagacggaggctacacgtggaaggggcggcctccttagagaccatatcccacgcggcaaggaggagctggagtctttggggggcggaaagactcccccaggaaggtag

SEQ ID NO: 195931 - DNA, 759 bp, Artificial Sequence
  Description of Artificial Sequence: Synthetic coding sequence
atggccagcctgagccggcccagcctgcccagctgcctgtgcagcttcctcttgctactacttctccaggtatcttcctcctatgccggccagtttcgagtgattgggccacggcatcccattcgcgccctggtgggggacgaagttgaactgccttgtagaattagcccaggaaaaaacgcgactgggatggaagtggggtggtaccggccacccttctccagagtcgtacatctgtaccggaatggtaaggaccaagacggagatcaggcacctgaatacagagggaggaccgaattactgaaggatgctattggagaaggcaaagtgactctgaggattaggaacgtccggttcagtgatgaggggggatttacttgcttcttccgagaccacagctaccaggaggaagcagccatggaactcaaagtagaagaccccttttattgggtgtctccaggcgtgctggtgttacttgcagtgttgccagtactcctcttgcaaatcacactgggcctcgtgtttctctgcctccaataccgactgcgtggtaagctccgagccgagattgaaaacttacacagaacttttgatccccacttcctgcgcgttccatgttggaaaatcaccctattcgttatcgtccctgtcctggggcctctggtagccctgattatttgttataattggctccataggcgtttggctggccagttcttagaggagctgttgtttcacctcgaggcactgtccgggtag

SEQ ID NO: 195932 - DNA, 540 bp, Artificial Sequence
  Description of Artificial Sequence: Synthetic coding sequence
tgacagttccgggtgatcggcccccggcaccccatccgggccctggtaggcgacgaagtggagttgccttgtcgcatctcacccggaaagaatgccacaggaatggaagttgggtggtatcgaccccccttttctcgggtcgtgcatctgtacaggaatggtaaggatcaggacggcgaccaggcacctgagtacaggggccgcacagagctcctcaaagacgccattggagaaggaaaggtcacgttgagaatcaggaacgtacggttttcggacgagggcggattcacctgcttctttcgcgaccactcttaccaggaggaagccgcaatggaactgaaagttgaagatcccttttattgggtatctcctggagtgctagtgctgctcgcagtactgccagttctccttctgcaaatcaccgtcggactggtatttttgtgcctgcagtaccggttacggggaaaactcagagctgaaattgaaaatctccaccgtacatttggacaattcctcgaagagttgaggaatcccttctag

SEQ ID NO: 195933 - DNA, 396 bp, Artificial Sequence
  Description of Artificial Sequence: Synthetic coding sequence
atggccagcctgagccggcccagcctgcccagctgcctgtgcagcttcctgctgctactgctgctccaggtgagctctagttatgccgatcctttctactgggtctctcccggtgtcctggtgttacttgccgtgctcccagttcttctactgcagattacagtaggtctggtgttcctatgtctgcagtataggctccgcggaaagcttcgcgccgaaatcgaaaacctgcatcgcaccttcgatcctcacttcttgcgagtaccctgctggaagattacccttttcgtgatcgtgcctgtgctcggccccttggtggcccttattatctgttacaactggctccaccgacggcttgccggacagttcctggaagaactgcgtaaccctttctag

SEQ ID NO: 195934 - DNA, 744 bp, Artificial Sequence
  Description of Artificial Sequence: Synthetic coding sequence
atggccagcctgagccggcccagcctgcccagctgcctgtgcagcttcttgctgctgctcctgttgcaggtttcttccagctatgccgggcagttccgggtgatcggtccccgacatccaatccgggcactggttggtgacgaggtcgaattgccttgtcggatctcccctgggaaaaacgcaactggaatggaggtgggatggtatagacctccctttagcagagtggtacacctctacagaaatgggaaagaccaggacggcgaccaggcccctgagtataggggaaggaccgaacttctgaaagacgccatcggcgaaggaaaggtaactttgcgaatcagaaacgttcggtttagcgacgaaggaggctttacttgtttttttagggatcacagttaccaggaagaggccgctatggaactcaaggtggaagatccattttattgggtctctcccggcgtgctcgtgttattagctgtgctgccggtgctcctccttcagattaccctcggtttagtttttctatgcctacagtaccgtcttaggggaaagctccgcgccgagatagaaaacctccacaggaccttcgatcctcactttctcagagttccgtgctggaagatcactcttttcgtgatcgtccctgtgctcgggccccttgttgccctgatcatctgctacaattggctgcaccggcgcctggctggtcaattccttgaggagctgcgaaatccattttag

SEQ ID NO: 195935 - DNA, 642 bp, Artificial Sequence
  Description of Artificial Sequence: Synthetic coding sequence
atggccagcctgagccggcccagcctgcccagctgcctgtgcagctttttattgctcctgctgctgcaagtgtcaagcagctatgccggacagttccgagtcatcggcccccggcatccgatcagagcactggtaggcgatgaggtcgaactgccatgtcggatttcccctggcaagaacgcaacagggatggaggtgggttggtatagacctcccttttccagggtggttcatctctaccgtaacggaaaggaccaggacggggatcaggcccccgaatatcgaggtaggactgaactgttgaaagatgccataggagaagggaaggttaccctgaggatccggaatgtgcgcttttccgatgaaggaggcttcacttgcttctttcgtgatcacagctaccaggaggaggctgcaatggagctcaaggtggaagacccattttattgggtgtcccccggcgtgctggtgctgctcgcggtgctgccagttttattgcttcagataacgctgggcttggtgttcctgtgcctccagtaccgactgcggggtaagctccgcgccgagatcgaaaatcttcaccgcactttcggtcaattcctggaagaactgctttttcacctcgaggcccttagtggctag

SEQ ID NO: 195936 - DNA, 615 bp, Artificial Sequence
  Description of Artificial Sequence: Synthetic coding sequence
agcctgagccggcccagcctgcccagctgcctgtgcagcttcctgctgttgctactgttgcaagtatcgagtagttatgccgggcagttcagggttattggcccgcggcatcccatacgggcccttgtcggggatgaggtcgagttgccatgtagaatttcgccaggaaagaacgccacagggatggaagttggctggtatcgcccccccttcagccgagtggttcacctttaccgtaacggaaaagaccaagatggcgatcaagcccctgaatatcgcggaagaacagaactcctcaaggatgcaatcggcgagggtaaggtcacactgcgaatccgtaatgtgcgcttctctgacgaaggtggattcacctgcttcttccgagatcatagttatcaggaggaggcagccatggagctgaaagttgaagaccccttttactgggtgagccccggagtgctggtgttgctggccgtgctgccagtcctgcttctccagattacagtcggcctggtttttctctgcttgcaataccggctccggggcaagctgcgcgccgaaattgagaatctccatagaactttcgttttccatctagaggccctctctgggtag

SEQ ID NO: 195937 - DNA, 690 bp, Artificial Sequence
  Description of Artificial Sequence: Synthetic coding sequence
atggccagcctgagccggcccagcctgcccagctgcctgtgcagcttcctgctgctcttattactgcaagtgtcgtcttcttacgccgggcagttcagagtgatcgggccccgtcaccccatcagggccctggtcggcgacgaggtggaattaccatgtcggatctctccaggcaaaaacgctaccggaatggaggtggggtggtatcggccgccatttagccgcgtagtacatctgtatagaaatggcaaagatcaggatggggaccaggctccggagtaccgcgggcgcaccgaactactgaaagacgccatcggcgaaggaaaggttactttgagaatcagaaacgtgaggttctcagacgaaggggggttcacctgcttttttcgcgaccactcctaccaggaagaagctgccatggagcttaaagtggaggaccccttctactgggtgtccccaggagttttagtcttgctggcggttctccctgtcttgcttctgcagatcacagtcggccttgtttttttgtgcctccagtaccgcctgagaggcaaactgcgggccgaaatcgagaatctgcacaggacgtttgagagttttggcgtcttaggtccacaggtaaaggaacctaagaagaccggccagttccttgaggagctgttgttccatttggaagccttaagcggctag

SEQ ID NO: 195938 - DNA, 615 bp, Artificial Sequence
  Description of Artificial Sequence: Synthetic coding sequence
agcctgagccggcccagcctgcccagctgcctgtgcagcttcctgctgctgctcctgctccaggtctccagctcgtacgcaggccagtttagagttattggccccaggcaccctatcagagcactggtgggggacgaggtggagctgccgtgtcgcatcagtcctggaaaaaacgccacaggtatggaggtagggtggtacagacccccttttagccgggtagtgcatctttacaggaacgggaaagatcaggatggtgaccaggcacctgagtaccgagggaggaccgagctccttaaagatgccattggagaggggaaggtgactctgcggattcgcaacgtgcgattttccgatgaggggggtttcacatgtttttttagagaccatagctatcaagaggaggctgccatggagctgaaagtcgaagatccattttactgggtaagtcctggagtactggtgctcctggccgtactgccggtgttactgctgcagattacagtgggcctagtgttcctgtgcttgcaataccgactgcgggggaaactgcgcgctgagattgagaacttacacaggacttttgtgttccacctagaggctctgtcaggatag

SEQ ID NO: 195939 - DNA, 690 bp, Artificial Sequence
  Description of Artificial Sequence: Synthetic coding sequence
atggccagcctgagccggcccagcctgcccagctgcctgtgcagctttctcttgctgctcctgctgcaggttagttccagttacgccggtcaattccgcgtgatcgggccccggcacccaatccgggctctagtcggggacgaggtggagctgccttgccgcatcagtccaggaaagaacgctactggaatggaagtgggttggtaccgaccgcctttcagtcgggtggttcatctttatagaaacggaaaggaccaggatggggaccaagcgccagaataccggggccggacagagctcctcaaggatgccatcggcgagggcaaagtgactctgcgcatcaggaacgtccggttttctgatgagggcggcttcacatgctttttccgcgaccactcgtaccaggaagaggccgcaatggaactgaaagtggaggaccccttttactgggttagtccaggagtgcttgtgctattggccgtgctgccagtcctcttactgcagataacactgggactcgttttcctgtgtttacaatatagacttagaggtaaactccgagccgaaattgaaaacttacataggacctttgaatcttttggagtactcggcccacaggtcaaggaacctaagaagacaggccaattcctggaggagctgctatttcaccttgaggctctgagtggctag

SEQ ID NO: 195940 - DNA, 690 bp, Artificial Sequence
  Description of Artificial Sequence: Synthetic coding sequence
atggccagcctgagccggcccagcctgcccagctgcctgtgcagcttcttattattgttactacttcaagtgagctccagttatgctggccagttccgcgtcatcggtccaaggcatcctattagagccctcgtaggagatgaggttgagctgccctgtcgcatctctccagggaaaaacgccacggggatggaggttggctggtatcggccaccattctctagagtggtgcacctgtacagaaatgggaaggatcaggatggcgaccaggcccctgaatacagaggccggaccgagcttctgaaggacgccattggagagggtaaagtgactctccggataagaaacgtacgattctctgatgaaggaggtttcacctgcttttttcgcgatcattcctatcaagaagaggcagctatggagctcaaggtcgaagatcccttctattgggtcagcccgggagttctggtactcctcgctgtgctccccgttttactgttacagatcactgtggggctaatttttctctgcctacagtatcggcttaggggaaagctacgcgccgagatcgagaacctgcacagaacatttgaatctttcggcgtacttgggcctcaggtaaaagaaccaaagaagacaggtcaatttcttgaggagttgttgtttcaccttgaagctcttagtggatag

SEQ ID NO: 195941 - DNA, 516 bp, Artificial Sequence
  Description of Artificial Sequence: Synthetic coding sequence
atggccagcctgagccggcccagcctgcccagctgcctgtgcagctttcttctccttctgcttctgcaagtgtctagtagctacgccggccagttcagggtaatcgggcctcggcaccctatccgagccctagtcggggacgaggtagaactcccatgccgcatttctcccgggaagaatgccactggtatggaggtggggtggtacaggcctcccttctctagagtagtgcacttgtacaggaacggaaaggatcaagacggagatcaggctcccgaatatcgtgggcgaacagagttgctgaaggatgccattggcgagggtaaggttacactgcgaataagaaacgtgcgtttctctgatgagggagggttcacctgctttttccgtgaccactcatatcaggaagaggccgctatggagctcaaggtcgaggtttcccattccgttacacaggattggttacaatggcacgatcacggttcccttcagcctccgcccccaagattgaagtag

SEQ ID NO: 195942 - DNA, 534 bp, Artificial Sequence
  Description of Artificial Sequence: Synthetic coding sequence
atgagccacatcagctgggaggagcggtaccggaacggcaaggaccaagacggggaccaggctccggaatataggggtcgtacagaactgcttaaggacgccatcggagagggaaaggtgacactgcgcatcaggaacgttaggttctctgacgagggcggattcacctgctttttcagagaccattcctaccaggaagaggcagcaatggagctcaaggtggaggatcccttttattgggtcagcccaggagtgctcgtccttctcgctgtgctaccggtgctgctcctccagattactgtaggtctggtcttcctgtgccttcagtaccggctgcgtggaaagctccgggccgagatagaaaatctgcatcggacattcgacccccattttttgcgagtgccttgctggaaaatcaccctgtttgtgattgtgccagtcctcggtcctttagttgctttgattatttgctacaattggttgcacagaagactggcgggccaattcctcgaggagctgcggaaccctttttag

SEQ ID NO: 195943 - DNA, 174 bp, Artificial Sequence
  Description of Artificial Sequence: Synthetic coding sequence
atggccagcctgagccggcccagcctgcccagctgcctgtgcagcttcctgctactgttgttactgcaagtatcgtcctcttatgccgggctggttgcagtggctcgtagctggctcatcgcggcttccactagccaggctcaagtaattctcctgacgcagcccctcgagtag

SEQ ID NO: 195944 - DNA, 627 bp, Artificial Sequence
  Description of Artificial Sequence: Synthetic coding sequence
atggccagcctgagccggcccagcctgcccagctgcctgtgcagcttcctcctgctgttgctcctacaggtcagcagtagctacgcaggacaattccgtgtgataggacctcggcaccccatcagggctctagttggtgacgaggtggagctgccatgcaggatcagcccgggaaaaaacgccacaggaatggaagtagggtggtaccgaccccctttctcaagagtcgtccatttataccgaaatggaaaggaccaggacggcgatcaggctcctgaataccgggggcggactgagttgctcaaagacgctattggagaaggcaaggtgacactgcgtattaggaacgttcggttcagtgacgaagggggcttcacctgttttttcagagatcattcctatcaagaggaagctgcaatggagttgaaggtggaggacccattttattgggtctcgcctggggtgttggttctactggccgtactgcccgtcctgttgttacaaatcactgttggtttagtgttcctgtgtctgcaatatcgcctgcgcggtaaactgcgcgctgaaatagagaacctgcatagaacatttgggcagttcctggaggagctgcggaatcctttttag

SEQ ID NO: 195945 - DNA, 516 bp, Artificial Sequence
  Description of Artificial Sequence: Synthetic coding sequence
atggccagcctgagccggcccagcctgcccagctgcctgtgcagcttcctccttctgctgctgttgcaagtcagcagttcctacgctggacagtttcgtgttataggtcccagacatccaataagagctctggtgggggatgaagtcgaactgccatgtaggatttcacctgggaagaacgctacgggcatggaagttggatggtaccggccacccttctcgcgggtggtgcacctgtatcgcaacggcaaagaccaagatggggatcaagccccagaatacaggggccggaccgaactgctgaaagacgcaatcggcgaaggtaaggtgaccttaaggatccgaaacgtgcggtttagcgacgaaggcggctttacatgctttttccgcgatcactcataccaagaagaggccgctatggagctcaaggtcgaggtcagtcattccgtcacccaggactggcttcagtggcacgatcatgggagtctacagccccctcccccaaggctcaagtag

SEQ ID NO: 195946 - DNA, 516 bp, Artificial Sequence
  Description of Artificial Sequence: Synthetic coding sequence
atggccagcctgagccggcccagcctgcccagctgcctgtgcagctttctactcctcctgctgctgcaggtcagttcgtcatacgctggccagtttagggtgataggccctcgacaccccattcgcgcactggtgggcgacgaggtggaattaccatgcaggatctcccccgggaagaacgctacggggatggaagtggggtggtacagaccccctttttctagggtcgtgcatctgtatcgaaatggcaaagatcaggatggagatcaggcgcccgaatacagagggagaactgagctcctgaaagatgcaatcggcgaaggaaaggtgaccctccgtattaggaacgttcggttttccgatgagggggggtttacatgttttttcagagaccattcgtaccaagaagaggccgccatggaactaaaggtagaggtcagccattccgtcacacaggactggctgcagtggcatgatcatggttctctccagcctccccctcctcgcctcaagtag

SEQ ID NO: 195947 - DNA, 621 bp, Artificial Sequence
  Description of Artificial Sequence: Synthetic coding sequence
atggccagcctgagccggcccagcctgcccagctgcctgtgcagctttctgttgctgttactgctgcaggttagctcttcctacgccggacagttccgagtgatcggccccagacatccaatccgggccctcgtgggggatgaagtggaactcccttgcagaatctcccctgggaagaacgctaccggcatggaggtgggttggtaccgcccccccttttcccgcgtggtgcacctgtaccggaacggcaaggaccaggatggggatcaggccccagagtaccgcggtaggactgaattgctgaaggacgccatcggagagggcaaggttacactgcgtattcgcaatgtacgcttttcagacgagggggggttcacttgcttttttcgcgatcacagctatcaggaggaggcagccatggaattaaaggttgaagaccccttctactgggtgagtcctggggttttggttctgctggcagttttaccagtgcttctcctgcagattacagtggggctggtatttctgtgtctgcagtaccgtctacgcggtaagttgagggccgagatcgagaacctgcataggacattcgtgtttcacctcgaagcactgagcggctag

SEQ ID NO: 195948 - DNA, 627 bp, Artificial Sequence
  Description of Artificial Sequence: Synthetic coding sequence
atggccagcctgagccggcccagcctgcccagctgcctgtgcagcttcttgctcttactgctccttcaggtgtcctctagttacgctggtcagtttcgggtcattgggcctagacaccccatacgggcccttgtaggggacgaggtcgaactgccgtgtaggatttctcctggtaaaaacgcgaccggcatggaagtcggctggtatcggccaccatttagcagagttgttcatctgtatcgaaatggaaaagaccaggacggggaccaagccccagagtacaggggacgcacagagctgttaaaagacgcaattggcgaaggcaaggtcaccctccgcatccggaatgtgagattttcggacgaaggtggattcacctgcttctttcgagatcactcctatcaggaggaagcggccatggagctgaaagtcgaagatcccttttactgggtgagtccgggggtattggtcttacttgctgtgttaccagtgctccttcttcagattacggtgggcctggtgttcctttgcctgcagtacaggctccggggaaagctccgcgccgagattgaaaacctgcacagaaccttcggacagtttttggaagaactcaggaacccattctag

SEQ ID NO: 195949 - DNA, 621 bp, Artificial Sequence
  Description of Artificial Sequence: Synthetic coding sequence
atggccagcctgagccggcccagcctgcccagctgcctgtgcagcttcctgctgttgctgctgctccaggtcagttcctcctacgccgggcagtttcgggttattggtcctaggcacccaatcagagctttggtgggtgatgaggtggaactgccttgtcggatctcccctggaaaaaatgccaccggaatggaggtgggctggtatagaccccctttctcacgggttgttcacctttacagaaacgggaaggaccaggacggagatcaggctcccgaataccgagggaggaccgagttgctcaaagacgctataggggaaggaaaggtgactctcagaatcagaaacgttaggttcagcgacgagggaggattcacctgttttttcagggaccacagctaccaggaagaggccgccatggagctcaaggtcgaggatcctttttattgggttagtcccggtgtcttggtcctcctggccgtcctccctgttctgctgttacaaataacagtgggactggtctttctgtgcctgcagtacaggctgcgcggtaaattgagagccgaaatagagaatctccacagaacctttgtgtttcatctggaagctctttccggctag

SEQ ID NO: 195950 - DNA, 534 bp, Artificial Sequence
  Description of Artificial Sequence: Synthetic coding sequence
atgagccacatcagctgggaggagcggtaccggaacggcaaggaccaggatggagatcaagctcccgagtatagggggcggaccgagctgctgaaggacgctattggggagggaaaggtcaccctgaggattcgcaatgtgcggttctccgatgaagggggctttacctgcttcttcagggaccattcctaccaggaggaagctgccatggagctgaaagtggaagaccccttctattgggtgtcccctggtgtgttggtcctcctggcggtactccctgtgttactgctgcagatcaccgtagggctcgtgtttctttgcctccagtaccgccttcgagggaagctacgtgccgaaattgagaatttacaccgtacatttgatccgcacttcctgagagtgccatgttggaagattacactcttcgtgatcgtgcctgttctgggcccgttggtagcgcttataatctgttacaattggttgcatagacgtctggccgggcaatttctagaggagcttagaaatccattctag

SEQ ID NO: 195951 - DNA, 621 bp, Artificial Sequence
  Description of Artificial Sequence: Synthetic coding sequence
atggccagcctgagccggcccagcctgcccagctgcctgtgcagcttcttgctgctgctgttactgcaggtcagttcttcttacgccgggcagtttagagtgatcggacccagacaccctatacgggctctggtgggagatgaggtcgagctgccctgtagaatttctccaggaaagaatgccaccgggatggaggttgggtggtatcggcctcctttttctagagtggtccacctataccggaatggcaaagaccaagacggagatcaagcgccggaatatcggggacgaacagagcttctgaaggatgctatcggcgagggcaaggttaccctgagaattcgaaatgttcggttctcagacgaggggggctttacttgtttcttccgcgaccacagctatcaggaggaggcggccatggagctaaaggtcgaggatcctttctattgggtatcccctggagtcctggtgctgcttgccgtgctacccgttctgctactgcaaattaccgttggtcttgtctttttgtgcctgcaataccggcttagaggaaaactgcgggctgaaatcgagaacctgcacagaacctttgtattccatctggaggctctcagcggatag

SEQ ID NO: 195952 - DNA, 621 bp, Artificial Sequence
  Description of Artificial Sequence: Synthetic coding sequence
atggccagcctgagccggcccagcctgcccagctgcctgtgcagcttcctgttgctcctgctgttacaggttagctccagttatgctggtcaatttagggtgatcggtccccgccatccaatacgcgctctggttggtgacgaagttgagctgccttgccggatttcgccaggcaagaatgccaccggaatggaggtgggatggtaccgacccccttttagcagggtagtgcatctttatcggaatgggaaggaccaagacggcgaccaagcgcctgagtataggggaaggacggaactgctgaaagacgccatcggcgagggaaaagtcactctaagaatccggaacgtgcggtttagcgacgagggcgggtttacgtgctttttcagggatcatagctaccaggaggaggccgcaatggagctgaaggttgaggacccattctactgggtgtcccccggggtcctggtcttattggccgttcttcctgtgttgctactacagattacggtcggtttagtatttctgtgcctgcaatacaggctgcggggtaagttgagagccgagattgagaacctgcaccgaacctttgtcttccaccttgaggccctgagtggttag

SEQ ID NO: 195953 - DNA, 534 bp, Artificial Sequence
  Description of Artificial Sequence: Synthetic coding sequence
atgagccacatcagctgggaggagcggtaccggaacggcaaggaccaagacggtgatcaggctcccgaatatcgtgggagaactgaactgctcaaagacgccattggggaaggaaaagtgaccttgcgaattcgcaacgtgcggttctccgacgagggagggttcacatgcttcttccgcgatcacagttaccaggaggaagctgcaatggagttaaaagtagaagatcctttttactgggtgagccctggggtgttggtgctgctcgctgtactgcccgttcttctcctccagattactgtggggctggtctttctgtgcttgcaatacagactgagagggaagctgcgcgcagagatcgaaaacttgcaccgtacgttcgatccccactttcttcgggtcccttgttggaagatcacgctcttcgtgattgtgccagtcctcggacccttggttgcgctgatcatctgttataattggctgcacagacgcctcgccggtcagttcctggaggagctgcgtaatccattttag

SEQ ID NO: 195954 - DNA, 621 bp, Artificial Sequence
  Description of Artificial Sequence: Synthetic coding sequence
atggccagcctgagccggcccagcctgcccagctgcctgtgcagctttctactgttactcttgctacaggtgtcctcatcatacgctgggcagttccgtgttatcggaccccgacatccaattcgcgccctggtcggggatgaagtcgagctcccatgccggatttcgcccgggaagaatgcaactggaatggaggtgggttggtaccggccccccttttcaagagtggtccacctgtacagaaatggcaaagaccaggacggtgaccaggcccccgagtatagaggtagaacagagcttctgaaggatgccataggtgaaggcaaagttacattgcggataagaaacgttcgcttcagtgacgagggaggctttacctgcttctttagagatcacagttaccaagaggaggctgccatggaactgaaggtcgaggacccgttctactgggtgtcaccaggcgtgctggtgctcttggccgttctcccagtgttgttgctgcagataacagtgggccttgttttcctttgtcttcaataccggctccggggcaaactgcgcgcggaaatcgagaacttgcatagaacctttgtgtttcacctggaggccctgtctgggtag

SEQ ID NO: 195955 - DNA, 174 bp, Artificial Sequence
  Description of Artificial Sequence: Synthetic coding sequence
atggccagcctgagccggcccagcctgcccagctgcctgtgcagctttctgttactcctgctgctacaggtttcatcttcttacgcggggctggtggccgtggctagaagctggttgattgcagcatctacgtcccaggcccaggtcattctcctcacccagccactggagtag

SEQ ID NO: 195956 - DNA, 621 bp, Artificial Sequence
  Description of Artificial Sequence: Synthetic coding sequence
atggccagcctgagccggcccagcctgcccagctgcctgtgcagcttcctcctgttgctgttgctccaagtcagtagttcatatgcaggtcagtttagggtgattgggccgcgtcatccgatccgagctctggtgggtgacgaagtcgagttaccttgcagaatttcccccgggaagaacgctacagggatggaggtgggatggtaccgcccacctttctcccgggttgtccacctttaccggaatggtaaggatcaggacggcgatcaggccccagaatacagaggacgaaccgagctcttaaaagatgcgatcggcgagggaaaggtgaccttgcggatcaggaatgtgagattctccgatgaaggcggcttcacctgttttttcagggaccacagttatcaggaggaggctgccatggagctgaaggttgaagacccgttttattgggtatctccaggcgtgctggtgctgctggccgttttgcccgtgctgctgctgcagatcacagtcggactagttttcctgtgcctgcagtatcggctacggggtaaactcagagccgagatcgaaaacttacataggaccttcgtcttccacttggaagccctttcagggtag

SEQ ID NO: 195957 - DNA, 516 bp, Artificial Sequence
  Description of Artificial Sequence: Synthetic coding sequence
atggccagcctgagccggcccagcctgcccagctgcctgtgcagcttcttgctgctgcttctgcttcaggtgtcttccagttacgccggccagtttagagttattggacctagacacccaatcagggcacttgtgggggatgaagttgaactaccgtgtcggatttctccaggaaaaaacgcaacaggcatggaggttgggtggtaccgacccccattctccagagtcgtgcatctgtaccggaacggaaaggatcaggatggggatcaggctccagagtatcgaggcaggaccgaactacttaaagatgcgatcggagagggaaaagttaccctcagaattagaaatgttcgctttagtgacgagggtggcttcacctgtttttttcgggaccattcctatcaagaagaggcggcaatggagctaaaggtggaagtgtcacattctgtgacccaagactggttgcaatggcacgaccacgggtctctccagcctccccctccccggctgaaatag

SEQ ID NO: 195958 - DNA, 621 bp, Artificial Sequence
  Description of Artificial Sequence: Synthetic coding sequence
atggccagcctgagccggcccagcctgcccagctgcctgtgcagctttctgctgctcctgctgttgcaggtgagctccagttatgcggggcaatttcgagttataggacccagacacccaatcagggctctcgtgggagatgaggtagagcttccctgcagaataagccctggaaaaaacgccacaggtatggaggtgggatggtataggccccccttctcccgggttgtgcatctatatcgaaacggcaaggaccaggacggggatcaagcccctgagtaccggggccggaccgaacttctgaaggacgctataggtgaaggcaaggttactctgcgcattcgcaatgtccgctttagcgatgaaggcgggttcacttgcttcttccgagatcacagttatcaggaagaagcggccatggagctaaaagttgaagaccctttttattgggtctctcctggagtcctggttctgctggccgtccttcctgtgttgctgttgcagattaccctaggcttagtgttcctgtgtcttcaatacaggctgcggggtaaattaagggcagaaatcgagaacctgcacaggacgtttgtgttccatcttgaggccctgagcgggtag

SEQ ID NO: 195959 - DNA, 516 bp, Artificial Sequence
  Description of Artificial Sequence: Synthetic coding sequence
atggccagcctgagccggcccagcctgcccagctgcctgtgcagctttctcctgctgctactccttcaggtgtcgagtagctacgcgggtcaattcagggtcatcggccctcggcatcctatccgtgccctagtcggagatgaagtcgagctgccctgtcgcatctctccaggcaaaaacgccaccgggatggaagttggatggtacagacctccgttctctcgggttgtacacctatatcgcaatggcaaggatcaggacggcgaccaagcaccggagtaccggggaagaactgagctgttaaaggatgctattggagagggaaaagtcactctgaggattcggaatgtgaggttttccgatgaggggggattcacttgttttttcagggaccactcataccaggaggaggcagccatggagctgaaggtggaggtatcccactccgtgacgcaggattggcttcagtggcatgatcatgggtcactccaacctccaccaccaagattgaaatag

SEQ ID NO: 195960 - DNA, 516 bp, Artificial Sequence
  Description of Artificial Sequence: Synthetic coding sequence
atggccagcctgagccggcccagcctgcccagctgcctgtgcagctttctccttctgttattgctgcaagtctcatctagctatgcaggccagtttcgagtgatcgggccgcgccatcccatccgggccctcgttggtgacgaagtggagctgccgtgccgcattagccctggaaaaaatgctaccggcatggaggtcggttggtaccgtcctccgtttagcagagtagttcacctatatcggaatggcaaagatcaggacggggatcaggctccagaatataggggaagaaccgagttgcttaaggatgccatcggtgaaggcaaggtgacgcttaggatccgaaatgtacggttcagtgacgaaggagggtttacctgcttcttcagggaccactcataccaagaagaagccgcgatggaactgaaggtcgaagtctcccactctgtgacacaggactggctacagtggcatgatcatggcagcttacagcccccgcctccccggctgaagtag

SEQ ID NO: 195961 - DNA, 627 bp, Artificial Sequence
  Description of Artificial Sequence: Synthetic coding sequence
atggccagcctgagccggcccagcctgcccagctgcctgtgcagctttctgcttctgttacttctgcaggtaagcagttcctacgcgggccaattccgcgtcatagggcctcgacaccctatccgggcactggtgggcgacgaagtcgagctaccttgtcgtatttctcctggcaagaatgccacaggcatggaagttggatggtaccgcccaccattctccagagtcgtgcacctgtacagaaatggtaaggaccaggatggagatcaggcgccagaatatagaggccgcacggagctgctgaaagatgcgatcggcgaggggaaagtgactttacgtatcagaaacgtgcggttttctgatgagggcgggtttacatgtttcttccgcgaccacagttatcaggaagaggcagcaatggagcttaaggttgaggaccccttctattgggtgtcacctggggttctggtgctcctggccgtgctgccggtgctgctgctgcagatcacagtcggtttggtgtttttgtgccttcagtatcgcctgcggggcaagctccgggccgaaattgagaatcttcaccggacatttggtcagtttctagaagagttacggaaccctttctag

SEQ ID NO: 195962 - DNA, 174 bp, Artificial Sequence
  Description of Artificial Sequence: Synthetic coding sequence
atggccagcctgagccggcccagcctgcccagctgcctgtgcagctttctgctgcttctgctgttacaagtaagttccagttatgcagggcttgtggccgtggcaaggagctggctcatcgctgcatccacaagccaagcccaggttattctcttgacacagcctctggaatag

SEQ ID NO: 195963 - DNA, 627 bp, Artificial Sequence
  Description of Artificial Sequence: Synthetic coding sequence
atggccagcctgagccggcccagcctgcccagctgcctgtgcagcttccttctgctgctccttctgcaggtgagttcatcctacgcaggacagtttcgggttatcggaccacgacacccaatacgggctttagtaggtgatgaagtggagcttccctgtaggatctcgccgggtaaaaacgcaaccggaatggaggtggggtggtatcgaccccccttttctagagttgtgcatctctatcggaatggtaaagatcaggacggtgatcaagcgcctgagtatcgaggtcgcacggagctcttaaaggatgcaataggtgaaggaaaggtgacgttgagaattagaaatgtccgattcagcgatgaggggggcttcacttgcttcttcagggatcacagctaccaggaggaggccgctatggaactcaaggtagaggatccgttttattgggtctcccccggcgtcctcgtgttactagccgtgcttcctgtgctgctgttgcaaatcactgtgggcctggtctttctgtgcctgcaataccgcctgcggggaaaactgagggctgaaattgaaaacttgcaccgtacctttgggcaattcctggaggagctgcgtaaccccttctag

SEQ ID NO: 195964 - DNA, 174 bp, Artificial Sequence
  Description of Artificial Sequence: Synthetic coding sequence
atggccagcctgagccggcccagcctgcccagctgcctgtgcagcttcctgttgctgctgctccttcaggtgtcgagctcatacgcaggattagttgctgtcgcacggagctggttgattgccgcctcaacgtctcaggcccaggtaatccttttgacccaacctcttgaatag

SEQ ID NO: 195965 - DNA, 534 bp, Artificial Sequence
  Description of Artificial Sequence: Synthetic coding sequence
atgagccacatcagctgggaggagcggtaccggaacggcaaggaccaggacggtgatcaggctcctgaatataggggccgcactgaactcctgaaggacgccataggagagggcaaggtgactctcagaatccggaacgtacggttttctgatgaaggcggatttacgtgtttcttcagggaccactcttaccaagaagaggcagccatggagttgaaagtcgaggatcctttttactgggtgagcccaggggtgctggtccttttagcagtgctacccgtgctcctgcttcaaatcactgttggactagtcttcttgtgtctccagtataggctgagaggcaagctccgggcggaaatcgaaaacctccacaggacgttcgacccccatttcctccgggtaccgtgttggaaaatcacgctctttgtcatcgtgcctgtccttggcccactcgttgcccttattatctgctacaattggcttcaccgcagattggcaggccagtttttggaggagctgaggaatccattttag

SEQ ID NO: 195966 - DNA, 516 bp, Artificial Sequence
  Description of Artificial Sequence: Synthetic coding sequence
atggccagcctgagccggcccagcctgcccagctgcctgtgcagcttcctgctgctgctgttgctgcaagtctcttcgtcgtacgccggacaatttcgggttatcggaccccgccaccccattcgggccctggtgggagacgaggtcgagctcccctgcaggatttccccagggaagaacgctactggcatggaggtgggatggtatagaccaccatttagccgggtggtgcatttatatcgcaatggcaaagatcaggacggtgaccaagccccagagtacagaggtcgaacagaacttctgaaggatgccatcggcgagggcaaggttactctgcgtataagaaatgttcggttctctgatgaaggcggcttcacttgcttttttcgagaccattcctatcaagaagaagcagctatggaattgaaggtggaggtgtcccactctgtgacccaggactggctgcagtggcatgatcacgggagtctgcaaccacccccccctaggctcaagtag

SEQ ID NO: 195967 - DNA, 534 bp, Artificial Sequence
  Description of Artificial Sequence: Synthetic coding sequence
atgagccacatcagctgggaggagcggtaccggaacggcaaggaccaagacggagaccaggcacccgaatatcgtggaagaacagagctgcttaaagatgcaatcggggagggaaaagtgactctgcgcatcagaaatgtacgattcagcgatgagggaggatttacttgttttttcagggaccacagctaccaggaggaggcggccatggagctcaaggtggaagaccctttctattgggtatctcccggtgtgctcgttctgctggccgtattgcctgttctcctgctgcagataacactgggattggttttcctttgtctacagtatcggctaagaggaaaattacgggcagaaattgaaaacctgcatcggacctttgacccccacttcttacgtgttccttgttggaagatcaccctctttgtgattgtccctgtcctggggcccctggttgcactgattatctgctacaattggctgcaccggaggttagctggccagttcctggaggaactccgtaatccattctag

SEQ ID NO: 195968 - DNA, 627 bp, Artificial Sequence
  Description of Artificial Sequence: Synthetic coding sequence
atggccagcctgagccggcccagcctgcccagctgcctgtgcagcttcttgttactcctgcttctccaggtttcttcatcctacgccggccagttcagggttattggaccaagacaccccatccgggccttggtgggggatgaggtggaactgccttgccgcatctctccaggcaaaaacgcaaccggaatggaagtggggtggtacagaccccccttctctcgggtcgttcacctgtatcgtaacggaaaagatcaggatggcgaccaggcgcctgagtatcgcggaagaacagaattgctgaaagacgctatcggtgaagggaaggtgaccctgcggatcagaaatgtccggtttagtgacgagggaggctttacatgtttttttagagaccatagttatcaggaagaagcagccatggaactaaaggtggaggatcctttttactgggtgtcacccggtgttcttgtcctgctcgcggtgctgcctgtcctgctgttacagattaccgtaggcctggtcttcctctgtttgcagtatagacttcggggaaaattgcgggccgagattgaaaatcttcaccgaacttttgggcagtttcttgaagagctccgcaatccattctag

SEQ ID NO: 195969 - DNA, 174 bp, Artificial Sequence
  Description of Artificial Sequence: Synthetic coding sequence
atggccagcctgagccggcccagcctgcccagctgcctgtgcagcttccttctgttgcttctgttgcaagtatcgtcatcctacgcgggccttgtcgccgttgccagatcttggctgatcgccgctagtaccagtcaggcacaggtgattctgctgacccagccgttagaatag

SEQ ID NO: 195970 - DNA, 174 bp, Artificial Sequence
  Description of Artificial Sequence: Synthetic coding sequence
atggccagcctgagccggcccagcctgcccagctgcctgtgcagctttctgctcctgttgcttctgcaggtgtcaagttcttatgctggtctggtggctgtcgcccgctcgtggttaatcgctgcctcaacttcccaggctcaggttattctactcacacagcctctcgagtag

SEQ ID NO: 195971 - DNA, 534 bp, Artificial Sequence
  Description of Artificial Sequence: Synthetic coding sequence
atgagccacatcagctgggaggagcggtaccggaacggcaaggaccaagacggggaccaggcaccagaatatcggggcaggacggaactgctgaaggacgctatcggtgaggggaaggtaaccctgcgcatcagaaacgtcagatttagcgacgaggggggatttacatgcttctttcgagatcactcatatcaagaggaagctgccatggaactgaaggtggaagatcccttctactgggtcagccccggagtgcttgtgctgttggcggtgctccccgtgttactccttcagatcaccgtcggactggtgtttttgtgcctgcagtacaggctgcgaggtaaattgagggccgaaattgaaaaccttcatcggacctttgacccccacttcctacgggtgccctgctggaagatcacactattcgtgatcgtgcctgtgcttggtcccctcgtggctctgataatctgctacaactggctgcatcggaggttggccggccagttcctggaggagctgagaaacccattctag

SEQ ID NO: 195972 - DNA, 516 bp, Artificial Sequence
  Description of Artificial Sequence: Synthetic coding sequence
atggccagcctgagccggcccagcctgcccagctgcctgtgcagcttccttcttttgctccttttacaagtttcttcaagctacgctggacaattcagagttattgggccccggcacccaattcgggcactagtcggggacgaggtagagctcccttgccgtatttctcctggcaagaacgcaacaggcatggaagttggatggtatcggccaccgttctccagggtcgtacacttgtacagaaatggcaaggaccaggacggcgaccaggccccagaatatcggggccgaacggaactcctaaaagacgctattggcgaggggaaagtcactctacgtatcaggaacgttcgcttcagcgatgaaggagggttcacgtgctttttcagggatcactcataccaggaggaggcagccatggagctcaaggtggaagtgagccatagcgtgactcaggattggctgcagtggcatgaccatgggagcctacagccgccccccccaaggttgaagtag

SEQ ID NO: 195973 - DNA, 534 bp, Artificial Sequence
  Description of Artificial Sequence: Synthetic coding sequence
atgagccacatcagctgggaggagcggtaccggaacggcaaggaccaggacggggatcaggcgcccgagtacagggggaggaccgagctgctcaaggacgcaatcggggaaggcaaggtcaccttgcggattcggaatgttcggttcagtgatgaggggggatttacatgtttcttccgcgaccactcatatcaggaagaagcagccatggaactgaaggtcgaagaccctttctactgggtgagtccaggtgtgttggttctcctcgccgtccttccagttttgcttttgcagattacagtgggtctggtttttctgtgtctgcaataccggctgaggggaaagctcagggccgaaattgagaatctccaccgcacatttgaccctcacttcctgcgtgtgccctgctggaaaattacactgttcgtgattgtccctgttctgggtccattagtcgccctaattatatgttacaactggctgcacaggcgcctcgccgggcaattcttagaggagctgcggaaccccttctag

SEQ ID NO: 195974 - DNA, 174 bp, Artificial Sequence
  Description of Artificial Sequence: Synthetic coding sequence
atggccagcctgagccggcccagcctgcccagctgcctgtgcagcttcttactgctgctgctcctccaggtcagctcttcttatgcaggcctcgtcgcggttgcccggtcttggttgatcgccgcatctacatcacaggcgcaggtaatcctgttgactcagcctctggaatag

SEQ ID NO: 195975 - DNA, 627 bp, Artificial Sequence
  Description of Artificial Sequence: Synthetic coding sequence
atggccagcctgagccggcccagcctgcccagctgcctgtgcagctttctgttactgctattgttgcaggtcagcagtagctatgccggccagtttagggtcataggccccagacaccccattcgagcactggtcggcgacgaggttgagcttccgtgccgcattagcccgggtaagaacgctacaggcatggaggttgggtggtatcgacccccgtttagtagggttgtccatctttaccgcaatggaaaggaccaggacggagaccaggcccctgagtatagagggagaaccgaactgctaaaggacgcaataggggaaggcaaagtgactctccgcataaggaatgtgaggttctccgacgaaggggggttcacttgcttcttcagggaccatagttaccaggaggaagccgccatggagctgaaagtggaggatccgttctattgggtatcacctggggtgctcgtcctacttgctgttctgccggtcttgctcctgcagatcacagtgggattggtcttcctctgtctacagtaccggctccgggggaagctgcgtgcagaaatagagaacctgcacagaacttttggacaatttctggaagaactgcggaacccattctag

SEQ ID NO: 195976 - DNA, 327 bp, Artificial Sequence
  Description of Artificial Sequence: Synthetic coding sequence
atggccagcctgagccggcccagcctgcccagctgcctgtgcagctttctgctgcttctattactgcaggtgagcagcagctacgctgacccattctattgggtgtcacctggcgtgctcgtgctccttgcagtcttgccagttctcctgctacaaatcaccgttggtcttatttttctctgtctgcagtatcggctgcgtgggaaacttcgggccgagatcgaaaatctgcatcggacattcgaaagctttggtgtgctgggtccacaagtcaaggagccaaagaaaacaggccagttcctggaagagctccgtaaccctttctag

SEQ ID NO: 195977 - DNA, 753 bp, Artificial Sequence
  Description of Artificial Sequence: Synthetic coding sequence
atggcccccggcgcccccagcagcagccccagccccatcctggccgtgttgctgtttagttcacttgtgctgtctccagcccaggccatagtagtatacacagatcgcgaggttcatggcgctgtgggctctagggtaacactgcactgctctttctggtctagtgaatgggtgtctgacgacatttcttttacatggaggtatcagccagaaggcggccgggatgccatttcaatttttcattatgcaaaggggcagccatacattgacgaagtcggcacattcaaggagaggattcaatgggtaggtgaccctagatggaaggacgggtccatcgttatccataatctggactatagtgacaatggaaccttcacctgcgacgtgaaaaatcctcctgatatcgtgggtaagacaagccaagtcacactgtacgtgtttgaaaaagttccaacccgatatggcgtcgtactgggcgctgttattggaggagtgctcggcgtcgtgctgctcctccttttgcttttctatgtggtgagatattgctggctcaggaggcaggcggcccttcaacgaagactgtccgcaatggagaaaggtaagctgcacaagcctggcaaggatgccagcaagcgcggacgccagacccctgtgttataccagtgctggactaccgccgaggcccccaaactgagcgtccggaggcgacctcgagggtggggaagcctggctcgcatacggaacagcggatag

SEQ ID NO: 195978 - DNA, 777 bp, Artificial Sequence
  Description of Artificial Sequence: Synthetic coding sequence
atgctgcgggcccccgcccccgcccccgccatggcccccggcgccccttcttcctccccatctcccattctggctgtactcttgttctcatccctggtcttgtcgcccgcccaggccattgtagtatataccgaccgagaagtgcatggcgccgtagggtcccgagtcacgctgcactgcagcttttggagctccgagtgggttagtgacgacatcagtttcacttggaggtaccaacccgagggcggcagagacgctatcagtatctttcactatgctaaggggcaaccctacatcgatgaagtgggtactttcaaggaacgaatccaatgggttggggaccccaggtggaaggacggctcgatcgttattcataatctggactattcagacaacggcacttttacgtgtgacgtcaagaacccacctgacatcgtcggcaagacctctcaggtcaccctatacgtgtttgaaaaagtacctacacggtacggggtcgtcctgggcgcggtgattgggggggtgctcggggtggtgctcctgctcctgttactgttctacgtggtgcgatactgttggctacgcaggcaagccgctctccagaggagactttcagccatggagaaaggtaaactccataaacccggcaaagatgcctccaagagaggacgtcagacccccgttttgtatgccatgcttgaccatagtagatctaccaaggcagtgtctgagaaaaaggcaaagggactgggtgaatcccggaaagataaaaaatag

SEQ ID NO: 195979 - DNA, 747 bp, Artificial Sequence
  Description of Artificial Sequence: Synthetic coding sequence
atggcccccggcgcccccagcagcagccccagccccatcctggccgttctactgttctcctctttggtgttgagccccgcccaagctatcgtggtatacaccgacagggaagtacatggcgcagtagggtcaagggttacactgcactgctccttctggtcatccgaatgggtatcggacgacatttccttcacctggaggtaccagcccgagggggggagagacgcgatctctatcttccattatgctaaaggccaaccttatatcgacgaagtgggcaccttcaaggaacggatccaatgggtgggggaccctcgctggaaggacggctctattgtgatacacaatctcgactacagcgacaacggtactttcacctgcgatgtgaagaaccctccggatatcgtggggaagacctctcaggtgactctatatgtgttcgaaaaggtgcccactcgctatggagtggttctgggggcagttatagggggggttctcggagtcgttcttctgctgctactgctgttttatgtggtacgctattgttggctgagacggcaggctgctttgcagaggcgcctatctgcaatggagaaaggaaagctgcacaaacctggcaaagacgcttctaagagaggtcggcaaactcctgtactgtacgcaatgctcgaccacagtcggagcacaaaagctgtcagtgaaaagaaggccaaaggattgggagagtcccgcaaggataagaagtag

SEQ ID NO: 195980 - DNA, 747 bp, Artificial Sequence
  Description of Artificial Sequence: Synthetic coding sequence
atggcccccggcgcccccagcagcagccccagccccatcctggccgtcctgttgttcagttccctagtactctctcccgcacaggccatcgtggtttacacagacagagaagtgcacggcgcggtcggctctagagtgacactacattgctccttctggagttccgagtgggttagcgacgatatctccttcacctggcggtaccaaccagagggcgggcgtgacgcaatctctattttccactatgccaagggtcagccatacatagacgaggtgggaacttttaaggagcggatccagtgggtgggggaccccaggtggaaggatggttctatcgtgatccacaacctcgactattccgataacggcactttcacatgcgacgttaagaacccccccgacattgttggaaaaacatcacaggtgacactgtacgtattcgagaaggtgcccacccgttacggcgtagtgttgggagccgtaatcggaggcgttctgggagtcgtgctgctcctcctgctgcttttctacgtagtgcggtattgttggttgcgacgccaggccgcgctacaacgtcgcctgtccgcgatggaaaaggggaaactccataagcctggcaaggatgccagtaagagaggacggcagactcccgtgctgtacgcaatgctggatcactcccgctccactaaagctgtgtccgaaaaaaaagctaaaggtttaggagaaagcagaaaggataagaaatag

SEQ ID NO: 195981 - DNA, 648 bp, Artificial Sequence
  Description of Artificial Sequence: Synthetic coding sequence
atgtacggcaagagcagcacccgggccgtgctgctgctgctgggcatccagctcactgcgctttggcctattgcagcggtcgaaatctacacatccagggtcctcgaggctgttaacggaactgacgccagactgaagtgtacattctcctctttcgcacctgtgggtgacgcccttacagtgacttggaatttcagacctcttgatggtggacctgaacagttcgtattctattaccacatagacccattccagccaatgagtggacggtttaaagacagagtcagctgggacggaaatcctgagcggtacgatgcctctattctactgtggaaactacagtttgacgataatggcacttatacgtgtcaggttaaaaatcctccggatgtggatggtgtgatcggcgaaatcaggctgtcagtggtccataccgtccgtttctccgagatccacttcctggccctggccattggatctgcttgcgccctcatgataattatcgttatagttgtggttctgtttcagcattacagaaagaaacggtgggcagaacgcgctcacaaagttgttgaaataaagtccaaggaagaggaacgcttgaaccaggaaaagaaagtttctgtctacctcgaggacaccgactag

SEQ ID NO: 195982 - DNA, 648 bp, Artificial Sequence
  Description of Artificial Sequence: Synthetic coding sequence
atgtacggcaagagcagcacccgggccgtgctgctgctgctgggcattcagctaacagctctatggcccatagccgcagtggagatctatacaagcagagtcctcgaggccgttaacgggaccgacgcgcgcctcaaatgtacttttagttcatttgctccagtgggcgacgccctgactgtcacctggaatttcagacctcttgacgggggcccagaacagtttgtgttttattatcatattgatccattccagcctatgtccggaagattcaaggaccgagtgagttgggacggaaatccagagagatatgacgcctccatcttgctctggaaactgcagttcgatgataacggtacctatacctgccaggtcaaaaacccccccgatgtggacggggtgattggggagatccgactgagcgtggtacatactgtaaggtttagtgagatccactttctcgctcttgctatcggctctgcttgcgccctgatgatcattattgttatcgttgtggtgctctttcagcactatcgcaagaagaggtgggctgaacgcgcccataaagtagttgagatcaagagcaaggaggaggagcggctgaatcaagagaagaaagtgagcgtatatctggaagacaccgactag

SEQ ID NO: 195983 - DNA, 708 bp, Artificial Sequence
  Description of Artificial Sequence: Synthetic coding sequence
atgcagcagcggggcgccgccggcagccggggctgcgccctgttccccttactcggtgtactgttttttcagggcgtctacattgttttctctctggaaatcagagccgatgcgcacgttcgtggttatgttggggaaaagataaaactcaaatgcacattcaagagcacctccgacgtgacagataagctgaccatagactggacctacagaccgccctcatcctcacataccgtctcaatcttccactaccagtccttccaatatcctacaacagcaggaacattcagggacaggatcagctgggtcgggaacgtctataagggggatgcctctatttctatctcaaatcccacaattaaggataatggaactttcagttgtgcggttaaaaatccgcccgacgttcaccataacattccaatgactgaacttacagtcacagaacgcgggtttggaacgatgctgagcagcgtggccctgctgtccatcctggtgttcgtgccatccgccgtcgttgtagctctgctcttagtgaggatgggacggaaggcggctggccttaagaagaggtctaggtcaggttataaaaagtcctcgattgaggtgtcggatgacaccgaccaagaggaggaggaagcctgtatggcaagattatgtgtccgctgtgccgaatgcctggattctgactatgaagagacctactag

SEQ ID NO: 195984 - DNA, 672 bp, Artificial Sequence
  Description of Artificial Sequence: Synthetic coding sequence
atgcagcagcggggcgccgccggcagccggggctgcgccctgttccccttactgggcgtgttgtttttccaggacgctcatgtgagaggctacgtgggggaaaagataaagctgaaatgtacgttcaaaagcacctcagatgttaccgataagctgactattgattggacctacagacctccttcttcctcccatacggtcagcatttttcattatcaaagcttccagtaccctactacggcaggcaccttcagggaccgcattagttgggtgggaaacgtgtataagggtgacgcatcaattagtatctcaaatccgaccatcaaggacaatggcaccttctcatgtgcagtgaaaaaccctcctgatgtgcaccataatatccctatgacagagctcactgttaccgagagaggcttcggcaccatgctatctagtgtggcgctcctgtccattcttgtgttcgtgccttccgctgttgtggtggctttgctgctggtgcgcatggggcggaaggcggctggcctgaagaaacgttcccgatcaggctataaaaagtcctccatagaggtttcggatgataccgatcaggaggaggaggaggcctgtatggctcgtctgtgtgtgcggtgcgccgaatgcctggatagtgattatgaggagacctactag

SEQ ID NO: 195985 - DNA, 3366 bp, Artificial Sequence
  Description of Artificial Sequence: Synthetic coding sequence
atgagcctggagaacgaggacaagcgggcccggacccggagcaaggctctgcgcggcccaccggagacaacagctgcggacctttcgtgccccactcctggatgcaccggctccggtcatgtgcgcggcaaatacagcaggcaccggtctttacagtcatgcccactggcaaagaaaaggaaactggagggagccgaggccgagcatctcgtcagtaaacggaagagccatcctctgaagctggctctggatgaagggtatggcgtcgactcagatggtagcgaggacacagaggtgaaagatgccagcgtcagtgacgaatcagaaggcactctagagggcgccgaggctgagacgtctgggcaagacgaaatccacagacctgagacagctgagggacgcagccccgttaaatcccatttcggttccaacccgatagggtcggctacagccagctccaagggttcttattctagttatcagggaattatcgcaacatcactcctgaacctggggcagattgctgaggagacgctggtggaagaggaccttggtcaggccgctaaaccaggacctggcatcgtacacctgctgcaggaagcagctgaaggggctgcctcagaagaaggcgagaaggggctctttatccagccagaggatgccgaggaggtcgttgaggtgactacagaaaggtcccaagacctctgtccccaatcactggaggacgctgcctcagaggaatcatcgaagcagaagggaatactttcacacgaggaggaggacgaagaagaggaggaagaggaggaggaagaagaagaagatgaggaagaggaagaagaggaagaagaggaagaggaagaggaggaggaggaagaagaggaagaggaggaagaggaggaggaggaagaggaagaagaggccgcccccgacgtaatctttcaggaggacacctcacacacatccgctcagaaggcgccagaattacgcggtccagagtcaccgtctcctaagcctgagtacagcgtgatcgttgaggtgagatctgacgacgataaagatgaagacacccacagtcgcaagagtaccgtgacagacgagtccgagatgcaagacatgatgactagggggaacctgggcctcctagagcaggctatcgcattaaaggccgagcaagttagaaccgtctgcgagcccggctgccctcccgccgaacagagccagctgggtctaggtgagccaggcaaggctgctaagcccctggacaccgtgcggaaatcctattattccaaggacccatcacgcgccgagaaaagagagataaagtgccctacacctggttgcgacggcacagggcacgttactggcctttatccacatcatcgctctcttagcggatgtccgcacaaggatcggatcccccctgagattctagcaatgcacgaaaacgtcttgaagtgccctacccctggttgcaccggacaagggcacgtaaactcaaatagaaatactcatcggtccctctccggctgccctatagcagctgcagagaaattagccaagagccacgagaagcagcaaccacaaactggcgatccatcaaaatcctcaagcaattccgacagaatcctacggcctatgtgtttcgtcaaacagttggaggttcccccttatggatcatacaggcctaacgtcgcgccggccactcccagagcaaatcttgccaaggagctcgaaaagttctctaaagtgaccttcgactacgctagttttgatgcgcaggtgttcggtaagcggatgctcgccccgaagattcaaacgtcagaaacttcgcccaaggcatttcagtgcttcgattatagtcaagatgccgaagccgctcacatggctgctactgccattctcaacctatcaacacgatgttgggaaatgcctgaaaacctcagcactaaacctcaggacctcccgtccaaaagtgttgatatcgaagttgacgagaacgggacactggatctcagtatgcacaaacaccgcaagcgagagaatgcttttccgtcgtccagctcctgttcctcatcaccgggcgtgaagtcacctgacgcatcacagcggcacagcagcacctcggcaccctcatcatccatgactagtccccagtcaagccaggcttcacgacaagacgaatgggacagaccactcgactataccaaaccttctaggctgcgcgaggaggagcccgaagaaagtgaacccgccgctcactcttttgccagtagcgaggcagatgaccaagaggtgtccgaggagaatttcgaagagagaaagtaccctggagaggtgacgctgactaatttcaaactcaagttcttgagcaaagacattaaaaaggaactcctcacctgtcccaccccagggtgtgatggttctgggcacatcacgggtaactatgcttcacataggagcctttctggctgtcctctggcggataagtctctgcggaatttaatggcagcgcactcagccgacctgaagtgccctacaccaggctgtgacgggagtgggcacatcactggcaattacgcctcacacaggtcactctccggctgtccgagggccaagaagagcggcgttaaggttgcaccgacgaaagatgacaaagaagaccccgagctgatgaaatgtcctgtaccagggtgtgtgggactgggacacataagtgggaagtatgcctcacataggtctgcctcgggatgtccactggctgcaagaagacagaaggaaggcagcctgaatggctcttccttttcttggaaatccctaaaaaacgagggccccacttgccctactcccggctgcgatggttcagggcacgctaacggatcctttttaacccaccgttccctgtccgggtgtccacgggctaccttcgccgggaagaagggtaaactgtcaggagacgaggttctgtcaccaaagttcaaaacatccgatgtgctggagaacgatgaagagattaagcaattaaatcaggagatccgggatctgaatgagtccaactccgaaatggaagccgccatggtgcaactacagtcccaaatatctagtatggagaagaacctgaagaatatcgaagaggagaacaagctgatcgaagaacaaaacgaagccctgttcctcgagttaagcgggctgagtcaggcactgatccagtccctcgccaacatccggctcccccacatggagcccatctgcgagcagaatttcgatgcctacgtgagtactttaaccgacatgtattccaatcaggaccctgagaataaggacctgctcgagtcaatcaaacaggctgttcggggaatccaagtctag

SEQ ID NO: 195986 - DNA, 1776 bp, Artificial Sequence
  Description of Artificial Sequence: Synthetic coding sequence
atgagcctggagaacgaggacaagcgggcccggacccggagcaaggccctgagagggccccctgaaacaacagccgcggacctctcttgcccaacaccaggatgtactggaagcggtcacgtgaggggaaagtacagtcgccaccggagcttgcagtcatgtcccctggcgaagaaacgtaaactggagggtgccgaagctgagcatctggtttcaaaaaggaagtcccacccactgaaacttgcactcgatgagggttacggtgtggattctgacggtagcgaggatactgaggtgaaggacgcgagcgtgtccgacgagtccgaaggaactttagagggcgcagaagcagaaacaagcggccaggatgagatccaccgccctgaaacagccgaggacccatcacgagctgaaaagagagagattaagtgccctacccctggctgcgatggtaccggacatgtcaccggactgtatccgcatcatcgctcactttccgggtgtccccacaaggacaggatcccgcctgagatcctcgctatgcatgagaacgtgctcaagtgtcctacccctggctgtacgggacagggacatgttaatagcaaccgaaacacccaccgcagcttgagtgggtgtcctatagcagccgcggaaaaactggctaagtctcatgagaaacaacagccccagaccggtgatccctcaaaaagctcctccaactctgatcggatactgaggcccatgtgcttcgtgaagcagctggaagtcccaccctatggcagttaccgccctaatgtggctcccgccacaccacgagctaatcttgccaaagagctggaaaagtttagtaaagtcacttttgactatgcctcttttgatgctcaggtattcggcaagaggatgctggccccaaagattcagactagcgagacaagtcccaaggcattccaatgcttcgactattcacaggatgccgaggctgcgcacatggccgcaaccgcaatcttgaacctgagcactcgctgctgggagatgcctgagaacctgtcaaccaaaccacaggatctgccaagcaagagcgtggacatcgaggttgatgaaaacgggacattggatttgtcaatgcacaagcaccggaaacgggagaacgcctttccgtcgtccagttcctgtagctcaagtcctggagttaaatctccagacgccagccagcgtcactccagcacaagtgcgccttctagcagtatgacgtcaccacaatctagccaggcatcccgacaggatgagtgggatcgccctctagactacaccaagccttctagactgagagaggaggagccggaggaatccgagccagctgcccactctttcgccagcagcgaagcagatgaccaagaggtgtctgaggagaattttgaggagaggaagtaccccggcgaagtgacactgactaattttaagttgaaattcctctcaaaggacattaagaaggaattgctcacatgcccgacaccggggtgtgacggcagcggccacattacagggaactatgcaagtcacagaaggtgtcctactcccggctgtgacggctctggccatatcacagggaactacgcttctcacagatctctgtccggctgccctcgcgccaagaagtcaggggtaaaggtagccccaaccaaggacgataaagaggatccggaactgatgaaatatgtggggccatgctggctttttcactgcatcgccgagctgagatttagctgtgtgctctag

SEQ ID NO: 195987 - DNA, 3447 bp, Artificial Sequence
  Description of Artificial Sequence: Synthetic coding sequence
atgagcctggagaacgaggacaagcgggcccggacccggagcaaggcgttgagaggacctccagaaaccacagcggcagatctatcctgcccgacacctggctgtaccggcagcgggcatgttcggggcaagtactcacgccacaggtcactgcaatcctgcccactggccaagaagcgcaagcttgaaggagcagaggccgaacatttggtgtctaagcggaagtctcatcctttgaaactcgccctcgatgagggatacggcgtggatagtgacgggtccgaagacaccgaggtcaaagacgcttctgtctcagacgaaagtgagggaacactcgaaggagctgaggcagaaacgtccggtcaagacgagatccataggcctgaaactgccgaaggccgctcgcctgtcaaatcacactttgggagtaatccaattggttcagctacggctagctctaagggcagttactcttcataccagggtattattgcgaccagtttgttgaacctgggtcagattgccgaagagacattagtcgaagaggatttaggccaggccgccaaaccaggtcctggcatcgttcacctcctgcaggaagcggctgaaggggctgcatccgaggaaggtgaaaagggactttttattcagccagaagatgccgaggaggtggtcgaagtgaccaccgaaaggtcccaagatctgtgcccgcagtccctcgaagacgcagcaagcgaagagtcgagtaaacagaaaggcatcctttcacacgaagaagaggacgaggaagaggaagaggaagaagaagaggaggaggaggatgaagaggaggaggaggaagaggaggaagaagaggaggaagaagaagaggaggaggaagaagaagaggaggaagaggaggaggaagaggaggaggaagcagcgcctgacgtgatatttcaggaagatacttcccacacctccgctcagaaggccccggaactgagggggccagagagtcctagccccaagccagaatattcagtgatcgtggaagtgaggtccgatgatgataaagacgaggatacgcacagcagaaagagtaccgtgaccgacgaaagcgaaatgcaggatatgatgactagggggaatctgggcctgttggagcaggcaattgcgttgaaagccgagcaagtgcggaccgtgtgcgagccgggatgtcccccggcagaacagagtcagctaggactgggcgaacctgggaaagcggccaagccacttgatactgtgaggaaatcttactactctaaggatccttcacgtgccgaaaaaagagaaataaaatgtccaactcccggttgcgatggcaccggacatgttactggtctctatccacatcatcgttccctgtcaggctgcccccacaaagatcggatccctcctgagatcctggcgatgcatgaaaatgtactgaagtgtcccacaccgggatgtacaggtcaaggccatgtaaattctaataggaacacacaccgatcactctctggttgtcccattgccgcggctgagaagctggcaaagtcacatgagaaacagcaacctcaaacaggagacccatcaaaatcttcatcaaacagtgatcgtattctgagaccaatgtgtttcgtcaagcagctggaagttcctccttacggctcatatagaccgaacgtggctcccgctacaccgcgggctaacctggcaaaggagttagagaagtttagcaaggtgactttcgactacgcaagttttgatgcccaggtctttggcaagagaatgctggctcccaagatccagacgagtgaaaccagtccaaaggcctttcaatccaagcccttcccaaaggcctccagcccccggcatagtcccagttcatcttatgtgaggagtacctcttcgtcgagtgcaggcttcgattactctcaggatgcagaagccgcacacatggctgcgactgccattcttaacctgtcaactcggtgctgggagatgccggagaatttgtcgacgaaaccacaagacctgccctctaagagtgtggatatcgaagtggatgaaaatgggacccttgatctctcgatgcataagcacagaaaacgcgagaacgcgtttccatcaagctccagctgttcctccagccctggggtgaagtccccagacgcctcgcagcgacatagttccacttccgccccctctagctcgatgaccagcccccagtcctcccaagcatccagacaggatgagtgggaccgccccctcgactacaccaagccaagccgccttagggaggaggaaccagaagagtcagaaccagccgcccacagtttcgcgtcctctgaagccgatgaccaggaagtgtccgaagagaatttcgaggaacggaagtaccccggcgaagttacattgacaaactttaagcttaagtttctgtcaaaggacatcaaaaaagagctccttacatgccctacgccaggctgcgacggttccggacacataactggcaattatgcctcacatcgttctctgagcgggtgtcctcttgccgataagtccctcaggaacctcatggcggcccactccgcagatcttaaatgccccacccctggatgcgatggatccggacatatcaccggtaattatgcatcccataggtcactgtcaggatgcccacgggctaagaagagcggcgtgaaagtagctcccacaaaggatgataaagaagatcccgagctgatgaagtgccccgtaccaggttgtgtggggctgggccacatttcagggaagtatgcctcgcaccgaagtgcctctggctgccctttggctgcccgaaggcagaaggagggctcactgaacggcagctcctttagctggaagagcctaaagaacgagggaccaacctgccctactcccggctgtgatggctcagggcatgcaaacggttcattcctgacccatagaagcctgtccggatgtcctagggcaacatttgccggcaagaaagggaagctgtctggggacgaggtactgagcccgaagtttaaaacctctgatgtgctcgagaatgacgaagagatcaagcagctcaaccaggagattcgagatctaaacgagagtaattctgagatggaagcggcaatggtccagctgcagtcccagatatcgtccatggagaaaaatctgaagaatatagaggaggaaaacaagctcattgaagagcagaacgaggccctgtttcttgaactttccggactcagccaggctcttattcagagccttgcaaacatcaggcttccacatatggagcccatctgtgaacagaacttcgatgcctacgtgtccaccctgactgatatgtatagtaaccaagatccggagaacaaggacttgctagaaagcattaagcaggctgttagaggcattcaggtttag

SEQ ID NO: 195988 - DNA, 3399 bp, Artificial Sequence
  Description of Artificial Sequence: Synthetic coding sequence
atggaggtggacaccgaggagaagcggcaccggacccggagcaagggggtacgggtccctgtggagcccgcaatacaggagttgttctcttgccctacgcccggctgtgatggttcgggtcacgtaagtggcaagtacgccagacatagatccgtgtacggttgtcccttagctaagaagagaaagacccaggacaagcaaccccaggagccagctcctaaaaggaaaccattcgcagtcaaggcagacagctcgtccgtggacgagtgcgacgattcagacggcactgaggatatggatgagaaggaggaagacgaggaggaagaggaggaggaagaagaagaaaacgaggatcatcaaatgaactgccataacactcggattatgcaagacactgaaaaggacgataataataatgatgaatacgataactacgatgaactggtcgccaagtctctgctcaaccttggcaagatcgccgaagacgctgcttatcgagctcggacagagtcagaaatgaactcaaatacttcaaacagtctggaggatgactccgacaagaatgaaaatctgggccggaagtcagagcttagcctcgatttggatagcgacgtggttagggaaaccgtagattctttgaaacttttggcgcagggacacggcgttgtgctctccgaaaatatgaatgaccggaactacgccgattctatgtcccaacaggacagccgtaatatgaattatgtcatgctgggcaaaccaatgaacaacggactcatggaaaaaatggttgaagaatcggacgaagaggtgtgtctgtctagtctggagtgtctgagaaaccagtgtttcgacctcgcaaggaaactcagcgagaccaaccctcaggagagaaatccgcagcagaacatgaatatcagacagcatgtaagaccagaggaggacttccctggaaggacaccagatcgtaattatagcgacatgcttaatctgatgcggctggaggagcagctgtcgccccggtcccgcgtgttcgcaagctgtgccaaagaagacggctgtcacgagcgtgatgacgacactacctctgttaatagtgacagatctgaagaagtattcgatatgactaagggcaatctaacgctgttggaaaaggccattgccctggagacagaaagggcaaaagccatgcgagagaaaatggccatggaggcagggaggcgtgataatatgcgttcgtatgaggaccagagtcctagacagctgcccggcgaggatcgaaaacccaaaagcagcgactcccacgttaagaaaccctattatgatcccagtaggaccgaaaagaaagagagtaaatgtcctacccctgggtgtgacggtactggtcacgtgaccggcttgtatcctcaccacagaagcctcagcgggtgtccccataaagatagagtgcctcccgaaatattagctatgcatgagtctgtgctaaagtgtcctaccccaggctgcaccgggcgcgggcatgtgaactccaacagaaactcacaccggagccttagcggctgcccgatcgccgctgctgagaagctcgctaaagctcaggaaaagcaccagtcctgcgatgtctcgaaatcctcccaggcctctgatagggttctgcggccaatgtgtttcgttaaacagctggagatcccgcagtatggatacagaaataatgtgccaacaaccacgccacggagtaacctggcgaaagaacttgagaagtactctaagacctccttcgagtataattcttatgataaccacacttatgggaaacgggccatcgccccaaaagtgcagactcgcgacataagtcctaagggctacgacgacgcgaaacgttattgtaaggatccatcgccttcttcttccagcacctcgagctacgcgcccagtagcagctcaaatctgtcttgcggggggggctcatctgcttcttcaacttgcagtaagagctccttcgactacactcatgatatggaggcagcgcatatggccgcaaccgccattttgaatctctcaacccgatgcagagaaatgccccagaatttaagtactaagccgcaggatctgtgcgccacccgcaaccctgatatggaagtcgatgagaatggtactctggacctgagcatgaataagcagcggccccgagacagctgctgccccattcttacgcccctcgaaccgatgtccccccagcagcaggccgtcatgaataatcggtgttttcagctgggcgaaggcgattgttgggacctgccagtggattacaccaagatgaaaccccggcgtatagatgaggatgagagcaaggatatcactcccgaagacctggacccctttcaggaagcactggaggagcggcgatacccaggtgaggtgacaatccctagtcccaagcccaagtatccacagtgtaaagagagtaaaaaggatcttatcaccctatcaggctgcccgctggccgacaaaagtattcgtagtatgctcgccacctcttcacaagagctgaagtgtccaactccgggatgcgacggttccggacatatcaccggaaattacgctagccatcggtccctgtcaggatgtcctcgcgccaagaaaagcgggatccggatcgcccagagtaaggaggataaggaggaccaggaaccaatcagatgtcctgttccagggtgcgatggccaggggcacatcaccggaaagtacgccagccaccgaagcgctagtggctgtccactggctgccaagcgccagaaggatggatacctcaacggcagccagttctcctggaaaagtgtgaagactgagggtatgtcatgcccgacacccgggtgcgatgggtctgggcatgtctctggatcattcctgacacacaggtccctgtcgggatgtccgcgagccaccagtgccatgaagaaggccaaactgtctggtgagcagatgcttacaatcaaacagagagcaagcaatggaatagaaaacgatgaggagattaaacagctagatgaagagatcaaggagctgaatgagtctaactcccagatggaagctgatatgatcaagttgaggacccagataacgacaatggagagcaacctgaagactatagaagaggagaacaaggtcatagagcaacaaaacgagtccctgctgcacgagctggccaacctgagccagagcctcatccacagtctcgccaatattcagttgccgcatatggatcctatcaacgagcagaactttgacgcctacgtcaccacgttaaccgaaatgtatacaaatcaggacagataccagagccccgaaaataaagccctgctcgagaatatcaagcaggcagtaagggggatacaggtctag

SEQ ID NO: 195989 - DNA, 3561 bp, Artificial Sequence
  Description of Artificial Sequence: Synthetic coding sequence
atggaggtggacaccgaggagaagcggcaccggacccggagcaagggagttagggtgcccgtcgagcctgcaattcaggagctattttcctgccctacccccggatgtgacggctctggccacgtgagcggaaaatacgctcgtcataggtctgtgtacggctgccccctggccaagaagcgcaaaacccaggataaacagccacaggagcctgcaccaaagcgcaagccctttgccgtgaaggctgatagtagctccgtcgacgaatgcgacgactccgatggtactgaagacatggacgagaaggaagaggatgagggagaggagtatagtgaagacaatgatgagccaggagatgaggacgaagaagacgaggagggcgatagagaagaggaggaggagatcgaagaggaagacgaagacgacgatgaggatggcgaagacgtggaggatgaggaggaggaggaggaagaggaagaagaagaggaggaggaagaggaaaatgaagaccaccagatgaactgccacaataccaggatcatgcaggacactgaaaaggatgataataataacgacgagtacgataactacgacgagcttgtcgcaaagtccctgttaaatttgggtaaaatcgccgaagacgccgcttatcgggcccggaccgagagcgagatgaactctaatacctcaaatagcctggaagatgacagcgacaagaatgagaatttggggagaaaaagcgagctgtccctggatcttgatagtgacgtcgtgcgagaaacagtggactccctgaagcttctggcacaaggccatggcgtggttctcagcgaaaatatgaatgaccgcaactatgccgatagcatgtcgcagcaggactctcggaacatgaattacgtgatgctggggaagcccatgaacaacggcctgatggagaaaatggttgaggaaagcgatgaggaagtgtgcctgtcgagcctcgagtgcctcaggaatcagtgtttcgatctggccaggaagctgagcgaaaccaacccccaggagcgaaacccacagcagaacatgaatattcggcagcacgtccggcccgaggaagatttccctgggaggacaccagaccgaaattattccgatatgctgaacctcatgcggctggaagagcagctgagccccagatcaagggtttttgcttcttgcgccaaggaggatggctgtcacgagagggatgacgacaccacctcagttaacagcgacaggtcagaagaagtgtttgacatgacgaaggggaacctcaccctgctcgagaaggccatcgccctcgagaccgaaagagcgaaagcgatgcgcgagaaaatggccatggaagctggccggcgcgataacatgcgatcctacgaagaccagagtccccgtcagctgccaggcgaggatcgtaaacccaaatcctccgacagccatgtcaaaaaaccatattacggaaaagacccgagtcgtaccgaaaagaaggagagcaagtgtccaaccccagggtgtgacggcaccgggcacgtcactggtctctatcctcatcatcgaagtctaagcggttgcccccacaaagaccgtgttcccccagagatacttgctatgcacgagagtgtgctcaagtgccctactcctgggtgtaccgggaggggtcatgtcaattctaaccgcaatagtcacagatccctgtctgggtgtcctatcgccgcggctgagaaactggcaaaggctcaggaaaagcaccaatcatgtgacgtgagtaagtcttcacaggcaagcgaccgggtactgagacccatgtgctttgtcaaacagctggagatacctcagtatgggtaccggaacaatgtgcctacaacgacacctcgcagtaatctcgccaaggagttagaaaagtatagtaagacctcctttgaatacaactcatatgataatcacacatatggcaagagagccattgcaccaaaggtacagacgagagacatatcccccaagggctatgatgacgcgaaacgatactgtaaggatccttctccttcctcaagttccacaagctcctatgcgccctcatcatcatcaaatctgagctgtgggggcgggtcaagcgcatcctctacctgtagcaaatcaagcttcgattacacacacgacatggaggcagcgcatatggccgcgaccgccattttgaatttgtccactcgctgtagagaaatgccccagaatttgagtacaaagccacaggacctttgcgcaactcgcaaccccgacatggaagtggatgagaacggaacactggacctgtccatgaacaagcaacggccccgcgactcgtgctgccccattttaactcctttggagccaatgtctccacagcagcaggccgtgatgaataacagatgcttccagctgggggagggggattgctgggacttacccgtggactacacaaaaatgaagccccgaagaattgatgaagacgagagtaaagatatcaccccagaagacttggatccctttcaggaagccctagaagagcggcgctaccccggcgaggtgacaatcccctccccgaaaccaaagtacccccaatgcaaggagagtaaaaaagaccttataacactctctgggtgtcccttagctgataagagcatacgcagtatgctcgctacatcttcccaggagctcaagtgtccaactccagggtgtgacggttccggacacattaccgggaactatgcatcacatcgcagcctcagcggctgcccccgcgctaagaagtccgggattaggatcgcccagagtaaggaggataaggaagaccaggagccaattcggtgtcctgtgccaggatgcgacggccaaggccacatcacagggaagtatgccagccataggtcagcctcaggctgccccctggccgctaaaaggcaaaaggatggctatctgaacggcagccagttttcctggaagtcagtcaaaacggaaggaatgtcatgtcccacacccgggtgtgacgggtccggccacgtgtctgggagttttctgacccaccgatccctcagtggatgtcctcgcgctacttcagccatgaagaaggccaagcttagcggagagcaaatgctgactataaaacagagggcctccaacggaattgaaaatgacgaggaaattaaacagctagacgaagagataaaggagctcaatgagtccaactcccaaatggaggccgacatgataaagttgagaacccaaataacaactatggaatctaacctcaagaccatcgaagaggaaaataaggtgattgaacagcagaacgagtctcttttacacgaactggctaatctctcgcagtctcttatccatagcctggctaatatccaactcccccacatggacccaataaacgagcagaactttgatgcctacgtcacgacattgaccgagatgtatacaaaccaagataggtaccagtcgcctgaaaataaggcactgctagaaaacatcaaacaggccgtaagaggcatccaagtgtag

SEQ ID NO: 195990 - DNA, 555 bp, Artificial Sequence
  Description of Artificial Sequence: Synthetic coding sequence
atgagctgccccacccccggctgcgacggcagcggccacgtgagcgggagtttcctgacccataggagtctgtctggatgcccccgggctactagcgctatgaaaaaagctaagctctcaggcgaacagatgcttaccattaagcaaagggctagtaacggcatagagaacgacgaggagattaaacagcttgacgaggagattaaagagctcaacgagagcaattctcagatggaagccgatatgattaaactaagaacgcaggtgaccattaccaccatggagtcgaatctgaaaactattgaagaggaaaacaaggtcatcgagcagcagaatgaatcgctactgcatgagttggcaaatctgtcccagagcttgatacactcccttgctaatatccagttgcctcacatggaccccatcaatgagcaaaatttcgacgcatatgttactactctgaccgagatgtacacgaaccaggaccgataccagtcgccggaaaataaggcccttcttgaaaacattaaacaagctgtaaggggcatacaagtctag

SEQ ID NO: 195991 - DNA, 3555 bp, Artificial Sequence
  Description of Artificial Sequence: Synthetic coding sequence
atggaggtggacaccgaggagaagcggcaccggacccggagcaagggcgtacgtgtaccggtggaacccgcgatccaggagttattcagctgccctacccctggttgcgatgggagtgggcacgtgtcaggaaaatatgcgaggcataggagcgtctatggatgtcctctggctaagaagagaaaaacccaagacaaacagccccaggagcctgcacccaagcggaaaccattcgctgtgaaggcggactctagctcagtggacgaatgtgacgacagcgacggaacagaggatatggacgagaaagaggaggatgagggtgaagaatatagcgaggataatgacgagcccggagacgaggatgaggaggacgaggagggcgatagggaagaagaagaagagatagaggaggaggatgaagatgacgacgaagatggcgaggacgtagaggatgaggaggaggaagaggaagaagaagaagaagaagaagaggaagaagagaacgaggaccatcagatgaactgccacaacacacgaattatgcaggataccgagaaagacgataacaacaacgacgaatacgataattacgacgagcttgtagctaagagtctgctcaatctgggaaagatagccgaggatgcggcctacagggcccgcactgaatcagaaatgaactctaatacttcaaatagtctcgaagacgatagcgacaaaaatgaaaatctgggcaggaagtctgaactgagtctggatctggacagtgatgtggtgagggagacagtcgattctttgaaactgctggcacaaggtcacggcgtggtgctgtcggaaaacatgaatgatcgcaattatgcggacagcatgagccagcaggatagcagaaacatgaattatgtcatgcttggcaagcctatgaataatggactgatggaaaaaatggtagaggagtccgatgaggaggtttgcctgtcttcgctcgagtgcctacggaatcagtgtttcgatctagccaggaaactttcagagactaatccacaagagagaaatccgcagcagaatatgaatatccgccaacacgtgcgaccagaggaggatttccctggccggacaccagaccgcaactacagtgatatgctgaacctcatgcgattggaggaacagctgagccccagatctagagtgttcgcctcctgcgccaaggaagatggatgccacgagagagatgacgacaccacatccgtgaacagcgatagatcagaagaggtcttcgatatgacaaagggtaatttgactctcttggagaaggctatcgctctggaaacagagcgtgccaaggctatgagggagaagatggctatggaagctggcaggcgggataatatgcggagttatgaagaccagtcccctagacaactccctggcgaagacaggaaaccgaagtccagtgattcccacgtaaaaaagccatattatgaccctagcagaactgagaagaaagagagcaagtgcccaacacccggctgcgatggaacaggccacgtcaccgggctttatccacaccatcgcagcctttccggatgcccccacaaagatcgggtgcctcccgagatactcgccatgcacgagagcgtgctcaagtgtcctaccccaggctgtacgggacgcggacatgtgaatagtaataggaatagccatcgaagcttaagcggctgccccatagccgcagcagaaaagttagctaaagcacaggaaaaacaccagtcttgcgacgtgtctaaatcatcacaggctagcgaccgagtgctgaggccgatgtgctttgtaaaacagctggagatccctcagtatggctatagaaataacgttcccacgacgacaccacggtcaaatctggccaaggaactggagaaatacagtaaaacgtctttcgagtataactcatatgataaccacacttatggaaagcgagctattgctcctaaagtgcaaaccagagacatctccccaaaaggatatgacgacgccaagaggtattgtaaagacccaagtccatcctccagctcgacctccagctacgcaccctcctctagttcaaacttgtcatgcggaggcggatcctcagctagctccacctgctcaaagtcttcattcgactatactcatgacatggaggccgctcacatggcagccaccgcaatcctcaatctgtccacacggtgcagagaaatgccacaaaatctgagcaccaaaccccaagatctgtgcgcaaccagaaacccagacatggaggtggatgaaaacgggacattggacctatccatgaacaagcagcgaccacgagattcatgttgtcctatcttaaccccacttgaacccatgtccccacagcagcaggctgttatgaacaatagatgctttcagctgggagaaggcgactgctgggatctacccgtggactacaccaagatgaaacctcggcgcattgacgaagatgagagcaaggatattactcccgaagacctggatccattccaagaggccttagaggagcgcagataccccggggaagttacaataccgtcccctaagcccaagtacccccagtgtaaggagtctaagaaggatctcataaccctttccggatgcccccttgctgacaaaagtattcggagcatgctcgccaccagctcccaggagttaaaatgtcctacgcccgggtgcgacggcagcggccatatcaccggcaactacgccagccataggtcgctgagtggttgcccccgtgccaaaaaatccggcattagaattgctcaatccaaggaggacaaagaggaccaagaaccaatccgatgccccgtgcccgggtgtgatggccagggtcatataaccggcaagtacgcatcccatcggagcgcttcaggctgtccattggccgctaaacggcaaaaggacggatatctcaacggcagccagtttagttggaaatccgtgaagaccgagggcatgtcctgtccaactcctggatgtgatgggagtggtcacgtgtcgggcagttttctgacgcaccggtccctctccggctgccctagagcaactagtgcaatgaagaaagcaaagcttagcggtgagcaaatgctgaccattaagcaacgcgcttcaaatggtatagaaaacgatgaagagatcaagcagctcgacgaggaaatcaaggaactgaatgagtccaacagccagatggaggcagatatgatcaagttgcgtacacagattacaaccatggagtctaatctgaagaccatcgaggaggaaaacaaggtcatcgaacaacagaatgaatccctgctgcatgagttggctaacttaagccagagcctgattcactccctggcgaacatccaattgccccatatggacccaattaacgagcagaacttcgacgcttacgtgacaactctgactgagatgtacacaaaccaggacagataccagagtcctgagaataaggcactgttggagaacatcaagcaggcagtgaggggaattcaggtctag

SEQ ID NO: 195992 - DNA, 552 bp, Artificial Sequence
  Description of Artificial Sequence: Synthetic coding sequence
atgagccagaagcccgccaaggagggcccccggctgagcaagaaccagaagtattctgagcacttctctatccactgctgccctccattcacttttctaaattcaaagaaggagatagttgacaggaagtatagtatctgtaagagcggctgtttctatcagaaaaaagaggaagactggatctgctgcgcctgccagaagacacgcactagtcggcgcgcaaagagtccacagaggcctaagcaacaacccgccgcccccccggcggtcgtgagagcacctgcaaagccccgcagccccccacgctcagaaaggcaaccccggagccctccccggtccgagaggcagcctcgcagtccgcctaggagcgagcgacagccaagatcccccccgcgttctgagcggcagccacggcccagaccagaggtgcgacccccacctgcgaaacaacggcccccccagaagagcaaacagcagcctcggagcagcccattgcggggtccaggagcctctagaggtggttctccagtaaaggcatcccggttttggtag

SEQ ID NO: 195993 - DNA, 246 bp, Artificial Sequence
  Description of Artificial Sequence: Synthetic coding sequence
atgagccagaagcccgccaaggagggcccccggctgagcaagaaccagaagtattctgaacatttttccatacactgctgtccccccttcacctttctaaattccaaaaaggagatcgtggataggaagtattccatttgtaaaagtggatgtttctatcagaagaaagaggaggactggatttgttgtgcctgtcagaaaactcgcctaaagcggaagattcggccgactccaaagaagaagtag

SEQ ID NO: 195994 - DNA, 246 bp, Artificial Sequence
  Description of Artificial Sequence: Synthetic coding sequence
atgagccagaagcccgccaaggagggcccccggctgagcaagaaccagaaatacagcgagcacttctccatacactgttgtcctcccttcacgttcctcaattctaagaaggagatcgtcgatcggaaatactccatctgcaagagtgggtgtttctatcagaagaaggaggaggattggatatgttgcgcatgccaaaagacccgcctgaaacgaaagatcagacccacccctaaaaaaaagtag

SEQ ID NO: 195995 - DNA, 246 bp, Artificial Sequence
  Description of Artificial Sequence: Synthetic coding sequence
atgagccagaagcccgccaaggagggcccccggctgagcaagaaccaaaagtactcggagcatttctctatacattgttgtcccccgttcaccttcctgaacagcaaaaaagaaatagtggaccgcaaatactctatctgtaagagtggatgcttttatcaaaagaaggaggaagactggatctgctgtgcctgccagaaaaccaggttgaaaagaaagatccgacctaccccgaagaagaagtag

SEQ ID NO: 195996 - DNA, 552 bp, Artificial Sequence
  Description of Artificial Sequence: Synthetic coding sequence
atgagccagaagcccgccaaggagggcccccggctgagcaagaaccagaaatacagtgaacatttcagcatacactgttgcccgcctttcaccttcctaaacagcaaaaaagagattgttgatcggaaatacagcatctgtaagagtgggtgcttctatcagaagaaggaggaggactggatatgctgcgcttgtcagaagaccagaacgtccagacgggcaaagtcgccacagaggcctaaacaacaaccagccgccccacccgctgtcgtgcgtgcgcccgctaagcctcgaagtccaccccgatctgagagacagcctcgatctccacccagaagtgagagacagcccagatcaccccctaggagtgagcgccaaccgcggtcaccccccagatccgagaggcagcctaggccaagaccagaagtccggccccccccggcaaaacagcgaccacctcagaaatctaaacagcaacctaggagctcaccccttagagggccgggcgcctcccgtggcggctctccagtgaaagcatctcgtttctggtag

SEQ ID NO: 195997 - DNA, 552 bp, Artificial Sequence
  Description of Artificial Sequence: Synthetic coding sequence
atgagccagaagcccgccaaggagggcccccggctgagcaagaaccagaaatatagcgaacatttctcaatacactgttgcccgcctttcacatttcttaactcgaagaaagagattgtggaccgaaaatacagcatctgtaaaagcggttgcttttaccagaagaaggaggaggattggatatgctgtgcgtgccagaagacccggaccagccggcgggcaaagtcaccacagcggcctaaacaacaacctgccgcaccaccagcagtcgttagggcccctgcaaagcccaggtctcccccaagatccgaacgacaaccaagatctcctccgagaagcgagcgtcaacctcgcagcccacctcggagtgaacgccagccaagatccccaccacggagcgagagacagccgagaccgcgacccgaggtgcgacctccgcctgctaaacagcggcctccgcagaagagcaagcaacaaccgcgatccagcccccttcggggcccgggcgcgagccggggagggagtccagttaaggctagtaggttttggtag

SEQ ID NO: 195998 - DNA, 246 bp, Artificial Sequence
  Description of Artificial Sequence: Synthetic coding sequence
atgagccagaagcccgccaaggagggcccccggctgagcaagaaccagaaatatagtgaacacttctccattcattgctgtccgccctttacctttctgaattccaagaaggaaattgttgaccgaaagtacagcatctgcaagtcgggctgcttctaccaaaaaaaggaagaggactggatttgttgcgcgtgtcagaaaactaggctaaagcgaaagattcgaccgaccccaaagaagaagtag

SEQ ID NO: 195999 - DNA, 552 bp, Artificial Sequence
  Description of Artificial Sequence: Synthetic coding sequence
atgagccagaagcccgccaaggagggcccccggctgagcaagaaccaaaagtattctgagcacttcagcatacactgctgcccaccttttacctttcttaactccaagaaggagatcgtggatcgtaagtattccatttgcaaaagtggatgtttttatcagaagaaggaggaagactggatctgctgcgcctgccaaaagacaaggactagtcgccgcgccaaatcaccccagcggccaaagcagcagccagctgctccacctgccgtggtgcgggcacctgccaagccacgcagcccccctaggagcgagaggcagcctaggtccccgccccgatctgagagacagccaagatctccccctagatctgagaggcagcctagatccccaccaaggtctgagcggcagccccgtcccaggccagaggttcgccctccacctgctaaacaacgtccgccccaaaagtccaaacagcagccacgttccagtcctttaagagggcccggagcctctcgggggggaagtccggtaaaggcctctaggttctggtag

SEQ ID NO: 196000 - DNA, 246 bp, Artificial Sequence
  Description of Artificial Sequence: Synthetic coding sequence
atgagccagaagcccgccaaggagggcccccggctgagcaagaaccagaagtacagtgaacattttagtatccattgttgcccaccctttactttcctcaatagcaaaaaagagattgtggatcggaaatactccatctgcaaaagcggatgcttctaccagaaaaaggaggaggactggatctgttgcgcctgccaaaaaactcgacttaagcgaaagatccgcccaacacctaagaaaaagtag

SEQ ID NO: 196001 - DNA, 177 bp, Artificial Sequence
  Description of Artificial Sequence: Synthetic coding sequence
atgagccagaagcccgccaaggagggcccccggctgagcaagaaccagaagtattcagagcatttctccatacactgctgccccccttttacttttctgaactccaaaaaagaaatagtggatagaaagtactcaatttgtaaatctggatgcttttatcagaaaaaggaagagtag

SEQ ID NO: 196002 - DNA, 423 bp, Artificial Sequence
  Description of Artificial Sequence: Synthetic coding sequence
atgctgcaggccgccgacttcatcgagcggaccgagaccgccggcgaactgtctcgaggtctcataggtgtgttgagttctcagatctcttggtgcttgttaaatgtaaacctcagtaaactgcctacacggctgcaacgactctcttgctctgtgctgaattcaagtcccgctatgcgcggaggagcacgaggcagacctcaattaacacttgaacgcccccttcgcccaggatgccgactgcacagctgcagcgaagcagagaagggtggctttgtgcgcaggaaagaaattatcctcttcccaccatgcgaggaccccgccagggggtggctatcggctaatcctgggagagagccctctcctggcatctgttggcacctaaatctgggcttgccaagtctgcataactgtgaagaatag

SEQ ID NO: 196003 - DNA, 816 bp, Artificial Sequence
  Description of Artificial Sequence: Synthetic coding sequence
atgttcggcctgaagcggaacgccgtgatcggcctgaacctgtactgcggcggagccggactgggcgccggatccggtggcgctacccgccctggggggagactattggcaactgagaaggaagcatccgcccggcgcgagatcggcgggggcgaagccggagccgtgatcggcgggagtgcgggtgcctcgccaccatccactctgacccctgactctaggcgggtggccagacctcctcctatcggagccgaggtcccggacgtcaccgccacacccgctagattactgtttttcgcccccacacggcgcgcagccccattggaagaaatggaggcgcctgcagcggacgccatcatgagccctgaagaagaactagacggctacgagcctgagcctttggggaaacgtcctgctgtcttaccactgctcgagctggtcggagagtcgggcaacaataccagcactgatgggtctctgccatctacaccgccccctgccgaggaagaggaagatgagctttaccgccagtccctggagattatatcccgctacctgcgggagcaagcaacaggagctaaagacactaagcccatgggcaggagtggagctacatcaaggaaagccctggaaaccttgcgccgggtgggcgacggtgtgcagcgcaaccacgaaaccgcctttcaaggctgggtgtgtggagtattaccttgtcggggaccccggcgctggcaccaggaatgtgccgccggcttctgcaggtgctgctggtcccggagttggttcggtatctctaataagatcgcactgctgtag

SEQ ID NO: 196004 - DNA, 1053 bp, Artificial Sequence
  Description of Artificial Sequence: Synthetic coding sequence
atgttcggcctgaagcggaacgccgtgatcggcctgaacctgtactgtggaggagctgggctgggagctggctcaggaggcgcaactcgcccagggggtcgccttttggccacagagaaagaggcttctgcacgccgggagataggtggtggagaggctggcgcggtcatcgggggctctgccggagctagtccgccttctacacttacccccgacagtcggcgcgtggcacggccaccccctattggggccgaggttcctgacgtcaccgcaacccccgccagattgctgttcttcgcccctaccagacgcgccgctccacttgaggaaatggaggcacccgcagctgatgccattatgagccccgaggaggagctggatgggtacgagccagagccactgggtaaacgccctgccgtgcttccattattagaactggtaggcgagagcgggaataacacttcgacagacgggtccctgccgagcactcctcctcctgcagaagaagaggaagatgagctgtacagacaatcgctcgagattatttctcggtacctgagagaacaagccactggcgcgaaggacaccaaaccaatgggacgctctggtgccacatcccgaaaagcactcgagacactacggcgcgttggggatggagtgcagaggaaccatgagacagcattccagggcatgctgagaaagcttgacatcaaaaatgaggatgacgtgaaatcactgtcaagggttatgatccacgtcttcagtgatggagtcaccaattggggaaggattgtaaccctgatatcctttggagcattcgtcgcaaaacaccttaaaaccatcaaccaggaatcatgtattgaacctctggcagaatctattacggatgttctggttcgtacaaaaagagactggcttgttaagcaaagagggtgggacggatttgtggagttctttcacgtggaagacctggagggaggaattagaaatgtgctgcttgctttcgcaggggttgctggagtcggcgccggactggcatacctgattcgctag

SEQ ID NO: 196005 - DNA, 840 bp, Artificial Sequence
  Description of Artificial Sequence: Synthetic coding sequence
atgttcggcctgaagcggaacgccgtgatcggcctgaacctgtactgcggaggagccgggcttggagctggctccggaggggctacacgccctggaggacgtctccttgctaccgagatggaggccccggcagctgacgccattatgtctccggaagaggagctggatggatacgaacctgagccattggggaagcggcctgccgtgctgcccctgctggagctggttggcgagtccggcaataatacctctacggatggatccctcccatccacgccaccacctgctgaggaggaagaggatgagttatatcgccaatcactcgaaatcatctcccggtacctgagggagcaagcaactggcgcgaaggatactaaaccgatgggcagatctggcgccacgtcaaggaaggccctggaaaccctgcggagagtgggggatggcgtgcagcgaaaccacgagacggccttccagggaatgctgagaaaactggatatcaaaaatgaagacgacgtcaaatcattgagtagagttatgattcacgtgttttctgacggggtcactaactggggccgtattgtgacgctcatctcgtttggagcgttcgtggccaaacatctcaagactatcaaccaagaaagttgcatagagcccctcgcagagagtattactgacgtgctcgtgcgtactaaaagggactggctggttaagcagaggggatgggacggatttgtcgaattctttcatgtggaagatttggagggggggatccgcaacgtcctcctggcctttgctggcgttgccggagtgggtgccggactggcatatctgattcgctag

SEQ ID NO: 196006 - DNA, 1224 bp, Artificial Sequence
  Description of Artificial Sequence: Synthetic coding sequence
atggtgaacgagtacaagaagatcctgctgctgaagggcttcgagctgatggacgattatcatttcacgtcaatcaagagcctgctggcatatgatctagggttgacgacgaagatgcaggaggaatataacagaatcaaaatcaccgacctgatggagaaaaagttccaaggcgtggcgtgcctggataaactcattgaactggccaaggacatgccatcattaaagaacctcgttaataacctgagaaaggagaagagcaaggtggctaagaaaattaaaacccaggaaaaagcacccgttaaaaaaattaatcaagaggaggtgggcctggctgctcccgcccctacggcacgtaacaagctgacgtccgaggctcgtggaagaattccagtcgcccagaagcgtaagactcccaataaggagaaaaccgaggcaaaaaggaacaaagtgagccaggaacaatctaaaccacctgggccctcaggtgcctctacttctgctgccgttgaccatccgccactgccccaaacttcaagtagcaccccaagcaacacgagtttcacgcccaaccaggaaacccaggctcaacgtcaagttgatgcccgtcgcaacgtgccccagaatgaccctgttaccgtggtggttctaaaagcaacagctccctttaagtatgagagcccagaaaacggcaagagtaccatgttccacgccactgtggcatcaaagacacaatactttcatgtcaaagtgtttgacatcaacctgaaagaaaaattcgtacggaaaaaggtcataacaataagcgactattccgaatgcaagggcgtgatggagattaaagaggcaagttctgtaagtgattttaaccagaacttcgaggtgcccaacagaatcattgagattgctaacaagaccccaaagataagccagctctataaacaggcctctgggacgatggtgtacggcttattcatgctgcagaaaaagtccgttcataagaaaaacaccatctacgagatccaggacaatactggctcaatggacgtagtgggatctgggaaatggcacaacatcaagtgcgagaaaggggacaagttgagacttttttgccttcagcttcgcacagtcgatcggaagctcaagctcgtctgcggctcccattcattcataaaggtgataaaagccaaaaaaaacaaggaaggtccaatgaatgtcaactag

SEQ ID NO: 196007 - DNA, 315 bp, Artificial Sequence
  Description of Artificial Sequence: Synthetic coding sequence
tgacccaaccggatcatcgagatcgccaacaagacccccaagatctctcaactctataagcaggcctccggcacaatggtttatgggctcttcatgctacagaagaaatcagtgcacaagaagaacaccatctatgaaatccaagacaacacggggtctatggacgtggtgggctcaggcaagtggcataacattaaatgtgagaaaggcgacaagctcagactcttttgcttacagttgaggactgtcgacaggaaactcaagctggtgattaaggccaagaagaataaagaagggcccatgaacgtcaattag

SEQ ID NO: 196008 - DNA, 795 bp, Artificial Sequence
  Description of Artificial Sequence: Synthetic coding sequence
atgcggcccgaccgggccgaggcccccggcccccccgccatggccgctggaggcccaggcgctgggagcgctgcgcccgtgtcttccacctcatcgctgcccttggccgctttgaacatgcgcgtccggaggcggttgtccctgtttctaaatgtccgcactcaggtagctgccgactggacggcactggcagaggagatggactttgagtatctggagattcgtcagctggagacccaggcagaccctaccggccgtctgctggacgcctggcaaggcagacccggagcaagtgtgggacgtctgcttgaactccttacgaaattaggcagggatgatgtgctgttggagttgggcccttccatcggacatatgcccgaacgcttcgacgcgtttatctgttattgtcccagtgacatccagttcgtgcaggagatgatacggcagctggagcagacaaattaccggttaaagttatgtgtgtccgaccgggatgttctccccgggacttgcgtgtggtctatcgcctcggagttgattgagaaaaggtgccgccgcatggtcgtggttgtgagtgacgactatctgcagagcaaggagtgtgacttccaaactaaatttgccctgagcctgagtcctggcgcacaccaaaaaaggcttattccaataaagtacaaggcaatgaagaaggagtttccatctatattgaggtttatcaccgtgtgcgattatacaaatccgtgcacaaagagctggttttggactcgcttagccaaagccctttccctcccttag

SEQ ID NO: 196009 - DNA, 615 bp, Artificial Sequence
  Description of Artificial Sequence: Synthetic coding sequence
atgcggcccgaccgggccgaggcccccggcccccccgccatggccgcgggcgggcccggggcgggtagcgccgctcctgtcagctcaacgtctagccttcctctggccgcgttgaatatgagagtgcggaggcgcctgtctcttttcttgaatgtgcgaacccaggtcgccgccgattggacagctcttgccgaagagatggactttgaatatctggagatcagacaattagagacgcaggcagatcctacaggccggttgctcgatgcttggcagggccggcctggagcatcagtgggccgcctcctggagctgcttacaaaactgggaagagatgatgtcttactcgaactaggtccatctattgaggaggattgccagaagtacattttaaagcagcaacaggaagaagccgagaagcccttacaggtagcagctgtggattcgtcagtgcctaggacagcggagttggctggcatcaccactctagacgacccccttggagcagcgggatggtggtggctttctctcatgattacctgtcgggcacgcaacgtgacctcccgccccaacctacactctgcatctctccaggtacccatacggtcagactag

SEQ ID NO: 196010 - DNA, 480 bp, Artificial Sequence
  Description of Artificial Sequence: Synthetic coding sequence
atgcggcccgaccgggccgaggcccccggcccccccgccatggccgcagggggccccggagcaggcagcgctgcccctgtgtcctcaacaagcagcctccctcttgccgcccttaatatgagagtaagacggcgcctgagcctattcctcaacgtgcggacacaggtcgccgctgactggacagcactggctgaggaaatggatttcgagtatttggaaatccgtcagctcgaaactcaggctgacccgactggtcgcctgctagacgcttggcaagggcggcctggcgcgtccgttggccggcttctcgagctgctcaccaagctaggccgcgacgatgtgctgctggaattgggtccatctatcggtgcggctggttggtggtggcttagtttgatgatcacatgtcgcgcgcggaacgtgacatcaagaccaaatttacattcggcttcattgcaggtacctattcgctcagactag

SEQ ID NO: 196011 - DNA, 807 bp, Artificial Sequence
  Description of Artificial Sequence: Synthetic coding sequence
atgttccggatgctgaacagcagcttcgaggacgaccccttcttctccgagtctatactggcccatagagagaatatgcgtcagatgatacgctcctttagtgagccattcggccgtgatctattgtcaatttcagatggacgagggcgtgcccacaacaggagggggcataatgatggtgaggattctctcacacatactgacgtctcatcatttcagacgatggatcaaatggtcagtaatatgcgaaactacatgcagaaattggagcgtaacttcggtcagcttagtgtggaccctaacggacactctttctgttccagttctgtgatgacatatagtaaaattggggacgagccaccgaaagtatttcaagcctccactcagaccagaagagccccgggaggaatcaaagagaccagaaaagccatgagagacagcgactctggactcgaaaaaatggccataggccatcacatccatgatagagctcatgtcatcaaaaagagcaagaataagaagaccggagacgaggaggttaaccaagaatttatcaacatgaatgaaagtgatgcacacgcatttgacgaggaatggcaatcagaggttttgaaatacaagccgggcagacacaatctggggaacacgcggatgcggtccgtcgggcacgagaacccagggtctcgcgagctgaaaaggcgtgagaagcctcagcaatccccggcaattgaacatggtaggaggagcaacgtactcggtgacaagctccatatcaaggggtctagcgtgaagagtaacaagaagtag

SEQ ID NO: 196012 - DNA, 732 bp, Artificial Sequence
  Description of Artificial Sequence: Synthetic coding sequence
atgcggcagatgatccggagcttcagcgagcccttcggccgggacctgttaagtatcagcgatggacggggacgcgcccacaatagaagaggtcacaatgatggggaagatagccttacccacacagacgtatcgagctttcaaacgatggatcagatggtgtcaaacatgaggaattacatgcagaagctggagaggaacttcggtcagctctcagttgaccccaatggccatagcttctgttcctcaagcgtcatgacatactccaagatcggggatgaaccgccaaaggtattccaggccagcacgcagacccgcagggctccagggggtataaaggagactaggaaggccatgagagactcggacagcggcttagagaaaatggccattgggcatcacatccatgaccgtgctcatgtcattaaaaaatcaaagaacaaaaagactggtgacgaggaggtaaaccaggagtttattaatatgaatgagagtgatgcgcatgcttttgacgaggagtggcaatctgaggtgttgaagtacaaacctggtcggcataacttagggaatacgaggatgagatctgtgggtcacgagaatcctggaagccgggagctcaaacggagggaaaagccacagcagtctcccgctatagaacacggccgaagaagtaacgtcctcggcgacaagctccacattaaggggagttcagtcaaaagcaacaagaagtag

SEQ ID NO: 196013 - DNA, 900 bp, Artificial Sequence
  Description of Artificial Sequence: Synthetic coding sequence
atgctgaaggaggtgctgcagcgggagggcaagagctacaagagcgagaccctcatgtatatcaagaaagctcgagctagcgaaaataaactatcagagtccatcctggcacaccgcgagaatatgcgtcaaatgatacggtccttcagcgagccgttcggccgtgacctgctctccatctcagacggtagagggcgggcacacaacaggagaggacacaacgatggggaggatagtctgactgcaactagttgcagcttggtccctttcggagatttcggaggcatgcacacggacgtttcctcctttcaaactatggatcaaatggtgtccaacatgcgcaattacatgcagaaattggaaagaaatttcgggcagctgtctgtcgatcccaatggacattcattctgttcttcatccgtgatgacgtattcaaaaataggagatgaaccacctaaagtttttcaggcgtctacacagactaggagagcaccaggcgggataaaagaaactcgtaaagccatgcgggattctgacagcggcctggaaaaaatggcgataggtcatcacattcatgacagggctcatgtcattaaaaagtcaaagaacaagaagactggggacgaagaagtgaaccaggagtttataaacatgaatgagtctgacgctcacgcatttgatgaagaatggcagagcgaggtgctcaaatacaaacccggcagacataatctgggaaatacgcgtatgcgcagcgttggccatgagaatcccggaagccgtgagctcaagcggcgggaaaaaccccagcaatccccagcaatcgaacatggacgacggtcaaacgtattaggagataaactacacataaagggttcctcggtgaagtctaacaaaaaatag

SEQ ID NO: 196014 - DNA, 777 bp, Artificial Sequence
  Description of Artificial Sequence: Synthetic coding sequence
atgcggcagatgatccggagcttcagcgagcccttcggccgggacctactgtccattagcgacgggcgaggcagagcgcacaataggcgtggacacaatgatggggaagactccctgaccgccacctcctgttctttagttccctttggagacttcggcggcatgcatactgatgtgagttctttccaaacaatggatcaaatggtcagtaatatgcgcaattacatgcagaagctcgagaggaatttcggacagctgagcgtcgatccaaatggacattccttctgctcaagctccgtgatgacctacagcaaaatcggagacgagccaccaaaagttttccaggcctctacccaaactaggagagctcctggggggataaaggagactaggaaagctatgagggactctgattccgggctagaaaagatggcaatcggccaccacattcatgatcgcgctcacgtgatcaagaagagtaaaaataagaaaaccggcgacgaggaggttaaccaagaattcatcaacatgaacgagtctgatgctcacgcgtttgacgaagaatggcaaagcgaagttctcaagtataagccaggacggcataatctaggcaacacacgaatgagatcagtcgggcacgagaatcccgggtctcgcgagctcaaacgccgtgaaaagcctcagcagtcaccggcgatcgaacacgggcggcgctccaacgtgctaggggacaagctgcacattaaggggtccagtgtcaagagcaacaagaagtag

SEQ ID NO: 196015 - DNA, 777 bp, Artificial Sequence
  Description of Artificial Sequence: Synthetic coding sequence
atgcggcagatgatccggagcttcagcgagcccttcggccgggacctactaagtatttcagacggcaggggtagggcacacaacagaaggggccacaacgatggggaggattcgcttaccgccacatcctgcagtctggtgccatttggcgactttggcggtatgcatactgatgtttccagtttccagacaatggaccagatggtgagcaatatgcgcaactatatgcagaagttggaaagaaacttcggccaactgagcgtcgatccaaatggccacagtttttgcagcagcagcgttatgacgtactctaagataggagacgagccacccaaggtcttccaggcttctacacagacccggagggccccgggtggtattaaggagacaagaaaggccatgcgggattcagacagcggtttagaaaagatggccatcgggcaccacattcacgaccgagcacacgtaattaagaaatccaaaaataagaagacaggagatgaagaagtgaatcaagaattcatcaatatgaatgagtctgacgcccacgccttcgatgaagaatggcaatccgaggtgctgaaatacaagcccggtagacacaacctgggcaatacccggatgcgctccgttggccatgagaatccgggcagcagggaactcaaaagaagagagaagcctcagcagagccccgccatcgaacacggccgaaggtccaatgtcttgggcgataagttgcatattaagggcagttcagtaaaatcgaataagaagtag

SEQ ID NO: 196016 - DNA, 732 bp, Artificial Sequence
  Description of Artificial Sequence: Synthetic coding sequence
atgcggcagatgatccggagcttcagcgagcccttcggccgggacttgctcagcataagtgatggacgcgggcgtgcccataaccggagggggcacaatgacggcgaggacagcctcacacacactgacgttagttcatttcaaactatggaccagatggtcagcaacatgaggaactacatgcagaagctagagcgcaactttggccagctcagcgtcgaccccaatggccatagcttctgtagtagctcagtgatgacctatagcaaaatcggggatgagcctcccaaggttttccaggcctcaacccaaactcgtagggctcctgggggcattaaagaaactcgaaaggcaatgcgtgacagcgacagcggccttgaaaagatggcaatcggccaccatatacatgaccgggcacacgtgataaagaaatccaagaacaagaaaaccggggatgaggaggtgaatcaggaatttatcaacatgaatgagtctgacgcacacgcctttgacgaagagtggcagtcggaagtgctcaagtacaaacccggccggcataatctgggaaacaccagaatgaggtccgtggggcatgagaatccaggcagccgggagctgaagaggagagaaaaacctcagcagtcccccgccatcgagcatggcagacgcagcaatgtactgggggataagctgcacattaaaggaagttccgtcaaatctaacaaaaagtag

SEQ ID NO: 196017 - DNA, 732 bp, Artificial Sequence
  Description of Artificial Sequence: Synthetic coding sequence
atgcggcagatgatccggagcttcagcgagcccttcggccgggacttactgagtatcagtgacggaagaggcagggctcataataggcgagggcataatgacggcgaggattccttgacccacaccgacgtatcctcatttcagaccatggaccagatggtgtccaatatgaggaactatatgcagaaactcgagagaaatttcggccagctgtctgtggatcccaatgggcactcattctgctcatcttctgtgatgacatactcgaagattggggacgaacccccaaaggtgttccaggctagcactcaaactcggcgggcccccggcggcatcaaagagacgcgcaaggccatgagggactcggactccgggctagaaaaaatggccatcggacaccacattcacgatcgggctcatgtgattaaaaaaagtaagaataagaaaacaggggacgaggaggtgaatcaggaattcatcaacatgaacgaatctgacgcccatgctttcgatgaagagtggcaaagcgaagttctgaaatacaagcctggaagacataacctgggaaatacaaggatgcggtccgtcgggcacgaaaatccaggttcccgagaattaaagcgccgcgagaagcctcaacaatctcccgctattgagcacgggaggcgcagtaacgtattgggcgataaactgcacattaaaggatcctcggtgaagagcaacaaaaaatag

SEQ ID NO: 196018 - DNA, 603 bp, Artificial Sequence
  Description of Artificial Sequence: Synthetic coding sequence
atgcggcagatgatccggagcttcagcgagcccttcggccgggacctgctgtctatatctgatggccgcggccgtgctcataatagaagagggcataatgatggggaggactctctgacccatacagatgtgagcagttttcaaaccatggaccagatggtgtctaatatgaggaactatatgcaaaaattggagcggaatttcattaaggaaacgcgcaaagctatgcgggattcggatagcggactggaaaaaatggctattggccaccatatacatgatcgggctcatgtgataaaaaagtccaaaaacaagaagacgggcgacgaggaggttaatcaggagttcatcaacatgaacgagtctgacgcgcatgcgttcgacgaagagtggcaatccgaggtcctgaagtataaaccgggaaggcacaacctgggaaatacccgcatgcggagcgtgggacacgaaaatcctggatcacgggaactcaaacgccgcgagaagccccaacagtccccggccatcgaacacggcaggaggagcaacgtcttgggggacaaactgcacatcaagggttcttccgtgaagagcaacaagaagtag

SEQ ID NO: 196019 - DNA, 747 bp, Artificial Sequence
  Description of Artificial Sequence: Synthetic coding sequence
atgttccggttcatgcgggacgtggagcccgaggaccccatgttcctaatggatccattcgctatccatcgccagcatatgtcaagaatgttatccggcggtttcggatactcccctttcctttctatcactgatgggaatatgccgggcactcgcccagcaagcagacgcatgcagcaggccggcgccgtgtccccgtttggtatgctgggtatgtcaggaggattcatggacatgttcggaatgatgaacgatatgatcggcaacatggagcatatgacagccggtggaaattgccagacattctcctcttcgaccgtgatttcgtatagcaacaccggggacggcgcccctaaagtgtatcaggagactagcgaaatgaggtctgcccccggtggtatccgtgaaacacgacggacagtgcgagactctgactcgggcttggagcagatgtcgatcggtcaccatatcagagatcgcgcccatatcctgcagcgctctaggaatcacagaaccggtgaccaagaggagcggcaggactatattaatctggacgagtccgaggcggctgcctttgatgacgagtggcggcgagaaaccagtaggtttaggcagcagcgcccattggagtttcgtaggcttgagtcgtccggtgccggcggccgaagagccgagggtcctcctagacttgccattcagggcccagaggattctccatccagacagtcacgtcggtatgactggtag

SEQ ID NO: 196020 - DNA, 747 bp, Artificial Sequence
  Description of Artificial Sequence: Synthetic coding sequence
atgttccggttcatgcgggacgtggagcccgaggaccccatgttcctgatggacccattcgctatccaccgtcagcatatgagccgcatgctgagcggaggcttcggctactccccctttctgtcaatcaccgatggtaacatgccgggaactcggccggcctcaagacggatgcaacaggccggagctgtgtcacctttcgggatgctggggatgtcaggagggttcatggacatgtttggcatgatgaacgatatgattggtaacatggagcatatgaccgccggtggtaactgccagacattctcctcatccactgtgattagctatagcaacactggagacggtgcgcccaaagtgtaccaggagacctctgaaatgcgctcggccccaggtgggatccgtgaaaccaggcgaactgtgagggactctgacagtggccttgaacagatgtctataggtcaccacatccgggatagagcccacatcctccaaagatctcggaatcacaggaccggggaccaggaagaacgtcaggattacatcaatctggatgaaagtgaggcggcagcctttgacgacgaatggagacgcgagaccagtcgcttcaggcaacagcggccgctggaatttcgtaggcttgagagcagcggagccgggggcagacgggctgaggggcccccacggctagcaatccaggggcctgaggactccccgtctcgacagagcaggagatatgattggtag

SEQ ID NO: 196021 - DNA, 747 bp, Artificial Sequence
  Description of Artificial Sequence: Synthetic coding sequence
atgttccggttcatgcgggacgtggagcccgaggaccccatgttccttatggacccctttgccattcatcgacagcatatgtcacgcatgctgtccggcggattcggctattctcctttcttgtctatcacagacggaaacatgcctggcacacggccggcctctagacgaatgcagcaagccggggctgtttctccatttgggatgctggggatgagtggaggcttcatggacatgtttgggatgatgaacgacatgattgggaatatggagcacatgaccgccggcggtaattgccagacatttagctccagcacagtgatctcatacagtaacaccggcgacggggcgcccaaagtttaccaagagacatcagagatgaggagtgcccccggtggcattcgggaaactcggcgaacggttagagacagcgatagtgggctggagcagatgtcaatcggacaccacattagagaccgggcacacatccttcagcgaagcagaaatcaccgcaccggggatcaggaggagagacaggattatattaatctggacgagagcgaggccgccgcgttcgatgatgagtggcggagagagacgtccaggttccggcagcagagacccctggagttcaggagacttgaaagtagcggggctgggggccgacgcgcagagggaccccctagattggccatccaggggccggaagattctccttcacggcagagcagacgctacgactggtag

SEQ ID NO: 196022 - DNA, 747 bp, Artificial Sequence
  Description of Artificial Sequence: Synthetic coding sequence
atgttccggttcatgcgggacgtggagcccgaggaccccatgttccttatggaccccttcgcaatccaccggcagcacatgtccaggatgcttagtggcggttttggttactctcctttcctttccattactgacgggaacatgccaggcacccgtccagccagccgacggatgcaacaggctggtgcagtctcaccgtttggtatgctgggcatgagcggaggcttcatggacatgtttggtatgatgaatgatatgattggcaacatggagcatatgacagctggcggaaactgccaaacctttagtagcagtaccgtgattagctacagtaatacaggggatggcgcccctaaggtctaccaggaaacttcggagatgcgaagtgctccaggcggcatccgggagacacgccggacagtacgggacagcgactctggcctggagcagatgtcgatcggtcaccacatcagagacagggcccacattctccaacgttctcgcaatcaccgaacgggcgaccaggaggagcggcaggactacattaacctggatgaatccgaggccgccgcgtttgacgacgagtggaggcgtgaaacctcccgtttcagacagcaacgaccattggaatttcgaaggctcgaaagctcaggagctggaggccgacgggcggagggaccccctagactggctattcagggacctgaagactcccccagccgtcagtcccgtaggtatgactggtag

SEQ ID NO: 196023 - DNA, 684 bp, Artificial Sequence
  Description of Artificial Sequence: Synthetic coding sequence
atgatggccgccggcgccgccctggccctggccctgtggctgctgatgcctcctgtggaagtggggggggcgggcccgccacctatccaagatggggaatttacattcctcctgcccgccgggcgtaaacagtgcttctatcaaagcgcgcctgccaatgcctcgctcgaaacggagtaccaggtcatcggtggagcaggacttgacgtggacttcaccctcgagtcgcctcaaggagtcttgctggtcagcgagtctagaaaggccgacggagttcatactgttgagccaaccgaggcaggtgattacaagctatgttttgataattcctttagcactatcagcgagaaattggttttctttgaactcattttcgactcactgcaagatgatgaagaagtggaagggtgggccgaagctgtggagcctgaggaaatgctggacgttaagatggaggatatcaaagagagcatcgagactatgcgaactaggctggagagaagcatccagatgttaacccttcttagagcttttgaagcccgtgacagaaaccttcaggagggtaatctggaaagggttaacttctggtctgccgtaaacgtcgcagtgctgctgctcgtcgctgtccttcaggtgtgcacacttaaacggttctttcaggataagcgccctgtccccacctag

SEQ ID NO: 196024 - DNA, 873 bp, Artificial Sequence
  Description of Artificial Sequence: Synthetic coding sequence
atgcggcccgccgtgctgggcagccccgaccgggccccccccgaggatgaaggccccgtcatggtaaaactcgaggacagcgaggaagaaggcgaggcggccctttgggaccccgggccggaagccgcaagactaaggttcaggtgctttcgctacgaagaggctactggcccccaggaggcgctggctcagctaagagagctctgtagacaatggctccggcctgaagtgcgatctaaggaacagatgctggaactgttggtattggagcaattcctgggagcactgcctccagaaattcaagctagagtacaaggtcagaggcccggcagcccagaagaggctgctgccctggttgacgggctcaggagagaacctggcgggcccagacgctgggtaaccgtccaggttcaggggcaggaagtactgagcgaaaagatggagccttcttcatttcagcctctacccgagactgaaccacctaccccagagccaggtcccaagacgccaccacgtactatgcaggagagccccctcggtctgcaggtgaaggaggagtcagaagtgaccgaagacagtgattttcttgaatccggccccctagcggctacgcaagaaagtgtgcccactcttttaccagaggaggctcagaggtgcggtacggtcctggaccagattttcccacatagcaagactggaccagagggtccatcctggagggagcatccgcgcgcactttggcatgaggaggccggcggaattttctctcctggcgccggcgcgggagccgcaccagctctgggcgcaggatggttgggcgctgccgtggccatgtatgtggcgcgatgctctgccaatgcagcaacctgctag

SEQ ID NO: 196025 - DNA, 2205 bp, Artificial Sequence
  Description of Artificial Sequence: Synthetic coding sequence
atgcggcccgccgtgctgggcagccccgaccgggccccccccgaggacgaagggccagtgatggtaaagctcgaagattcagaggaagagggtgaagctgctctgtgggatcccgggccagaagctgcacggcttcgattccggtgttttaggtatgaagaggctactggccctcaagaggccctggcgcagcttcgcgaactatgccgccagtggctgcggcccgaagtccggtcaaaagagcagatgctcgagctcctcgtgctggagcagtttctgggagctttacctccagagattcaggcacgcgtacagggacaacgtcctggatcaccagaagaggccgcagccttggtggacggccttagacgtgaaccaggtggaccgagaagatgggtaaccgtgcaggtccaaggccaagaagtactctcagaaaagatggagccgtcatctttccagcctctaccagaaaccgaacctcctacccctgaaccaggtccaaaaaccccaccacgcacaatgcaggaatcccccctgggcctgcaagtgaaagaggagtctgaggttacagaagactcagattttttagagagcgggcctctggctgccacgcaggagagtgttccaaccctactccccgaagaagcccagcgctgtggtacagttctagaccaaatctttccacatagtaaaactgggcctgaggggccctcctggagagaacacccacgtgccctctggcatgaggaagctggaggtatcttctcgcccggatttgcccttcagctgggaagcatcagcgctgggcccggcagcgtctctccgcacctgcatgttccatgggacctcggaatggcgggattatctggtcagattcagtcacctagtagagagggggggttcgctcacgcacttcttctgccgtccgacctgaggagcgagcaggaccctactgacgaagacccctgcagaggggtcggccccgccctgattactacgcgctggcggtctcccaggggtcgatcaaggggcagacccagtacaggcgggggcgtagtgagaggtggccgctgcgacgtgtgtgggaaggtgttttcccagaggtccaatctcctgaggcaccaaaagatccacaccggggagaggccttttgtttgcagtgaatgtgggcgctctttctcacggagcagtcatttgttacgccatcaactgacgcacaccgaagagcgaccttttgtgtgtggagattgtggccagggcttcgttcgatccgcccggttggaggagcaccgaagagtccacacaggggagcagccgtttagatgcgctgaatgtggtcagtcctttagacagcgcagtaacctgttgcaacaccaacgcatccacggtgaccctcctggacccggagccaagccacctgctcccccgggagctcctgagccacctggcccatttccttgctcagaatgccgggagagttttgctagacgggccgtcctgcttgagcaccaggctgtccacaccggggacaaaagttttggttgtgtggagtgcggcgaaagatttggcagacgcagcgtgctgctgcagcatagacgggtgcactcaggggaaaggccgttcgcctgcgcagagtgcggccagtcatttcggcaacgatctaatcttacacagcatcgacggatacacaccggggaacgcccatttgcctgcgccgaatgcggtaaagcttttcggcaaagacccactctaacacagcacctccgagtccatacaggagaaaagccatttgcatgtcccgagtgtggccagagattctctcaaaggcttaagttgactcgacaccagcggacccacactggggaaaaaccatatcactgcggagagtgcggactcgggtttacccaggtctctaggctgacagaacaccagaggattcacacaggagagcgtccttttgcttgccccgagtgcggacaatcatttcggcagcatgctaatctcacgcaacatcggaggatacacaccggggagcgtccttacgcatgtcctgagtgcggtaaagccttcaggcagcgcccaacccttacccagcacctgcgcacacacagacgcgaaaaaccctttgcatgtcaagactgtggaaggcgctttcaccagtccactaaattaatccagcaccagagagttcactcagccgaatag

SEQ ID NO: 196026 - DNA, 1539 bp, Artificial Sequence
  Description of Artificial Sequence: Synthetic coding sequence
atggcccacagctgccggtggcggttccccgcccggcccggcaccacaggcgggggcggaggcgggggccggagagggctgggtggcgctccccggcaacgagtgcccgcattactgctgccgcctggtccaccagtcggaggtggcggcccgggcgctccaccatcgcctcccgctgttgctgcagcagccgcggcagcggggagcagcggggcgggcgtgcccggtggcgcagccgcagctagcgccgctagtagtagcagcgccagctctagtagcagcagttcatcatccgcgtctagcggccccgcactgctgagagtgggcccaggattcgacgcagctcttcaggtgtcagctgccatcggaactaacttgcgcagattccgtgccgtgttcggtgagtccggagggggaggaggaagcggcgagctgacaacacagattccatgctcgtggagaactaagggacacatacacgacaagaagaccgaaccattcaggttgctcgcatggtcgtggtgcctaaacgacgagcagtttttggggttcggctcggatgaagaagtgagagtacggtcacccacacggagtccctcggtgaaaactagtcctaggaaaccaaggggtcggcctcgcagtgggtcagacagaaattcagccatcttgtcagacccatctgtgtttagcccccttaataaatcagagacgaagagtggggacaaaataaagaaaaaggattctaaatccattgagaagaaacggggccgccctcctacgtttccaggagtcaaaatcaaaatcactcacgggaaggatatttcggaactgccaaaaggtaacaaggaggattcattaaagaagatcaaaaggacacccagcgccactttccagcaagcgacaaaaatcaaaaaactgagagcaggaaaactctcccctttaaaatcgaaattcaagaccggaaaattacaaatcggcagaaaaggtgtccagatcgtgaggcgacgaggcagaccgccctccacagagcggatcaaaacccccagtggcctgctcataaacagcgagttagaaaaacctcagaaagtgagaaaggataaggagggcaccccccccctgacaaaagaagataaaactgtcgtacgtcagtcacccagacggatcaagcctgttcgaatcatcccttcttctaagagaacagatgccacaatagcaaaacagctactccagagggccaagaaaggggcgcagaagaagatagaaaaggaagcagctcagctacagggaagaaaagtcaagactcaagtcaagaacatccgacaattcattatgcctgttgtctccgccatcagctcacggatcatcaaaacccctagaagattcatagaagacgaagactatgatccccccatcaaaatcgcccggttagaatcaaccccaaactcccggttcagtgccccaagctgcgggtctagcgagaaatctagtgcagctagtcagcacagttcgcaaatgtctagcgatagttctaggagctag

SEQ ID NO: 196027 - DNA, 11796 bp, Artificial Sequence
  Description of Artificial Sequence: Synthetic coding sequence
atggcccacagctgccggtggcggttccccgcccggcccggcaccacaggcggtggcgggggtggcggtcgcagaggcctaggcggcgcaccaagacagcgcgttcccgcgctgctgctgcctcctggcccacctgtgggcgggggtgggcccggagcgccaccctcaccgcccgctgtcgccgctgccgccgccgctgcagggagctccggagctggcgttccaggcggtgctgcagccgcctccgctgcctcttcaagctccgcatcttcctcttcatcatcgtcttcttccgctagctcaggacctgccctcctccgcgtaggccccggtttcgatgccgccctccaagtgtctgctgctataggtactaatctgaggcggtttagggcagtcttcggggagagtggcggagggggggggagtggtgaagacgagcaattcctgggatttggaagtgacgaggaagtgcgtgtgcggtcacccacccggagtccaagcgttaagacttctccacgtaaacctagagggcgtcctcgctctggctccgacagaaactccgccatcctgagcgatccctctgtgttcagtcccttaaacaaatccgaaaccaagtctggcgacaaaattaagaaaaaagattcaaaaagcattgagaagaagaggggccggcctcctacattccccggcgtcaagataaaaataacccatggcaaagatattagcgaacttcccaagggaaacaaggaggactctctcaagaaaatcaagcggactccctcggccacgttccagcaggctacaaagattaaaaagttgcgggcaggcaagctgtccccactgaaatcaaagttcaagaccggcaaactgcagatcgggaggaagggagtccagattgtgagaaggcgcgggaggccccccagtactgaacgtatcaagaccccaagtggccttctcattaactcagaactggagaagccccaaaaggtccgcaaggacaaagaggggacccctccactgactaaagaagacaagacagtggtccgccagtctccccggcgcattaagccggtgcggataatcccatcaagcaagaggaccgacgctaccattgccaaacagctgctgcagagggcgaagaagggagcccagaagaagattgagaaggaagcagcccagctgcaaggtcgcaaggttaaaacgcaggttaaaaatattcgtcaatttatcatgccagtcgtgtcagctatcagtagtaggattatcaagaccccaagacgcttcattgaggatgaggactatgaccctcccatcaagatagctcgtcttgagtctactcccaatagtcggttctccgctccatcttgcggatcgtctgagaagtcatctgccgccagccaacacagctctcagatgagttcggattcatctaggagcagttcccctagcgtggacacaagtactgacagccaagcttccgaagagatccaggtgcttcccgaagagcgatccgatacgccagaggtgcaccccccactccccatctcacagtcccctgagaatgagagcaacgacagacggtcccggcgctacagtgtcagtgagcgaagctttgggtcaaggaccacgaagaaattgagcacccttcagtctgcaccgcagcaacagacgtcgtcctcaccaccgccccctcttctgacgccacccccccctctacagccggcttcctctatcagtgatcacaccccgtggctcatgccacctacgatccctctcgcctcccctttcctgccagctagcaccgcccctatgcaaggcaaacgcaagtctattctaagagagcccactttccgttggacgagcctgaagcactccaggtcggaaccccaatacttctcctctgcgaagtacgccaaagaaggcctcatcaggaagccgatctttgataacttccggccacctccattgacaccggaggacgtgggattcgctagtggattcagtgcttcaggcacagcagcatccgccaggctgtttagccccctgcattcaggcactcgctttgatatgcacaaaagatctcccctcctgcgagccccacgtttcactccctccgaagcgcactccagaatttttgagtctgtcacgcttccaagcaaccgtacgagtgctggcacatcctcatccggagtgtccaatcgtaagcggaagcgcaaagtgttctccccgattcgctccgagcccaggtccccgagtcacagtatgcggactagatcaggtcggctttcctcttccgaactcagccctttgacccctcctagttccgttagttcttccttaagtatatccgttagtccactggctacctctgcccttaaccctacttttacattcccttctcattccctgacccagtcaggggagagcgcggaaaagaatcagagacctagaaaacaaacctctgccccagcagaaccattctcaagtagttctccgacaccactgttcccatggtttacccccggctcccagacggagcgcgggaggaataaagacaaggcacccgaagaactttcaaaagatcgggacgctgataagtctgtggagaaggataagtccagagagagggatcgtgagcgcgaaaaggagaacaagcgggagtccagaaaagagaagcgtaaaaagggctccgagatccaaagctccagcgccctctaccccgttggtagggtctcaaaagagaaggtggtgggtgaagatgtggcaacatcttcctccgccaagaaggctacaggacggaagaagagcagctcccatgatagcggaaccgatataacatctgtaacccttggcgacaccacagctgtgaagacaaaaatcctgatcaaaaaagggagggggaacctggagaagacaaatctggacctgggacccaccgcccctagccttgagaaggagaaaacactgtgtctctcaacaccctcaagtagcactgtgaaacattctacttcctcgatcgggtccatgctggcgcaagctgacaagctaccaatgacagacaaacgcgtggcatctctgcttaaaaaagcaaaagcacaactgtgtaaaatcgagaagagcaagagcctcaaacaaaccgaccagcccaaagcgcagggtcaggaatctgatagctccgagacctcagtgagaggacctcgcatcaaacacgtgtgtcgacgtgccgccgtggcactgggaagaaaacgcgccgtgtttcctgacgatatgccaaccctttcggccctaccctgggaagagagggagaaaatcctcagttctatgggtaacgacgataaatcatccatcgcggggtccgaggacgctgaacctctcgcacctccaatcaagccgattaaacctgtgaccagaaataaggcccctcaggagccaccggtcaaaaaaggccggaggtcacgaaggtgtggccagtgccctgggtgccaagttcctgaggactgcggcgtgtgcacaaattgtctggacaaaccaaaatttgggggacggaacataaaaaaacaatgctgcaaaatgcggaaatgtcaaaaccttcagtggatgccatccaaggcctatctgcaaaaacaggcgaaggctgtgaagaaaaaggaaaagaaaagtaaaactagcgaaaagaaggactcaaaagagtcgtcagtagttaaaaacgtggtcgattcttcccagaaaccgactccgtccgcccgcgaggaccccgcccccaagaagagctcctcagaacccccaccgagaaaacccgtagaagaaaaaagcgaggaaggcaatgtgtcagcccctggcccagagtcaaaacaggctaccacccctgcctcccggaaatcctccaaacaggttagtcaacccgcactcgtcatccccccacaaccccccacaaccggacctcccagaaaagaagtgcctaaaaccacacctagcgaaccaaagaaaaagcagcctcctccgcccgaatccggcccagaacagagcaagcaaaagaaagtagccccacgcccttccatacccgttaaacaaaagcctaaggaaaaggagaaacctcccccagttaataagcaagaaaatgcaggaaccctgaacatcctgtccactctgtccaatggcaattcctctaagcagaagatccccgcggatggcgtgcaccgtattagagtcgattttaagttcgtatactgccaggtgtgttgtgagcctttccacaagttctgcctggaggaaaacgagcggcccctggaggatcagctggaaaactggtgttgccgaaggtgcaaattttgtcatgtgtgtggccgtcagcatcaggcgaccaagcaactgctggagtgtaataaatgccgcaactcgtaccatcctgagtgtcttggacctaactaccctaccaaaccaactaaaaagaaaaaggtgtggatctgtacaaaatgtgttaggtgcaaaagctgcggctcaacaactccagggaaaggctgggacgcccagtggagtcacgatttttctctttgccatgattgtgccaagctgtttgccaaggggaatttttgtcctctgtgcgacaaatgctatgatgatgacgactatgaaagtaaaatgatgcaatgcggcaaatgcgacagatgggtgcacagtaagtgtgagaatctttcagatgaaatgtatgaaattctgagtaatctcccagaaagcgttgcctacacctgtgtgaactgtacagagagacatcctgcagaatggagactcgctctggagaaggagttgcaaatcagcctaaagcaagtgcttactgccctgttaaatagtcgaacgactagccatctgctgaggtaccgccaggccgcaaagccccctgatctaaatccggagacagaggaatctattccctctcggtcctcacccgaaggtcctgatccacccgtcctgactgaagtcagcaaacaggacgaccagcagcctctagacttagaaggtgtgaagcgtaagatggatcagggcaactatacatccgtgttggagttttcagacgacattgtcaaaataatacaggctgctatcaatagcgacggtggccaaccagaaataaagaaggccaatagcatggtgaagtcttttttcatcagacagatggagcgcgtgtttccctggttttccgtgaaaaagtcccgattctgggagccaaataaagtcagcagcaatagcggcatgctgccaaacgccgtactccctcctagcctcgatcacaattacgcccagtggcaggaacgcgaagagaattcccacactgaacaaccacccctcatgaagaagataataccagccccaaagccgaaaggaccaggagaacccgacagtcccaccccactgcacccacccacccctccaatactctctactgaccgctcacgcgaggatagcccagagctgaatccaccccccggcattgaggacaaccgccaatgcgccttatgccttacttacggcgacgattcagcgaacgatgctggccgcctcctatacattggccagaatgagtggacccatgtcaattgcgcactttggtctgctgaggtgtttgaagacgacgacgggagcctgaaaaacgtgcacatggccgtgatcaggggcaaacagctgagatgtgaattttgtcagaagcctggagccactgttggatgttgtttaacctcgtgtacgtcaaactaccattttatgtgcagccgcgccaaaaactgcgttttcctcgacgacaaaaaggtctactgtcagaggcacagggacctaattaaaggcgaggtcgttcccgaaaacggattcgaggtgtttcgacgggtgttcgtggacttcgaagggatctccctgcggaggaagtttctgaatggattggagcccgagaatatccatatgatgatcggctccatgacaattgactgtttggggattctcaatgatcttagcgactgtgaagacaaactattccccattgggtaccagtgtagtcgagtttactggtcgactaccgatgcaagaaagcggtgtgtctatacatgcaaaattgtagagtgtagaccaccggtggtggaacccgacatcaacagcactgtggaacacgatgagaacaggacgattgctcactctccaactagcttcacagagtcctcttccaaggaaagtcagaacaccgcagagatcatttcgcccccctccccagaccgtccacctcactctcagacctcaggtagctgttactatcatgtgatttctaaagttccccgtatccgaactccgagctacagccctacacagcgatcacctgggtgcaggccactcccctcagctggaagtcctacacccaccacacatgaaattgtcaccgttggcgatccccttctgagctcggggctccggtctatcggaagccggcggcactccacctcatctctttccccacaacgctccaaactaagaattatgtcccctatgcggactggcaatacttactcaaggaataacgtgagcagcgtttccacaaccggaactgctaccgacctggagagttccgcaaaagtggtggatcacgtcctaggcccacttaatagcagcacaagtctgggacaaaatactagcacctcttctaacctgcagcgcactgttgtcacggtcggcaacaaaaacagtcatcttgacgggagttcgtcctctgaaatgaagcagtcctccgcctccgacctggtgagcaaaagctcttctctcaaaggcgagaagactaaggtactgtcatcgaaatcatctgaagggagcgcccataacgtggcatacccaggcattcctaaactcgctcctcaggtacacaacaccacctctagagaacttaatgtaagcaagatcggtagctttgctgaaccaagctccgtgtcgttttcttcaaaagaggctctgtctttccctcacctgcacctccgcggccagcgaaatgatagggatcaacataccgactccacacaaagcgccaacagcagtccagatgaggacacagaggtgaagactctgaaactgtccggaatgtcaaataggtctagcattatcaatgagcatatggggtcaagcagccgcgatcgcagacagaagggtaaaaagagctgtaaggagacgttcaaggagaaacactctagcaagtcttttctggaacccgggcaagtcactaccggggaggaaggtaacctcaagcccgaattcatggacgaggtgctgacacctgaatacatgggacagcgaccatgtaataacgtgagcagtgataagatcggggacaaggggctgagtatgccaggagtgcccaaagcaccccctatgcaggtggaagggagcgctaaagaactgcaggctcctagaaagcgcactgtcaaagttaccctcacgcctctcaaaatggagaacgaatcccaatcaaagaacgcgttaaaagaatccagtcccgcttctccgctccaaattgagtcaacttccccaaccgagccgatatctgcctcagagaaccctggcgacgggcctgttgcacaaccaagtcccaataacacttcttgtcaagactcccagtcaaataactatcagaatttacctgtacaggatcgtaatctgatgcttccagacggccctaaacctcaggaggacggcagctttaagcgcagataccctaggcggtccgcgcgggctaggtctaacatgttcttcggtttgaccccactatacggagtcaggtcctacggtgaagaggacatccccttttattcgtcctccacagggaagaagcgcgggaagaggagcgcggaggggcaggtggacggagccgatgacctgagtacatctgatgaagatgatctctactactacaattttactagaaccgtcattagctccgggggagaggagcgcctggctagccacaacctctttcgggaagaagaacagtgtgacttgcccaaaataagccagctggatggggtggatgacgggacggagagcgacacctctgttaccgcgactaccagaaagagttcccagattccaaagagaaatggtaaggagaatggcacagagaacctgaaaatagataggcctgaagatgcgggggagaaagagcatgttaccaaatctagtgtaggtcataaaaatgaacccaagatggacaactgccacagtgtgtcgcgcgtaaagactcagggtcaggacagcctcgaggcacagctatcatccttggagagcagtcgacgcgtccacactagcaccccatctgacaagaatctgttagatacatataatactgagcttctcaaatctgacagcgataataacaattccgatgattgcgggaatatcctgccatccgacatcatggacttcgtactgaaaaacacgccttccatgcaggctcttggggagagccctgaaagtagctcttccgagctgctcaatctgggagaaggtctggggctggatagcaaccgggaaaaggatatgggactctttgaagtgttcagccaacagctccctaccaccgagccagtggacagttccgtcagctctagtatttccgcagaggagcagtttgaactgccgctggagctgccttcagacctgagtgtcctaaccacccgctctcctaccgtccccagtcagaacccaagccgactcgcggttattagtgattccggtgaaaagagagttaccatcaccgagaagagtgtggcctcttcagaaagcgaccctgctctgctctctcccggagtggacccaacccctgagggtcacatgaccccagatcacttcattcagggccatatggatgccgatcacatttccagtccgccatgtggcagcgttgaacaagggcatggaaataatcaagacctgacaagaaattcgtccacacccggcctgcaggtgccagtaagcccaacggtgccaattcaaaatcagaaatacgttcctaacagcaccgacagtcctgggcccagccagatcagcaacgctgctgtccagaccacaccaccacacctgaagcccgctactgaaaagctcatagtggtgaatcaaaatatgcagccgctctacgtgctgcaaactctcccgaacggagtgactcagaaaattcaactgacatcttcagtcagctcaacaccctccgtgatggaaactaacaccagtgtcttgggcccgatgggtggagggcttactctgaccacagggctcaatcccagtctcccgacatctcaatcccttttccccagcgcatcgaagggcttgctgccaatgtctcatcaccagcaccttcatagctttcccgccgcgacccagtcctcatttcctcctaacatttccaaccccccaagcggactgctaataggggtgcagccaccacccgacccacagttgctagtgagtgaatcctcacagagaacagacctcagcactacagttgcaacaccttcctctggcttgaaaaaacgccctattagccgcctacagacgagaaaaaacaagaagctcgcgcctagtagcactccctcaaatatcgcaccctctgacgtggtgtctaatatgacactcataaattttactccctctcagctccccaaccaccccagtttgctcgacctgggcagcctgaacacatctagccataggactgtacccaatattatcaagcgaagtaaatcttctattatgtattttgaaccagcccctctactaccccaatccgtgggcggcacggccgccacagctgcgggcacttccacaatttcccaggatacatcccaccttacaagcggctcggtgagcgggttagcctcctcaagttctgtgctcaatgtagtttctatgcagaccacaacgacaccaacctcaagcgcttcggtccccggacatgtgactctcacaaaccctcgcctgctgggaaccccagatattgggagcattagtaacctgcttatcaaggctagccagcagagcctgggtattcaggaccaaccggtggccctaccacccagcagcggcatgttcccccagcttggcacaagccaaaccccgagcaccgcagcaattacggcggccagctccatatgtgtacttccctccacacaaaccactggcataactgcagcatctccttcaggggaggcagacgagcattaccagctgcagcacgtgaatcagctcttggcttccaagaccggcatccacagttcgcagcgagatctcgattcagcttccggaccccaggtgtctaacttcacacagaccgtggatgctccaaactctatggggctggaacagaacaaagctctctctagcgccgtccaagccagtccaactagcccaggcggatccccgtcatcacctagtagcgggcagaggtctgcctccccatcggttccaggaccaaccaagccaaaacccaagactaagaggtttcaactgccactggataaggggaatgggaagaagcataaggtctctcacctccgtactagttctagtgaggcacacattcccgatcaagagaccacatccctgacttccggtactggcacccccggagcggaggccgaacagcaagatactgcttctgtggaacagtcatcacaaaaagagtgcggccaacccgctggacaagtggccgtgctgcctgaagtccaggtgacccagaatcccgccaatgaacaggagtccgccgaaccaaaaaccgtcgaggaagaggagagtaacttttcctctccgctgatgctctggttgcagcaagagcagaagagaaaggaatctatcacagaaaaaaagcctaagaagggtctggtttttgagattagtagtgatgatggctttcagatttgcgctgagagcatcgaggatgcctggaaaagcctgaccgacaaagttcaggaagcgcggagcaacgctcggttgaaacagcttagtttcgccggggttaatggtttgagaatgctgggcattctgcacgacgctgttgtgttcctaatcgagcaactgtccggggcaaagcattgtaggaattacaagtttcgattccataaacctgaagaggctaacgaaccacccctcaatccccatggttctgctcgtgctgaggttcaccttcgtaagtccgcatttgatatgttcaatttcctcgcatctaagcaccgccagccacccgaatacaatcctaacgacgaagaagaggaggaggtgcagttgaagagtgcacgcagggcgacaagtatggacctgcccatgcctatgaggtttagacacttgaagaaaacatctaaagaggccgtgggggtgtaccgatcccctatccacggtcggggcctcttctgtaaacggaacatcgacgctggcgagatggtgattgagtatgcggggaatgtaattagatcaatccagacagataaacgggagaaatattacgatagcaaagggattggatgctatatgtttcggatcgacgattccgaggtggtggacgccacaatgcacggaaatgcagcgcggttcataaaccactcatgcgagcccaactgttactctcgcgtcattaacattgacggacagaaacatatcgtgatatttgctatgcgcaagatttacagaggggaggagctgacttacgactataaatttcccattgaagacgcttccaacaagcttccttgtaactgcggcgcaaaaaaatgcaggaaatttcttaactag

SEQ ID NO: 196028 - DNA, 8640 bp, Artificial Sequence
  Description of Artificial Sequence: Synthetic coding sequence
cacgcccaccccgagtgcctgaccatggagcgggagaagatcctgagtagcatgggaaacgatgacaagtccagtatcgctgggtccgaggacgccgaaccacttgccccacccataaagccaatcaaacctgtcaccaggaacaaagccccccaggagccccctgttaaaaaaggccgccgaagtaggcgttgtggccagtgtcctgggtgtcaggtgccagaagactgcggcgtctgtaccaactgtctggacaaaccgaaatttggtggccggaacatcaaaaaacaatgctgcaagatgcggaaatgtcagaacctccagtggatgccttctaaagcctacctgcagaagcaagccaaggccgttaagaaaaaggagaaaaagtccaagactagtgaaaaaaaggactcaaaggagtcgtcggtcgtgaagaatgtggtggactcatcacaaaaacctactcctagcgctagggaggaccctgcccccaaaaagtcaagttcggagcctcccccccgtaaaccagtggaggagaaatcagaagaaggaaatgtatctgcaccagggccagagagcaaacaggccacgaccccagcctcacggaagtcgagcaagcaggtctcccagcctgccctcgtgatcccaccccagccaccaacaaccgggccaccaagaaaggaggttcccaagaccacacccagcgagcctaagaaaaagcaaccacctcctcccgagtcgggccccgaacaaagtaaacagaagaaggtggcccctcgcccttcaattcctgtcaaacaaaagcccaaggagaaggagaagccaccgcctgttaacaagcaagagaacgccggtacccttaatatcctcagcaccctgtctaacggtaatagctccaagcaaaaaattccggctgatggcgtgcaccgcatacgagtggatttcaaagaggactgtgaggccgagaatgtctgggagatgggcgggctgggaattttgacttctgtccccataacaccccgggtcgtatgtttcctgtgtgcgtcgagcggacacgttgaattcgtatactgccaagtctgctgcgagcccttccataagttttgtctagaggagaacgaaagacccctcgaggaccagttagaaaattggtgctgtcggcggtgcaagttttgccacgtatgcggtagacagcaccaggcgaccaaacagttgttggagtgcaacaagtgccgcaattcctatcacccagagtgtttgggacctaattatcccaccaagcctactaaaaaaaagaaggtgtggatctgtacaaagtgcgtcagatgtaaaagttgcggcagtaccaccccaggcaaggggtgggatgcccagtggtcccacgatttcagtctgtgccacgattgcgcgaagcttttcgccaagggcaatttttgcccgctctgtgataagtgctacgatgacgacgattatgagtccaaaatgatgcaatgcggcaaatgcgatcgctgggttcattctaaatgcgaaaatctctcagacgaaatgtatgaaatcctgagcaatctgcccgagtccgtggcatacacatgcgtgaactgcaccgagcgccacccagcagagtggcggctcgccctggagaaggagctgcaaatctcactcaagcaggtattgacagctcttctcaacagtcggacgacgtcgcacctgctgaggtacaggcaggctgcaaaacccccggacctaaaccccgaaaccgaagagtcaattccatctcgaagctcccccgagggaccagatccaccagtgctaaccgaagtgagcaaacaggacgatcagcagcctttagatttggaaggagtgaagagaaagatggaccaaggaaactatactagcgtgctggaattcagcgacgacatcgtgaaaattatccaggccgccattaactctgatggcgggcaaccagagattaaaaaagctaacagcatggtaaaatcatttttcattaggcagatggagagagtgttcccgtggtttagtgtgaaaaagagtaggttctgggaacccaacaaggtctcctccaactctggaatgcttcctaacgccgttttgccccctagcctggaccacaactatgcccagtggcaagagagagaggaaaatagtcacaccgaacagcccccccttatgaagaagataataccagctcctaagccaaagggccctggggaaccagactctccaacacccctgcacccgcctacaccaccaattctgagtacagacagatcacgcgaagattctccagaacttaatcccccgcctggtatagaagataatcggcagtgtgcgctctgcctaacgtatggtgatgatagcgccaatgatgctggacggctgctttatattggacagaacgagtggacacatgttaactgtgccctctggtccgccgaagtcttcgaagacgatgatggtagcctgaaaaatgttcatatggccgttatacgcggaaagcagcttcggtgcgagttctgtcagaaacccggagccacagtcgggtgctgtcttacctcatgcacatctaactaccattttatgtgctcccgcgccaagaattgtgtgtttctggacgacaagaaagtgtattgccagcgacacagggatctcattaagggagaagtagtgcccgagaatggttttgaggtctttaggagggttttcgtcgacttcgaggggatctctctgcggcgcaaattcctgaatggtctggaacccgaaaacattcatatgatgattggctccatgacaattgattgtcttggaatcctgaacgatctgtctgattgcgaggacaagctgtttcccatcggatatcagtgctcccgggtctactggagtaccacagacgcaaggaaaagatgcgtttatacttgcaagatcgtggagtgtcgtcctccagtggtggaacccgatattaattccacagttgaacacgacgaaaaccggaccatcgctcactccccaacgtcgtttaccgagtccagcagtaaagagtcacagaatactgccgaaattataagtcccccttctcctgatcgcccaccccatagtcaaacatctggatcctgttattatcacgtgatttccaaggttcccagaattcgcacaccctcctatagccctactcagaggagcccaggttgccgcccactgcccagcgctgggtcccctactcctacgacacatgagatcgtgacggtgggtgatcccctcctgtcctcaggtctgcgctcaattggctcaaggcgacactctacttccagcctcagtccccaacgcagtaagcttcgcataatgtcccctatgcgtacggggaacacgtactctaggaataacgtctcgtctgtctcaactactggcacagctaccgatctcgaaagcagcgcaaaggtggtcgatcacgtgctgggccctctgaattcttcaacttcacttggccagaacacaagtacctctagcaacctgcagcgcacggtagtgactgtgggcaacaagaatagccatctcgacgggagttcaagctccgagatgaaacagtccagtgccagtgacctggtgtctaagtcttcctctctgaagggagagaaaaccaaggtgttatctagcaaaagctctgaggggtccgctcacaatgtcgcttaccccggcatacccaagttggcccctcaggttcacaataccacatcccgggagttgaacgtgtctaaaatcggatcattcgcggagccgtcatctgtgagtttttcttcaaaggaagcactatcatttcctcacctacaccttagagggcaacgaaatgatagagatcagcacactgatagtacccagtccgcgaattcatcaccagacgaggatacagaagtaaaaacgcttaaactgtctggaatgagtaatagatcctcgatcatcaacgaacacatgggctcatccagcagggaccgcaggcaaaaggggaaaaagagctgtaaagagactttcaaggagaagcattccagcaaatctttcttggagcccggtcaggtcacgaccggggaggaaggtaatttaaaacccgagtttatggacgaggtgttaacaccagagtatatgggccagaggccttgcaacaatgtcagctcagacaagattggagataaggggctgagcatgcccggtgttccgaaggcaccccctatgcaagtagaaggtagcgcaaaggaattgcaagcaccgcggaagaggacagtcaaagtgactcttacaccacttaaaatggagaacgaatctcagtccaaaaacgccctcaaggagtcttcgcccgctagccccctgcaaattgagtcaaccagccccacagaaccgatctcagctagtgaaaatccaggcgacgggccagtcgcccagcctagtcctaataacactagctgccaggattcacaatcaaataattatcagaaccttccggtccaggacagaaacctgatgctgcccgacggacctaagccccaagaggatggaagttttaaacggcgttaccctagacggtcggccagggctcgtagcaatatgttctttggcttaacaccactctatggcgtgcgcagttatggggaagaggacataccattctacagcagttcaactggaaaaaagcgagggaaacgctcagccgaaggccaggtcgatggcgctgacgacttgtccactagcgacgaggatgacttgtactactataactttacaagaacagtgatctcaagcggcggcgaggagagactggctagccacaatctcttcagagaggaagagcagtgtgatttgcccaaaatcagtcaactggacggcgttgatgacgggacagaatcggatacctcagttaccgctacaacacgcaaatcttcccaaatccctaagaggaatggcaaggagaacggtacagagaacctaaaaatcgaccggcccgaggatgccggagagaaggagcacgttacaaaaagtagtgtgggccacaaaaatgagcccaagatggataattgtcatagcgtctcccgcgtgaagacacaaggccaggactctttggaggctcagctctcctccctcgagtcctcccggcgtgttcacactagtactccctcagacaagaatctgcttgatacgtataacaccgaactattaaaatccgactctgacaataacaactctgacgattgcggaaacatcctgccaagtgacatcatggattttgtgctcaagaatacaccttccatgcaggccctcggtgagtcccctgaaagtagctcctccgaattactgaatctgggggagggactgggtctggacagtaaccgagagaaggacatgggcctatttgaagtattcagtcaacaactgcccaccaccgaacccgttgactccagcgtctcgagcagtatctcagcagaagagcagttcgagttgcccttggaactgcccagcgacctgagtgtgttgaccactagatctccaaccgtaccttcccaaaaccctagtcggctggccgttatatccgatagcggcgagaagcgagtgactatcactgaaaagtcggtggcatcctcagaatccgaccctgcactcctctcccctggagtggatccaacaccagagggacacatgactccagaccacttcattcagggacacatggatgcagatcatatttctagtccgccatgtggatctgtggagcaagggcacggcaacaaccaggatctgacgagaaattctagtacgcccgggctgcaagtccctgtttcacctactgtcccaattcagaaccagaaatatgtgcccaacagcacagatagcccaggacccagccagatttccaatgctgctgtgcagactacgcctcctcatctgaaacccgctacagaaaagcttatcgtcgtgaaccagaacatgcagccactttacgtgctgcagacacttcctaatggcgtcacccagaagatccagctcacaagcagtgtttcttccaccccttctgtgatggagaccaacacatccgtgctgggcccgatgggaggcgggctgaccttaactacgggactgaatcctagcctcccaacgagtcagtctctctttccgtcggcttccaagggcctgctgccaatgagccatcaccagcacctacactcatttcccgccgctactcagtcgtcgttccccccaaatataagcaatcctccgtccggactgctgatcggggtgcagccaccccccgacccgcagctgctggttagcgagagtagtcagagaactgatttgagtaccactgtggcgacacctagttccgggttgaagaagagaccgatctcaagactgcagacacgcaagaataaaaaactcgcgcccagtagcaccccatccaacatcgccccctcagacgttgtgagcaacatgacactcatcaatttcactccgtcacagctccccaaccacccaagtctgctggatctggggagtctcaacacatcttcccacagaactgtgcccaatattattaaacggtcaaagtcctccattatgtacttcgagcccgcccccctactgccacagtctgtgggcggcacagctgcaaccgctgcaggcacctcgactatctcccaagacacctcccatcttacctctgggagcgtcagtgggttagctagtagcagctccgttctcaatgttgtgtcaatgcaaaccaccacgacgccaacctcctccgcttcggtacctgggcacgtcactctcaccaaccctcggcttttagggaccccagatatagggtctataagcaacctgctgatcaaagctagccagcagtccttggggattcaggaccagcccgtggctctgccgccctccagtggcatgttcccacaactgggcacaagccagacaccatcaaccgccgctataaccgccgcttctagtatctgcgtgttacccagtacccaaactactggcatcacagcagcgtctcctagtggtgaggccgatgaacactatcagctacagcatgtgaaccagctgttggcctccaaaacaggcattcactcctcacagcgcgacctggacagcgcctccggaccacaggtctccaactttacccagaccgtggatgcacctaatagcatgggcctggagcagaataaggccctaagctccgccgtgcaagcctctcccacgtcaccaggtggatctccgtcgtccccaagctctggacagaggtccgcctctccttctgtccccggcccaactaagccgaagcctaagaccaagaggtttcagttgcccttggacaagggaaatggaaaaaaacataaggtttcccatctgaggacctcaagtagcgaggctcatattccagaccaggagaccacaagtctcacatctggaaccggaacgccaggagccgaagccgagcaacaagacacagccagtgtggaacagagctcccaaaaagaatgtggccaacctgccggccaggtggccgtgttgcccgaagttcaggttacccaaaaccccgctaatgagcaggagtctgccgagcctaagacggtggaggaggaggagtctaatttcagttctcccctgatgttgtggctacaacaagagcagaagaggaaagagtccattacagagaaaaagcctaagaagggtctggtgtttgaaatcagttctgatgatggtttccaaatatgtgccgaatccatcgaggatgcctggaagtccttgactgacaaggtgcaggaagcgcgctccaatgcccgcctgaagcagctgtctttcgccggagtgaacggccttcgtatgttaggcatcctccatgacgccgtagtcttccttattgaacagttgtcaggagctaagcactgcaggaattataaatttaggttccataagccagaagaagcgaatgaaccaccgctcaatccccatgggtccgcccgggcagaagtgcacctccggaagagtgcattcgatatgttcaatttcctggctagcaagcacagacagccacctgaatataaccctaatgacgaggaagaggaagaggttcagctcaaatcagctcgacgggccacttctatggaccttcccatgccgatgaggttccggcacttgaaaaaaacaagcaaagaggctgtgggggtctaccgctcccccatccacggtcgtgggctcttttgtaaacgcaacattgacgccggcgagatggtcatagagtacgctgggaacgtcatcagatctatccagacagacaagagggagaaatactatgattctaagggtattggctgttacatgttccgcatagatgactccgaagtcgtggatgctactatgcacggtaacgctgcaaggttcataaaccattcatgcgagccgaattgctattctagggtcatcaacatcgacgggcagaaacacatcgtgattttcgccatgcgcaagatataccgaggagaggaactgacctatgactacaagttccctatagaagacgcctccaataaactgccctgtaactgcggggctaaaaaatgccgaaaattcttgaattag

SEQ ID NO: 196029 - DNA, 11910 bp, Artificial Sequence
  Description of Artificial Sequence: Synthetic coding sequence
atggcccacagctgccggtggcggttccccgcccggcccggcaccaccggcggcggcggaggaggggggcgccggggcctgggcggggcccctaggcagcgtgtgccagccttactgttacctcccgggcctcccgtcggcggcgggggcccgggtgcacccccttcacctcccgctgtggccgccgcggcagcagccgctggctcctctggcgctggagtaccaggcggcgccgccgctgcgtcggcagcaagcagttcttctgcctcatcctctagttcctcgagcagctctgcttccagcgggcccgcactgctgcgggtgggacccgggttcgacgccgctctgcaggtttcagcagccatcggaacgaacctgagacgcttccgggctgtatttggcgagagcggcgggggcggtggttcaggcgaagatgagcagttcttagggtttggaagtgatgaggaagttagggtcaggagtccgaccagaagccctagcgtgaaaactagtcctaggaagccccgggggaggcccaggagtggttccgatcgcaactcagcgatcctttctgacccaagcgtgttttcccctttaaacaagtcggaaacgaaatccggagacaaaatcaaaaaaaaagatagcaagtctattgagaagaaacgaggcagacctcctacctttccaggtgtcaagattaaaataacacatggaaaggacatcagtgaactgcctaaaggcaacaaagaggattctctgaagaaaatcaagcggactcccagtgccacgttccagcaggctacgaagatcaaaaaactgcgcgcagggaaactgagccctcttaaaagcaagttcaagaccggtaagctgcagattgggaggaagggggtccagatcgtgcgccggcggggcagacctccatccacggagaggataaagaccccttctggcctcctcattaatagcgagctcgaaaagccacagaaagtgcgcaaggataaggaaggaacacccccactgacgaaggaggacaagaccgtggtcagacagagccctcgcaggatcaagcctgtgaggatcattccgagcagtaagaggaccgacgcgacaattgcaaagcagctgttgcagcgtgcaaaaaagggggcacaaaaaaaaattgaaaaggaagccgcccagctgcaaggccggaaagtcaaaacccaagtgaagaacatcagacagtttattatgcccgtcgtgagcgccatatcctccaggatcattaagactcctcgccgcttcatagaagatgaggactatgacccccctatcaagatcgcccggctggagtcgacaccaaattcgcgattctcagctcccagctgcggaagttctgagaaaagcagcgctgcctcacaacatagctcccagatgtcctcagacagcagtcgatcctcaagccctagtgtggataccagcacagattcccaggcgtcagaggaaatccaggtattgcctgaagagcggtcagacactccggaagtccacccgccactcccaatttcacaatctcccgaaaatgaatcaaatgatcgaaggtcacgccgctattctgtgtcggaacggtcctttggaagcaggacaacaaaaaaactgtctactctgcagagcgccccgcagcagcagacgtctagctctccacctccccccctgctcacacctcctccacccctgcagccggcttcatccatctctgaccacacaccatggctaatgccacctactatacctcttgcctcgcccttccttcctgcatccacagctccaatgcagggcaaacgaaaaagtatcctcagggagccaacctttcgctggacatcactaaagcattctcggagcgagcctcagtatttttccagcgctaagtacgccaaagaaggactcatcaggaagccaatttttgacaatttccggccacctcccctcacgcctgaagacgtcgggtttgcttcgggtttcagcgcctccggaactgcggcatccgccagattgttctctccccttcacagcgggacccgcttcgacatgcacaagaggtcaccactgctgcgcgcaccgcggttcactccatcagaagcccattccaggatattcgagagtgtaactctgccctcaaatcgaacgagtgctggcaccagttcctctggtgtgtcgaaccgcaaacgcaagcgcaaggtcttttctcctatccgctcagagcccagaagtcctagccatagcatgcgtacccgttcaggtcgcctcagttcatccgaattgtcacctcttacccccccgtcatcggttagctctagcctcagtatttctgtgtcccccttggcaacctccgcacttaaccccacatttacttttccttctcattcgctaacccagagtggtgaatccgccgagaaaaaccagcggcctcgcaagcaaaccagcgccccagcagagcctttttcctccagcagcccaacacccctcttcccttggttcactcctgggagccagacagagagaggccggaacaaagacaaagcccccgaggagctgtcgaaagacagagacgcggacaagagcgtagagaaggacaagagccgcgagcgcgatagggaacgcgagaaagagaacaaaagagagagcagaaaggaaaaacgcaagaaggggagtgaaatccaatcctcatccgccctgtatcccgttggtagagtgtcgaaggagaaggtggtgggggaagacgtggctaccagctcttctgcaaaaaaagcaacaggccggaagaaatcctcctcccatgacagcgggaccgatataacaagcgtaacactgggagacaccactgctgtcaaaaccaaaatcctcattaaaaagggccgcggcaatctggagaagaccaacctcgacttgggtccaacagccccctccctcgaaaaggagaagaccctgtgcctcagtaccccttcctcatctacagtaaagcactctacatcttcaatcggctctatgctcgctcaggcagacaaattgcctatgacagataagcgcgtagcctcacttctgaaaaaggccaaagcccaactgtgtaaaattgaaaaatcgaagagccttaagcagacagatcagccaaaggcgcaaggccaggagtccgatagctccgagacttcagtgagaggacctcgaatcaaacatgtttgtcgcagagctgccgtcgctctcgggcgaaaacgggccgtctttccagacgatatgccgactctctcggcgctcccctgggaagaacgcgagaaaattctttcatcaatggggaatgacgacaaatcatctatcgccggaagcgaggatgctgagccactcgcgccaccaattaagccaattaagcctgtgacgcggaacaaagccccccaggaaccaccagtcaaaaaaggtcgccgtagccgccggtgtggacagtgtcccggatgccaggtgccagaggactgtggagtatgcacaaattgcctggacaagccaaagtttggcggccgaaacataaagaagcagtgctgcaaaatgagaaagtgtcaaaacctgcaatggatgccttctaaggcgtatctgcagaaacaggccaaagcagtgaaaaagaaggaaaagaagtcgaagacatcagaaaagaaggattcgaaggagagcagcgtagtaaagaacgtcgtggatagctcccagaagccaaccccctctgccagggaggaccctgcaccaaaaaagagcagcagcgagcctccccctcgcaagccggtggaagagaagtcggaagagggtaacgtgagcgccccaggacccgagtccaagcaagcgactacacccgccagccgcaagagcagtaagcaggttagccagcctgctctggtcatacccccccaaccgccgacaactggacctcctaggaaggaggtgccaaagaccactccttcagagcctaaaaagaagcagcctcccccacctgaatcagggcccgagcagagtaagcaaaaaaaggtagctccccggccaagcatacctgtgaaacaaaagccgaaggagaaagagaaaccccctcctgtgaataagcaggaaaatgccgggaccctcaacatcctctcgactcttagtaatggcaactccagtaagcagaaaatcccagccgatggagtgcatagaatccgggtggactttaaggaagattgtgaggccgagaacgtctgggaaatgggtggcctggggatcctgacaagcgtgccgattaccccccgggtggtttgctttctgtgcgccagcagcgggcatgtggaattcgtgtattgtcaggtctgctgcgaaccttttcataagttctgcctggaggagaacgagagacctttagaggatcagcttgagaattggtgctgtaggagatgcaagttttgccacgtatgcggtcggcaacaccaggcgaccaaacaactgctggaatgcaataagtgcaggaactcttaccacccagaatgcctgggacccaattaccctaccaagcccaccaagaagaaaaaggtttggatatgtacaaaatgtgtacgctgcaagagctgcggaagcaccacccccgggaaagggtgggatgctcagtggtcccacgatttttctctgtgccatgactgtgctaagctctttgcaaagggtaacttttgtcctctgtgtgacaagtgttacgacgatgacgactatgagtctaagatgatgcagtgcggaaaatgcgatcggtgggtacactctaaatgtgagaatctctctgatgaaatgtatgaaattctttccaatttacctgagagcgtggcatatacatgcgtcaactgcaccgaacgacatcccgccgagtggcggctggctctggagaaagaattgcagatttctctcaagcaggtgctgactgcgttactcaactctaggaccaccagtcacctgctacggtatcgccaggctgcaaaacccccagacctgaaccctgagacggaggagtccataccatccaggagctcccccgagggaccagacccaccagtactgaccgaagtctctaagcaggatgatcagcagccacttgacctggaaggcgtgaagagaaaaatggaccagggaaattacacaagcgtcctcgaattctccgatgatattgtgaaaataattcaggcagccatcaacagcgacgggggtcaacccgaaataaaaaaggccaactccatggtcaagtctttctttattaggcaaatggagagggtctttccatggttctcagttaagaagtccagattctgggagccaaacaaagtgtcatccaattctggcatgcttcccaatgcagtcctgccaccctctttagaccacaactacgcccagtggcaggagcgggaggagaatagtcatacagagcagccgcccctgatgaagaaaattatccctgcacctaaaccgaagggtcctggagagccagactcgcccacccccctccaccccccaacaccaccaatcctctccactgatcgttcaagggaagactcacctgaactgaaccccccgcccggcatagaggacaacaggcaatgtgccctgtgtttgacctacggcgatgacagcgctaacgatgccggacggttactctacattggccagaacgagtggacacatgtcaactgcgccctctggagcgctgaagtttttgaggatgacgacggctccctcaagaacgtccatatggccgtcattcgcgggaagcagctgaggtgtgagttttgccagaaacctggggccacagtgggctgctgcttgacgtcatgtacatctaactatcactttatgtgtagtcgggccaaaaattgcgtattcctggacgacaaaaaagtatattgccagagacatagagacctcatcaagggggaagttgtgcctgagaacggcttcgaggtgttcaggcgggtctttgtagacttcgaagggataagtctgcggcgcaagttcctcaatggtctcgaacctgaaaacatccatatgatgatcgggtccatgactattgattgcctcgggatactgaatgatctgtctgactgcgaggataaattgttccccattgggtaccagtgcagcagagtgtactggagtaccaccgacgctcgcaagcggtgcgtgtatacttgtaagattgtggagtgtaggcccccagtcgtagagccagacatcaattccacagtggaacatgatgagaatcgcacgatcgcacactctcctacaagctttaccgagagctcatctaaggagagccagaacacggccgagattatcagccccccctcccctgataggccaccccattctcagacatcagggtcatgttattatcacgtgataagcaaagtgcccaggatccggacaccaagctattcccctacgcagagaagcccaggctgtagacccctaccctccgcaggctcaccaacgccgaccacacacgagatcgtgaccgtgggcgatccactcctgtccagcgggcttagatcgatcgggagccgacgccacagcacatcaagcctgtcaccacagcgaagtaaactacgcatcatgtcccccatgcgaaccggtaacacttattctcggaacaatgtaagtagtgtgtctacaaccggcaccgccacagatctagaatccagtgctaaagtcgtcgatcacgtgcttggacccctaaactcctccactagcctgggtcaaaatactagtacgtcctcaaatctgcaaaggacggttgtgactgtaggcaacaagaactctcatcttgatgggagctcttcatcggagatgaagcagtcctccgcttccgatcttgtctctaagagttcatccctaaagggggagaaaactaaggtcttgtctagcaagagtagcgaagggtctgcgcacaacgtagcctaccctggaattcccaagctggccccgcaggtacacaatactactagccgcgaattaaatgtatccaagataggcagcttcgccgagcccagtagcgtttccttcagctcaaaagaagccctgagtttccctcaccttcatctgcgcggtcagagaaacgaccgggatcaacataccgattccacacagtctgccaactcttcaccggacgaggataccgaggtgaagacacttaagctctctggaatgtctaacaggagctccattatcaatgaacacatggggagcagtagtcgggaccggagacagaaaggcaagaaatcgtgtaaggaaactttcaaggagaaacacagtagcaaatcctttctcgagcccggtcaggtgacaaccggtgaagagggcaatctgaagcctgaattcatggacgaagttctaacccccgagtatatgggacagagaccttgcaacaatgtgtcctcagataagatcggagataagggtctgtccatgcccggcgtaccaaaagctcctcccatgcaagtcgaagggtccgctaaggagttacaggctccccgcaagaggactgtcaaggtgacactgacacctctaaaaatggagaacgaaagtcagagtaaaaatgcgctaaaggagagctcacccgcatcccccttgcagattgaatccactagccccaccgaaccgataagtgctagtgagaacccaggagatggccccgtcgctcagccgagtccgaataataccagttgtcaggatagccagtccaataactatcagaacctgccagtgcaggacaggaacttgatgctgccggatgggccaaaacctcaggaagatggcagctttaaacgccgctatccacgccgcagcgctcgcgctaggagcaatatgttcttcggcttgacgcctctttatggcgtcagaagctatggtgaagaggacattcctttctacagttccagtaccggaaaaaaacgcggcaaacggagcgccgagggccaagtggacggcgccgacgatctgagcacctccgatgaagacgacctctactattacaatttcaccagaacagtgatctctagcggcggtgaagagcgacttgctagtcataaccttttcagagaggaggaacagtgcgacctcccaaaaatcagccaattggacggcgtcgacgatggaacagagtccgacacgagcgtgaccgctaccactcgcaaatcctcccagatcccaaagcgaaatggtaaggaaaatggaactgagaatctgaagattgatagacctgaggatgcgggagagaaggaacacgtgaccaagagtagcgtagggcacaaaaacgagccaaagatggacaattgtcattccgtgtctcgagtgaagacccaaggacaggattctctggaggcgcagctgtcttcactggagtcctcaagacgagtgcacaccagtacacccagcgacaagaaccttttggatacttataatacggaactgttgaagtctgacagcgataataataatagcgatgattgcgggaacatcctgccttctgacatcatggacttcgtccttaaaaataccccctccatgcaggccttgggagagtctccagaaagttcatcatcagagctcctgaacctgggggaaggccttggtcttgactccaatagggaaaaagacatgggcctgttcgaagttttctcacagcagctgccgacgacagagccagtagactcatcggtgagctctagcatctcggcagaggagcagtttgagctgccactagaactaccaagtgacctaagtgtactcactacccgctcaccgacggtaccaagccaaaatccttcccgactggccgttatctcagactccggagaaaaaagagtcacaattaccgaaaaatctgtggcatcttccgagagcgaccctgctcttctttctcctggtgtggatccgactccggaaggacacatgacgccagatcactttatccaaggccacatggacgccgatcacatcagcagtcccccatgcggctccgtcgaacaggggcacgggaataatcaggatctgaccaggaattcctccacccccggactccaggttcctgtgtcccccactgtgcccatccaaaaccagaaatacgttccgaacagcactgattccccgggaccatcgcagatctctaacgctgctgtacagaccacaccgcctcaccttaagcctgctaccgaaaagcttattgtggtgaatcagaacatgcaacccttgtatgtcctgcaaacactgccaaacggagttactcagaaaatccaattaacttcatccgtgtcctctactccaagcgttatggagacgaacacctcagtgctgggtcctatggggggtggccttacccttacaacaggtctgaatcctagtctgcccacttctcagtcactatttccaagcgcctccaagggactactgccgatgtcccaccaccagcatctgcattccttccccgccgccacgcagtctagtttccccccaaacatctctaacccacccagtggactcctaatcggcgttcagccacctcctgatccacaattgctcgtgagcgagagttctcagcgaacagatcttagcacaacagtggccacccccagctctgggctgaagaaacgacccattagccgcctacagacacgcaagaacaaaaagcttgccccatcgtcaactccctcaaacattgccccaagtgacgtggtatcaaacatgaccctcattaacttcacaccttcacagctgcctaatcatccatccctcttggatttggggtctctcaacacctcctctcatcgtactgtgccaaacattattaaacggtcaaagtcctctattatgtacttcgagcctgcaccgctgttaccccagagcgtggggggtactgccgccactgcagcaggaacatcaacaatttctcaggatacgagtcacctaacatctgggagcgtgtcaggcctggcctcaagctcatcagtgcttaacgtagtgtctatgcaaacaaccaccacacccacaagctccgctagcgtgcccggccacgtaactctgacaaatcccagactgctcggaactcccgacatcgggagcatctccaacttactgatcaaggcttcccagcagtcgctgggcatccaagaccagccagtcgccctgccaccctcatccggtatgtttccgcagttaggaacgagtcagaccccctccactgccgctatcacagcagcatccagtatctgtgtactcccatctacccagacgacaggaatcacagcggcctctccatcaggagaagccgatgaacattaccaactgcagcacgtcaatcagctgctggcatcaaaaacaggcatccatagcagccagcgcgaccttgacagcgcttctggtcctcaggtgtcaaactttacacagaccgttgacgctccaaacagcatgggcctggagcaaaataaggcgctgtcaagcgccgtccaggcttcccccacgtctccaggtggctcaccctcctctccttccagcggccaaaggtccgccagtcccagtgtacccggccctaccaaacccaaacccaaaaccaaacgtttccaactgcctctcgataaaggcaacggcaaaaaacacaaagttagccatttgagaacttcctcatctgaagcccatatcccggaccaagagaccacaagcctaacaagcggaaccgggaccccgggggccgaggcggagcagcaggatacagcgagtgttgagcagtcttcgcaaaaggagtgcggccagccagcaggccaggtggccgtgttacctgaagtgcaggtaacacagaatcccgcaaatgagcaagagtcagcggaaccgaaaacagtggaggaggaggaatccaacttcagcagtcccctcatgctgtggctgcagcaagaacagaaaagaaaagaaagcattaccgagaagaaacctaaaaaggggctcgttttcgaaatctcttccgacgacgggttccagatctgcgccgagtcaatcgaggatgcttggaagtccctcaccgataaggtgcaagaagcccggagtaacgcaagattaaagcagctctcgttcgcaggagtcaatggcctgcgcatgctgggaattcttcatgatgcagtggtctttctcatcgagcagctttccggcgcaaaacactgccgaaactataaatttaggtttcacaaacccgaggaagctaacgaaccgccccttaacccacatggctccgccagggccgaagtgcacctgagaaagtctgctttcgatatgttcaattttctggcctctaagcatagacagcccccagagtacaatccaaatgacgaagaggaggaagaggtccagttaaagagcgcaaggcgggcgacgtcaatggatctaccaatgcctatgaggtttaggcacctcaaaaagacaagcaaggaggcagtaggggtgtatcgatcacctatccatgggaggggcttgttttgtaaacgcaatatcgacgctggggagatggttattgagtacgccgggaatgtcatccgcagcatccagaccgacaaaagagagaaatattacgatagcaaggggataggatgttacatgtttaggattgatgactctgaagtagtcgatgccacaatgcatggtaatgccgcaaggttcattaaccactcttgcgaacccaattgctatagccgtgtgattaatatcgatgggcagaagcacattgtgatttttgccatgaggaagatttaccggggcgaggaactgacttacgactacaagttccctattgaggacgcatccaacaaactcccatgtaattgtggagccaaaaagtgtcgcaagtttttgaattag

SEQ ID NO: 196030 - DNA, 336 bp, Artificial Sequence
  Description of Artificial Sequence: Synthetic coding sequence
gacttcaaggacgagcagttcctgggcttcggcagcgacgaggaggtaagagtaaggagccctaccagaagtccgtctgggtccatgctggctcaagcagacaagttaccaatgacagacaagcgggtcgcatccttgttgaagaaggcaaaggcccagctgtgcaaaattgagaagagcaagtctttaaaacagacggaccagccgaaggctcagggccaggaaagcgatagttcagagacctccgttcgaggcccccgcatcaaacacgtgtgccggagggcggcagtagcactcgggaggaaacgggccgtattccccgatgatatgccctag

SEQ ID NO: 196031 - DNA, 4320 bp, Artificial Sequence
  Description of Artificial Sequence: Synthetic coding sequence
atggcccacagctgccggtggcggttccccgcccggcccggcaccacaggcggcggtggcggtggaggacggcgagggctcggtggggctccccgccagcgagttcccgcccttctgttgccccctgggcctcctgtgggagggggaggcccgggggctcccccttcaccacctgccgttgccgcggctgccgcagctgctgggtcctcaggggctggcgtccccggcggagctgccgctgccagcgccgcttcgagctcttccgcctcctcaagctccagtagcagttcctccgccagctccggacccgcactgcttcgggtcggccctgggttcgacgcggccctgcaggtttctgccgcgattgggaccaatttgcgccgttttagggcagtttttggcgagagtggggggggcggcggctcgggggaattgactacccagattccttgtagctggagaactaaagggcatatccatgataagaagaccgagcccttccgcctccttgcatggtcatggtgcctgaacgatgaacagtttctaggatttggctcagacgaagaagtgcgggttcgatcccccacgcgcagcccatctgtgaagacctctccaagaaaacctcgggggaggccacgatccggcagcgacaggaacagcgcgatcctgtcggacccatccgtgtttagccctcttaacaaaagtgagactaagtccggtgacaagataaaaaaaaaagattccaagtcgattgaaaaaaagaggggacgcccaccaaccttccccggagtaaagatcaaaattactcacggaaaggacatcagtgagttgcccaaaggcaataaggaggactctctgaagaagattaaacgcacaccatcagccaccttccagcaggccaccaaaatcaaaaaactgcgggcagggaagctttctcccttaaaaagtaagtttaagactggaaaattacagattggacggaaaggggtccagattgtcagaagacgcggcaggcctcccagtaccgagcgcattaaaactcccagcggcctactgattaattccgaattagagaaaccgcaaaaggtcaggaaagataaagaaggaaccccacctctgacaaaggaggataagaccgtagtgcggcagtcaccaaggagaatcaaacccgtgagaataatcccatcttctaagcgcacagatgcaactattgcaaagcagttactgcaacgcgccaagaagggcgctcaaaagaagatcgaaaaggaggccgcccagttgcagggccgcaaagtgaagactcaggttaagaacattcggcagtttataatgcctgtcgtctccgcgatctcaagcagaataatcaagacgccacgccggtttatcgaagacgaagactatgaccctccaatcaaaattgcccggctggaaagcacgccaaattcgagattttcagcgccatcttgcggcagttcagaaaaatcttccgccgcctcccagcacagttcacaaatgagtagcgactccagcaggtcttctagccccagcgtggacaccagtaccgattctcaggcctccgaggaaatccaggtgctgcctgaagagagaagtgatacgccagaagttcacccaccgcttcccataagtcagagtcccgagaacgaaagcaatgaccggagatctcgcaggtatagcgtgtctgagcgttctttcggttctcgcaccacaaagaaactgtctacattacagagcgcacctcagcaacaaacgagttctagcccccctccacccctgctcactcccccgcctcctctgcagcccgcatcctcaatttcagatcacacaccttggctgatgccacccaccatccctcttgcctctccattcctgcctgcgtctaccgcgcccatgcaggggaaacgcaagtccatcttaagagaacctacatttcgttggacgagcctcaagcatagccgcagtgagccacagtacttttcctccgcgaaatatgcaaaagagggccttattaggaaacccatcttcgataacttcagacccccccctctgacacctgaggacgtggggtttgcctccggattttccgcctctggtacggcggcgtccgcccgtctgttttctccattgcactccggcacaagattcgatatgcataagcggagtccccttctgagagctccgaggtttacaccatctgaggctcacagccgcatttttgagtctgtaaccctgccttctaaccggactagcgcaggtacttctagctccggtgtgtcaaaccgaaaacggaagagaaaagtgttttcgcctatacggagcgaaccaaggagcccaagtcactccatgagaaccaggagtgggaggctgagctcttccgagttatcccccctgacaccccctagttccgtatcctcgtctcttagcattagcgtgtcacccctggccacatcagccctcaatcccacatttaccttcccaagccacagtttaacccagtcaggcgagagtgccgaaaaaaaccagaggcccagaaaacaaacatcagcgccggcagaaccattctcaagctcgtcgccaacacccctctttccttggtttacccctggctcccagacggaaagaggacggaataaggataaggccccagaggagctgtcaaaagaccgtgacgctgacaagagtgtggaaaaagataaatcccgcgagcgcgaccgggagcgggagaaagaaaataagcgcgagtcacggaaggagaaaaggaaaaagggaagcgagatacagagctcgtccgctctctatccagttggacgcgtgagcaaagagaaagtggtcggcgaggatgtcgctacttcctcaagtgcaaaaaaggccactgggcgcaaaaaaagttcaagtcatgactccggcaccgacatcacttctgtgactctaggtgacactactgccgtcaagactaagatcctgataaagaaagggcggggcaacctggagaagaccaacctggatctaggtcccacagccccaagcctggaaaaggaaaagaccctgtgcttgtctactccttcttcctcaacagtgaaacacagcacatcaagcatcggctccatgctggcccaggccgataagcttccaatgactgacaagcgcgtagcatcattgttaaaaaaagccaaggcccagctttgtaaaatcgaaaaatcaaagagcctaaagcagaccgatcagcctaaagcgcaggggcaagaaagtgactcgtccgagaccagcgtgcgtgggccccggatcaagcatgtctgtaggcgggcggcagtagctctggggagaaaaagagccgttttcccggacgacatgccaactctgtctgccctgccttgggaggagagagagaaaatactcagctcaatgggcaacgacgataagtcatctatcgctggctctgaggatgctgaacctctggccccgccgattaaacccatcaagcccgtcacaaggaataaggcccctcaagaacctcccgtgaagaaagggaggagaagtaggcggtgcggccagtgccctggctgtcaggtccccgaggattgcggagtgtgcacgaattgcctggataagcctaagtttggcggcagaaacatcaagaaacagtgctgtaagatgcggaaatgccaaaatctccagtggatgccatctaaagcctatctccagaagcaggcgaaggccgttaagaagaaagagaagaaatcaaagaccagtgagaagaaagacagcaaagaaagctcggttgtgaagaacgtagttgattcgtcccagaagcctacaccttctgcccgtgaggatccagcgcctaagaagtcatcaagcgagcccccccctagaaaacccgtggaagaaaagtctgaggagggcaatgtttctgcaccgggtccggagtcgaaacaggcaacaacccccgctagccggaaatcgtctaaacaggtgagccagcctgccttagtaatacctcctcaacccccgactacaggtcccccacgaaaggaagtcccaaaaacaacccccagcgagcccaagaagaagcaacctcccccccccgaaagcggcccagaacagtcaaagcagaaaaaggtcgcaccgcggccgtctatccctgttaagcagaagcccaaggaaaaagagaaacccccccctgtcaacaagcaggaaaacgcaggcacactaaacattctgtcaacgttaagtaatgggaacagtagtaaacagaagatccctgctgatggagtgcataggattcgggtcgacttcaagtag

SEQ ID NO: 196032 - DNA, 11919 bp, Artificial Sequence
  Description of Artificial Sequence: Synthetic coding sequence
atggcccacagctgccggtggcggttccccgcccggcccggcaccactggaggtggaggaggcgggggtaggaggggcctgggcggagcccctcgacagagggtgccagctctgcttctccctcccggccctccggtcggaggcggcgggcccggggcacccccctctccgcccgccgtggccgccgccgcggctgccgcgggttcatcgggagcgggtgtgcctggcggagccgctgccgcaagcgccgccagcagctcaagcgcatcttcttcatccagctcaagctcctccgcatcctcaggccccgccttgctgagagttggcccgggcttcgacgccgcgttgcaggtgtctgcagcgatcggaactaaccttaggaggttccgcgctgtgttcggcgaaagtggcggtggaggaggctctggtgaggacgaacagtttcttggtttcggctccgacgaagaagttcgcgtacgatcacccactaggagcccgtccgtgaagacctcacccagaaagccgaggggccggcccagaagcggatccgacagaaatagtgcaatcctgagcgacccatccgtgtttagccctctcaacaagagtgagaccaagagtggcgacaaaattaaaaagaaggatagtaagtctattgaaaagaaacgaggccggccacctacatttcccggagtcaagatcaagattacgcacggcaaggatatctctgaattacccaagggaaacaaggaggatagccttaagaaaattaagcggacaccaagtgccactttccagcaggccaccaagattaagaaactacgcgctggaaaactctctcccctgaaaagcaaattcaaaaccggaaaacttcagattggcagaaagggagtgcagatcgtgcgcagacgtggccgacctccgtcaacagagagaatcaagacaccttccgggctcttaatcaattccgaactcgagaaaccacagaaggtgcgtaaggataaggaggggaccccacccctcactaaggaggacaaaaccgtggtgaggcagtctccaaggcggattaagccggtccggattataccatcttctaagcgcactgatgctaccattgccaaacagctgctacagagggccaagaagggagcccagaagaaaattgagaaagaggcagctcaactgcagggccggaaagtgaagactcaagtgaagaatattcgccagttcataatgcccgtggtctccgctatcagttcccgcatcattaagaccccccgccggtttatcgaggacgaggattacgacccccccattaagatcgcccgattggagtctactcctaactcaagattttcagcgcccagttgtggctcaagcgagaaatcgagcgcagccagccagcactccagccagatgagtagtgatagcagtcggtccagttctccatctgtcgatacatctaccgacagtcaggcttctgaggaaatacaggtactgccggaagaaaggagcgataccccggaagtgcatccccctttacctatttcccagtctcctgagaacgagtcaaatgacaggaggagcagacggtactccgttagcgaacggtcgtttggcagccggaccactaaaaaactgagcacactgcaatccgctccacagcagcagactagttcatcaccccctcctcccttactgacgcctccgccacctcttcagccagcatctagtatctccgatcacacgccctggctgatgcctccaactattcccctggcctcaccttttctgcctgcaagcactgctcccatgcaagggaaaagaaagagcatcctgcgtgaaccaacttttaggtggactagtctcaaacactcgcgttcagagccccagtatttcagtagtgcaaaatatgcgaaggagggattaattagaaagcctatatttgacaattttcggcctcctccgttgactcctgaggacgtgggtttcgcaagtgggtttagcgcttccggcacagcagcttccgcccgtctattctcacctctccattcaggcacccgcttcgacatgcacaaaagaagtcctcttctgcgtgcgcccagattcactccaagtgaggcacacagtcgtatctttgagtccgtaacgctgccctctaaccgaaccagcgctgggacttcaagtagcggcgtgagtaatcgcaaaaggaaacgaaaggtgttttccccaatccgtagtgaacctcggtcccctagtcactctatgagaactcgctctggacggctctctagctcggaattgtctcccctgaccccaccctcctctgtctcctcctcgctgtcaatttccgtctcacctctggccacttctgcccttaatccaacattcacattcccatcacatagcctgacgcagtccggtgagagcgcggagaaaaatcagcggcccagaaaacagacttcagctccagcagagccattctccagtagttccccaacacccctcttcccctggttcacccccggctctcaaaccgagagaggccgaaataaggacaaagcacccgaggaactttccaaagatcgggatgccgataaatctgtagagaaggacaagtcaagggagcgagaccgggagcgtgaaaaagagaacaagcgtgagtcccggaaagaaaagaggaagaaggggagcgagattcaatcttctagtgctctgtatcctgtcggtcgggtctcaaaagaaaaagtagtaggggaggatgtggccactagcagttcggccaaaaaggctacaggaaggaagaaatccagctcacacgacagcggaacggatataacctccgtcactctgggcgataccaccgcggtgaagaccaaaattctgatcaaaaaaggccgtgggaacttggagaagacgaatctcgatctcgggcctaccgcccctagtctggaaaaggaaaaaactctgtgtctttccacccctagctcttccacagtgaagcacagtaccagtagcataggctcaatgctcgcacaggcagacaaactccccatgactgacaaacgggttgcatcccttctcaaaaaggccaaggctcagctatgcaagatcgagaagtcaaagtcgcttaaacaaacagaccagcctaaagcccagggccaagagagcgacagtagtgaaacgtccgtgagaggtccgcggatcaaacacgtttgtcgtagagcggccgtagcactcggtaggaaaagggcagtttttcccgacgatatgccaaccctgagcgcactcccgtgggaagaaagagagaagattttatcttctatggggaatgacgataaaagttctatcgccggatctgaggacgctgaaccactggccccacctatcaagccaatcaaacccgtgacccggaacaaggctccccaggaacccccagtcaagaaagggcgtcggtccagacggtgcgggcagtgtcccgggtgccaggtcccagaggactgtggggtctgcactaactgcctggataaaccaaagttcggaggcagaaacatcaaaaagcagtgttgtaagatgagaaagtgccagaatttacagtggatgccctccaaggcatatcttcaaaagcaggccaaggctgtaaagaagaaggagaaaaaatcaaaaacaagtgaaaaaaaagacagtaaagagtcaagcgtggtaaagaatgtcgtcgatagttcacaaaagcccaccccgtctgcaagggaagacccggcgcccaagaagtcaagttccgagccccctcctaggaaaccagtcgaagagaagtctgaggaaggcaacgtcagtgcccctgggcccgaaagtaagcaagccactaccccagcaagtcgcaagagtagcaagcaggtttcccaacctgcgctcgtcatccctccccaacctccaaccaccggacctccccgaaaagaggtacctaagacaaccccatcggagccgaaaaaaaagcaacctccgccccctgaaagtgggcccgaacagtctaagcagaagaaggtcgcgcccagacctagcattccagtgaagcagaagcccaaggaaaaggagaaacctccccctgttaacaagcaagagaacgcgggtaccctgaacatcctgtccacgctgtctaacggcaattctagcaagcaaaagatccccgccgatggcgtgcaccgcatcagagttgattttaaagaggactgcgaggccgaaaacgtatgggagatgggaggactaggaatcttaacttcagttcccatcactcccagagtggtgtgtttcctgtgcgccagctcgggtcatgtggagttcgtgtattgtcaggtgtgctgtgagcctttccataaattttgtttagaggagaatgagagaccactggaggatcagcttgagaactggtgttgcagaagatgcaaattctgccatgtatgcgggcgacagcaccaggccacaaagcagctgctagaatgtaataagtgtcgtaacagctaccaccctgagtgtctgggccctaattaccccacaaaaccaactaagaagaagaaagtctggatctgtaccaagtgtgtccggtgcaagagctgcggttccacaacacccgggaagggctgggatgcgcagtggtcacacgacttttctctctgccacgattgcgccaaactatttgccaaggggaatttttgtccactgtgtgataagtgctatgatgacgatgactacgaatcaaaaatgatgcagtgtggtaagtgtgacagatgggtccacagtaagtgtgaaaaccttagcggaaccgaggacgagatgtacgagatcctgtctaacctacctgagtctgtcgcgtacacatgcgtaaattgtacagaacgccatcctgccgaatggaggcttgccctggaaaaggaacttcagatttccctgaaacaggtgttgaccgcattgctgaattcacgaaccacgtcccaccttttgaggtatcggcaggctgcaaagcctccagatctgaaccctgagaccgaagagtctatccccagtagatcctccccggagggccccgaccccccagttctcacggaagtgtccaaacaggatgatcagcagccgctggatctggagggcgtgaagaggaaaatggaccaaggaaattacacatccgtgctggaattctccgacgatattgtcaaaatcatacaggccgccatcaactccgacggtggtcagcccgaaataaagaaagcgaacagcatggtgaagagcttttttatccgtcagatggagcgggtttttccctggttttctgtaaaaaagtcccgcttctgggaacccaacaaggtcagctctaattctggaatgctcccaaatgccgtactgcctccaagcctggaccacaattacgcccagtggcaagagcgggaggaaaacagccatactgaacaaccgccactgatgaagaaaataatccccgccccaaaacccaagggccctggtgaacctgactcgccaaccccgctgcatccaccaacaccacccattctgagcacggatcgctctagagaagatagtcccgagcttaacccacctcctggtattgaagataacagacagtgtgccctatgtcttacatacggggacgacagcgcaaacgacgctggacggttgttgtacattgggcagaacgagtggacgcatgttaactgcgcgttgtggtcagccgaggtattcgaagatgacgacggaagtttgaagaacgtgcatatggctgtcatacgggggaagcagctgagatgcgagttctgccagaaacccggtgccactgtcggctgctgtttaacctcatgtacctcgaattatcatttcatgtgttctagagcgaaaaactgcgtgttcctcgatgataagaaggtgtattgccagcggcatcgcgatctgatcaagggcgaagtcgttccggagaacggcttcgaagtttttaggagagtgtttgtggactttgaagggatttcactgaggagaaagtttcttaatgggttggaacccgaaaacatccatatgatgatcggcagtatgacaatcgattgcctgggtatcctgaacgacctgtccgattgcgaggacaaactctttcctatcggctaccagtgttcaagagtgtattggtctacaactgatgctaggaagagatgcgtttatacttgcaagatcgtggagtgccgcccaccagtggtggagcccgatatcaattctactgtggaacacgacgagaaccgcacaattgcacacagtccgacaagtttcacagaatcttcaagtaaggagtcacagaatactgcggagatcatcagtccaccatcgcctgaccggcccccccatagccagacctctggttcttgctattatcacgtcatcagtaaggtgccacggattcgcacaccttcctattcaccaacacagcgtagcccaggttgtcgtcccctccctagcgctggatcacccacaccaactacccacgaaattgtgacagtcggagatccgcttttgagttctgggctccgatcaatcggcagtcggaggcactcaacttcatctctgagccctcagcgatccaagctcaggattatgagccctatgaggactgggaatacctactcaaggaataacgtcagtagcgtcagcacgaccggaactgccacggatctggaatcctcagctaaagtggtggatcatgtgctgggcccgctgaactcatccacttctcttggtcaaaacacatccacaagttcaaatctccagaggactgtggtgactgtcgggaataaaaatagccacttggacgggagttcatcctccgaaatgaagcagtcgtccgccagcgacctggttagcaagtcaagcagcctaaaaggtgagaagacgaaggtcctttccagcaagtccagcgaggggtctgctcacaacgtcgcctaccccggcatcccaaaattggccccccaagtgcacaacaccacttcccgcgagctcaatgtgagtaagatcgggagttttgcggagccctctagcgtcagcttcagcagtaaggaggcgctgagttttccccacctgcatctacgcggtcagagaaacgacagggaccagcacaccgacagtacgcaatcagcaaacagttccccggacgaagatactgaagtgaaaaccttgaagctgagcggcatgagcaacagaagctccatcattaatgagcacatggggagtagttctagggacaggcgccaaaaaggtaaaaaaagctgcaaggaaactttcaaggagaagcacagttccaagtccttcctcgaacccgggcaggtcacaaccggagaggagggcaatcttaagccagagttcatggacgaggtactaacacctgagtatatgggccagagaccatgtaataatgtaagcagtgacaagatcggcgacaagggcctttccatgccaggagtgccgaaagccccaccaatgcaggtcgagggaagcgctaaggagctgcaggctccgagaaaacgcacagtcaaagtgacacttactcccctgaaaatggagaatgagtcacaaagcaagaacgcactaaaggagtcgagcccagcttccccattgcagatagagagcactagccccaccgaacccatcagcgcctccgaaaacccgggggatggcccagtagcacagccctcccccaacaacacctcctgtcaggactcacagtctaacaactaccagaacctgcccgtgcaggaccgcaacctgatgctgcctgacggacccaagcctcaggaggatggctctttcaagcggcgttacccccgacgatcagctcgcgctcgaagtaacatgtttttcggcctcacccccctctacggggtgcgatcctatggagaggaggatataccattttattcctcttccaccggaaaaaaacgcggcaagcgctcagccgagggccaggtcgatggtgccgatgacctgtcaactagcgatgaggacgatctgtactattataactttacaagaacggtgatttcctccgggggagaagagcgactcgccagtcataacttattccgcgaagaagaacagtgtgatttacctaagatcagtcagttagacggggtagatgacggtacagagtccgatactagcgtcacagccacaacccggaagagctcacagattccaaagcggaatggcaaagagaacggaactgagaacttgaagatcgatcgacccgaggacgcgggcgagaaagagcacgtgaccaagagctctgtgggccataaaaacgaaccaaaaatggacaactgccactctgtgtctagggtcaaaacgcagggtcaagattctctcgaggcacagctgagtagtctcgagagtagtagacgcgtgcacacctcaacacccagcgataagaatttgctggacacatataacactgagttgttgaaatccgattctgataacaacaatagcgatgattgcgggaatatactgccctcagacataatggactttgttttaaaaaatactccttcaatgcaggctttaggagaatcacctgaatcatcaagttcagaactgctgaatcttggggagggcttgggcctggactccaaccgagaaaaggacatgggtctgttcgaagtgtttagccagcagctgcccacaacagaacccgtagattcctccgtatccagttctatctccgctgaagagcagttcgagctgccattagagctgccttccgatctcagcgtcctgacaaccaggtcccccactgtgccctcacagaatccttctcggctcgcagtgatcagcgactcaggtgaaaagcgggttacaattacggaaaagtcagtcgccagttccgaatctgacccagccttgctgtctcctggcgttgatcccacgccagagggacatatgacaccagatcatttcatccagggtcacatggacgctgatcacatatcttcccctccctgcggatcggtcgagcaggggcacggcaataaccaagacctcacgagaaattcatctacacccggactgcaggttccggtctctcccacagtgcccatccaaaaccagaaatacgttcccaacagcactgacagccctggtcccagccaaatctcaaatgcagccgtacagaccacccccccgcacctgaagcctgccacagagaagttgatcgtcgttaatcagaacatgcagcccttgtatgtcctccagactctgcctaacggggtcacgcagaaaatccagctcacttctagcgtgtcctctacaccttcggtgatggagaccaacacatctgtgctgggaccaatgggtggtggacttactcttactacgggactgaacccatccctgccaacctcacagagcctttttccttctgccagcaaaggactgctcccaatgtcccaccatcaacacctgcactcatttcccgccgccactcagagctcctttccacccaatatttccaatccgccttcaggactgctcattggtgtgcagcctccaccggacccccaacttctggtgtctgaatcctctcagaggaccgatctaagtaccaccgtggccaccccttcgtcggggctcaaaaaacgacctatcagcagattacaaacacgtaaaaacaagaagctcgctccaagctctaccccaagcaatattgcccctagcgacgtggtgtccaacatgaccctcataaattttacacctagtcagctgcctaatcaccctagcctgctggatctaggaagtctgaacactagcagtcaccgtacagtgcctaacataatcaaaagatcgaaatcatctatcatgtatttcgaaccagcccccttactgccacagtcagttggcggtacggctgctacagcagctggaactagcactatttcccaggatacctctcaccttacatccggctcagtgagcgggctcgccagcagcagtagtgtgctgaatgtggtcagcatgcagacaaccactacccccacgtcttccgcttccgtacccggccatgtcactctgacaaatcctcggttgctgggtaccccagatatcgggagcatcagcaaccttctgatcaaggcgagtcagcagtccctcggaattcaggaccagcccgtggcactgccaccatcctctgggatgttcccccagctgggaacatcacaaacccctagcactgctgccatcacggccgcttccagtatttgtgtactgccatcaacccagaccaccggcattacagctgccagcccgtcaggcgaagctgacgagcactaccagctgcagcatgtcaatcaacttctagcatccaaaaccggcattcattcgtctcagagggatctcgattctgcaagcggcccacaggtctcaaacttcacacagacagtggatgcacctaacagcatgggtttggagcaaaacaaagctctgtcctctgctgtgcaggcttcccctacttcacctggaggaagcccgtcctctccctcgtccggccaacgttctgcatcgccctctgtacctggacctacgaagccaaagccaaagaccaaaaggttccagctgccacttgacaagggcaatgggaaaaagcataaggtgagtcatcttagaacctcatcctcagaagcacacatcccagatcaggaaacaacatccctgacttcagggactggaactccaggggccgaggcagaacagcaagatactgcctccgtggaacagagcagtcaaaaagaatgtggacagcccgcgggacaggtggcggtcctccccgaagtgcaggtgacacagaacccggctaatgagcaggaaagcgccgaaccgaagacagttgaagaggaagagtctaattttagcagccctctgatgctctggctccaacaggagcagaagcgtaaggagtctataaccgagaagaagcccaagaagggcttggtgtttgagattagtagcgacgatggctttcagatttgtgctgagagtatagaggatgcctggaaatccctaacagacaaggtccaggaagcgcggtcaaacgcccgcctgaagcagctcagtttcgccggggtgaatggcctcagaatgttgggaattctccatgatgcagtggtattcctgatcgagcagctgagcggcgcgaagcactgtagaaattacaagttccgatttcacaagccggaagaggccaatgagccccctctgaatccccatgggtcagccagagcagaagtgcacctccgaaagtctgccttcgatatgttcaattttctcgccagtaaacatcgacagccacccgagtacaacccaaatgacgaggaggaggaggaggtacagcttaaatcagctcgtagggccacatccatggacctccccatgccaatgaggtttcggcatttgaagaaaacttccaaggaggccgtcggagtctaccgctctcccatacatgggcggggcctcttctgtaaacgaaatatagatgccggggaaatggttatcgagtatgctggcaatgtgattcggagcatacagacggataagagggagaaatactacgatagtaagggcatcgggtgctacatgtttagaatagatgacagcgaagtggttgacgccacaatgcacgggaacgcagccagattcatcaatcattcctgcgaacctaattgttactcacgcgtaatcaatatagatggccagaagcacattgtaatattcgccatgcgcaagatttatcgcggtgaggagcttacatacgactacaagttccccattgaagatgctagcaacaagctgccctgtaattgcggggctaaaaagtgtaggaagtttttaaactag

SEQ ID NO: 196033 - DNA, 1680 bp, Artificial Sequence
  Description of Artificial Sequence: Synthetic coding sequence
atggacaaccagtgcaccgtgcaggtgcggctggagctgggccacagagcccaattgaggaaaaaaccaaccacagaaggcttcacacatgattggatggtattcgtgcgggggccggaacagtgtgacattcaacatttcgtagaaaaggttgtcttctggttgcatgatagttttcctaaaccgaggcgggtctgcaaagagcccccctacaaagtcgaggagagcggatacgccggatttataatgccgattgaggtgcattttaagaataaggaggagcccagaaaggtttgtttcacatacgacctgttccttaacttggaggggaatcctcccgtgaatcatttaagatgcgaaaagttgacttttaataatcctaccactgagtttagatacaagctgcttagggccgggggcgtaatggttatgcccgagggggccgatacagtgtccaggccaagtcccgattaccccatgctcccaactatccccctctcggccttttctgacccaaaaaagaccaagcccagccacgggagtaaggacgccaacaaggagtcctctaaaacctcaaaacctcacaaggtgacaaaagagcatcgagagcgcccccgtaaagacagcgagtctaaatcatcatcaaaggaattagagcgcgaacaggctaaaagtagcaaagacacctctaggaagctcggagaggggcgcttgccaaaggaagagaaagctccacctcccaaagccgccttcaaggagcctaagatggctctaaaagagactaagctcgaaagtacttcgcccaagggcggccctccccctcctcctccacccccgcctcgtgcaagtagtaagcgccccgctaccgctgatagccctaagccctccgccaaaaaacaaaaaaaatcttctagcaaggggtcaaggagcgcaccaggtactagcccccgtacgtctagctctagcagcttcagtgataaaaagcctgccaaagacaaatcctcaacaaggggtgagaaggtcaaagcagaaagcgagccaagagaagcaaagaaggccctggaagttgaggaatcaaattcagaagacgaagccagcttcaagtccgagtcggcccagtcctcccccagcaacagctcctcctcatcagattccagctccgactcagactttgaacctagccaaaatcattcacagggcccgctccgctctatggtcgaggaccttcagtccgaggaaagcgatgaggatgactcttcctccggcgaggaggctgcgggaaagacaaaccccggaagagacagcaggcttagttttagtgacagtgaatccgataattcagccgattcatcgctgccctcccgggaaccccccccaccccagaaaccccccccacccaacagtaaagtctcagggcgccggagccctgaatcctgctctaagccagagaaaatcttgaagaaaggtacatacgacaaggcttacacagacgagttagtcgagctgcacaggcggctgatggctctgagagaaagaaatgtgctgcaacagatcgtgaatctcatagaagaaaccgggcactttaatgttacaaacaccacatttgactttgacttgttcagccttgacgagactactgtcaggaaactccagagttgcctggaggcggtcgcaacctag

SEQ ID NO: 196034 - DNA, 273 bp, Artificial Sequence
  Description of Artificial Sequence: Synthetic coding sequence
atgcgggaccccgtgagcagccagtacagcagcttcctgttctggaggatgccgatcccagagctggatctcagcgaattggagggcctgggactatccgacacagcaacgtacaaggtgaaggactcctctgttggcaaaatgatcggccaggcaacagcagcagatcaggagaagaatcccgagggcgacggactgttagagtattctaccttcaatttttggcgggccccaatagcttctatccattcgttcgaactggatttgctgtag

SEQ ID NO: 196035 - DNA, 417 bp, Artificial Sequence
  Description of Artificial Sequence: Synthetic coding sequence
atgaaggacctgcacagcgacgacaacgaggaggagagcgacgaggtggaggacaacgataacgattcggagatggaacggcctgtgaatcgcggaggctcccggagcagaagggttagcctgagcgatgggtcggactccgaatcaagctccgctagctccccactacaccacgaaccgccccctcctctactcaaaaccaataacaaccaaatcctagaggtcaagagtcctattaaacaaagtaagtccgacaagcaaattaaaaacggggaatgtgacaaaattgtgaacctcatcgaggagacggggcattttcacatcacaaatactacatttgacttcgacctgtgctccttagataaaactaccgtgagaaaactccaaagttatctggaaacttctggcacttcctag

SEQ ID NO: 196036 - DNA, 489 bp, Artificial Sequence
  Description of Artificial Sequence: Synthetic coding sequence
atgaaggacctgcacagcgacgacaacgaggaggagagcgacgaggtggaggacaatgacaatgacagtgaaatggagaggcctgtaaatagaggcggatctcgctctcggcgggttagcctctccgatggctcagattccgagagtagttccgcttcttccccgttgcaccatgagccaccccctccccttcttaagacaaataacaatcaaattttggaggttaaaagccccattaagcagtctaaatccgacaaacagatcaagaacggcgagtgcgataaagcctacctagacgagctggtcgaactccaccgtaggctgatgactctccgggaacgccatatcctgcagcagattgtgaacttaatcgaagaaacagggcattttcacatcaccaatacaacattcgacttcgacctttgtagcctcgacaaaaccaccgttcggaagctgcagtcttacctcgagacctctggtacttcatag

SEQ ID NO: 196037 - DNA, 417 bp, Artificial Sequence
  Description of Artificial Sequence: Synthetic coding sequence
atgaaggacctgcacagcgacgacaacgaggaggagagcgacgaggtggaggataacgacaacgattcagagatggagcggcccgtcaaccggggcgggtcccggtccagaagagtgtctctaagcgacgggtccgactcagaatccagctccgcgtctagtccattgcaccatgagccacccccaccgttgctcaaaactaataataatcagatcctggaggttaaatctccaattaagcagtcaaagtcagacaaacagattaagaatggcgagtgcgataagatagtcaatctgatcgaagaaaccggacacttccacatcactaacaccaccttcgatttcgacctttgcagcctggacaagacaacggtccgtaaattgcagtcgtatttggaaaccagcggcacctcctag

SEQ ID NO: 196038 - DNA, 1707 bp, Artificial Sequence
  Description of Artificial Sequence: Synthetic coding sequence
atggccagcagctgcgccgtgcaggtgaagctggagctgggccaccgtgctcaagtgagaaagaaaccaacagttgagggattcacccatgactggatggtgtttgtgagggggccagagcatagtaacatccagcacttcgtggaaaaggttgtgtttcacctgcatgagtctttccctcggcccaagagggtttgcaaagatcctccatataaggtggaagagagcgggtacgccggctttattctcccaatagaagtatatttcaaaaataaagaggaacccagaaaggtgcgcttcgattacgacttgtttctgcatcttgaggggcacccccccgtgaatcatctgaggtgcgagaagttgaccttcaacaaccccacagaggactttcgacgaaagcttcttaaggcgggcggagatcccaatcggtctatacatacgtcctcctccagttcctctagctcctcttctagttcaagcagtagcagctcttcttcatcctcatcatctagttcttcctcctcttccagcagcagctcctctagtagctcatcatccagtagttctacctcattctccaaacctcacaagctcatgaaggaacataaggagaaaccttcaaaggacagcagggagcataagtcagcctttaaggaaccatcccgagatcataataaatctagcaaggaaagctctaagaagccaaaggagaacaaaccactgaaagaggagaaaatcgtgcctaaaatggcattcaaagagccaaagccaatgagtaaagaaccaaaaccggacagtaatctgctgaccatcacgtctggtcaggataagaaagcaccttccaaacgaccccctatttccgactccgaagaattgtctgccaaaaagcgcaaaaagtcctcctccgaggctctttttaagtcattttcctccgctcctcccctaattctcacatgtagcgcagataagaaacagataaaggataaatcccacgtcaaaatggggaaagtgaaaatcgagagtgagacatccgagaagaaaaaaagtaccctgccccctttcgacgatatcgtggatccgaatgacagcgacgttgaagagaatatctccagtaagtctgacagcgagcagcctagccctgcctcaagttcatcttcatcttcgtcctcgttcacaccatctcagacccgccaacagggcccactgagaagcatcatgaaggatctccacagtgatgacaatgaagaagagtcagatgaagtggaggacaacgataatgattctgaaatggagcgacccgtcaatagaggaggttctcgcagtcgccgggtttccctgtctgacggcagtgactccgagagcagttcagctagctcccctctccaccacgagccaccacccccactgttgaaaacaaacaataaccagatactggaggtgaagagccctattaaacaatctaagtccgacaaacagatcaaaaatggagaatgcgacaaggcctatttagacgaattggtagaactccacaggaggttgatgacactcagggagcgccacattctgcagcaaattgtcaacctcatcgaagagacaggacattttcacatcacaaataccacctttgatttcgatctgtgttccttggataagaccactgtaaggaaactccagagttatcttgagacctcaggcacaagctag

SEQ ID NO: 196039 - DNA, 1698 bp, Artificial Sequence
  Description of Artificial Sequence: Synthetic coding sequence
atgtgcgccgtgcaggtgaagctggagctgggccaccgggcccaggttcgtaagaaaccaactgtggagggattcacccacgattggatggtatttgttcggggaccggagcattctaatattcagcactttgtcgagaaggttgtatttcacctgcacgaatccttccccagaccaaaaagggtgtgtaaggacccgccgtataaggtggaggagagcggatacgcgggattcattcttcctatcgaggtctactttaaaaacaaggaggagccacgcaaggttagattcgactacgatctctttttgcacctcgagggtcatccaccagtgaatcacctgcgatgcgaaaaactgactttcaataaccccacagaagacttcagacggaagcttttaaaggcaggtggtgatcctaatcggtcgattcatacatcctcctctagcagtagctcctccagctcctcttcatccagcagcagctcatccagttcctcaagtagcagctcctctagttcctccagctccagctcctcttcatcctcctcaagtagcagttccaccagtttctcaaagcctcacaagctcatgaaggaacacaaggaaaagcccagtaaagattctcgcgaacacaaatcggcctttaaagaacctagtagagatcacaataagtcctctaaagaaagttcgaagaaacctaaagagaacaaaccactgaaggaagaaaagatagtgcctaagatggcttttaaggagcccaagcctatgtctaaagaacccaagccagacagcaacttactcactattacgtcaggtcaagataagaaagcgccttcaaagcggccacctatttccgattccgaagaacttagcgccaaaaaacgcaaaaaaagctcatcggaagccctgttcaagtcctttagctcagccccacccctcatcctgacttgcagcgccgataagaagcagataaaagacaaatcgcacgttaagatggggaaagtcaagatcgagagcgaaacgagcgagaaaaagaagtccacgctccccccgttcgacgatatagtagaccccaatgattctgatgtcgaggagaatatcagctcaaaatctgatagtgagcagccgtccccggcatcatcgagctcatccagctcgtcgagttttactccaagtcagacccggcagcaaggcccactacggtccataatgaaggacctgcacagcgacgacaatgaggaggagtccgacgaggttgaagacaacgacaatgacagcgagatggagcgtccagtgaacagaggtggtagcagatctagacgcgtgtctctgtctgatggttctgatagcgaatccagctccgccagcagcccgctgcaccacgagcctcctcctcctttgctgaaaaccaataacaatcagatcttggaggtgaaatcccctatcaaacagagcaagagcgacaaacagatcaagaatggcgaatgcgacaaagcttatctggatgagctggtggaactgcaccgcaggctcatgaccctcagagagagacacattttacagcagatagttaatcttatagaagagaccgggcactttcatattacgaacacgactttcgattttgatctctgctccctggacaagacaacggtcaggaaactgcagagctaccttgaaacttcaggcacttcatag

SEQ ID NO: 196040 - DNA, 1824 bp, Artificial Sequence
  Description of Artificial Sequence: Synthetic coding sequence
atgcagcgggccccccccttccccttcatgtgcgtgagccggcggcgaaagaaatgtcaggcacaacgaagcttgcctaagccccgactgcccgtgattcacggttgcctaagttctccttgtcctcaatgtgcggtgcaagtaaagctggagcttggacaccgggctcaggtgaggaaaaagcctactgtggagggtttcacccacgactggatggtgtttgtacgtggacccgagcacagcaacatccaacacttcgtggagaaggtggtgtttcatcttcatgagtcatttccacggcctaaacgggtttgcaaggacccaccttacaaagtggaagaatccggttacgccggattcatccttcccattgaggtttacttcaaaaataaggaagagccccggaaggtccgctttgattatgatttattccttcatctcgagggccatccgcccgtcaatcatcttcgctgcgaaaagttgacttttaacaatccaactgaagacttcagacgaaaattacttaaggcgggaggggatcctaaccgttctatccacacctcctcatcatccagctcaagctctagcagctcttcttctagctcttcaagctcttctagctctagctctagtagctctagtagcagcagctctagttcctcatccagcagttctagttcttcctccacctccttcagcaaaccccacaagcttatgaaggagcataaggagaagccatcaaaagactctagagagcacaagtcagcatttaaagagccttccagggatcacaataaatcatcaaaagaatccagtaaaaagccgaaagaaaacaagcccctgaaggaggagaaaatagtcccgaaaatggcgtttaaggaacctaagcccatgtcaaaggagcccaagccagatagtaatttgctgactataacatcagggcaggacaagaaggcacccagcaagagaccaccgatatcggatagcgaggagctctctgccaaaaaacggaaaaaatccagttccgaggcgctgttcaagtcattttccagcgctcctcctctaatactgacctgttctgcggacaagaaacaaattaaagataagtctcatgtcaagatgggcaaagttaagattgagagcgagacatctgaaaagaaaaagtcgactctacccccatttgacgatattgtagatcccaatgattccgacgtggaggagaatatctcttccaagtccgactctgaacagccttccccagcaagcagctcctccagctcttcgagcagtttcacaccgagccagaccaggcagcagggccccctgaggtcgattatgaaagatctgcactcagacgacaatgaggaggaatctgatgaagtcgaggataacgataatgactccgaaatggagaggcctgtcaaccgcgggggttctagatctcgaagagtgagcctgagcgatggcagcgactcagaatcatccagtgcgagttcaccgctccatcatgagccaccaccccctctgttgaagacaaataataaccagattctggaggtaaagagtccaatcaaacaatcgaaatcggataagcaaatcaaaaatggcgagtgtgacaaggcatacctggatgagttggtcgagctccataggcggttgatgactctgagagagcgacacatcctgcagcagatcgtcaatttgattgaggagacgggacatttccatatcaccaataccacatttgacttcgatctgtgctccctcgacaagactacagtaagaaagcttcaatcctatcttgagacttctgggacgtcttag

SEQ ID NO: 196041 - DNA, 4986 bp, Artificial Sequence
  Description of Artificial Sequence: Synthetic coding sequence
atgagcgccggcggccgggacgaggagcggcggaagctggccgacataattcatcactggaatgcaaacaggctcgacctgtttgaaatatcacagcccactgaggaccttgagttccacggcgtaatgcgcttttattttcaagacaaggcggctggcaattttgcaaccaaatgtatcagagtgtcctcaactgctacaacccaagacgtgattgagacactcgctgaaaagtttaggcctgatatgagaatgctcagctcaccgaagtatagcctgtatgaggtccatgttagcggagagcgtaggctggacatcgacgagaaaccgttggtagtgcagctcaattggaacaaagacgacagggaaggtagattcgtgttaaaaaacgagaatgatgcaattcctcctaagaaagcgcagagtaatggacctgagaaacaggagaaggaaggtgtgattcagaacttcaagcgcaccctgagcaaaaaggaaaaaaaagagaaaaagaagagagaaaaggaggccctcaggcaggcttctgataaggatgaccgacccttccagggagaggacgtggagaattccagactggcggcggaggtttacaaggatatgccagagacctccttcacccgcaccatttcaaatcctgaagttgttatgaaacggagacgacaacaaaaactcgaaaaacggatgcaggaatttagaagctctgatggcaggccagatagcggaggtacactgaggatctacgctgactcccttaaaccaaacattccctataagaccattctcctctctactactgacccagcggactttgccgtcgccgaagccctggagaagtacggtctcgagaaggaaaaccccaaagattactgcatcgcccgggttatgcttcctcctggagcccagcacagcgacgaaaagggtgcaaaggagatcattcttgacgacgatgagtgccctctgcagatttttagagaatggccctcagacaagggaatcctggttttccagctcaagcggcggcctccggatcacatccccaaaaagacaaagaaacatctggaggggaagacgccaaaaggcaaagagcgggcagacggctctgggtacggaagtactttacctcctgaaaagctcccgtaccttgtggagctgtcccctggtaggagaaaccacttcgcctattacaactatcacacctatgaagacggcagcgattcacgggacaaacctaaattgtatcggctccagctttctgttacagaggtgggtacggagaagttagacgataacagtatccagctgttcggaccaggtattcagccacaccattgcgacctaaccaacatggacggagtcgtgacagtcacaccacgcagcatggacgccgagacatatgtcgaggggcagcggatttcggagacaaccatgctgcagagtgggatgaaggtacagttcggcgcctcacacgtctttaagtttgtggacccctcccaggaccacgcattagccaagaggagcgttgatggggggttaatggtaaaaggaccccgtcacaagcctggtattgttcaggaaacaacctttgatctcgggggggatatccacagcgggaccgccctgcccaccagcaagagtacaaccagacttgatagcgaccgggtttccagcgcatcatcaacagctgagcgcggcatggtcaaaccgatgattagggtagagcagcaacccgactatcgaaggcaggagtcccgaacacaggacgcatcaggcccagaactgattctaccagcctctatcgagtttcgcgaatcgtccgaagacagtttcttgtcagctattatcaactacacgaacagctctacagttcacttcaagctgtcgcctacatatgtcctgtacatggcttgccggtatgttctgtccaaccagtatagacccgatatctcccctaccgaaaggacacacaaagtgatcgctgtggtgaataagatggtgagtatgatggagggcgtaatacagaaacagaaaaacatcgcaggagccctggcgttctggatggccaatgccagcgaactgctcaatttcattaagcaggacagagatttaagcaggatcacgcttgatgcccaggatgtgttagctcacctggtacagatggctttcaaatacctagtgcactgcctgcagagcgagctgaataactatatgcctgcctttctggacgaccctgaggagaactctctacaaaggcccaaaatcgacgatgtacttcacaccctgacaggcgctatgtccctcctcagacgctgccgcgttaacgccgccctcaccatacaacttttttctcagctcttccactttattaacatgtggctgttcaacaggctggtcacagatccagatagcgggctgtgtagtcattattggggcgccattatcagacaacagctgggtcacattgaagcttgggctgagaaacagggattggagctggcagccgattgtcacctgagcagaatcgtgcaggccaccaccctgcttaccatggacaagtatgcccctgacgatataccgaacatcaacagcacttgcttcaagctaaacagcctccagcttcaggcgttactgcagaactaccattgtgctccagatgaaccattcattcctactgacctcatagagaatgtggtcacagtggcagagaatactgccgacgaactggcacggagtgacggtcgcgaggtgcaactagaagaggaccctgatctgcagctgcccttcctgttgcccgaggacggctacagttgcgacgtagtgagaaacatcccaaacggtctgcaagagtttctcgaccctttgtgccagagagggttttgtagactgatccctcatacacgctcaccaggcacatggacaatctacttcgaaggcgcagattatgagtcacatctgctgcgggagaataccgaactggccattccacttcgcaaggagccggagattattactgtaactctgaaaaaacagaatggtatgggcctctcaatcgtcgccgctaagggagctggacaggataaactgggcatctatgtgaaatccgtggtgaagggaggagccgcggacgtggacggtcggctggcggccggtgatcagcttctgtctgtggacggccgttcactggttggactttcacaggaaagggccgcagagctgatgaccagaaccagcagtgtagtgacgttggaggtggccaagcaaggagctatttaccacggcctagctacacttctgaatcaaccttccccaatgatgcagaggatttccgacagacgagggtcgggcaagcctcggcctaagtccgagggctttgagttatataataatagcacccaaaatgggagccctgaaagcccccagctgccctgggctgaatacagcgagcccaagaaattgcccggtgacgaccggctgatgaaaaaccgagcagaccacaggtccagccccaatgttgctaatcagcccccttccccaggtggaaaatctgcatatgccagcgggacaaccgcgaagatcacatccgtgtcaacgggcaatctgtgtactgaagagcagacaccccccccccggcccgaggcctatcccattcctacacaaacctacaccagagagtactttaccttcccagcttccaaatcccaggatcgcatggctccaccacaaaaccagtggcctaactatgaagagaagcctcacatgcacacagatagcaatcatagtagcattgctatccagcgtgtgactagatcccaggaagagctgcgcgaagataaagcctatcagcttgagcggcataggatcgaggctgcaatggatcggaagtctgactctgacatgtggatcaatcaatctagttcactggactctagtacttcctcccaggagcatctgaaccatagcagtaaatccgttacgccagcaagtacgcttacaaaaagtggccccggacgttggaagacccctgctgccattcccgctacccctgtggcagtgtcacagcctattaggaccgacctaccaccaccaccacctcctcctcctgtgcattacgccggagatttcgacggtatgtctatggatttaccactgccccctccaccatccgcaaatcagattgggctgcccagtgcacaggtggctgcagccgagaggagaaagcgggaggagcaccaaagatggtacgagaaagagaaagcccgactggaagaggagcgtgagcgtaaaagacgcgagcaggagagaaaacttggccagatgcggacccagagtctcaacccagccccctttagccccctgacggctcagcagatgaagcccgaaaagccctctacgctccaaagaccgcaggagactgtgatacgggaacttcagccccaacagcagccaagaacaatcgagaggagggatcttcaatacattacagtgtcaaaggaagagcttagctccggcgatagtctctccccagatccgtggaaacgcgatgcgaaagagaaactagagaagcaacaacagatgcacatagtggacatgctcagcaaggagatccaggagctgcagtctaagcctgacagatccgcggaggaaagcgatcgcctgcggaagctaatgctggaatggcagttccagaagagactccaagagagcaagcagaaggatgaggatgacgaagaagaggaagacgacgacgtggacaccatgctgatcatgcagcggctcgaagccgagcgcagggcccgccagacggctatgccggcgattagtgtcctggacctccttcaggacgaagagcggagacggcagcaacagctggaggaaatgagaaagcgcgaggccgaggatcgcgcacggcaggaagaggaacgcaggagacaggaggaagaacggactaagcgtgatgctgaggagaagtag

SEQ ID NO: 196042 - DNA, 4998 bp, Artificial Sequence
  Description of Artificial Sequence: Synthetic coding sequence
atgagcgccggcggccgggacgaggagcggcggaagctggccgacattattcaccactggaatgcaaacaggttggatttgtttgagatttcccaacccactgaagatttggaattccatggcgtgatgaggttctatttccaggataaggctgccggcaatttcgcaactaaatgtattagggtttcaagtaccgcaaccacccaggatgtcatcgagaccttggctgaaaaatttcgacctgatatgagaatgttgtctagccctaaatatagcttgtatgaagttcatgtgagcggtgagcggaggttagatatagatgaaaagcctctggtcgtgcagctcaattggaataaggatgatagagaggggcgcttcgtgttgaaaaacgaaaatgacgctattccccctaaaaaggcccaaagtaatggcccagaaaaacaggaaaaggagggtgtgatccagaacttcaagcggacactttccaagaaagagaagaaggaaaagaagaaacgcgagaaggaggccctgcgccaagctagcgataaggatgatcggccatttcagggggaggacgtcgaaaattcccggcttgctgctgaggtgtacaaagacatgcccgagacaagcttcaccaggaccattagcaatccagaggtagtgatgaaacggcgccggcaacaaaaactggagaagagaatgcaggaatttcggagcagcgacgggagacctgactcaggaggcacactgaggatatatgctgatagcctgaaaccaaacattccctacaaaactatcctgctttctactaccgaccctgccgacttcgctgtggctgaagcactggagaaatacggcctggagaaagagaaccccaaggactattgcatagcccgggtcatgctgccacccggcgcacaacactcagacgagaagggcgcgaaagagatcatcctggacgatgatgagtgcccccttcagatctttcgggaatggccgtccgataaagggattcttgtctttcagcttaagagacgccccccggaccacattcctaaaaagacgaagaagcaccttgagggtaagaccccaaaggggaaggaacgagccgatgggagcggctacgggagcaccctgccaccagagaagctcccctatctcgttgaactgtcgcctgggcgcagaaaccactttgcttactacaactaccacacttatgaggacggttctgactccagagacaagcccaagctctatcgcctgcaactgtccgtaaccgaggttggcaccgagaaacttgacgataactcgattcagctgtttggccccgggattcagcctcaccactgcgacctaacaaatatggatggagtggtaactgtaacccctaggtccatggacgccgagacatacgtagagggtcaaagaattagcgagacaaccatgttgcagagcggaatgaaagttcagttcggtgcatcccatgtcttcaagtttgtggacccctctcaagatcacgccctggccaagcgatccgtcgatggcggattgatggtgaaagggccccggcataagcctgggattgttcaggaaaccacatttgatcttgggggcgacattcattcaggcactgccctgcccacctcaaagtctaccacccgcctggatagtgaccgcgtctctagtgcctcatccactgctgagcgtggaatggtgaaacctatgattcgcgtcgaacagcaacccgattaccggaggcaggaaagccgaacccaggatgcgtcgggccctgaactgattctcccagcttcaatcgaatttcgagagtcatctgaggatagtttcctatccgcgatcattaactacacaaactctagtaccgtacacttcaaactcagtccaacatacgtcctctatatggcttgccgctatgtgctgtcaaaccaataccgccccgatatcagtcccactgagcgaactcataaggttatcgccgtagtcaacaagatggttagcatgatggagggggttatccagaagcaaaagaacatagccggtgccctggctttttggatggcaaatgcgtcagagctgctgaatttcattaaacaggaccgcgacctcagccgcatcaccctggacgcgcaggatgtgttagcccatttagtgcagatggcctttaagtatctggtccactgtctgcaatcagagctcaacaattacatgccagcatttctggatgaccctgaggaaaacagcctgcaacgaccaaaaatcgacgatgtcctgcataccctcaccggggcaatgtcgctgctgcggcggtgccgagttaacgccgcccttactatccagttgttcagtcagctgtttcacttcataaacatgtggttgtttaacagactggtgacagatcctgactccggactgtgcagtcattactggggagccattatccgccagcagctcggccacatcgaagcctgggccgaaaaacaaggcctggaactagccgcagattgccacctgtccagaattgtgcaggctactaccctcctgacaatggacaagtatgcccccgatgacattcctaacataaacagtacatgttttaaacttaatagtttacagctccaggccctgctgcaaaactaccattgcgccccagatgaaccattcattcccactgacctcattgagaatgtggtgactgtggcagaaaatacagctgacgagcttgccagatctgatgggcgcgaggttcagctggaggaggaccctgatctacagctaccattcttgctgcccgaggatggctacagctgcgacgtagtgcgtaacattccgaatgggttgcaggaattccttgatccactgtgccaaagaggtttttgccgcctgatcccacacacaagatcccctggtacgtggactatttattttgaaggcgccgactacgagtctcatctgttgcgggaaaataccgagcttgcacagccattaagaaaggagccggaaatcatcactgtgaccctcaaaaaacagaatggcatgggattgtccatcgtggccgctaaaggtgctgggcaggacaagctggggatatatgtaaaatcagttgtgaagggcggcgccgctgatgtggacggccgactcgccgccggagaccagctgctgtctgtggatggccggtcactggtagggctcagccaagagcgggctgctgagctaatgacccgaaccagcagcgtggtgacactcgaggtagccaaacagggagctatctaccatggcttggcaactctgctgaatcagccatcacctatgatgcagcggatttccgatcggcggggttccggtaaacccaggcccaaatccgaaggctttgagctatataacaactccacccagaacggaagcccagagagtcctcagctgccctgggcagaatattcagagcccaaaaaactccccggcgacgacaggttgatgaagaatcgggccgaccaccgttcatcccccaatgtggcgaaccaacctcctagtccaggaggtaagtctgcctacgcctcggggaccacagcgaaaatcacttccgtgagtaccggtaatctgtgtacagaggagcagacaccccctcctagacccgaggcttaccctattcccactcaaacctacaccagagagtacttcacatttccagcttcaaagagtcaggaccgtatggctcccccccaaaaccagtggcccaactacgaagagaaaccccacatgcatacagattccaatcattcttctattgcaatccagagagtcaccaggagtcaggaggaactgcgcgaagacaaggcctaccaacttgaacgccatcgtatagaggcagccatggaccgcaagagcgattccgatatgtggatcaaccagagttcctctttggatagctcaacgagcagccaggaacatctgaatcattcttcaaagtccgtgacccccgcatcaacattaacaaaatcaggccctgggaggtggaaaaccccggccgccataccagctacaccagtggcagtgtcacagcctatacgcaccgatttacctccacccccccctccgccccccgtgcactatgccggagactttgacgggatgtccatggacttgccactgccacccccccctagcgccaaccaaattggacttcccagcgctcaagtggctgctgcagagagaagaaagcgcgaggagcatcaaagatggtatgaaaaggaaaaagcccggctggaggaggaacgggaacgcaagagacgggagcaagaacgcaagctcggccagatgagaacccagtctctgaatcctgcacccttttcacctctgaccgcacaacagatgaagccagagaagccttctactctgcagagaccccaggagactgttattcgggagctacagcctcagcaacagcctcgtactatcgagaggagggatctgcagtatattaccgtcagtaaggaggagctatcgtcaggggacagcctcagcccggacccatggaaacgcgatgccaaggaaaagcttgaaaaacagcaacaaatgcacattgtcgatatgctctctaaagagattcaggagctgcaatccaagcccgacaggagtgcagaagaatctgatagactgcgcaaactcatgctggagtggcagttccagaaaagactgcaagagagcaaacaaaaggacgaggacgacgaggaggaggaggatgacgatgttgacactatgttgattatgcagcggctggaggccgaacgcagggcaagacaaacagctatgccagcaatctccgttctggacctattgcaggacgaggagaggcgacgacagcagcagttggaggagatgcggaaaagggaggccgaggaccgtgcgcggcaggaagaagagcgccggcggcaggaggaggagcgtacaaaaagggacgccgaggaaaaagtcatggtactatag

SEQ ID NO: 196043 - DNA, 5475 bp, Artificial Sequence
  Description of Artificial Sequence: Synthetic coding sequence
atgagcgccggcggccgggacgaggagcggcggaagctggccgacattatccatcactggaacgcaaaccgcctggacctcttcgagatcagccagcctaccgaagatctggaatttcacggagtgatgaggttctacttccaggacaaggctgccgggaactttgcgactaaatgtatcagagtgtcctctaccgccaccacacaagacgtaatcgagacactggcggaaaaattccggccggacatgcgaatgttgagcagcccaaagtactcactttacgaggtccacgtatctggcgaacgtaggctggatatcgatgagaaacctctggtcgtgcagctcaattggaacaaggatgatcgggaaggacgcttcgtgctcaagaacgagaacgatgccattccacccaagaaagcccaatccaatggacctgaaaaacaagagaaggagggagttattcaaaacttcaagaggaccctgtcaaaaaaggagaaaaaggagaagaagaaaagagagaaggaggccctgcgccaggccagcgataaggacgatcgcccctttcaaggcgaggacgtggagaacagtagacttgcagcggaagtgtacaaagacatgcccgagacgtccttcacaaggaccatcagtaatcccgaagttgtgatgaaaagaaggagacagcaaaagcttgagaagagaatgcaggaatttcggagctcggacggtcgccctgattctggagggacgcttcgaatttacgccgactctttgaagcctaacattccatataagacgattcttctctctacaaccgaccccgcagactttgcggtggctgaggcgctggagaaatatggattggaaaaggagaatccaaaggactactgtatcgccagggtaatgcttccgcctggcgctcagcactcagacgagaaaggcgccaaagagatcatcttggacgatgacgagtgtccactccagatttttcgcgagtggccttcagacaagggcattctcgtgtttcaactgaaaaggcgaccacccgaccatattcctaagaaaactaagaaacacctagagggaaagacccccaaggggaaggagcgggccgatggatctggctatgggtccactctgcccccggaaaagctcccctatctggtagaactaagtcccggccgacgcaaccacttcgcctattataattatcatacctacgaggacggtagcgactcccgagacaaaccaaaattatatagactccaactgtcagttactgaagtggggacagaaaagcttgacgacaacagtattcagctgttcggcccgggtattcagccccaccactgtgacttaacaaacatggacggagtggtcacggtgacgccgaggtcaatggacgcagagacttacgtagaaggccagcggattagcgagacaacgatgctccagtctgggatgaaagtccagtttggggcctcccatgtgttcaagtttgtcgacccaagccaggatcatgccctcgccaagaggtccgtcgatggcggacttatggtgaagggcccaaggcataaacctggcatcgtccaggagacaaccttcgacttggggggggacattcacagtggaaccgcactccctacctcaaagagcacaactaggctggatagtgaccgtgtgagtagtgctagtagcacggccgaacgcggaatggtcaaacccatgatcagggtagagcagcagcccgattaccgccggcaggagtccaggacccaagacgcatctggcccagaactgattttaccggccagcatcgaattcagagaatcttccgaggacagctttctaagtgcgatcatcaactatactaacagttcaactgtgcatttcaagctgagccccacctatgtcctgtatatggcctgcaggtatgtgctcagcaatcagtacaggcccgatatctcccctaccgaacgtactcataaggttatcgccgtggtcaacaagatggtcagcatgatggaaggagtcattcagaagcagaagaatattgccggagcactcgctttctggatggctaacgcatctgaactacttaacttcattaaacaagaccgcgatctatcccgaataacgttggatgcccaggacgtgctggcacatctagtacagatggccttcaaatatttagtacactgcctgcagtctgagttaaacaactacatgcccgcattcctcgacgatcccgaagaaaattctctccagaggcccaaaatcgatgatgtgctgcacaccctgaccggtgccatgtcactcctgcggcgctgtagagtaaacgccgctctcactattcaactatttagccagttatttcacttcattaacatgtggctctttaacaggttggtcacagatcccgattcaggcctctgctcccactattggggagccatcatcaggcagcagctggggcacattgaggcatgggccgaaaagcaggggctagaactcgctgcggattgtcacctgtctcggattgtccaagccacaaccctcctcaccatggacaaatatgccccagacgacattcctaacattaattcaacgtgttttaaactcaatagcctccagcttcaggcccttctgcagaactaccactgcgcgcccgacgagcctttcatacctactgacctgattgaaaacgtggtgaccgtggccgaaaatactgctgacgagctagccagaagcgacgggagagaggtgcagctcgaggaggatcctgatctgcaactgcctttccttctccccgaagatgggtatagctgtgacgtggttcgtaatatacccaacgggctccaggaattcctggatcctctgtgccagcggggattctgcagacttatccctcatacacggagccccgggacatggaccatatattttgagggtgccgattatgagtcgcacctgctgcgggagaacaccgagctcgcaatacctcttaggaaggaacccgagattatcaccgttactcttaaaaagcagaacggaatgggcttgtcaattgtagccgccaagggcgctggtcaagacaagcttggaatctatgttaaatctgtggtcaaaggtggcgccgctgacgtggatggacggctggcggcaggtgatcagctgctttcggtcgatgggagaagcctggtcgggctttcacaagaaagggccgcagagctgatgactagaacgtcttctgtggtgaccctggaggttgctaagcagggcgctatttaccacggtttggcgactctgcttaaccagccgagtccaatgatgcaacgaattagcgaccgtaggggatccggcaagcctagacctaagagtgaaggtttcgaactgtataacaacagcacacagaacggttcccccgaaagccctcagcttccttgggcagaatacagtgagccaaagaagttgccaggggatgatcgcttgatgaagaatcgcgcagatcaccgctctagccccaatgttgcaaatcagccgccttcccccggcgggaagtccgcttacgctagtggaaccactgctaagataacgtctgtttccacaggcaacctctgtacagaggagcagacccctccacctcgccccgaggcttacccaatccccacccagacctacaccagagagtatttcacttttccggcaagcaaatcacaagatcggatggccccaccacagaaccagtggccaaactatgaagagaagccccacatgcatacggattccaaccacagttctattgctattcaacgagtgacaagatcgcaggaggagcttagagaggataaggcctatcaactcgagagacaccggattgaggcagctatggatagaaagtcagactcagacatgtggattaatcagtcgtcctcactcgattcctctacaagctctcaggaacatctgaatcatagtagtaagtctgtgactccagcatccacactgacaaaaagcggacctgggcgatggaagacccctgccgctattcctgccacgcctgtggctgtgtcacagccaataagaaccgatctccctccacccccaccacctccacccgtccattacgccggcgatttcgatggcatgtcaatggatctcccgctcccgccacccccatcagccaaccaaatcgggctgccctccgcacaggtggccgcagcagaaaggcggaagagagaagagcaccagcggtggtacgagaaggaaaaagctcgattggaagaagaacgagagagaaaacgtcgagaacaggaacgcaaattgggccagatgagaactcagtcattgaacccagcgccgtttagtcccctcacagcccagcagatgaaacctgagaaacccagtactttacagaggccacaggaaacagtgattcgagagctgcagccgcagcaacaacccaggaccatcgaaagacgggatctgcagtatatcaccgtcagcaaggaagaattgtcatccggtgactccctgtcacctgatccctggaagcgtgacgcaaaagaaaagttggagaaacagcaacagatgcacatcgtcgatatgttgtccaaggagatacaagaactccagtcaaagcctgaccgatctgccgaagagtccgaccgcttaagaaagcttatgctcgagtggcagttccagaaacgcctgcaggagtctaagcagaaggacgaagacgatgaggaggaagaggacgacgatgtcgacaccatgctcatcatgcagcgcctcgaagccgaaaggcgggccagacttcaagatgaagagcgccgacggcagcagcagctcgaggaaatgcgcaagagggaggcagaggaccgtgcacgacaggaagaagagagaagaaggcaagaagaagagcgcactaaacgggatgcagaggagaagcgccgccaggaggaggggtattacagcaggcttgaggccgagagacgccgtcagcacgacgaagctgctagaaggcttctggagccagaggcccccggcttgtgtcgcccgcctctgccaagggattacgagccaccctcgccttcccccgctcctggggcacctccccctccaccacagagaaacgcctcctatttgaagacccaggtcctgagcccagactctctgttcaccgcgaagtttgtggcatataatgaagaagaagaggaggaggattgttctttggctggcccaaactcctatcccggaagcaccggagctgcagtgggcgcacatgacgcctgcagggacgctaaagagaagagatctaagagccaggatgcagactcccctgggtcctcaggtgctcccgagaatcttacttttaaggagcggcagcgcctgttctcccaggggcaggacgtgagtaataaggtgaaggccagtaggaagctcacagaactggagaatgagctaaacaccaagtag

SEQ ID NO: 196044 - DNA, 4956 bp, Artificial Sequence
  Description of Artificial Sequence: Synthetic coding sequence
atgagcgccggcggccgggacgaggagcggcggaagctggccgacataatccatcactggaacgccaaccggctcgatctatttgagatcagccagcccactgaggatctggagttccatggagttatgcggttctacttccaggacaaagcggccggaaactttgctaccaagtgtatcagagtgtcgtccaccgctacaacccaggacgtaattgagacactggccgagaagtttcgtcctgatatgagaatgctgagctccccgaagtactccctgtacgaagtgcacgtgtctggtgagaggagactggatattgacgagaagccactggtcgtacagcttaattggaacaaagatgatagagaggggaggtttgtgttgaaaaatgaaaacgatgcaatacccccgaaaaaggcccagagcaacggcccagagaaacaggagaaggaaggagtcatccaaaattttaaacggacactctccaaaaaggagaagaaagaaaaaaagaagcgagagaaggaagcattgcgacaggcatcagacaaagatgacagacctttccagggtgaggacgtggagaatagcaggctagcagctgaagtgtacaaggatatgcctgagacctcctttacaagaacaatttctaaccccgaggtggtgatgaaaaggaggaggcagcagaagctggagaagaggatgcaggaattccgctcttctgacggaaggccagactctggaggcacgttaaggatttatgccgatagtctcaagccaaacattccctacaagacaattcttctgagcacaacagaccccgctgactttgccgtcgctgaggctctcgagaaatacgggctggagaaagagaatcccaaagattactgtattgctcgtgttatgctgccaccaggggcacagcattccgatgagaaaggcgccaaagaaatcattctggacgatgatgagtgccctttacagattttccgcgaatggcccagcgacaaagggattctcgtcttccagcttaagaggcggccgcctgatcacattccgaagaaaacaaagaagcacttggaaggtaaaactcccaaaggaaaagaaagagcagatggaagtggatatggcagcacattaccaccagaaaagctcccatacttagtggagttgtctcctgggcggcgtaatcacttcgcatattataactatcacacatacgaggacgggtccgattctagggataaacctaagctgtatagattacaactaagtgtcacagaggtgggcaccgaaaagcttgacgacaatagtatacagcttttcggtcctggaattcagcctcaccattgtgatctcacaaatatggacggagtggtaaccgtgacacctcgttccatggatgcagagacttacgtggaggggcaacggatttcagaaactacgatgctgcagtccggcatgaaggtgcaattcggcgcctcccacgtgttcaaattcgtcgatccaagtcaggaccacgcactggcaaagagaagcgtggacggcggcctgatggtgaaagggcctcgccacaaacctggaatcgtgcaggaaacaaccttcgatctcggcggtgacattcatagcgggacagctttgccgacgtccaagagcactactcggctggactcagacagagtcagttcagccagctccactgctgaaagagggatggtaaaacccatgattagagtggaacagcagccagattaccgacgccaagaaagccgaacacaggacgctagcgggcctgaattgatcttgccagcatctatcgagtttcgagaatcgtccgaagactcctttctgagcgctattattaattataccaacagctcaactgtccattttaagctcagcccaacttatgtactgtacatggcttgccgctatgtactgtctaaccagtaccgccctgacatatccccgaccgaacgaacccataaggtgattgcggtggtaaataagatggtatcaatgatggagggcgtgattcagaaacagaaaaacatagcgggggctttagcattttggatggctaatgcttcagaattgctcaatttcattaaacaggaccgcgacctatcacgtatcactctggacgcccaggatgtcttggcccacctggtgcagatggcattcaagtatttggtacactgcttgcagtccgagctgaataactacatgccagcgttcctggacgaccccgaggagaacagcttgcagcggcccaaaattgacgacgtgctccatacactgactggggcaatgtccctgctccgccggtgccgggtgaacgctgcgttgaccattcagttgttcagccagctcttccacttcattaacatgtggctttttaataggcttgttacagatcctgattccgggctgtgcagccactattggggcgctattattcggcagcaactcggacatattgaggcatgggctgagaagcagggactggagctcgcggcagattgtcatctcagtcgcatagtgcaggccacaacattgctgacaatggataaatacgccccagacgacataccaaacattaatagtacgtgttttaagctgaattctttacaactacaggcattgcttcagaactatcactgtgctccagatgaaccctttattcccacagaccttatcgagaatgtggtcactgtggccgaaaacaccgccgatgagttggcccgctcagatggaagggaagtacaactggaagaggatcctgatctgcaactcccttttttgctgcccgaggatgggtactcctgcgatgtagtccgcaacatccctaatggactgcaggaatttcttgatcccctgtgccagagaggattctgccggctgatcccacacacaaggtcgccgggcacatggacaatatatttcgaaggcgctgattacgagagccacctattacgcgagaacaccgagttggcccagcctctgcggaaagagcccgaaatcatcaccgtgacgctaaagaaacaaaacggcatggggctcagcattgtcgccgccaagggagcagggcaggacaagctgggaatttacgtgaaatctgtggtgaaggggggagccgctgatgtggacgggagactggctgccggcgaccagttgctctccgtggatggacgcagtctggttggtttatcacaggagcgagccgcagagctcatgacccgtacaagcagcgtcgtgactctggaagtagctaagcagggcgccatctaccatggtctggccacccttctgaaccaacctagccccatgatgcagcggatcagcgataggaggggctctggtaaaccccgcccaaagtctgaaggatttgagctttacaataactccacacagaacggcagtcccgaatccccccaacttccttgggctgaatacagcgaacccaagaaactccccggggatgatcgactcatgaagaacagggccgatcatagatcatccccaaatgtggctaaccaaccaccatcaccgggggggaaatccgcatacgcgtctggaaccaccgcaaaaattacaagtgttagcacaggaaatctgtgcaccgaggaacaaaccccccctcctaggccggaagcctacccaattcctacacagacctatactagagaatacttcactttccctgcctctaagtcccaggatagaatggcccccccacagaaccaatggccaaactacgaagaaaaaccgcacatgcacacagactccaaccattcctctattgctatacagcgtgtcaccagatcacaggaagagctgcgagaggataaagcttaccagctcgaaaggcaccggattgaggccgccatggacaggaagtccgattccgatatgtggattaaccaatcatcatctctggactcgtcaacaagtagccaggagcatcttaaccactccagcaagtccgtgacccccgcctccacccttaccaagtccggacccggcagatggaaaaccccagccgccattcctgccacacccgtcgcagtgtcacagcccatcaggactgatctccctccacccccaccccctcctcctgttcattacgccggggactttgatggaatgagcatggatctgccactccctcctcctccgtcagcgaaccagatcggactgccttcggcccaggtggccgccgctgaacgacgcaagagggaggaacatcagaggtggtatgagaaagagaaagctaggctggaggaggagcgtgaacggaagcgtagggagcaggagcggaaattgggtcaaatgcgcactcaatccctgaacccagccccattttcccctctcactgcacagcagatgaagcctgaaaaaccaagcacactgcagcggccccaagaaaccgtgatacgcgaactccagccacaacaacagccgcgcaccatcgagcgtagagacctgcaatatatcactgtctctaaggaagaactgtcctcaggcgacagcctaagccccgatccttggaaacgcgacgccaaggagaagttggagaagcagcaacaaatgcacatcgtcgacatgctcagcaaagaaatccaggagcttcaatctaaacctgatcggtccgcagaagaatcagataggcttaggaagctgatgcttgagtggcagttccagaagaggttgcaagagagcaagcagaaagacgaggacgacgaagaggaagaagacgatgacgtagacaccatgctcatcatgcagagactggaggcggagagacgcgccagggatgaggagcgtcggcgacagcagcaacttgaagagatgcgtaaaagagaagctgaggatcgcgccaggcaggaagaagaaagacgaaggcaggaagaagagagaacaaagcgcgacgccgaagagaaagtgatggtactgtag

SEQ ID NO: 196045 - DNA, 5232 bp, Artificial Sequence
  Description of Artificial Sequence: Synthetic coding sequence
atgagcgccggcggccgggacgaggagcggcggaagctggccgacatcatacatcactggaacgccaatcgtctggatctgtttgaaattagccagccgactgaggacctggagtttcacggagtcatgcgattttattttcaggataaagcggctgggaactttgccactaagtgtatcagagtctccagtaccgccaccacccaggatgtcattgagactctcgctgagaagtttagaccggatatgcgtatgctgtcgagcccaaagtacagcctgtacgaggtgcacgtaagcggcgagagaaggttggacatcgatgagaagccattagttgttcagctcaactggaataaggatgaccgggagggccgctttgtgcttaagaacgagaacgacgccatcccacctaaggcgcaatcaaacgggccagaaaagcaggaaaaggagggcgttatacagaacttcaagcggactctttctaagaaggagaagaaggagaaaaaaaaaagagagaaggaggctctccgacaggcctctgataaagacgatcggcccttccaaggggaagatgtggaaaatagtcgacttgctgctgaagtttacaaggatatgcccgaaacctctttcacccgaactatttccaatcccgaggtcgtgatgaagcgccgacgtcaacagaaactagaaaagaggatgcaggagttccggtcatctgacggcagaccagactccggtgggactttgcgaatctatgctgactccctgaaaccgaatatcccctataaaactatccttctgtctactactgatcccgccgactttgccgtggccgaagcccttgaaaagtatggtctggagaaagaaaaccctaaagactactgtatcgcccgcgtgatgctgcctcctggggctcagcactccgatgagaagggcgccaaggagattatactggacgatgatgaatgtccgcttcagatttttcgtgaatggcccagcgataagggaattcttgtctttcagcttaagaggagacccccggatcacatccctaaaaaaacgaagaagcatctggaggggaagacccctaaaggcaaggaacgcgccgacggatctggctatggtagtaccttaccaccggaaaagctcccttacctggtcgagctcagccctgatgggagcgactcgcgggacaagcccaagctgtatcgcctgcaactgagtgttacagaggtggggaccgagaagctggacgataattctatccaactttttggtccgggtattcagccacaccactgtgacctgacgaatatggatggtgtcgtgacagttacccccagaagcatggacgccgaaacttacgtcgaaggtcaacgaatcagtgagaccaccatgctccagagtgggatgaaggttcagtttggggcatctcatgtgttcaagttcgtagaccctagccaggatcacgctttggccaaacgatctgtagatggcggactgatggtgaaagggccccgccataaacccggcattgtgcaagagactactttcgacctgggaggggatatccattccggaaccgctctgcccacctccaagtctaccaccagattggactccgacagagtttcttctgcttcatccactgccgagcggggaatggtgaagcccatgattcgggttgaacagcagccagactaccgccgacaggagtcaaggacccaggacgccagcggccctgaacttattctccccgcaagcatcgagtttcgggagagtagcgaagattcctttctgtccgctatcattaactacaccaatagcagcactgtgcatttcaaactctctcccacctacgtcctctacatggcttgtagatacgtgctgtcgaatcagtaccgccccgacatctcccctactgagagaacgcataaagtgatagctgtagtgaacaagatggtgagcatgatggaaggagtgatccagaagcagaaaaatatcgccggtgccctggccttctggatggccaatgcttctgaattgctgaatttcatcaagcaggatcgtgacctgagcaggatcacactggacgcccaggacgttctggcccatctagtgcagatggcctttaagtatctggtccactgtttgcaatccgagctcaataattatatgcccgcttttcttgacgaccctgaagaaaactcccttcaacgacccaagattgatgatgttctccataccctgacgggcgccatgtctctacttcgacgctgcagggtcaatgcggccctgacaatacagctcttttcccagttgtttcacttcatcaatatgtggctgttcaaccggttggttaccgatcccgacagtggcctttgctcccattattggggcgcaatcatacggcaacagctgggtcatattgaggcttgggctgaaaaacaaggtctcgaactagcggcagattgccacctatcgaggatcgtccaggctactacacttctcaccatggataagtacgccccagacgatattcccaacatcaactccacttgtttcaaattgaactccctgcaactgcaagccctgttgcagaactatcattgcgcacctgatgaaccttttatcccaactgacctgatcgagaacgtggtgaccgtggccgagaacaccgctgacgagcttgcacgcagcgatggacgcgaagtgcaactggaggaggacccagacttgcagttgccattccttctgcccgaagatggctatagttgcgatgtggtgcgtaacatcccaaacgggctccaggagtttctggaccctctgtgtcagcgtggcttctgccgactgattcctcatacacggagcccgggaacgtggacaatttactttgagggggcggactatgaatcccacctgctccgtgaaaacaccgagctggctatccctcttcggaaagagcctgaaattatcacagtgacgctgaagaaacagaatggaatgggcctgagcattgtcgcggcgaaaggggccggacaggacaagttaggaatatacgtgaaaagcgtggtaaaaggaggggccgcagacgacggccggctcgcagctggtgaccagcttctgagcgtggacggcaggtccttagtgggactctctcaggagagggccgctgaactgatgacccgcacctctagcgtcgtcacactggaggttgcaaagcagggcgctatctaccatggtctggccacgctcctgaatcaacccagccccatgatgcagaggatctcagataggagagggtcaggcaaaccgcggccaaaatctgaagggttcgaactctacaataacagcactcagaatggatcccccgagagccctcaactcccttgggcagagtacagcgaaccgaaaaaactgcccggagatgataggctgatgaaaaatcgggcggaccatcggagttcaccaaacgtcgcgaaccaaccaccatctcctggcggaaagtcggcatacgctagcggcaccaccgcaaaaatcacctccgtgtcaaccgggaacctgtgcaccgaagagcagacccccccgccgcgtcccgaagcttaccccatcccaacccagacgtacacgcgcgaatactttactttccctgcaagcaagtctcaggatagaatggccccaccgcagaaccagtggcctaattatgaagaaaagcctcatatgcatacagattcaaatcattcttccatcgctattcagcgagttactagatcccaggaggagcttcgtgaagataaagcatatcagctggagcgacatagaatcgaagcagcaatggaccggaaatcagacagcgatatgtggatcaatcaaagtagttctttagattcttcaacatcatcacaggaacaccttaatcactcgagcaagtcagtgacacctgcctctactttaactaagtccgggcctgggcggtggaaaacccctgccgccatccccgctactcctgtggccgtctcacagcccattcgtaccgatctgccaccgcctccaccccccccgccagtacactatgccggggatttcgacggcatgagtatggacctccctctgccaccccccccttcagctaaccaaattggactcccctcagcacaggtggcagccgctgagaggcgcaaaagagaggaacatcagcgctggtacgagaaggagaaggcccggttggaggaggaaagggagagaaagaggagagagcaagagaggaaactagggcagatgaggacccaaagtctaaaccccgctcctttcagtccccttacagcacagcagatgaagccagaaaagccatcaaccctccagcggccacaggagactgtcatcagggagctgcagccgcagcagcagccgcggaccatcgaaaggagagaccttcagtatatcacagtgtcaaaggaagaactatcttctggggattccctctccccagacccctggaagcgggatgctaaggagaagctcgagaagcagcaacagatgcatatagtggacatgttgagcaaagagatccaggagttacagagtaagccggatcggtcagctgaagagtctgaccgtctgcgaaagttgatgcttgagtggcagttccaaaagaggctccaggagtccaaacaaaaggacgaagatgacgaggaagaggaggacgatgatgtggacacaatgttaatcatgcagcggctggaggccgagagacgggctcggctgcaggacgaagaacgacgcagacagcagcagctggaagaaatgcgcaagcgcgaggccgaagacagagcaagacaggaggaagagcgacgccggcaagaggaggagcgcacgaagcgagatgcagaggagaagagaaggcaggaggaaggctattatagccggctggaggccgaacgacggaggcaacatgacgaagctgcccggcgactgttggaaccggaggcccctggtcctaactcatacccaggcagtacaggggcggcagtgggcgcacacgatgcatgtcgagatgccaaggagaagcgctcaaaatcccaagacgcagatagcccaggcagttccggcgcccctgaaaacttaacctttaaagagaggcagagattgttctctcagggacaggacgttagcaacaaggtgaaggcaagcagaaaattaactgaactggagaatgaattgaacactaagtag

SEQ ID NO: 196046 - DNA, 5475 bp, Artificial Sequence
  Description of Artificial Sequence: Synthetic coding sequence
atgagcgccggcggccgggacgaggagcggcggaagctggccgacattatccaccactggaacgcaaacagattggacctattcgaaatttcccagccaactgaggacctggaattccatggagtcatgcggttctacttccaggacaaggcagcaggaaactttgcaaccaaatgtatacgagtttcaagcactgcaacgactcaagacgtcatcgaaactctggcagagaaattccggcctgacatgcggatgctctcgagcccgaaatactcgttgtacgaggttcacgtgtcaggcgagagacgattagatatagatgaaaagcctcttgtcgtgcagctcaattggaataaggacgaccgcgaagggcggtttgttctgaaaaacgaaaatgacgccatacccccaaaaaaggcccagagtaacgggccagaaaagcaggagaaggaaggcgtgattcagaacttcaaacggaccctgtcgaagaaagagaaaaaagagaagaagaagcgcgagaaggaggccctgaggcaagcatcagacaaagatgaccggccgtttcagggagaggatgttgaaaatagtagacttgcggcagaagtgtacaaagacatgcctgagacttctttcacacgaaccattagcaatcccgaagtcgtgatgaaacgtcgtaggcaacagaaactggaaaaacggatgcaggaattccggtcctccgatgggcggccagacagcggcggtacgctacggatatatgcagactctctcaagcccaacatcccctataagactatcttgctctcaaccacggatcccgccgacttcgctgtcgccgaagccctggagaagtacggactggaaaaggaaaatcctaaagactactgtattgccagagttatgcttcctccaggagctcagcattccgatgagaaaggtgctaaagagataatacttgacgatgatgagtgcccccttcaaatattccgcgaatggcccagcgataaaggaatcctggtattccaacttaaacgccggcctcccgaccatataccaaagaaaacaaaaaagcaccttgaaggcaaaactccaaagggaaaagaaagggcagacggaagcggctatggatctactttgcctccagagaagctgccttacctcgtagagttgtcccccggcaggaggaatcatttcgcctactacaattaccacacgtacgaggacggatccgattcccgcgacaagccaaaactttatcgcttgcagctgtccgttaccgaggttggtacggagaagttggatgacaattctattcagctgttcgggcccggaattcagccacaccactgtgatctgacgaatatggacggagtagttacggtcacaccacggagcatggacgccgagacctatgttgaagggcagaggatcagtgagaccactatgctgcagtccggtatgaaagtacagtttggcgcttcacatgtctttaaattcgtggaccccagccaggaccatgcattagccaagcggagtgtggacggggggcttatggtgaagggcccacggcacaaaccgggcatcgtgcaggagacaaccttcgatctggggggtgatatccactcaggtacagctctccctacatccaaaagcacgacacgtcttgacagcgacagggtttcatccgccagcagcacggctgaacgcggaatggtgaagcccatgatacgggtagaacagcagcctgattaccgtcggcaggagagcaggacacaggatgcatccggtccagagctcatactgccagcttctatcgaatttcgcgaaagtagcgaggatagttttctgagcgccatcattaattatactaactcttccacggtgcacttcaaactgagccccacctatgtgctctacatggcctgtcggtacgtcctatcgaaccaatatcgacccgacattagccccaccgagcggacccacaaggttatagctgtggtgaacaaaatggtcagcatgatggagggagtcatccaaaagcaaaagaacattgccggggccctggccttctggatggccaatgcgagcgagttgcttaacttcataaagcaggatagggatctctcccggattaccctcgacgcccaagacgtcctcgctcacttggtgcagatggccttcaagtatttggttcactgtctgcagagcgagctgaataactacatgccagcttttctggacgacccggaagaaaatagtctacaaagacccaagattgacgacgtcctgcacacattgaccggggccatgagtctcctgcgaaggtgtcgcgtcaacgccgctctgaccattcagctatttagccagctatttcatttcatcaatatgtggctgtttaaccggctggtcactgatccagacagcggactttgcagccactattggggcgcaattatccgacagcagctgggccacatcgaggcttgggccgagaagcagggtctcgagctcgctgctgattgtcatctgtcaagaatcgtgcaggccaccacgctcctcactatggataagtacgccccggatgatatccccaatattaactccacttgctttaagcttaacagtctgcaactgcaggctttactccagaattatcattgcgctcctgacgagccttttatccccaccgacctcattgagaacgtggtcaccgttgccgaaaataccgccgacgaactcgctagaagtgacggccgtgaggttcaactggaggaagaccctgacttgcagctgccattcctcctacctgaggatggttactcctgtgacgtggttcgcaacattcccaacggactccaagaattcctggatccactgtgtcagaggggattctgtcggttgatcccccatacaaggtcccccggaacatggaccatttacttcgaaggcgccgattacgaatcccacctcctgagggagaacaccgaactggcccagcctctgcgcaaggaacccgagattatcactgtcactctcaaaaaacagaatggaatgggactcagcatagtggccgccaaaggcgcggggcaggacaagttggggatatacgtcaagagtgttgtgaaggggggcgccgcagacgtagatggccgcctggcagctggggaccaactcctaagcgtagacggcagatctttagttggactatcacaggagagagccgctgagctgatgacaaggacaagctccgtcgtaactctggaggtagctaagcagggggctatttatcatgggctagcaacccttctgaaccaaccatccccgatgatgcagcgcatttcagataggcgaggctccggaaagcctcggccaaagagtgaaggtttcgagttatacaataatagcacgcagaatggctcgccagaatccccccagctgccctgggccgagtacagtgagccaaaaaaacttccaggcgacgatagattaatgaagaacagggccgaccatcgcagttcaccgaacgtagctaaccagcccccatcccccggtggcaagagcgcctacgccagtgggacaactgccaagatcacctcggtaagcacgggaaacctttgcaccgaggagcagactcctccgccacggcccgaggcatatccaatcccaacgcaaacctatactcgcgagtacttcacgttcccagcctccaaaagccaggaccgcatggctcctccacagaaccagtggcccaattatgaggaaaagccccacatgcacacggactcgaaccactcttctatagctatccagagggtcacaaggtcccaggaagaattgcgcgaagacaaggcgtatcagttagagcggcacagaattgaagccgcaatggacagaaaatccgacagcgacatgtggattaatcagtctagttccctcgattccagcacatcatctcaggagcacctgaaccacagcagcaagtcagttacaccagcctcaactttaacaaagagcgggcctgggagatggaaaacaccagcagccatacctgccaccccagttgccgtttctcaacccattcgcacagatcttccacctcccccccctccgccccctgtccactacgctggggacttcgatggcatgtctatggacctgcccctcccgccaccaccttcggccaaccagatcgggctccctagcgcccaggtcgcggctgcggagagacgaaaaagggaagagcaccaaaggtggtacgaaaaagaaaaagccagattagaggaagaacgcgagcggaagcggcgagagcaggagagaaagctggggcagatgcggactcaaagcctgaatccagctccattttcccccttgactgcacaacagatgaaacccgagaagcccagcactctccaacgcccccaagaaaccgtaatccgggagctgcagccacagcagcagccaagaactatagagaggcgcgacctccagtacatcacggtgtcgaaggaggagctgtcatccggcgactccttgtcccccgacccttggaaaagagacgcaaaagagaagctcgagaagcagcagcagatgcatatcgtcgatatgctgtctaaggagatccaagaattgcagagcaaaccagacagaagtgccgaggaatctgacaggctacggaaactcatgctcgaatggcagttccaaaagaggctgcaggaatctaagcagaaagatgaggatgatgaagaggaggaggacgacgatgtcgacacaatgctgataatgcagagactggaagccgaacggcgggcccggctccaagatgaggagagaaggagacagcaacagttagaggaaatgcgaaagagagaggccgaggacagagcgcgacaggaagaggagcgtcgacgccaggaggaagagcggactaaacgggacgccgaagaaaagagacgccaggaggagggctattactccaggttggaggcagagcgccggcggcagcacgacgaggccgcacggcgactactcgagcctgaggccccggggttatgccgccctcccctccctagagactatgaaccgccctcccccagtcccgcccccggcgccccgcctcctccccctcaaaggaatgccagctatctcaagactcaggtgctaagtcccgatagcttatttactgccaaattcgtggcctataatgaagaggaggaggaagaggattgttcactggcaggtccaaatagctatcccggtagcaccggcgccgctgtgggagcccacgatgcctgtcgtgatgctaaggaaaaacgttctaagtcccaggacgcagattccccaggcagcagtggtgcccctgaaaatcttacctttaaggagcgtcaacgccttttttcacagggccaggacgtgagcaacaaggtgaaagctagcaggaaactgactgagctggagaatgagctgaacactaagtag

SEQ ID NO: 196047 - DNA, 3282 bp, Artificial Sequence
  Description of Artificial Sequence: Synthetic coding sequence
atgaaggagatggtgggcggctgctgcgtgtgcagcgacgagcggggctgggccgagaacccgctggtgtactgtgacggtcacgcctgtagcgtggtggtgcatcaggcctgctacgggatcgtccaggtacctaccggcccttggttttgtaggaagtgtgagtcccaggagcgagccgcccgggtccgctgtgaactctgtcctcacaaggatggagcactcaaacgaacggataacggagggtgggcccatgtggtctgcgcactctacatccccgaagtgcagtttgccaatgttctgacaatggagcccattgttctccagtacgtgcctcatgatagattcaataagacatgttatatttgtgaagagcaagggagggaatccaaggcggcatctggcgcttgcatgacatgtaatcgccatggctgccgacaagctttccatgttacgtgtgcccagatggccggtctgctttgcgaggaggaggtccttgaggtcgacaacgttaagtattgtgggtattgcaaataccacttctccaagatgaaaacctcaaggcactccagcggcggaggcggggggggggctgggggggggggcggctctatgggaggtggcggctctggctttatctcagggcggaggtctcgaagtgcctcaccatctacccaacaggaaaagcaccccacacaccatgaacgggggcaaaaaaagtctcggaaagacaaagagagacttaagcaaaaacacaagaaaagacccgaatctcccccgagcatccttacccccccagtcgttcctaccgctgataaagtgtccagctccgcttccagctcatcgcaccatgaagcctcaacacaggagacctcggaatcgtcgcgggaatcaaagggaaaaaagtctagcagccattccttaagccacaagggtaagaagctgtcttcaggtaaaggcgtctcttcattcacctccgccagttcatcttccagctctagtagctcttcatcaggcgggccttttcaacctgctgtgtcgagcttacagtcatctcctgacttctcagcatttcccaagctcgagcaacctgaggaagataagtattccaagcctaccgctcctgccccgtccgcacccccttctccctctgcaccggaaccgcctaaagccgacctatttgagcagaaagtggtcttcagtggcttcggccccatcatgcggtttagcaccacaacctcatcatctggacgcgcacgggcgccctctcccggtgattataaaagccctcacgttacaggctctggtgcttctgccggaacacacaaaagaatgccagcactgtcggctacaccagtcccggctgacgagacccctgaaaccgggctgaaagaaaagaaacataaggcctctaaaagaagcagacacggccctggccggccaaagggtagccgcaacaaggaggggaccggcggcccagccgcaccctctctgccgtctgctcaactggcaggctttactgccaccgcggcctcaccattctctgggggatccttagtgtcgagtggtctgggcggcttgtcttcccgcacattcggcccatcgggttccctcccctccctttcactggagtcaccgttgctcggtgcaggcatctacacctccaacaaggatcctatcagccatagcggcggcatgttgcgcgctgtgtgcagcaccccacttagcagcagtctgcttggccctccgggaacgtctgccctgccaaggctctctaggagcccctttacatccacacttccaagcagctcagcatccattagtacaacccaggtgttcagcctggctgggtccacattctctcttcccagcacccacatatttggtacccccatgggggcggtgaatcctttgttgtcacaagcagagtccagtcataccgaaccagatcttgaagactgctctttcaggtgtcgcgggacgtctccccaggaatctcttagctccatgagccccatttcctctctgccagccctcttcgaccagaccgcctcagcaccttgcggcgggggccagctcgatccggccgccccaggtactaccaatatggaacagctgttagagaaacagggggatggcgaagcaggtgtcaatatcgtggagatgctaaaagctctgcatgcgcttcagaaagaaaaccagcggttgcaggagcagatcctgtccctgaccgcaaagaaagagcgtctgcagattcttaatgtgcagcttagcgtcccctttccggccctccctgctgccttaccagcagccaatggcccagtgcccggtccttacggtctgcccccccaggcgggcagttccgattccctgtctacatccaagtcaccgccaggcaagtccagtctggggctggataatagcttatccacaagcagcgaagatcctcattccggctgtccatctagaagctctagctctctttcctttcattctacaccaccacccctgcccctgctgcagcagtccccggccactttacctctggccctgcccggggcccctgcccccctcccgcctcaaccgcagaatgggttaggacgcgctccgggagcagccggactgggggcaatgcccatggccgaggggctgcttggcggattggccggctccggcggcctgccattaaatggtctgctgggcggtctgaatggtgccgcggcacctaatccagccagcttaagtcaggccgggggtgcccccaccctccaactaccagggtgtctaaacagtctcaccgaacagcaaagacacttgcttcagcagcaggaacagcaactccaacagctgcagcagttgctcgcatccccacagctgacaccggagcaccaaacagttgtgtaccagatgatccaacagatccagcagaaacgcgagttgcagagacttcaaatggctggcggatctcagctgccaatggcaagcctgctcgctggctcaagtactcccttactgtccgccggaaccccggggctcctgcctacggcttctgctccgccactgcttcccgctggcgccctcgtcgctccctcactcggcaacaataccagtctcatggcagctgccgctgctgcagccgctgtagctgcagcagggggcccacccgtcttgactgctcagaccaacccgtttctatcgctgtccggtgcagaaggcagcggcggcggccccaagggggggacagctgacaagggcgccagtgctaaccaggaaaaggggtag

SEQ ID NO: 196048 - DNA, 978 bp, Artificial Sequence
  Description of Artificial Sequence: Synthetic coding sequence
atgaaggagatggtgggcggctgctgcgtgtgcagcgacgagcggggatgggctgaaaaccccttggtgtactgtgacggccacgcctgcagcgtggtggtacaccaggcttgctacggtatcgtgcaggtgccaaccggaccctggttctgtcgcaagtgcgaatcccaggagcgtgctgctcgtgtccgctgcgaattgtgtccacacaaagatggcgcactgaaacggaccgacaatggagggtgggctcatgtggtgtgcgctctctatattcccgaggtgcagtttgccaacgtcctgaccatggaacctattgtgctgcaatatgtgccccatgatcgattcaacaaaacatgttatatttgtgaggagcagggtagggaaagcaaggccgcatcaggggcatgtatgacttgtaaccgacacggatgccggcaggcttttcacgtgacctgtgcccagatggctggcctgctatgtgaagaggaagtgttagaggtcgacaacgttaagtattgtgggtactgcaaatatcacttctcaaaaatgaagaccagccggcattctagtggcggcgggggaggaggcgcgggcggtggcggtgggtcaatgggcggcggcggtagcggttttatatctggccggaggagccggtcggcctctcccagtacccagcaggagaaacatccaacacatcacgagagagggcaaaagaaaagtcgtaaagacaaggagagattgaagcagaagcacaaaaagaggcccgaatctcctccttcaatattaaccccccccgtggtccccacagccgataaaccccgcagaggccaccagagcccaaccaatcatggaattggtagcctgggctgttgtctgccagatactcctatctgtctctgcccagaaggtcttagccccgggttattgtcagctgaatccggcgggagacatagtggactactgtccaagttctag

SEQ ID NO: 196049 - DNA, 16614 bp, Artificial Sequence
  Description of Artificial Sequence: Synthetic coding sequence
atggacagccagaagctggccggcgaggacaaggacagcgagcccgcggctgacggcccagccgcctccgaggatccgtccgcaactgagtcagatttgcctaatccccatgttggcgaggtgtcggtgctcagttccgggtcgccaagactgcaagagactccccaggactgtagcgggggacctgtgcggcgatgcgccctgtgcaactgcggtgaaccttcccttcacggccagagggagctgcggcgcttcgaattgccattcgactggccacgttgtccagtggtttcaccagggggatccccaggcccgaatgaagcagttctcccttccgaggacctttcacagatcggattccctgaaggtttgacccctgcccacttgggggagcccggtggctcttgttgggctcaccactggtgcgctgcatggtctgccggcgtgtggggccaggaggggcccgagctgtgcggagtggataaggcaatcttcagcggaatttcgcagcgctgctcacactgcactcgactgggcgcatctataccttgcaggtcccccggatgtcctagattatatcacttcccttgcgccacggcatccggtagcttcctgagcatgaaaacactgcagctgttatgccctgagcacagcgagggcgctgcgtaccttgaggaagccagatgtgcagtctgtgagggcccgggcgagctgtgcgatctgtttttctgtacctcatgcggtcatcattaccacggcgcatgcctagatactgcattgacggcacggaagcgtgctggttggcagtgcccagagtgcaaagtctgccaggcctgccgcaagcctgggaacgactcaaagatgctcgtttgcgagacctgcgacaaggggtatcacaccttctgcttaaagccccccatggaagagttaccagcgcatagctggaaatgtaaggcttgccgggtgtgtagggcgtgcggggccggcagtgctgaactgaacccaaactctgaatggttcgagaactactccctgtgccaccgctgccacaaagctcagggtggacagacaattaggtcagtcgctgagcaacataccccggtgtgctccagattttcccctccagagcctggggatacccccactgacgagccggacgccttgtatgtcgcctgccaggggcagcctaaggggggccatgttacatctatgcagccaaaggaacctggccctctgcagtgcgaggctaagcccttagggaaagccggagtgcagcttgaaccacaactggaggcacccttgaacgaggaaatgcccctgctccccccccccgaggagtcaccactcagtccccccccagaagaatcccccactagtccacccccagaagcatcaagactgtcccccccaccagaggagttacccgcgagtcccctgcctgaggctctacatcttagtagacccctcgaagaatcccccctgtccccgccaccagaagagagtcctctgtctccaccccccgagtcatctccctttagcccacttgaggagagtcctttatctccccctgaggaatccccgccttcaccagccctggaaaccccgctgagtcccccacccgaggcctcgcccctgtccccccctttcgaagagtccccgctgagcccaccccccgaagaactccctacctccccccctccagaagcgtctagactgagtccaccacccgaggagagccctatgtctcccccaccagaggagagtcctatgagccctcctccagaggccagccgcctgttccctcccttcgaggaatcacccctgtcacctccacccgaggaatcccctctttcgcctccacctgaggcgtcaagattaagccctcctccagaagacagccccatgtcccccccccctgaagagagtcccatgagcccaccccccgaggtctcacggttgagtccccttccggttgtgtcgagactgtcaccccctcctgaagaatcccctctgagccctccgcctgaggagagtccgacttcgccccctcccgaagcttcccggctgagtcccccacctgaggatagcccgacctctccccccccagaggattcccctgcctctcccccaccggaggattcgctgatgtctctgcccctcgaggagagcccgctgctgccactgcccgaagaaccccagctgtgccccagatctgagggtccacacctgagccctaggcccgaagagcctcatcttagccccagacctgaggagccacacctgtcaccacaagcagaagaacctcacttaagtccacagccagaagagccatgtctctgtgctgttcctgaagagccccatctgagcccacaggctgaaggtccacatctgagtccccagcccgaggagctgcatctgtcaccccagaccgaggagcctcatctgtcccctgttccagaggagccatgcttgtccccccagcccgaagagtctcaccttagccctcagtccgaggaaccttgcttgtcaccaaggcccgaagaatcacacctatcaccagaacttgaaaagccgcctctgagtccacgccccgagaagcctccagaagaacccggtcaatgtccagccccggaagagttgcccttatttcccccccccggagagcctagcttatcacctctgctaggagagccggcgctgagcgaacccggagagcccccgctaagccctctccccgaagagctgcccctgagcccgtctggagagccctcgctctctcctcagctgatgccccccgacccactccccccaccgttgagccctattattaccgcagcagctcccccagcactaagccctttaggtgagcttgaatatccctttggcgcaaagggggacagcgatccagagtccccactggcagcccctatactagagacccccatcagcccaccccccgaggccaactgtactgacccagaaccggtgccccccatgatcctgcctccttcaccgggctcccctgtggggccggcatccccaatcctgatggaaccattacctcctcagtgctcccccctgctgcaacacagcttagtccctcagaatagcccaccatcacagtgcagcccccctgccctgcctttgtcagtcccctcaccacttagtcctatcggcaaggtggtgggcgtttcagacgaagccgaactccacgaaatggagactgaaaaagtgagcgagcctgaatgccccgccttagagccaagtgccacttccccattgccttctccgatgggtgatctaagttgccctgctccgtcccctgcccccgctcttgacgatttctccggccttggggaggacacggctcccttggacggaatcgatgccccaggaagccagcctgagccaggccaaacccctggttctttggcaagcgagttgaaggggagtcctgtgttattggatccagaggagctggctcctgtgactcctatggaggtctatcctgagtgtaaacagaccgcaggccaaggttctccctgcgaggaacaggaggagccgagggccccagtggccccaacaccaccaactcttataaaaagtgatatcgtgaacgagatttctaatctcagtcagggcgatgcttccgccagttttcctggcagcgagccgctgctcgggagccccgatccggaaggaggcggcagtttgtccatggaactgggcgttagtaccgacgtgtcgccagccagggacgagggctctctccgcctatgcactgattctctaccagagactgacgacagcctcctgtgcgatgcgggaactgcgatcagtggaggcaaagccgaaggggagaaaggacgtaggcggtccagtccggcccggtcacgcatcaagcaggggaggtctagtagttttccgggacgcagaagaccgcggggaggcgcacatggaggacgtggacgtggaagagcaagacttaagagcaccgcatcaagtatcgagactctggtggtggcagacattgacagctcccccagcaaggaagaggaggaggaggatgacgatacgatgcagaatacagtagtgctgtttagcaacaccgacaaattcgtgcttatgcaggatatgtgtgttgtgtgcggatcattcggacgcggcgccgaagggcatctgctcgcctgttcacaatgttcacagtgctatcatccatattgtgttaacagtaaaatcacaaaagttatgctgctcaaagggtggcgttgcgtcgagtgcatcgtgtgtgaggtgtgcggccaggcgagcgatccttccagactcctgctttgcgatgattgcgatatttcctatcacacttattgtctggaccccccgttactgaccgtgcctaagggaggctggaagtgcaagtggtgcgtgtcctgcatgcagtgtggcgctgccagcccaggctttcactgcgagtggcaaaatagctatacccattgcggaccttgcgcttcactggtaacatgcccaatctgccacgctccgtacgtcgaggaagatctgctgatccaatgcaggcactgtgagcgctggatgcatgccggctgtgaatccctgttcaccgaggatgacgtggagcaagcagcagacgagggctttgactgtgtgtcctgccagccatacgtagttaaacccgtggcacccgtggctccacctgagctcgtaccgatgaaagtgaaagagcctgagccccagtattttcgcttcgagggggtttggctgacggagaccggcatggccttgctgagaaatctcactatgtcgcccttgcacaagcggagacagaggagaggaagattgggtctgccgggcgaagcgggcctggagggaagtgagccctcagacgctctgggccctgatgataagaaggatggcgacctcgataccgatgagctcctaaaaggcgaagggggagtcgagcatatggaatgcgagatcaaattggaaggccccgtttccccagatgtggaacctggaaaagaagaaactgaagaaagcaaaaaacggaagcgaaagccgtacaggcctggcatcgggggattcatggtccgacagcgtaagagtcataccagaacaaaaaaaggtccggctgcccaggctgaggtactcagtggcgacgggcagccagatgaagtgattcccgcagatctgccagcagaaggggcagtggagcagagcctcgccgagggggatgaaaagaagaagcagcagcggaggggcagaaagaagagtaagcttgaggacatgtttcccgcatatctacaagaggcattctttggtaaagaactacttgacctctcgcgcaaagcgctgttcgcggttggagtcggcagaccctctttcgggctgggtacacccaaggcaaaaggtgacggcgggagtgaacggaaggaactgcccaccagccagaagggagatgacggccctgatatcgctgacgaggagtcgcgggggctggaaggcaaagccgacactcccgggcccgaggacgggggagtgaaggcctcccccgttcccagcgaccccgagaagcccggcacacccggcgagggaatgctctcgtctgatcttgaccgcataagtacagaggaacttccaaagatggaaagtaaggatttgcagcagttattcaaggatgtgctcggctcagagcgggagcagcacctcggctgtggcacccctgggctggaaggctctcgaactccactgcagagaccctttctgcagggtggtcttccgctgggaaatctcccttcctcttcacctatggacagttacccaggcctgtgccagagccctttcctcgatagccgggagcgtgggggtttttttagtcctgagccgggtgagccggattctccttggacggggtccgggggcacgacacctagcacccctactacaccaaccacagagggggagggagatggcctgtcttataatcagcgttctttgcagcggtgggaaaaggacgaggaactgggacaactgtccaccattagccctgtcctgtatgccaatattaatttccctaacctgaaacaggactacccggactggtctagccgctgcaagcagatcatgaagctgtggcggaaggtcccggccgccgataaagccccctatctacaaaaagcaaaagataatcgcgctgcccaccgaataaataaggtgcaaaaacaggccgagtctcaaatcaacaaacagactaaggtaggcgacatagctcgtaagaccgatcgccccgctctgcacttacgaatcccaccccaaccaggagccctcggaagccctccgcccgccgctgctccaaccatctttatcgggtcacccacgactcccgcaggcctttccaccagtgcggacgggtttcttaagccgccagctggcagcgttccagggcccgactctcctggagagctctttctgaaactccccccacaggtgccagcccaggtccctagccaggatcctttcggactggcaccagcataccctctcgagccgcgctttccaacggcccctccgacatatcctccatacccctcaccgacaggggctcccgcccaaccacctatgctgggagcaagctctagaccaggagccggccagcccggagaatttcataccacaccacccggcactcctaggcaccagcctagcacccctgacccctttttaaagccgagatgtccatctcttgacaacttagctgtgcccgagagccctggggtcggggggggaaaggcctccgagccactcctgtcacctcctccttttggtgagtccaggaaagccctagaggttaagaaagaggaactgggagcatccagtccgagctatgggccccccaacctgggctttgttgactctccctcaagtggtacacatttaggcgggctagaactcaagaccccggacgtctttaaagccccacttacgcctagggccagtcaagtggagccacagagcccaggcctcgggctgcggccacaagaaccgccgcccgcccaggccttggctccttctcctccttcccaccccgacatctttaggccggggtcatacacagacccctatgctcagccgccactgacaccacgaccacagcccccccccccagagagctgttgtgccctgccccctaggagtcttccctctgatcccttttcccgggtgccagcctcccctcagagccaatcatcatcacagtcccctcttacaccaaggcccctgagtgcggaggccttctgtccttcaccggttacacccaggttccaatcgcctgacccttattctaggcctccctcccggccccaaagtagagacccattcgcccctctacataaacctccacgtccacagccaccagaggtggcgtttaaggccgggtctctcgctcacaccagcctgggggccggtggatttccagccgccctacctgcaggtcccgcaggggagctccacgcgaaagtgccctctggccagccacccaactttgtgaggtctcccgggaccggggcgttcgtgggaacaccatctcctatgcggtttactttcccacaggccgtcggagagccatccctgaaacctcctgtgccccaacccggcctgccaccaccacacggtattaactctcactttggtccggggcccaccctggggaaaccacagagcacaaactacacggtggcgaccggcaatttccaccctagtggcagccctcttggcccaagtagcggctccacgggggagtcatacggactctctccactgcggccaccatccgtccttcctcctcctgctcccgacggcagtctgccgtatctctctcatggcgctagccagaggagtggaattacatcccccgttgagaaacgggaggatccagggactgggatgggctctagcttggccacagcagaacttccaggaacacaggatccaggcatgtctggcctatcccagaccgagctggagaagcagcgccaacgtcagcgccttagggagctcttgataaggcagcaaatccagcggaacaccctgagacaggaaaaagaaaccgcagcagccgccgccggtgctgtgggaccgcccggatcatggggggcagagccttcgagcccggcttttgagcagctttcgagaggccaaacgccctttgctggcacccaagacaagagttcgctggtgggcctccccccttctaagctgtcgggaccaattttagggcctgggtctttcccaagcgatgacagactctctagaccaccaccaccagcaacaccctcctccatggacgtgaattcaagacagctggtcgggggaagtcaggcattttaccaaagagccccctacccagggagcctgcccctacagcagcagcaacagcaactttggcagcagcagcaggcgacggctgccactagtatgcggttcgccatgtccgctcggtttcctagtacacccgggccagagctaggacgccaggctctgggctctcccctggctggaatctctacccgcctgcccggcccgggcgagcctgtccccgggcccgctggtcctgcccagtttattgagctgcggcataatgtccagaagggcttgggaccaggtggaactccattccctggacagggaccaccacagagaccacggttttacccggtctccgaggatcctcaccgactggctcctgaagggctgagaggactcgccgtcagtggcttgcctccccagaagccctctgcacctccggctcccgaactcaacaacagcctccatcccacgccccacactaagggcccgactctccccacaggccttgagctggttaaccggcctccgagctccacagagctgggacgacctaatccacttgccctcgaagcagggaagctgccctgcgaggatccagaactggatgacgactttgacgctcacaaggcactggaagatgacgaggaactcgctcatctggggttaggagtagatgtggccaagggagacgatgaactgggaacactggagaaccttgagaccaacgatccccatctggatgatctgctgaacggagacgagtttgacctgctcgcctataccgatcccgagttagacacaggagacaaaaaggatatcttcaacgagcacctcagacttgtagaatctgccaacgagaaagcagagcgcgaggccctgctgagaggagtggaaccgggacccttggggcccgaagaacgacctcctcccgctgcagatgcttcagagcctaggctggcttctgtactccccgaagtgaaacctaaggttgaggagggcgggcgtcaccccagtccctgccagtttacaatcgccacacctaaagtggagccagctccagctgccaactcgctggggctgggtcttaaaccgggccagtcaatgatggggagtcgtgatacacgtatgggcactggtccattttcgtctagtgggcacacggccgaaaaggcctcatttggcgccacaggaggccctcccgctcacctacttaccccctcaccactatccgggcccgggggttcatcccttctcgagaagttcgaattagagtcaggggcccttacacttccgggcggcccagccgcttcaggcgacgaactcgacaagatggaaagttctctggtggcaagcgagctccctcttctcatcgaagacctactcgaacacgagaaaaaggagctgcaaaaaaaacagcagctgagtgcccagctacagcctgctcagcagcagcagcaacagcaacagcaacacagcctgctctccgccccaggacccgcgcaggccatgagcctcccccacgagggcagcagcccatctttagccggctctcaacagcagttgtccttgggcttggctggagccagacagcccggtctgccccaacccctgatgcctacacagcccccagcccatgcattgcaacagcggctggcacctagcatggccatggtttccaaccaggggcacatgctgagcggccaacacggcggacaggccggcctggtccctcagcagtcctctcaaccagtccttagccaaaaacccatggggactatgccaccaagcatgtgtatgaagccacagcaacttgcaatgcaacagcagctagccaatagcttttttccggacaccgatcttgacaaatttgcagccgaagacatcattgacccaattgctaaagccaagatggtggccctcaaggggatcaagaaggtgatggcacagggaagcattggcgtcgcacccggcatgaatagacaacaagtgtcattattggcacagaggctgagcggaggaccttcttcggaccttcagaatcacgttgcagccggcagtggtcaggaacgcagtgcgggcgaccccagccagcccaggcctaatccacctacattcgcccagggcgtcataaatgaagccgatcagagacagtatgaggagtggctgttccacacgcagcagttgctgcagatgcagctgaaggtcctggaggaacagatcggcgtccaccgaaagtcaagaaaagcactgtgcgctaagcagagaaccgcgaagaaagccggccgcgaattccccgaagccgatgccgagaaactgaagttagtgaccgagcagcaaagcaagatccaaaaacagcttgaccaagtccgcaaacaacaaaaggaacatacaaacttgatggccgagtatcggaataagcagcaacagcagcagcagcagcaacagcagcagcaacaacagcacagtgcggttctggcgctaagcccctcgcaatcaccacgtctgctgaccaaactaccagggcagctgctccccggtcacggcctgcaacccccccagggccctcccggaggtcaagcaggcggattgcgtcttacccctggagggatggcattgcctggccagcctggaggtccattcttgaacacagctctcgcccagcagcagcaacagcagcactcgggtggagccggcagtctggccggacctagtggcggcttctttcctggaaatttggccttgaggtcactgggaccagactcccgtttactccaagaacgtcagttgcagctccagcagcagaggatgcagcttgcgcagaagctccagcagcaacagcaacagcagcagcaacaacaacatctcctcggccaggtcgcaatccagcagcagcaacagcagggtcccggcgtgcagactaaccaagcgctgggcccgaagccacaagggttgatgcctccctccagccatcaaggactgctggttcagcagctttccccacaaccgccacagggaccgcaaggtatgctgggcccagcgcaggtagctgttctccagcagcagcaccctggcgccttggggccacaggggccgcataggcaagtgctcatgacccagagccgggtattgtcttcgcctcagcttgctcaacagggccagggcttgatgggtcaccgcctggttaccgcccaacagcagcaacagcagcagcagcatcagcaacagggaagcatggctggcttgtctcacctgcagcaaagtctgatgtcgcatagcggccaaccaaagctctccgcccagcctatggggtccttgcaacaattgcaacagcaacaacagcttcagcagcagcagcaactgcaacagcagcaacagcagcagttgcagcaacagcagcaattacagcagcagcagctccaacagcaacagcagcaacagcagcttcagcaacagcagcagcagcagcttcaacaacaacagcagcagctgcagcagcagcagcagcaacaacagcagcagtttcaacagcaacaacagcaacagcagatgggcctgttgaaccagtcccgcacgctcttgtccccacagcagcagcagcagcagcaagtggctctaggccccggcatgccagccaagccattacagcacttctccagccctggagcgctcggaccaactctgctcctgacgggcaaagagcaaaatactgtggacccagccgtgtctagcgaagcaaccgagggccctagcactcaccaggggggccctctggcaatagggaccacgcctgaatctatggcaacagagcctggcgaagttaagcctagcctctctggagactcccagctattacttgtgcagccccagccccagccccagccaagttcccttcagcttcaaccgcccctccgcctacccgggcaacagcaacagcaagtttccctgctgcacaccgccggtggggggtcacatgggcaactgggctcaggatcctcatcagaggcttcttccgtccctcacctgctggctcagccctctgtatccctgggggatcagccaggaagcatgacgcaaaatctgttagggccacagcaaccaatgctggagcgcccgatgcagaataatactggtccccagccccccaagccggggccggtcctgcagagcggtcaggggctacccggagtggggataatgcccactgtcggccaactgcgcgcccagctccagggcgtcctcgcaaaaaaccctcagctcaggcacttaagtccacaacagcagcagcaactccaagctttgttgatgcagcgccagctgcagcaatctcaggccgtgaggcagactcccccataccaggagcctggtacacagacgagcccgctgcaggggctgcttgggtgtcagcctcagctcggcggctttcccggtccacaaacaggcccacttcaggaattgggagccggcccacgcccacagggccccccaaggctccccgccccccctggggcactcagtaccggacccgtgctagggccagtccatcccacccctcctcccagcagccctcaagaacctaagcgtccctcccagctcccctcaccctcgagccagctgcctaccgaggcccagcttccacccacccatcccgggactcccaagccccaaggccctaccctggaacctccccccggtagagtcagcccagccgccgcacagctagcagacactctgttctccaaggggctgggtccgtgggaccctcccgacaacctggcggaaactcagaagcccgagcagtcttctctggtacccggtcacctggatcaggtgaatggtcaggttgtgccggaagcgtctcagttatctatcaagcaggaacctcgtgaggagccatgtgccctgggggcccagagtgttaagcgcgaagccaacggggagccaattggagcccccggcacttctaaccacctcctcctcgccggcccaagaagtgaggccggacatctgctcctacagaaactgctccgggccaagaacgtgcagctctctaccggacgcggatctgagggactgagggcggaaatcaacggccatattgattcgaaattggctggcctggaacaaaagctccagggtaccccatccaacaaagaagacgccgctgcccgcaaacccttgactcctaagcctaaaagggtacagaaagctagtgacagactggtaagctcacggaaaaagctcaggaaagaggacggagtacgggcatctgaagccctccttaagcaacttaaacaagaactctctttgctgcctctgactgaacctgccatcacagcaaatttcagcctcttcgccccttttggatcagggtgcccagtgaacggccagtcgcagctccgcggagcctttggatctggggccctccccactggccctgactactacagccagctcctgaccaagaataatctttcaaacccgccgactccaccaagttctctgccccctacccctccacccagcgtacagcagaagatggtcaatggggtgaccccctcagaggaactaggcgaacatccaaaagacgcagcaagtgcgagggactccgagagggccctgcgagatacctccgaggttaagagtttagacctgttagctgcactgccaactcccccacataaccaaacagaggatgtgagaatggaatctgacgaggactctgactcccctgattctatcgtaccagcaagcagtcctgagtctatccttggcgaagaggctcccagattccctcatctgggaagcggtaggtgggagcaagaggatcgcgcactgtcacccgtcattcctctcattccacgggcttcaataccggtgttccccgatactaaaccttacggcgctcttggactggaagtccctggtaaactccccgtgaccacatgggagaagggcaaggggtccgaagtctcagtgatgctgaccgtgagcgctgctgccgcaaagaacttaaacggagtcatggtggccgttgccgagctgttaagcatgaagatccccaatagttacgaggtgttgttcccggaatcccctgcgcgggcagggactgagcctaaaaagggagaggctgaagggccaggggggaaggagaagggacttgagggcaaaagccctgatacgggccccgattggctgaagcagtttgatgccgtcctacccggctatactctgaagtcccagttggacatcctatcgctcttgaagcaggagtctccagcacctgagcccccaacacagcatagctatacgtacaatgtgtctaacctggacgtgagacagctcagtgcccctccccctgaggagccctcccccccacccagcccacttgcaccctcccccgcctcacctcctaccgaacccctcgttgagctccctacagagccacttgccgagccccccgtcccttcacccctcccactcgcgagctcacccgaaagcgctagacctaaaccccgagcacggcctcccgaggagggcgaggacagtcgcccacctcggctcaaaaagtggaaaggtgtaagatggaagcggcttagattgctcttaacaatccagaaaggatcgggtcggcaggaagatgagcgggaggtcgctgaatttatggagcagctcggcaccgccctgcgacctgacaaggtcccaagagatatgaggagatgttgcttctgccatgaagaaggcgatggagcaacagatggtcctgcccgcttacttaaccttgatcttgacctatgggtgcaccttaactgtgctttatggtccaccgaggtctatgaaacgcaggggggggcactgatgaacgtggaagtagccctccacagggggttattaactaagtgctccctatgtcagagaaccggtgccacgagttcgtgtaatcgtatgcgctgtccaaacgtgtaccacttcgcctgcgctataagagctaaatgcatgttttttaaagataaaaccatgctctgccctatgcacaaaatcaagggaccatgtgaacaggaactaagcagttttgcggtgtttcgacgggtctatattgaacgcgatgaagtcaagcagatcgctagcataatccagcgcggggagcggctgcacatgtttcgggtgggtggactcgtttttcacgcgatcggtcagctcctgccccatcagatggcggatttccactcggccaccgccctgtaccctgtgggttacgaggcaacacgcatctattggtccttgagaactaacaatagaagatgctgttacagatgttcgatcggggaaaataacgggaggcccgagttcgtcatcaaagtgatcgagcagggactggaagatctcgtgttcactgacgcctcgcctcaggccgtatggaacagaattatcgaacctgtggccgccatgcggaaggaagccgatatgctgcgtttgtttcctgagtacctgaagggagaggagctcttcggtctgacggtgcacgccgttctgcggattgcagagagcctgccgggtgtagagagctgtcagaactacctgttccgttatgggcgccatccgttaatggaactgcctctgatgatcaatcctaccgggtgcgcacggagcgagcccaagatattgacccattacaaaagacctcacacgttgaactcaactagcatgtccaaagcttatcagtctacctttaccggagagaccaacacaccctactccaaacaatttgtccatagtaagagcagtcaatatcggagactgagaaccgaatggaagaacaacgtctacttagcacggagtcgcattcaaggcctgggcttgtacgcagccaaagacctggagaagcacactatggtgatcgaatatatcggtactattattcgcaacgaggtagctaaccgacgcgagaaaatctatgaggaacaaaaccgggggatctacatgtttcggataaataatgagcacgtgatcgacgcaaccttgacaggtggaccagcaagatatatcaaccactcttgcgccccaaattgcgtagctgaagttgtaacgttcgataaggaagataagatcatcattatctccagtaggcgcattcctaaaggagaagagctcacatatgactaccaatttgactttgaggacgatcagcataagatcccctgccattgtggcgcctggaactgccggaagtggatgaactag

SEQ ID NO: 196050 - DNA, 441 bp, Artificial Sequence
  Description of Artificial Sequence: Synthetic coding sequence
atggacagccagaagctggccggcgaggacaaggacagcgagcccgctgcagatgggccagcggccagcgaggatccatcggccacagaatcggacctccctaacccacatgtcggggaggtttccgtccttagcagcggcagccctaggctgcaagaaacaccacaggactgttcgggcgggcccgtgagaagatgtgctttatgcaactgtggcgagccaagccttcatggccagagagaactgcggcgctttgagttgcctttcgactggccacgctgtccagttgtctcacctggcgggtctcctggaccaaatgaagctgtgctgccctccgaagatctctcccagatcgggttcccagaggggctgactccggcccatctaggcgaaccagggggatcttgctgggcccaccactggtgcgcagcctggagctag

SEQ ID NO: 196051 - DNA, 14736 bp, Artificial Sequence
  Description of Artificial Sequence: Synthetic coding sequence
atgagcagcgaggaggacaagagcgtggagcagccccagcccccccctccacccccagaagagcctggggctccagcgccatcacctgctgccgcggacaaaagaccacggggcagaccacggaaggacggagcatctccgtttcagcgcgcccgtaaaaagcctcgcagccgaggcaagaccgccgtggaagatgaagacagcatggacggtctagaaaccaccgagacagagactattgtggagacagagattaaagaacagtcagccgaggaggacgccgaggctgaagttgataattccaaacagctcattcccaccctccaacgttctgtgtctgaggagagtgccaactctctcgtgagcgtgggcgtggaagcaaagattagtgagcagctatgtgctttttgttactgtggggagaaatcttccctcggccagggagacctcaaacagttcagaatcactccaggcttcattctgccttggaggaaccagccatcgaacaaaaaagacatagatgacaactcaaatgggacctacgaaaaaatgcaaaacagtgccccacggaagcaaagaggccagaggaaggaacgaagtccccagcagaacatcgtctcctgtgtatcagtttctacacagaccgcctcggatgaccaggcaggcaaactctgggatgagctctctctcgtgggactcccagatgccatcgatatacaggccttatttgattcaaccggcacatgctgggcccaccatcggtgcgtggagtggtctctgggagtttgccaaatggaggaacctctcctcgtgaatgtggacaaggctgttgtgagcggtagtacagaacgctgcgccttctgcaagcacctgggagcaaccatcaagtgttgtgaggaaaaatgcactcagatgtaccactacccatgtgcagccggtgctggtaccttccaggacttcagtcacatcttccttctatgccctgagcacatcgaccaggcaccagaaaggtcgaaagaagacgcaaattgcgctgtgtgtgattctcccggtgatctgctagaccaattcttttgcaccacctgcggacagcattaccatggtatgtgcttggacattgcagtgacgccactgaaaagggcgggatggcaatgcccggagtgtaaggtgtgtcaaaattgtaagcagagcggtgaggattccaagatgttggtctgtgacacttgtgataaaggctatcacacattttgtctccaaccagtgatgaagtcggtcccaaccaatggttggaaatgcaaaaactgcagaatctgcattgagtgtgggacgagatcctccagccagtggcatcacaactgcctgatctgcgacaactgctaccagcagcaagacaatctgtgcccattctgtgggaagtgctaccacccagagctgcaaaaagatatgctgcactgcaacatgtgcaagcgttgggtgcacctagaatgcgacaagcctacggatcacgaattggacactcagttgaaggaagagtatatttgtatgtattgtaaacatcttggtgccgaaatggaccggctccagccgggtgaagaagtagaaatcgccgagctgacgacagattataataatgagatggaggtcgagggccccgaagatcagatggtgttctcggagcaggccgccaacaaagatgtaaatggacaagagtccactcctgggattgtccccgatgccgtgcaggtgcacaccgaagagcagcagaagagtcatccaagcgagtccttggacacagactctctgcttatagctgtgagtagtcagcataccgtcaataccgaattagagaagcagatttctaacgaggtcgatagcgaagacttgaagatgagtagcgaggtgaaacatatttgcggagaggatcagattgaagacaagatggaagttacagagaacattgaagttgtgactcatcagatcacagtgcaacaagagcagctgcagctactggaggaacctgagacagtagtgagcagggaggaatctagacccccaaagctggtcatggagagtgtgactctgcccctggaaaccctcgtgtctccccacgaagagtctatcagtctctgtcccgaagagcagctcgttatcgagcgattgcagggcgagaaggaacagaaagagaatagcgagctcagcacggggctgatggactctgagatgactcccaccattgaggggtgcgtgaaggacgtgagctaccaaggaggaaagtccattaaactttcatctgagaccgagagcagcttctcatccagtgccgatattagtaaggcggatgtgtccagctctcccacaccttcttccgacttaccaagccacgacatgctgcacaattacccttccgccttgtcatcttctgctgggaatattatgccaacaacctatatatctgtcactccgaaaataggcatgggcaaacccgccatcaccaaaagaaaattttccccagggagacctcgaagtaagcagggggcctggtccacccacaacaccgtctcaccgccctcctggtcaccagacatatcagaaggtcgcgaaatcttcaagcccaggcaactccccggcagtgctatttggtcaatcaaagtgggacgcggcagtggatttcccggtaaaaggaggcccagaggcgcagggctgagtggaagaggaggtagggggaggtccaaactgaagagcggaatcggcgcagtggtcttgcccggcgtgtccactgcggacatttcgagcaacaaggatgacgaagagaactccatgcataacaccgtggtgttattttccagttcagacaaattcaccctgaaccaagacatgtgtgtggtttgcggatctttcggccagggagctgaagggcgcctactggcctgcagccagtgtggacagtgttatcatccatattgcgtgagcatcaaaattaccaaggtggttttaagcaaagggtggaggtgcctggagtgcacggtgtgcgaggcctgcggtaaagcaacagatcccggtcgtctgctcctctgtgacgattgcgacatcagctatcacacctactgccttgaccctcctttgcagacagttcccaagggaggctggaaatgcaagtggtgcgtttggtgcaggcattgtggtgccaccagtgctggccttaggtgcgagtggcagaacaactatacacaatgcgctccttgtgcatctctcagtagttgtccagtgtgctatcgaaactacagagaagaggaccttatcctgcaatgccgacagtgcgatagatggatgcacgctgtgtgccagaacctgaatactgaagaagaggtagagaatgtagctgacatcggattcgattgctccatgtgtcgcccatatatgcccgcatccaacgtgccgtcctccgattgttgtgagagcagtctggtggcacagatcgtgaccaaagttaaggagcttgatcctccaaaaacatacacacaggacggggtgtgtcttactgagagcggaatgactcagctgcaatcgctcacggtaactgtaccaagaaggaagcgcagtaaacctaagctgaagctcaaaattatcaaccaaaatagtgtagcagtgttgcagacgccccctgacatccagagcgaacacagtagggatggggaaatggatgatagcagggagggagaactgatggactgcgatggtaagtcagaatcctctcccgagcgcgaagctgtcgacgatgaaaccaagggagtggagggcactgatggagtaaaaaaacgaaaacgcaagccctacagacccgggattggaggctttatggtgcgccagaggagcaggacaggccagggaaaaactaaaaggtccgtcattcgcaaggatagctccggtagtattagcgaacaactgccgtgtagagatgatggctggtctgagcagctccctgacactttggtggatgagagcgtttccgtgactgagagtactgagaagattaaaaagcgttatcggaagcgaaagaacaagctcgaagaaactttccctgcctaccttcaggaagcctttttcggaaaggaccttctggacactagccgacagtccaagattagccttgataatctcagcgaagacggagcccagctgctctataagactaacatgaataccgggttccttgacccatccctcgaccccctgctgtcaagctctagcgcccctacaaaatctggaacacatgggccggctgacgaccccttggctgatatttcagaggtgttaaataccgatgatgacatcctggggatcattagtgacgatctggccaaaagtgtggaccacagtgatatcgggcccgtgactgatgacccaagctctctgccccaaccaaacgttaatcagagttcccgcccgctctctgaagagcaactggacggcatcctgtctcctgaactcgacaaaatggtgactgacggtgcaattttgggaaaactatacaagatccctgaactcggaggaaaggacgttgaggaccttttcaccgctgttctatctcccgccaacacacagccgactcccctgcctcagccccctccccccacacagctgctcccaatccacaaccaggacgcattctcccgcatgcctttgatgaacgggctgatcggcagttctccacacctaccccataattctctgccgccagggtcgggacttggcaccttctcagctattgcccagtctagctatccggacgcccgggataagaatagtgccttcaacccaatggcaagcgatccaaataactcttggacaagttcagcccccacagtggagggcgagaatgatacaatgtctaatgcccagcgctcaactttaaaatgggaaaaagaagaggccctaggtgagatggctaccgtggcaccagtcctttatacaaacatcaacttcccaaatttaaaggaagagtttcccgactggacaactcgggtgaaacagatagcaaagttgtggcggaaggcgtcatcccaggaacgggccccatacgtccaaaaagccagagacaacagagccgccctgcgtatcaacaaggttcagatgagcaatgacagcatgaagcgtcagcaacaacaggactccatagatccatctagtagaatcgacagtgagttgtttaaggatccactgaaacagcgcgaatctgaacacgaacaggagtggaaattccgccagcaaatgcgacagaaatccaagcaacaggctaagatcgaggcgactcagaaactcgagcaggtcaaaaatgagcaacaacaacaacaacagcagcagttcggtagccagcatctgctggttcaatctggctctgatacaccttctagcggcatccagtcccctcttaccccccagcctggtaatggaaatatgtcaccggcccaaagttttcacaaagagttattcacgaaacaacccccatccactcccacaagtactagcagcgacgacgtctttgtgaagccacaggcaccccccccaccgccagcccctagtaggattccaatccaggacagtttaagccaggcacagacgtcccagccacccagcccccaggttttctcaccaggctcatccaactcccgccccccaagcccgatggacccttatgccaaaatggtaggcactccaaggcccccacccgtgggccacagtttttcaaggcgaaattcggctgctcctgtggagaattgcacccctctttccagcgtcagccgacccctgcagatgaatgaaactactgcaaatcggccaagtcccgtccgggacctatgctcctcctcaacgaccaacaacgacccctatgccaaaccacctgatactcctaggcccgtgatgactgaccagttcccaaagtccctcggactctcccggtcccccgttgtgtcagagcaaacagctaagggtcctatcgcagcaggaacatcagaccacttcacgaaaccttctcctcgcgctgacgtcttccagcggcagagaattcccgattcttacgcgagacctctgctgaccccggcaccattggacagcggcccgggcccctttaagactcccatgcagccccccccatcctcgcaggacccctatggctcagtatcacaggcaagtcgtagactttccgtggacccatacgaaagacccgcgctgactccaagacctattgataacttttctcacaatcagagcaatgacccttacagtcaaccaccactgaccccacacccagccgttaacgaatcttttgcccaccctagtcgggccttctcgcagccaggaaccatctcacggcctacttctcaagatccatacagtcagccgccgggaacccctaggcctgttgttgacagctatagccagtcttctggtacagcgcgatctaacaccgatccgtacagtcagcctccaggcaccccacggcccacaacggtcgacccttactcccagcagccgcagaccccgcggcccagtacccagaccgatctgtttgtgactccggttacgaaccagagacattccgacccttacgcccacccacccgggactccacggcccgggattagtgtgccttactcacagcctcctgccacacccagaccgcggataagcgaagggttcacaaggtcctctatgacccgaccagtcctgatgcctaaccaggacccattcttgcaagcagcgcagaatcgcgggcccgccttaccagggcctctggtccgcccccccgacacttgctctcagactccgaggccacccggccctggcctgtccgataccttctcacgtgtgagcccctcagcagccagagacccctacgatcaatctccgatgaccccgaggtctcagagcgactctttcggaaccagtcagacagcccatgacgtggcagaccagccccggcctggaagtgagggctccttctgtgccagttctaacagccccatgcattctcaggggcaacagttcagcggcgtgtcccagctcccagggccagtacctacctcaggggtgaccgacactcaaaacacggtgaacatggctcaggcagacacggagaagctcaggcagcgccaaaagttgcgtgagatcatcctgcagcaacagcagcaaaagaagatcgcaggacgtcaggagaagggcagtcaggattctccagccgtgccccacccggggccactccagcattggcaacccgaaaatgtcaaccaggctttcactcgaccacctcctccatacccaggaaatatccgcagcccagtcgccccacctctgggcccacggtacgcagtgtttccaaaggatcagaggggtccctaccccccagacgtggcctctatgggcatgaggccacatgggtttcgctttgggtttcccgggggatcacacgggactatgccatctcaggaacgctttctggtgcctccccaacagatccaggggtccggtgtttcgccgcagctccggcgttccgtctccgtggacatgcctcgaccactcaataactcccagatgaacaatcctgtaggactccctcagcactttagcccgcagtcgctcccagtgcagcagcacaacattttagggcaggcttacatagagctgaggcatcgagctcctgacggaaggcagagattgccgttcagcgcaccgccgggctctgtcgtggaggccagctcaaatctacgccacggcaatttcataccgagacctgactttccaggccctcgtcataccgaccctatgagacgaccacctcaagggctgcctaatcagctgccggtgcaccctgatctcgagcaggtacccccaagccagcaagagcaaggacattctgtgcattcctcttctatggtgatgagaacactgaatcatcctcttgggggtgaattcagcgaggccccattaagcacatcagtcccctctgagaccacgtcagataacttgcagattaccactcaaccatctgacggtctggaagagaagctggactccgatgatccttcggtaaaggagctggatgtgaaggatctggagggggttgaagtgaaagacctggatgatgaggacttggaaaacctcaacctggatacggaggatggtaaagtggtggaattggacacactggataacctggaaacaaatgacccaaatctagacgacctcttgagaagcggtgaattcgatatcattgcttacacggaccctgagctggatatgggcgataagaaaagcatgtttaatgaggagttggacctgcctatcgatgacaagttagacaatcagtgtgtgtccgtggagcccaaaaaaaaagagcaggaaaataagacactggtgcttagcgataaacacagcccccagaaaaaaagtacggtgaccaatgaagtgaaaactgaagtcttgagtcccaattcaaaggtggagagtaagtgcgagacagagaagaacgacgaaaacaaagataacgttgacaccccctgctcccaagctagcgcacatagcgatctaaacgacggagaaaaaactagtctgcacccgtgtgaccccgatcttttcgaaaaaagaacaaatagagaaacggctggcccctcggcaaacgtgattcaggcttcgacacagctaccagcacaggacgtcatcaattcttgtggcataacgggaagcaccccggttctctccagcctgctggcgaatgagaaaagtgataattctgatatccgaccttccgggtctcctccaccgccaacgctgcctgccagcccctcgaatcacgtaagctcactgcctcctttcatcgcacccccaggccgggttctcgacaatgccatgaattctaatgtgaccgtggttagtagggtcaatcatgtcttcagccaaggagtacaggtaaaccccggtctcatcccagggcaatcaacagtaaaccactctctcggaactggaaagccagccactcagacaggaccccagacaagtcagagcggtacttcctccatgtccgggccacagcagctcatgatcccccagactttggctcagcagaatagggaacgccctctgcttttagaggaacagccactgttgctccaggacctgctggaccaggagcgacaggagcagcagcagcagcgtcagatgcaggcaatgattcggcaacggagcgagccatttttcccaaatatcgattttgatgctatcaccgatcctattatgaaggccaaaatggtggctctaaagggaataaacaaggtgatggcgcagaacaaccttggcatgcccccaatggtgatgtctcggttcccttttatgggtcaggtggtgactggaacgcagaactcggagggacaaaaccttgggcctcaagccattcctcaggatgggtcaatcactcaccaaatatctcgccctaatccccccaacttcggccctggattcgtgaacgactcacagaggaagcagtatgaggaatggctgcaagagacccagcagctgttgcaaatgcaacaaaaataccttgaggagcagataggcgcccaccgaaaaagcaagaaagcactgtcagccaagcagaggaccgcaaagaaggcaggccgggaatttcccgaagaagatgccgagcagctgaagcacgtgactgagcagcagagtatggttcagaaacagctggagcagattcgaaagcagcagaaggagcacgccgagctgatagaggactatagaatcaagcagcagcaacagtgtgctatggctccccctacaatgatgccctccgtacagccacagccacccttgataccgggagccactccacccactatgtcacagccaacctttcctatggtgcctcagcagttgcagcatcaacagcacacgactgtaatctccggacatacctcacccgtgcgcatgcctagcctgcccgggtggcaacctaactcagctccggcacacctgccactaaacccacctaggatacagcccccgattgcccagctgccaattaaaacctgtacaccagcacccgggacggtgagtaacgctaaccctcagtccgggccacctccccgggtggaatttgacgacaataaccccttttcagagtccttccaagagcgcgagaggaaggagaggctccgtgagcaacaagagcgccagcggattcaactcatgcaagaagtggaccggcagagagccctgcaacagcgaatggagatggaacagcacggcatggtaggatcagaaatctctagctcaagaaccagcgtgagccagatccccttttattcgtccgacctgccttgtgatttcatgcaacccctcgggcccctccagcaaagcccacaacaccaacaacagatgggccaggtgttgcagcaacagaacatacagcagggttccatcaattccccaagcacacagaccttcatgcagaccaatgagaggagacaggtggggccgcctagctttgttcctgactccccttcaatccccgttggctcacccaatttttcgagtgtaaagcaggggcatggcaacctgtccggaaccagttttcagcagtcccccgtacgaccttcgtttactcccgctctgcccgcagcaccacctgttgccaattcttctctcccctgcggccaggacagcacaataactcacgggcactcttatcctgggagtacccagtccctaatccagctctatagcgatataattccggaagagaaaggaaaaaagaagagaaccaggaagaaaaagagagacgatgacgcagagtctaccaaggcccccagcacaccacattccgatatcaccgctccccccacgcccggtatttcagagacaacctccactcctgcagtaagcactcctagcgaactgccgcagcaagccgaccaggaaagtgtggagccggtcggaccgtccacccccaatatggccgcaggccagctgtgcactgagctggagaacaaacttccaaactctgactttagccaggccactccaaatcagcagacctacgctaattccgaagtggataaacttagtatggaaacacccgctaagacagaggaaattaaactggagaaggccgagaccgagtcttgtcctggacaagaagagcccaaactggaggaacagaatgggagtaaagtcgaagggaatgcagtcgcttgcccggtgagttcggctcagtctcccccacactcagccggagctcccgctgctaagggcgattccgggaatgagcttctcaaacacttattaaagaacaagaagtctagctctctcctgaaccaaaaacctgaaggatccatatgttcagaagatgattgcacaaaagacaacaaactcgtggagaaacagaatcctgctgaagggttacaaaccttaggagcacagatgcagggaggcttcggatgcggtaaccagctcccaaaaaccgatggcgggagcgaaactaaaaagcaacgttctaagcggacacagaggactggcgagaaggcagcgccaagaagtaagaaacggaagaaagacgaagaagagaaacaggcaatgtactcttccaccgatacatttacacaccttaaacagcagaataacctgtcgaatcctcccacccctcctgccagccttccccctacgccccccccaatggcctgccaaaaaatggccaacggtttcgctaccaccgaggaactcgccggaaaggcaggcgtcttggtgtcccacgaggtgaccaaaaccctggggcccaagccattccagttaccttttaggccccaggatgatttgctcgctcgtgcgctggcacaaggacccaaaactgtggatgtccccgccagcctgcctacccccccacacaataatcaggaggagctccgcattcaagaccactgcggcgatagggatacgcctgactcttttgtccctagctcgagccctgagtccgtcgtgggagttgaggtgagcaggtatccagacctgagcctggtaaaggaagaaccgcctgagcccgtcccctcccccattatccccattctgcccagcaccgccggaaagagtagtgaatcgcgtaggaacgatatcaaaacagagcctggtacgttatactttgcaagccctttcggccctagcccgaatgggcccagaagtgggctaatcagtgtggcaattaccttgcatccgaccgccgccgagaatataagctccgtggtggcagccttctccgatctgttgcatgtccggatcccaaattcttatgaggtatcttccgctcccgatgtgccatccatggggcttgttagcagtcataggatcaaccccggcctggagtaccggcagcacctgttactgagaggaccgccaccagggtccgcaaatccgcctagactcgtgagctcctaccgcttgaagcagcccaacgtgccgtttccccctaccagtaacggactcagcggatataaggactccagccatggcatagccgaaagcgcagctttgcgcccacagtggtgctgccactgcaaggtagtcatcttaggatcaggagtgcgcaagtcatttaaggacttaactctgttgaacaaggactcacgggagtccactaaacgggtcgaaaaggacatcgtgttctgctctaataattgcttcatactgtacagctctaccgcccaagccaaaaacagcgaaaacaaagaatccataccctcactcccccagtcccctatgagagaaacaccctcaaaagccttccatcagtattctaacaacatttcgacgctcgatgttcactgtctgccacagctgccagaaaaggcttctcctccagcaagtccgccaatcgcatttcctcctgctttcgaggctgctcaggttgaggctaagcctgatgagttgaaggtaaccgtgaaattgaagcctaggctgcgagccgtgcatgggggattcgaggattgtaggccattaaataagaagtggcggggcatgaagtggaagaaatggtccatccatatcgtcatcccaaaggggacttttaaacccccttgtgaagacgaaatcgacgagttcttaaaaaagttggggaccagcttaaagcctgacccagtccccaaagattaccgaaaatgctgcttttgccacgaagagggcgacgggcttacagacggaccggctcgtctgctcaatctggatttggatttatgggtgcatctgaactgtgctctgtggagtacagaggtgtatgagacacaggccggcgctctcatcaacgtagagctggctctcagacgcggcctccagatgaaatgcgtgttctgtcacaagaccggcgctacctccggctgccacagatttaggtgtactaacatctaccacttcacctgtgcaatcaaagcacagtgcatgttctttaaggataaaactatgctctgtcctatgcataagcctaaagggattcatgagcaggagctgagttatttcgccgtcttcagacgcgtgtatgtacagagggacgaagtgaggcaaatcgcttcaatcgtccagaggggagaacgcgatcacacgtttcgggtgggctctctcattttccacacgatcgggcagctgctgccccagcaaatgcaagcgtttcacagcccaaaggctctcttccccgtcggctatgaagcttcccgcctctactggagcacacgctacgccaaccgtagatgtaggtatttatgctctatcgaagagaaggacggtcgtccggtgtttgtcatcagaatcgtggagcagggacacgaagacctcgtgctctcggatatttctcccaagggtgtgtgggataaaatcttggagcccgttgcgtgtgtgcgcaagaagtccgagatgttgcagctttttcctgcctacctgaaaggtgaagatctatttgggttgacagtctccgcagtagcccgaatcgcagagagtctgcccggcgttgaggcctgcgagaactacacgttccggtacggaaggaaccctctgatggaattgcccttggcggtcaaccctaccggctgcgctagatccgagcctaagatgagcgcacatgttaagcgctttgtcctaagacctcacactttgaacagcactagcacctctaagtcatttcagtctactgtcactggtgaactgaatgccccctactctaaacagtttgtgcactctaaaagctcccagtatcgaaagatgaagacagagtggaagagcaacgtgtacctggcgcgtagtcggattcaaggcttgggactgtacgccgccagggacattgaaaaacatactatggtgattgagtatatcgggaccatcatcaggaacgaggtggctaaccgtaaagaaaaattgtatgagtctcaaaatcgtggcgtttatatgttcaggatggataacgatcacgtaatcgatgccacgttaactggcggccccgcacgatatattaaccacagctgcgcccccaactgcgtggctgaagtggtgacctttgagagggggcacaagattatcatttcctcgtctaggaggatacagaaaggtgaagaactttgctacgattataaattcgactttgaagacgaccagcataaaatcccttgccattgcggggcagtgaattgcagaaagtggatgaactag

SEQ ID NO: 196052 - DNA, 14907 bp, Artificial Sequence
  Description of Artificial Sequence: Synthetic coding sequence
atgagcagcgaggaggacaagagcgtggagcagccccagccccccccccccccacctgaagagcctggcgcccccgcacctagcccagccgcagcagacaagcgccctcgtggcagaccaaggaaagatggagcgtccccgtttcagagggcccgcaaaaagcctcgatccagaggaaagaccgccgtagaggacgaggactccatggatgggctcgaaaccacggaaacggagaccattgttgagacggagataaaggagcagagcgctgaggaggatgccgaggccgaagttgataactctaaacagctgatcccaacactgcagcgctccgtttctgaggagagtgctaattccctcgtttccgtgggtgtggaagctaagattagcgagcagttgtgcgccttttgttattgtggcgaaaagagcagcctaggccaaggggatttaaagcagtttcggattacaccggggttcattctgccttggaggaaccagcccagtaataagaaggacattgatgacaatagcaacggcacctacgaaaagatgcagaacagcgcacctcgcaagcaaagggggcagcgcaaggaaaggagcccacagcagaatatcgtgtcttgtgtcagtgtttctacccagacggcttctgatgaccaggctggcaagctgtgggatgagctgagtcttgtaggactgcccgacgctatagacattcaggccctgtttgacagtaccggcacctgctgggcgcatcacaggtgcgtggaatggtcccttggagtatgccaaatggaggaacctttactggtgaacgtagacaaagcagttgtctctggatcaacagaacgatgcgccttttgtaagcacctcggagctaccatcaagtgttgcgaagagaagtgcacacagatgtatcattacccctgtgcggcaggcgccggcaccttccaggacttcagccatatttttttattatgccctgagcacatagaccaagcccctgagagaagcaaggaagacgcgaattgcgcagtctgtgacagtcccggtgatttgttggaccaattcttctgcactacttgtggccaacattatcacggaatgtgtctggatattgcagtgacccccctgaagagagccggatggcagtgtccagagtgtaaagtttgccaaaactgtaagcagagcggggaagactcgaaaatgttggtgtgtgacacctgcgataaaggctatcacacattctgcctgcagcctgtgatgaagtcagtcccaactaatgggtggaagtgcaagaattgccgcatctgtatcgagtgtggcacccggagttctagtcagtggcaccacaattgcctcatatgtgataattgttaccagcagcaagacaatttgtgccccttttgcggcaagtgttaccaccccgagctgcagaaagatatgcttcattgcaacatgtgtaaaagatgggtccaccttgagtgtgataagccaacagatcatgagctcgacacccagctcaaagaggaatatatctgcatgtattgtaaacatctgggcgccgaaatggatcgcctgcagccaggagaagaagtggagatcgcagagctcactaccgactataataatgagatggaagtggagggacctgaggatcagatggtgttctctgagcaagccgcaaacaaggatgtcaacggacaggagagcacccccgggatcgttcccgatgccgtgcaggttcacaccgaggaacagcagaagtctcatccaagtgagagcttagataccgacagcttactgatcgcagtgagttcacagcataccgttaacactgaactggagaagcaaatctctaacgaggtggacagtgaagatctaaagatgtcttcggaagtgaaacacatctgtggcgaggatcagatcgaggacaagatggaagtgaccgagaatattgaggtagtgacccatcagataacagtccagcaggaacaactgcaactgttggaggaacctgagacggtagtgagtcgtgaagagagccggcctcctaagctggtaatggagagtgttacactccctctggaaacactggtgtcgccgcatgaggagtcaatctcgctgtgccctgaggagcagctagtaatcgaacggctgcagggagagaaggagcagaaggagaatagcgagctgtctaccggcctgatggatagcgaaatgacaccaactatcgaaggatgcgttaaggatgtatcgtaccaggggggcaaaagcataaagttatcaagtgagaccgagtcctccttctcatcctctgcagatatatcaaaggcagacgtaagctcaagcccaacgccaagttccgatcttcctagtcacgacatgctgcacaactatccctccgctctgtcctcatcggccggaaacattatgcccaccacttatatttccgtgacacccaaaatcggcatggggaaaccagctatcacaaagcggaagttcagtcctggtaggccgagatctaaacagggtgcatggtctacacacaatacggtgtcacctccatcatggagcccagatatctccgaggggcgggaaatctttaaaccacgacagctgcccggctcagccatctggagcattaaagtcggacgtggaagcggatttcctggcaagaggcgaccaaggggtgctggattgtccggccgtggggggagaggaaggtccaagctcaaatcaggaatcggagctgtagttctacccggcgtcagcaccgcagacattagcagcaataaagacgatgaagaaaattccatgcataacacagtagtcctgttctcctcctctgacaagtttacccttaaccaagatatgtgcgtggtgtgtggatctttcggtcagggagctgaaggcagactgctggcttgttcgcagtgtggtcagtgctatcacccatactgtgttagcattaagatcacaaaggttgtgctctcaaaaggctggcgttgtctggaatgtaccgtgtgcgaagcctgtggcaaggcaacagatccaggtaggcttctgctctgcgatgattgtgatattagttaccatacctattgcctggacccaccacttcaaaccgtccccaaaggaggttggaagtgcaaatggtgcgtgtggtgtcgccattgcggtgccacaagtgctggcttaaggtgtgaatggcagaataactatacccagtgcgccccatgtgcaagtctttcctcttgccccgtgtgttatcggaactacagagaagaggacctgatcctccagtgcagacagtgcgatcgctggatgcatgccgtttgtcaaaatctaaacacagaggaggaggtggaaaatgtcgccgatattggcttcgactgctccatgtgtcggccgtatatgcccgccagcaacgtccctagctccgactgttgcgaaagttccctagtcgctcagatcgtaactaaggtcaaggaactcgaccctcccaagacctacacacaggatggggtgtgcttaacagaatcagggatgacacagctccaatcactgactgtgactgtcccccggcgaaaacgcagcaagccgaagctgaaactaaagatcataaaccaaaactccgtagcagttctccagaccccacctgacatccagtcagaacactcacgcgatggtgagatggatgactcaagggagggcgagctgatggactgtgatgggaagtcggagtcctcccccgagagggaagccgtcgatgatgaaaccaagggcgtcgaaggaactgacggcgtgaagaaaaggaaaagaaaaccatatagaccaggtattggaggatttatggttagacaaaggagtagaactggccagggcaaaaccaaacgttccgtcattcggaaggatagtagcgggtcgatatccgagcagctgccttgtcgtgacgacgggtggagcgaacagctccccgacaccctcgtcgatgagtctgtctctgtcacggaatcgaccgagaagataaagaagcggtaccggaagagaaagaacaagctcgaggagactttccctgcatacctgcaagaggcctttttcggtaaagacctgcttgataccagcagacaatctaagatctctctagataatctctccgaggatggcgcacaactcttatacaagactaacatgaacaccggtttcctcgatccatcattagaccctctcctgtcctcaagctctgctccgaccaaatctggcacacatggcccggctgacgacccgttagcagatatttccgaggtgctgaataccgatgatgatattctggggatcatcagtgacgatctggctaagtccgtggaccattcggatattggccctgtaacagacgatccgtcttccctgccgcaacccaacgtgaatcagtctagcagaccactttccgaggaacagttggatggcatactctcgcccgagctggacaagatggtaacagacggcgcaatcctcggaaagctgtacaagatccccgagctgggaggcaaagacgtggaagatctgttcacagcggtgttgtcccctgcaaacacccagcccacaccactgccccagccgcctcccccgacgcaattattaccaatccataaccaagacgcctttagtcgcatgcctctcatgaatggactcatcggctcctctcctcacttacctcataacagtttgcctccaggcagtggactcggcacctttagtgctatagcgcaaagttcataccccgacgcacgagataagaacagcgcgtttaatcccatggcctcagacccaaataacagctggaccagtagcgcccctacggttgaaggcgagaatgacaccatgtccaatgctcagcggtcaacgcttaagtgggaaaaggaggaagcccttggtgagatggcaaccgttgctcctgtgctctacactaacatcaatttccccaatctgaaggaagaatttcctgactggacaacccgcgttaagcaaatcgctaagctgtggcgaaaagcctctagtcaggaacgagccccatacgttcaaaaggccagggacaatagagctgcgctgaggataaataaagtgcaaatgagtaatgacagtatgaagcggcagcagcagcaggacagtatagacccctcttcccgcattgacagtgagttgttcaaggaccctctgaaacagagggagagtgagcacgagcaggagtggaagtttaggcagcagatgcgtcagaagtcgaagcagcaggcgaaaattgaggccacacaaaaacttgaacaagtgaaaaatgaacagcaacagcagcaacaacagcagttcgggtcccagcatctgctggtgcagtctggctccgatactccatcttcaggtatccagagcccgcttacacctcagcctggtaatggtaatatgtccccagcccagtcttttcacaaagaactatttacgaagcagccacctagcacgccaacatcgactagtagtgatgatgtgttcgttaagcctcaggctccccctccaccaccagcccccagtagaatccccatacaggatagtctctctcaagcccaaacctctcaacctccctcccctcaggtgttctctcctggatcctctaacagccggccaccttcgccgatggacccatacgcgaaaatggtgggaaccccccgaccccctccggtgggccacagtttctcccgcaggaactctgccgcccccgtggagaactgtacccctctctcaagtgtaagtcgcccattgcagatgaacgagacaacagccaacaggcccagtcctgtaagagatctatgcagctcaagcaccactaataatgatccctacgccaagcctccagacactcctcgccctgtcatgacagaccagtttcctaagagtctgggcctgtcccggtcccccgtcgtgtccgagcagaccgcaaagggaccaatagccgcgggaactagcgatcacttcacgaagccaagcccacgggctgacgtgttccagcggcagcgcatcccggactcttatgccaggccactccttactccagcaccgttggactcaggacccgggccattcaagacacccatgcagccaccaccctcttctcaggacccttacggttctgtgtcccaggcttcacgacggctgtcagtggatccctatgagcggccagccctgaccccacgacccatcgacaatttctctcacaatcagtctaatgatccatatagtcagcccccgttgacccctcatcctgccgtcaatgaatcatttgcccaccccagtagggcgtttagtcagccgggtacaatctcgcgcccaacctctcaggacccctacagtcagccccccggcacaccccgccccgtggtggattcctattcccagagttccggcacagcccgatcaaacaccgatccctacagccagcccccgggcacgcctcgcccgaccaccgtggatccatacagccagcagcctcagaccccgagaccctctacccagactgatttgttcgtgacaccagtgacaaaccaaagacatagcgacccctatgcccaccctcctggaactcctaggcccggaatttctgtcccttattctcagcccccagctactccgcgccctaggatatctgagggatttacacgaagcagtatgacaaggccagttctcatgccaaatcaggatccttttctgcaggccgcgcagaaccgtggcccagccttaccggggccacttgtccggcctccagacacctgtagccagacacctcgacctcctgggcctgggttatcagacaccttcagcagggtgtccccatctgctgctcgcgatccttatgatcagtccccaatgacccctcgaagccagtcagacagctttggcacttcgcagacggctcatgacgtggcagatcagcccaggcccggttccgagggttctttttgtgcctcctctaatagcccaatgcatagtcagggccagcagttttcaggggtgtctcagttgcctggacctgtacctacatccggcgttaccgatacacagaacaccgtgaatatggcacaggctgacacagagaagttgcggcagcgccagaaactgcgcgaaattatattgcagcagcagcaacagaagaagattgctggtcggcaagaaaaaggcagtcaggactcccctgctgtgccccaccctggaccgttacagcattggcaacccgaaaacgtgaaccaagccttcacacggccaccacctccataccctggcaacatacggagccccgtggcccctccgctcggacctaggtacgccgtgttccctaaagaccagcgggggccatatcctcccgacgttgcctccatgggcatgagacctcacggctttcgctttggttttcccggtgggagtcatggcacaatgccttctcaggagcggtttctagttccaccccaacaaattcagggatctggtgtgtctccccagctccgtcgatctgtgtccgtcgacatgccccgaccacttaataattcacagatgaacaacccagtgggacttcctcagcacttctcccctcagagcctccctgtgcagcagcataacattctgggacaggcctacatcgaactgcgccatcgcgcccccgatgggcgacagcgactacctttctcggccccgccaggttctgtcgtggaggcatcatccaacctgcggcacgggaactttatccccagacctgattttcccggccctagacataccgatcctatgcgccggcctccacaggggttaccaaaccagctgccggtgcatcccgatctggagcaagtgcccccctcccagcaggaacagggccacagtgtgcacagctcttcgatggtgatgagaacgctgaaccatcctcttggcggcgagttttcagaagcgcccctatctacatctgtgccatctgaaacaacgtctgacaatctccagatcacgacccaaccctccgacgggcttgaggagaagttagattcagacgacccctccgtgaaagagttggacgtaaaggatctcgagggcgttgaagtcaaggacttagacgatgaggatctggagaacctcaatctcgacaccgaagacggcaaggtagtggagcttgacaccttagataacttggaaacaaacgatccaaatctggacgatcttctacggtctggagagttcgatattattgcgtatacagatcctgagttagatatgggcgacaagaagtccatgtttaacgaagaactggacctcccaatcgacgataagctggacaatcagtgtgtgagcgttgagccgaagaagaaggagcaagagaacaagactttggtgctgagcgataagcactcaccccaaaaaaaaagcaccgttacgaatgaagtgaagacagaagtgctgagcccgaatagcaaggtggaaagcaaatgcgaaaccgagaaaaacgatgaaaacaaggataacgtcgacaccccttgttctcaggcttccgcacacagtgatttgaacgacggtgagaagacttccctacacccgtgcgacccagacctctttgagaagcggactaatcgtgagaccgccggtccctccgccaacgtgattcaggctagcacccagttgcctgctcaggacgttattaacagctgcggcataacaggtagcacgcccgtgctgagttcactgctggccaacgaaaagtcagacaatagcgatattagaccctcaggatccccaccacccccgaccctgcccgcctcaccatcaaaccatgtgagctccctgccaccctttatcgctccaccaggaagggttttagacaacgcgatgaacagtaatgtgaccgttgtctcaagagtcaaccatgtgttttcgcagggagttcaagtaaatcccggccttatacccggccagtctactgtcaaccactcattgggcaccggaaaacccgccacacagaccgggccacaaacaagtcagagtggaactagtagcatgtccggccctcagcagttaatgattccgcagaccttggcacagcagaacagggagaggccccttctcctcgaagagcagccgctgctgctgcaggatttgctggaccaagagagacaagagcagcagcagcaaaggcagatgcaggctatgatccgccaaaggagcgagccattcttcccaaacatcgattttgacgctattacagacccaattatgaaggctaaaatggtcgcattgaagggtattaataaagtgatggcgcagaacaacctgggtatgcccccaatggtaatgtcccgatttccgtttatggggcaggttgtgaccgggacccaaaactcagagggtcaaaacctgggcccccaagctatcccgcaggatggaagcataactcaccagatttctcgccccaacccccctaacttcgggcctggattcgtcaatgattcacagcgcaaacagtacgaagagtggcttcaggagactcagcagctcttgcagatgcaacagaagtacctggaagagcagatcggtgctcatagaaagagcaaaaaagccctctccgctaagcagagaactgctaagaaggctggcagggagtttccagaagaagacgcagaacaactaaagcacgtcaccgaacagcaaagcatggtgcagaaacaactggaacagatccgcaagcagcagaaggagcatgccgaactgattgaggactatagaatcaagcaacagcaacagtgtgcgatggcgccaccgaccatgatgccatccgttcagcctcagcctcctctgattccaggcgccacacccccaaccatgtcccagcccactttccctatggtcccccagcagctgcagcatcagcagcacacaacagtgatcagcggccacacaagccccgttcggatgcccagtttacccggatggcagcccaactcggcccctgctcatctacctcttaatcccccaaggattcaacctcccatcgcccagctcccaattaaaacgtgtactcccgccccaggcaccgtgtcaaacgcaaacccacaaagcggacctcccccgcgggtggagttcgacgataataatcctttttcagaaagcttccaggaacgggaacgcaaggaaagactgagggaacagcaagaacgacagcgcatacagttgatgcaagaggtcgacaggcaacgagcgttgcagcaaaggatggaaatggagcagcacggcatggtcggttccgagatctcaagtagtagaaccagtgtctcccagatccccttttactcatctgacctgccctgtgattttatgcagcccctaggacccctacaacagtccccccagcatcagcaacagatgggacaggttctgcagcaacagaacatccagcaggggagtataaacagcccatccacccagactttcatgcaaacaaacgagcggcgacaggtcggacccccttctttcgttccggactcccctagcatcccagtaggaagcccaaacttctcaagcgttaaacaggggcacggaaatctctcgggcactagttttcagcagtcacctgttcgtccctcctttacaccagctttgcccgccgcaccccccgtggctaactctagtttaccctgcggtcaagattcgactataacccatgggcatagttaccccggatccacgcagagcttgatacagctgtattctgacattatcccagaagaaaagggcaaaaaaaagcggacaagaaagaaaaagagagacgatgatgcagagtcgacgaaagctccttccacgccgcacagtgatatcactgcaccacccactcccgggattagcgaaaccacctctacaccggcagtgagcaccccatctgaactgccgcagcaggctgaccaggagtccgtggagcctgtgggtcccagcacccctaatatggccgccgggcagctctgtacagagttggagaataagctgccaaacagcgatttcagccaggcaactcccaatcagcagacctatgcaaatagtgaagtggataaactctcaatggaaacccctgcaaaaacagaagagattaaattggagaaagccgagaccgaaagctgtcccggacaggaggagccgaaactggaagaacagaatggcagcaaggtcgaagggaacgctgtggcgtgccccgtctcctcagctcaatcgcctccacacagtgcaggagcacccgcagccaaaggagactcaggaaatgagctgctaaagcacctgcttaaaaataagaagtcctcatctcttctgaatcagaagcctgagggatcgatctgcagtgaggacgactgcacaaaggataacaaactggtcgagaaacaaaaccctgccgagggtctgcagactttaggggcacaaatgcagggcggattcggatgcggtaatcaattgccaaagactgacgggggctctgaaacaaaaaagcagcgcagcaaacgcacacagaggacgggagagaaggcggccccacggtccaaaaaacgtaaaaaggatgaggaagagaaacaagctatgtattcatctactgacacgtttacgcatctcaagcaggttagacagctgagcctcctccctctcatggaacccatcattggagttaactttgcccattttcttccgtacggaagcggtcaattcaatagtgggaaccgcctgctgggaaccttcgggtccgcaaccctggaaggggtcagcgattattattcccagctgatttacaaacaaaacaatctgtctaacccacccacacctcccgcctctctgcctcctacacccccccctatggcctgtcaaaaaatggctaacggctttgctactactgaagagctggccggaaaggctggcgtcctggtttctcatgaggtgacaaagacccttggccccaagcccttccagcttcctttccgcccccaagatgatctcttagcccgtgcgctggcacaaggacctaaaactgtggacgtccccgcctcactgcctactccaccccacaacaaccaggaggagttacgcatccaagaccactgcggggaccgcgacacccccgatagcttcgtcccgtcgtcttcaccagagagtgtggtgggtgtcgaagtgagccgatacccagacctgtcattagtgaaggaagaaccaccagagcccgtgcccagccctatcattcccatccttccttctactgctggtaaaagctcagagtcccggagaaatgacattaaaacagaacccgggacactgtacttcgcttccccctttgggccttcaccgaatggcccacggtcaggtctcattagcgtcgctataacacttcacccgaccgctgccgagaatatttcctccgtggtggcagcgttctcagacctgttacacgtgcgtatacctaacagttatgaggtgagctccgcccctgatgtgccctctatgggcctcgtgtcaagccatcgcataaacccagggctggagtacaggcagcacctactgttgcggggcccgccccctggtagcgcaaatcccccccgccttgtgtcatcgtacagactgaagcagccgaatgtgcccttcccccctactagtaacggcttatcgggatataaagatagctcacacgggatcgccgaatctgcggctctgagaccccagtggtgttgccactgtaaggtggtcattctgggatcaggagtgcgtaagtccttcaaggatcttaccctcttaaacaaagatagccgcgagtctacgaaaagagtggagaaggacattgtcttctgcagtaacaattgtttcatcctctactcatccacggcccaggccaagaactccgaaaataaggagtccatccctagcctgcctcaaagcccaatgagggaaacccccagtaaagccttccaccagtatagcaataacatcagtacactcgacgtgcattgtctgccccaactgcccgagaaggcgagtccccccgcttctcctcctatcgcattcccgcctgcgtttgaggcagcccaagtggaagctaagcccgatgaactcaaagtgaccgttaaacttaagccaaggctgcgagccgtacacggcggtttcgaagattgcagacccctgaacaagaaatggcggggaatgaagtggaagaaatggagcatccatattgtcatacctaagggaaccttcaaaccaccttgcgaggacgaaatcgacgagttcctgaagaaattggggaccagccttaagcctgatccagtgccaaaagactatcgaaagtgttgcttctgtcatgaggagggcgacggacttaccgacgggcctgcccgcttgcttaatttggacttagacctctgggtgcacctcaactgcgccctgtggtccactgaggtgtacgaaacccaggccggggctctgatcaatgttgaactcgcccttcgcagaggactccaaatgaagtgcgttttttgccataaaactggggccaccagcggttgccacaggttccggtgcacaaatatctatcacttcacctgcgctattaaagcccagtgcatgttctttaaggataaaaccatgctgtgccctatgcacaaaccgaaaggcattcacgaacaggaactaagttacttcgcagtgtttaggcgagtgtatgttcagagggatgaggtccggcagatcgcttctatagtccagcggggggaacgggaccacacttttcgtgtgggtagtctgatcttccatacaatcggacagttactcccccagcagatgcaagcttttcacagtccaaaagccctgtttcccgtgggatacgaggcatcgcggctttactggtcgacacggtacgccaaccgtcggtgcagatatctatgcagtattgaagagaaggacggacggccagtcttcgtgataaggattgtggagcagggtcatgaggacctcgttctgagcgacatcagccctaagggagtgtgggataaaatcctcgagcctgtggcctgcgtcagaaaaaaaagtgagatgttacagctgtttccagcatatctcaagggagaggatctcttcggcctgaccgtgagcgccgtcgcccgtattgccgagtctctgccaggagtagaggcctgtgaaaactatactttcaggtacggaaggaatcccctgatggaactgcctctagcagtgaacccaactggctgtgctaggtccgaacctaaaatgtcagcccatgttaagcggttcgtattgcggcctcacactctgaattccacctcaacctcaaagtctttccaatctacagttactggtgaacttaacgctccatactcaaagcagttcgtgcattccaagtcatctcagtataggaaaatgaagactgagtggaagtcaaacgtgtatctggctcgctctcggatccagggcctcggcctttacgctgccagggacattgagaaacacaccatggttatagaatatatcggcacaatcattagaaatgaagttgcaaaccgcaaagaaaagctgtacgaatctcagaatcgcggcgtctatatgttccggatggataacgatcatgtgatagatgcgactctgaccggcgggcccgccagatatattaatcatagctgcgcacctaactgtgttgccgaagtggtgacctttgaacggggccataaaattattatttcatccagcaggcggatccagaaaggggaggaactttgttatgactacaaatttgactttgaagatgaccagcacaagattccgtgtcactgtggcgccgtgaattgtagaaaatggatgaactag

SEQ ID NO: 196053 - DNA, 4575 bp, Artificial Sequence
  Description of Artificial Sequence: Synthetic coding sequence
ctgatgcaggaggtggaccggcagcgggccctgcagcagcggatggagatggaacaacatggcatggtcggaagcgagataagtagctcacggacgagtgttagccaaatacccttctactcctccgatctgccctgtgactttatgcagcccctcggtccccttcagcagagcccacaacaccagcagcagatgggccaggtcctgcaacagcagaatattcagcaggggtctatcaacagtccttctacccagacatttatgcagactaatgaaaggcgccaggttggaccaccttcttttgtgcctgactccccatcaatcccagtgggaagtccaaacttctcgagtgtgaagcaggggcatggaaacctctctgggacctccttccaacagtctccagttcggccgagctttacacccgctctgcctgccgcacctcctgtcgccaacagttcgctgccgtgcggccaggacagtacaatcacccatgggcactcctaccctggctccacccagagcttaatccagctgtatagtgatattattcccgaggagaaaggaaagaaaaagcgtacccgcaagaaaaagagggacgacgacgccgagagcacgaaggctcctagcacccctcattcggatatcacagctccacctacccccggcatctcagaaaccacaagtacccctgctgtaagtaccccttccgaactccctcagcaagcagatcaggaatccgtggaaccggtagggccaagtaccccgaacatggctgcaggacagctgtgcaccgaactcgaaaataagctgcccaactctgacttctctcaggcaacaccgaaccagcagacctacgctaattccgaggtggataaactttcaatggagacaccagcaaagaccgaggagataaaactggagaaggctgaaactgagtcgtgtcccggtcaagaagagcccaagctggaggaacaaaatgggagcaaggttgaagggaatgccgtcgcctgccccgtgtcttccgctcagtccccgccccacagtgcaggggcccccgctgcgaagggagattctggcaacgagcttctgaagcaccttcttaaaaacaaaaagtcctcatctctactgaatcagaaacccgaggggagcatctgtagtgaggacgactgtacaaaagataataaactcgttgaaaagcaaaaccctgcagagggcctgcagactctgggggcgcaaatgcagggcggattcggctgtgggaaccaacttcctaagacggacggaggctccgagactaaaaagcagagatcaaagcgcacacagcggaccggagagaaggccgcccccagatctaagaagcgcaagaaggacgaggaggagaaacaggcaatgtattccagcaccgacacattcactcacctaaagcaacagctgagcttactgcccctgatggagccgataatcggcgtgaatttcgctcatttcctcccatacggctctgggcaatttaactccggcaatagattgctgggaacattcggctctgccacattagaaggcgtgtccgactactacagccagttaatctacaagaaaatggccaatgggtttgcaactactgaggagctggccgggaaagctggtgtgctagtatctcacgaggtgacaaaaactctgggcccaaagccctttcagctgccattcaggccccaggacgacttgcttgctcgggcgcttgcccagggtcccaagaccgtggacgtgcctgcaagcctcccgacgcccccacacaataaccaagaggagttacggatccaggatcactgcggcgaccgggatacccctgacagttttgtaccatcatcctcgcctgagtcggtcgtaggcgttgaggtttcaagatatcccgacttaagtctggtcaaagaggaaccgcccgagcctgtgcctagtcccattattcccatcttaccaagtacagccggcaaaagtagcgagagccgcagaaatgatatcaaaacagaaccgggcaccctctactttgcctccccatttgggcccagccctaacggaccaagatccgggctgatttctgtggccatcacacttcatccgacagccgcagagaacatttccagcgtagtagcagccttcagcgatctcttgcatgtgaggattcctaatagctatgaagtatcatccgctccagacgtgccttccatgggcctcgtttctagtcaccggattaaccctggactggaatataggcagcatctgctgttgcgggggccccctccaggtagcgcgaacccaccacgactggtctcttcatatcgacttaaacagccaaacgtgccatttccgcctacaagtaacggtctatcggggtacaaggattcgtcccacggcatcgccgagagcgccgctctgagacctcagtggtgctgccattgtaaggtggtcattttgggcagcggcgtcagaaaatctttcaaggacttgacactgctgaataaggactctcgagaatccacgaaaagagtggagaaggatatcgtgttctgtagtaataattgcttcatcttatactcatcaacggcacaagccaagaattctgaaaacaaagagagtatcccgagtcttcctcagagtccgatgagagaaaccccaagtaaagctttccaccagtactctaacaatattagtacactagacgtacactgcctccctcaactgcctgaaaaggcctcacctcctgcttccccccccatcgccttcccacctgcttttgaggcggcccaggttgaggcaaaacccgacgagcttaaagtcactgtcaaactcaaacctcggctgcgggccgtccatggtggctttgaagactgccgacccctgaataagaaatggcgaggcatgaagtggaaaaaatggtccatccacatcgtgatcccaaagggcacattcaagccaccctgcgaagacgaaattgatgaattcctaaaaaagctgggaacatctctaaagcccgaccctgtgcctaaagattaccggaaatgctgtttctgccacgaagagggggacggactgacagatggcccggctcgtctgctgaatctagacttggatctttgggtccatctcaactgcgctttatggagtacagaagtgtatgaaacacaggcaggcgccctcatcaacgtcgagttggccctgagacgcggtctgcagatgaaatgcgttttttgtcataagacaggcgcaaccagcggttgtcaccgttttcgctgcactaacatttatcattttacatgtgccatcaaggcccaatgcatgttctttaaagacaagactatgctgtgccctatgcataagccaaaaggaattcacgaacaagagctcagctactttgcagtgttcagaagggtgtatgtgcagagagacgaagttcgccagatcgcgtccattgttcagcgtggcgagcgggatcatactttccgggtggggtcactcatctttcataccatcgggcagctgttgcctcagcagatgcaggctttccatagccccaaggccctgtttcctgtgggatacgaggccagcaggctgtattggtcaacacggtacgctaataggaggtgcagatatttgtgtagcatagaagaaaaggacgggcgtcccgtgttcgtgatccgaatcgtggagcaggggcacgaagatctggtgctctctgatatctcacctaagggggtttgggataagattcttgagcctgttgcttgtgtaagaaaaaagtccgagatgctccagctattcccagcttacctcaaaggcgaggatttgttcgggttaacggttagtgccgttgctagaatcgccgaatctctgccgggagttgaggcttgtgaaaactacaccttccgttatgggcgaaatcccctaatggagctccctttagctgtcaaccctacagggtgcgcaaggagtgagcccaagatgtccgcccacgtgaagcggcctcacactcttaattctacgtcaacctcaaaatcttttcagagcaccgtgaccggggaattgaacgccccttatagcaagcagttcgttcactcgaagagtagccagtatcggaagatgaagaccgagtggaaaagcaacgtgtacctggccagatcccgcatacaggggctgggactgtatgcagctcgggacattgagaaacatacaatggtgattgaatatatcggaacaatcatccgcaacgaggttgccaaccgcaaagaaaagctgtacgagtcccagaataggggagtgtacatgttccggatggacaatgatcacgttatagatgccacacttacagggggccccgctcgctacattaatcacagttgtgctcccaattgcgtggcagaggtggtgactttcgagagaggccacaaaatcatcatttctagctctcgcagaatccagaaaggagaagagttgtgctacgactacaagtttgatttcgaggacgatcagcacaaaatcccttgtcactgtggagccgtcaactgcagaaaatggatgaattag

SEQ ID NO: 196054 - DNA, 351 bp, Artificial Sequence
  Description of Artificial Sequence: Synthetic coding sequence
atggtgatcgagtacatcggcaccatcatccggaacgaggtggccaacaggaaggagaaactttatgaaagtcagaacaggggagtgtatatgtttagaatggataatgaccatgttattgacgcaacactaaccggaggccccgcccgatacataaaccactcatgtgcacccaattgcgtcgccgaggttgtcacctttgagaggggtcacaagatcatcataagttcctcaagacgcattcaaaagggcgaagagctttgttatgactacaaatttgattttgaagatgaccagcacaaaattccttgtcactgtggcgcggtcaattgccggaagtggatgaattag

SEQ ID NO: 196055 - DNA, 5577 bp, Artificial Sequence
  Description of Artificial Sequence: Synthetic coding sequence
atgagcatcgtgatccccctgggcgtggacaccgccgagaccagctatctggaaatggccgctgggtctgagcccgagtcagtggaagcatctcctgtggtggtggaaaagagtaacagctaccctcaccagttgtacactagcagcagccaccattctcactcctacatcggtttgccgtacgcagatcacaattatggcgcccgcccccccccgaccccaccagccagcccccccccgagcgttctgatcagtaagaacgaggtaggaatttttactaccccgaattttgacgagacgagctccgctactactatctctacctccgaagatgggtcgtatgggaccgatgtcacacgctgtatctgcggattcactcacgacgatggctacatgatttgctgtgataagtgctcagtttggcagcatatcgattgcatggggattgaccggcaacatattcctgatacctacctgtgtgaaagatgtcagccccggaacttggacaaggaaagggcggtgctgctacaacgacgcaaaagagagaatatgtctgacggagacacttctgccacggaatccggcgacgaagtccctgtggaactgtacacagcctttcagcacacacccacgtcaattaccttgacagctagcagggtatctaaggttaatgacaagagacggaagaaaagcggggagaaagaacagcacatctctaaatgtaagaaggcattccgggaaggcagccggaagtcgtccagagttaagggttctgcccccgagatcgatccaagtagtgatggtagcaactttggatgggagacgaaaatcaaagcgtggatggaccggtacgaagaagctaataataatcagtatagtgaaggcgtccaacgggaagctcagcggatagcgcttagattgggaaatggaaacgataaaaaggagatgaacaagtctgatctaaacacgaataatctgctgttcaagcccccagtcgagagtcatatccagaagaataaaaaaattctgaaatccgcaaaggatctccctcctgacgcgctcatcatcgaatatagggggaagtttatgcttcgtgagcagttcgaggctaatggatatttctttaaacggccgtaccccttcgttttgttctatagtaagttccacggattagaaatgtgtgtcgatgcgcgcacgtttggtaacgaggcgagattcattcgccggagttgcacaccgaacgccgaagtacgccacgaaattcaggacgggacgatacacttgtatatttacagtattcacagtatccccaagggcacagaaataaccatcgcatttgacttcgattacggaaattgtaagtacaaagttgactgcgcatgcttgaaggaaaatccggaatgccccgtgctcaagcgcagtagtgaatccatggaaaacatcaacagcggctatgagacgaggcggaaaaaaggcaagaaagacaaggacatctcaaaagagaaggatacccagaatcagaacatcacactggactgtgaaggcaccacgaataagatgaaatcccccgagacaaaacagcggaaactcagtcccctgcggctgtctgttagcaataaccaggaaccggactttattgatgatattgaggagaagacacccatctcaaacgaggtggaaatggaaagcgaggaacagattgccgaaagaaaacggaagatgacacgagaggagcgaaaaatggaagccatcctgcaggcctttgcaaggctggagaagagggagaaacggcgagaacaagcgcttgagagaatttctacagcaaaaaccgaggtgaagaccgagtgcaaggatacccaaatcgtgagtgatgctgaagtgattcaggaacaggctaaggaagagaacgcctctaaacccacccccgcgaaggtcaacaggactaagcagaggaaaagcttttcccgcagtcgtacccacataggccagcaacgaaggcggcacagaaccgtgagcatgtgctcagatattcagccttctagcccagacatcgaagtgacttcccagcagaacgacatcgagaataccgtgctgaccatcgaaccagaaaccgaaacagcactggccgagattattactgagacagaggtgcccgcgcttaacaagtgcccaactaaatacccaaagactaagaagcacttggtgaacgaatggctctcagaaaagaacgaaaagaccggtaaaccatcggatggactttccgaaaggccgctgcgcatcactactgatcctgaagttctagctacccaattgaacagcctacccgggttaacttattccccccatgtttactcgactcctaaacactacatcagattcacttccccatttcttagtgagaagagacggcggaaggagccgaccgagaacatcagcggatcctgcaaaaagcgttggctgaagcaggcactagaggaggagaacagtgcgatactacacaggtttaattccccttgccaggagcgcagcaggtccccagctgtcaatggggaaaataagagtccacttttgctcaatgacagctgttccctgccggatctgaccacaccattgaagaagcggagattctatcaactactcgattccgtctacagcgaaaccagcaccccgacaccctccccttacgccacgcctacccataccgacatcactcccatggacccctcctttgccacaccgcctaggatcaagagtgatgatgagacatgcagaaatggctataagcccatctacagtcctgtgacacccgtgacccctggtacccccggaaataccatgcatttcgaaaatatctcaagtcccgagtcttcccccgaaataaaacggcggacctactcccaggagggctacgaccggtcctccactatgttaactctgggcccgttccgtaacagcaacctgaccgaactgggtttgcaagagatcaagactattggctatacaagcccacgcagcaggaccgaggtgaaccggcagtgccccggtgagaaggagcctgtctccgatcttcagcttggtctcgatgccgtggagcctaccgcactgcacaaaacactggaaaccccagcacacgatcgtgctgagcccaactctcagctcgactctactcactctgggaggggcactatgtatagttcctgggtcaaatctcccgatcgtactggcgtcaacttttctgtgaattcaaacttacgcgatttaactccaagccatcagttggaagtgggcggcggcttccgtatcagcgagtccaaatgcctgatgcaggatgacacccgaggaatgtttatggagacaaccgtcttttgcacgagcgaggatgggctggttagcggattcggcaggacagttaacgacaacttgattgacgggaactgtactcctcagaatcccccgcaaaagaaaaaagtgtctctcttagaatacagaaagaggcaacgagaagcccgtaagtccggtagtaagaccgaaaactttcccctgatttctgtcagcccgcacgcgtcgggatcgctctccaacaatggtgatgggtgtgcgagtagcaatgataatggcgagcaggtggatcatactgcatctctacccctcccaacccctgctacggtgtacaatgcgacctcagaagaaaccagcaataattgtcctgtgaaggatgcaacagcttcggaaaaaaatgagcctgaggtacaatggaccgcgtctacatctgtggagcaagttagagaaagatcttatcagcgcgcccttctgctgtccgaccaccgcaaggacaaggacagcgggggcgaaagcccctgtgtgtcttgctcaccctcacacgtccagtcctctccttcaagccacagtaaccatattccacagctgcaggccaaaggacctgtcccctctttttcggaactgatggaggaccctgaccctgaaaatccggagcctaccacaacaaacgagtgcccaagtccagacacatcgcagaatacctgtaagtcacccccgaaaatgtctaaacctgggtcccctggaagcgtgattcctgctcaggctcacggaaagatatttactaaacccgacccacagtgggatagcactgtgtctgcgtcagaggcagagaatggtgtccacctgaagacagaacttcagcagaaacaactttccaataacaaccaggctctgagcaagaatcacccaccccagacacatgtgcgaaactcctccgaacaactctcacagaaacttccctcggtacctactaagctccattgtcccccttcgccacatctcgagaatccaccaaagagctcaacgcctcacaccccggtgcagcacggatatctctcaccgaaaccaccatcacagcagctgggatctccgtatcggcctcaccattctcagtcaccacaggtaggtacaccccaacgggaaccccagcggaacttttaccccgccgcccagaacctcccggctaatacacagcaggcgacttcaggaactctcttcacacaaacgccctccggtcagagctcagccacctacagtcagttcaaccaacagagcctgaattcgactgccccgccccctcctccacccccacctccaagcagctcatactaccagaatcaacagccctcagccaatttccagaattacaatcaactcaaaggttccctatctcagcagacagtgttcacatccgggcccaaccaggcactgccggggactacctctcagcaaactgtgccaggccatcacgttacccctgggcatttcctcccttcccaaaacccgaccatacaccaccagaccgctgctgccgttgtgcccccccctcccccccccccacctgccccaggcccacacctggtgcaacagccgaactctcatcagcagcatagcgttgcacatgtcgtgggcccagtacacgccgtgacaccagggtcgcatatccattctcagacagcaggtcatcacctgcccccaccccctccccctcctggtcctgccccccaccaccatcctccccctcacccatccaccggtctgcagggtctgcaagcacagcatcagcacgtggtgaactcagccccaccgccacctcccccgccaccacccagcagtgtgctggcaagcggtcaccacaccactagcgcccaggcacttcaccacccccctcatcaagggccccctctgtttccatcaagcgctcacccgacggtacctccatacccttcccaagccacacaccataccactttgggccccgggcctcagcatcaaccttccggtaccggcccccactgccctcttcctgtcaccggcccccatttgcagccgcaggggcccaatagtatccctactccaactgcaagcggtttctgcccccaccctggaagtgtggccctgccacacggggtgcaggggcctcaacaggcgtctcctgtgccgggccagattcccattcacagggcacaggttccacccacattccagaataattaccatgggagcggatggcattag

SEQ ID NO: 196056 - DNA, 5577 bp, Artificial Sequence
  Description of Artificial Sequence: Synthetic coding sequence
atgagcatcgtgatccccctgggcgtggacaccgccgagaccagctatttagagatggccgcaggcagcgagcccgaatccgtcgaagcttcacctgtggtggtcgagaagtcaaatagctatccgcatcagctctatacttcatcgagccaccactctcattcttatatcgggcttccgtacgctgatcataactacggagcccgcccacctccgactcctcccgctagcccgcctcccagcgtcctgattagcaagaacgaagttggaatcttcaccacccctaattttgacgagacctcctcagccaccaccatttctacctcagaagatggcagttatggtacagacgtaacaaggtgcatttgtggattcacacatgatgatggttacatgatctgttgtgataagtgctctgtatggcagcacatcgactgcatgggaatcgacaggcagcatattccagatacctacctgtgcgagcgctgccagccccggaacctggataaggagagagcggtactgctgcagagacgtaagagagaaaatatgagcgacggagatacatccgctactgaatccggcgatgaagttccggtcgaactttataccgcatttcagcacaccccaacatccatcaccctaaccgcttccagagtgagtaaggtgaatgataagagaagaaagaagtctggcgagaaagagcagcatatcagtaaatgtaagaaggctttccgcgaaggtagcagaaagtcctctcgcgtgaaagggtctgcacctgagattgatccttctagcgacgggagtaactttggatgggaaacaaaaattaaggcttggatggaccgctatgaggaagcaaataacaaccaatacagcgagggggtgcagcgggaggcacagagaattgcactgcggctaggtaatggtaacgacaaaaaggaaatgaacaaaagtgacctgaacactaataacctcctgtttaaacctccagttgagtcccacatccagaaaaacaagaagatactcaaaagcgctaaagacctgcctcccgacgcccttatcattgagtacagagggaaatttatgctaagagagcagtttgaagcgaatgggtacttctttaaaagaccatatcctttcgtactgttctatagcaaattccatggcttagaaatgtgcgtcgacgctagaacatttggcaatgaggcccgattcattagacgaagttgtaccccaaatgccgaagtgagacacgagatccaagacggcaccatccatctctacatctacagtatccactccattccaaaagggactgaaataactatcgccttcgactttgactatggtaattgcaagtataaagtggattgcgcctgccttaaggaaaatccggaatgcccagtgctcaagcgctctagtgagtctatggaaaatattaattcagggtatgagactaggcggaagaaaggcaaaaaagacaaagatattagcaaggagaaggacactcagaatcagaatatcactctggactgcgaaggcacgaccaataagatgaagtcccctgaaactaaacagcgtaagctctcacctctgcgtctgtccgtgtccaataaccaggagccagacttcatcgacgacatagaagagaaaacccctatatctaatgaagtcgaaatggaaagcgaagagcagatcgccgaaaggaaacggaagatgacccgggaggaacggaagatggaggccattttgcaagcatttgctagactggagaaacgtgagaaacggagagaacaagcattggagcggatctcaaccgccaagaccgaagtcaaaactgagtgcaaggacacacaaattgtgtccgatgcggaggtgatccaggaacaggcaaaagaggaaaatgcttctaaacctacacccgccaaggttaatcgcactaaacagagaaaatcattttctcgatcccgaacgcacattggccaacagcggagacgccaccgtactgtgtcaatgtgtagtgatatccagccgtccagtccagacattgaggtgaccagtcagcagaatgatattgagaatacggttcttacaattgaaccagaaaccgaaaccgcccttgctgaaattattaccgaaactgaggtgccggctctgaacaaatgcccgaccaaatatccgaagacgaagaagcacctggttaatgagtggctttccgaaaagaatgaaaaaaccggaaaaccatccgacgggctcagtgagcgccctctcagaatcacgactgaccccgaagtgctggccacccagctgaacagtcttcccggtctaacatacagcccccacgtgtatagtacacctaagcactacattagatttacctctccctttctgtctgaaaagcgcagaaggaaagagcctacagagaacatcagcggttcgtgcaagaaacgatggcttaagcaggcgcttgaagaggagaactccgccattctgcacagattcaattccccatgccaggagcggtctcgctctccggccgttaacggggagaacaagtcccccctcctcctgaacgattcatgtagtctgccagatctgactacccctttaaagaaacgacggttctatcagctccttgattcagtctattcggagacgagcacgccaactcccagcccttatgctaccccaactcataccgatattacccctatggatccatcattcgcaaccccaccaagaatcaagagcgacgatgagacatgcaggaacggctacaaacctatatacagtccagtcacgccagtgacacccggcacgccaggcaacaccatgcactttgagaatataagttcccccgagtccagccctgagataaagcggaggacctactctcaggaggggtacgatcgcagtagtacgatgctgactctgggccctttccggaactccaatttaacagagttagggttacaggagattaaaacaatcggatatacatctcctcgatcccgcacggaggtcaataggcagtgcccgggagagaaggagcctgtgtccgacttgcaattggggctggatgcagtggagcccaccgcactgcataaaacgctcgaaacaccagcccatgatcgagctgagcccaacagtcagctggacagcacacattcgggccggggtaccatgtacagtagttgggtgaagagcccagatcgtacaggcgttaatttcagtgtgaactccaatctacgggatctcaccccaagccatcagctggaggttggggggggcttccgcatctcggaatcgaaatgccttatgcaagacgacacaagaggtatgtttatggaaaccactgtcttttgcacttctgaagatggcctggtgagtggcttcggacggaccgttaatgataacctgatagacggcaattgtactcctcagaaccccccacagaagaagaaggtatcgctcctcgagtacaggaaacggcagagagaagcccgcaaatcgggtagtaaaaccgaaaactttcccctaatctcagtgtctccgcacgcttcgggctctctctcgaataacggcgacggttgcgcgagcagcaatgataacggggaacaagtcgatcatactgcttctcttccactccctacaccggccacagtctataacgccacctccgaggagactagcaacaattgccccgtcaaggatgccaccgcctccgagaagaacgagcctgaagtgcagtggacagcctctactagtgtcgaacaagttcgggagcgaagctaccagcgtgcattgctgctctccgatcaccggaaagacaaggactctgggggagagtccccatgcgtttcctgttctccgtctcatgtccagtcgagcccctcttcacattctaaccatattccccagttgcaggctaagggtcccgtacctagttttagtgagcttatggaagacccggatcctgaaaaccctgagccaacaacaaccaatgagtgcccttccccggatactagccagaacacgtgtaaatcccccccgaaaatgtctaaacctggtagcccaggctccgtcatcccagctcaggctcacgggaagatctttaccaagcctgatccccagtgggacagcaccgtgtctgcctctgaggccgagaacggagtgcacctgaagacagagctccagcagaaacagcttagcaacaacaaccaggccttgagcaagaaccacccaccacaaactcatgtcaggaacagtagcgaacagctttctcagaagctcccatctgtccccactaaactgcattgcccaccatctccacatctggaaaatcctccgaaatcaagcactccccatacaccagtccaacacggctacctgtcccctaagcccccatctcagcagctgggtagcccttatcgtcctcaccactctcagtccccgcaggtcggcactcctcagcgcgaaccacagcgcaatttttaccccgccgcacaaaacctcccggccaacacacaacaggcaactagcggaacattgttcacacagaccccgtctggacagtcttccgccacttactcccagttcaatcagcagagccttaacagcaccgcaccccctccacctcctccaccccctccttcgagcagttattaccaaaatcaacaaccttctgccaatttccagaattataaccaactgaaaggcagtctctcacagcagaccgtgttcacttcagggcctaaccaggctcttcctggtacaactagccaacagaccgtgcccggacaccatgtgactcctgggcacttcttgccttcccagaatcctactattcaccaccaaactgccgctgcagtcgtgccccccccaccacctcctccaccagcgccgggacctcacctagtgcaacagcctaactcccaccagcaacactcagtggcccacgttgtgggaccagtacacgcggtaacccctggtagccacattcacagtcagacagccggtcaccatctcccgccccctccacctccacccggcccagctcctcaccaccacccgcccccacatccctcaacaggactccagggtctccaggctcagcaccagcacgtcgtcaatagtgccccgccccccccccccccccccccaccaagcagtgtattggcatctggacaccacaccacaagcgctcaagccttgcatcatccgcctcaccaggggcctccactcttcccatcatccgcgcatccgacagtccctccatatcccagccaggcaactcatcacacaactctgggccctggaccacagcaccaaccatccggcacaggtccacactgcccgctccccgttaccggtccgcacctgcagcctcagggtcctaatagtatccctactcctactgcttcaggattttgtccacatcccgggagcgtcgccctgccccacggggtacaggggcctcagcaggcgtcaccagtaccgggacagattccaattcacagggcccaggtccctccgacgtttcagaacaattaccacggctctggatggcattag

SEQ ID NO: 196057 - DNA, 5451 bp, Artificial Sequence
  Description of Artificial Sequence: Synthetic coding sequence
atgagcatcgtgatccccctgggcgtggacaccgccgagaccagctacctggaaatggctgccggcagcgagcccgagtcagtggaagcctccccggtcgtggtggaaaaatccaattcatacccccaccagttatacacctctagcagccatcatagccatagctatatcgggcttccctacgccgaccacaactatggggccaggccacctcccacgccaccagccagtcccccccccagcgttttgatcagcaagaatgaagtgggcatcttcacaacaccaaactttgacgagacatctagcgccaccaccatatccactagcgaagatggatcctatggcactgacgtgacccgttgcatctgtggtttcactcatgacgatggatatatgatctgttgtgataagtgctccgtatggcagcacattgattgtatgggcatagacaggcaacatattccggatacctacctatgcgagcgctgccagcccagaaatttagacaaggagcgcgctgtactcctccagaggcggaagcgtgagaacatgtctgacggggatactagcgcaaccgaatcaggtgatgaggttcccgtagagttgtatactgcctttcagcatacgcctaccagcatcactcttacagcctctcgtgtctcgaaggtaaatgacaagaggaggaagaaaagcggcgaaaaggagcagcacatttcaaaatgcaaaaaggcgttccgcgaagggtctcgaaagtcctcccgggtcaaggggtccgccccagaaatagaccctagcagcgatggctccaactttggatgggagactaagattaaggcatggatggacagatatgaggaagccaataacaaccagtattctgagggggtgcagcgcgaggctcagcgtattgcccttcggctggggaatgggaacgataaaaaagaaatgaacaaatccgacctcaacactaataatttgttgtttaaacctccagtggaaagtcacattcagaaaaataaaaagatcctgaagtcggcaaaggatctgcctccagatgcactaattatcgaatacagaggaaaattcatgctgagggagcagtttgaagctaatgggtattttttcaagcgaccctatccatttgtgctcttttatagcaagttccacgggcttgaaatgtgcgtcgacgctaggacatttggaaacgaagcgcggtttatccgccggagctgcacaccaaatgcagaggttagacatgaaatacaagacggtacaatccatctgtatatctatagcattcacagcattccaaaaggcaccgagatcaccatcgcctttgacttcgactatggtaattgtaaatacaaggtggattgcgcttgcctgaaggaaaacccggaatgccccgtgcttaagaggagttccgagagtatggaaaatataaacagtggatatgagacgcgacgcaaaaaagggaagaaggacaaggatatctcaaaggagaaagacactcagaaccagaatataacactagactgcgaggggacaacaaacaagatgaagagtccagaaacaaaacagagaaaactctcgcctctgcgactatccgtttctaacaaccaggaaccagattttatagatgatatcgaagaaaaaacccctatctcgaacgaagtagagatggagtctgaggaacaaattgcggagcggaagagaaaaatgactcgggaggagagaaagatggaggctatattgcaggcttttgcaaggttggaaaaaagggagaaacggcgtgagcaggcactagagaggattagcactgctaagacagaagtgaaaacagaatgcaaggacacccagattgtgagtgacgctgaggtgatccaagagcaagccaaggaggagaacgcctctaagcccacccctgcaaaggtgaatagaacgaagcagagaaagagcttttcacgcagtagaactcacatcggacaacagcgtaggcgacatagaaccgtctcgatgtgtagcgatattcagccgagtagcccagacattgaggtgacctctcagcagaacgacatagaaaacactgttctgacaattgagcccgagactgagacagccctcgccgaaattatcactgagacagaagtccctgcactgaataagtgccccaccaaatacccaaaaacaaagaagcacctggtgaatgagtggctctccgagaagaacgaaaagaccggcaagccttctgacggcctctctgagagaccgcttaggattaccacagatcccgaagtgctcgctacccagcttaatagtctacctggactgacttactccccacacgtctactcaactcctaagcattatattcgcttcaccagcccgtttttgtccgaaaagcgtaggcgcaaggagccaaccgaaaatatctctggttcttgtaaaaaacgatggcttaagcaggctctcgaagaagagaattctgccatccttcacagattcaacagtccttgtcaggaacgaagccgatcccctgccgtcaatggcgagaacaaatccccgctgctgctcaacgatagttgctctcttcctgacctgaccacccctctcaaaaagcgccggttttatcagttgctcgactcggtgtacagcgagaccagcactccaactcccagtccttacgctacccctactcacacagatattacgcctatggatcctagcttcgctacgcctcctagaatcaaaagcgatgatgagacttgccggaatggatacaagccaatttactcaccggtgactccagttacacccggcacccctggaaacaccatgcacttcgagaatattagcagtccagaatctagcccggaaatcaaaagaaggacatactcacaggagggatacgatcggagcagcactatgcttacgctaggcccctttcgcaacagtaacctgactgaactcggactgcaggaaatcaaaaccatcggatatacgtcacctcggtctcggacagaagtcaatcgccagtgcccgggtgagaaggagcctgtgtctgacctgcagctggggctagatgccgtggagcccaccgcgctgcacaaaaccctagaaacaccggctcacgatcgggctgagcccaacagccagttggactccacccattctggtagaggtacaatgtacagttcatgggtgaagtctccagacagaactggcgtcaattttagcgtgaactcaaaccttcgagacctgacgccatcccatcagcttgaggtcggcggcggattccggatttcagagtcaaagtgtttgatgcaggacgacactaggggaatgttcatggagacgaccgtgttttgcacatccgaggacggcttggtatctggcttcggacgcacagtaaacgataacctgatcgacggcaactgtacgccgcagaaccccccgcagaagaagaaggtcagcttactggagtaccgcaaacgtcagcgcgaggccaggaagtccggaagcaaaacggagaatttcccactgatttccgtgtcacctcacgcaagcggctccctctccaataatggagatggatgtgccagctcaaacgacaatggcgagcaggtggatcatactgctagtctgccgctcccgacccccgccaccgtgtacaatgccaccagtgaagagacttcaaacaattgccccgtgaaggacgccacagccagcgagaaaaacgaacccgaggttcagtggaccgccagtacctctgtggaacaggtgagggagcgcagctatcagagagcgctgttgctctccgaccaccgaaaggacaaggattctgatcccgaccctgagaacccagagccgaccacgacgaacgagtgtcctagtccggatacctcacagaatacatgtaagagtcccccaaagatgagcaaaccgggttcacccggaagtgtgattccagctcaggcgcacgggaaaatctttacgaagcccgacccacaatgggatagcacagtctccgcctctgaagccgaaaacggcgttcatctgaaaactgagttgcagcaaaagcaactgtcaaacaataatcaagcactgagcaagaatcaccccccacaaacccatgtgagaaactcctcggagcagctttcccagaaactgccatctgtgcctacaaagctgcactgccccccctcaccgcacctggagaacccccccaaatcctccacaccccacacccctgtccaacacgggtatttatctccaaaaccaccatcacagcagctgggtagcccctacaggccacaccattctcagtccccccaggttggtacgccccaaagggagcctcagagaaacttttacccagctgcgcaaaatctgccagccaatacacagcaggcgaccagcggcacacttttcacacagactccctcaggccagagcagcgccacatactcccaatttaaccagcagtctctgaactctaccgcgcccccgccaccaccacctcccccaccttctagtagctattatcaaaatcagcaaccatccgctaactttcagaattacaatcagttgaaaggctcccttagccaacagactgtcttcacctctggcccaaaccaggctttacctggcactacgtcccagcagaccgtgcccggtcatcatgtaacgcctggacatttcctaccatcacagaatccaaccattcaccaccagacagcagctgcagtagttcctccaccccctcctcccccacctgcacccggacctcatttggtgcagcagccaaactctcaccagcagcacagcgttgcgcacgtcgtggggcctgttcacgccgttactccaggaagccatatccactcacaaacagccgggcaccacctgcctcccccaccaccccccccaggtcccgcgcctcaccaccacccaccacctcacccaagcaccggcctccaggggctccaggcacaacaccaacacgtcgttaacagcgcaccccctcccccaccccctccaccaccgagttccgtactggcaagtggtcaccataccactagtgcgcaggctctgcaccatcctccccaccaaggtcctcccctgtttccctcctcggcccatcccaccgtccccccttatccctcacaggcaacacaccacacaacactgggcccaggaccccagcaccagccttccgggaccggaccccactgtcccctgcctgtgacaggcccacacctccagcctcagggcccaaacagtattccgactcccaccgcgagcgggttttgtcctcaccctgggagcgtcgccctcccccatggggtccagggtccccagcaggcatcccccgtgcccggacaaatacctattcacagggctcaggtgcccccaacttttcagaacaattatcacgggagcggatggcactag

SEQ ID NO: 196058 - DNA, 1770 bp, Artificial Sequence
  Description of Artificial Sequence: Synthetic coding sequence
atgcacttcgagaacatcagcagccccgagagcagccccgagatcaagcgtagaacttattcgcaggaggggtacgaccgatccagtacaatgcttacacttggccccttccggaactctaatctcacagagctgggattacaagaaattaagaccatcgggtacacgagcccccggtcccgtaccgaggtaaatagacagtgcccaggggaaaaggaaccagtgagtgacctgcagctcggcctggatgccgttgagccaacagcactgcataagaccctggagacaccagcccacgaccgggcggaacccaacagccagctggatagtacccattctggtagaggcacaatgtactcatcctgggtgaagtctccggatcggaccggagttaacttctcagtgaattctaatttgagggatctgacgccctcgcaccagcttgaagtcggggggggcttccgtatatccgaatccaagtgtttaatgcaggacgatacccgcgggatgtttatggagaccaccgttttctgcactagtgaggatggactcgtgtcgggctttggccggactgtgaacgacaatcttatcgacgggaattgtacaccccaaaaccccccccagaaaaagaaggtctcacttctcgaataccggaaacggcagagagaggcaaggaaatccggcagcaaaacagagaatttccctctcatatctgtgtctcctcatgcatctgggtccttaagcaataatggagacggatgcgccagcagtaacgacaacggcgaacaagtcgatcacaccgccagtctgccgctacctaccccagccaccgtgtataacgctacaagcgaggagacaagcaacaattgccccgtgaaagatgcaaccgcctccgagaaaaatgaacccgaggtgcagtggacagcctccacttctgtggaacaggtgagagaaagaagttaccaaagagccttgttgttatctgatcaccgcaaagataaggatagtgggggggagagcccgtgtgtgtcctgctcaccatcgcacgttcagagtagccctagctctcacagtaatcatatccctcagctgcaggccaagggaccggtacctagtttcagtgagttgatggaggaccccgacccggagaatccagagcctaccaccactaatgaatgcccatctccagacactagtcagaacacttgtaaaagtccgcctaaaatgagcaagccagggtcaccagggagcgtgattccggcccaggcccacggaaagatctttacgaagccggacccgcaatgggactccactgtgtcggcgtctgaagctgagaatggcgtgcacctgaagactgagctccaacagaagcagctgtccaacaacaatcaggctctcagtaaaaaccaccctccccagacacatgtcagaaactccagtgagcagcttagccagaaactgccttcagtccccaccaaactccactgtccaccttctccccacttggagaatcctcctaaatcaagtactcctcatacaccagttcagcacggttacctctccccaaaaccacctagtcaacagttaggaagcccatacaggccacatcactctcagagcccccaggtcggaacccctcagcgggaaccacagcgcaatttttacccagctgcccagaacctcccagctaacacgcaacaggctactagcggcactctcttcacccagactccgtcaggccaaagctcagccacctacactcagagatag

SEQ ID NO: 196059 - DNA, 5337 bp, Artificial Sequence
  Description of Artificial Sequence: Synthetic coding sequence
atgagcatcgtgatccccctgggcgtggacaccgccgagaccagctaccttgagatggccgctggaagcgagcctgagtccgtggaagcctcccccgtggtagtggagaagtccaactcctatccacaccagctgtacacctctagttctcatcactctcatagctatatcggcttaccctacgccgatcataattatggcgctagaccacctcctactcctcctgccagcccgccgccctccgtactgatctctaagaatgaagttggtatcttcacaaccccgaattttgacgaaacgtcaagtgccactacgataagcacaagtgaagacggatcctatggtactgacgtcacccgctgtatatgcggttttacccacgatgatggctacatgatttgttgtgacaagtgtagcgtctggcagcacatcgactgtatgggcatcgacaggcagcacatcccagacacctatctgtgcgagcgttgccaaccaagaaacttggataaggaacgcgcagtgcttttgcaacgccgcaagagagagaacatgagcgacggcgatacgagtgctactgaatccggggatgaggtcccagtcgaactttataccgccttccagcacacacccaccagcatcaccctgacagcctcgagagtctctaaggtgaacgataagcgtcggaagaaatcaggcgagaaggaacagcacatctccaagtgcaaaaaggctttccgggagggatctaggaaatccagccgcgtaaaaggctctgcccccgagatcgacccaagctcggacggatcaaatttcgggtgggaaacaaaaattaaggcttggatggaccgatatgaggaggccaacaataatcagtacagtgaaggtgtccagagggaggcccagaggattgccctccgcttgggtaatggtaacgacaagaaagaaatgaataaatcagacctcaacactaacaatttgctgtttaaacctcctgtcgagtcccatatccagaaaaacaaaaagatcttaaaatcagccaaagacctgcctcccgacgctttaatcatcgaatatcgcggaaaattcatgctccgtgaacagttcgaggctaacggctatttctttaagaggccttacccctttgttttattctacagcaagttccatgggcttgagatgtgtgttgatgctaggaccttcggaaacgaggccaggtttataaggcgtagttgcactcccaatgcagaagtccgccatgagattcaggatggtacaatacacctctatatttatagcattcattctataccgaaaggcacagagattactattgcctttgatttcgattacgggaattgcaaatacaaggttgattgcgcctgccttaaagagaatcccgaatgtcccgttctgaaaaggtcttctgagtccatggagaacattaattccggctacgagactcgccggaagaaaggcaagaaaacgcgcgaggagcggaagatggaggccatcctccaagcttttgccaggttagaaaaacgcgagaaacgtagggaacaggcactggaacggattagcactgccaagacggaggttaagactgagtgcaaggacactcaaatcgtctcagacgccgaggtgatacaggagcaggctaaggaggaaaatgcgtcaaagcctacgccagcgaaggtgaaccgaaccaagcaacggaagtccttcagcaggagccgcacacacattggacaacagaggcgtagacataggacagtgagtatgtgtagtgatatccagccatcttctccagatatcgaagtcacttcgcaacaaaatgatattgaaaacaccgtgctcaccattgaacccgagaccgagaccgcacttgccgagatcataacagagacggaggtacccgccctaaacaagtgcccaacaaagtatcccaaaaccaaaaaacacctggtcaatgaatggctcagcgaaaagaacgaaaagacaggtaaaccttcagatggtctgagcgaaagacctttgagaattacaactgatcctgaggtgttagcaactcagcttaattctctccccgggctcacttattctcctcatgtctacagcacaccaaagcattacatccggtttacctccccctttctgtccgaaaaacgccggaggaaggagcccacagagaacataagcgggagttgcaaaaagcggtggcttaagcaagcacttgaggaggaaaatagtgctatcctgcacagatttaactctccatgccaagagcgaagccggagtcctgctgttaacggggaaaataagagccctttattactgaatgatagctgttcccttcctgacctcactaccccattaaaaaaacggagattttatcagctgctggacagtgtttatagcgaaacatctacgcctactccaagtccatatgccaccccgacacacacagatatcacgccaatggatccatcatttgctacccctccaagaattaagagtgatgacgagacttgtcggaatggctacaaaccgatctacagcccagtgactcctgtgacgcctgggaccccaggcaatactatgcactttgagaatatttcttcacctgaatcttctcctgaaatcaagcggagaacctactcacaggaagggtacgacagaagttccactatgctgacactcgggcctttccggaactctaatctcaccgaattagggcttcaggagattaagaccatcggctacacgtctccccggtcgcgcaccgaggtgaacaggcagtgcccaggggaaaaggaaccagtgtccgaccttcagctgggactcgacgctgtggagcctactgccctccacaagaccctggagacacccgctcacgatcgcgctgagccgaattcacaactggacagtacacactcgggacggggaactatgtactcctcttgggtcaaaagtcccgataggaccggtgtcaatttctctgttaattcaaatctacgggatttaacgccaagccaccagcttgaagtgggcggtggcttcaggattagcgagagcaagtgtctaatgcaggacgacacaaggggaatgttcatggaaactactgtgttttgcacatccgaggatgggctagtgtctggctttggtcgcaccgtgaatgataacctgatagacggtaattgcacacctcagaaccccccacaaaaaaagaaggtgtctctgcttgagtatagaaaacgccagagggaggcacggaagtccggttccaagaccgaaaatttcccacttatctcggtcagtccccacgcgagtggatctcttagcaacaatggcgacggctgtgcctccagcaatgacaatggcgaacaggtagatcacaccgcgtctcttccccttcctacccctgccactgtctataacgccacctcagaagaaacttcaaataattgtccagtaaaggacgccacagcgagcgagaagaacgaacccgaggtgcagtggaccgcctcgacgtcagtcgaacaagtaagagagcgaagctaccagcgggccctgctcctttcggatcatcgcaaagacaaagatagtggtggcgaatctccgtgcgtcagctgctctccctcccacgtccaatcctcacctagctcccactccaaccacataccccagctacaggccaaaggccccgtacccagcttttccgagctgatggaagatcccgaccccgagaaccctgaacccaccactaccaatgagtgcccatcccctgacaccagccagaacacatgcaagagcccaccaaagatgtcgaagccggggagcccagggtcagtgattccagcccaggcccacggaaaaatttttaccaaaccagatccccagtgggactccactgtaagtgcatctgaagcagagaatggagtccacttgaagactgagctccagcaaaagcagctcagcaacaacaaccaagccttatccaaaaatcatcccccccagacacatgtccgcaacagttcagaacagttaagtcagaaactgcccagtgtaccaacaaagctgcactgtcctccctcgccccatttggaaaacccaccaaagagctcaactccccacactcctgtgcaacacggttatttaagcccaaagccgcctagtcaacaactgggatctccctatcgcccacaccacagtcaatctcctcaggtcggcacacctcaacgcgagccccagcggaacttttatccggcggctcagaacctgcctgccaatactcagcaggctacatccggtactctatttactcagactccttctggccaatctagcgcaacctacagccaattcaaccagcagtccttgaatagtacagcgccaccaccccccccccctccaccaccgtcttcatcgtactatcaaaatcaacagccaagcgcgaactttcagaattacaatcagctcaagggctccctttcccagcagactgtgtttacttccgggccaaaccaagccttgccagggacaacttcacagcagactgtgcctggccaccacgtgaccccagggcattttcttccctcccaaaaccctaccattcatcatcagactgcagctgccgtggtgccaccgccgccaccaccccctcctgcacccgggccccacctcgtccagcagcccaattctcaccagcagcactctgtggctcatgtggtgggccccgtgcacgccgttacgcctggttctcatatccattcgcagacggcaggacatcatctcccaccaccaccgccacctccaggcccggcgccacaccaccacccccctcctcatccatccacgggtctccagggtcttcaggcacaacaccagcatgtagtaaactccgctccgcctccccccccccctccccccccttcctcagtgttagccagtggtcatcacactactagcgcccaagcactgcaccaccccccacatcaggggccccctctttttccatcctctgcgcatcccaccgtccctccctacccaagccaggccacacatcacaccaccctcggtcccggtccccagcatcagccatcgggaacaggtcctcattgccccctccctgtgacgggcccacacctgcagccccagggcccaaactctattcccacaccaacagcatctggtttctgcccccatcccggatctgtggctctcccacacggagtccagggcccccagcaggcttccccagttcctggtcagatccccattcatcgtgcccaggtgcctccaactttccagaataattatcacgggagcggctggcattag

SEQ ID NO: 196060 - DNA, 4962 bp, Artificial Sequence
  Description of Artificial Sequence: Synthetic coding sequence
atgagcatcgtgatccccctgggcgtggacaccgccgagaccagctacctagagatggccgccggctcagaacccgaaagcgtggaggcttccccagtggtagtagagaagtctaactcatacccccatcagctttatacatcttcctctcaccatagccattcctacattgggttgccgtatgccgaccacaactacggcgcaaggcccccaccaaccccacctgcatccccaccaccgtcagtgctcattagtaagaacgaagtcgggatcttcacgacacccaatttcgatgaaacttcatctgccacaacaatatcaaccagcgaggatgggtcctatggcaccgacgttaccagatgtatctgtggcttcacacatgatgacggctatatgatctgctgtgacaagtgcagcgtgtggcagcacatcgattgcatgggtattgaccggcagcatatcccggatacctatctctgcgagcgatgtcaaccacgtaacctcgacaaagaaagagctgtcctgctccaaagacggaagagggagaatatgtccgacggcgacactagcgctaccgaatccggagacgaggtgccagtagagttgtatacagcctttcagcacacgccaaccagcataacgctcaccgcatctcgcgtgtctaaggtcaatgacaagagacgcaaaaagtccggcgagaaggagcagcacatcagcaagtgcaaaaaagctttcagagaagggtcaaggaagagctcccgcgtgaagggctctgctcccgaaatcgaccccagctctgatgggtcaaatttcggatgggaaactaagatcaaggcctggatggatcgttacgaagaggccaacaataatcagtacagtgagggggtccagcgcgaggcacaaaggattgctctgcggcttggcaacggaaatgacaaaaaggaaatgaacaagagcgacttgaacacaaacaatctcctttttaagccaccagtggagtcccacatccagaaaaacaaaaagattctgaagagcgccaaggatttgccccccgacgcactaattatcgagtaccgcgggaagtttatgctgagggagcagttcgaggccaatgggtactttttcaagagaccctacccatttgtccttttctacagcaaatttcatggtctcgaaatgtgtgttgacgcaagaaccttcggcaacgaggcacgattcatccggcggagttgcacccccaacgctgaggtgcgtcacgagatccaggatgggactatccatctgtacatctactccattcactccatccccaaggggactgaaataactattgcattcgattttgattatggtaactgcaagtataaagtggattgcgcttgcctgaaagaaaaccctgaatgccccgtcttgaagaggtcctctgagtccatggagaacatcaattcaggatatgagacacgacgcaaaaagggcaagaaagataaggacatctctaaagagaaggatacccagaaccagaacatcacactggactgtgaggggacaactaacaagatgaagtccccagagaccaaacagcggaagctgagcccactgcgcttgagcgtttctaacaatcaggagcctgattttatagatgatattgaagagaagacacccatctccaacgaggttgaaatggagtctgaagagcagatcgctgaacgcaaacggaaaatgactcgtgaggaacgcaaaatggaggcgattctgcaggcatttgcccggcttgaaaaacgggagaagagacgtgagcaagccttagagaggatttctacagctaagactgaagtgaaaaccgaatgcaaggatacgcagatagtgtcagacgcggaagtgatccaagaacaagcgaaggaagagaatgcatccaaacccacccccgcgaaagtgaatagaactaaacagagaaaaagcttttcgagatccaggacacatattggccagcaacgacggcgacatcggaccgtgagcatgtgctccgacatccagccatcctccccagacatagaagtgacgagccagcagaatgatatcgagaataccgtgctcactatcgagccagagactgagaccgcgttggccgagattatcacagagactgaggttccagcactcaacaaatgtcccaccaagtaccctaaaaccaagaaacatctggtcaacgagtggctgtccgaaaagaatgaaaaaacagggaagcctagcgacggcctctcagaacggcccctgaggataacaaccgatccagaggtgctagccacgcagctgaatagcctgccgggcctcacttactccccacacgtctactctactcctaagcattatattagattcacctcacccttcctctctgagaagcgtagacgaaaagaacccacagagaacatcagtgggtcgtgcaaaaagagatggctaaagcaggctctggaagaagaaaacagcgccatcctacatcggttcaactccccatgccaggaacgtagtagatctccagcggtgaatggcgagaacaaatctccgctgctccttaacgattcatgctctcttcctgacctcacaacccccctgaagaaacgccgcttctatcagctcctggacagcgtgtactcagaaacttccacccctacaccaagcccctacgctaccccgacccataccgatatcactcccatggacccttccttcgcaaccccacctcggattaagagtgatgacgaaacttgccgcaacggctacaaaccgatctattcccccgtgactccagttacacccggcactcctggcaatacaatgcacttcgagaacatctcctcacccgagagttcacccgagatcaagagacggacctacagtcaggagggatatgaccggagctccacaatgcttacgcttgggccattcaggaacagcaatctcacagagctcggactgcaggagatcaagaccattggttacaccagccccaggagcagaaccgaagtcaatagacagtgcccaggagagaaagaacctgtgtctgatttgcaactcggactagatgccgtggaaccgactgctcttcataaaacacttgagacgcccgctcacgaccgcgccgagcctaactctcagctggatagcactcattccgggagaggaaccatgtacagctcttgggtcaagagtcctgatcggacgggcgttaatttctctgtcaacagcaacctcagggaccttacaccctctcatcaactcgaggtaggcggggggtttcgaattagcgagtctaagtgcctgatgcaagacgatacccgcgggatgttcatggaaacaactgtgttctgcacctcagaagacggtttggtgtcagggtttgggcgaacagtgaatgacaatctgatcgatggaaattgtacgccccagaatccaccacagaagaagaaggtctccctgctggaatacaggaaaaggcagcgggaagctcgcaaaagcggttctaagaccgaaaattttcccctgatctcagtctcaccccatgcctctggatctctcagcaacaatggcgatggctgtgcgtcaagtaatgataatggggagcaggtcgaccacactgcctctttgccactgcccacccctgctaccgtgtataatgccaccagtgaagagacctccaataattgccccgtgaaggacgccaccgcatctgagaagaatgaacccgaagttcagtggactgcatcaacatcggtagaacaggtccgcgaacggagttaccagagggctcttctgctgagtgatcacagaaaggacaaggattctggcggtgagtccccatgcgtctcatgctcaccaagccatgtgcaatcttccccttccagtcactcaaatcatataccacaattacaggcaaaaggacctgtgcctagcttctcggaattgatggaggaccccgaccccgaaaaccccgagcctaccaccacaaatgaatgcccatccccggacacaagccaaaatacttgcaagtcgccacccaagatgtcaaagcctgggagtcctggctccgtcattcccgcccaggcccacggaaaaatattcacgaaaccagacccccagtgggactccaccgtgtctgcctcagaagcagagaacggagtccacctcaagactgagctgcaacagaaacaactctccaataataaccaggctctgtctaagaatcatccaccccagactcatgtcaggaattcctccgagcagctctctcaaaagctgccctctgtgcctactaaactgcactgtccgccatctcctcacctggagaaccctccaaagagtagcacaccccacactccagtgcagcatgggtatctgagccctaagccacccagccaacagttgggctcaccataccgcccccaccattcccagtcacctcaagtggggactccccaaagagaaccacagcggaatttttatccagctgcccagaatctgccagtgttctggctacttggcattatcccacatcaattgaaaccatatacaacccatctgatcaaggacctgcatttctttctccgggttctgatccagttgtaccaccggattcctcacaagctgcacataatcccgctgtgggacagagacccatcaacgagcctactcgaacaaggtcacatcgtacactacttaagtcaggtcctcatcagctcccccaaagatcagactgtgttccagcacctcctattgcaggggtccgtgctcatcttggctttatggccatgtcacatgggcttcaaagacctcagccgccacctgcagtgcttagacaggttccaattcacagagcaccgatgtcaccaacattttaagactatcactatggggcaagggggtataaagatggattctaagaacatttttctcaacgtgttgtag

SEQ ID NO: 196061 - DNA, 378 bp, Artificial Sequence
  Description of Artificial Sequence: Synthetic coding sequence
tgaggcagcctgagcaacaacggcgacggctgcgccagcagcaacgacaacggggagcaagttgaccacaccgcttctctgcctctaccgacccctgctacagtatacaacgcgacgtctgaagagaccagcaacaattgcccagtgaaggatgccacagcgtccgaaaaaaatgagccagaggtacagtggacagcatccacgtctgttgagcaagtgcgcgaacggagctatcagcgtgctttactgctcagcgaccaccggaaggataaggactcggacccagaccccgaaaatcccgagccgacgacaacaaatgagtgcccttcgcctgacacgtcccaaaacacgtgcaagagtcctccaaaaatgagctag

SEQ ID NO: 196062 - DNA, 216 bp, Artificial Sequence
  Description of Artificial Sequence: Synthetic coding sequence
atgagcatcgtgatccccctgggcgtggacaccgccgagaccagctacttagagatggcagcaggaagtgagcccgaatccgttgaggcctcccctgtggtggtcgagaaatccaacagttacccgcatcagctatacacatcctcttctcaccattcacactcctatattggcctgccgtatgcagaccacaattacggagccagacccccttag

SEQ ID NO: 196063 - DNA, 1830 bp, Artificial Sequence
  Description of Artificial Sequence: Synthetic coding sequence
atgagcatcgtgatccccctgggcgtggacaccgccgagaccagctatctggaaatggcagcaggatccgagccagaaagcgtcgaggctagccctgtcgtggtagagaagagtaactcttacccacaccaactctacacatctagttcccatcactcccattcttacattggcctcccatatgcagatcataactacggtgctcgaccgccccctacacccccagcgagccccccccccagtgtgctaataagtaagaatgaagtcggtatcttcactactcccaattttgatgaaacaagctcagcgacaaccatcagcacctccgaggacggctcttacggtacagacgtgaccaggtgtatctgcggattcactcacgatgatggatacatgatttgttgcgacaagtgttcggtgtggcaacacatagactgtatgggcattgacaggcagcacatcccagacacctatctctgtgaaaggtgccagccgaggaatctcgacaaggagcgcgccgtcctgctgcaaagaagaaagcgagagaacatgtccgatggagatacatccgccactgagtccggtgatgaggttccagtggaactgtacacagccttccagcacactccaacatcaattacgctgaccgcttcccgcgtgagcaaagtgaacgacaagcggaggaagaagtccggcgagaaggaacagcatatttccaaatgcaagaaggcgtttcgggaagggtctcgtaagtcctccagggtgaagggctcagctcccgagattgatccctcatccgatggatccaacttcggatgggagaccaagattaaagcttggatggatcgctatgaggaggccaataacaaccagtactcagagggcgtacagagagaggcacaacgcattgcactacgcctaggcaacggcaatgacaaaaaggagatgaataagtccgatcttaacaccaataatctcttgttcaagccccctgtggaatcgcacatacagaagaacaagaagatcctcaagagcgcgaaagatctgcccccagacgccttgatcatcgagtatagggggaaattcatgttgagggaacaattcgaagccaacggttacttctttaaacggccgtatccattcgtgctgttctacagcaaattccatggtctggaaatgtgtgttgacgccaggaccttcgggaacgaggcccggttcatcaggagaagctgcactccaaacgctgaggtcaggcacgaaattcaagacggcaccatccacttatacatctattcaatacattctatccctaaaggaaccgaaattacaattgcattcgattttgactacgggaattgcaagtataaggtcgattgtgcttgtctgaaggagaatccagaatgtccagtactcaaacggtctagcgaatccatggaaaacatcaacagcgggtacgaaacgcggagaaagaaaggaaagaaggataaggacatatctaaggagaaagacacgcagaaccaaaacatcaccttggattgtgaaggcacaaccaacaagatgaaaagccctgaaaccaaacagcgaaagttgagcccccttcgccttagcgtctctaacaatcaggagccagatttcatagacgacatcgaggagaagacacctatctcaaacgaagttgaaatggagagtgaagaacaaatcgccgagcggaagagaaaaatggtgtcttgggaagccagtagcttaggactagtgactgctgctctacatatggtgatagtggcggccttcacttgggcgtttacccttttctttgaagtgtcagagtag

SEQ ID NO: 196064 - DNA, 693 bp, Artificial Sequence
  Description of Artificial Sequence: Synthetic coding sequence
atgagcatcgtgatccccctgggcgtggacaccgccgagaccagctatctggaaatggccgccggttccgagcccgagtcggttgaagcctcacccgtggtagtggagaaaagcaacagctatccacatcagctgtacacatcaagcagtcaccactcccactcctacattggcctcccatacgccgatcataactatggtgccaggcccccccctacacccccggcttcccccccgccaagtgtactcatctcgaagaacgaagtcgggatctttacaacgcccaatttcgacgagacatccagcgctacaaccatatccacctccgaggacggcagttacggcaccgacgtaaccaggtgcatttgcggattcactcatgacgacggttatatgatctgctgtgacaaatgctcagtctggcagcatatcgactgtatggggatagaccgccagcacattcctgatacctacctgtgcgaacggtgtcagcctcggaacctagacaaggagagggcggtgttgctgcagaggcggaaacgtgagaatatgtccgacggggatacatcagcaacagagagcggcgatgaggttcctgtggaactgtataccgcatttcaacacacgccaacctccatcaccttgacagcttcccgagtgtctaaagttaacgataaacggcggaaaaagtag

SEQ ID NO: 196065 - DNA, 1362 bp, Artificial Sequence
  Description of Artificial Sequence: Synthetic coding sequence
atggtgctggtgctgagcgacaccagcgccagccccccccccagcgtcctcataagcaagaacgaggtcgggattttcacaacccctaacttcgatgagactagctcggccactaccatcagtacctcggaagatgggtcatatggtactgacgtcacccgctgtatatgtggctttacccacgacgatgggtacatgatttgttgcgacaaatgtagtgtgtggcagcatatcgattgcatgggcatcgatcgccagcacattcctgatacgtatttatgcgaaaggtgtcagccacgaaatttagataaagagcgcgccgtgcttctgcagagacgcaagcgggagaacatgtcagacggcgacacctcagctacagagagcggggacgaggtccctgtggagctatacacggcctttcaacacacacctaccagtatcactctgacagccagtagggttagcaaagtgaatgacaaaaggagaaaaaaatctggcgaaaaagagcagcacatctcgaagtgcaaaaaagcttttcgcgagggttcaaggaaatctagtcgggtgaagggatcagcacccgaaatcgatccatcttctgacgggagcaacttcgggtgggagactaagatcaaggcctggatggatcgatatgaagaagccaacaacaatcagtatagcgagggtgtccagcgggaggcccaacgaatcgcactgcgcctgggcaatggtaatgataaaaaggagatgaacaagtcagacctcaacaccaacaatctgctttttaagccgcctgttgagtcacatatccagaagaataagaaaattctgaagtccgctaaagacctcccacctgacgccctgatcatagagtacaggggcaagttcatgctgcgtgagcagtttgaagccaacggatatttcttcaagagaccatatccctttgtgctcttttattccaagttccatggactggaaatgtgtgtggatgctcgcacatttgggaatgaagcaagattcatccgaagatcttgtacacctaacgcggaggtgaggcatgaaatacaggacgggaccattcatctgtatatctattctatacatagcataccgaaagggactgagatcaccatcgccttcgattttgactacggaaactgcaagtacaaagtagattgcgcttgcctaaaggaaaatccagagtgtccagtgttgaagcgctcatccgagagtatggaaaacattaattctggatatgagactagacggaagaaggggaaaaagaccaagatatttcagaagaagaaaattcacaagattaggatcttgctgtggattgtcaaagagcgaccgaccaagtag

SEQ ID NO: 196066 - DNA, 969 bp, Artificial Sequence
  Description of Artificial Sequence: Synthetic coding sequence
atgcccgtgaccgtgacccggaccaccatcaccaccaccaccacctcctcgagcggactggggagcccaatgattgtcggcagcccaagggccctgacacaaccattgggcttgttgcgcttgctgcagcttgtctccacttgcgtagcctttagtctggtagcatccgtgggtgcttggactggctctatgggtaactggtccatgtttacctggtgcttttgtttttctgtcaccttgatcattttaatagttgaattgtgcgggctccaagccaggtttccactaagctggcgaaattttcccatcactttcgcctgttacgccgcgctgttttgcctctccgcgtccattatctatccgaccacttatgttcagtttctgtcacacggcagatcccgggatcatgccatcgctgctacttttttctcttgtatcgcttgtgtggcttacgctacagaggtagcgtggaccagggcgcgtccgggcgaaattacaggctacatggcaacggttcccgggctcctgaaggtgctggagacctttgtagcatgcatcatttttgcgttcatatccgacccaaacctgtatcagcaccagcctgctctcgaatggtgcgttgcagtctacgctatttgttttatactggcagcaatcgccatcctgttaaacctgggcgagtgcacaaatgtcttgcctattccttttccaagctttctctccggactcgcccttctgtctgtcctgctgtacgccaccgctctggtgctgtggcccctctatcagttcgatgaaaagtacgggggacagcccaggagaagtcgcgatgtgtcctgctcccgcagccacgcgtactacgtctgtgcctgggatcgaaggctggctgtcgccattctcactgccatcaacctgctcgcctatgtggcagaccttgtccacagtgcacacttggtctttgtcaaagtctag

SEQ ID NO: 196067 - DNA, 969 bp, Artificial Sequence
  Description of Artificial Sequence: Synthetic coding sequence
atgcccgtgaccgtgacccggaccaccatcaccaccaccaccaccagcagtagcggcttaggtagtcccatgatcgtgggatcacctagggcattgacccagccacttgggttgttaaggctattgcaattagtctctacatgcgtagccttcagcctggttgcatccgtgggggcgtggacagggagcatgggaaattggagcatgtttacttggtgtttctgcttctctgtcacgcttatcattttaatcgtggagttgtgcggcttgcaggctagattccctctatcgtggcgaaactttccgatcactttcgcctgctatgccgccttattttgtctttccgcgagtattatttaccctacaacatacgtgcagttcctctcacatggacgcagtcgcgaccacgccatcgcagcaacattctttagctgtatagcatgtgttgcctacgcaactgaggtcgcctggacaagggcaaggcctggggaaattaccggctacatggccacggtgccgggtctcctcaaagtccttgagacctttgtcgcttgcattatttttgcatttatctctgatcctaatctgtatcaacaccaaccggccctcgaatggtgcgtggctgtttacgccatctgcttcattcttgcagccatcgctatacttctgaatctcggcgaatgcaccaacgtgttaccgatcccctttccttcattcttgtccggactagcgctcttgtccgtactcctctatgccactgctttggttctatggccgctgtaccagtttgatgaaaaatatggggggcaaccacggcgctcccgagacgtcagctgttctcgatcccatgcctattacgtgtgtgcatgggaccggaggctggccgtcgccattttgacagcaattaacctattggcttatgttgccgaccttgttcactctgctcatctggtgtttgttaaggtctag

SEQ ID NO: 196068 - DNA, 969 bp, Artificial Sequence
  Description of Artificial Sequence: Synthetic coding sequence
atgcccgtgaccgtgacccggaccaccatcaccaccaccaccacctcttctagcgggctgggatctcccatgattgtgggaagcccccgggcacttacacaacccctggggctgctccggctcctgcaattggtgtctacctgtgtggccttctcactagtagccagcgtgggcgcctggactgggtccatgggaaactggagcatgttcacatggtgtttttgtttttctgtgactctcatcattctgatcgtcgagctgtgtggtctgcaagctagatttcccttgagctggagaaactttcctatcacctttgcttgttacgccgccttgttctgtcttagcgcttctatcatatatccaaccacctacgtgcagttcctctcgcacggccgctctcgtgatcacgctattgccgccacctttttttcctgcattgcgtgtgttgcctacgctactgaggtggcatggacccgcgccaggcccggcgagataacggggtatatggctactgtcccgggtctgctgaaagtgctggaaactttcgtggcctgcatcattttcgcgttcatttcagatcccaacctgtaccagcatcagcctgccctcgaatggtgcgtagcggtctacgctatctgtttcatcctggctgccattgctatcctgctaaacctgggggagtgtacaaatgtgttgcctataccatttccatcttttctgtctggtctggcgctgcttagtgtgctgctgtacgcgaccgcccttgtactgtggccactgtaccagttcgatgagaaatacggaggccagcctaggcgatcgcgggacgtctcatgttcacgcagtcatgcctactacgtgtgtgcgtgggaccggagacttgctgtggccatcctcactgctattaatctcctcgcctacgtcgctgaccttgtgcatagtgcacacctggtcttcgtcaaggtgtag

SEQ ID NO: 196069 - DNA, 969 bp, Artificial Sequence
  Description of Artificial Sequence: Synthetic coding sequence
atgcccgtgaccgtgacccggaccaccatcaccaccaccaccacctcctccagcgggctcggatcccccatgatagtgggaagcccgcgcgcactcacccagccacttgggttactgcgcctgctgcagctggtgtccacatgcgtggcattctccttggttgccagcgtaggcgcctggacagggtctatgggaaactggtccatgttcacgtggtgtttttgcttcagcgttacattgattatcctgatcgtcgaactgtgcggacttcaggcaagattcccactctcttggcgcaattttcccatcaccttcgcatgctatgcggcgctcttttgcctgtcggcatcaattatttaccctactacctacgtgcaattcttaagccacggtagatctagggatcacgccattgctgctacattcttcagttgcatcgcatgtgttgcctatgccaccgaagtcgcctggacgcgtgcaagaccaggcgagatcactgggtacatggccacggttccaggtcttctcaaggtgctggagactttcgtggcctgcatcatctttgcgttcatctccgaccccaacctttaccagcatcagccagctctggaatggtgtgtggctgtgtatgcaatatgctttatcctggcagcaatcgcgattctgctcaacctcggagagtgtaccaacgttttgccaattccatttccatcgttcttgtcagggctcgctctcctgtctgtccttctgtacgcgacggctctggtcctctggcctctgtaccagttcgatgaaaaatacggaggacagccccgcagatccagagatgtttcctgtagccggagtcacgcttactatgtctgtgcctgggatcgcaggttagctgtagctattctcactgcaatcaatttgctggcttatgttgccgatttggtgcattcagcccacttggtcttcgtgaaggtgtag

SEQ ID NO: 196070 - DNA, 969 bp, Artificial Sequence
  Description of Artificial Sequence: Synthetic coding sequence
atgcccgtgaccgtgacccggaccaccatcaccaccaccaccacctcatctagtggcctaggcagcccaatgatcgtgggtagtccaagagctttgacccagcctttgggactactccgtctgctgcagctggtgagcacatgcgtcgcgtttagtctggtcgcttcagtgggagcttggacaggatccatgggtaattggtctatgtttacttggtgtttttgtttttccgtgaccctgatcattctgattgtggagctctgtggcctacaggctcgattcccgctgtcgtggagaaacttccctattacttttgcctgctatgccgctctgttttgtctcagcgcctcaatcatttatccaacaacgtatgtgcagtttctgagccacgggaggtcgagagaccatgccattgcagcaacctttttcagctgtatcgcgtgcgtggcatatgccacagaagtggcgtggacccgtgccagaccaggggaaattactggatacatggcgaccgttccaggtctcttgaaagtccttgagacatttgttgcgtgcattatctttgctttcatctctgatcccaatttatatcaacaccagccagcgctcgaatggtgcgtggcagtgtacgcaatctgcttcatcctcgctgcaattgcaattctcttgaaccttggggaatgtactaacgttctccctatccccttcccttccttcttatcgggacttgccctcctctctgtgctgctgtacgctacagcccttgtgctttggcctctataccaatttgacgaaaaatatgggggtcagccccggcgatcccgggatgttagttgttcccgcagccacgcgtactacgtatgcgcctgggaccgcaggcttgccgtggctatactgaccgccatcaatttgctggcctatgtggccgacttggtgcacagcgctcatcttgtattcgtgaaggtgtag

SEQ ID NO: 196071 - DNA, 444 bp, Artificial Sequence
  Description of Artificial Sequence: Synthetic coding sequence
atgcccgtgaccgtgacccggaccaccatcaccaccaccaccacctccagctcaggcttgggatcccccatgatcgtcggttcccctcgagccctcacgcagcccctgggcttgctgcggcttctccagctggtgtcaacatgtgtggccttctcgctcgtggccagcgtgggagcttggactggatctatgggcaactggtccatgttcacctggtgcttctgcttctctgtcactctaatcatcctgatcgtggagctgtgcggcctacaggctcgattccctctttcatggagaaatttcccaataacattcgcatgctacgcagcactattttgtctaagtgcttcaattatttaccccacaacatatgtccaatttctgagtcacgggagatcacgggatcatgccatcgccgccacattcttttcttgcatcgcatag

SEQ ID NO: 196072 - DNA, 858 bp, Artificial Sequence
  Description of Artificial Sequence: Synthetic coding sequence
atgcccgtgaccgtgacccggaccaccatcaccaccaccaccaccagctcctcagggctaggtagccccatgatcgtggggagcccacgggccctgacacaacctcttggcctgttacgtctgctccagctggtgtccacttgtgttgccttttcgctcgtcgcttcagtgggcgcctggactggctccatggggaactggagcatgttcacatggtgtttttgcttttccgttacgctgataatcttgatcgtggaactatgtggcctgcaagctagatttcccctgtcttggcgtaactttccaatcacattcttctcttgtatcgcctgcgtagcctatgcaactgaagtggcctggacaagggctaggccaggagaaattaccggatacatggccaccgtccccggccttctcaaggtgttggagacctttgtggcatgtatcatctttgcattcattagcgatccaaacctgtaccagcaccaacctgccctggaatggtgcgtagccgtttacgctatctgtttcattctggccgccattgccatcttgctaaatctcggagaatgcacgaacgtgctgcctatcccattcccgtccttcctgtcaggattggccctgttgagcgtgctgttatatgctacagcactcgtgctgtggcctctctaccagttcgatgagaaatatggcggacaaccccgcaggtcacgggacgttagctgctcacggtcccacgcctactacgtctgtgcatgggaccgtagattggccgtggcaatccttaccgccatcaacctactggcttatgtagccgatctcgttcactcagcgcacctggtattcgtcaaggtctag

SEQ ID NO: 196073 - DNA, 729 bp, Artificial Sequence
  Description of Artificial Sequence: Synthetic coding sequence
atgcccgtgaccgtgacccggaccaccatcaccaccaccaccaccagctctagcgggctgggaagcccaatgatcgtagggagcccacgcgctttgacccagcccttggggcttttacgcctgttgcaactggtttctacctgtgtggccttttctctagtagcttctgttggggcttggaccggctctatgggcaactggtccatgtttacctggtgtttctgttttagcgtgacattgataattctgatagtagagctgtgcggtttgcaagcgcgatttccgctgagttggagaaactttcctataaccttcgcctgctatgctgctctcttctgcctgtccgcttcaatcatttatcccacaacgtatgtccagtttctgagccatggacgctcaagggatcacgccatcgccgcaactttcttttcatgtatcgcatgtgtcgcttatgctaccgaggtggcatggaccagggctcgaccgggggagataaccggctacatggcaacagttcctggcctcttgaaggtgcttgagacctttgtagcctgtatcatattcgccttcatctccgatccaaatctttatcagcaccagcctgctctcgagtggtgtgtggcagtgtacgctatttgcttcatcttggctgcaattgccattttgctgaacctcggcgaatgcaccaacgttctgccaattcctttcccatcctttctgtccggctag

SEQ ID NO: 196074 - DNA, 780 bp, Artificial Sequence
  Description of Artificial Sequence: Synthetic coding sequence
atgcccgtgaccgtgacccggaccaccatcaccaccaccaccacctcttcttctggccttgggtcccctatgatcgtgggtagcccgcgggcgcttacacagccattgggtcttctgcgactgctgcagctggtgtccacatgcgtggccttttcactggttgcatctgtcggtgcgtggaccggctcaatgggaaattggtctatgtttacttggtgcttctgctttagcgtcacgctgataatcctgatcgtggaactttgtggactgcaggcaaggttcccactgagctggcgcaatttcccaatcacttttgcgtgctatgcagccttattttgtctctcagcatccatcatttatcccactacctatgttcagttcctgagtcacgggcggtccagggatcatgccatcgccgccacattcttctcttgcatcgcgtgtgttgcttacgccactgaagtggcttggaccagggccagacctggagaaattactggttatatggctacggtacctggcctgttgaaagtcctagagaccttcgtcgcatgcatcattttcgccttcatttcagatcctaatctgtaccaacaccaaccagcccttgaatggtgcgtcgctgtgtatgcgatctgcttcatcttagccgccattgccatactcctgaacctgggagagtgtaccaacgtcctgcccatcccgttccccagctttcttagtggtctggcactcctttctgtactcctgtacgccaccgccttggttttgtggccctag

SEQ ID NO: 196075 - DNA, 567 bp, Artificial Sequence
  Description of Artificial Sequence: Synthetic coding sequence
atgcccgtgaccgtgacccggaccaccatcaccaccaccaccacctcttcgtctgggctcgggagcccaatgatcgtcggaagtccccgagcccttacacagccgctgggactactccgcctccttcagctcgtttcaacttgcgttgcgttctcccttgtggccagcgtcggcgcctggactggcagcatggggaattggtccatgtttacctggtgtttctgcttcagcgttacacttatcatactgattgtggagctgtgcggcctccaagctcgattccctttatcatggagaaattttccgatcacctttgcatgttacgctgcactgttttgcctcagtgcctcaatcatttatcctacaacatacgtgcagttcctgtctcacgggcggagtagggaccacgctatagccgcgacctttttctcttgcatcgcctgcgttgcctacgctaccgaggtggcttggactagggctaggcctggggagatcactgggtacatggctacggtcccaggactgctcaaggtcctggaaaccttcgttgcttgtattatcttttag

SEQ ID NO: 196076 - DNA, 942 bp, Artificial Sequence
  Description of Artificial Sequence: Synthetic coding sequence
atggccctgcggatctgcgtgacctacacccccgccctgcccatcggtctctgcacacggtgttgtctgtgtctggaacaaagtcctagctggtgtcactgtctccgcggcgtgtcgttcctcacattccacctgcatcagagcgttccattgggcgatcgtgactccctgctgatgtttacacgccaagcaggtcacttcgtggaaggttctaaggcaggcaggagccgaggccggttgtgcctttcacaggcactccgcgtcgccgtgcgtggcgcattcgtctccctctggttcgcagccggggcaggggatcgcgagcgtaataaaggggataagggagcacagaccggtgccggcctctctcaagaggctgaggatgtagacgtgtcacgtgcccgtcgggtgaccgacgctccccaagggaccctctgtggaaccggaaaccgaaactccgggtcacagagtgctcgtgtggtgggtgtggctcacttgggggaagcgtttcgcgtcggcgtggagcaggccatcagctcctgcccggaagaggtacatggtcgccatggattgtcaatggagatcatgtgggccaggatggacgtcgccctcaggagtcctggacgaggcctcctggccggcgctggagcgttgtgcatgactctggcagagagttcttgtccagattatgagcggggtcggcgggcatgtcttacgctgcatagacacccaactcctcactgctcgacatggggcctgccattacgggtcgctggatcatggctgaccgtggtcacagtggaggccctcggcgggtggaggatgggtgtgcggcgcaccggtcaagttggaccaactatgcacccaccaccagtgtccggcgcctcacccctgttacttcaccatctattgcttctcttgctgattataattctcacttgttag

SEQ ID NO: 196077 - DNA, 942 bp, Artificial Sequence
  Description of Artificial Sequence: Synthetic coding sequence
atggccctgcggatctgcgtgacctacacccccgccctgcccatcggcctatgcaccagatgctgcttatgtctggaacagtcaccctcctggtgtcactgtctgcgaggtgtgagcttccttacctttcacctgcatcagagcgtgcccctgggcgaccgtgatagcttactcatgtttacaaggcaagccggtcacttcgtggaagggagtaaggctggtagatctcgaggcaggctctgcttgtcacaggcactgcgagtggcggtccgcggagccttcgtgtcactatggtttgcagccggagctggggaccgggaacgcaataagggagacaagggcgcccaaactggcgcgggcttatcccaggaagctgaggatgtggatgtgagccgtgcgcgaagagtgactgatgcgcctcaagggacgctttgtggcactgggaaccgaaattctggatcacaaagtgctcgcgtcgtcggtgtggcacatttgggagaggcgtttagagttggcgttgaacaggcaatcagtagttgccccgaggaagtccacggccgccatggcctgtcgatggaaatcatgtgggcccgaatggacgtggcactccggagtcccggccgcgggttgctggccggagcgggcgcactttgtatgactctcgccgagtcctcctgccccgattatgagcgcggtaggcgagcctgcttgacgctgcaccggcatcccacaccccactgcagcacttggggcttaccactccgggtggctggctcttggctgacagttgtaactgtggaggcccttggaggatggcgaatgggcgtccggcggactggccaggtgggtcctaccatgcacccccctcccgtgtcaggtgccagcccactcctgctccaccatctcctcctgttactgctaatcatcattttaacatgctag

SEQ ID NO: 196078 - DNA, 279 bp, Artificial Sequence
  Description of Artificial Sequence: Synthetic coding sequence
atgcaggtgagcaccgccgccctggccgtgctgctgtgcaccatggccctctgcaatcagttcagcgctagcctcgcagctgatacgcccactgcatgctgcttctcttacacgtcacgccaaatcccacagaattttatagcagattattttgagacatccagtcagtgctctaaacccggagtcatctttctaaccaagcgctcccgtcaggtctgtgctgatccctccgaggagtgggttcagaagtatgtttcagacctggagctttccgcttag

SEQ ID NO: 196079 - DNA, 2334 bp, Artificial Sequence
  Description of Artificial Sequence: Synthetic coding sequence
atgggcgtgcccttcttcagcagcctgcggtgcatggtggacctgggaccctgctgggcagggggactgactgcagagatgaagcttctcctggccctcgcaggactgctggctatcttagccacacctcagccatctgagggcgctgcccccgccgttctgggtgaagtcgacacttctctggtactcagctcaatggaggaagctaagcagttggtggacaaagcatacaaagagagacgagaaagcatcaagcagagactgcgtagtggctctgcgagcccaatggagcttttgagctacttcaaacagccggtcgcagctactagaactgccgtaagagccgctgactatctgcacgtggccctggacctgttggagagaaagctgcggtcgttgtggaggcgtccatttaatgtgacagatgtgttgactccagcccagctgaatgtgcttagtaaaagctctggatgtgcctatcaggacgttggcgtgacttgccccgaacaggataagtaccggaccataactggcatgtgcaataatagatgcggctggctgggagtggctgcgggcactgggctcagagaagccagtagaacacctcaagcaagtaggtgtcagcgccccgtgctcccttgtcggcgctcccctacactaggagcctcaaaccgggccttcgtccggtggctccctgccgagtatgaggacggctttagccttccctacgggtggacgccgggcgtgaaacgcaatggcttcccggtggcactagcacgtgccgtgagcaacgagattgtgcgctttcccaccgatcagctcactccggatcaagaacggagcctgatgttcatgcagtggggccagctgctggaccacgacctggactttacgcctgagccagccgcaagggcctcatttgtcacaggggtgaattgcgaaaccagctgtgtgcagcaaccaccctgttttcccttaaagattccacctaacgatccccggatcaaaaatcaagctgattgcatacctttttttcggtcatgtccagcctgccccggaagcaatattacgatccgaaatcagattaatgcgctgaccagttttgtggacgctagcatggtatacgggagcgaagaaccattggcaaggaatctgaggaatatgtctaaccagttagggctgttggcagttaaccagaggtttcaggacaacggacgagcccttctgccttttgacaacctccacgacgacccttgtctcctgaccaataggtctgctcggattccttgtttcttggcaggcgacaccagaagctctgagatgcctgaattgacatcaatgcatacacttctgctaagggaacataatagattagcaacagaactaaagagcttaaatcccagatgggatggtgagagactgtaccaagaggcgaggaagatcgtgggtgcgatggtccagattatcacctatagagattacctccccctggtcttaggtccaaccgcgatgcggaagtaccttccaacatataggagttataatgactccgtcgatccccggatcgcaaatgtgttcaccaatgcttttaggtatggacacacgctcattcagccgttcatgttcaggctagataatcgctatcagccaatggaaccaaacccgagagtcccgttatcaagagtgtttttcgcgtcctggcgcgtggttctggaggggggcattgaccccatcttgcgcgggctcatggccacacctgccaaactgaatcgccagaaccagattgccgtcgatgaaatccgtgagcggcttttcgagcaagtcatgaggattggtctcgacctgccagccctcaacatgcaaaggtctcgggaccacggacttccagggtataacgcctggagaagattttgtggtctcccccaaccagagacggtcgggcaattgggaaccgttctcagaaatctaaagctggctcgaaagctcatggagcagtacggaacccctaacaacatcgacatctggatgggtggagtcagcgaaccgctcaagagaaagggccgggtgggcccactgttagcttgcatcattggaacgcagttccgaaagctgagggacggcgaccggttctggtgggagaacgagggcgtttttagcatgcagcagaggcaggcccttgcccaaatctccctgcctaggataatctgcgacaacacaggaattaccaccgtgtcgaaaaataatatattcatgagcaactcctatccacgagatttcgtgaactgtagcacattgcccgcacttaatcttgcatcgtggagagaagcctcctag

SEQ ID NO: 196080 - DNA, 1542 bp, Artificial Sequence
  Description of Artificial Sequence: Synthetic coding sequence
atgcccagctgggccctgttcatggtgaccagctgcctgctgctggcccctcaaaacttggctcaggtgtccagtcaagatgtatcccttttagcctccgatagcgaaccgttgaaatgcttctccagaacatttgaagacctgacttgtttctgggacgaggaagaggctgctccttcaggcacctatcagctgttatatgcatatcctcgcgagaaacctagagcttgtcctctgtcttctcagtccatgccccactttggcacccgttatgtttgtcagttccccgatcaggaggaagtacggctcttcttccccctgcacctttgggttaaaaacgtttttctgaaccagacacggactcagagagttctttttgtggattctgtgggcttgcccgcccctcccagtatcataaaagccatgggcggcagtcagcccggcgaactccaaatatcttgggaggaacccgcaccagagataagcgatttcctgcgctacgagctgagatacgggccgcgagatccaaaaaacagcactggacctacggtaattcagctgattgccaccgagacttgttgtccagcactgcagaggcctcattccgcctcagcattggatcaatctccctgtgctcagcccacaatgccctggcaggacggaccaaaacagacctcaccctctcgtgaggcaagcgcattgactgccgaaggtgggtcatgtttaattagcggccttcagcccggcaactcatactggctccaactaaggagtgaacccgacgggattagtttaggcggttcctggggttcttggtctctgccggtcaccgtagatctccctggtgacgcggttgccctggggctgcagtgcttcaccctggacctgaaaaacgttacatgccagtggcaacagcaagatcacgcttcctcccagggctttttttatcacagtagggcacgatgctgcccccgtgatcggtacccaatctgggagaactgtgaagaggaagaaaagactaatccagggctacagactccacagttctcacggtgccacttcaaatcccgcaatgattctatcattcacatcctggtcgaagtgactactgcacctggcacagtgcactcctatcttgggtcccccttctggattcaccaagccgtgcgcctgcctacccctaacttgcattggcgggagatctcgtccgggcatctggaactggaatggcagcaccctagttcatgggccgcacaggagacctgttatcaactgaggtatactggggaagggcatcaagattggaaggttttagaacccccacttggggcaaggggtggcaccctggagttgaggcctagatctcgataccgattgcagttacgggcccgtctgaatggacctacataccagggaccctggtcttcgtggagtgacccaactcgggtggaaacagctaccgaaacagcttggatttctctggtgaccgctctgcacctggttttaggcctgtctgctgtgctgggccttctgctactgtag

SEQ ID NO: 196081 - DNA, 1908 bp, Artificial Sequence
  Description of Artificial Sequence: Synthetic coding sequence
atgcccagctgggccctgttcatggtgaccagctgcctgctgctggcaccccagaatctcgcccaggtcagttcccaggatgtaagtctgcttgccagcgatagtgaacctttgaagtgcttcagcaggacatttgaagatttgacatgcttttgggatgaggaagaagccgcgcctagcggaacgtaccagctgctgtatgcttaccccagggagaagccgagagcctgtcctctgtctagtcagtctatgccgcactttggtacgcggtatgtgtgccagtttcccgaccaggaagaggtgcggctgttttttcctctgcacctatgggtgaagaacgtcttcctgaaccagactagaactcagagggtgctttttgtggactcagtcggactgccagcacccccgtccataattaaagcaatgggaggctctcaacccggcgagctgcagattagttgggaggagccagctcccgagatcagcgacttcctgcgttacgaactgcgatacggccccagggatcctaaaaattcaactggcccaacagtgattcaactcatcgccactgagacatgttgccctgctttacagcgccctcactctgcctccgcgctcgaccagagcccttgtgcacagccaacgatgccttggcaagacggccccaaacagacctccccgtcacgggaggctagcgcgctcactgccgaaggtggtagctgcctcatctcaggtctgcagcccggcaattcttattggctccagctaaggtccgagcctgatggcataagtctcggcgggtcttggggttcatggtccctccccgttacagtcgatctgccaggagatgcggtggccctcggccttcaatgcttcacactggacctgaaaaatgtcacttgccagtggcagcagcaggaccatgcaagttcacaaggtttcttctaccactctagagcccgatgctgccctcgcgatcggtatcctatctgggagaattgcgaagaagaggaaaagaccaaccctggtcttcagaccccacagttttcccgttgtcacttcaagtcaaggaacgatagtattattcacatccttgtggaggtgactaccgcgcccggcaccgtccattcttacctcggcagcccgttctggatacatcaggccgtgaggttgcccacaccaaacctccattggagggaaatctcgagtggacaccttgaactagagtggcaacacccttcctcatgggccgctcaagaaacctgctaccagctgcgctataccggcgagggacatcaggactggaaagtgcttgagccccccctgggcgctagaggaggcacccttgaactacgaccgcggagccgttaccgtttgcagctgcgtgcccggctgaatggacccacataccaggggccctggtcttcgtggtctgatcctactagggttgagaccgccacagagaccgcttggatatcgctggtaacagcgctgcacctagttctgggactctcagccgtgctcggactgttattgctccggtggcaattccctgcacattaccgaagattacgacacgcactgtggccatccctgcccgacctccaccgtgtgctaggacaatacctgcgcgatacagctgccctgtcgccacccaaggctactgtgtctgacacctgcgaggaggttgagccctctttacttgagatcttgcctaagtcctcggagagaacacccctaccattatgcagctcgcaagcccagatggattaccgtaggcttcagccttcatgcctgggaaccatgcctctgagcgtgtgtccacctatggctgaatctggatcctgttgcactacccatatcgccaaccacagctacctgccactctcctactggcagcaaccttag

SEQ ID NO: 196082 - DNA, 1650 bp, Artificial Sequence
  Description of Artificial Sequence: Synthetic coding sequence
atgcccagctgggccctgttcatggtgaccagctgcctgctgctggctccccagaacctcgcccaagtgagtagccaggatgtgagccttctggcctccgacagtgagcctctgaaatgtttcagccggacattcgaggacctaacctgcttctgggacgaggaggaggcggccccaagcggaacttatcagctgttatatgcttacccacgagaaaaaccaagggcttgtcccctgtccagccagtcaatgccccatttcggaacccgttacgtgtgtcagtttcccgaccaggaagaggtccggttgttcttccccctccatttatgggtgaaaaatgtatttctgaatcagaccagaacacagagagtacttttcgtcgacagcgtaggcttacctgccccaccctcaattattaaagctatgggcggaagccagcctggggagttacagattagttgggaagagccagctccagagatctctgattttctgcgctatgaacttcgttacggacccagagatcctaagaactccacagggccgacagtgatccagctgattgctacagaaacatgctgcccggcgctccagaggccccatagcgcctccgccctagaccaaagcccctgcgctcagccaactatgccctggcaagacggacccaagcagacctcacctagccgggaggcttccgcactaacagctgagggcggctcctgtttaatctctggtctgcagccaggcaacagttactggctgcagttaagatccgaaccagacggcatctcactcggtgggagctgggggtcctggagcctacccgtcacagtggaccttcccggcgatgctgttgccctgggtcttcagtgctttaccctagatctgaagaatgtgacgtgccaatggcagcaacaggaccacgccagctcccagggttttttctaccacagccgggctagatgttgcccaagagatcgctatcccatctgggagaactgtgaagaagaagaaaaaacaaatcccgggttgcaaacccctcagttttctagatgtcactttaagagcagaaacgactccatcattcatatccttgtggaagtgaccactgcacccggtactgtgcacagctaccttggatccccgttctggattcaccaggccgtgaggttgccgacccccaatcttcactggcgggagattagttcaggccacctggaattggaatggcagcacccttcctcctgggcagcccaagaaacctgttaccagctgaggtatacaggggaaggccaccaggactggaaagtcctagagccccccttgggggcacgggggggaacattagaacttaggcctagatcaagataccggctccaactgagagctcgattgaatggtcctacctaccaaggcccctggtcaagctggtctgatccaactcgggttgaaacagctactgagacagcctggatctcactcgtgactgccctgcatctggtgctgggcctcagcgccgtgctggggctattgctcctccggtggcagttccccgctcattaccggtacaggcccaggcaggccggagattggagatggacaaggtggtcacgacgaccagtgaaccgccatagttggtttgcactttag

SEQ ID NO: 196083 - DNA, 2817 bp, Artificial Sequence
  Description of Artificial Sequence: Synthetic coding sequence
atgaccctgctgggcagcgagcacagcctgctgatccggagcaagttcagatccgtcctgcaactgcgcctgcaacaacgcaggacccaggagcagctggctaaccaggggattatcccaccacttaaaaggccagctgagtttcacgagcagcgtaagcatctggactctgataaggcaaaaaacagcctgaaacggaaagctcgcaacaggtgcaacagtgccgacctggttaacatgcacatcctccaagcatcgactgccgaaaggtccatacccactgcccagatgaagctgaaaagagcccgactagccgacgatctgaatgagaaaatagctctcaggcctggacccttagagctggtcgaaaagaacatcctgccagtggacagtgcagtaaaagaagcaatcaagggtaatcaggttagcttcagcaagtccacggatgcttttgcatttgaagaggatagctcctctgacggtctctctccagatcagactagatccgaggatccccagaactcagcaggctcacctcctgacgcaaaggcctctgatacgccctccacaggcagccttggaaccaaccaggaccttgcatccggcagcgaaaacgaccggaatgatagcgcctctcagccatcccaccagagcgatgcagggaaacaaggactcggccccccaagcacccccatagcagttcacgccgccgtgaagtccaagtccctgggtgacagcaagaacagacacaaaaaaccaaaggaccccaaaccaaaggtgaaaaaattgaagtaccaccagtatatccctccagaccagaaggcggaaaagtccccacctcccatggattcagcatatgcccgtctgctccagcaacagcagctgttcttgcaattgcaaatccttagccagcaacaacagcagcagcagcacaggtttagttatctaggtatgcaccaagcccaactcaaggagcccaatgaacaaatggtaagaaaccctaacagctctagcactcctctatctaacacaccactgtcgccagttaaaaacagcttttctggacaaactggtgtgagctcttttaagcccggacctctccccccaaatctggacgacctcaaggtgagtgagctacggcagcaactccggattagaggtctacctgtatctggcacaaaaaccgccctgatggaccggcttcggcccttccaggactgtagtggcaaccctgtgcccaactttggggacattacgactgtcactttcccagtgacccctaacaccctgccgaactaccaatcttccagcagtacctccgccctcagtaacggattttaccactttggcagtacctcaagcagcccccctattagccccgccagttctgatctgtcagtggcaggcagcctccctgacacatttaatgacgccagcccgtccttcgggttacatccaagtccagtgcatgtctgcacagaagagtcactgatgtcctctctcaacggtgggtccgtgccatcagagctggatggtcttgattcggagaaggataaaatgctggtcgagaaacagaaggtgatcaacgagctcacctggaagttgcaacaggagcagaggcaggttgaggaactgaggatgcagctccagaaacagaagaggaacaattgtagcgagaaaaaacctctgcccttcttggcagcctctatcaaacaagaggaggctgtgagcagctgtcctttcgctagccaagtgcctgtgaagagacagtcatcaagcagcgagtgtcatccgcccgcatgcgaggctgcccagttacagccattggggaacgcacactgcgtcgaaagctcggatcaaacaaacgtcttaagtagcacttttttatcaccacagtgctcgcctcagcattctccacttggcgctgtcaaaagcccgcaacacattagcttgcccccctcaccaaacaacccacacttcttaccctcatcctcgggtgctcagggcgaaggccaccgagtatctagtccgataagcagtcaggtttgcaccgcccagatggctggcctccactcaagtgacaaggtgggtcccaagttcagcattcctagtcctacattctcaaaaagctccagtgctattagcgaggttacccaaccaccctcctacgaagatgctgtgaaacagcaaatgacccgaagccaacagatggatgagctgttagatgttctcatcgagtccggcgaaatgcctgccgacgctagggaggaccactcttgcttgcagaaagttccgaagatccctagatccagtagaagccctaccgccgttctaaccaagccgtcagccagttttgaacaggcttcctccggttcacaaatccctttcgacccttacgccacagacagcgacgagcacttagaagttctcctcaattcccaaagtcctcttggaaagatgtcggatgtgaccctgctgaagattggttccgaggaaccccactttgatgggatcatggatggtttcagcgggaaggccgcagaagatctgttcaatgcccatgaaattctgcctggacctctgtccccaatgcagactcaatttagtcccagttcagtagatagcaacggcctgcaactatcatttacagaatctccttgggagactatggagtggttggacttgacgccacctaattcaaccccgggcttttcagctctcaccaccagcagtccctccattttcaacatcgactttctggacgtgaccgatctgaacttgaacagtagcatggatctccatttgcagcagtggtag

SEQ ID NO: 196084 - DNA, 1989 bp, Artificial Sequence
  Description of Artificial Sequence: Synthetic coding sequence
atggacagcgcctacgcccggctgctgcagcagcagcagctgttcctacaacttcagattctgagtcaacaacagcagcagcagcagcatcgattcagctacctgggaatgcaccaggcacagctgaaggagcctaatgaacagatggtaaggaacccaaactcctcctccactccactttccaacacaccgctctcaccagtgaagaatagtttcagcggacagacaggagtgagctcattcaaacctggacctctgcccccgaacttggatgacctaaaggtaagtgagttacggcagcagcttcggatcagagggttgcccgttagtggcaccaaaacagccctgatggatcgcttgaggccctttcaggactgcagtgggaatcctgtcccaaatttcggtgatataaccacagttacttttcccgttacaccgaacaccctgcctaactaccagtcgtcctcttctaccagtgcactgagtaatgggttttatcacttcggaagtacatctagtagccctccgatctcgcctgcaagtagcgatctgagcgtcgcaggaagtcttcccgatacgtttaacgatgctagcccaagtttcgggctacatccgtcacctgtgcatgtgtgtaccgaagaaagtctcatgtcctctctgaatggtggatcagtccccagcgaattggacgggttggattctgaaaaggataagatgctggtggagaaacagaaggttataaacgagctcacatggaaactccaacaggaacaaaggcaggtggaagagcttagaatgcaactccaaaaacagaagagaaacaattgttccgaaaaaaagccgctacctttccttgccgctagtattaaacaggaggaagcagtgtcatcgtgtccattcgcttctcaggtgcccgtcaaacgccagtccagctcatctgaatgtcatcctccagcatgtgaggcagcgcaacttcagcccctgggcaatgcccattgcgtcgagtccagcgatcaaacaaatgttctctcaagcacatttctttcaccacagtgcagtccgcagcatagcccactgggggccgtaaagagcccgcagcacatttccttaccaccttcccccaacaatccacacttcttaccctccagctccggcgcgcaaggagaaggacaccgggtgagttctccaatcagtagccaagtatgcaccgcccaaaactccggtgcgcacgacggtcatccacccagtttctctccccactcttcatccttgcatcctccattttccggtgcgcaggcagacagtagccatggcgccggtggtaacccttgccctaaatcaccctgcgttcagcagaagcagatgacgcggagtcaacaaatggacgagctgctagatgtactgattgagagcggagagatgccggctgacgcccgtgaagaccattcttgcttgcagaaggtccctaaaattcccaggtcttccagaagtcccaccgcagtacttaccaaaccgtctgcctcattcgagcaagcctcgtcggggtctcagattcccttcgatccatatgccacagattccgacgagcacctggaggtccttttaaattcgcaatccccactgggcaaaatgtccgatgtgactctgttaaagattgggagtgaggagccgcattttgatggaataatggacggcttttcagggaaagccgccgaggacttgtttaatgcccatgagatcctgcctggccctctctccccgatgcagacacagttcagcccaagttccgtggactccaacggcttacaactgagcttcacagagtccccctgggagactatggaatggctagacctcacgccccctaactcaacccccggcttttctgccctgaccacaagctccccctctatcttcaacatcgacttcctggacgtgaccgatcttaatttaaattcttccatggatcttcacttgcagcaatggtag

SEQ ID NO: 196085 - DNA, 2055 bp, Artificial Sequence
  Description of Artificial Sequence: Synthetic coding sequence
atgaagctgaagcgggcccggctggccgacgacctgaacgagaagatagctttgcgtccgggccctttggagctagtcgagaagaacatcctgccagtggattctgctgtcaaggaggccatcaagggaaatcaagtttcatttagtaaatccacagatgcttttgctttcgaagaggacagcagttctgacggtctttcgccagatcagacccgcagcgaagatccacagaacagcgctggatcccctcccgatgcaaaagcatctgacacgccaagcacggggtctctcggcacaaaccaggatctagcatcgggatcggaaaatgatcggaacgactccgccagccagccttcccaccaaagcgatgcagggaaacaggggctgggtcctccttccactcccatcgctgtgcacgctgccgtgaagtctaaaagcctcggggactctaaaaaccggcataagaagcccaaggatcccaagcctaaagtgaaaaagctcaagtatcatcaatacatcccacccgaccagaaagcagagaagtctcctccaccaatggacagcgcatatgcacggctgctgcagcagcagcagctgtttctgcagctgcagatcttaagtcagcaacagcaacagcagcagcacaggttttcttatctgggaatgcatcaggcacagctcaaggagccaaacgaacagatggtaagaaaccccaactcaagcagtactcccctcagtaataccccactcagtcccgttaaaaattcattctccggccagacaggagtgagcagttttaagcccgggccactcccgccgaatcttgacgacctgaaagtcagcgaattgagacagcaactgaggattaggggtctccctgtatcgggaacaaagactgctcttatggatcggctgaggccatttcaggattgttcgggaaaccctgtgccaaattttggagacatcacgaccgtgaccttcccagtgacacctaataccctgcctaattaccagtcgtcaagcagcacctccgcattgtccaacgggttctaccacttcggctcaacctcttcaagcccacccatctctcccgccagttccgatctgagtgtcgctggaagtttgcctgacactttcaatgacgcttctccatcttttggtctgcacccaagcccagttcatgtctgcacagaggagtccttgatgagtagcctgaatggggggtcggtacctagtgagcttgacgggttagattctgagaaagacaaaatgctcgtggagaagcagaaggtcattaacgagctcacctggaagctccaacaggaacagagacaagtggaagaactccgaatgcagctgcagaaacagaagcgaaataattgctctgaaaaaaaaccgctgccattcctggcagcctcgatcaaacaggaagaggccgtgtctagttgcccatttgcctctcaggtgccagtgaagcggcagtcatcgtcaagtgagtgccacccacccgcatgtgaagcggcccagcttcagccattgggaaatgctcattgtgtagaatccagtgaccaaaccaatgttttgagtagtaccttcctgtctccccagtgctcaccacagcattcccccctaggagccgtcaaatcccctcagcatatctcactgccaccatcccccaataaccctcatttcttaccctctagctccggcgcccaaggtgaaggtcatcgtgtgtcaagtcccatcagttcccaggtctgcaccgcccaaaacagcggtgctcatgatggacaccccccatccttctccccacatagctcttctctgcacccccctttctctggggctcaagccgactcctcacacggcgctggcgggaacccctgccctaaaagcccttgcgtacagcaaaaaatggctgggctgcattcttcagataaggtgggtcccaagttctctatcccgagccccactttctctaaatcctctagcgccataagtgaggtgacacagcccccttcttatgaagacgcagtgaagcaggtcaccatgtag

SEQ ID NO: 196086 - DNA, 2961 bp, Artificial Sequence
  Description of Artificial Sequence: Synthetic coding sequence
atgaccctgctgggcagcgagcacagcctgctgatccggagcaagtttcgatccgtgttacagttgaggctgcagcaacgccgaacacaggaacagttagcaaaccagggaataatcccgcccttgaagcgacctgccgagtttcacgaacagaggaaacatctggactctgataaggcaaagaactctctgaaacgaaaggctaggaaccgctgtaacagcgccgatctggtgaacatgcatatcttgcaagcctctaccgctgagagatctatccctactgcccagatgaagttgaagcgggcacgactggctgatgatttgaatgagaaaatcgcactgagaccagggccgctggagctggtggagaaaaacatcctgcccgtcgattctgccgtgaaggaagccattaaggggaaccaggttagcttcagcaagtcaactgacgcgttcgctttcgaagaagatagctcctcagacgggctaagtcccgaccagacaagatccgaagaccctcaaaactcagctggatcccctcccgacgctaaggcatccgacacaccttcaaccggcagtttaggcacaaaccaagatttggcctccgggagtgagaacgataggaacgatagtgccagccagccttcacatcagtccgacgccggaaagcagggtctgggccctcctagcaccccgatcgcggtgcatgcagccgttaaatctaagtcactcggggacagcaaaaacaggcacaaaaagccaaaggatccaaaacctaaagtcaaaaaactgaaatatcaccagtacattcctcccgatcagaaggctgaaaagagcccaccaccaatggacagcgcatacgcacgactgctccagcaacagcagttgttcctccagctccagattctgtcccaacagcagcaacagcaacagcatcggttctcctacctcggcatgcaccaagctcagcttaaggagcccaacgaacaaatggtgagaaaccccaactctagctccaccccgctctcgaacactcccttatcccccgtcaaaaattcgttcagcggtcagactggagtttcttctttcaagccagggccactgcccccaaatctggacgacctaaaagttagtgaactgcggcagcagctgagaattcggggattgcccgtctccggaacgaagactgctctcatggataggctgcggcccttccaggactgttcaggaaaccctgttcctaactttggggatatcaccacagtgacttttcctgtgacccccaacaccctccctaactaccagtcttcctcatctaccagcgcccttagcaacggcttttatcatttcgggtcgacgtcgagcagccctccaatctcccctgcctcttccgacctctccgtggccggcagtcttccagacacttttaacgacgccagcccctcctttggacttcacccctccccagtgcacgtctgcacggaagagtccctcatgtccagccttaatggtggatctgtgccatccgagcttgacggactggactcagagaaagataaaatgttagtggaaaaacagaaggtaatcaatgaactcacttggaagctgcagcaagaacagcgccaggtcgaagaactgcgtatgcaattgcaaaaacagaaacgcaataactgttccgagaagaagccactgccatttctggccgcgagcatcaagcaggaggaggcagtgagcagctgcccatttgccagccaggtgcccgtcaagagacaaagctcgagctctgaatgccacccgccagcttgtgaggccgcgcagctgcagccgttggggaacgcacattgcgtcgaatcttctgaccagacaaatgtgctttcctccacgtttctgagtcctcagtgctctccacagcatagccctcttggcgcagtgaagagtccacaacacatcagcctacccccttcccccaacaatcctcatttcctgccttccagtagcggggctcagggggaggggcaccgcgtgtcctcccctatctccagtcaggtgtgtaccgctcagaactccggcgcccacgacgggcatcccccaagcttctcccctcattcctcatccttgcatccacctttttctggcgcccaggctgatagctcacatggggccggcggtaacccgtgtcccaagtccccttgtgttcagcagaaaatggccggccttcacagttcggataaggtcggacctaaattcagcatcccctctcccacgttctctaagtcttccagtgccatttcagaggtgacgcaacccccatcatatgaagatgccgtgaaacagcagatgacgaggtcacaacagatggatgaactactggacgtgctcatcgaaagcggagagatgcccgctgatgcccgggaggaccacagctgccttcagaaagtacccaagatcccacggtcaagccggagcccgacagccgttctgaccaaacccagcgcctccttcgagcaggcttcttccgggtctcaaattccctttgatccctacgccactgactcagatgagcacttggaggttctgctcaactctcagtccccgcttgggaagatgtctgacgttacacttttaaaaatcggctcagaggagccgcatttcgatggtatcatggatggcttttcaggcaaggccgccgaagacttgttcaacgctcacgaaatcttacctggtcccctatcgcccatgcagacccagtttagccctagtagtgtggatagtaacggactccagctgtctttcacagagagcccctgggaaaccatggaatggctggatctcacaccacctaactcaactcccgggttttcagcattgacgacttcttcaccatctattttcaatatagacttcctagatgtgacggacctcaatctaaactccagtatggacctccacctgcagcagtggtag

SEQ ID NO: 196087 - DNA, 1947 bp, Artificial Sequence
  Description of Artificial Sequence: Synthetic coding sequence
ttcctgcagctgcagatcctgagccagcagcagcagcagcagcagcaccgcttttcgtacctgggcatgcatcaggctcagctcaaagaaccgaatgaacagatggttcggaaccctaacagcagcagtacacccctgtcaaatacccctctaagtccagtcaaaaacagcttctccggacagaccggcgtgtcatcttttaagcctgggcctcttccgcctaatctggatgatttgaaggtttccgagctacgccaacagttacgtatccgtggcttgcccgtgagtggtaccaaaacggcattgatggataggttacgccccttccaggattgctccggtaatccagtgcctaattttggggacattactactgtgacctttcctgtcacccctaacaccctgccaaactatcagtcatcttcctccactagtgccctttctaatggattctaccatttcggctccacctcctctagccctcccataagcccagcttcctccgatttatccgtcgcagggagcttacctgacacattcaacgatgcgagcccctccttcgggctgcaccctagccccgtgcacgtgtgcacagaggagagcctcatgtcctccttgaatgggggctccgtgcctagtgaactggacggtctcgacagcgagaaagataaaatgctcgttgaaaagcagaaagttattaatgagcttacatggaagctccagcaggaacagaggcaggtcgaagaacttagaatgcagctgcagaagcaaaagaggaacaactgttctgagaagaagcccctcccatttctggcagcatcaattaagcaagaggaagccgtgagcagctgcccttttgcaagccaggtcccggtcaagcgtcagagctcatcctccgaatgccatcctccagcttgtgaggcagcacagctgcagcccctgggtaacgctcattgcgtggagtctagtgaccaaaccaacgtcctgagctccacctttctgagcccacagtgttcgccacaacactcacctctgggggctgtcaagtcgcctcagcacatctccctgcctccaagccctaacaatccacatttcctgcccagctcttcaggcgcccagggcgaagggcaccgggtttcctccccgatcagttcccaggtgtgcaccgcacagaacagcggagctcacgacggacacccacctagtttcagtcctcattcctcctcccttcatcccccctttagcggagcccaggccgacagtagccatggtgctggcggaaatccctgtcccaagagtccctgcgttcagcagaaacagatgacgcggagccaacaaatggatgagctcctagacgtgcttatagagagcggagaaatgcccgcggatgctcgagaagaccattcgtgcttacagaaagtccctaagatccctcggtcctcccgaagccctacggctgttctgacgaaaccatcagcatctttcgagcaggctagttcaggcagccagatcccgttcgatccctatgctaccgactcggatgaacacctcgaggtgctccttaatagccagagccccctgggcaagatgtcagacgtgaccctccttaaaataggctccgaagaaccgcacttcgacggcattatggacggatttagcgggaaggccgctgaggacctttttaacgcccacgaaattcttcccggccctctgtctcctatgcagacccaattctctccttccagcgtggattcaaacggactgcagctgagcttcaccgagtccccgtgggaaaccatggagtggctggacttgactccacctaattccacgcctggattctccgccctgactacctcttccccttctatcttcaacatagattttctggatgttaccgaccttaacttaaacagctcaatggacctgcatctgcagcagtggtag

SEQ ID NO: 196088 - DNA, 1515 bp, Artificial Sequence
  Description of Artificial Sequence: Synthetic coding sequence
atgcggttcttctgcgcccggtgctgcagcttcggccccgagatgcctgccgtccaattgctcctgctggcctgtctcgtgtgggacgttggcgcccgtactgcgcagctacggaaagccaatgatcagagcgggcggtgtcagtatacatttagtgtggcctcgccaaacgaaagctcatgccccgagcaatctcaggccatgtcagtgattcacaatctgcagagagattcgtccacgcaaagactggacctcgaggctaccaaggctcggctttcgagcctcgaatccttactgcatcagctcactctggatcaggccgcccgtcctcaagagacccaggaggggctccaaagagaactcggcaccctccgccgggaaagggatcagctagaaacccagactcgagagcttgaaactgcctattctaaccttctgcgcgacaagagtgtactcgaggaggagaagaaaagactgcgtcaggagaatgaaaatctcgccaggaggcttgagtcttcaagtcaggaggttgctcggcttaggcggggacagtgccctcaaacacgcgatacggcgcgggctgtaccaccaggatctcgtgaagtgtcgacctggaacctggacacgctcgcgttccaggaactgaagagcgaactgaccgaggtcccggcttcgcgaatcctcaaggagagtccatccgggtatctgcgcagcggggaaggagacacaggctgtggggaactcgtatgggtgggtgagcccctgaccctccggaccgcagaaacaatcaccggcaagtacggcgtctggatgcgcgaccccaagccaacctacccatacactcaggaaactacctggcgaatcgatacagtaggcacagatgtgagacaggtgtttgaatacgacttgatttctcagtttatgcagggctaccccagtaaagtgcatattctgccgagacctttagaaagtaccggcgccgttgtttatagtggcagcctctactttcagggcgctgagtcacggacagttattagatatgaattgaataccgaaactgttaaagccgaaaaagagattcctggagctggctatcatggccagtttccctattcatggggcggctacactgacatcgacctcgccgtggacgaagccggactctgggtcatatattccaccgatgaggctaagggcgccattgtgctttccaagttaaatcctgagaatcttgaactggaacaaacttgggagaccaacatccgcaaacagtccgtggccaacgcattcataatttgcggcacactgtacaccgtgtccagctatacctccgcagatgccactgtcaacttcgcttatgacaccggcacaggcatttctaaaacacttacaatccctttcaagaataggtataaatacagcagcatgatcgattacaaccctctggagaaaaaactgtttgcttgggataacctcaatatggtgacttacgacatcaaactgagcaagatgtag

SEQ ID NO: 196089 - DNA, 1374 bp, Artificial Sequence
  Description of Artificial Sequence: Synthetic coding sequence
atgcggttcttctgcgcccggtgctgcagcttcggccccgagatgcccgcggtccagctcctactgctggcatgtctcgtgtgggacgttggcgcgaggacagcacagctgcggaaggctaacgatcagtcaggcaggtgtcaatatactttttctgtagcatctccaaacgaaagctcgtgcccggaacaatcacaggcaatgtctgtcatacataatctccaaagagatagttcgacccaacggctggacctggaggctaccaaggcccgcctgagttctttggagtcacttttgagggataagagtgtactagaagaggaaaaaaaacggttacggcaggagaacgaaaatctggctcgaaggctggaatctagtagccaggaagtggccaggctgcgcagaggacagtgccctcagacacgggacacagcaagagcggtacctccaggcagcagggaagtaagcacctggaatctggatacacttgccttccaggagctaaaaagtgagctaacagaggtgcccgcttcacgaatcctcaaggaatcccccagtggttatcttcgcagcggggagggtgatacaggatgtggtgagctcgtgtgggttggggagcccctaacactgaggacggccgaaacaataactgggaagtatggggtgtggatgagggaccccaagccgacctatccctatacccaagagacaacctggcgtatagatacagtggggactgacgtgagacaggtatttgagtacgacctgatctctcagtttatgcaggggtatccctccaaggtccatatcctgcctaggccattagaatcaactggcgcggtggtttattctggcagcctgtactttcagggcgctgagagtagaactgttatacgctacgagctcaacactgaaactgtaaaagctgagaaggagattcccggcgccgggtaccacggccagtttccctactcatggggcggctacactgatatcgacctcgccgtggacgaggccggcctctgggtgatctactccaccgacgaagcaaaaggcgctatcgtgctgagcaagctgaatccagaaaacttagaactcgagcagacgtgggagacaaatatacgaaagcagagcgtcgccaatgcctttattatttgtggaaccctgtacaccgtgtccagctatacctctgccgacgctaccgtgaatttcgcttatgatacaggaactggcatatccaagaccctgacgatcccattcaagaataggtacaagtattccagcatgatcgactacaatccgctcgagaaaaaactgttcgcctgggacaatctcaatatggtgacctacgatatcaaactttccaaaatgtag

SEQ ID NO: 196090 - DNA, 1314 bp, Artificial Sequence
  Description of Artificial Sequence: Synthetic coding sequence
atgagcgtgatccacaacctgcagcgggacagcagcacccagcggttagacttggaagctaccaaggctagactgagcagtttagagagtctgcttcaccaactgacacttgatcaggctgcccgaccccaggaaactcaggagggcctgcagagggaattgggaacactgaggagagaacgcgatcagttagagacgcagacccgagagctggagaccgcctactctaatcttttgcgtgataaaagcgtactcgaggaagagaaaaagcgcctgagacaggagaacgagaatctagcgcggcgactcgagtcatcaagccaagaggtggctcgactcagacgcggccaatgtccacagactcgcgatacagccagagctgtgcctccgggtagtcgggaggtgtctacttggaacttggatacactggcatttcaggagctgaaaagtgaattaacggaggtaccggccagccgcattcttaaagaatccccctctggctatctccgaagcggggagggtgatacggggtgcggcgaacttgtgtgggtgggagagcccttgactctccgcaccgctgaaacaatcactggcaagtatggcgtctggatgcgcgaccctaagccaacctatccttacacccaggagactacatggcggatcgataccgttgggacagacgtaagacaagttttcgagtatgacctcattagtcagttcatgcaggggtaccccagcaaggtacacattctaccccgccctctcgagtctaccggggcagtggtgtatagcggctctctgtactttcagggcgcagagagtcgtaccgtgatccggtacgagctgaatactgagaccgtcaaggctgagaaggaaatccccggtgctgggtaccacggacagttcccatattcatggggaggctacacagatattgacctggcagtggatgaggccggcctctgggttatttacagcactgacgaggccaagggggccatcgtgctgtcaaagttgaatcccgaaaatttagaattggaacaaacctgggagacaaacatcaggaagcagagtgtggcaaacgcatttatcatctgcggcacactgtataccgtctcctcttacacatccgccgatgctacagttaactttgcatatgatacaggaacgggcatctctaagaccttaactattccatttaaaaaccgttataaatatagctcgatgatcgattacaaccctcttgagaagaagctattcgcttgggataatctgaacatggtcacttacgacatcaaactgagtaaaatgtag

SEQ ID NO: 196091 - DNA, 1035 bp, Artificial Sequence
  Description of Artificial Sequence: Synthetic coding sequence
atgcggttcttctgcgcccggtgctgcagcttcggccccgagatgcctgccgtgcagctcctgctgctcgcttgcctagtgtgggacgttggcgcccgaactgcccaattacggaaggcaaacgaccaatccggacggtgccagtacaccttcagcgtcgcttcccccaacgagtcaagctgtcctgaacagtcgcaagctatgagtgtcatccataacttgcagagggactcttcgactcagaggctggatttagaggcaactaaagcccgcttatcttccctggaaagcctcctgcatcagctaaccctggaccaggcagcccggccccaggaaacccaggagggccttcagagggaactggggaccctgcggcgtgagcgcgaccagttagaaacccagactcgagagctggagacagcctactcgaacctcctaagggacaagtctgtcctcgaagaagagaaaaaaagactgcgtcaggaaaacgagaatctcgcccggagactggagtcctcctctcaagaggtcgccaggctgagaagaggacaatgcccccagacccgggacacggctagggcagttcctccggggagccgcgaagtgagcacctggaacttggatactcttgcttttcaggaactgaagtcagagttgaccgaagtgccagcaagtcgcattttgaaggaatctcctagtgggtatctgaggtccggagaaggtgatacggggtgcggcgaacttgtgtgggtcggcgaacccctgacactgcggactgctgaaaccattactggtaagtacggcgtgtggatgagagacccaaaacccacttacccctatactcaggagacaacctggaggatcgataccgtggggacagacgttaggcaggttttcgagtacgaccttatctcacagttcatgcaggggtatcccagcaaggtgcacattctccccaggcccttggagtccaccggcgctgttgtgtatagtgggtccctttatttccgcgctcttagtccagaacttagctag

SEQ ID NO: 196092 - DNA, 1521 bp, Artificial Sequence
  Description of Artificial Sequence: Synthetic coding sequence
atgggccggaagaagatccagatcacccggatcatggacgagcggaacaggcaagtgacttttacaaagagaaaattcgggctgatgaaaaaagcctatgaactcagcgtgctctgcgattgcgagattgctctcatcatttttaacagctcaaacaagctcttccagtacgcctccacagacatggacaaggtattactgaaatacaccgaatataacgaacctcatgaatcccggaccaactccgatattgtggagacacttagaaaaaaggggttaaatggatgcgaatctcctgatgccgatgactacttcgaacacagtccattgtctgaagatagattcagcaagttgaacgaagactcggacttcatcttcaaacgtggacccccgggcctgcctcctcagaacttcagcatgagcgtcaccgtgcccgtaacttcacccaacgccctatcatacacaaatccgggttcgtcccttgtgagtccatcattagcagcgtcatccaccctcactgattcttcaatgcttagtcctccccagaccactctccatcgcaatgtttccccaggcgcccctcagcggccccctagcacgggcaacgctgggggcatgttgtcgacaaccgacctgacggtgcctaacggcgccggatccagtcccgtaggcaacggcttcgttaatagccgggcctctcctaaccttatcggcgctactggggccaactccctcggcaaagtgatgcccaccaagagcccccctccgcctggagggggaaatctcggcatgaacagccgcaagccagacctgcgggtagtaattcccccatcctccaaaggaatgatgccacccttgtatctcaaaaggcagctgaatacgaataatacccagaggatcagtagcagccaggcaacacaacctcttgctactcctgttgtctctgtgactaccccttcgttgccacctcaggggctggtctactctgcaatgcccacagcctacaatacagactactctctcacctcagcagatctgtctgcactgcaggggttcaatagccctggcatgctgtcgctaggccaagtctctgcctggcaacagcatcacttagggcaggccgccctctccagcctcgtcgcggggggacaactgtctcagggcagcaatctttctatcaatacaaatcaaaatatatccataaagagtgagcctataagcccgccaagggatcgcatgacaccctccggatttcagcagcagcagcagcagcaacagcaacaacagccaccccctcccccccagccacagccacaacctcctcagccccagccccggcaggaaatgggacgctcccctgtggacagcctctccagctcgtcctcttcctacgatggatccgacagagaggatcctagaggcgattttcacagtccaattgtcctgggccgccctcccaatactgaggaccgggaatcaccgagtgtcaagcggatgcgaatggatgcttgggtgacttag

SEQ ID NO: 196093 - DNA, 1500 bp, Artificial Sequence
  Description of Artificial Sequence: Synthetic coding sequence
atgggccggaagaagatccagatcacccggatcatggacgagcggaacaggcaggtaacttttacgaaaagaaagttcggcctgatgaagaaggcttatgaattgtccgtactgtgcgactgcgaaatagccttaatcatttttaactcttcaaacaaactgttccagtatgcgtctaccgatatggacaaggtgctgctgaagtatacagagtacaacgagccccacgagagccgcaccaattccgacatcgtggaggctttaaataaaaaagaacataggggatgcgacagtcctgaccctgacacctcttatgttctgactccccacacagaggagaaatacaaaaaaattaatgaggaattcgacaacatgatgcgcaatcacaagattgccccaggtctaccaccccagaatttcagcatgtcggtgacagtgcctgtgacgagccccaatgcattgagttacacaaaccccggctcttctctggtgagcccttctctagcagcctccagcacacttaccgacagtagcatgctgtcgcctccacagaccaccctgcaccgcaacgtctcccccggcgctcctcagcgtccaccatcaactggcaatgcgggggggatgctcagcacgaccgacctcacagtacccaatggagccggtagtagccccgtcggtaatgggttcgttaactcacgggcgagccctaacctgatcggggctactggcgctaactcactcggtaaagtgatgcctaccaagtctccaccccctcccggaggaggcaatctgggaatgaactcgagaaaacctgatctgcgggtggtgatcccacccagtagtaaggggatgatgccgcctctgaacactcaacggatctcttccagccaggctacacagcccctggccactccggttgtatctgtgacaactccctctttacccccccagggactggtctattctgcaatgcctacagcctataataccgactactctttgacaagtgctgacctgtcagctctgcaaggattcaactcccccggtatgctgtctctcgggcaggtctctgcgtggcaacaacaccatctggggcaggcggccctctccagtttagtggctggaggacaactgtcacagggctccaatttaagcatcaacacgaaccaaaacatatccataaagtctgagcccatttcaccaccaagagaccgtatgacaccttccggcttccagcagcagcagcagcaacagcagcagcagcaacctcctcctccaccacagcctcagccccagcccccacagccccagcccaggcaggaaatgggcaggagccccgtggatagcttatcctcttcttcctcatcctatgacggaagtgaccgggaagaccctcgcggtgattttcactcaccaatcgtgctgggccgaccacctaacactgaggatcgggagagcccatctgttaaacgcatgcgaatggatgcctgggtgacctag

SEQ ID NO: 196094 - DNA, 1290 bp, Artificial Sequence
  Description of Artificial Sequence: Synthetic coding sequence
atgggccggaagaagatccagatcacccggatcatggacgagcggaaccgccagacactgcggaagaaaggactgaatggatgcgaatcacctgacgcagacgattacttcgagcacagccccctttcagaggaccgtttttcaaagctgaacgaagattccgactttatctttaaaaggggccccccaggcctccccccccagaattttagtatgtctgtcacagtcccagtgacatctccaaacgctttgtcctacaccaaccccgggtcaagcctcgtcagtccatctctggcagcgagctcgactctcacagacagttctatgctgtcaccccctcagacaacacttcaccgcaacgtaagtccaggggcgccacaaaggcctcctagcacagggaatgcaggagggatgctgtctactaccgatctcacagtgccaaacggggctgggtcatcgcctgtggggaatggtttcgtgaattctcgagcctctcccaatctgataggcgctaccggagctaatagtctgggcaaggttatgcccaccaaatccccacccccgcccggcggggggaacctgggcatgaatagcaggaagcctgaccttcgggttgtaatacccccctcaagtaaagggatgatgcctccattgaatacgcagaggatctcgtcttctcaggccacgcagccccttgccacacctgtggtcagtgtgaccacaccctcgcttcctcctcaggggttggtatacagcgctatgcccactgcctacaacaccgactactccctaacctccgctgatttgtccgcgttacagggcttcaactcaccggggatgctgtctcttggacaggtttcagcgtggcagcaacatcacctcgggcaagccgccctctcttccctagttgccggaggccagctgagccagggctctaacctcagcataaacacaaatcagaatatctcaataaagtccgagcctatttcccctcctcgggatcgcatgaccccaagcggctttcaacagcaacaacagcagcaacagcagcaacagccccctccaccaccccagccacagccccagcctccccagccgcaaccgaggcaggaaatggggcgcagccctgttgatagcctgagttcgtctagctcttcatatgatggctcagatcgagaagatcctagaggcgacttccatagccccattgtgctcgggcgcccccctaatacggaagaccgggaaagcccctcggtcaaacgtatgagaatggacgcctgggttacttag

SEQ ID NO: 196095 - DNA, 1494 bp, Artificial Sequence
  Description of Artificial Sequence: Synthetic coding sequence
atgggccggaagaagatccagatcacccggatcatggacgagcggaataggcaggtgacgtttactaaacgcaaattcgggctgatgaaaaaggcctacgaactgagcgttttgtgcgattgcgagatcgctctaatcatctttaattcctctaacaagctgttccagtacgccagcacagacatggacaaagtcctgctgaagtacacagaatacaacgaaccccacgaatctcgaaccaacagcgacatcgtcgagaccctgagaaagaagggcttgaatggatgcgagtcccccgacgctgatgactatttcgaacattcgcccctgagcgaggacaggttcagcaagctcaacgaggattcagacttcatattcaaacgtggtccccctggactgccaccacagaacttttcaatgtctgtcacggttcccgtgacaagtcccaacgctttgtcctatacaaacccaggcagctctctagtgagtccttctctggcagcgtcatccaccctcacagattcatcgatgctctcacctcctcaaacaacactgcaccggaacgtttcacctggggctcctcagcgcccaccctctacgggtaatgcgggcggaatgctgagtaccacggatttaacagttccaaacggggccggaagctcacccgtgggaaacgggtttgttaattcacgggcgagccccaacctgattggggccacgggagccaactccttagggaaagtgatgcccacaaagtccccccccccacctggtgggggtaacctcggaatgaactcacgtaagcctgaccttcgggtcgtcatccctccttcctcaaaaggaatgatgccccctttgaatacccagcgcatctccagttctcaagctacccagcctctggccactcccgtagtcagcgtgaccacgccgagcttaccaccccagggactggtttattctgccatgccaaccgcatataacacagattatagtctgaccagcgctgacctctccgcattgcagggatttaactcccctggcatgttaagcctgggccaggtgtccgcctggcaacagcatcatctgggccaggctgccctctcttctctggtcgccggaggccagctgtcccaggggtcaaacctgtcaattaatactaatcagaacatcagcatcaagagtgagcctatcagtccacctcgtgatagaatgacaccttctgggttccagcagcaacagcaacaacagcaacaacagcaacccccccctccaccacagcctcagccccaaccgccgcaaccacagccacggcaagaaatgggaaggagtcccgtcgattctttgtcgagctcatcctccagctacgatggtagcgatcgcgaagaccctcgcggagactttcattctcccatcgtgctgggaagacccccgaacaccgaggaccgtgaaagcccatcagtcaaaaggatgcgaatggatgcttgggtgacctag

SEQ ID NO: 196096 - DNA, 1494 bp, Artificial Sequence
  Description of Artificial Sequence: Synthetic coding sequence
atgggccggaagaagatccagatcacccggatcatggacgagcggaatagacaggtcacgtttactaaacgcaagtttggtctgatgaagaaagcatatgaactgagcgtcttgtgcgactgcgaaattgctctcattatcttcaactcctctaacaaactgttccagtacgcgtcaacagacatggataaggtcctgttgaaatacacagaatacaatgagccacatgaaagtcggacaaatagtgacatcgtggagaccctgagaaagaaaggcctcaatggatgcgaatcacctgatgccgatgactacttcgaacactcccccttgagtgaggacagattctccaaactgaatgaagatagcgactttattttcaaacgtggaccgccagggctcccgccccagaactttagcatgtctgttactgtgcccgtgactagccccaacgccctctcgtacaccaaccctggcagctccctggtgagccccagtctggctgcttcgtcaaccctgacggattcctccatgttgtcaccaccccagactactttgcataggaatgtttcccccggtgcaccacagcgtccgcctagcaccggtaatgcagggggaatgttgagcaccaccgatcttacagtgcccaatggggccggaagtagtcctgtgggtaatggcttcgttaacagccgagcttctccgaacctgataggcgctaccggggccaacagccttggcaaggtcatgccaaccaagtccccgccacctcccggaggaggaaacctgggtatgaactctaggaagcctgatttgcgggttgttataccgccgtccagtaagggaatgatgcccccactgaatacacaacggatcagttcctcacaggcgacccagcccctggccactccggttgtgtctgttacaaccccaagccttcccccacagggactggtttattcagctatgccaactgcatacaatactgattattccttgacgagtgctgatctgtcagctttgcaaggcttcaacagtcccggcatgctttcgctgggccaagtgtcagcgtggcagcaacatcacctgggacaagctgccctctccagtttagtggcaggcggccagctgtcccaggggagtaatctctccattaacaccaatcagaacatatcaatcaaaagcgaacccatctcccctccaagagaccgtatgacaccatccggttttcaacagcagcagcaacagcaacagcaacagcagccccccccacctccacagccccagccccagccacctcaacctcagccgagacaggagatgggacggtcccccgtggactccttgtctagtagcagcagtagctacgacggatcggatcgcgaggatcctcgcggggactttcattcccccatcgtgttggggcgcccaccaaacacagaagacagagagtcccctagcgtaaagcgcatgcgcatggatgcttgggtcacttag

SEQ ID NO: 196097 - DNA, 1518 bp, Artificial Sequence
  Description of Artificial Sequence: Synthetic coding sequence
atgggccggaagaagatccagatcacccggatcatggacgagcggaacagacaggtcacttttacaaaacggaagtttggtctgatgaaaaaggcatacgaattgtccgtcctgtgtgactgcgaaattgctctgatcattttcaatagctctaacaaactgttccagtatgcatcaacagacatggataaggttctcctaaaatacaccgaatacaacgagccgcacgagagccggactaacagtgatatcgtcgaaactctgcgtaaaaagggccttaatggctgcgagtccccggacgctgacgattactttgagcattccccattatcagaggatcgattttcaaagctcaatgaggacagcgactttatcttcaagcggggccctcctgggctgccaccacaaaatttcagtatgtctgtgaccgtacctgtgacttcccctaatgccctttcctacacgaaccctggaagctcattagtttccccatctcttgccgctagtagcactttgactgattcttcgatgctaagtcctccccagactactctgcatcgcaatgtcagtccaggtgccccccaacgtccgcctagcaccggcaacgccggcggcatgctaagcaccacagaccttactgttccaaacggggccggttcctcccctgttgggaacggcttcgtgaacagccgggcttcacccaaccttataggggccaccggagctaacagcctcgggaaggtgatgccgacaaaatccccgccccctccaggaggcggcaatctgggtatgaactctcgcaagccagacctgcgggtggttattccaccatcaagtaaaggcatgatgccgcccctgtctgaagaagaggagctggaactgaatactcagcggataagtagttcacaggcaacccagccattagccacgcccgtcgtttcggttacaacccccagcttgcctccgcaaggtttggtgtactcagcaatgccaaccgcctacaacactgattacagtctcacctctgcagacctgagcgcactgcaggggttcaactcaccggggatgctgtctctcggccaagtatcagcctggcagcagcaccacctgggccaagccgctctgtccagccttgtggccggcgggcagctgtcgcagggaagtaatcttagcattaatactaatcagaatatttccatcaaatctgaaccaatttctccccccagggacagaatgaccccctcagggtttcagcaacagcagcagcagcaacagcagcagcagcctccgcctccgccccagccccagccgcagcctcctcagccccaaccacgccaggagatgggcaggagccccgtcgattctctgagctcttccagctctagttatgacggctccgaccgtgaggaccctagaggggacttccatagcccaatcgtgctgggccgacccccaaacactgaggatcgagaatctccaagcgtgaagagaatgcgcatggatgcatgggtgacttag

SEQ ID NO: 196098 - DNA, 117 bp, Artificial Sequence
  Description of Artificial Sequence: Synthetic coding sequence
atgggccggaagaagatccagatcacccggatcatggacgagcggaatcgccaggtgaccttcacaaagaggaaattcggattgatgaagaaggcttatgaactcagcgtgttgtag

SEQ ID NO: 196099 - DNA, 1314 bp, Artificial Sequence
  Description of Artificial Sequence: Synthetic coding sequence
atgggccggaagaagatccagatcacccggatcatggacgagcggaacaggcaaacgttgcgcaaaaaggggctcaacgggtgcgagtcccccgacgcagatgactatttcgagcactcacctctgtctgaagacaggttctccaaactgaacgaggactccgattttatctttaaacgtggcccaccagggctgccaccccaaaatttttcgatgtctgtgacggttccagttacttcgcccaatgcactgagctatacaaaccctggcagttctctggtgtctccatcgctggccgccagttctactctgacagactctagcatgttatcaccaccgcaaacaaccctccataggaatgtgagccccggcgcgccccagaggccaccttcaacaggtaatgctggtggtatgcttagtacgactgacctcacagtcccaaatggggccggctccagccctgttggcaacggtttcgtgaatagccgagctagccccaacctaataggggctacgggggctaactctctcggtaaggtcatgcccacaaaatcaccacccccacctggcggaggtaacctaggcatgaatagcaggaaaccagatctgagagttgttatcccacctagctctaagggtatgatgccacctctgtcagaagaagaagagcttgaattgaacacacagaggattagcagcagccaggcaacacagcccttagctacccctgtagtatccgtgactaccccatccctgccacctcagggactggtgtattctgctatgcccacagcctataataccgactatagcctgaccagtgccgacctttccgcccttcaaggattcaattctcctggtatgctcagtcttggtcaggtatccgcgtggcagcagcaccatctggggcaagctgcactctccagcttagtggcgggcggccagctctctcagggatcaaacctctccataaacaccaatcagaacatatccatcaagagcgagcccatttcccctccacgtgacaggatgacaccaagtggatttcagcagcagcagcagcagcagcagcagcagcaaccccctccccccccccagccccagccccagcccccacagccacaaccacggcaggagatggggaggtcacccgtcgacagtctgtcctccagcagctcttcctatgacggtagtgaccgtgaagaccccagaggcgacttccatagtcctattgtcttagggcgtcctcctaacactgaagaccgggaatcccctagcgtgaaaaggatgcggatggatgcatgggtgacttag

SEQ ID NO: 196100 - DNA, 234 bp, Artificial Sequence
  Description of Artificial Sequence: Synthetic coding sequence
atgggccggaagaagatccagatcacccggatcatggacgagcggaatcggcaggtaaccttcaccaagaggaagttcggtctcatgaagaaggcgtatgaattgtcggtgctatgcgattgcgagatcgcattaattattttcaatagtagcaacaagttgttccagtacgcctccacagatatggacaaggtgctgctgaagtatacagagtacaatgaaccgcatgagtag

SEQ ID NO: 196101 - DNA, 258 bp, Artificial Sequence
  Description of Artificial Sequence: Synthetic coding sequence
atgggccggaagaagatccagatcacccggatcatggacgagcggaacagacaggtcacttttaccaagcgtaagtttggtcttatgaaaaaggcgtatgagttatctgtgctctgcgattgcgaaattgcactgatcatattcaactcaagtaataaacttttccagtacgctagtacagatatggataaggtcctgctcaagtacacggaatataatgaaccccacgagtcaagaactaactcggatattgtgtag

SEQ ID NO: 196102 - DNA, 1107 bp, Artificial Sequence
  Description of Artificial Sequence: Synthetic coding sequence
atgggccggaagaagatccagatcagccggatcctggaccagcggaatcgccaggtgactttcaccaaacgcaagtttggactcatgaagaaagcatatgagctatctgtactgtgtgactgtgagatcgctcttattatatttaattccgccaatcgcctatttcaatacgcctctactgacatggacagggtcctactcaagtatactgagtacagcgagccccacgagtcgcgtaccaatacagacatcctggagacactgaagcggcggggaatcggcctggatggaccagaactggaacctgacgaggggccggaggagcccggggaaaaattcaggcggctggccggggaggggggagaccctgcactgccacgcccccgactatatccggccgccccagcaatgccaagtcctgacgtagtgtacggggcactcccacccccggggtgcgaccctagcggactcggagaagccttgcccgcccagtctcgaccctctccttttcgtcccgctgcaccgaaagctggtccacctggcctcgtgcacccactgttctcccccagtcaccttacctccaagaccccgcctcccctctacctgcccacggagggccgccgcagcgacctccctgggggacttgcgggcccacgagggggtcttaatacgtctcgcagcttgtacagtggcctccaaaacccatgttccacggcaactcctgggcctcctctcggatctttcccattcttaccaggcggccccccagagtatggcctaggcgacccaccccctcctccaggcttgctacagccaccaacactggctccctggcaacccagccgcggagatgggccgcccgcggtgagcagccaaccaagtggtggtaggtcattgggagaggagggacccccaactagaggcgcctctcccccaaccccgcctgtctcaatcaagtccgagaggctaagccccgctccggggggtcctggggattttccgaaaacattcccatacccactcctgctcgctcgaagccttgccgaacccctacgccctgggccagccctgcgccggctgcctttggcagacggctggcccaggtag

SEQ ID NO: 196103 - DNA, 894 bp, Artificial Sequence
  Description of Artificial Sequence: Synthetic coding sequence
atgggccggaagaagatccagatcagccggatcctggaccagcggaatagacaggtcaccttcacaaaacgaaaattcggtctcatgaagaaggcctacgagctgtcagtgctgtgtgattgcgaaatagctctcattatatttaattcagcaaaccggctcttccaatacgccagcacagacatggatcgtgtcctgctcaagtacacagaatatagtgagccacatgagtcccgcacaaataccgacattttagaagtcccacagaccttgaagagaagaggaatcgggttggacgggccagagctggagccagacgaaggacctgaggaacctggtgagaagtttcggcggcttgcaggcgaaggcggcgacccggccttaccccggcctcgtctgtatcccgctgccccagctatgcctagtcccgacgttgtttacggtgccttaccccctcccggatgcgatccaagcggtctaggcgaggccctgcccgctcagtccaggcctagcccatttaggcccgcagctccgaaggccggaccacccggcttggttcatccacttttttcaccaagccatctcacttccaaaactccccccccattgtacctccccacagagggcagacggtccgacctaccgggcggactggcgggccctcgaggcgggctcaatactagtcgatcactgtactctggcctgcagaatccctgcagtaccgccactcccggacctccactcgggagctttccgtttctacccggtggaccaccggagtacggacttggcgatcccccacccccacctggactgctacagccccctacactggccccctggcagccatctagaggggacgggcctcctgcagtctcgtcacaaccccgctag

SEQ ID NO: 196104 - DNA, 1107 bp, Artificial Sequence
  Description of Artificial Sequence: Synthetic coding sequence
atgggccggaagaagatccagatcagccggatcctggaccagcggaataggcaggtcaccttcacgaagagaaaattcgggttgatgaaaaaggcgtatgaactctccgttttatgcgactgcgaaatcgcactgataatctttaactccgcaaaccgattatttcagtacgcatcgaccgatatggatcgggtccttctgaaatataccgaatattcggagccgcacgagagccgcactaacacggacattctggaaaccctgaagcgccggggaatcggtctcgacggtcctgagctcgagcccgacgagggcccggaggagccaggagaaaaatttaggaggcttgccggcgaaggcggcgaccctgctctgcccaggccccgcctttatcctgccgcaccagctatgccaagcccagacgtcgtttacggcgctttgcccccacctggatgcgatccttcgggcttgggagaagccctccccgctcaaagccgaccctccccatttcgccccgccgcgccaaaagctggcccgccgggccttgtccatcccttgttctcgccctcccatctgacaagcaagactccacctcctctgtacctcccaactgaagggcgccggtctgacctgcctggaggcttggcaggccctagagggggcctcaacacgtcgcgctccctttattctgggctccagaacccatgctctaccgccactcctggacctcccttaggttctttccccttcctccccggcggaccgcccgaatacggcttgggggatccgccccccccccccgggcttttacaacctccgactcttgccccatggcagcctagcaggggcgatggacctccggctgtgagttctcagccaagcgggggccgttccttaggagaagaagggcctcccacccgcggagcatctccccctaccccacccgtgagtatcaagtcagaaaggctgtcccccgcacctggtggtccaggcgattttcccaaaacgttcccctatccactgcttttggctaggtcactggctgagccgctgcgcccaggtcccgctctgagacgtctcccacttgccgatggctggccacgctag

SEQ ID NO: 196105 - DNA, 1098 bp, Artificial Sequence
  Description of Artificial Sequence: Synthetic coding sequence
atgggccggaagaagatccagatcagccggatcctggaccagcggaatcggcaagtgacatttactaaacggaagttcggtctcatgaagaaagcctatgaactgtccgttctctgtgactgcgagattgccttgatcatctttaattccgcaaatcgactgtttcagtacgcctccacggacatggaccgggttctgctcaaatatacagaatattccgagccacatgagtctcggacaaacactgatatcctggaaacactcaaacgaagaggtatcggccttgacggcccagagctcgagccagatgagggccccgaagaaccaggcgaaaaatttagacgactggcaggagagggcggcgacccagccctccctcgcccaaggttgtaccccgccgcgcccgccatgccctcacctgatgtggtctacggcgcattgcctcctcctgggtgcgacccatccggtctgggcgaagcacttccagctcaatccagaccatctccttttagacccgctgcacccaaggctggccccccgggattagtacaccctctgttttcaccttcacatctcacttccaaaacccctccgcctttgtaccttcctacagagggtaggcgcagcgacctacccggtgggctggccggtcctcgcggaggtctgaatacatcacggtccctttacagtggcttgcagaacccttgcagtactgccactcccgggcctccacttggttcctttcccttcctgcccggtggccctccggttggcgccgaagcatgggcccgacgggtaccacagcccgctgcccctccaaggaggccacctcagagcgccagctcactgtctgcctcgctgcggccgccgggggcccctgccaccttcttacgccctagtccaatcccatgctcctctccaggcccctggcagtccctttgtggtctgggcccaccctgtgccggttgtccgtggcccaccgcaggtccaggccgtcgctcacccgggggtacctcaccagagcggtcccccggcacagcacgggcccggggcgaccccacttctttgcaggcttcttctgagaagacccagcagtag

SEQ ID NO: 196106 - DNA, 1392 bp, Artificial Sequence
  Description of Artificial Sequence: Synthetic coding sequence
atgggccggaagaagatccagatcacccggatcatggacgagcggaatcggcaggtgacattcactaagagaaaatttggcctaatgaagaaagcctacgaactcagtgtgctttgtgactgtgagatcgctttgatcatctttaattcaacaaataagctgtttcagtacgcaagcacggacatggacaaggttctgttaaagtatactgaatataacgagccccatgaatccagaaccaatagtgatatcgtcgaagctctgaataagaaagaaaataagggctgcgagtctccagatccggactcttcgtacgcactgaccccacgaactgaagagaagtataagaaaattaatgaggaatttgataatatgatcaagagccacaaaatcccggccgtgccaccaccaaatttcgaaatgcccgtgagcatcccagtgagcagccataatagccttgtttactccaaccccgttagcagtctgggcaatccaaacctcctgccacttgcccaccctagcctgcagaggaactccatgtcccccggggtgacgcatcgacctccaagcgccggcaatacgggaggccttatgggaggcgacttgacctccggggccggtacttccgccggtaatggatacggcaacccgaggaattcccctggactactcgtgagcccaggtaacctgaacaaaaatatgcaggcgaagtcacccccgcccatgaacttgggcatgaataatcgaaagcctgacctaagagtgctgataccccccgggtcaaaaaacactatgcccagcgtgaaccagagaattaacaacagccagagcgcccagtctcttgcaacacccgtggtgagtgtggctacccccacgctgcccgggcagggcatgggtggatatccaagcgccatctctaccacttatggaaccgaatattctttgtcatcggccgatctgtcatcactgtctggctttaatacagcgtctgcgcttcacttaggatcagtcacaggatggcagcagcagcacctccacaatatgcctccttctgcactgagccagcttggggcatgcacctcaacccacctgtcacagagttcaaatttgtccttgccgtctacacaaagtctgaacatcaagtccgaacctgttagtcccccgcgcgatcggacgacaaccccctcccggtatccccagcatactcgacacgaagccggtcggagtcccgtggactccttgtccagctgcagttccagttacgacggaagcgatagagaagaccacaggaacgaatttcacagtcccatcggcctgacccgacccagtccagatgaaagggagtcccccagcgtgaaaaggatgaggctgtctgaaggctgggccacttag

SEQ ID NO: 196107 - DNA, 1422 bp, Artificial Sequence
  Description of Artificial Sequence: Synthetic coding sequence
atgggccggaagaagatccagatcacccggatcatggacgagcggaatagacaagttaccttcacaaaacgcaagtttggcttaatgaagaaggcctatgagttatcggtgctttgcgactgcgaaatagccctaatcatattcaatagcacaaacaaactctttcagtatgcatctacagatatggacaaagtgctgttgaaatataccgagtacaatgaaccccacgagtccagaaccaattctgacatagtggaaactcttagaaaaaagggtcttaacggctgcgactccccggatccggacgctgatgacagcgtcgggcattcccctgaaagcgaagacaagtacaggaagatcaatgaagacatagacctcatgataagcagacagcgactgtgtgccgtgcccccacccaactttgagatgcccgttagcatcccagtaagctcgcataattcgctggtctattccaatcctgtatcttctctgggaaatccaaatcttctgccgctggcccatccaagcctgcagcgtaattcaatgtccccaggagtgacccaccgccccccatcagccggcaacacgggtggactgatgggtggcgacctaacctctggagcagggacaagcgccggcaacggttatggcaatcctcgaaacagcccaggcctgctcgtctcaccaggcaatttgaataaaaatatgcaagccaaaagtccacccccaatgaatctgggaatgaataaccgaaagcctgacctgcgcgtacttattccccctggttcgaaaaataccatgccttctgtatctgaggatgtagacttgctgcttaaccagcggatcaacaattcacaaagtgcccagagtctggccacacccgtggtttctgtcgcaactcctactctgccaggacagggtatgggcggttacccttccgccatttccaccacatatggaacagagtactccctgtcaagcgcagatctctcttccctgtcaggctttaataccgcctccgccctgcatctagggtcagtcactggttggcaacagcaacaccttcataatatgcctcctagcgctctgtcccagctcggagcttgcacgagtactcacctgtcccagtcaagcaacttatcgctgccatcaacccagtcacttaacataaaaagcgagccggtttctccccctcgggaccgcaccacaacaccaagccggtatccccagcataccaggcacgaagctggtcggagcccagttgactctctgagctcttgctcatcctcctacgatgggtcggatagagaagaccacagaaacgagttccactctcctattggtctcactaggcccagtcccgacgagcgagagtccccgtcagtgaaacgtatgagactgtcagagggatgggccacttag

SEQ ID NO: 196108 - DNA, 297 bp, Artificial Sequence
  Description of Artificial Sequence: Synthetic coding sequence
atgggccggaagaagatccagatcacccggatcatggacgagcggaataggcaggtgacgttcacaaagaggaaatttggattgatgaagaaagcttatgagctgtctgtgctgtgtgactgcgaaattgcgctgatcatcttcaattccacgaataagctctttcagtatgcttctaccgacatggacaaggtcctactgaagtacactgagtataacgagccccatgagtctaggaccaactctgatatagtggaaacactgcggaaaaaggggctgaacggctgtgattcctag

SEQ ID NO: 196109 - DNA, 390 bp, Artificial Sequence
  Description of Artificial Sequence: Synthetic coding sequence
atgggccggaagaagatccagatcacccggatcatggacgagcggaatcggcaagtgacctttacaaagaggaagtttggcctgatgaagaaggcttatgaactgagtgtcctgtgcgattgcgagatagcattgattatctttaattcaacaaataaactttttcagtatgcatctactgatatggacaaggtactactgaaatacactgaatacaacgagccacacgagtccagaacaaactcagatattgtcgagacattaaggaagaagggccttaatggctgcgacagccccgaccccgatgccgatgattctgttggccattcccccgagagtgaagacaaataccggaaaatcaacgaggatatcgatttgatgatttcatag

SEQ ID NO: 196110 - DNA, 264 bp, Artificial Sequence
  Description of Artificial Sequence: Synthetic coding sequence
atgggccggaagaagatccagatcacccggatcatggacgagcggaaccgacaggtgactttcacaaaacggaagtttggattgatgaagaaggcgtacgagttgtctgtgctgtgtgattgcgaaatcgcgctcattatcttcaacagcacaaataagctgttccaatatgcatcaacagatatggacaaggtgcttctaaagtataccgaatataatgagcctcacgagagccggactaattccgatatcgtggagacctag

SEQ ID NO: 196111 - DNA, 1422 bp, Artificial Sequence
  Description of Artificial Sequence: Synthetic coding sequence
atgggccggaagaagatccagatcacccggatcatggacgagcggaacaggcaggttacatttactaagcgcaaattcggacttatgaagaaggcctacgaactgtccgtcctctgcgattgtgagatcgccctcattatcttcaattcaactaataagctgtttcaatacgcttccaccgacatggacaaagtgctgctgaagtacaccgagtacaatgagccacacgagagccgcaccaactctgatattgtggaaacacttagaaagaagggcctgaacggatgtgatagccccgaccctgacgcggatgactccgtcggacacagtcctgagtctgaagacaagtatcggaagattaatgaagatatcgacctgatgatcagccggcagaggctgtgcgccgtccctcctccaaactttgaaatgcccgtgtcgatccccgtgtccagtcacaatagcttggtttacagcaatcccgtttctagccttggaaaccctaatctgctccctttggcccatccctccttgcagaggaatagcatgtcccctggcgtaacacatcgcccaccttctgccggaaacacaggaggtctcatgggcggtgatttgacttcgggtgccgggacaagtgcaggcaatgggtacgggaatcctcggaacagtcctgggttactcgtttcaccaggcaacctgaataagaacatgcaagccaaatcacccccccctatgaatctcggcatgaacaataggaaacccgatttgcgcgttcttattcctccagggagtaagaacaccatgccctcggtcgtcatacagaattatatactcaaaaatcagaggatcaacaactcccagtcagcccagtccctagcaacccctgtggtgagcgtagctacccctactttgcctggccagggcatgggggggtatccaagtgccatcagcactacctacggtacggagtactcgctgtcctctgctgatctgagtagtctgagcggttttaatactgcttcagctctgcacctcggctccgtgactgggtggcagcagcagcatctgcacaatatgccaccatcagcactgagccagctgggcgcctgcacctctactcacctgtctcagtcctctaatttgtctctgccctccactcagagcttgaatatcaaatcagagccagtgagccctcctagagaccggaccacaactccctctaggtaccctcagcatacaaggcatgaggctggaaggtccccagtggatagtctctcctcttgttcgtcttcttatgatggaagtgatcgggaggaccatcgtaatgagttccattcccctataggcttgactcggccgtctcctgatgaacgtgagtcaccatctgtcaagcgcatgagactatccgagggctgggccacatag

SEQ ID NO: 196112 - DNA, 684 bp, Artificial Sequence
  Description of Artificial Sequence: Synthetic coding sequence
atgggccggaagaagatccagatcacccggatcatggacgagcggaaccgccaggtaacatttacaaaacgcaagttcggcctgatgaagaaggcatatgagctcagcgtcctgtgcgactgtgaaatcgccttaataatctttaactccacaaacaaattgtttcaatatgcttccaccgacatggacaaagttctgctcaaatacaccgaatacaacgagccccacgaatccagaacaaactccgatatcgttgaggctctaaataaaaaagaaaataagggatgtgagtctcccgatcctgatagttcatatgctctcaccccgcgcactgaagagaaatataagaaaatcaacgaagagttcgataatatgataaagagtcacaaaatcccggctgtcccccctcctaactttgagatgcctgtcagcattcctgtgagctcccacaactctctggtttacagtaaccccgtgagctcattggggaatccaaacctcctgcctctggcacacccctccctccagcgaaattcaatgtctcctggcgtcacccacagacccccatctgcgggcaacactggtgggctcatgggtggcgacctgacctccggcgccgggacatcagcgggaaatggctatggcaaccccaggaattcccccggactcttggtgtccccatag

SEQ ID NO: 196113 - DNA, 363 bp, Artificial Sequence
  Description of Artificial Sequence: Synthetic coding sequence
atgggccggaagaagatccagatcacccggatcatggacgagcggaaccgccaggttacattcaccaagcgcaagttcggacttatgaagaaagcttatgagcttagcgtgctgtgcgattgtgagattgctcttattatctttaattcaacgaacaagcttttccagtacgcatccactgatatggataaggtacttttgaagtatactgaatacaatgaaccccacgagagcaggactaacagcgacatcgtggaagccctgaataaaaaggagaacaagggatgcgagagtccggaccctgattctagctacgctctgacacccagaacagaggagaagtacaagaaaattaatgaatag

SEQ ID NO: 196114 - DNA, 381 bp, Artificial Sequence
  Description of Artificial Sequence: Synthetic coding sequence
atgggccggaagaagatccagatcacccggatcatggacgagcggaatcggcaagtaacctttacaaagcggaagttcggactaatgaagaaagcatacgagttaagcgtgctgtgcgattgtgaaatcgctctcatcatcttcaactccaccaataaactctttcagtatgcctctacagatatggataaggtgctgttaaaatacaccgagtacaacgaaccccacgagagccggaccaattccgacatcgtggaaaccctccggaagaaagggctcaatgggtgtgacagccccgatccagacgctgatgattccgttggccactcaccagaatcagaagacaaatacagaaaaatcaacgaggatatcgatttgtag

SEQ ID NO: 196115 - DNA, 87 bp, Artificial Sequence
  Description of Artificial Sequence: Synthetic coding sequence
atgggccggaagaagatccagatcacccggatcatggacgagcggaatcgtcaggtaacattcactaaaagaaaatttggtctgtag

SEQ ID NO: 196116 - DNA, 1398 bp, Artificial Sequence
  Description of Artificial Sequence: Synthetic coding sequence
atgggccggaagaagatccagatcacccggatcatggacgagcggaataggcaagtgacatttacgaagaggaaatttggcctgatgaaaaaggcatacgagttgagtgttctgtgtgactgtgagatcgcgctaatcatcttcaactctactaataagctttttcagtacgcctccaccgatatggacaaagtactcttgaaatatacggagtataacgagccccatgaatcaaggacaaacagtgatatcgttgagactctgagaaagaaaggactgaatggttgtgattccccagatccagacgctgacgattcagtggggcatagccccgagtccgaagataagtataggaagataaacgaggacattgatctgatgatctcaagacagaggctgtgcgctgtgcccccccccaatttcgaaatgcccgtgtctatccccgtatcatctcataattcactggtatatagcaacccagtttcaagcctagggaacccaaacctgctgcccctggcacatccaagcctacagcgcaattccatgagccccggagtcacccaccgccccccttctgccggaaacaccggcggattaatgggaggcgacctgacgtcaggcgctggaactagtgccggcaatgggtacggtaacccacggaattccccaggcctgctggtgagccccggaaacctgaacaagaacatgcaggctaaatctccccctcccatgaatctaggtatgaacaatcgtaagcccgacctgcgcgtgctgattccaccaggttccaagaacaccatgccttcagttaatcaacggattaacaattctcagtctgcccagtcgctagcaacgcccgtcgtctccgtcgccactccaaccttgcccggacaaggaatggggggttacccgagtgcgatctcaaccacctacggaactgagtactccctcagtagcgccgatttgtctagtctgagtggatttaatacggctagtgccttgcacctcggcagtgtaacgggctggcagcagcaacacctgcacaatatgccgccttcagcattgagccaactcggcgcgtgcaccagcacgcatttgagtcagagctccaatttatctcttccgagtacccagtccctgaacatcaagtccgaacccgttagccctcctagagatcgcactactactccctctagatacccccagcatactcgccatgaagctggcagatctcctgttgatagcttgagctcttgcagttcaagttatgatggtagcgatcgcgaggaccaccggaatgaattccacagccctataggcttaacgcgccccagtccagacgagcgagagtccccctcggtgaagcggatgcgcctctccgagggatgggccacatag

SEQ ID NO: 196117 - DNA, 729 bp, Artificial Sequence
  Description of Artificial Sequence: Synthetic coding sequence
atgggccggaagaagatccagatcacccggatcatggacgagcggaatcggcaggtgacctttactaaacggaagtttggtctcatgaaaaaggcctacgaactcagcgtcctgtgcgactgtgagatcgccctgatcatctttaactctacgaataagttattccagtacgcatctactgatatggacaaagtgttactgaaatacacggaatataacgagccacatgagtcgcgcactaattctgacatcgtggaggctctgaataaaaaggagaataaggggtgcgagagcccggatcctgacagttcctatgcgctcacgccgcgcaccgaagaaaaatacaagaagattaacgaggagttcgataatatgatcaaaagccacaaaatcccagcggtaccaccacccaattttgaaatgcccgtgtccatcccagttagttcccacaacagcctggtgtacagcaacccagtgtccagtcttggcaatcccaacctgttgccgcttgcgcatccttccttgcagcggaactctatgtccccaggtgtgacccataggccgccctccgccggaaatacgggcggcctgatggggggtgacctcacatcaggtgcggggacttccgcgggtaacggctatggaaatcccagaaactcacccggtctgctggtgtccccagggaatctgaacaaaaatatgcaagctaagtctcccccacccatgtag

SEQ ID NO: 196118 - DNA, 1326 bp, Artificial Sequence
  Description of Artificial Sequence: Synthetic coding sequence
atgggccggaagaagatccagatcacccggatcatggacgagcggaaccggcaggtcaccttcaccaagcgcaagttcggactgatgaagaaggcttatgaactgtccgtcctatgcgattgcgagattgccctgattattttcaactcaactaacaaactgtttcagtacgctagtaccgatatggataaagtcctgctgaagtatactgaatacaatgagcctcacgaaagccgcaccaattctgacatcgtggagacattgcgaaagaaaggccttaatggctgcgatagccccgatcctgatgcagacgactcagttggacatagccctgagtcagaagataagtaccgtaaaatcaacgaggacattgacctgatgatctcacgacagaggttatgcgccgtgccacctcctaacttcgagatgccagtgagcattcccgtgagtagtcataactccctggtgtactccaaccctgtgtcctcactggggaaccctaatctgcttcccctcgcccacccatctctgcagaggaattcaatgtccccgggtgtaactcacaggcctccttccgccggcaacactggtgggctgatgggaggtgaccttacttcgggtgctggcacctccgctgggaacggatatggaaatccccggaacagccccgggctcttggtgtcccctggcaatttgaataaaaatatgcaggccaagtcaccacccccaatgaacctcggcatgaataatcgtaagccagacctgagagtgctgatccctccagggagtaaaaataccatgcccagcgtgagcgaggacgtcgacctgctgttgaaccagcgcataaataactcccagagtgctcagtctctggcgacgcccgttgtcagcgtagccactcccactctgccaggtcagggaatgggggggtatcctagtgccatctcaactacttatggcactgagtatagcttgagtagcgccgacctttcgtcactgtcgggatttaacacggccagtgcccttcaccttgggtctgtgaccggctggcagcagcagcatctgcataatatgccgcctagcgcattgagccagctgggcgatcgcactactaccccttcacgatatccacagcatacacgccatgaggccggccggtcccctgtagattcgctgagttcctgcagctcgtcatatgatggatcggaccgagaagaccacagaaatgaatttcactcaccaatcgggttgacccgcccgtccccagatgaacgagaaagtccgtcagtgaaacgcatgaggttgtcagaagggtgggcaacctag

SEQ ID NO: 196119 - DNA, 1422 bp, Artificial Sequence
  Description of Artificial Sequence: Synthetic coding sequence
atgggccggaagaagatccagatcacccggatcatggacgagcggaaccgccaggttacttttacaaaacgaaaatttggattaatgaagaaggcatacgagttgtctgtgctgtgcgactgcgaaatcgcgcttataatttttaattcaaccaataagctgttccagtacgcttcgacagatatggacaaggtactcctcaaatatactgagtacaatgaaccccatgaatctcggacaaattcagacatcgtggaaacattgaggaagaagggactcaatggttgcgattccccagaccccgatgctgatgattcggtcggacactctcccgagagtgaggacaagtacagaaaaatcaacgaagatattgacctcatgataagccgtcaacgcctgtgtgcagtgccccctccaaattttgagatgccagtttctattcccgtcagcagtcataacagtctggtgtactccaatccggtctctagtttgggcaaccccaatctgctgccgctggctcacccatccttacagcgcaattccatgagccctggggtcacccataggcccccttctgcaggtaacaccggcggcttgatgggtggggacctcactagcggagctgggacctcagccggaaatggctacggcaacccacgcaactcccctggcctcttggtgagccctgggaacctgaacaaaaacatgcaggccaagagcccaccccccatgaatttgggaatgaacaatcgaaaaccagacctaagggttctcattccccccggtagtaaaaatacaatgccttccgtctccgaggacgtggacctgctcctcaatcagaggataaacaactcccaatctgcacagtctctggcgacgcccgtcgtgagcgtcgctactccaacactgcccggccaggggatgggagggtaccctagcgcaataagcacaacctacggcaccgagtatagcctatccagcgctgatttgtcatcactgtctggctttaataccgcatctgctttacacctcgggtccgtgactggatggcagcagcagcatctgcataatatgccacctagtgccctgtcccagctgggggcatgcacaagtacacaccttagccagagtagcaatctgagcctcccaagtacccagtcactcaatattaagagcgaaccggttagccccccccgcgacagaacaacgaccccaagccgatacccccagcataccagacatgaggctgggcgttcacctgttgactccctgtctagttgtagctctagctatgatggctcagatcgcgaagatcaccggaacgaattccacagcccaattgggttgactaggcccagccccgacgaacgggagtcaccttcagtcaagcgtatgcgtctctctgaggggtgggcgacgtag

SEQ ID NO: 196120 - DNA, 1254 bp, Artificial Sequence
  Description of Artificial Sequence: Synthetic coding sequence
atgggccggaagaagatccagatcacccggatcatggacgagcggaatcgacaagtgacgttcacaaagagaaagttcggcctcatgaagaaagcatacgagctgagtgttctctgcgactgcgagattgccctaatcatctttaattcgactaataagttgtttcagtatgcctccactgatatggacaaggtcctgcttaaatacacggagtacaatgaaccccacgagagccgcacaaattcagatattgttgaagcagtcccgcctcctaattttgaaatgcccgtgtccatcccagtttccagccacaattcactcgtgtattccaaccctgtttcatctctgggcaatcccaaccttcttcccctggcacatccatcactccaaaggaactccatgagccccggtgtgacccatagacctccatccgcaggtaacaccgggggactcatggggggcgatctaacttcaggggccggaacctccgccggaaatggctacgggaacccacggaattcccccggcttgctggtctcgccaggcaatttgaataagaacatgcaagctaaatctcctcctcccatgaacctggggatgaataatcggaagcctgatctgagggtgttaatacctcctgggtcaaagaacactatgccctcggttaaccagcggatcaacaactcccaatccgcccagtcacttgccactccagtcgtgagcgtggccaccccaaccctgccagggcagggaatggggggatatccaagtgcgatctcaacaacttacggaactgaatactcactgagtagcgctgacctgtcatccctgtcagggtttaacacggcctctgccctccatctaggctccgttaccgggtggcagcagcaacacttgcataatatgcccccttctgcattatcccagctgggagcctgcaccagtacgcaccttagccaatcttcgaacctctccctcccctcgactcagtctctcaatatcaagagcgagcccgttagcccaccccgcgatagaaccactacaccatctcggtatcctcagcacacccgacacgaggcaggtcgaagtcccgtggactccttgtcatcttgctcatctagctacgacggatctgatcgagaggaccataggaatgagtttcactctccaatcggcctcactcgcccctcccccgatgagcgcgagtcaccttcagtcaaacggatgagactctcagaaggttgggcaacatag

SEQ ID NO: 196121 - DNA, 1452 bp, Artificial Sequence
  Description of Artificial Sequence: Synthetic coding sequence
atgggccggaagaagatccagatcacccggatcatggacgagcggaatcgccaggtgaccttcaccaaacgcaaattcgggttgatgaaaaaggcctatgaactcagcgtactttgtgactgcgagattgctctgatcatctttaattcaacaaacaagttattccagtacgcctctactgatatggacaaagtccttttgaaatacactgaatataatgaaccgcatgagtcccgcaccaatagtgatatcgttgaaaccctgcgcaagaaagggcttaacggttgtgacagtccagacccagacgccgacgattcagctctcaataagaaggagaacaagggctgcgaatcccctgatccagatagttcatacgccctgacaccacggacagaagagaaatacaagaagattaatgaggaatttgacaacatgataaagagtcacaagatacctgctgtacctccgcccaactttgagatgcctgtgtctataccagtgtcatctcacaacagcttggtttacagcaacccagtctcctcactgggaaacccaaatcttctgccactggcccacccatccttgcagagaaactctatgagccctggagtaacccatcggcctccgtccgcaggcaataccggcggtctgatgggcggggaccttacatctggagctgggaccagtgccggtaatggatacggcaatccaaggaactcccccggcctgctcgtttcacctggtaacctgaataagaatatgcaggcaaagagtccaccaccaatgaacctcggcatgaataatcgcaaacccgatctgcgagttttgatacctccaggctctaagaatactatgccgtctgtgaaccaaagaatcaataactctcaatctgcgcagtccctcgctaccccggtggtgtctgtggcgacccctacgcttcctggacagggcatgggaggttatccttccgccatcagcaccacctatggtaccgagtattcactttcctcagccgacctctcttcgctcagcggatttaacactgccagcgcactgcacctcggtagtgtgaccggctggcagcaacagcacttacacaatatgcccccttccgcactcagtcagttgggagcatgtacttccactcatttgtcccaaagctccaacctctcactgcctagcacccagagcctcaatatcaagtccgaaccagtcagcccgccaagagacaggactacaacgccatcacgataccctcagcacacaaggcacgaggcaggtaggagtcctgttgactcactctcatcctgctcttctagctacgacgggagcgaccgggaagaccaccggaacgaattccattcacctatcgggctgaccaggcctagccccgatgaaagagaaagcccttccgtcaagcggatgcggctgtctgaaggatgggctacttag

SEQ ID NO: 196122 - DNA, 1563 bp, Artificial Sequence
  Description of Artificial Sequence: Synthetic coding sequence
atgggccggaagaagatccagatccagcggatcaccgacgagcggaaccggcaggttacttttaccaaacggaagtttgggttgatgaaaaaagcttatgagctctcagttctgtgcgactgtgagattgctttgatcatatttaatcactccaataagttgttccaatatgcctctactgatatggataaagttctcttaaaatacacggaatacaacgagccacacgaaagtaggacgaatgcagatatcatagaagccttgcacaagaagcatagagagtgcgaatcacctgaggtcgacgaggtgttcgccttgactccgcagacagaagaaaagtacaagaagatcgacgaggaatttgataaaatgatgcaaagttatcggttagcctctaccgtcccagcaccaaacttcgctatgcccgtcaccgtgcccgtgagcaatcagtcttcccttcagttctcgaatccatcaggttccttagtgaccccgtcacttgtcaccagcagcctgaccgatcctcggttgcttagtcctcaacaacccgcccttcagcggaattccgtctcaccaggtttaccgcaaaggccagcttcagccggggcgatgctaggcggagatctgaactctgcaaatggcgcctgccccagtcccgttggcaacgggtacgtctccgctagggcctcgcctggactgctccctgtcgccaatggcaactcccttaataaggtgatccccgccaaaagcccacctcctcccactcactcgacacagctcggcgcccccagccgaaaaccagaccttcgtgtcattacgtctcaagctgggaagggtctcatgcaccacctgacggaggatcacctagatcttaacaacgcacaacggctgggagtctcgcaaagcactcactcactgactacacccgtagtctcagttgccacaccgtctctactttctcagggactgccgttttcttccatgccaacagcctacaacacagactaccagctaacttctgccgaactgagttccctaccagctttttcttctccaggagggctgtccttagggaatgtgaccgcatggcagcaaccacagcaacctcaacagccccaacagccacagcccccccagcagcaaccacctcagccacagcagccccagccccagcagccccaacagcctcagcagccacctcagcaacagagtcacctagtccctgtctccttgtctaaccttatcccgggaagtccactcccacatgtgggagccgccttgactgtaaccacccatccccatatctcgatcaaatctgaaccggtctcaccctcccgcgagcgctccccagcaccacccccccccgcagtttttcctgcagccagacctgagccaggagatggcttgtcctcacctgccggaggcagctacgaaacaggagacagagatgatggccgcggggacttcgggcctactctggggctgctgcgtcccgctccagaacccgaagctgaggggtctgccgtcaagcgcatgcgactcgatacgtggaccctcaagtag

SEQ ID NO: 196123 - DNA, 1566 bp, Artificial Sequence
  Description of Artificial Sequence: Synthetic coding sequence
atgggccggaagaagatccagatccagcggatcaccgacgagcggaaccggcaggtaaccttcaccaagagaaagttcggcttgatgaaaaaggcatacgagctcagcgtcctttgtgattgtgagatagcactgattatattcaaccacagcaataaattattccagtacgcatcaacggacatggacaaggtgctgttgaaatataccgagtacaacgaaccacacgagtctcgtacgaatgcagatatcatcgagacactgcggaaaaagggctttaatggctgcgattccccagaacctgatggagaggattcgctcgaacagtcaccactgctggaggacaaatacagaagggcaagtgaagaactcgacggtctatttaggaggtacggctcaaccgtgccggcaccgaacttcgcaatgcccgtgaccgtgccggtatcaaaccagagttctttgcaattttcaaacccatctgggagcctcgtgaccccttctctggtcaccagttctctcacagacccaagactgctgagccctcagcagccggctctccaacggaactccgtctcccctggtctgcctcagagacccgcctccgccggagcaatgttagggggtgatctgaactctgccaatggtgcatgcccatcccccgtcggcaatgggtatgtgagcgcgagagccagtcccgggttgctcccagtcgccaacggaaatagtctcaacaaggtcatccctgccaagagcccgcctcctcccacacattccacgcagttgggcgcaccctcaaggaaacctgatctacgcgtgatcacctcacaggcggggaaagggctcatgcatcatctcaccgaggatcacctggacctcaacaatgcccagcgcctgggtgtgagccagtcaacccatagtctgaccacacctgtggttagcgtagccacaccctccctattgtcgcaggggctgcctttctcctctatgccaaccgcttataacacagattatcagctgactagcgccgagctgtccagtcttcctgcattttcatcgcccggcggcctgtcactgggtaacgtaactgcttggcagcaaccacaacagccccagcagccccagcagccacagcctcctcagcaacagccgccccagccccaacaaccccagccgcagcagccacagcagcctcagcagccgccccagcaacagtcccatttggttccagtgagcttgagcaatttgattcccgggagcccactgccccacgtgggcgccgctctaaccgtcaccactcacccccatatcagcattaagtctgagcctgtgagcccatctcgcgagagatctcctgcacctccacccccggccgtctttccggctgcccgacctgaaccaggtgatggcctgtcaagccctgctggaggctcttacgagaccggtgatcgcgacgatggcagaggcgacttcgggcctactctcggactgctgagacctgcgcccgaaccggaagccgagggaagcgccgtaaaacgcatgcgcctggacacttggactctgaagtag

SEQ ID NO: 196124 - DNA, 1428 bp, Artificial Sequence
  Description of Artificial Sequence: Synthetic coding sequence
atgggccggaagaagatccagatccagcggatcaccgacgagcggaacaggcaggtgacattcactaaacgtaaattcggattgatgaagaaggcctacgaattgtcagtgttatgcgactgtgagatcgccctaattatcttcaaccactccaataaacttttccagtatgcgagcacagacatggataaagtactgcttaagtatacagagtacaacgaaccgcacgaatcaagaaccaacgctgatattattgaaagcacggtccctgcgcccaacttcgccatgcccgtgacagtgccggtgtcaaaccaatcatccctgcagttctctaacccaagtggtagcctggttactcctagccttgtgacatcgtcgctgacagaccctcgcctgctttccccgcagcaacccgccctgcagcgaaattctgtctcacccggcctgccacagcggcctgcttcagcaggggcgatgctgggaggcgatctgaactccgccaatggcgcctgcccttccccagtcgggaacggctatgttagcgccagggcgtccccagggctcttgccagtggctaacggtaacagcctgaataaggtcatcccagccaagagcccacctccacccactcattccacacagctgggagccccatcaagaaagcccgatctccgggtgattacttcccaggccgggaagggcctgatgcatcatttaacggaagaccacttggatctcaacaatgctcaaaggctaggcgtatcgcagagtacacactccttaactaccccggtggtgagtgtagccactccatccctactgtcacagggcctgcctttctctagtatgcctacagcatacaacactgattaccagctaacttccgctgagctgtcgtcacttcccgcgttcagcagccccgggggcctatccttgggaaacgtcacagcctggcagcagccacaacaacctcagcagcctcaacaaccccagcccccccagcaacagcctccccagccacagcagccccagccacagcaaccccaacagcctcagcagccccctcagcaacagtcacaccttgtcccggtcagcctcagcaatttgatccccgggtcgccattaccccatgtgggggctgcccttacggtgactacacaccctcacatctctatcaagagcgagcccgtgagtccctcacgtgagaggagtcctgccccacccccacccgcagtgtttcctgcggcaaggcccgagcccggcgacggactcagttccccagccggtggctcttacgaaacaggcgatcgggacgatgggagaggagactttggtcctacgctcggacttctccggccagcccctgagcccgaagccgaaggtagcgctgttaaaaggatgagacttgacacctggactttaaagtag

SEQ ID NO: 196125 - DNA, 1545 bp, Artificial Sequence
  Description of Artificial Sequence: Synthetic coding sequence
atgggccggaagaagatccagatccagcggatcaccgacgagcggaatcgtcaggtcactttcacaaaaaggaaatttggcctcatgaagaaagcctacgaattgtcagtgttatgtgactgtgagattgccctgatcatttttaatcacagcaacaaactgtttcagtatgctagcacagatatggacaaagtgctgctgaagtatactgaatataacgagccacacgaaagtaggacgaacgctgatatcatagaaaccctcagaaaaaagggtttcaacggctgtgactctcctgagccagacggtgaggattcacttgagcaaagccccctccttgaagacaagtataggcgagcatctgaggaactggatggcttgtttagaagatacgggtctaccgtcccagctcctaatttcgcaatgcctgtcaccgttccggtgtctaaccagtcgagtctgcaattttccaatcctagcgggtcccttgtgactcccagcctggtgacctcaagcctgacagatccacggcttctcagtcctcagcagccagcactgcagagaaacagcgtgagtcccggcctgccgcagagacccgcctccgctggagccatgctcggcggagacctgaatagcgctaatggggcctgccctagccctgtgggcaatggatatgtgtccgcacgcgcttcacccggcttactgcccgtggccaacggcaactcattaaacaaagtgatcccagcaaagagcccccctccccccactcactccacacagctgggggcaccttcaagaaagcccgacctgcgggtgattacgtcacaggcggggaaagggctcatgcatcacttaaacaacgcccaacggttgggcgtttcccagagtacacattctttgacaacacctgtcgtgtcagtcgccactccatccttgttgagtcaggggttgcctttttcttctatgcccaccgcgtataacactgattaccagcttacaagcgctgaattgagcagccttcccgccttcagctcccccggtgggctgagtctggggaatgttactgcgtggcagcaaccacagcagccccagcaaccacaacagccacagcccccacagcaacagcctccccagccacagcagccgcagccccaacagcctcagcagccccagcagccgcctcagcagcagtctcatctcgtgcctgttagtctaagtaacctcatcccagggagtcccctcccgcatgtcggtgcagctctcaccgttaccacacaccctcacataagcataaagagcgagcctgtgtccccatcccgtgagagaagtcccgctccaccacctccagccgtctttccagccgccaggcctgagccaggcgatggcctttcctctccggcgggaggatcctacgaaaccggggatcgggatgatggacgaggcgattttggcccaaccctaggactgctacgcccagcccctgagcctgaggctgagggcagcgccgtgaagcgcatgaggttggacacttggacacttaagtag

SEQ ID NO: 196126 - DNA, 1545 bp, Artificial Sequence
  Description of Artificial Sequence: Synthetic coding sequence
atgggccggaagaagatccagatccagcggatcaccgacgagcggaaccggcaggtcacgttcacgaagagaaagtttggccttatgaagaaggcctatgagctctctgttctctgcgactgcgagattgctttgataatcttcaatcatagcaataagctgtttcagtatgccagcacagatatggataaggtcctgttgaagtacactgagtacaacgaaccccacgagagccgcactaatgctgatattatcgaaaccctccgcaagaagggctttaatggatgtgattcccccgagcccgatggcgaggacagcctggagcagagccctttactggaggataagtaccgacgcgcgtccgaagaactagatggtctgtttaggaggtacggcagcactgtgcctgccccaaactttgcaatgccggttacagtccctgtcagtaaccagagtagcctccaattctccaacccttccggttctctcgttactccgtccctggtgacctcttccttaacagaccctcgtttactctcccctcaacagccggctttgcagcgtaactccgtgagtcctggactgccccagaggcccgcaagcgccggggcgatgctgggcggtgacctcaactctgctaatggtgcctgccccagccctgtggggaatgggtacgtctccgcgcgcgcttcccccggcctcctgcctgtagccaatggtaattcactgaacaaggtcataccagcaaagtcacctccaccaccaacacacagcacccagcttggggcccctagcaggaagcccgatctgcgagtgattacaagtcaggcaggtaaaggcctcatgcaccacctcaacaatgcccagagactgggggtttcccagtctacccattctctgactactcccgtggtttccgtggcaaccccatcactcctcagccaggggctgccgttcagcagtatgcctacggcatacaacaccgactatcagttgacttctgcagagttgtctagtcttccggcgtttagctcgcctggtggcctgtctctaggaaatgtgactgcttggcagcaacctcagcaacctcagcaacctcaacaacctcagccccctcaacagcagccgccccagccccagcagcctcagccccaacagccgcagcagcctcagcaacccccccagcaacaatcccacctggtcccagtgagcctgagcaatctcattccaggcagtcccctcccccatgtgggcgctgccctcacagtgaccacgcatccccatatttctattaagagcgagcccgtctccccatctagggaacgcagcccagccccaccacccccagccgtcttccccgccgctaggccagagccaggagacggattatcaagtcccgccggaggcagctacgagaccggggaccgggatgacgggagaggcgattttggacctactctcggactcctgagacctgcgcccgaacccgaagccgagggtagcgcggtcaaaaggatgcggctggacacatggacgttgaagtag

SEQ ID NO: 196127 - DNA, 1533 bp, Artificial Sequence
  Description of Artificial Sequence: Synthetic coding sequence
atgggccggaagaagatccagatccagcggatcaccgacgagcggaatagacaggtgactttcaccaagagaaagttcggcctgatgaaaaaagcctatgagcttagcgtattgtgcgattgcgaaatcgcactgatcatatttaaccactctaacaaattgtttcagtacgcatccacagacatggacaaagtgctgcttaagtacaccgagtacaacgagccccatgaaagtcgcactaacgccgacatcatcgaagcgttgcacaagaagcatagggaatgcgagagtccagaggtggatgaggtgttcgctctgaccccacaaactgaggaaaagtacaaaaagatagacgaggaattcgataagatgatgcagtcttacagattggcgtcaactgttccagctccgaattttgcaatgccggtgactgttcccgtctcaaatcagtcttctttgcagtttagcaacccatctgggtccttggtgaccccctcgctggtgacctcttcgctaaccgacccgcgcttactgagccctcaacagccagcccttcagcggaactcagtgtccccaggtctcccgcagaggccggctagtgccggagctatgctggggggggatttaaactccgcaaatggtgcatgccctagtcctgttggtaacgggtatgtgagcgcacgcgcgagccccgggctccttccagtcgcgaatgggaactctctgaacaaagtaataccggctaaaagccccccgccaccgacacatagcacacagctgggtgctccgagtagaaagcctgatctcagagtaattaccagccaggcaggaaaaggccttatgcaccatcttaacaatgcccagagactgggagtatctcaatctacacactccctgaccacgccagtggtaagcgtcgccactccttccttactgagtcaaggcctgcccttctcatctatgccgacagcctacaacacagattatcaactgacctccgcggagctcagcagcctgcccgccttctcctcgcctggagggctgtccctgggtaacgtgaccgcctggcagcagccgcaacaacctcaacagccccaacagccgcagccccctcagcaacagcctccacaacctcagcagccacagccccagcagccgcagcaaccccagcagccccctcagcagcaatcccatctggttcccgtctcgctgtctaacttaatcccaggatctcccctgccccacgtgggcgcagctttgacggttactacacaccctcatatatctatcaaaagtgaacctgtgtctcctagtagggagcgctctcccgccccgcctcctcccgccgtgtttccagcagctaggcctgagccaggcgacgggctgtcttcgcctgccggtggctcctacgaaaccggcgatagggacgatgggcggggagacttcggacctactctaggcctgttgagacctgcccccgagccggaagcagagggcagcgccgtgaaaaggatgcggctcgatacttggtag

SEQ ID NO: 196128 - DNA, 420 bp, Artificial Sequence
  Description of Artificial Sequence: Synthetic coding sequence
atgggccggaagaagatccagatccagcggatcaccgacgagcggaatagacaggtgaccttcacaaagcgtaagtttggcctcatgaagaaagcctatgagttgtctgtgctgtgtgattgcgagatcgcactcatcatatttaatcactctaataagctgttccagtatgcttcaaccgacatggacaaagtgttgctcaaatacacggagtacaacgagccccatgaatcccgcacaaacgctgacatcattgagactcttcggaaaaaaggtttcaacggctgtgattctcctgaacccgacggggaggattcactggagcagtcgcctttgctcgaggataaataccggcgggcaagcgaagaactagatggactgttccggagatacggggggccttgttggggagtcacctag

SEQ ID NO: 196129 - DNA, 1410 bp, Artificial Sequence
  Description of Artificial Sequence: Synthetic coding sequence
atggccgaggagcgggagcccgagctgtacctgaagtggaagcactgcgagacgcccggcgtaaagaccctgtgcaacctgaaacactgcgaaactcccggtgtgaaaactctatgtaaccttaagaaattgctgaacagactccagaaagatcacagagaggacgtatacctgtacatatccggtcacctgaaccctaacaaattgtaccagcctcctgaaaccatcctacaacactggcccaacgcccataggcccaagggtgagagggccagcgaggtgggagagcctccagcaggcaaagtggcacggatgaaagaggcccttgcccactttactatccacactgcattagtgccctctgaggctcaggacactcccctttttcgatatctaaatccccaggcatcactcagccatacgtccgaggaagacttcctgcccgtcgaagctgttcgggaggggaaggaagaaaagaaaggaggacctcccgggcgtggcccacccggttggaggcggagagaggaactcaggttgccagatctcaaagtattgtgctaccaggaggcaggtagccgagggaccagggatcggcaccactatgtgagttcctacctggctggtgccactagcgccgatcgctacaggatgtttctcagattccaaaaagaggttctcgcgaaacaggacttactcaagaatgatttcacaggttcgaaagcagccgccgggcacgaacgcaaactgcaacaggagttacagaaaatctgcacgtgctccccccagcagtttaatcggcttcacgtgtttggcaaagttttcgaagacatatgcaatagctccctcattttcggggatttgctgaagaaggtaaaagacgagtacgagctgtacatggccactctgctggaatcacagccggccgcccagtatgaagcactgctcgctcagctaaaagcgctgggtcagcggccagtcaaaacagccgatatggatctggcgagggaggaactaagaatgctcgtcaccgcaaccaaagccgccctggaacaaaatgaccgattgaggtcagaattggagatggaggtggcactgctgcagagcgccaaggagcgttctgagtcaagcgagaaacatatcatcgacgaaaatcgtcttacacttaccgagaaggtggagaagaagcgctgtgaaattctgtctaaatgggacgaaattcaggctcttgagaaagaaatcaaaaccacgctggtccatactggtatcagcgatatcaccgagaaccgaattaaatctatagaacatgaagcgatccagctcgagacagaaaacatgatactgaagaagaagatcaaggggccgctcgagatttatcagggtatatgtaagatccgaggcaataggcgttag

SEQ ID NO: 196130 - DNA, 741 bp, Artificial Sequence
  Description of Artificial Sequence: Synthetic coding sequence
atgtaccaggtgagcggccagcggcccagcggctgcgacgccccctatggagccccgtctgctgctcccggtccagcccagacattgtctttgttgcccggtcttgaagtcgtgacgggcagtacgcatccagcagaagctgcccccgaagaggggtcactggaggaggcggcaacaccaatgccacaggggaacggtcccggcatcccccagggcctagattcgacggatctggatgtgccgaccgaagcggtgacctgccagccgcagggcaatccgctgggatgcacgcccttactgcccaacgatagcggccatccctcagagttgggcgggaccaggcgagccgggaacggggcactgggcggcccgaaggcacatcgaaagctgcagacacacccatcattagcatcacaggggtccaagaagtccaaaagttcaagtaaatctaccacttcgcagatccccctgcaagcccaagaagattgctgtgttcactgtattctgtcctgtctcttctgcgaattcctgaccctttgtaatattgtgctggactgtgccacctgcggatcatgttcctccgaagactcgtgcctgtgctgctgttgttgtggttctggcgaatgtgccgattgtgacctgccatgcgacctggattgcggcattttggacgcatgttgtgagagtgctgactgtcttgagatttgtatggaatgctgcgggctgtgtttctcaagctag

SEQ ID NO: 196131 - DNA, 696 bp, Artificial Sequence
  Description of Artificial Sequence: Synthetic coding sequence
atgtaccaggtgagcggccagcggcccagcggctgcgacgccccctacggggcacccagcgccgcccctggccctgcccagacactgtcccttttgccaggactggaagtggtcacagggtctacccacccagccgaagccgcccctgaagaagggtcactcgaggaggcggcaacacctatgccccagggcaatggcccggggatccctcagggcttagacagtacagacctcgacgtccccactgaggccgtgacctgccagccgcaagggaaccctctcgggtgcaccccgcttttacccaacgactctggtcatccttcggagctagggggcacaaggcgggctgggaacggagctctgggcggacccaaggctcaccggaagctgcagacccacccctctctggccagccaggggtccaagaagtctaaatcaagttctaaaagtactacatctcagatcccactacaggctcaggaggattgttgcgtgcattgcatcctgagttgcttgttctgcgagtttttaacactgtgcaacatagtgctcgattgcgccacctgtggtagctgttcctcggaagacagctgcctgtgctgctgctgctgtggctccggcgaatgcgccgactgtgaccttccctgcgaccttgattgcggcattttggacgcctgctgcgaaagtgcagattag

SEQ ID NO: 196132 - DNA, 642 bp, Artificial Sequence
  Description of Artificial Sequence: Synthetic coding sequence
atgtaccaggtgagcggccagcggcccagcggctgcgacgccccctacggtgcccctagcgccgcccctggccccgcccagacactgtccttgctccctggcctggaggtggttaccgggtcaacccatccagctgaggccgctcccgaagaagggagcctggaggaagcggcaacccccatgccccaggggaatggacccggcatccctcaagggcttgatagcacggaccttgatgtacctactgaggctgtcacatgtcagccccagggcaatcccctgggatgtaccccgctgctccctaacgactcagggcacccctctgaactgggggggactcgccgggctggtaacggcgccctgggcggacccaaggctcacagaaagctgcaaacacatcctagtctcgcgtctcaggggtctaaaaagtccaaatccagtagcaagagcactacgtcccagatcccgttacaggcacaggaggattgttgtgtgcactgcattttaagttgcctgttttgcgagtttttgaccctgtgcaatattgtgctggactgtgctacatgcggatcatgctcgtcagaagactcctgcttgtgttgttgctgctgcggatctggcgaatgcgctgactgtgactag

SEQ ID NO: 196133 - DNA, 297 bp, Artificial Sequence
  Description of Artificial Sequence: Synthetic coding sequence
atgtaccaggtgagcggccagcggcccagcggctgcgacgccccctatggtgccccttccgccgctcccggacctgctcaaaccctgtccctgctgccagggctcgaagtggtgactggctccacgcaccccgcagaggccgcacccgaagagggatcacttgaagaggcagcaactcccatgcctcagggcaatggcccgggtatcccacagggtttggacagcacggatctggacgtacccaccgaagccgttacctgtcagccccagggtaatcctctcggctgcacaccatag

SEQ ID NO: 196134 - DNA, 387 bp, Artificial Sequence
  Description of Artificial Sequence: Synthetic coding sequence
atgtaccaggtgagcggccagcggcccagcggctgcgacgccccctatggggccccctccgctgctccgggccctgctcagaccctgtcactcctcccaggactggaagtagtgaccggaagtacacacccagccgaggctgcaccagaggaaggatccctggaggaagctgccacccccatgcctcagggaaacggaccaggtatcccacagggcctggattctaccgaccttgacgtgcctacagaggccgtcacctgccaaccacaaggcaatccacttgggtgcactcccttgctgcctaacgatagcggacacccttctgagcttggtgggactcgccgcgctggaaacggagctctcgggggccctaaggcccacaggtag

SEQ ID NO: 196135 - DNA, 741 bp, Artificial Sequence
  Description of Artificial Sequence: Synthetic coding sequence
atgtaccaggtgagcggccagcggcccagcggctgcgacgccccctacggggcccctagtgcagccccgggaccagcccagaccctttccctgcttccgggtctcgaagtggtcacaggtagcactcacccagccgaggcggcccccgaggaaggatctttggaggaagcggctacacctatgccacaggggaacggccctggcatccctcagggcttggattcaaccgatttggacgtgccgacagaagctgtaacctgtcagccccagggcaacccgctcggatgcacgcccctcctgcccaacgacagcgggcaccctagcgagctgggggggactcgccgagcagggaatggcgcgttgggaggtcctaaagcacacagaaaactgcagacacatccgagtttggcttcacaggggtctaaaaagtccaagtctagctcaaaatcaacgaccagccagattccactccaggcccaggaagactgttgtgtgcactgcatcctgtcttgcctcttctgcgaatttctaacactatgcaacatcgttctcgactgtgccacatgtggttcatgttcatctgaggattcttgtctatgttgctgctgttgcggttccggcgaatgcgcagactgtgacttgccatgcgacctcgactgcggtatcctggacgcatgctgcgagtcagctgattgcctggagatatgcatggagtgttgcggtttgtgctttagcagctag

SEQ ID NO: 196136 - DNA, 729 bp, Artificial Sequence
  Description of Artificial Sequence: Synthetic coding sequence
atgatgatggacctgttcgagaccggcagctacttcttctacctggatggggaaaatgtgacgctgcagcctcttgaagtggcggagggtagccccctctatcccggttccgacggcactcttagcccctgccaggaccagatgccgcccgaagctggttctgattcaagtggcgaggagcatgtgttggctccccctggacttcaacccccgcactgtcctggtcaatgcctgatatgggcatgcaagacgtgtaagaggaaaagcgctcctacggatagaagaaaagcggcaacattacgagaacgaagacggttaaagaagattaatgaggcttttgaggcacttaagaggcgtactgttgccaatccgaaccagcgtctgccaaaggtagagatcctacggagcgcaatctcttatatcgaaaggctgcaggatctcctgcacaggttagatcagcaagagaaaatgcaggaattgggcgtggatccttttagctaccgtcctaaacaggaaaaccttgagggagcggacttcttgagaacttgttcttctcaatggcccagcgtgagtgatcactcgagaggattggtgattaccgctaaagagggcggcgcctcgattgactcaagcgcgagctccagcctccgctgcctgagttctattgtggactccatttcctccgaggaacggaagcttccatgcgtagaggaggtggtggaaaaatag

SEQ ID NO: 196137 - DNA, 1527 bp, Artificial Sequence
  Description of Artificial Sequence: Synthetic coding sequence
atgacccagaccctgaagtacgccagccgggtgttccaccgggtgcgatgggctccagaattgggcgcctccctggggtaccgcgagtaccactctgcacgcaggagcctagcggacattcctggtccatcaacaccttctttcctcgctgaactgttttgcaagggcggactgtcgcggctgcacgaactacaggtccagggcgccgcacacttcggaccagtttggcttgcatcattcgggaccgtccggaccgtatatgtagctgcacccgccctggtggaggagttgctcagacaggagggtcctagacctgagaggtgctcattttccccgtggactgagcaccgccgctgtagacagcgtgcctgcgggttgcttacagccgagggggaggagtggcagcggctgcggtctctattggcccccctgctcctgcggccacaagctgctgccaggtacgcaggaactttgaacaatgtcgtatgtgacctggtcaggagacttagacgacagcgggggcggggaacaggaccacccgctttggtgcgggacgtggccggtgagttctataagttcggtttagagggtattgctgccgtgcttctcggcagccggctgggatgcctggaggcacaggtccctccagacacggagacctttattagagctgttggaagtgttttcgtgagcacactgctgacaatggcaatgccacattggttacgccacctcgtgcccggaccttgggggaggctctgtcgagattgggaccaaatgtttgcatttgctcagcgccatgtggaacgtagagaggcggaggcagcgatgcgcaatggaggccagccagaaaaggatctagaatctggggctcacctcacgcactttctgtttagagaggagctgccagcacagtcaatcttgggcaacgtcactgaactgctcctggctggagtggacacagtctctaatacactgtcctgggctctttacgagctgtcgcgacacccagaggtgcaaacagcattgcattctgagatcacagccgctctgtctccagggagctccgcctacccttctgctaccgttttgagccaacttcctctgctcaaggccgtggtcaaagaggtcctgaggctgtaccctgttgtccccggtaattcaagagtccctgacaaggacattcatgtgggcgattatattattcctaaaaataccttagtcacactctgtcactatgcaactagtagagatccagcgcagtttccagagccaaattctttcaggcctgcacggtggcttggtgaaggaccaactccccatccatttgcatcactcccatttgggtttgggaagaggtcatgcatgggacgaaggctggccgaactcgagctccaaatggcgctggcgcagatccttacgcatttcgaggtgcagcctgagcccggagcagcacctgtaagacctaaaaccaggacagtactcgtgccagaaagaagtattaatctgcagtttttggatcgatag

SEQ ID NO: 196138 - DNA, 675 bp, Artificial Sequence
  Description of Artificial Sequence: Synthetic coding sequence
atggagctgtacgagaccagcccctacttctaccaggagccccggttctacgatggagagaattatctccccgtgcaccttcaagggtttgaaccaccaggttatgaacgtacagagttgacgctgagccccgaagctcccgggcctttggaagataagggcctcgggacgcctgagcactgtccgggccaatgcctcccttgggcttgcaaggtgtgcaagagaaaaagtgtgagtgtggacaggcggagggcggccaccctgagagagaagcgacgtctgaagaaggtgaatgaggccttcgaagccctgaagaggtctaccctcttgaaccctaaccagaggcttcctaaagttgaaatcttaaggtcagcaatacagtacattgaacgcctgcaggcccttttgtcaagcctgaaccaggaggagcgcgacttgaggtacagaggtggcggcggtccacaacccggggtgccaagcgagtgcagttctcacagcgcctcatgctctccggaatgggggtcagccctcgagtttagtgccaacccgggggaccaccttttaacagcggacccgacagacgcccacaacttgcactctctaacaagcatcgttgattctattacagtggaggatgtttctgtagcttttccagatgagacgatgccaaactag

SEQ ID NO: 196139 - DNA, 465 bp, Artificial Sequence
  Description of Artificial Sequence: Synthetic coding sequence
atgggcctgagcgacggcgagtggcagctggtgctgaacgtgtggggcaaggtggaagcggatatcccgggacatggccaggaggtgcttatcagactttttaagggtcaccctgagaccctggaaaaatttgataagttcaaacatctcaaatctgaggatgagatgaaagcgtccgaggacctgaaaaaacacggagctaccgtgctaaccgctctcggcggcattttgaagaagaagggccaccacgaggctgaaattaaaccgctggctcagtcacatgctacaaagcataagatccctgtaaagtatctagagttcatctccgagtgtataatccaggtgttgcagtcaaaacatcctggcgactttggtgccgacgctcaaggcgcaatgaataaagcattggagctgtttcggaaagacatggcatccaactacaaggaactaggctttcagggctag

SEQ ID NO: 196140 - DNA, 465 bp, Artificial Sequence
  Description of Artificial Sequence: Synthetic coding sequence
atgggcctgagcgacggcgagtggcagctggtgctgaacgtgtgggggaaagtcgaagccgatatccccggacatggacaggaagtactgattaggctgtttaaaggccacccagagacactcgaaaaatttgacaagtttaagcacttgaagtctgaggacgaaatgaaggccagcgaggatctcaagaaacacggagctaccgtgctaacagcattgggggggattctcaaaaaaaaaggacatcatgaagctgagattaagcccctggcacagtctcacgccaccaagcataaaatacctgtcaagtacctggaatttatcagcgaatgtataatccaggtgctgcagtcaaagcaccctggagactttggcgccgatgcacagggcgccatgaacaaggctctcgagctctttcgaaaggacatggccagcaactataaagagctggggtttcagggttag

SEQ ID NO: 196141 - DNA, 465 bp, Artificial Sequence
  Description of Artificial Sequence: Synthetic coding sequence
atgggcctgagcgacggcgagtggcagctggtgctgaacgtgtggggcaaagtcgaagccgatattccgggtcatggtcaggaggtgctgatcagactctttaagggacacccggaaaccctggaaaagtttgataaatttaaacatttgaagagtgaggatgagatgaaggctagtgaagacctcaagaaacatggtgcgacggtgctcactgccctgggggggattctcaagaagaaggggcatcacgaggctgaaattaaaccactagctcaaagtcacgcaacaaagcataagatccctgtgaagtatctggagttcatttctgagtgcatcatacaggtgctccagtccaagcatccaggagatttcggcgccgatgcgcaaggcgcaatgaataaggcgctagaactgttcagaaaagatatggcctcaaattataaagaattagggtttcagggctag

SEQ ID NO: 196142 - DNA, 465 bp, Artificial Sequence
  Description of Artificial Sequence: Synthetic coding sequence
atgggcctgagcgacggcgagtggcagctggtgctgaacgtgtggggcaaagtggaggcagacattcccggccatggtcaagaggtactgattcgactgtttaaggggcaccctgagacactcgaaaagttcgataagtttaagcacctgaagtcagaggatgagatgaaggcttccgaggatctcaagaagcacggggctaccgtgctgaccgctcttggagggatcctgaagaaaaagggccaccatgaagccgaaatcaaaccactcgctcagtcccacgccaccaagcataagatcccagtcaagtacctcgagtttatttccgaatgtattattcaagttctccaaagcaaacatcccggtgattttggcgcagatgcccagggagcaatgaacaaggcgctggaactgtttcggaaagatatggcaagcaactataaggagcttggctttcaggggtag

SEQ ID NO: 196143 - DNA, 234 bp, Artificial Sequence
  Description of Artificial Sequence: Synthetic coding sequence
atgggcctgagcgacggcgagtggcagctggtgctgaacgtgtggggcaaggtagaagccgatattcctggtcacggacaggaggttctaattcgcctttttaagggtcaccccgaaaccctcgagaaatttgataagtttaagcacctgaagtcagaagacgaaatgaaggctagcgaggacctaaagaagcacggcgccactgtactcaccgccctggggggcatactctag

SEQ ID NO: 196144 - DNA, 432 bp, Artificial Sequence
  Description of Artificial Sequence: Synthetic coding sequence
atgggcctgagcgacggcgagtggcagctggtgctgaacgtgtggggcaaagtggaagctgacatcccaggtcacggacaggaagtgctcatacgactgttcaagggccatccagagaccttagaaaagtttgacaagtttaagcacctaaagtctgaggacgaaatgaaggcttcagaggacctcaaaaagcacggtgccacagtgctaaccgctctcggtggaatattgaaaaagaaggggcatcacgaggccgaaattaagcccctggctcaatcccatgcgacaaaacacaagatcccggtcaagtatctggaattcatttcagagtgtattattcaagtgctgcagtccaaacatcctggggattttggggcagacgcccagggggccatgaacaaagctctcgagttgtttcgaaaggatatgtag

SEQ ID NO: 196145 - DNA, 321 bp, Artificial Sequence
  Description of Artificial Sequence: Synthetic coding sequence
atgggcctgagcgacggcgagtggcagctggtgctgaacgtgtgggggaaagtcgaggccgacatccccggccacggccaggaagtgttgataaggctcttcaagggacatcctgaaacgctagaaaagtttgataagttcaagcacctgaagtcagaggacgagatgaaggcctccgaggatctcaagaagcacggggccacagtgctcaccgctctcggaggaattctcaagaagaagggtcaccatgaggccgaaatcaagcccctggcccaatctcacgcaacaaaacacaagattcctgtgaagtatcttgaatag

SEQ ID NO: 196146 - DNA, 321 bp, Artificial Sequence
  Description of Artificial Sequence: Synthetic coding sequence
atgggcctgagcgacggcgagtggcagctggtgctgaacgtgtggggcaaagtggaggccgacatccctggccacgggcaggaagtgctgatccggctcttcaagggccacccagaaacactggaaaagttcgacaagtttaagcaccttaagagtgaggacgaaatgaaggccagcgaggatctgaaaaaacatggcgcaaccgttctaacagccctgggggggattctgaaaaagaaagggcatcacgaagcagagatcaagccactcgcgcagtcacatgccaccaaacataaaatcccggttaagtatcttgaatag

SEQ ID NO: 196147 - DNA, 411 bp, Artificial Sequence
  Description of Artificial Sequence: Synthetic coding sequence
atggccgtgggcgccgagcggctgggcgaggtgctgatccggctgttcaaaggtcaccctgagactttggagaagttcgacaagttcaagcatctcaagtccgaggacgagatgaaggcaagtgaggacctgaagaaacacggagccactgttctcactgcgcttggggggattctgaagaagaaaggacaccacgaagccgaaatcaaacctttagcacaatctcatgctaccaaacacaagattcctgtcaaatacctcgagttcatctccgaatgcataatccaggttctgcagagcaagcatcccggggatttcggagctgacgcccaaggcgccatgaataaagctctggaactctttagaaaggatatggcgtccaactacaaagaactcggtttccaggggtag

SEQ ID NO: 196148 - DNA, 4398 bp, Artificial Sequence
  Description of Artificial Sequence: Synthetic coding sequence
atgagcctggtgaccgtgcccttctaccagaagcggcaccggcactttgatcaatcttaccggaatatacagactagatatcttttggacgagtacgcttcaaagaagcgggcctctacgcaggcttcctcacaaaagagtctgtcccagcgtagctctagccagagagcttcctctcagacgtcgttgggtgggactatatgcagagtttgtgccaaacgtgtcagcactcaagaggatgaggaacaggaaaacagatccagatatcagagtctggtggctgcatacggcgaggccaaaagacaaagattcctgtctgagttagcgcacctagaagaagatgtacacctcgcacgatcgcaggccagggacaagttggacaagtacgctatacagcagatgatggaagacaaactggcctgggaacgccacacattcgaagaacgcatcagcagggccccggagattcttgtccgcttgagatcacacaccgtgtgggaaagaatgagcgtgaagctgtgcttcactgtgcagggctttccgactcccgttgtgcagtggtataaggatggttcactaatctgtcaggccgcggaaccaggcaaataccggattgagtctaattatggcgtccacacgctagaaattaatagagctgatttcgatgacacagcaacctactcggccgtcgccaccaatgcccacggccaggtgagtaccaatgctgccgtcgtggttcgtaggttccggggcgacgaagagccgttcaggagcgtcggtctgcccataggcctccctctcagctctatgatcccatatacccatttcgatgtgcagtttctggagaagtttggcgtgacatttcggcgagagggggagacggtcacattgaagtgtaccatgctggtgacgcctgacttaaagagggtgcagccgagggccgagtggtacagagatgatgtgctcttgaaagaatcaaaatggaccaaaatgtttttcggagagggacaagcttcactctccttcagtcatctccacaaggacgacgaggggttgtatactctgcggatagttagtaggggtggtgtctctgaccactctgcttttctctttgtccgggatgccgatccgttggttactggagcaccaggcgctcctatggatctccagtgccatgatgctaatcgggattacgtaatcgtgacctggaagccgcccaacaccaccaccgagagccccgttatgggctatttcgtcgacaggtgtgaagtagggaccaataattgggtgcagtgtaatgatgctcccgtgaaaatctgtaaataccctgtcacaggtctgttcgagggtagatcctatatctttagggttcgcgccgttaattctgctggaatatcccgcccttctcgagtctcagacgccgtggccgcccttgacccactggatctcagaaggttgcaagcggtgcacctcgaaggcgagaaagaaattgcgatctaccaagacgacctggaaggtgacgctcaggtgcctggaccacccacaggagtgcatgcttctgagatttccaggaattatgtcgtactgagttgggaaccaccgacaccacgtggtaaggaccccctgatgtacttcattgagaagagtgtagttggatctggcagttggcagcgtgtgaatgcccagactgccgtgaggtcacccaggtacgccgtctttgatctgatggaaggtaaatcctatgtgtttcgggtcctgtccgcgaatagacatggtctgtccgagccttctgagataacttcacccatacaagcacaggacgtgactgttgttccatcagctcccggacgagttctagcctcaaggaataccaagacatccgtcgtggtgcagtgggaccgacctaagcacgaggaggatctcctgggctattatgttgactgctgtgttgcaggaaccaatctgtgggaaccgtgtaatcataaaccaatcggttacaataggtttgtggtgcacggcctgactacaggtgaacagtacatcttccgcgtaaaagccgtgaacgcagtggggatgagtgaaaatagccaggaatccgatgtgatcaaagtgcaagcggcgcttactgttcctagccacccttatggaataactctccttaattgtgatgggcactccatgaccctgggttggaaggtccctaaattctccgggggatctcccattctcggatattacctggacaagcgggaagttcatcataagaattggcacgaggttaactcctcacccagtaaacccaccatattgactgtcgacggcctaacggagggatccttatacgagttcaagatcgctgctgtgaatttggccggaattggcgagccaagcgatccgtccgagcactttaaatgcgaagcctggaccatgcccgaaccgggaccggcctacgacctaactttttgcgaagtgcgtgatacttccctcgtgatgttatggaaagccccggtgtacagtgggtcatcacccgtctcaggctattttgtggactttcgtgaagaggacgccggagagtggattacagtgaatcagaccacaaccgccaatcgttacctgaaggtgtcagacctgcagcagggaaaaacatatgttttccgtgtccgcgcagtcaatgccaatggtgtaggaaaaccttctgacaccagtgagcctgttctggtcgaggcacgacctgggacaaaggagataagtgccggggtggacgaacaggggaatatatacctgggattcgactgtcaggaaatgaccgacgcttcccaattcacgtggtgtaagtcttacgaagagatctccgatgatgagaggtttaagatcgagaccgtgggcgaccacagtaaactttatctgaagaacccagataaggaggacctgggcacctatagcgtgtctgtgagtgacactgatggagtgtcttcctcatttgtgctggaccctgaagagctcgaacgtttaatggccctttctaatgagattaagaacccaacaattcctctcaagtccgagctcgcatatgaaatttttgataaagggcgggtccggttttggctgcaagcagaacatttaagccccgacgcctcttatcggttcatcataaacgaccgggaggtgtctgactcagaaattcaccgcatcaagtgtgacaaagcgaccggaattatcgagatggtgatggatcgcttcagtatagagaatgagggcacttataccgttcaaatccacgacggaaaggctaagagccagtccagcctggtgctgatcggtgatgccttcaagaccgtccttgaagaagccgaattccagagaaaggaatttctcaggaagcaggggccccatttcgcagaatacctgcactgggatgtcacagaagagtgcgaggtacgtttagtttgcaaggtcgccaatactaaaaaggaaactgtgtttaaatggctgaaggatgatgtgctgtatgagactgagacactgccgaacctggagcgcggcatttgtgagctcctgattcccaaactgtcgaagaaagaccacggagagtataaggccacgttgaaggatgaccggggtcaggacgtatctattctcgaaattgcggggaaagtctacgatgacatgatcttggcgatgtccagagtgtgtggtaaatctgcttccccgctgaaagttctgtgtaccccggaggggattcggctgcagtgctttatgaaatactttaccgacgaaatgaaagttaactggtgccataaagatgcaaaaatctcaagcagtgagcacatgaggattggcgggtcagaggaaatggcgtggctccagatctgtgagccaactgagaaagataaagggaagtatactttcgaaatctttgacggcaaagacaatcatcagcgcagcctagatttgagcggccaagcctttgatgaagccttcgctgaatttcaacaattcaaggccgcagcatttgccgaaaaaaatagaggccggcttattggcggcttgcccgatgtggttaccatcatggagggtaagacgttgaaccttacttgtactgttttcggaaatcctgaccctgaggtaatttggttcaagaatgatcaagatatccagctgagcgagcacttctcagtgaaggtagagcaggcaaagtatgtttcaatgaccattaagggggtgacaagcgaagactccggaaagtacagcatcaacatcaaaaataaatatggaggcgagaagatcgacgttactgtatcagtctataaacacggcgagaaaataccagatatggcacctccacagcaggccaaacctaagctgatccccgcaagcgcgtcagcagctgggcagtag

SEQ ID NO: 196149 - DNA, 3420 bp, Artificial Sequence
  Description of Artificial Sequence: Synthetic coding sequence
atgcccgagcccaccaagaaggaggacgaggaggaggtgagcccccccagcgctctgccccctgactggaccctagtggaaacacccccgggggaagaacaggccaaacaaaacgctaattcccagctgtccatcctgttcatcgaaaaaccccaggggggcacagtgaaagttggggaggatattacctttattgcaaaggtaaaagctgaggaccttctgagaaaaccaacaatcaagtggtttaaaggaaaatggatggacttagcctccaaggccggcaagcacctgcagttgaaggagacatttgaaagacattccagagtttatacctttgagatgcaaattattaaagccaaagacaactttgcaggcaactacaggtgcgaagtgacctacaaggataagtttgactcatgttcttttgatctggaggtccacgaatctaccgggacaacacccaatattgatatcaggagcgccttcaagaggtccggcgagggacaggaggacgcaggggagcttgatttttcgggactactgaagcgtagagaggtcaagcagcaggaagaggagccccaggtcgacgtgtgggagctgttgaagaacgccaagccgtcagagtacgaaaaaattgccttccaatacgggatcaccgaccttcgaggtatgctgaagcggcttaaaaggatgcgtagggaagaaaagaagtccgccgcattcgctaagatccttgatccggcatatcaggtggacaagggcggacgggtgaggtttgtggtggaattggctgatcccaaattggaggttaagtggtacaagaacggtcaggaaatcaggccctccaccaaatatatctttgagcataaggggtgccaaaggatcttattcatcaacaactgtcagatgaccgacgattccgagtactacgttacagcaggagatgagaagtgttctacggaactttttgtaagggagccccccatcatggtcaccaagcagctcgaagacaccaccgcctactgcggtgaacgggtggaactggagtgcgaggttagtgaggatgacgctaacgtgaaatggttcaaaaacggcgaggaaattatcccggggccaaaatctcgttataggatacgagtggagggcaagaagcacattctgattatcgaaggagctacaaaggcagacgccgctgaatattccgtcatgaccaccggagggcagtcctcagccaaactgagcgtggacctgaaaccattgaaaatcctgacacctctgacagaccagacagtgaacctgggtaaagaaatctgtcttaagtgcgagatatcggaaaacatcccagggaaatggaccaagaacggcctacccgtccaggaaagcgacaggctaaaagttgtccacaaaggaaggattcacaaactggtcatcgccaacgccctcaccgaggatgagggcgactacgtttttgcacccgatgcttacaatgtgaccctcccagcaaaggtacacgtgatcgaccctccaaaaatcattctggacggtttggacgctgataacacagtcacagttatcgcggggaacaagctgcggctggaaatccctataagtggagagcccccacctaaggcgatgtggtcaaggggagacaaggctattatggaaggcagcggacgcattcgcaccgaatcttacccagacagcagtaccctggtcatagatatcgctgagcgggacgacagcggagtctaccacattaatctcaagaatgaggctggagaagcccacgccagtatcaaggttaaggtcgtagacttcccagacccccccgtagcccctacagtgacagaggtgggcgacgattggtgcattatgaactgggagccacccgcatacgatggcggtagcccaattctgggttatttcatcgagaggaaaaagaagcagtccagtaggtggatgagattgaattttgacctttgtaaagaaacaacgttcgagccaaagaagatgatcgagggggtcgcttacgaggtacgtatcttcgcagtgaatgccatcggcatctctaaaccttccatgccctctcggcctttcgtgcccctggcagtgacgtcccctccgactttactgaccgtagactccgtgaccgacaccacggtgaccatgcggtggaggccgccggatcatatcggcgcagctggcttggatgggtatgtcctggagtactgtttcgaggggacggaagattggattgtggccaataaggatctgattgataaaaccaaattcacaattacaggcctgccaacggacgcaaaaatctttgtgagagtgaaggctgtgaacgccgccggagcctccgagcctaaatactacagtcaacctatcctggtaaaagaaataattgaaccacccaagattcggatacccaggcatctcaagcagacctacatccgaagggtaggggaggcagtcaatctcgtcatccccttccaggggaagccccgaccagagctgacatggaaaaaggacggtgccgagattgataagaaccagatcaacattcgtaattcagaaacagacaccattattttcattcgaaaagctgagcgttcccactctggaaagtacgaccttcaggtgaaggtggacaagttcgtggaaaccgctagcatagacattcagatcatcgacaggcctggcccaccacagattgttaaaatcgaagatgtatggggggaaaacgtcgctctcacttggacgccccctaaggacgacgggaacgcagcaattaccgggtacacaattcagaaagcagacaagaaatcgatggagtggtttaccgttatcgaacactaccatcgtacctctgccaccattacggaactcgtcatcggcaatgagtactattttcgagtattttcagagaatatgtgcggcctgtccgaggatgctacgatgacaaaggaatccgccgtgatagcaagggacggaaaaatctataaaaaccccgtctatgaggacttcgacttcagtgaggctcctatgtttacccagcctctagtcaatacttatgctatcgctggctataatgctactctgaattgttccgtgaggggaaacccaaaacccaagattacatggatgaagaacaaggtggcaattgtggatgatccacgttatcgcatgttttctaatcagggggtctgcaccctcgagatccggaagcccagcccttatgacgggggtacttactgttgcaaagctgttaacgacctgggtactgtggagattgaatgtaaactggaggtaaagggcggcctttcattctgcaggctattactgcaaggagtgccccccaacattatagactcctacctcagagacctgcacagcagtaaccctgaggagtactag

SEQ ID NO: 196150 - DNA, 3522 bp, Artificial Sequence
  Description of Artificial Sequence: Synthetic coding sequence
atgcccgagcccaccaagaaggaggagaacgaggtgcccgcccccgcccccccacccgaggagccaagcaaggagaaggaggctggaaccacccccgccaaagactggacacttgtggagactcctccaggcgaggaacaggccaagcaaaatgctaatagccagctgtccatcctttttattgagaagccccagggcggtaccgtcaaggtcggggaagatattacctttattgctaaagtgaaggccgaggacttgctgcgcaaacctaccatcaaatggttcaagggcaagtggatggacctggcctcaaaggccggcaagcacctgcagttgaaggaaacctttgaacgtcatagcagagtctacacgtttgagatgcagatcatcaaagctaaagataacttcgccggaaactaccggtgtgaagtgacctacaaggataagttcgacagctgcagttttgatctggaggtccatgagtccacagggaccactcccaatattgacattaggagcgcctttaagcgttcaggtgaaggccaggaagatgccggcgagctggatttctccggcctcctcaagcgcagggaggtgaaacagcaggaagaggaacctcaagtggacgtgtgggagctgctgaagaacgccaagcccagcgaatatgagaagatcgccttccagtatggtattaccgacctcagggggatgctgaaacggctcaagcgcatgcgccgtgaggagaaaaaatctgccgcatttgctaaaattctcgatcctgcgtaccaggtcgataaggggggcagagttagattcgttgtggaactagccgatcctaagctggaagtcaagtggtacaagaacggtcaagaaatcagaccatcaacgaaatacattttcgagcacaagggttgccaaaggatcctgtttatcaataattgccagatgaccgatgatagcgagtattacgtcacagccggagatgaaaaatgctccactgagctgttcgtgagggagccaccaataatggtaaccaaacaactggaggacacaactgcatactgcggcgagagagttgagttggagtgcgaggtaagtgaagacgatgctaatgttaagtggttcaagaatggcgaggagatcatcccaggacccaagagcagatacagaattagagtggagggtaaaaaacatatcctgatcatcgaaggagcgacaaaagccgatgccgccgagtacagcgttatgactaccggagggcagtcgtcagcaaagctgagcgtggaccttaagcccctgaaaattcttacccctctgacagaccagaccgtaaatctggggaaagagatttgtcttaagtgcgaaatcagcgagaacattcctggcaaatggacgaagaacggcctgcctgtgcaggagtctgaccgattgaaggttgttcataaggggcggattcataagcttgtgatagcaaacgccttaaccgaagacgagggcgactacgtatttgcacctgatgcctacaatgtcacattgccggcaaaagtgcacgtaattgatccccccaagattatacttgatggcctggatgctgacaacaccgttacggtaatcgccgggaacaagctacgcttggagattcccatttccggagaaccgcctccaaaggccatgtggagcaggggagataaggctatcatggagggatccggccgtatcaggaccgagtcgtatccagattcctctactctggtgatagacattgccgaacgagacgactcgggggtctatcacattaatctaaagaacgaggctggggaagcccatgcctccattaaagttaaagtcgtagacttcccggacccaccggtggcccctaccgtaactgaagtaggtgacgactggtgtataatgaactgggaacctcccgcctacgatgggggatccccgattctgggctactttatcgagcgaaagaaaaaacaatcctctcggtggatgagacttaactttgacctgtgtaaagaaacaacctttgagcccaaaaagatgattgaaggagttgcttacgaagtccgcatcttcgcggtgaatgctatcgggatcagcaagccatcaatgccaagcaggcccttcgttcctctggccgtgaccagcccccccaccctgctaaccgtagatagcgtcacagatacgactgtgacaatgcgatggcgccctcccgatcacattggagccgctggtctcgacggctacgttctagaatattgttttgaaggcagtactagcgcgaaacagtcagacgaaaacggcgaggctgcctacgatctccctgcagaagattggatcgtagctaacaaagacctgatcgataaaactaagtttacgatcactggactgcccacagatgctaagatcttcgtgcgtgtcaaagcagttaacgccgcaggcgccagcgaacctaaatactactcgcagcctatcctcgtcaaggagattatagagccaccaaaaattagaatccctcgtcatctcaaacagacttacataagacgggtgggggaggctgtgaacctggtgatcccctttcagggtaaacctcgaccagagttaacgtggaaaaaagacggtgcagaaatcgataagaatcagatcaatatcaggaattccgagacagatactattatctttattagaaaagcagaacgatctcactcaggaaagtacgacttgcaagttaaggtggacaaatttgtcgagaccgcttcaattgacatccagatcattgacagacctggtcccccccagatcgtcaagatagaagatgtctggggtgagaacgtagctctgacatggactcctcccaaagacgatggcaatgctgctattacaggatataccatccagaaggctgacaagaagtctatggagtggtttacagtgatagaacactaccaccggacatcggcaaccattaccgagctggtcatcgggaatgagtattatttccgcgtctttagcgaaaacatgtgcggactgtccgaggacgctacaatgacaaaagagtccgccgtgatcgcccgagacgggaaaatatacaagaatccggtgtatgaagacttcgactttagtgaagcacctatgtttactcagccgctagtaaatacatacgccatagcaggctacaacgccacactaaattgtagcgtgcgcgggaacccaaagcctaagattacctggatgaaaaataaagtggctatcgtcgacgaccctagatatcgaatgtttagcaatcagggtgtgtgtacgctggaaattcgaaaaccatcaccttatgacgggggcacttactgttgtaaggcagttaatgacctcgggacagtggagatagagtgcaagctggaagtaaaggtgatctatcagggggtgaatacaccaggacaaccagtatttctggagggtcaacagcaggttgggagccccagcgccgactcctcttgcaaggcctacctccagacctag

SEQ ID NO: 196151 - DNA, 3384 bp, Artificial Sequence
  Description of Artificial Sequence: Synthetic coding sequence
atgcccgagcccaccaagaaggaggagaacgaggtgcccgcccccgcgccccctcccgaagagccgagcaaggaaaaggaagccgggacaacacccgccaaggattggaccctagtggaaactccaccaggagaggaacaagcgaagcagaacgccaacagtcaactgtctatcctattcatagagaagccacaggggggtactgtgaaggtgggcgaggacattactttcatcgctaaagtaaaagcagaagatctgttaagaaaaccaacaatcaaatggtttaaaggcaagtggatggatttagcgtccaaggccgggaaacacctgcagttaaaagagaccttcgaaagacactcacgtgtctatacattcgaaatgcagattataaaagccaaggacaattttgccggcaattacagatgcgaggttacttacaaagataagtttgattcatgctccttcgaccttgaggtgcacgaatccacaggcaccacccctaacatcgatatccggtcagcctttaaaaggagagaagtcaaacagcaggaagaagaaccccaggttgatgtctgggagctgctaaaaaacgccaaaccctccgaatatgagaaaatcgcatttcagtacgggataactgatctgcgagggatgctcaagcgtttgaagcgcatgcggagggaagagaagaagagcgccgcttttgccaagatcttggatcctgcctatcaggtggataagggcggaagagttagattcgtggtggagctggccgatcctaaattggaagtgaaatggtacaaaaacggtcaggagatccggcctagcaccaaatacatcttcgaacacaaaggatgccagagaatcctgtttatcaacaactgtcagatgacagatgactccgaatattacgtgaccgccggggatgagaagtgctcaaccgagctcttcgttcgcgagcctccaatcatggtgacgaagcagctcgaggataccaccgcctactgtggtgagagagtagagttggaatgtgaggtgagcgaagatgatgcaaacgtgaaatggttcaaaaacggggaggagatcatccctggccccaaatctcgctacaggatccgcgtggagggaaaaaagcacatcctgataatagaaggggccaccaaggccgacgccgcggagtattctgtcatgacgaccggcggacaatcttctgccaagctttctgtagatctcaagcccctgaagattctcaccccgttgactgaccaaactgtgaatctggggaaagagatatgcctcaaatgcgagatttcggagaacataccaggtaagtggaccaaaaacgggctgccagtccaggagagtgatcgcctgaaggtagtgcacaaaggtcggattcataagctcgtgatcgccaacgcactgactgaggacgaaggcgactatgtttttgccccagacgcatataacgtcacactgccagctaaagtgcacgtgatagacccccccaagatcatcttggatggactagatgccgacaatacagtgaccgtgattgccggcaacaaattaaggctggaaatacctatttctggcgagcccccaccaaaagccatgtggtctcgcggcgataaagccatcatggaagggtctggccggattagaacggagtcttacccggactcgtctactctggttattgatatcgctgaacgcgatgatagtggagtttaccatatcaatctgaagaatgaggcaggcgaggcccacgcttcgattaaggttaaagtggtggactttccagacccacccgtggcgcccaccgtgactgaagtgggtgatgactggtgcatcatgaactgggagccacctgcctacgacggtggatccccaatcctcgggtattttatagagcggaagaaaaagcaaagtagcagatggatgagactgaatttcgatctgtgcaaggagacaacctttgaaccaaaaaaaatgattgaaggcgtagcctatgaagtgcgtatcttcgctgtgaacgctatcggcatctcaaaacctagcatgcccagccgaccatttgtcccactggctgtaacctccccccctacgctgctaacagtggacagtgtgacggatacaacggtgactatgcggtggcggccacctgaccatatcggtgctgctggacttgacggatacgtcctggagtattgctttgaaggtaccgaggattggatcgtggcgaacaaggatctcatcgacaaaacaaaattcacaattaccgggctcccaactgacgcaaaaatcttcgtcagagttaaagccgtgaacgccgccggcgccagcgagccgaagtactactcacagcccatattggtgaaggagatcatcgagccaccaaaaatccgcatcccaaggcacttgaaacagacatatatcagaagggtgggagaggctgtgaaccttgtgatccccttccaaggcaagccccgaccagagctgacctggaaaaaggacggagcagaaattgataagaaccaaattaacattcggaattctgagaccgacaccattatttttatcaggaaagccgaacgttcacatagtggaaagtatgaccttcaagtaaaggtggacaagttcgtggagaccgcctcaatagatatccaaataattgacagacctgggccaccgcaaatagtcaagattgaggatgtgtggggagagaacgtggcattgacctggactccccctaaggatgatgggaacgccgctatcacagggtacaccatacagaaggcagacaaaaaatctatggaatggttcactgtgattgagcactaccaccgaacctcagccacaataacagaactagtcatcggaaacgaatactactttagagttttcagtgaaaacatgtgcggcctaagcgaggatgcaaccatgaccaaggaaagcgcagtcattgccagagacgggaagatatataagaacccagtctatgaagacttcgacttctcagaggctcccatgttcacgcagccactggttaacacttacgccatcgcaggctacaacgccaccctgaattgcagtgtaagggggaaccctaaacccaaaattacttggatgaaaaataaggtggccatcgtcgatgatccaagatatcgtatgttcagcaatcagggcgtgtgtacgctcgagattagaaagccctccccatatgacgggggtacatactgctgtaaggctgtgaacgatctggggactgttgaaatcgagtgcaagctggaggttaaggtcatctatcagggggttaatacacccggccagcctgttttcctggaaggacagcagcagagcttacataacaaggacttttag

SEQ ID NO: 196152 - DNA, 3363 bp, Artificial Sequence
  Description of Artificial Sequence: Synthetic coding sequence
atgcccgagcccaccaagaaggaggactggaccctggtggagaccccgcccggtgaggaacaggcgaagcagaacgctaacagccaactcagcatactgtttattgagaaaccacagggcgggacagtaaaggtaggggaggacattacatttattgctaaagttaaagcggaagatctgttacgaaaacctacaatcaaatggtttaaaggaaagtggatggacttagctagtaaggcagggaagcacctgcaactgaaagaaacgtttgagagacacagtagggtgtatacatttgagatgcaaataattaaagcaaaggataacttcgctggcaattaccggtgcgaagtcacatataaggacaagttcgactcatgttcctttgatctcgaggtccacgagagcaccgggactactccaaatattgatatcaggtcagcctttaaacgaagtggtgaagggcaagaggacgccggcgaattagatttctctggtctgctcaaaaggcgggaagttaaacaacaggaggaagagccgcaggtggacgtgtgggagcttctgaaaaatgccaagccgagcgagtacgagaagatcgctttccagtacggcattactgacctgcgcgggatgctaaagaggctgaaaagaatgagaagggaagaaaaaaagtccgcagcctttgcgaaaattcttgatcccgcgtatcaagtcgacaaaggtggtcgggtgagatttgtggtagaactagctgaccccaagctggaggtaaaatggtataagaatgggcaggaaatacgccctagcactaagtatatcttcgagcataaaggatgccaacggatattgtttataaataactgccagatgactgatgatagtgagtattacgtgacagcaggcgacgagaagtgtagtaccgagctgttcgtgcgcgagccgcctatcatggtaacaaaacagctggaggacaccaccgcttactgtggcgagcgtgtagagctggagtgcgaggtgagtgaggatgacgcaaatgtgaaatggttcaagaatggcgaagagattattcctgggccaaaatctcgatacaggatccgcgtggagggcaagaagcacattttgattatcgaaggagcgacgaaagccgacgccgccgagtattccgtgatgacaacgggcggacagtcgtccgcaaagttgtccgtggatctcaaacccctaaaaattttaacacccctcactgaccaaactgtcaatcttggcaaggagatctgtttgaagtgtgaaatatcagagaacatccctgggaagtggactaagaacggtctgcccgtacaggagtctgatagactgaaggtggttcataaggggcgtatccacaaactggttatcgccaatgctctgactgaagacgaaggagattatgtctttgctcctgacgcgtacaatgtcaccttaccggcgaaggtgcacgtgattgatccgcctaagattatcctggatgggcttgatgccgacaatacagtgacagtcattgcaggcaacaagctgaggctggagatcccgatttccggcgagcctccaccaaaagctatgtggagccgcggggacaaggccattatggagggctcggggagaatccgcacagaaagctatccagattcttctaccctggtaatcgatatcgccgagagagatgacagcggagtgtaccatattaatctcaaaaatgaagccggtgaagctcacgcatcaattaaggtcaaggtggtcgacttccctgatcctcctgttgcaccgactgtgactgaagtcggtgacgactggtgcattatgaactgggaacctccagcctacgatggtggatcaccaatacttgggtattttatcgagcggaaaaagaaacaatcctcacgatggatgaggctcaacttcgatctctgcaaagaaactactttcgaacctaaaaaaatgattgaaggagtggcttacgaggtccgtattttcgccgtgaatgccatcggaatctccaaaccatccatgccctcgcgcccttttgttcctctagcagtgacttccccaccgacccttctgacagtagactccgtgactgacaccaccgtgaccatgcgctggcgaccaccagaccacatcggcgcggccggcctggatgggtatgtcctggagtactgtttcgaaggcaccgaggattggatcgtggcgaacaaagacctaattgataagaccaagttcactatcacagggttacccacagacgcgaaaatctttgtccgagtgaaagccgtaaatgccgccggggcttctgaaccaaaatattacagccagcccatacttgtaaaggagatcatcgagcccccgaagattcgtatacctcgacacctcaagcagacttacatccggagggttggagaggctgtgaatctggtaattcctttccagggaaagcctcggccagaattgacctggaagaaggatggagctgagattgacaagaaccagattaatatccgcaactctgagactgacactataatcttcatccgaaaagccgaaagatcgcattccggtaaatatgatttgcaagtcaaagtcgataaattcgttgaaaccgcttcaattgacatccaaattatagaccgccccgggccgccacaaattgttaagatcgaagacgtctggggtgagaacgtggcattgacgtggactccccctaaggatgacggcaacgctgccattactgggtacaccatacaaaaagccgacaagaaatccatggaatggtttactgttatcgagcactatcaccgcaccagcgcgacaattactgaactcgttatcggcaatgaatactacttcagagtcttttcggaaaacatgtgtggactgtcggaggatgctaccatgacaaaggagtctgcagtgattgcccgcgatggaaaaatttataaaaatcccgtatatgaagacttcgatttcagtgaagcccctatgtttactcagccacttgttaatacatacgctatcgctggctataacgcgacccttaattgttctgtgcgcgggaaccctaagcctaagataacttggatgaagaataaagtggccattgtagatgatccgcgatacagaatgttcagtaaccagggggtgtgcacactagagattaggaaacccagtccctatgatggcggtacatactgttgcaaggccgtgaatgacctgggaactgtagagatagagtgcaagctggaagtgaaggtaatctatcagggggtaaacacacccggacagcctgtttttttggagggacagcaacaaagcctgcacaacaaggacttttag

SEQ ID NO: 196153 - DNA, 3399 bp, Artificial Sequence
  Description of Artificial Sequence: Synthetic coding sequence
atgcccgagcccaccaagaaggaggagaacgaggtgcccgcccccgctcccccacctgaagactggactctcgtggagacgccaccaggtgaggagcaagctaagcagaacgcaaacagccaactgtcaattctctttatcgaaaaaccacagggcggaaccgtaaaagtgggcgaggacatcacttttattgctaaagtgaaggcagaggatctgttgcggaaaccaaccatcaaatggtttaagggcaagtggatggacctggcgagtaaggctggtaagcacctccagctcaaagaaaccttcgaacgccactcacgtgtgtatacatttgagatgcaaattattaaggcgaaggacaatttcgcagggaattaccgctgtgaagttacctataaggacaagttcgatagctgttcatttgacttggaggtccacgagagcaccgggactacacccaatatcgatatccgctcggcgtttaaacggtcgggtgagggccaggaagacgctggggaactagacttcagcggcctgctcaagaggagggaagtcaaacagcaagaagaggagccacaagtggatgtgtgggaactgcttaaaaacgccaaaccgtccgaatacgagaagatagccttccagtacggtatcacggatttaagaggaatgctaaaaaggcttaagagaatgagacgtgaagagaagaagtcggcagccttcgccaaaatcctggatcccgcctatcaggtggataagggagggagggtgagattcgtggtcgaactcgccgatccaaagcttgaagtcaaatggtacaaaaatgggcaggaaattagacctagcactaaatacatctttgaacacaagggctgccagcggattctcttcattaataattgccagatgaccgacgactccgagtactacgtcacggcaggcgatgagaagtgcagtacagagttatttgtacgagagccccctattatggttacgaaacaattggaagacactacggcgtattgcggggaaagagtagagcttgaatgcgaagtgagcgaggatgacgccaatgtgaaatggtttaagaatggagaagagattatcccgggccctaagagtcggtaccgcatcagggttgaaggaaaaaagcacatcctgatcattgaaggggcgacaaaagccgatgctgcagagtacagtgtcatgacgactggcggacagtcatctgctaaactcagcgttgacttaaagccactgaagatcttgactccgttaaccgaccagacggtgaatctgggtaaggagatctgcctcaaatgcgagatcagtgagaacatccccggaaagtggaccaagaacggattgccagtgcaggaatctgatagattaaaggtcgttcacaaagggcggattcacaagttggttatcgccaacgccctaacggaggacgaaggtgattatgtctttgcaccagacgcttataatgtcaccctgccagcgaaagtgcacgttatcgatcctcccaagatcattctggatggactggacgctgacaataccgtgacagtgatcgccggtaataaactgagactggagattcccatctcaggcgaaccgcccccaaaggcgatgtggtcccgcggtgataaggccatcatggaggggagtgggcggatccgaacggaatcctaccctgacagcagtacgttggtgatcgatattgctgaacgcgacgattccggggtctatcacataaatctgaagaacgaggccggggaggcacatgcatccattaaagtgaaggtcgtcgacttcccagaccctcccgtcgcaccaactgtgaccgaagtcggtgacgactggtgcattatgaattgggagccccctgcctacgatggcgggtctcccatcttggggtacttcattgagaggaagaagaagcaaagctccaggtggatgagactgaatttcgatctgtgtaaagagactaccttcgagcccaaaaaaatgatcgaaggcgtcgcctatgaggtgcgcatttttgcagtaaatgccatcggtatctcaaaaccaagcatgccaagtcgcccatttgtgcctctagcggtaacttcccccccaaccctcttaactgtagatagtgttactgataccacagtcactatgcgttggcgaccacctgaccacatcggcgctgcgggcctcgatggctacgtgctcgagtattgctttgaaggaaccgaggattggatcgtagcaaataaggacctcattgacaagacaaaattcacaatcacaggattgccgacggacgctaaaatcttcgttagggttaaagcagtcaatgccgcaggcgcctccgagcccaagtattactcccaacctattcttgttaaggagatcattgaaccacctaagattaggatcccccggcacctgaagcagacttatatcagacgcgtgggagaggctgtcaacctcgtgatcccgttccagggcaaacctagaccagagctgacttggaaaaaagatggagcagaaattgataagaatcagatcaacattcggaattccgagaccgataccatcattttcataaggaaggctgagagaagtcattcaggcaagtacgacttacaggtgaaagttgacaaattcgttgagacagcgtctattgacatacaaatcattgataggcctggacctccccagattgtaaaaatcgaggacgtttggggtgagaacgtggccttaacttggaccccaccaaaagacgacggcaatgctgctatcactgggtatacaattcagaaggccgacaagaaatctatggagtggttcaccgtcatcgagcattaccacagaacgtccgctaccataaccgaactggtcatagggaatgaatattacttcagggtcttttcagagaatatgtgtggattgagcgaggatgcgaccatgacaaaggagtccgctgtgattgccagagacggcaagatctataaaaatccagtgtatgaagacttcgacttttccgaggctcccatgttcactcagccactagtaaacacctatgcaatcgcgggatacaatgctaccttgaactgtagtgttcggggaaaccccaaacccaaaattacatggatgaagaacaaggtggccatcgtcgacgacccgagatatagaatgttctcgaaccagggtgtgtgtactctggagattcggaaacctagcccctacgacggtggtacatactgttgcaaagctgtcaacgatcttggcactgtggaaattgagtgcaaattggaggtgaaggtgatctaccagggcgtcaatactcctggccagccggtcttcctggaaggacagcaacagagtctgcacaacaaggacttttag

SEQ ID NO: 196154 - DNA, 3822 bp, Artificial Sequence
  Description of Artificial Sequence: Synthetic coding sequence
atgcccgagcccggcaagaagcccgtgagcgccttcagcaagaagccaagatcagtggaggtagcagcaggaagccccgccgttttcgaggcggaaacggaaagggccggggttaaagtgcgctggcagcggggaggttctgacatttcagcctccaacaagtatgggttggccaccgagggaactcggcacacgctgacggtgagggaggtcggccctgcagaccaagggtcatatgcggtgattgccgggtctagtaaggtcaaatttgacctcaaggttattgaggccgaaaaggcagaacccatgttggccccagcccccgcacccgctgaagccacgggggctcctggtgaggcacctgcacctgctgccgaacttggcgaatctgctccatctcctaagggctcttcctccgcagccttgaatggacccactcctggtgcccccgacgacccaatcggcctctttgtaatgaggccgcaggatggggaggtcaccgtgggcgggagtatcacattttctgccagggtggctggtgcctcgctacttaagcctcccgttgtgaagtggttcaaggggaagtgggtggacctgtcttccaaggttggccagcacttgcaacttcacgacagctacgatcgggcatcaaaagtgtatcttttcgagttgcacatcacagatgcacaacctgcctttaccggatcttacaggtgtgaagtgagtacaaaagacaagttcgactgctccaactttaacttaactgtgcacgaggctatgggaacgggtgacctcgacttgctctccgcgttcaggcggactagtctggcaggggggggtaggcggatttccgactcccatgaagacaccgggatactcgacttcagtagcttgctgaagaagagttcttcattccggacccctcgcgattccaagcttgaggcgccagctgaagaagacgtctgggaaatcctgaggcaggccccaccatcggagtacgaaaggatagccttccagtatggagtgactgatctccgggggatgctcaagaggttaaagggaatgaggcgggatgagaaaaagagcaccgccttccaaaaaaaactcgagccagcttatcaggtgtctaaaggacacaagattagattgactgttgagctggccgaccacgacgccgaagtgaaatggttgaaaaatgggcaggaaatccagatgagcggaagatacatctttgaaagtattggtgctaagaggacactgaccatcagtcaatgcagtttggctgatgacgccgcatatcagtgtgtcgttggcggagagaagtgttctaccgagctgttcgttaaggagcctcccgttctaattacacgccctctggaagatcaactcgtgatggtggggcaaagagtggaatttgagtgtgaggtgagcgaggagggtgcgcaggtcaaatggctgaaggatggcgttgaactcacccgagaggagacattcaagtatcgttttaagaaggacggacaacggcaccacctcatcatcaatgaggcaatgctggaagacgccgggcactacgccctgtgtacgagtggcggacaggcattggctgagctgattgtgcaggagaagaaactggaggtgtatcagagcattgctgacctaatggtgggagcgaaagaccaggcagttttcaagtgtgaggtttctgatgaaaacgtacgcggcgtctggttaaagaatggaaaggaactggtgcccgatagccggattaaggtttctcacattggcagggttcataagttaacaatcgatgacgtgactccagcggatgaggctgactacagcttcgttcccgaaggctttgcttgcaatctgtcggccaagcttcacttcatggaagtgaaaatcgactttgttcctcgacaggaaccacctaaaatccaccttgattgccccggtcgaattcctgacactatcgtagtggtggctggcaacaaactgcggcttgacgtgccaattagtggggatcctgcacccaccgttatttggcagaaagccataactcagggcaacaaggctcctgccaggcctgcccccgacgcccctgaagacactggagattctgatgaatgggtatttgacaaaaagttgttgtgtgagaccgagggtagggttcgggttgagactactaaggatcgcagcatttttaccgtggaaggggcagaaaaagaagatgagggcgtctacactgtgactgttaaaaacccagtgggagaggaccaggtcaaccttacagtgaaagtgattgacgtgcctgatgcgccagcggctccgaagatctccaacgttggcgaggatagctgtacagtccaatgggagcctcctgcgtatgacggaggccaacctatactggggtatattctcgagcggaagaagaaaaaaagttatcgctggatgcgactcaacttcgatttgattcaggagcttagtcatgaggcaaggcgaatgatcgagggcgtagtgtacgagatgagggtttatgcagtgaatgctatcggcatgagccgcccatctcccgcttcccaaccctttatgcccatcggacccccatcggagcctactcatcttgctgtggaggacgtgtccgacaccactgtttctctgaagtggcgcccacctgaaagggtgggcgctggcggattagacggttactcagtggaatattgccccgaggggtgtagcgaatgggtggcggccctacagggcctcaccgagcacacctcaatactggtgaaggatctgccaaccggcgccaggctcttgtttcgcgtccgggcccataacatggctgggccaggcgcccctgtcacgaccactgagcctgttaccgtgcaggaaattctccaaagacctaggttgcaactaccccggcacctccggcagacaatccaaaaaaaggtcggagaaccggtcaatctgctgataccgtttcaaggtaagccacggccgcaagtgacatggacaaaggagggccagccactcgccggtgaagaagtctccatcagaaactcaccaaccgacaccatccttttcataagagctgctcggcgagtccattccggaacatatcaggttactgtgagaattgagaatatggaggacaaggctactctcgttctgcaagtcgttgacaaaccgagtcctccccaggatttgagagtgaccgatgcctggggactgaatgtcgctctggagtggaaacccccccaggatgtcggcaacacggaactgtggggttacaccgtccaaaaggccgacaagaagaccatggagtggtttaccgttctcgagcactatcgccggacccactgcgtggtgcccgaactcatcatcggcaatgggtattattttcgcgtattttcccagaacatggtgggattctccgacagagccgcgaccaccaaggaacctgtgtttatccctaggccgggaattacctatgagcctccgaactataaggctctggacttctcggaggccccgagctttacccagccccttgttaaccggagtgtaatcgccggctacaccgccatgctgtgttgtgcggtgcgggggtcccctaaacccaagatcagctggttcaaaaatggcttagatctaggggaggacgctaggtttcgcatgttttcaaagcagggagtgttgactctggagatcagaaaaccctgtccatttgacggtggaatctatgtgtgtagagctacaaaccttcagggggaagccagatgtgaatgcagattagaggtacgcgtgccacagtag

SEQ ID NO: 196155 - DNA, 3825 bp, Artificial Sequence
  Description of Artificial Sequence: Synthetic coding sequence
atgcccgagcccggcaagaagcccgtgagcgccttcagcaagaagcccaggagtgtggaagtagcggcggggagtcctgccgtctttgaagccgagactgagcgggcgggggtgaaggttcggtggcaacgcgggggttctgatatatcggcatcaaataaatacgggctcgcaaccgagggcacacggcacactctgaccgtgcgcgaggtgggccctgcagaccaaggctcctacgcagtaattgcaggatcatccaaggtgaaatttgatctgaaagtgattgaagcagagaaagccgagcccatgctggcacctgcgcctgcaccggccgaggctacaggggcgcccggagaggcccctgcgcctgcggccgaactgggagagtccgctccatcgcctaagggaagctcctccgctgctctcaacggccctacccctggtgcacctgatgaccccatcggactgttcgtcatgcgccctcaggacggcgaggttactgttggtggttcgatcacattcagtgcacgagttgctggggccagcctattgaagcctcctgtggtgaaatggtttaagggtaagtgggtagacctcagcagtaaagtcggtcagcaccttcagctgcacgacagctacgatcgagcgtccaaggtgtacctttttgagctgcacatcacggacgcacagcctgcctttacaggtagctatcgttgcgaagtttcgactaaggacaagtttgactgctccaactttaacctcacagtccatgaagcaatggggaccggggaccttgatctgctttctgcttttaggcgtacgtccctggcaggtggtggcaggaggatctccgactcgcatgaggatactggaatcttggacttttcctctctcctcaaaaagagctcttctttccggactcccagggacagcaagctggaagcacctgccgaagaggacgtctgggagatccttcgtcaggcccctccctcggaatatgagcggatcgcattccaatatggtgtcacagatctccgcgggatgctcaagaggctgaaggggatgcggcgagacgaaaaaaagtcaaccgctttccagaagaaattagagcctgcttaccaggtgtccaaagggcacaaaattagacttactgtcgagctggctgatcacgatgccgaagttaagtggctcaagaacggacaagaaattcagatgtctggaagcaaatacattttcgaatctattggagcgaagaggaccttaaccataagccagtgctctctggcagacgacgccgcataccaatgtgtggtgggcggagaaaagtgctccacggaactgttcgttaaagagccgcccgtactgatcactaggccgctcgaggaccagttagtgatggtagggcagcgagtggagttcgagtgtgaggtgtccgaggagggggctcaagtgaagtggctgaaggacggggttgaactgactcgcgaagagacctttaagtatcgctttaagaaagatggtcagcgccaccatctaattatcaatgaagctatgctggaagacgctggccactacgcactgtgcacatcaggcgggcaggctctggctgaactgatagtgcaggaaaagaagcttgaggtataccaatccatcgccgaccttatggttggggccaaggatcaggccgtgtttaagtgcgaggtgtccgacgagaatgtccgcggagtgtggttgaagaacggtaaagagctggtccctgactcgcgaatcaaagtctctcacattggtcgcgtacataagcttacaatcgatgacgtgacccccgccgacgaggccgattactctttcgtccctgagggtttcgcctgtaacctatcagcaaagctgcacttcatggaagtgaagatagattttgtgccaagacaggaaccccccaagatccacctggactgcccaggccgcatccctgacacaatagtcgtggtggcgggaaacaaacttcgcttagacgtccccatctcaggagatcccgcccccaccgttatctggcagaaagcaataacccaaggaaacaaagccccagcacggcctgcccctgatgcccctgaagacactggggactctgacgaatgggtcttcgacaaaaaactgctgtgcgaaactgagggccgggtgcgcgtggaaaccactaaggatagatctatcttcacagttgagggggccgaaaaagaagatgagggcgtgtatactgttaccgtgaaaaatccagtgggggaggatcaggttaatttgaccgtcaaggtgatcgacgtgcctgatgcacccgctgcacctaaaatctcaaatgtcggcgaggacagctgtaccgtccagtgggaacctccagcttatgacggcggccagccaatcctcgggtatattttggaaaggaagaaaaagaagagctatcggtggatgcgcctgaatttcgatctcatacaggaactaagccacgaggctagaagaatgattgagggcgtcgtgtacgaaatgcgcgtatatgcagtcaatgccatcggaatgtctcgaccaagtcctgcctcccagcccttcatgcctattggtccacctagtgaaccaacgcacctggcagtggaagacgtgtctgatacaacagtgagccttaaatggcgaccccctgagcgcgttggagccggcggcctcgacggctactcagtcgaatactgccccgaaggatgctccgaatgggtcgccgccctgcaaggactgacagagcacacgtctatattagtgaaggaccttccgacaggagcacgcctgctctttcgtgttcgagcccataacatggctggccctggtgccccagtcaccaccaccgagcccgtgacagtgcaggagatcttacaacgcccgcgtttgcaactcccaaggcacctcaggcagaccatacagaagaaagttggggagccagtaaatctgcttattccatttcaggggaagccgcgaccccaggtcacctggactaaggaaggacagcctctcgctggcgaggaggtgtctataagaaatagccctacagatacaattctctttattagggccgccaggagagtgcactctggtacctaccaggttaccgtgagaattgagaatatggaagataaggccacactcgtcctccaggttgtggacaagccctcgccacctcaagatcttcgcgtcacggacgcatggggcctcaatgttgcccttgaatggaaacctcctcaggatgtgggcaataccgagctctggggctacacagttcaaaaggccgataaaaagacgatggaatggtttactgttctggagcactatcgtagaacccactgtgttgtcccagaactgatcatcgggaatggatactatttccgggtgtttagtcaaaacatggtaggcttttcagatagagctgcgactactaaagagccagtgttcattccgcgccctggaattacctatgagccccctaattacaaggccctggacttcagtgaagccccctcttttacacagccgctggtgaacagaagtgttattgccggatataccgccatgttgtgctgcgctgtccgaggttctcccaaacctaaaatctcttggttcaaaaacggcctggacctgggggaggacgccaggttccgaatgttttccaagcaaggtgttcttacattggagatccgtaaaccctgcccttttgatggcgggatatacgtgtgccgggccacgaatctgcaaggagaagcccgatgcgaatgcaggcttgaggtgcgggttcctcaatag

SEQ ID NO: 196156 - DNA, 3825 bp, Artificial Sequence
  Description of Artificial Sequence: Synthetic coding sequence
atgcccgagcccggcaagaagcccgtgagcgccttcagcaagaagccgaggagcgtggaggtcgccgctggcagtcccgcagtatttgaggccgaaactgagagagctggtgtgaaagttcgatggcagcgcggcggtagcgatatctccgcctcaaacaagtacggacttgctaccgaggggaccaggcacactctgacagtcagagaagtgggccccgcagatcagggcagttacgctgttatcgccggtagttccaaagtgaagttcgatctcaaagttatagaggcagagaaggccgaaccgatgttagctcccgcacccgcccccgctgaggcgactggtgcacctggagaggctcctgccccggcggctgagctgggcgagagcgcaccctccccaaaaggtagcagttcagctgctctgaatggcccgacacccggtgcaccagacgatcccatcggattattcgtaatgagaccccaggacggggaggtgacagttggcgggtctatcacattctcagccagagtggccggcgcatccctgcttaaaccgccagtggtgaagtggtttaaggggaaatgggtggacctatcctccaaagtggggcagcacctccagctgcatgacagttatgacagggcatcaaaagtctatctctttgagttgcatattaccgatgcacaacccgcctttaccggctcctacaggtgcgaggtctcaaccaaggacaagtttgattgttccaacttcaacctcaccgtgcacgaggccatggggactggtgacctggatctattaagcgcattccggcgtacaagtctggcaggcggcggaaggcgtattagtgattcccatgaagacacagggattctggatttttcatcccttctgaagaagcgtgattcatttcggacacccagagacagtaagctcgaagcccctgcagaggaggatgtctgggagattcttcgacaggccccgccctcagagtacgaaaggatagcgttccaatatggcgtaaccgacctaagggggatgctgaagaggcttaagggcatgcggcgcgacgagaagaagagtacagcttttcaaaagaagctcgagcccgcctaccaagtttctaagggccataaaataagactaaccgttgagttggctgaccacgacgcggaagtcaagtggctcaaaaacggtcaggagattcagatgagcggcagtaagtacatcttcgaatcaatcggcgccaagagaactcttactatctcacagtgtagcttggctgacgacgctgcataccagtgcgtggtcggtggcgagaagtgctctacagagctgtttgtgaaagagccgcccgtgttgatcacacggcccctcgaagaccaactggttatggtgggacaacgtgttgaatttgagtgcgaggtcagcgaagagggcgctcaggtgaaatggctcaaggatggagtcgagctgactcgcgaggaaaccttcaaatatagatttaagaaggacggtcagcgccatcatttgatcataaacgaggctatgctggaagacgccggtcattatgccttgtgcacctcgggcgggcaggccctggctgaactgattgtccaagagaaaaaactggaggtttatcagtcgatcgccgacctcatggtgggggctaaggaccaggccgtgttcaagtgtgaagtgagcgacgagaatgtgcggggcgtgtggctgaagaatggcaaggagctggttcccgactcacgaatcaaggtctctcacattggccgggttcataaacttactatagatgatgtcacacccgccgacgaagcagactactcatttgtgcccgaaggtttcgcctgtaatctatccgcaaagcttcacttcatggaagtcaagatcgactttgtgccaagacaagagccacccaagattcacttagattgtcctggcaggatacccgataccatcgtggtggtggctggcaataagctgaggttggacgtgccaatttcaggcgaccctgcccccactgtgatatggcagaaggcaataacacaaggtaacaaggcgcctgcgcgcccagctcctgatgcacccgaggataccggggactcagatgagtgggtgttcgataaaaagttactctgcgagactgaagggagagtgcgggtcgagactactaaagaccgttctatttttactgtggagggggccgagaaggaggatgagggggtgtacaccgtcacagttaaaaaccccgtaggcgaggatcaggttaatctgactgttaaggtgatagacgtcccagatgcacctgctgcacccaaaatctcaaatgtgggggaggattcgtgtacggtgcagtgggaacctccggcctatgacggcgggcagccaattctcggctatattttggaaagaaagaaaaaaaaatcctaccgatggatgcggctgaactttgatttgattcaagaacttagtcacgaggcccgccggatgattgagggcgtggtctatgagatgagagtctacgcagtaaatgccattggtatgtccagaccctctccggcctcgcagcccttcatgccaatcggcccaccctccgaaccaactcatctcgccgttgaggacgtgtcagatacaaccgttagcctgaagtggcgcccacctgagcgagtcggagcaggaggcttagacggttattcggtggagtattgccccgaaggatgtagcgaatgggttgcggcactgcaggggctcacggagcacactagcattctcgtgaaggacctccctacaggcgcacggctgctgtttcgcgtccgagctcataatatggcaggcccgggcgcacccgtgacaactacagagccagtgaccgttcaagaaatcctgcagagacctcggctacaactgccacgtcacctccggcaaactatccagaagaaggtcggcgaaccagtgaaccttctgattccgtttcagggtaagccccggccccaggtcacttggacgaaggaagggcaacctcttgccggggaagaggtctcaatacggaattccccgacagataccatcctgtttattagggccgcccgaagagttcacagcggtacctatcaggtaactgtaaggatagagaatatggaggacaaggccacattggtacttcaggtcgtggataaaccctcccctccccaagacttgcgcgtgactgacgcctggggattaaatgtggctctcgagtggaagccgccccaggacgtgggaaatactgaactgtggggctataccgtccagaaggcagataaaaaaaccatggaatggtttaccgtgttagaacactatcgtcggactcattgcgttgttcccgaactgatcattggaaacgggtactacttccgcgtcttcagccagaatatggtcggattcagcgatagagctgctacaaccaaggagccagtgtttattccccgtccagggattacctacgagcccccgaattacaaagcccttgatttctccgaggctcccagtttcacccaaccactagtgaatagaagcgttatcgcaggttacacagccatgctgtgctgtgctgtccgcggctctcccaagccaaagatctcttggttcaagaacgggctcgatctaggagaggatgcccggtttcgaatgttcagcaagcagggagttcttaccctggagattcggaaaccctgtccctttgatggaggcatttacgtttgtagagctacaaacctccaaggagaagcgcgctgcgagtgtagactcgaagtccgggtcccgcagtag

SEQ ID NO: 196157 - DNA, 3426 bp, Artificial Sequence
  Description of Artificial Sequence: Synthetic coding sequence
atgcccgaggccaagcccgccgccaagaaggcccccaagggcaaggacgctccgaaaggtgctccaaaggaggcccctccgaaggaagccccagcagaggcccctaaggaagcgcctcctgaagaccagtcacccaccgcagaagaacctacaggggtctttttaaagaagccagattccgttagcgtggagacgggtaaagacgcagtagtcgtagctaaggtgaatgggaaggagctgccagataaacccacaatcaagtggttcaagggtaaatggttggaactggggtccaaatcaggagcaagattcagcttcaaagaatcccacaatagcgctagtaatgtgtacaccgtggagctgcacataggaaaggtcgtactgggtgatcgcggctactaccggcttgaggtgaaggccaaagatacatgtgacagctgtggtttcaacatagacgtggaggctccacgccaggatgcttcaggccaatcgttagaaagtttcaagcgcaccagcgagaaaaagtcagatacagcaggcgaactcgattttagtggcctcctgaagaagagagaggttgttgaagaagaaaaaaaaaagaaaaagaaagacgacgacgacctggggatccctcccgaaatttgggaactcttaaagggagctaagaagtccgagtacgagaaaatcgcgttccagtatggaataacagatctaagagggatgctgaagcgtctcaaaaaggctaaggtggaagttaagaagagcgcagcttttaccaagaagctagaccctgcataccaggtagatcgcggcaataagataaaactgatggtggagattagtgatcctgatctgacgcttaagtggtttaagaacgggcaggaaatcaagccatcttcaaagtacgtctttgagaatgtgggaaagaaacgtatccttactatcaataagtgtactctcgccgacgatgccgcttacgaagtagccgtcaaagacgaaaagtgcttcaccgaactgtttgtgaaggagccccccgttctgatcgttacaccactggaggaccagcaggtgttcgtaggagacagggtggagatggctgtagaggtgtccgaagagggtgcccaggtaatgtggatgaaggacggagtggagctgactcgtgaggattccttcaaagcacgctataggttcaaaaaggatgggaagagacacatcctgattttctctgatgtggtgcaggaggatcgcggacggtaccaagtcatcacaaacgggggtcaatgcgaagctgaacttatcgttgaagaaaaacagctggaagtgcttcaggacatcgccgatttgaccgtaaaggccagtgaacaagccgtattcaaatgcgaggtgagcgatgagaaagtgactggaaagtggtataagaatggtgtggaagtgagaccatccaaaaggatcactatcagccacgtgggcaggttccataagctggtcatagatgatgttcgccctgaagacgagggcgattatacatttgttcccgacgggtacgccctgtcactttctgccaagttaaattttctggaaattaaggtggaatatgtgcctaagcaggagccccccaaaattcacttggactgtagcggaaagacttccgagaatgctattgtcgttgtggctggtaacaagctgaggttagatgtgtcaatcactggcgagccaccgcccgtggccacatggctcaaaggtgatgaggtgttcaccacaaccgaaggccggactcgaatcgagaagcgcgtggactgctcaagttttgtgatcgaatcggcacagcgtgaggacgagggccgctacacaattaaagtcaccaatcccgtcggggaggacgtagccagtattttcctccaggtggtggatgtgcctgacccacctgaagcagtccggatcaccagcgtgggtgaagactgggctattctcgtttgggagcctcctatgtatgatgggggcaagccagttaccggatatctggttgagcgaaaaaagaagggatcccagaggtggatgaaacttaactttgaggttttcacagaaacaacttacgagagcactaaaatgatcgagggcatactgtatgaaatgcgggtcttcgctgtcaatgccatcggcgtgtcgcagccatctatgaatactaagcccttcatgcctatcgccccaacgtctgaaccgttgcatcttattgtggaggatgtaacagacactacaactaccctgaagtggcgcccacccaaccgcattggcgctgggggcatcgacgggtacctagtggaatactgcctggaaggttcagaggaatgggtgcccgctaacacagaacctgtcgagcgatgcggtttcaccgtgaaaaatctgccaactggtgcccgcatcctgttcagagtggtgggcgtcaatattgccggaaggtccgaacccgcgacactcgcccagcccgtgactatacgcgaaatagcagaacctcccaagattcgcctgcctcgacacttacggcagacttatatcaggaaagtgggcgagcagctgaatctggtcgttccatttcaaggcaaacccagacctcaggtcgtctggactaagggaggcgcccctctggacacaagccgagtccacgtgcgcaccagtgatttcgacacagtgttcttcgtcaggcaggccgccaggtctgactccggtgaatacgaactgagtgttcagatcgagaacatgaaggatactgctaccatccggatccgggttgtcgagaaagctggtcccccaataaatgtgatggtcaaagaggtgtgggggaccaacgccctcgtggagtggcaggcccccaaggacgatggtaattcggagattatgggctattttgtgcagaaggcagataagaaaaccatggaatggttcaatgtctacgagagaaacagacacacgtcctgtaccgtgagtgacctgattgtggggaatgaatactatttccgggtctacactgagaacatatgcggactgtcagactctccaggcgtgagtaagaataccgccagaatattaaagaccgggatcacattcaagccttttgaatacaaagagcatgattttcgtatggcgcctaaattcttgaccccactaattgaccgggtagtggtcgcaggctattctgctgcactgaactgcgcagtcagggggcatccgaaaccaaaagtcgtttggatgaagaataaaatggagatacgggaggaccccaaattccttattaccaattaccagggagttctgactctcaacatacgaaggcccagtccattcgacgcaggcacatatacttgtcgtgccgtaaacgaactgggggaagctctggcagagtgtaaactggaagttcgagtgcctcagtag

SEQ ID NO: 196158 - DNA, 3426 bp, Artificial Sequence
  Description of Artificial Sequence: Synthetic coding sequence
atgcccgagcccaccaagaaggaggagaacgaggtgcccgcccccgcgcctccccccgaggagcctagcaaagaaaaggaggctggaaccacgcctgccaaggactggaccctggtggagacaccccctggggaggagcaagcaaagcagaacgcgaattcccaactatccatcttgttcatagagaagccccagggcggcaccgtcaaagtcggtgaggatattacttttattgcaaaagtaaaagccgaggacttattacggaaacccaccataaaatggttcaaaggcaagtggatggaccttgcctcaaaggccggtaaacatcttcagctgaaggaaacattcgaaaggcactctagagtgtatacttttgaaatgcagatcatcaaagctaaagacaattttgccggtaactatcggtgcgaggtcacatacaaggataaattcgattcttgttccttcgatctggaggttcacgaaagtacgggtacaactcccaatatcgacattcggagcgcgtttaaacggtcaggcgagggccaggaggatgccggtgagttggatttctcaggtctgcttaaacggcgggaagtgaagcagcaggaggaggaaccccaagtagatgtttgggaactgctcaagaatgctaaaccatctgagtatgagaaaatcgccttccagtacggcatcaccgatctgcgcggcatgttgaagcgcctaaagaggatgcgcagggaggagaagaagagtgcagcatttgctaagatcttggaccccgcttaccaggtcgataagggcggtcgcgttagatttgtggtggagctggcagatcccaagctggaggttaagtggtataaaaacggtcaggaaattaggcccagcacgaagtatatctttgagcacaaggggtgccagaggatcctctttatcaataactgccaaatgacagacgattccgaatactacgtgacggctggcgatgagaaatgctctactgagctgttcgtgcgggaaccccctataatggttactaaacaactcgaggacactacagcttactgtggcgaacgagtagaactggaatgcgaggtttctgaggacgacgcaaacgtcaaatggttcaaaaatggcgaggagataataccgggcccaaagtctaggtaccgcatccgcgttgaggggaaaaagcatattttgatcatcgagggggctactaaagccgacgccgcagagtactctgttatgacaacgggcggccagagtagtgccaagctcagtgtggatcttaaaccactaaaaatacttacccctctgactgatcaaacagtcaatctgggaaaggagatttgtctgaaatgtgaaatctctgagaacatccccggcaagtggaccaagaatggactgcccgttcaggagagcgatagactgaaagtggtgcataaagggagaattcataagcttgtcatagccaatgctttgaccgaggatgagggcgattacgtcttcgcgccagacgcgtacaacgtgacgttacctgccaaggtacatgtaatcgatccccctaagattattctcgacggtcttgatgccgacaatacagtgaccgtgattgccggtaacaaactgaggcttgagatacccatctccggtgaacctcctcccaaagccatgtggagtcgcggggacaaagccattatggaaggtagcggccgaatcaggactgagtcttacccggattcctcaaccttggtgatagacattgcagaacgtgatgacagtggcgtgtaccatattaatctcaaaaacgaagcaggggaggctcatgcctccatcaaggtgaaggtggttgactttcccgacccccccgtcgcccctacggtaaccgaggtgggcgatgattggtgcatcatgaactgggaacctcctgcttatgatggtggctcacccatccttgggtacttcatcgagagaaagaagaagcagagttcgagatggatgagattaaactttgacctctgcaaggaaaccacattcgagcccaagaaaatgatcgagggggtagcttacgaagtccgcatctttgccgtgaatgccataggcatctccaaaccttcaatgccaagcagacccttcgtgcctttggcagtcacttctccccccaccctgctgaccgtggactcagtgactgacactactgtcaccatgaggtggaggccacctgatcatatcggcgccgcaggcctggatggttacgttctcgagtattgctttgagggctcaacctccgcaaaacagtcggatgagaacggggaggcggcgtatgatctaccagccgaggattggattgtggcaaacaaggacctgatcgacaagaccaagtttactatcactggcctgccaactgacgccaaaatatttgtaagggttaaggcagtgaatgccgcaggcgcctctgagccgaaatattacagccagcccatcctggttaaagaaattattgaacccccgaagattcgaataccaaggcatctgaaacagacttatatacgacgagtcggcgaggctgtgaacctcgtcatcccattccaaggtaagccccgacctgagctaacgtggaagaaagatggggcggagattgataaaaatcagataaacataagaaacagtgaaacagatacaatcatatttatcagaaaagctgaaaggagccacagcggcaaatatgatctccaggtgaaggtagataaattcgtggagacagcctccatcgatatccagattatcgatcgaccgggtcctcctcagattgtaaaaatcgaggatgtgtggggcgagaatgtggctttgacctggacaccaccaaaggacgacggtaacgccgccatcacagggtacacaattcaaaaagcagacaagaaatccatggagtggttcaccgtcattgagcactaccataggactagcgcaaccatcactgaacttgttattggaaatgagtactactttagggtgttttccgagaatatgtgtggactgagcgaggacgcaactatgacaaaggaatcggctgtgatcgcccgggatggcaagatctataagaaccccgtgtacgaggactttgatttctccgaagccccaatgttcacacagcctctagtgaatacatacgccatcgcaggctacaacgcaaccctgaattgttccgtgcgggggaatcctaagcctaagattacttggatgaaaaacaaggtcgcaatcgtggatgatccaagatatcgcatgtttagcaaccagggcgtgtgcaccctcgagattcgcaaaccgtccccgtacgacggtgggacgtactgttgcaaagccgttaacgaccttggcactgtagagatcgagtgtaaactggaggtgaaagtcatcgcccagtag

SEQ ID NO: 196159 - DNA, 3516 bp, Artificial Sequence
  Description of Artificial Sequence: Synthetic coding sequence
atgcccgagcccaccaagaaggaggagaacgaggtgcccgcccccgcacccccacccgaggaaccatcaaaagaaaaggaagcaggcaccactccggccaaagatgaagaagaagtaagtccaccttccgccctgccacccggactggggagccgtgcgctggaaagaaaagattccgattggaccctcgtcgaaacaccccctggagaggagcaggccaagcaaaacgccaatagccagctctccatcctcttcatcgagaaaccccagggtggaacggttaaagtaggcgaagacatcacttttatcgccaaagttaaggccgaagacttacttcgcaagcccaccatcaagtggttcaaaggcaagtggatggatctggcaagtaaagccggaaaacacttgcagctgaaggaaacctttgaacgtcacagtcgcgtgtacacttttgaaatgcagatcatcaaagcaaaggacaacttcgctgggaattaccgctgcgaagtcacctataaggacaagttcgatagttgcagttttgaccttgaagtccacgaaagtacaggaaccacccccaacatcgatattcgctccgcgtttaaaaggagcggagaagggcaggaagatgccggcgagctggattttagcgggctactcaagcggcgcgaggtaaagcaacaggaagaggagccacaggtagatgtctgggaactcttaaagaatgcaaaaccttccgaatacgagaagatcgcctttcagtacggcatcactgacctacggggtatgttaaagcgactgaaaagaatgcggcgagaggaaaagaagagcgccgcgttcgctaagattctagatccagcctatcaggtcgataagggagggagggtgaggttcgtcgttgaactggcagaccctaagctcgaggtaaagtggtataagaacggccaggaaattaggccctccactaaatacatatttgaacataaggggtgtcagcggatcctattcattaataactgccaaatgaccgacgattccgagtactatgtcacagccggcgatgagaaatgtagcactgaactatttgtccgcgagcccccaatcatggttaccaaacagctggaggacactaccgcctattgtggcgagagggtagagctggagtgtgaggtgtccgaagacgacgccaatgtgaagtggtttaagaacggcgaggagattatcccaggtccaaagagtagatatcggattagggtggagggtaaaaagcatattctcataattgagggcgcgaccaaagccgacgcagcagagtattccgtgatgacaaccgggggacagagtagcgccaaactcagcgtagatctgaagcccctcaaaatcctcacaccactgacagatcaaaccgtcaatctgggtaaggagatctgcctgaagtgtgagattagcgagaatattcctggaaaatggactaagaatggcctgcccgtgcaagagagtgacaggctgaaggtggtccacaaaggcaggattcacaaactggtgatagccaacgccctgacagaagatgagggagactacgtattcgctcctgatgcctacaacgtgaccctgcccgcgaaagttcacgtaatagaccctcctaagattatcctcgacggcctcgatgcagacaatacagtcaccgtcatcgctgggaacaaactccgtcttgagattcctatcagcggcgagccaccccccaaggcaatgtggtcgagaggggacaaagcaatcatggaggggtccggacggatcagaacagagagctatcccgattccagcactttggtgatcgacattgcagaaagagatgattccggagtgtaccatatcaacctgaagaatgaagctggtgaggcacacgcaagtatcaaggtgaaagtcgttgattttcctgacccacctgtcgccccgaccgtcactgaagtgggagatgattggtgcatcatgaattgggagccacctgcttatgatggaggcagcccgatactcgggtacttcatcgaacgcaaaaaaaaacaaagtagtagatggatgcggcttaactttgatctatgcaaggaaaccacctttgagccgaagaaaatgattgaaggagttgcttacgaggtgagaatcttcgctgtgaacgctattgggatcagcaagccgtccatgccgtcccggcctttcgtgcctctggcggtgacttccccacctacccttctaaccgtggattctgtaacagatactaccgtcaccatgcgttggcggccaccagatcatattggagcagcagggctggacggctatgtgctggaatattgttttgagggaacggaggactggatcgtggccaacaaagatcttatcgataagacaaagttcaccatcacaggcctgcctacggacgctaaaattttcgtgcgcgtgaaggcagttaacgccgctggggcatcagagcccaagtattattctcagccaatcctcgtaaaggagatcatcgaacccccaaaaatccgcatccccaggcatctgaagcagacctatattcggcgggttggggaagccgtaaacctcgtgataccctttcaggggaaaccccgcccggagctgacctggaagaaagacggtgcagagattgacaagaaccagatcaacataagaaattcagaaacagacaccattatcttcatacgcaaagctgaacggagccactcaggcaagtatgacctacaggtgaaagtggataagttcgttgaaactgcttctatcgatatccagatcatcgaccggcctggccctcctcagatcgtaaagatagaagatgtctggggcgagaatgtggccttgacctggacccctccgaaggatgacggcaatgccgctatcacagggtacacaatccagaaagccgacaaaaagtctatggagtggtttacagtcattgaacactatcaccgcacttctgccactatcaccgaactagtcattggcaacgaatactattttcgcgtattcagcgagaacatgtgcgggctctccgaggacgcgaccatgactaaggagtctgcggtgatcgctcgggatggcaagatctacaagaacccggtgtatgaggacttcgatttctctgaggccccgatgtttactcagcctctggtgaacacttatgctatcgcaggatataacgccaccctgaattgcagcgttcgcgggaatcccaagccaaagatcacctggatgaaaaataaagtcgctatcgtagatgatccacggtacagaatgttttctaaccaaggcgtatgcaccctggagatccgcaaaccttccccatacgatggtgggacgtattgttgcaaggccgtgaacgacttgggcacggttgagattgaatgcaagcttgaggtgaaggtgatttatcagggtgtcaacacacctggtcagcccgtgtttctcgaggggcagcagcagtctctgcacaacaaagatttctag

SEQ ID NO: 196160 - DNA, 3447 bp, Artificial Sequence
  Description of Artificial Sequence: Synthetic coding sequence
atgcccgagcccaccaagaaggaggagaacgaggtgcccgcccccgccccccctcctgaggagcccagcaaggagaaagaggccggcaccacacctgctaaggacgaagaggaggtaagcccacccagcgcgttgccacctggccttggctccagggccctcgagcgtaaggactcagattggaccctagtcgagaccccgcccggagaagagcaggcaaagcagaacgctaattcacagttatcaatactgttcatcgaaaagcctcagggcggtacagtgaaagtgggggaagatatcacttttatcgctaaggtgaaggcagaagacctcctcaggaagccaacaatcaaatggtttaaggggaaatggatggacttggcaagcaaggcggggaagcacctgcagttgaaggaaacattcgagaggcactctcgtgtgtacacgttcgaaatgcagataatcaaggccaaggataatttcgccggcaactataggtgtgaagtgacgtataaggacaaattcgactcttgcagcttcgacttggaagtgcacgaatcaacaggaactacacctaacatagacatccgctccgcatttaaacgcagcggagagggccaggaagacgccggggagctggatttcagtggtcttctcaagcgccgtgaagtgaaacagcaggaggaagaaccacaggtcgatgtgtgggagctcctgaaaaatgcgaaaccctcagaatacgaaaagatagcctttcagtatggaattacggacctccgcggcatgctaaagcgactgaagcgcatgcggagagaggaaaagaagagtgccgcctttgcgaagattctggaccccgcttaccaggtggacaagggaggaagggtgcggttcgtcgtggaattagccgacccaaagttagaagtcaagtggtataaaaatggacaggaaattcgcccctccaccaaatacatattcgaacataaaggttgccaaagaattctgtttattaacaactgtcagatgacagatgatagcgagtattacgttactgcgggcgacgagaaatgttctaccgagctgttcgtcagggagcctcctattatggtcactaaacaattggaagatacaaccgcctactgtggagaacgtgttgaacttgagtgtgaggtgtccgaggatgatgcaaatgtaaagtggttcaagaatggtgaagagatcattccaggccctaagtcacggtataggattcgggttgagggaaaaaagcacattctaatcattgagggcgctacgaaagccgacgccgctgaatactcagtgatgactaccggtggtcagagcagtgcaaagttaagcgtggatcttaaacctcttaagattctgactccattgactgaccagaccgtaaatttaggcaaagaaatttgcctgaagtgtgaaatctctgaaaatattccaggcaaatggacaaaaaacggactgccggtccaggagagtgatcgccttaaagtggttcataaggggcgcatacacaaactcgtgatcgccaacgcactgaccgaagacgagggtgactacgttttcgccccagatgcatataacgtaaccctgccagcaaaggtccatgtgattgacccgccaaagatcatcctcgatggtctggacgcagataacaccgtcacagtgattgcagggaataagctgcggcttgaaatccctatctccggtgaaccgcccccaaaggcaatgtggtctcggggtgacaaagctatcatggaaggcagcggtcgcattaggactgaatcctatccggattcatctacactggtcattgacattgccgagagggatgacagtggagtctatcacatcaacctaaaaaacgaggcgggtgaggcccatgcgtccatcaaggtcaaagtggttgacttccctgatcctccagtcgccccaacagtgaccgaagtaggtgacgattggtgtattatgaactgggaacccccagcatatgacggcggaagtcccatcctgggttactttattgaaagaaaaaagaaacaaagcagcagatggatgagactcaattttgacttgtgcaaggaaacgacgtttgagcccaagaagatgatagaaggtgtcgcttacgaggtgcgcatctttgcagtgaacgcaatcggcataagcaagcccagtatgccaagtagaccatttgtgcccctggcagtgacatctccacctactttgcttaccgtggatagtgtaacagacacaaccgtgaccatgcgttggcggccacctgaccatattggcgctgccggtctcgatgggtacgtgcttgagtactgcttcgagggcacggaggactggattgtggctaacaaggaccttatcgacaagaccaaattcaccattactggattgcccacagacgcgaaaatcttcgtacgggtaaaggcagtcaacgcagctggagcttccgagccaaaatactatagccagcccattctggttaaggagataatagaacctccaaaaatcagaataccccggcatctgaagcagacctacattaggcgcgtgggtgaagccgtcaacctcgtcattcccttccagggtaagcctcggcctgagcttacttggaaaaaagacggcgcagagatcgacaagaatcagataaacatacggaatagcgagaccgacacaattatcttcattagaaaggccgaacgttcccactctgggaagtacgatttgcaggtgaaggtcgacaaattcgtggaaaccgcctctatagatatccagattatagaccgccctggacccccccaaattgtaaaaatcgaggatgtgtggggtgagaacgtcgcgctgacctggacaccccccaaggatgacggtaatgcagccattactggttacactattcaaaaagcagacaagaagtctatggagtggttcacggtgatagaacattaccataggactagtgcaaccatcaccgagttggtcattggtaatgaatactactttagagtcttcagcgaaaacatgtgcggcctatccgaagatgccacgatgactaaagaatcagcagtaatcgcccgggatggtaaaatctataagaatccggtttacgaggattttgacttctcagaggcgcccatgtttactcagcccctggttaacacttatgccatcgcaggctacaatgctaccttaaattgctctgtgcggggcaaccccaagcctaaaatcacctggatgaagaacaaagtggccattgtggatgaccctaggtatcgcatgttctcaaaccaaggcgtttgcaccctggagatcaggaagccgagcccttatgatggcggcacttattgctgcaaagccgtcaacgacctcggtactgtggagatcgaatgcaagcttgaagttaaggtgatcgcccagtag

SEQ ID NO: 196161 - DNA, 3495 bp, Artificial Sequence
  Description of Artificial Sequence: Synthetic coding sequence
atgcccgagcccaccaagaaggaggagaacgaggtgcccgcccccgccccgcccccagaagaaccaagcaaggagaaggaggccggcacgactcccgctaaagattggactttggtcgagacccctcctggtgaagagcaagcaaaacaaaatgccaatagtcaactcagcattctgttcatagaaaagccccagggggggacggtgaaggtgggggaagacataactttcatcgcaaaggtgaaagctgaggacttactgcgtaagcctactatcaaatggttcaaggggaaatggatggacctcgctagtaaagccgggaagcacttacagctgaaagagactttcgagagacactcgagggtatacactttcgaaatgcagatcattaaagcgaaggacaatttcgcaggaaactataggtgcgaagtgacctacaaggataagttcgactcctgctctttcgacctcgaagttcacgagagtacgggaactacacccaatatcgacattagaagcgccttcaaacggtccggggagggccaggaagacgccggtgagctggatttttccggcctgctgaagagaagggaggtgaagcagcaggaagaagagccccaagtggatgtttgggagctgctaaagaacgccaaaccaagtgaatatgaaaagattgccttccagtacgggataacagatctcagggggatgctaaagcgactcaaacgcatgaggagagaagagaagaaaagtgcagctttcgcaaaaattctggacccagcctaccaggtggataagggaggaagagtgcggttcgtggtggaattggctgatccaaagcttgaggtgaaatggtataaaaatgggcaagagatcaggccatctacaaagtatatattcgagcataaaggctgccagcgaattctgttcatcaataactgccagatgacagatgactctgagtattacgtgaccgcaggcgatgagaaatgcagcacagaattatttgtcagagaacccccaatcatggtcaccaaacagctggaagacacaacagcgtactgtggggagcgcgtggagctcgaatgtgaggtgtccgaggatgatgcaaatgttaagtggttcaaaaatggggaagagatcattcccggccctaaaagccgctatagaatccgagtcgaggggaagaagcacattttgatcatcgagggggccacaaaggcagatgctgctgagtactccgtcatgactaccggaggccagtcatcagccaagctgagtgtcgacctcaaacctctgaagattcttactcccctcaccgatcagactgttaatttaggcaaagaaatctgtctgaaatgcgagattagtgagaatattcctggaaagtggactaagaatggccttcccgtgcaggaatcggaccgcctcaaggtggttcacaaggggagaatccataaacttgttattgctaacgccttgacagaggatgaaggcgactatgtgttcgcccccgacgcttataacgtcaccctgccagctaaagttcatgtgattgaccccccaaaaataattcttgatggactagatgcggataatactgtaaccgtcatcgccggaaataagctacggcttgagatccccatttccggagaaccgccccccaaagctatgtggagccgcggcgacaaggccatcatggaagggtcaggcaggatccgcacagagtcttatcccgattcctcaaccttagtcatcgacatagccgagcgcgacgactctggggtttaccacatcaatctcaagaacgaggccggcgaggcacacgcatctattaaggtgaaggtggttgacttccccgacccaccggtggcgccaaccgttaccgaggtcggggacgactggtgcattatgaattgggaaccacccgcctatgatggcggctctccaattctgggatacttcatcgaacggaagaagaagcagtcttctcgatggatgaggcttaacttcgacctctgcaaagagaccacgttcgagcccaagaaaatgatagagggcgtggcctatgaggtcagaatatttgctgtcaatgccatcggaatctccaagccatccatgccaagcaggccttttgtcccactggctgtgaccagtcctcccactctcctgacagtggacagtgtgacggacacaaccgtgacgatgcgctggcgaccacccgaccacattggtgctgcgggactcgatgggtacgtcttagagtactgtttcgaaggatctacatctgcaaaacagagcgatgagaatggggaggccgcctacgatctgcccgccgaggactggattgtggcaaacaaagacctcatagataagacaaagtttaccattactggcctaccaacagacgcaaagatctttgtgcgcgtgaaagcagtgaatgcagccggagcttctgagccaaaatattactcccaaccgattctggtcaaagagatcattgagccacccaagatacgaattcctaggcacttgaagcagacatatattaggcgtgtaggagaagctgtcaatttggtaattccatttcaaggaaaacctagaccagagctgacctggaaaaaagacggagccgagatcgacaagaaccaaattaatattcggaatagcgaaacagacactattatttttatccgaaaagcggagaggagccattcgggaaagtacgacctgcaagtaaaggtggataagtttgtagagacagcctccatagacatccagatcatcgatcgccctggacccccgcagatcgttaaaattgaggatgtttggggagagaacgtggctctgacttggacacccccgaaggacgacggaaacgcagccatcactggttataccatccaaaaggcagacaaaaagtccatggaatggttcacagtaattgaacactaccacaggacatcagccacaatcactgagcttgtcataggaaacgaatactattttcgtgtcttctccgagaacatgtgcggactgtcagaagatgcaaccatgaccaaagagtccgcggttatcgcccgagatggcaagatctataagaacccagtgtatgaagacttcgatttcagcgaggctccaatgttcactcagccactcgtgaatacttatgccattgcaggctacaatgcgactctcaactgtagcgtccgcggaaacccaaagccgaagattacatggatgaagaacaaggtcgcgatagttgatgatccccgctacaggatgttcagcaatcaaggggtgtgcacccttgagatccgtaaaccctcaccctatgacgggggcacttactgttgcaaggcagtcaatgatctaggaacggtggaaatcgaatgtaagctggaggtgaaagtaatatatcagggtgtgaacacccctggacagcctgtctttctcgaaggccagcaacagtcactgcataataaggacttctag

SEQ ID NO: 196162 - DNA, 2349 bp, Artificial Sequence
  Description of Artificial Sequence: Synthetic coding sequence
atgcccgagcccaccaagaaggaggagaacgaggtgcccgcccccgcccccccccctgaggagcctagcaaggaaaaggaagccggcaccaccccagccaaggatgaggaagaggtttcaccccctagtgcgctgcccccaggactggggtctcgagccctggaaaggaaggatagcgactggacgctggtggagaccccccctggtgaagaacaggccaagcagaacgctaattctcaactgagtattttgttcatcgaaaaacctcagggcggcactgtgaaggttggggaggacatcacctttatcgccaaggtgaaggcggaggacctgctgcgaaagccgactattaaatggttcaagggtaagtggatggacctcgcatccaaggccggaaagcacctgcaacttaaagaaacgtttgagagacactcacgagtgtatactttcgagatgcagattatcaaagcaaaggataacttcgctggcaactacagatgtgaggtgacatataaggacaagtttgattcctgttcttttgacctggaggtgcacgagagcactgggacaacacccaatatagatatcaggtccgccttcaagagaagcggcgaaggacaggaagatgctggagagctggatttttcgggtctcctcaaaagaagggaggttaaacagcaggaggaggaaccccaggtggatgtgtgggaattgctaaagaatgccaaaccttccgagtacgaaaagatcgcctttcagtatggtatcacagacctgcgtggaatgctgaagagactcaagaggatgcgccgtgaagagaaaaagtcagcggctttcgctaaaatcctggacccggcgtaccaggtggacaagggaggcagagttaggtttgtagttgagctggccgatccgaaactggaggttaaatggtataaaaacgggcaggagattcgaccttctaccaaatacatttttgagcacaaggggtgtcagcgcattctctttataaataactgccagatgaccgacgacagcgaatattacgtaaccgccggtgacgaaaagtgcagtactgagctttttgtgagagagccaccaatcatggtgacaaaacagcttgaagataccacggcctactgcggagagcgagtggagctggagtgtgaagtttccgaggatgacgccaacgtcaaatggtttaaaaatggggaagagatcatccccggccccaaaagccgctaccgcattcgggttgaaggaaagaaacacatcctgatcatcgaaggtgcaacaaaggccgacgccgccgagtatagtgtcatgaccaccgggggtcagtcatccgcgaaattgagcgtagacctcaagcctctgaagatcctgacccctctgactgatcagacagttaacctaggcaaggaaatctgtctgaaatgcgaaatcagcgagaatattcctggcaaatggacgaagaacggactaccagtgcaggagagcgaccggctgaaggtggtacacaaaggacgcatccataaactggtgattgctaatgcgctgactgaagatgagggcgactatgtgttcgcgccagatgcgtacaacgtgacacttcctgcgaaggttcacgtgattgaccccccaaaaattattttagacggcctggacgcggacaacaccgtaaccgtgattgctggcaacaaactcagactggaaattcctatcagtggagaaccaccacctaaagccatgtggtctcgcggcgataaagctattatggagggcagcggacggattaggacagaatcatatcctgacagctcaacgctggtgattgacatcgctgaaagagatgatagcggggtgtatcatattaaccttaagaacgaggccggagaagcacacgcatcaattaaggtgaaagtggtcgacttccccgatccacccgtggcccccaccgtcactgaggtcggtgacgattggtgcatcatgaactgggagccacccgcctacgacggaggttcccccatcctcgggtacttcattgaacgcaaaaaaaagcaatcaagccgctggatgagattgaacttcgatctatgcaaagagacaacgttcgaacccaaaaaaatgatcgagggcgtggcttatgaggtcaggatctttgctgtcaatgcgatcggaatcagcaagccctcaatgccttcacggccctttgtgcctctggctgtgacatctcctcctacattgctgaccgtggatagcgtgacagacaccaccgtgacaatgcggtggcgtcctcgaccccattggtgttccagattccgatggctttgtgccagggtcctgctgtag

SEQ ID NO: 196163 - DNA, 3426 bp, Artificial Sequence
  Description of Artificial Sequence: Synthetic coding sequence
atgcccgagcccaccaagaaggaggagaacgaggtgcccgcccccgcacccccccctgaagaaccctctaaagagaaggaggccggcacaactcctgccaaggattggacattggtagaaacaccacctggtgaagagcaggcaaagcagaacgccaatagccaattaagcatcctttttatagaaaaacctcaggggggcactgtgaaggtcggggaagacatcacgttcattgctaaagtcaaggcagaggacttgctgcggaaacctacgatcaagtggtttaagggaaagtggatggacctggcctccaaagccggcaagcacctgcaactgaaggaaaccttcgaacggcactcccgcgtctacacattcgagatgcagataattaaggcaaaagacaatttcgccggcaactacagatgtgaggtcacttacaaggacaagtttgactcatgctcctttgacttagaggtgcacgagagcacaggcaccaccccgaacatcgatatccggtccgccttcaagaggagtggcgaaggtcaagaggacgctggcgaactggacttcagtggtctgctcaaacggcgggaggtcaaacaacaagaagaagagccacaggtggacgtctgggaactgcttaaaaatgcaaaaccttccgagtatgaaaagatcgctttccagtacggtattaccgaccttcgagggatgctcaagagattgaaaagaatgcggcgagaagagaaaaagtccgcagcttttgctaaaatccttgaccccgcttatcaggtagataagggcgggagggtccgcttcgtcgtggagttggcagaccctaaactggaggtgaagtggtacaagaatggacaagagatacgaccatctaccaaatatatcttcgaacataaaggatgtcagcgaatcttatttattaacaattgtcagatgacagacgactcagaatattatgttaccgcgggcgacgaaaaatgctctacggaattgtttgttagggagcctcctattatggtgacgaagcagctggaggacaccacggcttactgcggagagcgcgtcgagcttgagtgtgaggtgtctgaggacgacgcgaacgtcaaatggttcaaaaatggtgaagagatcatcccggggcctaaatccaggtataggatcagagttgaagggaagaagcacatccttatcatcgagggcgccaccaaagcagatgctgcagaatactccgttatgactaccggtggccaaagttcggcaaaactgtctgttgatctcaagcctctcaagatcctgacccccctgaccgatcagaccgtgaacctcggcaaagaaatctgtttgaagtgcgaaatctccgagaacatcccgggcaagtggacaaagaatggtcttcccgtccaagagtccgatagactgaaggtcgtccacaaggggcggatacacaagctggtgatagcaaatgccctgacggaggacgagggggattacgtgtttgctcctgatgcctacaacgtaaccctgcccgccaaagtgcacgtcatcgacccccctaaaattatccttgatggcttggatgccgacaacaccgtgactgtcatcgcgggcaacaagttgcgtctggaaataccaattagcggcgagcctccaccgaaagctatgtggtccaggggtgacaaggccatcatggagggatccggtagaatcaggaccgagagctaccccgattctagtaccctggttatagatattgcagagagggacgattccggcgtatatcatatcaacctgaagaatgaggctggagaggcacatgcttctattaaagttaaggtggtggactttcccgaccctccggtggcccccacagtgactgaggtaggtgatgactggtgcataatgaactgggaaccccccgcttacgacggaggttcccctatcctgggctacttcattgaaagaaaaaaaaaacagtcctcccggtggatgcgcctcaactttgatttatgtaaagagacaacgtttgagccgaagaagatgatcgagggggttgcctatgaggtaagaatctttgcagtcaatgcgatcgggattagcaaaccctctatgccctctcgacccttcgtgccactcgccgtgacatctcctcctaccctgctcactgtggactccgttacggacacaaccgtcacaatgcgatggagaccaccggatcacatcggagccgccgggttagatggatatgttctggaatactgcttcgaaggttccacttcagccaagcagagtgacgagaacggagaggccgcatatgacctccctgccgaggactggattgtggccaacaaagacctcattgacaagactaagtttacaataactggcctgccgacagatgccaagatctttgttcgtgtcaaggccgtgaacgctgcaggggcctctgagcccaagtattactcccaaccaattttagtgaaggaaattatcgaacctcccaagattcgcatcccccggcaccttaaacagacatacatccgccgcgtgggagaggccgtcaacctggtgatcccattccaaggcaagcctcgtcccgagttaacctggaaaaaggacggtgccgagattgacaaaaatcaaatcaacattcggaactcagagacagacaccattatttttattaggaaagccgaacgctcccactctgggaaatacgatcttcaagtgaaggtagacaagttcgtcgagaccgcttctatcgacatccagatcatagatcggccaggaccaccgcagatcgtcaaaatagaggatgtgtggggggagaatgtggctttgacttggacgcctcctaaagatgatgggaacgcagccataactggatacaccatccagaaggccgacaagaaatcaatggaatggttcaccgtcatcgaacactaccaccgaacgtccgccacaatcaccgaactggtgatagggaacgaatattattttcgggtctttagcgagaatatgtgtgggctgtcagaggacgcaactatgaccaaggaatccgccgtaatcgctcgggacgggaagatctataagaaccccgtgtacgaggattttgacttcagcgaggccccaatgttcacacaacccttagtgaacacctacgcaatcgctggatacaatgctaccctgaattgttccgtaaggggcaaccctaagccgaagattacttggatgaaaaacaaggtcgccattgtggatgaccctagatacaggatgttctctaaccagggggtgtgcaccctggaaatcagaaaacccagcccgtacgatgggggtacatactgttgtaaagcagtgaatgatctgggcaccgtggagattgaatgcaaattggaggtaaaggttattgctcagtag

SEQ ID NO: 196164 - DNA, 3372 bp, Artificial Sequence
  Description of Artificial Sequence: Synthetic coding sequence
atgcccgagcccaccaagaaggaggagaacgaggtgcccgcccccgctcctcctccagaggaaccaagtaaagaaaaagaagccggcacgactccagcgaaagactggaccttggtggagactccccctggtgaagaacaggcaaagcagaacgcaaacagccagctttcaattctcttcatcgagaagccccaaggggggaccgttaaggtcggcgaggacattacatttatcgccaaggtgaaggcagaggatctacttcgcaaaccaactatcaagtggtttaaaggaaaatggatggatttagcttcgaaagccgggaagcacctgcagctgaaagagacttttgagagacattcgcgcgtctataccttcgaaatgcagatcatcaaagccaaagataatttcgctggtaattaccgatgtgaagtgacctacaaggacaagttcgactcctgctcttttgacctcgaggtgcacgaatctaccgggacgacccccaatatcgatattcgcagtgcctttaagagaagcggagagggacaggaagatgcgggtgagcttgattttagtggtttactgaaacgccgcgaggtgaaacagcaggaggaagagcctcaagtggacgtctgggagctcctgaagaacgctaagccttctgaatatgaaaaaatcgccttccagtacggtatcacggacttacggggtatgctcaaacgcctcaagcggatgcggcgtgaggaaaagaagtccgcagcctttgctaagatcctagacccagcctatcaggtcgacaagggaggccgcgtgcgcttcgtggtcgagctggctgaccccaagctggaagttaagtggtataagaatggccaggagatacggccctctacaaagtacatcttcgaacataagggatgccaaaggattttattcattaataattgtcaaatgaccgatgatagcgaatattacgtgactgccggcgacgagaagtgtagcacagagcttttcgtgcgcgaaccgcctatcatggttactaagcaattggaagatacgaccgcctattgcggcgagagagtcgagctggagtgcgaggtgagcgaggacgacgcgaacgtgaagtggttcaagaatggagaggaaatcatccccggccctaagtcacggtatagaatccgcgtagagggcaagaagcatatattaatcattgagggagcaaccaaggcggacgccgctgagtatagtgtgatgacaacaggagggcagtctagtgctaaactcagcgtggacctcaaacctttgaagatccttacccctctaactgatcagaccgtcaacttgggaaaggagatttgtctgaagtgcgagatatcagaaaatatccctggcaaatggacgaagaatggcctgccggtgcaagagtccgatcgactgaaagtcgtgcacaagggtagaattcacaagctggttattgccaatgccctgacagaagatgaaggagattatgtcttcgcgcccgatgcctacaatgtgaccttaccagcaaaggtgcacgtcatcgatcctcctaagattattctggatggcctggatgccgacaacacagtcacagttatcgctggaaacaagttacggctggaaattcctatcagtggcgaaccaccgcccaaagcaatgtggtctaggggcgacaaagcaattatggaggggagtgggcgcatccgaacagaaagctatccagacagctcaaccttggtgattgacatagccgagcgcgatgactcaggcgtataccatatcaacctgaagaatgaagctggtgaggcccacgcaagcatcaaggtcaaagtggtcgacttcccggatcccccagttgcgcccaccgtcacggaggtgggggatgattggtgtatcatgaattgggaaccacccgcttacgatggggggtctcccatcctgggatatttcatcgaaaggaaaaagaagcagagcagtagatggatgaggctgaactttgacctgtgcaaagagaccacctttgagcctaagaaaatgatcgagggcgttgcctacgaagttaggatcttcgcagttaacgccataggcatatccaagccaagtatgccctcaagaccctttgtgccgttagctgtgactagtcctcccacactgcttactgtagactccgttaccgacacgaccgtcacaatgcgctggaggccccccgaccatatcggcgcagccggattggacggatacgtcttggagtattgtttcgaggggacagaggactggatagtagctaataaggatcttatagataaaacaaagtttacaataactggcctccctactgatgcaaaaattttcgtgcgggtgaaagccgtcaatgcggccggcgcgagtgagccgaagtactatagccagcccatactggtcaaggagatcatcgagcctcctaaaattaggatccctaggcatctcaaacaaacctacattcggcgcgtgggcgaggcagtcaacctggttattccattccaggggaaacctagaccagaactgacctggaagaaggacggcgccgagattgataaaaaccagatcaatatcaggaattctgagactgacaccattatcttcatcagaaaggcagagcgctcgcattccggaaagtacgacttacaagtgaaggtcgataaattcgtggaaacggccagcatcgacatccaaatcatagataggcctggacccccccagattgtcaagatagaggatgtgtggggcgagaacgtggccctcacttggacgccaccaaaagacgatgggaatgctgccatcaccggctataccattcagaaggccgacaaaaaatctatggaatggtttactgtcatcgaacactatcaccggacatccgccacaattaccgaactggtgattggcaacgaatactatttcagagtcttctctgagaatatgtgtggactgagcgaagatgccacgatgaccaaagagagtgccgttatagcgcgagacggtaagatctacaaaaatcctgtatacgaagacttcgattttagcgaagcgcccatgtttacgcaacccctggtgaacacttacgctatagcagggtacaatgcgaccctgaactgctccgtacgaggcaatccaaagccgaagattacctggatgaagaacaaagtggcaatcgtagatgaccctagatatcgaatgttttccaatcaaggtgtgtgcaccctggagattcgtaaacctagcccttatgacggaggtacttactgctgtaaggccgtaaacgacctgggcaccgtggaaattgagtgcaaattagaggtgaaggtgatcgcccagtag

SEQ ID NO: 196165 - DNA, 1434 bp, Artificial Sequence
  Description of Artificial Sequence: Synthetic coding sequence
atgatggagaagaacaccagcgagggccccgcctgcagccccgaggagacagcttctgagagtgcgaaagtgcctacagctgaaccccccggagaagtggccgtgagcgagagcacaagggaggaacaagtacctaaaccccaggcccccgcgccccaggccccaacagccagcacagccaccaagccagcgcctcccagcgaggatgtgccctccgccccgctcctgctgacactcgacgatgtgtcatccagttctgtcactgttagttgggagccgcccgagcggctggggaggcttggtctgcaggggtacgtgcttgaactatgtcgtgagggcgcctccgaatgggtaccagtgtccgcccggccaatgatggttacacagcagacggtgcgtaatctagctctcggcgataaattccttctgcgggtctctgccgtgtcttctgccggagcaggaccgcctgccatgctggaccagcccatacacataagggaaaacatcgaagctcccaaaattcgcgtgccgcgacacttgcgccagacttacatccgccaggtgggggagaccgtaaacctccagattcctttccagggcaagcctaagccacaggcgacatggacccacaatggacacgcactcgacagccagcgagtgagtatgagaaccggagatcaggacagcatactttttatccggtcggcgcagagatcagatagcgggcgctacgagctgacggtgcgggtcgaagatctagaggctaaggccgtgattgatatcctggtcatcgaaaagcctgggcctccgtcttccattcgcctgctggatgtgtgggggtgtaatgccgccttgcagtggacccccccacaggacaccggcaacaccgaactgctcggttatatggtacagaaagctgacaagaaaaccgggcagtggttcaccgttctggaacgttatcatcctactacttgcacgatctctgatctcattatcggcaactcctactcgttccgggtgttcagtgagaacctctgcgggttatcgacttccgccacagtgactaaggagctggcccacatccagaaggctgacattgctgctaaaccaaagggctttatagaacgggatttctctgaagcgccgtctttcactcagcctctggcagaccacaccagcacaccgggctactctacccagcttttttgtagtgtgcgcgccagccctaagcctaagatcatttggatgaaaaacaaaatggaaatccagggaaatcccaaataccgcgcactgtcagagcagggtgtctgtacactggagatccgaaaaccatcaccattcgatagcggcgtctatacctgtaaggctatcaatgtgttgggggaggcctccgtcgactgtaggctggaagtaaaagccagcgcggcccattag

SEQ ID NO: 196166 - DNA, 5817 bp, Artificial Sequence
  Description of Artificial Sequence: Synthetic coding sequence
atgagcagcgacgccgagatggccatcttcggcgaggccgccccctatcttagaaaacctgaaaaggagcgaattgaggcacaaaaccggcccttcgatagcaagaaggcctgcttcgtcgccgacaacaaggaaatgtatgttaaaggcatgattcagacccgggaaaacgacaaggtgatagttaaaacactggatgaccggatgctcactttgaataatgatcaagtttttcctatgaaccctccgaagtttgacaagattgaggatatggccatgatgacgcatctgcacgagcctgcagttctctataacttgaaagagcggtacgcagcctggatgatctacacatactctggcctattctgtgttactgtaaacccatataaatggctgccggtctacaagccagaagtggtagcggcctacagagggaagaaaagacaggaggcgcccccccatatctttagcattagcgacaatgcatatcagtttatgctgaccgaccgcgacaatcaatcaatactcatcacaggcgagtccggagcaggcaagactgtgaacacaaagcgtgttatccaatactttgccaccatcgccgtgaccggggacaaaaaaaaagagacacaacctgggaaaatgcagggcacactggaagaccagataattcaggcaaaccccctactggaggcgtttggtaatgcgaaaacagtgagaaatgacaattcgtcgcgatttgggaagtttattagaatccacttcggggcgacagggaagcttgcctccgctgatattgaaacgtaccttctggagaaaagcagggttactttccaacttagctctgagcggtcatatcacatcttctaccaaatcatgagcaacaagaagccagagttgatcgatttgctgctgatttctaccaatccctttgatttccccttcgtctctcaaggcgaggttacagttgcatccatcgacgattcagaagaactgctggcgacggataacgctatagacatcttaggattctcttctgaggagaaagtaggtatttataaattaacaggagctgtcatgcactacggtaacatgaaattcaagcagaaacaaagagaggagcaagcagaacccgacggaaccgaggtagcggacaaggccggctatctgatgggactgaactctgccgagatgctgaaggggctgtgctgtccgagggtgaaagtgggtaatgaatacgtgacgaagggacaaaatgtccagcaggtcacaaatagcgtcggcgcgcttgcgaaagctgtgtacgagaagatgtttctgtggatggtcaccaggatcaatcagcaactggacactaaacagcctaggcagtacttcattggtgtcttggacatagctggatttgagatttttgactttaattcgctagagcagctatgcatcaacttcaccaacgagaagcttcagcagttttttaaccaccacatgtttgtgcttgaacaagaggaatacaaaaaagaaggcattgaatgggaattcatcgattttggcatggacctcgcagcctgcatagagctgattgaaaagccaatggggattttttcaattttggaagaggagtgcatgttccccaaagctacggatacctcttttaaaaataagttatatgatcagcatctgggcaaatcaaataatttccagaaaccaaagcctgcaaaaggcaaggcggaagcacacttctctttagtccactacgctggcaccgtggactacaacatcgcgggatggttggacaagaacaaggaccccttgaatgaaactgtggtgggcctgtatcaaaaaagtagcctcaagctgctgagctttctttttagcaattatgccggggctgagacgggcgatagtggtggttccaagaagggtggcaaaaaaaaaggtagtagcttccaaaccgtatctgcggtcttccgcgaaaacctaaacaagttaatgacgaaccttagatccacccaccctcattttgtgagatgtcttattcctaacgaaacaaaaacacccggagtgatggaccattatctggtgatgcatcagttgcgttgcaacggagtgctcgagggcatccgcatttgtagaaaggggttcccctctcgtatactgtacgcggacttcaaacagagatatcggattttaaatgcgtcagccattcccgaaggccagttcattgatagcaaaaatgctagcgagaagctgctgaactctatcgacgtagatcgcgagcagttccgctttgggaatactaaagttttcttcaaagccggcctactggggctgctcgaggagatgagagacgaaaagttagtaaccctcatgacttctacccaggcagtttgtagggggtatctgatgagggtggagtttaagaagatgatggagcgtcgggacagtattttctgtattcagtataacatccgctcattcatgaatgtgaagcactggccttggatgaatctttttttcaagatcaaacccttgctaaagagtgccgaagcagagaaagagatggccaccatgaaagaggacttcgagcggactaaggaagaactcgctcgaagcgaagcacggcggaaagagttggaggagaaaatggtgagcctcttgcaggagaagaacgacctccagcttcaggtgcagagcgaaacggaaaaccttatggatgccgaggaacggtgcgagggcctgatcaagtctaaaattctgcttgaggcgaaagtcaaggagctgaccgaacgtctggaagaagaagaggagatgaatagcgaactcgtggctaagaagcgcaacctggaggacaaatgctcctccctcaaaagagatatagacgatcttgaactcaccctgaccaaggtcgagaaggagaaacacgctaccgaaaacaaagtgaagaatctttctgaagagatgacagctctcgaggagaatatctctaagctcacaaaagagaagaagtccctccaggaagcacatcagcagacactggatgacctgcaggtcgaagaagataaagtgaacggtctgattaagattaatgctaagttagaacagcagaccgatgatctggaagggtctctcgagcaagagaagaagctgcgggcagacctggaacgagccaagagaaagcttgagggcgacctgaaaatgtcacaggaaagcatcatggatctggagaatgacaaacagcaaattgaagagaaactgaagaaaaaggagtttgagttaagtcagttacaagcaaaaatagacgacgagcaggtgcacagcctgcagttccaaaagaagataaaggaattacaagctcgaattgaggagctcgaggaagagattgaagctgaacacacactccgtgccaaaattgaaaagcagcggtcggatttggcccgagagttggaggaaatcagcgagaggctggaggaagcgtcgggagccacgagtgcgcagattgagatgaacaaaaagcgggaggccgaatttcagaagatgcgacgcgatttggaggaggctacactgcagcacgaggccacggctgccactctgaggaagaagcaagccgattccgtggccgagttgggagaacagatcgataacctgcagagggtgaagcaaaagctggagaaggagaagagtgagttgaagatggagatcgacgacatggcctccaatatcgaggctctgtccaaatccaaatccaatatcgagcgcacttgcaggaccgtggaagaccagttttccgagatcaaagccaaagacgagcagcaaacgcagctcatccacgatttgaacatgcaaaaagcccgactgcagactcaaaatggggagctgagtcatcgcgtcgaagaaaaagaatccctgatatctcaactgacgaaaagtaagcaagccttgacccaacagttggaggaactcaagcgccagatggaagaggaaacaaaagcaaaaaatgccatggctcatgccctgcaatctagtagacacgattgtgaccttctgagagagcaatatgaggaggaacaggaagcaaaagcagaactccagcgcgcgctttccaaagcgaacagcgaagttgcgcagtggaggacaaagtatgagaccgatgcgatccagagaactgaggagctggaggaggctaaaaaaaagctggctcagcggctccaggaagctgaggagaacactgagacagctaacagtaaatgtgcaagtctggagaaaaccaagcagagacttcagggggaagttgaggatttaatgcgcgacttagagcgaagccacaccgcatgtgccacgcttgacaagaagcagcgcaatttcgataaggtgctggccgaatggaaacagaagctggacgagtcacaagcagagctggaagccgctcagaaggagtcaaggtccctcagcaccgaactgtttaagatgcgtaatgcctatgaagaagtggtggaccaactcgaaacccttaggagggagaacaagaatctccaggaggagattagcgacctgacagagcagatcgccgagaccggtaagaatttacaagaggctgagaaaacgaaaaagttggttgaacaggagaaaagcgatctccaggtggctcttgaagaggtggagggaagcctagaacacgaggaatccaaaattcttcgcgtgcaactggagttatctcaggtgaagagcgaactggacaggaaggtgattgagaaggacgaggagattgaacagttgaagagaaactcacagcgagctgctgaggcactccagtcagtcctggacgccgagattaggagtcggaacgacgcgctcaggctcaagaaaaagatggagggggacctgaatgaaatggagatccagctggggcactccaatagacagatggcagagacacaaaagcacttgagaacggttcagggacagctcaaagactcccagctacacctagacgacgcactgagatccaacgaagatcttaaggagcagctggctatagtagaacgccgtaacgggctgttgcttgaggaactggaggagatgaaggtggccttagagcagaccgaacgcacacgtcgactatctgagcaggaactcctggacgcatccgacagagttcaactgctccattctcagaacacaagcctgataaacacgaagaagaagttggaggcagatatcgcccagtgccaggcagaggtggaaaactctatccaagaatcacgcaacgcggaggagaaggcgaagaaggccattacagacgcggccatgatggctgaagaactgaaaaaggaacaagacacatccgctcacctagagcgtatgaagaaaaatctcgaacaaaccgtgaaagacttgcagcataggctggacgaagctgagcaacttgcattaaagggcggcaaaaagcagattcagaagttggagaaccgcgttagggaactggaaaatgaactggacgttgagcagaagcgaggcgcagaagccctgaaaggggctcacaagtacgaaagaaaggtgaaagagatgacatatcaagccgaggaagaccataagaacatcctaaggcttcaagatctcgtggataagctgcaggctaaagtgaagagttataaacggcaggccgaagaggccgaggagcaggctaatactcaactcagcaggtgcaggagagtacaacacgagctagaagaggctgctgaacgggccgacatcgctgagagtcaggtaaataaactgcgtgccaagtcgcgtgacgtggggtctcaaaagatggaagagtag

SEQ ID NO: 196167 - DNA, 6111 bp, Artificial Sequence
  Description of Artificial Sequence: Synthetic coding sequence
atggccgccgtgaccatgagcgtgcccggccggaaggccccccccagacctggccctgtccctgaggcagcccagcctttcctgtttacgccaaggggcccttcagccgggggggggcctggctccggtacctctcctcaggttgagtggacagcccgcagacttgtgtgggtgccatctgaacttcacgggttcgaagccgctgcactccgcgatgaaggcgaggaggaagcagaagtggagcttgctgaatccggccgccggctgcgtctcccacgggatcagatacagcgaatgaatccccccaaattcagtaaagcagaggacatggcggaactgacatgtctaaatgaggcaagcgtgctacataacctcagagaacgttactattctggtttgatctacacttacagtggacttttctgtgtagttattaacccctacaagcaactccctatatacaccgaagctatagttgaaatgtacagaggtaaaaagcgccacgaagtcccaccccatgtttacgcagtgactgaaggcgcctataggtcgatgctacaggatcgcgaggaccagtcaatcctctgtaccggtgagagcggcgccggaaaaaccgagaatactaagaaagtgatccagtacttggcccatgttgccagttctccaaaaggacgcaaggagccgggggttcctgccagcgtcagcaccgtctcatatggagagttggaacgccagctccttcaggccaatccaattttagaggccttcgggaatgccaaaactgtgaagaacgacaactcctcccgttttgggaagttcattcgtatcaactttgatgtggccggctacatcgttggagcaaatatagaaacatacttgctggagaagagccgagccatcaggcaggccaaggacgagtgttcttttcacattttctaccaattgcttgggggcgcgggggagcagctgaaggccgacctgttgctggagccctgctcccactacagatttttaaccaacgggcctagctctagccccgggcaggaacgagaactgtttcaagagaccttggaaagcctgcgggtgctgggcttcagccacgaggagatcatcagcatgctcaggatggtctccgcagtgctgcagttcgggaacattgccctgaaacgggagcgcaacactgaccaggccacaatgcctgataataccgccgcccagaagctctgtagacttcttggtcttggcgttaccgatttcagccgggcccttttgactccgcggattaaagtgggaagagattacgtccagaaggcccagacaaaagaacaagccgatttcgctttagaagccctcgccaaagccacgtacgaaagattgtttcggtggctggttcttaggctaaaccgagccctggataggtctcctcgacagggtgcaagttttctgggtattctggacatcgccgggtttgagatctttcaactgaattcatttgaacaactgtgtattaactacaccaatgaaaaactgcagcaattatttaaccacaccatgtttgttctagaacaggaggagtatcagcgggaagggataccatggacttttctcgatttcgggcttgatttacaaccctgcatagatttgattgagaggccggccaatccccctggcttactggcccttcttgatgaggaatgctggttccctaaggccacagataaatccttcgtggagaaagtggctcaggaacaggggggccatcctaagttccagaggcccaggcatctccgagaccaggccgacttcagcgttctgcactacgcaggcaaggtggactataaagccaacgaatggctgatgaagaatatggatcctcttaatgataatgtcgctgcactgctgcatcagagtacagataggctgactgccgaaatctggaaagacgagcacgggggttttcagcagttcagctttctgggctcattcccaccaagcccccccgggagcgcggaacgttgttcttcagctatatcacctccgggcgtcgaggggatagtgggcctggagcaggttagcagtctcggggacgggccccctggggggcgtccccgcagaggcatgtttcggacagttgggcagctctacaaagaaagcttatcgcggcttatggcaacactgtccaacaccaatccatcattcgtcaggtgcatcgtgcctaaccatgaaaaacgtgccgggaaacttgagccacggctggttttagatcagctccgatgtaatggtgtgttggaaggcatacgcatatgtcggcagggtttccctaaccggatcctcttccaggagtttcgacaacgctacgagatcctgacacccaatgccattccaaaaggctttatggatggcaagcaggcatgcgagaaaatgattcaggctcttgagctggatcccaatttgtaccgcgtcggccagtctaagattttcttcagggcgggggtactggcccagctagaagaagaacgtgatttaaaagtgaccgacataatcgttagctttcaagctgcagctagggggtacctggcccggagggccttccaaaagcggcagcaacagcaaagcgccttgcgcgtaatgcagcgtaactgcgccgcctacctgaagctccgtcattggcagtggtggcgcttattcacaaaagtcaagcctttactccaggttacccgccaggatgaagtgctacaggcaagggcgcaagagctgcaaaaggtgcaggaactgcaacagcaaagtgcccgagaagtgggcgagctacagggtcgggtcgcccagttggaagaggagcgagcacgcctagctgagcagctgcgggccgaagcagagttgtgtgctgaagccgaggagacccgtgggcggctggcggccagaaaacaggagctcgagctggtggtaagcgaactcgaggcacgggtcggggaggaggaggagtgctctagacaaatgcaaaccgagaaaaaaaggctccagcagcacatccaggagcttgaggctcacttggaagcagaagagggagctaggcaaaaactgcagctggagaaagtgactaccgaagcgaagatgaaaaaattcgaagaggatctgctcctgctggaagaccagaactccaaacttagtaaagagagaaagttgctggaagatcggctggcggaattctcttcccaggccgccgaggaagaggaaaaggtgaagtcattgaacaaattgagactcaaatatgaagccacaatcgccgacatggaggaccggctgcgtaaggaggagaaggggaggcaggagctggagaagctgaagaggcgccttgatggcgagagcagtgagcttcaggagcagatggtggagcagcagcagcgcgctgaagagcttagggctcagctcgggcgaaaggaagaggagttgcaggcggcattagcgagagccgaggacgaaggcggcgcccgggctcagctgctgaagtccctgcgggaagcccaagctgcactcgccgaagcccaggaagatctcgagagtgagcgggttgcccgcaccaaggccgagaaacagaggcgggatttaggcgaagagttggaagccctccgtggcgaattagaggatacactcgactctacgaatgcccaacaggaacttcgctctaagcgagagcaagaagttacggagctcaagaagactctggaagaggaaactcgcattcacgaggcagcggtgcaagagctccgccagagacacggtcaggccctcggggagctcgcagagcagcttgaacaggcccgaaggggcaaaggtgcctgggagaagacgcgcctagctctcgaagccgaagtgtcagagttgcgcgcagagttgtcctccctgcagacggccagacaggaaggcgaacagcggcgtcgtcgcttggaactgcagctgcaggaggtgcagggccgggcgggagatggggaacgagcccgcgccgaagcggccgagaagctgcagcgggcacaggccgaactggaaaacgtgagcggtgctcttaacgaggccgaaagcaaaaccataaggctctcaaaggaattaagcagtacagaagcacaactgcacgacgcccaggagctgttacaagaagaaacgcgcgccaagctggcactgggatcacgcgtgagagccatggaggccgaggccgccggcctgcgagagcagctggaagaagaagcagcagctcgcgaacgagctggacgggagctacagacagcccaagcacagctgagtgagtggcgacgaaggcaggaagaagaggccggtgcgctcgaagccggtgaggaagcccgcagacgggcagccagggaggcggaagccctgactcagcgcctcgccgagaaaactgagaccgtcgatagacttgaacgcgggagaaggcggttgcagcaggagctggacgacgccacgatggacctcgagcagcagcggcagttggtgagcacactcgagaagaagcagcgtaaatttgaccagttacttgccgaggagaaagcggccgttttgagggctgtagaagaacgggagcgggctgaagcagaagggcgcgaacgagaggccagggcactgtctctcaccagagcattggaggaagagcaggaggcccgggaggagctcgagaggcaaaaccgggcactgagagccgagcttgaagccttgctatcatccaaggatgatgtgggaaagtccgttcacgagctagagagagcctgccgcgtagcagaacaggcggccaatgatctgcgggcacaggtgacagagctggaagatgagttgaccgctgcagaggatgccaagttgagactggaagtgaccgttcaggccttgaaaacacaacacgagcgcgatctgcagggtcgcgacgaggctggagaagaaaggaggcggcagcttgccaagcagctcagagatgctgaggtggagcgcgatgaagagcgtaaacagaggactctcgctgtagccgcccgaaagaaactcgaaggcgagttggaagagttaaaggcacagatggcatccgcaggccagggaaaagaggaagcggtgaagcagctgcgaaagatgcaggctcagatgaaggaactgtggcgggaggtagaagagacacgcacctcacgggaggaaattttttcccagaatagggagtcagagaaaagactgaagggcttagaggcggaggtgttgaggctacaggaggaattggcagcctctgacagagcaagacgccaggcccagcaggacagagacgagatggcggatgaagtagcgaatggcaatctgagcaaggccgcaatcttggaggagaagcgccagcttgaaggccggttaggccagctggaggaagagcttgaggaggagcaatccaatagcgagctgctgaacgaccgttacaggaagctacttctccaagtggagtccttgactactgagctgtccgctgaaaggtctttcagcgctaaggccgagtctggacggcaacagttggaaagacagatccaggaattgcggggtaggctgggagaggaagatgccggggcccgtgcgagacacaagatgacgatcgcggccttggaatctaagttagcacaggctgaggagcagctggagcaggagaccagagagcgtattctctccggtaaactggtgaggagggctgagaagagattgaaagaagtggtcctacaggtcgaggaggagcgcagggtggcagatcagctgcgtgaccagctggaaaaggggaatcttcgggtaaagcaattaaagcggcagttagaggaggctgaagaggaagcgagtagggctcaggctgggagaaggcggctacagcgtgagttagaagatgtgaccgaatcagctgagagcatgaacagagaagtcaccactctgagaaaccgcctgaggaggggacccctaacttttacaactcgcacggtaaggcaggttttccggctagaggagggcgtggcttctgatgaagaggcagaggaggcccaaccgggatctggcccatcccctgagccagaaggaagcccccctgcccatccacagtag

SEQ ID NO: 196168 - DNA, 5823 bp, Artificial Sequence
  Description of Artificial Sequence: Synthetic coding sequence
atgagcagcgacaccgagatggaggtgttcggcatcgccgccccctttctgagaaagtccgagaaagaaagaatcgaagcccaaaaccagcccttcgatgccaaaacgtattgctttgtggtggactcgaaggaagagtatgcgaaaggaaagatcaaatccagtcaggacggaaaggtaacggtggaaacagaagacaatcggaccctcgtggtcaagcctgaggatgtctatgcaatgaacccccccaaatttgatagaatcgaggatatggccatgcttactcacctgaatgagccagcggtgctttataacctcaaggacaggtacacatcctggatgatttacacctatagtggtctgttctgcgtcacagttaatccctacaagtggctcccagtctacaatccagaggttgtagaaggctatcgggggaagaagcgccaggaggcacctcctcacatattctcaatctctgataacgcttaccagtttatgcttaccgaccgagaaaatcagagcatcctgataaccggggaatccggtgctggcaagacagtcaacaccaaacgggtgatccagtactttgccaccatcgccgccacgggagacctggccaagaagaaggattcaaagatgaaaggtaccctcgaagatcaaatcattagcgcaaatcctctgctcgaagcttttggaaatgccaaaacagtccgcaacgataactcttccaggttcggtaaattcattcgcatccattttgggaccacgggcaagctggcctctgccgatatcgaaacctatcttctggaaaaatctcgcgtgaccttccaactgaaggctgagaggtcctatcacattttctaccaaatcctctctaacaaaaaacccgaacttatcgaactcctcctcattacaaccaacccctacgattaccccttcatatcccagggcgagattcttgtggcctccatcgacgacgccgaggaactgttagccacggattctgcaatcgacatcttaggtttcactcctgaagaaaaatccggactgtacaaactgactggcgccgtcatgcattatgggaacatgaaattcaagcagaaacagagggaagagcaggccgaaccagacggaacagaggttgccgacaagactgcgtacctgatgggcctcaatagttcagatctgctaaaagctctttgtttcccgcgcgtgaaagtaggcaatgaatatgtgaccaagggccaaacagtggatcaagtacatcacgcagtaaatgcgctgtctaaaagtgtatatgaaaaactgttcctgtggatggtcacacggatcaaccagcagctggacaccaagttgcccaggcagcacttcatcggcgtgctggacatcgctgggttcgaaatttttgaatataacagtctggaacagctctgcatcaactttactaacgagaagctgcagcagttcttcaaccaccatatgtttgtgttagagcaggaggaatataaaaaagaaggaatcgaatggaccttcatcgactttggtatggacctggctgcctgcatcgaactcatcgagaagcctatggggattttctcaatactggaggaggaatgcatgtttccgaaagccactgatacgtcatttaagaacaagctgtacgatcagcacctgggcaagtctaataattttcaaaaacccaaagtggttaaaggacgggccgaagcccatttctcactgattcattatgccggtactgtagactactccgtgtccgggtggctggagaagaacaaggaccctttgaacgaaactgtcgtggggctctaccagaagagttccaaccgtttgctcgcccacctgtacgcgactttcgcaaccgcagatgcagactcaggcaagaagaaggttgccaagaaaaaggggagtagcttccagaccgtctccgccttgtttcgcgagaatcttaataagcttatgtccaacctaagaactacacatcctcattttgtgcggtgcattattccaaacgagactaaaaccccaggggcaatggagcatagtctcgttctgcaccagctccggtgtaatggcgtactggagggtattcgcatatgcaggaaaggttttccaaatagaatactttatggggatttcaagcagcggtacagggtattgaacgctagcgccataccagaaggccagttcatcgatagcaaaaaagcgtgcgagaagctgctcgcgagcatcgatatagatcatacacagtacaaatttggacataccaaggtctttttcaaggcggggctgctgggaacccttgaggaaatgcgtgatgaccggctggcaaagctgataacaagaactcaggccgtgtgccggggattcctcatgcgcgttgagtttcagaagatggtgcagaggcgagagtctatcttctgcattcaatataacatacgctcatttatgaatgtaaaacactggccctggatgaagctgttttttaagattaagccgctcctgaagtctgctgaaacagagaaggagatggctacaatgaaagaggagttccagaagacaaaggatgagctggccaaatctgaagcgaaacgcaaagaactggaggagaagctcgtgaccctggtgcaagagaagaatgatctccagctgcaagtccaggcagagtccgagaacctgttggatgctgaggagcgttgtgatcagctgatcaaggccaaattccagctggaggccaagatcaaggaggtcaccgaacgggcggaggatgaggaagagataaatgctgagctaaccgcaaagaagcggaaactggaggatgagtgcagcgagctcaaaaaggacatagatgacctcgagttgactctggcaaaggtggagaaggagaagcacgccactgaaaacaaggttaaaaatttgaccgaggagctgagtggcctggacgaaactattgctaaactcacgcgagaaaaaaaggcactacaggaagctcatcaacaggccctcgacgatctgcaggctgaagaggacaaagttaattccctcaacaaaacaaaatctaaactggagcagcaggttgaagacctggagtcctcattggaacaagaaaagaaacttagagttgaccttgaacggaataaacgcaagctcgagggcgacctgaagttggcccaggaaagtatccttgacctagagaatgacaaacagcagctggacgaacggctgaagaaaaaggattttgagtactgtcagctccagagcaaggtggaggatgagcaaaccctggggctccaattccaaaaaaaaatcaaggaactgcaggcccggatagaggagctcgaagaagagatagaggctgagcgggccacccgggccaaaacagaaaaacagcgctcagattatgccagagagctcgaagaactgtccgaacggctagaagaggccggtggtgtgacctctacccagatagagcttaacaaaaaacgtgaagcggagtttctcaagctccgccgagacctggaggaagctactttacagcatgaggctatggtagccgcactcagaaaaaaacatgccgattcagtggccgagcttggtgagcagatcgacaacctccaacgggtgaagcagaaactcgaaaaagagaaaagcgagttcaaactcgaaattgacgacttatcttcgtccatggagtctgtgtctaaaagcaaggccaacctggaaaaaatatgcagaacactggaggatcaactgtccgaagctagagggaaaaatgaggaaatccagcggagcctgtctgaattgacaacccagaagtcaagactgcaaactgaggcaggcgaactcagtaggcagcttgaggagaaggaatccattgttagtcagctgtctaggtctaagcaggcatttactcagcagaccgaggaactgaagcggcagctcgaggaagaaaacaaggcgaagaatgccctcgcacatgctctgcagagttctcgacacgattgtgatcttctccgggagcaatacgaggaggaacaggagggcaaggccgagttgcagagagcccttagcaaggcaaacagcgaggttgcccagtggcgcactaaatacgaaacagacgcaattcaacgaaccgaagagctcgaagaggccaaaaaaaaactggcacaacgtctgcaagattccgaggaacaggtagaggcagtgaacgccaagtgcgccagcctggagaaaactaagcagagactgcagggcgaggtcgaagacttaatggtggatgtcgagagagctaatagcctggctgcagcgctggataaaaaacagcgaaattttgacaaggtcctggccgagtggaagacaaagtgcgaagagtcccaggcagagctcgaggccagcctgaaggagagccgatctctaagcaccgagctgtttaaacttaagaacgcctacgaggaggctctggaccagttggagacggtgaaaagagagaataaaaacctggagcaggaaatcgccgacttgactgagcagattgctgaaaatggcaaaacaattcacgagcttgaaaagagccgcaaacagatcgagctcgaaaaggccgacattcagcttgccttggaggaggcagaagccgcgctagagcacgaggaggccaagattctgagaatccagctggaacttacccaggtgaaaagcgagatcgaccggaagattgcggagaaggatgaagagattgaacagttgaagaggaattatcaaaggacagtggagacaatgcagagcgctctcgatgccgaggttaggtcaagaaacgaagctattcggttgaaaaagaagatggaaggcgacctgaatgagattgagattcaactgagccacgcaaacagacaggccgccgagaccctgaagcacttgagatccgtgcagggtcagctgaaagacacccagctccatctcgatgatgctctaagaggacaggaggacctgaaagaacaactggccatcgtggagcggagagcaaatctgctgcaagctgaggtcgaagagctgcgggctacactcgaacagacagagcgagctcggaagctggctgagcaggaactgctggattcaaacgaacgggtccaactgctccacacccaaaatacctctctaatccatacaaagaagaagctggagacggacctgatgcagctccagtccgaagtcgaagatgccagccgagatgcaagaaatgccgaggagaaagcaaagaaggcaataacagatgccgctatgatggcggaggagctcaaaaaggagcaggatacatcagctcatttagagaggatgaaaaagaacctggaacagacagtaaaggacctgcagcaccgattagacgaggccgaacagctggccctgaaaggagggaagaaacagatccagaagctcgaaacccgaatcagggagctcgagttcgaattggagggcgagcagaaaaaaaacaccgaaagcgtgaaagggcttcgcaagtacgaacgacgcgttaaagagctgacttatcagagtgaggaggaccgaaagaacgtgttaagactccaggacctggttgataagctgcaggtgaaagtgaaatcatacaaaaggcaagcggaggaggccgatgagcaggccaatgcccatctcaccaagtttcggaaggcgcagcacgaattggaagaagccgaagagagagcagacattgcggaaagtcaggtgaataagctccgtgcaaaaactagagatttcacctcttcacgaatggtcgtccatgagtcagaagagtag

SEQ ID NO: 196169 - DNA, 3132 bp, Artificial Sequence
  Description of Artificial Sequence: Synthetic coding sequence
atgcccctgctggagggcagcgtgggcgtggaggacctggtgctgctcgagcctctggtagaagaatcgttgctaaagaacctgcagctgcgctacgagaataaggaaatttatacttacattggaaatgttgtcatctcagtgaacccctatcagcagctgccaatctatgggccagagttcattgcgaaataccaggactatacgttttatgaactcaagcctcacatctatgctctggcaaacgtggcataccagtccctccgggacagagaccgggaccaatgcatactgataaccggcgagtccggaagcggcaagaccgaggccagtaagcttgttatgtcctatgtcgctgccgtctgcggtaaaggtgagcaagtcaactccgtcaaggaacagttgttgcagtccaaccccgtgcttgaagctttcggcaacgccaaaacaatacgcaataacaattcatcaagatttggaaagtacatggacatcgagtttgactttaagggctcgccattagggggcgtcatcacgaattacctcttggagaaatcaagattagttaagcaactgaaaggcgaaaggaacttccacattttctaccagctccttgccggagccgatgaacagttgttgaaagcactgaagttagaaagagacacgactggctatgcctaccttaatcacgaggtgagccgtgtcgatggcatggacgacgcatcttcttttcgcgcggtgcaatccgccatggctgttatcggcttttccgaagaggagatacgccaggtgttggaggtgacctccatggtcctaaagttaggtaatgtgctggttgccgacgaatttcaggcaagcggcattcctgcaagcgggattagggatgggagaggggtgagggaaattggcgagatggtgggtctgaattcagaagaggtggaaagggctctgtgttctcgtacgatggagacagcaaaggagaaggtcgttaccgcattaaacgtcatgcaagcccagtatgctagggatgcccttgccaagaacatatattcccgcctctttgactggatcgttaacaggataaacgagtccattaaggttgggatcggagagaagaagaaagtcatgggtgtgctcgacatttatgggttcgagatcctggaagacaacagcttcgaacagttcgtgatcaactactgcaacgagaaactgcagcaggtgtttatcgagatgaccctgaaggaggaacaggaagagtacaagagagagggtatcccctggactaaggtggattattttgacaatgggatcatatgtaagctcatcgagcacaaccagcgaggcatactggcaatgctggatgaagagtgcttgcgcccaggagtggttagtgatagcacttttctagcaaaactgaatcagctgtttagtaaacatggccattatgaatcaaaagtgacccagaacgcgcagcgccaatacgatcacacaatgggcttaagctgttttagaatttgccactatgcaggcaaagttacctataacgtaaccagcttcattgacaagaataacgatctcctgttcagagatctcttgcaggcaatgtggaaagcccagcatcctctgttgaggtcccttttccccgaagggaacccaaagcaagcgtcactgaaacggcctcctactgccggagcacagttcaaatcatcggtggcgatactcatgaagaacctttatagcaaatctcccaattatatacgctgtatcaagcccaatgaacaccagcagcggggacagttctcctctgaccttgtggcaacccaggcacggtaccttggcctgctggagaacgtgcgcgtgagacgcgcgggctatgcccatcggcagggctacggcccctttctggagcggtatagacttctgagccgcagcacctggccccattggaacgggggagaccgtgagggagtggaaaaagtactgggggagctctctatgtccagtggcgagctcgcattcggaaaaaccaaaatctttattaggtctcctaaaacactcttttatctggaggagcaacggagacttaggttgcaacagttggcaacattgatccagaagatctatagaggctggagatgccggactcattaccagctgatgcgaaaatctcagatcttgatatccagctggtttcgcggaaacatgcaaaagaaatgttatggcaaaatcaaagcgagtgttttattaatccaagcatttgtgcgcggttggaaggcccgaaagaactatcggaaatatttccgctctgaggccgccttaaccctcgctgatttcatctacaagagcatggtgcagaaatttctgctggggctgaaaaacaacctgccttctactaacgtccttgataaaacttggcccgcagcaccttacaagtgcctctccactgcgaaccaggagctccaacagctcttttatcagtggaaatgcaagaggttccgtgaccagctgtcacctaagcaggtggagatcctacgtgagaagctttgtgccagtgaactgtttaaaggaaaaaaggccagctatccacaaagcgtgccaatccctttctgtggcgattatatcggcctgcagggcaatcccaagctgcagaaattgaaaggcggcgaagagggtcccgtgttgatggccgaagcagttaaaaaggtgaacagaggcaacggaaagacaagctcccgtatcctgttgctgaccaaagggcacgtcatcttgaccgacacaaagaaatcacaggccaagatagtgatcggcctagacaatgtcgcaggtgtgtccgttacaagcctgaaagacgggttgttcagcctgcacctatccgagatgagtagcgtcggatcgaaaggggatttcctcctggtttccgagcatgtcattgagttacttactaagatgtaccgcgcggtactggatgcaactcaaaggcagctgactgtgactgtcacagaaaaattttctgtacgctttaaagagaatagcgtcgctgtcaaagtggtgcagggtccagcaggcggcgataattcaaagcttcgctacaagaaaaaagggagccattgcctggaggtgacagttcagtag

SEQ ID NO: 196170 - DNA, 291 bp, Artificial Sequence
  Description of Artificial Sequence: Synthetic coding sequence
atgcccctgctggagggcagcgtgggcgtggaggacctggtgctgctcgaaccactggttgaggagagcttgctgaaaaaccttcaactgcgctatgagaacaaagagatttacacctatatcgggaatgtggttatttcggtgaatccataccagcagcttcccatttacggcccagagtttattgccaaatatcaagactataccttttacgagctaaagccgcacatatacgccctggccaacgtggcctatcagtctctaagagatcgcgatagagaccagtgttag

SEQ ID NO: 196171 - DNA, 3132 bp, Artificial Sequence
  Description of Artificial Sequence: Synthetic coding sequence
atgcccctgctggagggcagcgtgggcgtggaggacctggtgctgctggaaccactggtcgaagaaagcctcttgaagaaccttcagctgaggtacgagaacaaggagatatacacttacattggaaacgtagtcatctccgtaaacccataccagcaactccctatttacggtcccgagtttatcgcgaagtaccaggattacaccttctatgaactgaaaccgcatatttacgcactcgcaaatgtcgcttatcagagtttgagagaccgcgatcgtgaccaatgcattcttattaccggcgagagcggctccggaaagaccgaggcatcgaaacttgtgatgagttatgtggcggccgtgtgtggcaagggagagcaggtgaatagtgtgaaggagcagctgctgcagtccaacccggttttggaggcctttggcaatgccaaaacaatccggaataataattctagtcgatttggtaaatatatggacattgaatttgacttcaagggcagtccactggggggtgtgatcactaattacttactggagaagtcacgattggtaaaacagctgaagggcgaacgtaactttcacattttttaccagctgctggccggcgcagatgaacagcttttgaaagctttgaagctcgagcgggacacaaccggttacgcctatctcaaccatgaggtcagcagagtagacgggatggatgacgcctctagctttcgggccgtccagagtgcgatggcggtcattggattcagcgaggaagagatacgccaggtcctggaggtcaccagcatggtgttgaagctgggcaacgtgctggtcgctgatgagtttcaggccagtgggattcctgcctccggtatccgggatggaagaggagtgcgcgagatcggagagatggtgggtttaaactcggaagaggtggagagggcgctgtgtagcaggacgatggaaaccgcaaaagagaaagttgtcacagcattaaatgtgatgcaggcgcagtacgccagggacgcacttgcgaagaatatctatagccgcctgtttgattggattgttaaccggataaacgagtccattaaagtcggcattggggaaaagaaaaaagtgatgggcgtgttggatatatatggattcgaaatattggaggacaatagcttcgaacaatttgtcattaactactgcaatgagaagttacaacaggtgttcatcgaaatgaccctgaaagaggagcaagaagagtacaagagagagggaatcccatggactaaggtggactattttgacaatggtatcatctgcaaactgatcgagcacaaccagcgcggtatactcgcgatgttggatgaagagtgtctcagaccgggtgtcgtgtctgacagcactttcctggctaaactgaatcaacttttttcaaaacacggacattacgaatcaaaagtcactcagaacgcccagcggcagtatgaccatactatggggctgtcgtgtttccgcatttgccactacgcagggaaggtgacgtacaatgtgacatcgtttatagacaaaaacaatgatcttctgttcagagatctgctgcaggcaatgtggaaggcccagcaccctctgttgcggtcactttttccagaggggaaccccaagcaggcttctctcaagaggccccccacggccggtgctcaattcaaaagtagtgtggcaatcctgatgaagaacctgtatagcaagtcaccaaactatatcaggtgcatcaaaccaaatgagcaccagcagcgaggacaattttcctcagatcttgtcgcaacccaggccagatacctcggcctcctagaaaatgtccgtgtccgacgtgccgggtatgctcaccgccaaggctacggccctttcctggaaaggtacagacttctgtctcgttcaacttggcctcactggaacgggggtgatcgcgagggcgttgagaaagtcctcggagaactcagtatgagctccggggagctcgctttcgggaagacaaaaatcttcatccggtccccgaagactctgttttatctggaggagcagcggcggctgcgcctgcaacagctagccactcttatacagaaaatttaccgagggtggcggtgtcgaacgcattaccagctgatgaggaaatcacagatactgatcagttcctggttccgcgggaacatgcagaaaaaatgctatggtaagataaaggccagcgtgctgcttatccaggccttcgttcgcggatggaaggcgcgtaaaaattaccgcaaatacttccggagcgaggctgcactcacgctggccgacttcatttataagtcaatggtccagaagtttttgctgggactcaagaacaacctcccaagtacaaacgtcctcgataaaacttggccagcagctccctacaagtgcttgtctacagcaaatcaggagctgcagcagttgttctaccagtggaaatgcaagcgtttcagggatcagctgtcccctaagcaggtggaaatcctccgggagaagttgtgcgccagtgagctctttaaagggaagaaggccagctatccccaatcagttccgattcccttctgcggtgactatattggcctgcaggggaatccaaaactccagaagctgaagggtggggaagaaggacctgtcctaatggctgaagccgtgaaaaaggttaatcggggaaatggcaaaaccagttcacgtattctgcttctaactaagggacatgtcatccttaccgataccaagaagagtcaggccaagattgttatcggtctcgacaatgtcgccggcgtcagcgttacctcgctgaaagacggactgtttagcttgcacctgtctgagatgagtagcgtcggcagcaaaggggatttcctgctggtgagtgagcacgtgatcgagctgctgacaaaaatgtaccgagccgtgctggacgcaacccagaggcaattgactgttaccgtgaccgagaagttctccgtgcgattcaaggaaaattccgtcgccgtgaaagtggtccagggtcccgccgggggagacaattccaaacttcggtacaaaaagaaggggtctcattgtctggaggtgaccgtgcagtag

SEQ ID NO: 196172 - DNA, 2646 bp, Artificial Sequence
  Description of Artificial Sequence: Synthetic coding sequence
atggacatcgagttcgacttcaagggcagccccctgggcggcgtgattaccaactacttgcttgaaaaatctcgactcgtcaagcaattgaaaggtgagagaaacttccacatattctatcaactgctggcgggggccgacgaacagctgctcaaagcccttaaacttgaaagggataccaccggatacgcgtatttaaaccacgaagtctcccgggttgatggcatggacgacgcttcttctttccgagccgtacaatcagctatggctgtgattggcttcagcgaggaggagattaggcaggtccttgaggtgacttcgatggttctgaagctgggtaacgtgctagttgcagatgaattccaggctagcggaatccccgcatccgggatcagggatggccgcggcgtgcgggagataggtgaaatggttggtttgaacagcgaggaagttgaacgcgcgttatgcagtcgcacaatggaaacagctaaggagaaggttgtcaccgctcttaacgtgatgcaggcgcagtacgctagggatgccttggccaagaacatctactcacgactcttcgattggatcgtgaatcgaatcaacgaaagtatcaaggtcggaatcggggagaagaaaaaggtgatgggggtcctagacatctatgggtttgagattctcgaggacaattcctttgagcaatttgtgattaactattgcaacgagaaactgcagcaggttttcatcgagatgactcttaaagaagagcaggaggaatacaagagagaaggtatcccctggacaaaagtagactatttcgacaatgggatcatctgtaaactgatcgaacacaatcagaggggcattctggccatgcttgacgaagaatgtcttcggcccggtgtcgtgtctgactccactttcctggctaaactgaaccagctcttctccaagcatgggcactatgaaagtaaggtgacccagaatgctcagagacagtacgaccacacaatggggctcagttgttttcgtatctgtcactacgccggaaaagtcacatacaatgtcacatcctttattgacaagaacaatgacctgttattcagagaccttctacaggccatgtggaaggcgcagcatccactgttgcggtcgctgtttcccgaagggaaccctaaacaggctagtcttaaacgacctccaacagccggcgcacagttcaaatcttccgttgcgatcctgatgaagaacctgtattcgaagagccccaattatatcaggtgcattaagccaaatgaacaccaacagcgaggacagttcagttcagatctcgtcgccactcaagcacgctacttgggcctgttagagaacgtgcgcgtgagacgcgccgggtatgcccaccgacagggttatggaccattcctcgaacgctatagactactttcgcgcagtacttggcctcattggaacgggggcgaccgcgaaggcgtggagaaggtgctgggtgaactatccatgtcttccggagagctggctttcggaaagaccaaaatcttcattcgaagccctaaaaccctgttttacttggaggagcagcggcggttacgtctgcaacagctcgcaactctgatacagaagatttatagggggtggcgttgccggacacattaccagctcatgaggaagtcccagatcttgatttctagttggtttcgcggtaacatgcagaaaaagtgttacggaaaaataaaagcaagcgtgctgttgatacaagcatttgtgagaggctggaaggccaggaagaattatcgcaagtattttagatctgaagctgcactcacactggctgatttcatatacaaatcaatggtgcagaagttcctgctcgggctcaagaataatctgccaagcactaatgtcctcgataaaacatggcccgcagccccttacaagtgtctgtctactgcgaaccaggagctgcaacagctgttttaccagtggaagtgtaagcgatttcgcgaccagctgtctcctaaacaggtagagattcttcgcgagaagctgtgtgcgagcgaactctttaaaggcaagaaagcaagctatccccaatcggtgccgattccattttgtggtgattacatcggccttcagggaaacccaaagctgcagaagctcaagggcggcgaagagggccctgtgctgatggcggaggctgtcaaaaaggtgaaccggggtaatggcaagaccagtagcagaattctactcttgacgaagggccacgttatcttaactgacactaagaagtcacaggcgaagattgtaattgggttagacaacgtggctggggtctcagtgacgtcactgaaggatggactttttagcctccatctctctgaaatgtcttctgtgggttctaaaggtgattttttgctcgttagtgagcacgtgatcgagctactgactaaaatgtatcgtgcagtcctggacgccacccaacggcagttgaccgtgacagttaccgagaagttttctgtgcgcttcaaggaaaattctgtggctgtgaaggtggtgcaggggccggctggaggagacaacagcaagttaaggtacaagaaaaagggatctcactgtctggaggtgacagtgcaatag

SEQ ID NO: 196173 - DNA, 3411 bp, Artificial Sequence
  Description of Artificial Sequence: Synthetic coding sequence
atggccaagatggaggtgaagaccagcctgctggacaacatgatcggtgtgggagacatggttctgcttgaacctttgaacgaagagacttttatcaataacctgaagaaacgattcgaccattccgagatttatacatatatcgggagcgtggtcattagtgtgaatccctacagaagcctgcctatctatagtccagagaaggtagaagaataccgcaaccgcaatttctatgaactgagcccccacatcttcgcgctaagcgacgaagcctatcggtctctccgagaccaggacaaagaccaatgcattctcatcaccggagagtcaggagctggcaagactgaggccagtaaactggtgatgtcgtatgtcgccgcagtgtgtgggaagggagctgaagtgaaccaagtaaaggagcagctccttcagtctaaccctgtgttagaggccttcggtaatgccaaaacagtgcggaacgacaactcttctcggttcggaaaatatatggacattgaattcgattttaaaggcgatccccttggaggcgtcatcagcaactacctcctggagaaatcacgggtcgtgaagcagcctaggggggagcgaaatttccatgttttttaccagctgttgtctggtgcctcagaagaactgctgaataaacttaagcttgagcgcgatttctcccgctacaattacctgagtctcgacagtgccaaagtcaacggcgtggacgatgcagccaacttccgaaccgtcaggaacgctatgcagatcgtgggatttatggatcacgaggctgagtccgtgctcgctgttgtggccgctgtgctcaagttggggaacattgaatttaaacccgagtccagagtcaacggcctggacgaatccaagattaaggataagaatgaattaaaagaaatatgtgaattgaccgggatcgatcagtctgttctcgagcgggccttttcctttcgcacggttgaagcaaaacaggaaaaggtctctaccacacttaacgtcgctcaggcttactatgcacgggatgctttagctaaaaatctgtactctagactgtttagctggctggtcaaccgtatcaacgaaagcattaaggcgcaaaccaaagtccgcaagaaagtgatgggagtactcgacatatacgggtttgaaatcttcgaagataactctttcgagcagtttataatcaactattgcaatgaaaaactgcagcaaatctttatcgagctgaccttgaaagaagaacaggaggaatacattagggaggatattgaatggacacacattgattatttcaacaacgcaattatctgtgacttgatcgagaataacactaacggcatcctcgcgatgctagatgaggagtgtctgaggccaggaacggtaaccgacgaaaccttccttgagaagttgaaccaggtgtgcgccactcatcagcattttgagtcaagaatgtccaagtgtagccgattcctcaatgacacttcattgccccacagctgttttcggattcagcactacgccgggaaggtactgtaccaagtagaaggctttgttgacaaaaataacgatcttctctacagagacctcagtcaagctatgtggaaagcctcccacgcattgatcaagagcctgttccccgagggcaatcccgcaaagataaacttaaagagacccccaaccgctgggagtcagttcaaggcgagcgtggcaacccttatgaaaaacttgcaaacaaaaaatccaaactacattcgttgcatcaagcccaatgacaaaaaagcggcgcatatcttcaacgaagccctggtctgtcatcagattagatacctgggtctattagaaaacgttcgcgtgagacgcgctggatacgccttcagacaggcttacgagccatgtctggaacgttataaaatgctgtgcaagcagacgtggccccactggaagggccctgcccgttctggagttgaggtgctgttcaacgagctggaaatccccgtagaggaatactctttcggccggagtaaaattttcattaggaatcctagaaccttgtttaagctggaggatctacgtaagcaaaggctggaagatctcgctacccttatccagaaaatctaccgggggtggaaatgtcggacgcactttcttttgatgaagaagagtcagatcgttatcgctgcctggtaccgaagatacgcacagcaaaagcggtatcagcagacaaaaagctccgctctggtgatccagtcttatatacgagggtggaaagcacgcaagattctgagggaactgaagcatcagaagcgctgcaaggaggccgtcactaccatcgcagcttattggcatggaacacaagctagacgagagctgcggcggctcaaggaagaagccaggaacaagcacgctattgccgtgatatgggcttactggctcgggagcaaggccagacgagagttgaagagactgaaggaagaggcccggagaaaacatgccgtcgctgtgatctgggcctactggttagggctgaaggtgcgtcgagaataccgaaagttcttcagagccaatgcaggcaagaagatatatgagttcacactgcagcggattgtgcagaaatacttcctagagatgaaaaacaaaatgccttcactctctccgatcgataaaaactggccgagtaggccatacctgttcctcgattcgactcacaaagagttaaagaggatatttcacttatggcgctgtaaaaaataccgggatcagtttaccgatcagcagaagctcatttacgaggagaagttagaggcctcagaactgtttaaggacaagaaagccttgtacccttctagcgtggggcagcccttccaaggcgcctacctggaaataaataagaaccctaagtacaagaaactgaaggacgctatagaagaaaagataattatcgctgaagtcgtgaacaaaataaatagggctaatggcaaatccacctcacgaatcttcctcttgaccaacaacaatctactcttggccgaccaaaaatctgggcaaattaaatccgaagttccactggtagacgtgacgaaagtgagcatgtcaagtcagaatgatgggttttttgcagttcatttgaaggagggcagcgaagctgcttccaaaggtgactttctgttctcctctgaccacctcatcgagatggctaccaagttgtaccgaacgactctctcccaaacgaagcagaagctgaacattgagatttcggatgagtttttagtccagtttcgccaggacaaagtctgtgtcaaattcatccagggcaatcagaagaatggaagcgtgcctacctgcaaacggaagaataaccggttactggaagtcgcggtgccttag

SEQ ID NO: 196174 - DNA, 3237 bp, Artificial Sequence
  Description of Artificial Sequence: Synthetic coding sequence
atggccaagatggaggtgaagaccagcctgctggacaacatgatcggggtcggtgatatggtactgctagagccgctgaacgaagaaacttttattaacaacctcaaaaagcggtttgaccacagcgagatttacacatacattggctccgtggtgatctccgtgaacccttaccggagtctcccaatttactcgcctgaaaaggtggaagagtatcgcaaccgcaacttttacgaactgtctcctcatatcttcgctttatccgatgaagcctatcgcagtctccgagaccaagataaggaccaatgcatacttatcactggcgaatctggagccggaaaaacagaggcctccaagctggtaatgtcatatgtcgctgccgtgtgtgggaaaggggcggaggtgaaccaagtcaaagagcaactactgcagagcaacccagtactggaggcctttggcaacgccaaaactgttagaaacgataattcgtcccggttcgggaagtacatggacatcgagttcgacttcaaaggcgaccctcttgggggagtcatctcaaattatttactggaaaagagtagagttgtcaaacagcctcgtggggaacgcaactttcatgtgttttatcagctgctgtctggagcgagcgaggagctgcttaataagctgaagctggagcgcgatttctcaagatataactatctgagtctcgattcagctaaagtcaatggcgtggacgatgcggcaaactttcgaacggtccgcaatgcaatgcagattgtcggctttatggaccacgaggcagagtctgtattagccgtggtcgccgccgtgctcaagctcggtaatatcgagttcaagcctgaatcccgggtgaacgggttagatgaatcaaagattaaggacaagaatgagctgaaggagatctgtgaactcactggtattgatcagtctgtgctggagcgggcgtttagtttccgtacagtggaggctaagcaggagaaggtttcaacaaccctcaacgtggctcaagcttactatgcccgtgacgcgctagcaaaaaatctgtattcccgactcttctcctggttagtcaatagaattaacgagagtatcaaagcccagactaaggtcagaaagaaagtgatgggcgtactcgacatatacggttttgagatcttcgaagataattcctttgagcagtttattatcaattactgcaatgagaaactgcaacaaatcttcatagagctaacgctgaaggaagaacaagaggaatatatccgggaagacatcgaatggacgcatatagattactttaacaacgccatcatttgcgatctgatagagaataacactaacgggattctagccatgctcgatgaggaatgcttacgacctggcaccgttaccgacgaaacattcttggagaagctaaatcaggtctgcgccactcaccaacacttcgagtctcgaatgagtaaatgcagtcgcttcctgaatgacaccagcttgccacattcttgtttccggatccaacattatgcaggtaaagttctgtatcaggtggaagggtttgtggacaagaacaacgacctgctgtacagggacctcagtcaggcaatgtggaaagcttcccatgccctaatcaaatccctcttccctgaaggcaatcctgccaagatcaatttgaaaaggcccccgaccgcgggatcccagtttaaggccagcgtggcaactctaatgaaaaacttacagaccaagaaccccaattatatcagatgcattaagccgaacgataagaaagctgctcacatcttcaacgaagcgctcgtgtgtcaccagatcagatacttgggcttactggaaaatgtgagggtgaggcgcgccgggtacgcattccggcaggcttacgagccatgtctagagagatataaaatgctctgtaaacagacctggcctcactggaagggacctgccaggagcggcgttgaagtgttgtttaatgaactggagattcctgtggaagaatatagttttggccgctcaaaaatattcatcagaaaccccaggacactgttcaaactcgaggatctccgcaaacagagactagaggatctggcaactctcatacagaagatctatcgcggctggaaatgtcgcacccactttttgttaatgaagaaatctcaaattgttatcgcagcctggtacagacgctatgcccagcaaaaacggtaccagcagaccaaatccagtgcactcgttattcagtcctatatccgtggatggaaagcacggaaaattctgagagagttgaagcatcagaaaagatgcaaggaagcagtaaccaccatcgcagcttattggcacgggacccaggtgcggagagagtaccgtaagtttttccgcgctaatgcaggaaaaaaaatctacgaattcacacttcagcgcatcgttcaaaagtactttctggaaatgaagaacaaaatgcccagtttaagccccatcgacaagaactggccgagccgaccttacctattcctggattccacacacaaggaacttaagagaatttttcatttatggaggtgcaaaaaatatcgggaccagtttaccgaccagcaaaaactaatctacgaagagaaattagaagcgtcggagctgttcaaagacaaaaaagcactgtatcctagctcagtgggacagcccttccagggggcttatctagagattaataagaacccaaagtacaagaaactgaaagacgccattgaagagaaaatcatcattgcagaagttgtgaataaaatcaatagggcgaacggaaagagtacaagcaggatctttttgcttacaaataataatttgctcttagccgatcagaaatcaggccagatcaaaagtgaagttcccctggtggatgtgaccaaggtgtccatgtcttctcagaacgacggcttctttgccgtgcatctcaaagagggctccgaagccgcttctaaaggggacttcctattctcatcggaccacctcatcgaaatggcaaccaaactgtatcgcaccaccctctcccaaacaaagcagaagctgaacatagaaatcagcgatgagttcttagtccagttccgtcaggataaagtctgtgtcaaatttatccaggggaatcaaaaaaatggaagcgtgccaacatgtaagcgcaagaacaatcgtctcctggaagtggccgtcccatag

SEQ ID NO: 196175 - DNA, 3324 bp, Artificial Sequence
  Description of Artificial Sequence: Synthetic coding sequence
atggccaagatggaggtgaagaccagcctgctggacaacatgatcggcgtcggcgacatggttctccttgagcctctaaacgaagaaactttcattaataatctgaagaaaaggtttgaccattccgagatttatacatatatcggaagcgtggttatctctgtcaacccatatagatccctgccaatctactcccccgagaaggtcgaggaataccgaaacagaaacttctacgagttgagtccacatatatttgcactgtctgacgaagcatacagaagtttgcgcgaccaagacaaggaccagtgtatcctcattactggtgaatctggagccggaaagaccgaagcaagcaagcttgtcatgtcgtacgtcgccgccgtctgtgggaaaggcgcagaggttaaccaggtaaaggaacagttactgcagagcaacccagtccttgaagcctttgggaatgccaaaacggtgagaaatgacaattcttcgcggtttggcaagtacatggacatcgagttcgactttaaaggtgatcctcttgggggggtgattagtaattacctcctcgagaaaagccgcgttgtgaaacaacctcgaggggagcgcaattttcatgttttttaccagctgctgtcaggtgcaagcgaagagctgcttaacaagctcaaactggagcgggacttcagtcgatacaattacctgagtttggatagtgcaaaggtcaacggtgttgacgatgcagctaactttagaactgtgcgcaacgctatgcagatagtgggctttatggatcacgaggcagagtctgtgctggccgtggttgcagcggtgttgaagttaggcaacatagaatttaaaccggagtctcgggtaaatgggctcgacgagtctaaaattaaagataaaaatgagctgaaagagatttgtgaactgacaggcattgaccaatctgtcttggagcgagcatttagtttcagaaccgtagaagccaagcaggagaaggtctccacaaccctgaatgtcgcccaggcttactatgcccgggatgcgctggcaaagaatctctattctagacttttctcatggttagtcaacaggattaatgaatcaataaaggctcagacaaaagttagaaaaaaggtgatgggtgtactcgatatatacggattcgagatcttcgaagacaattctttcgaacagttcattattaattattgcaatgaaaagctgcagcaaatcttcatcgagcttactctgaaagaggagcaagaggagtacattcgcgaagacatcgagtggacacatatcgactacttcaacaatgccattatttgtgacctgattgaaaacaacaccaatggcatcctcgccatgctggatgaagaatgcctgagaccggggaccgttaccgacgagacattcttggaaaaattaaatcaagtgtgtgcaacacatcaacacttcgaatccagaatgagcaaatgtagccggttcctgaatgacactagccttccacactcatgtttcaggatacagcactacgctggaaaggttctgtatcaggtcgaagggttcgtggacaagaataatgacctcctgtatcgagacttgagccaagcgatgtggaaagcgtctcacgccctgatcaagtcgctcttcccagaggggaacccggctaaaattaacctcaagagaccacccacagccggaagccaattcaaagcctcagttgctaccctcatgaaaaatctgcaaacaaaaaaccctaattatattcgctgtattaaaccaaacgacaagaaggcggcacacatcttcaacgaggccctggtgtgccaccaaatacgctacctcgggctgttagagaatgtcagggtgcgaagggcgggctacgcatttcgacaggcgtacgagccctgcctggaacgttacaaaatgttgtgcaaacagacatggccacattggaagggtcctgctcggtcaggggttgaggtgctctttaacgagctggaaattccagtcgaggagtatagcttcggtcgctcaaaaatcttcattcgcaatccccgcactctgttcaagctcgaagacctgcgaaaacagcgtttggaggaccttgccacccttatccagaaaatttacagaggttggaagtgccggactcattttctgctcatgaaaaagtcgcagattgtcatcgctgcttggtatcggcggtatgctcagcagaaaagataccagcagacgaagagttctgccctggtcattcagagctacatacggggctggaaagctcgtaaaattctcagagaactgaagcaccagaaaaggtgtaaagaagcagtgacaactatagccgcctactggcatggtacgcaggctcgccgtgaactgaaacgccttaaggaggaggctcgcaggaagcacgctgtggctgtcatctgggcttactggcttgggttgaaggtacgccgcgagtatcggaagttcttccgcgctaatgccggcaagaagatctatgagtttacccttcaacgcattgtccagaagtatttccttgaaatgaagaacaagatgccttctctgagtcccattgacaaaaactggccgagtaggccgtacctgttcttggactccacgcataaagaattaaagcggatctttcatctgtggagatgtaagaagtatcgggaccagtttacagaccagcagaagctcatctacgaggagaagttggaagcctctgagctgttcaaggataaaaaggcgctgtaccccagctcagtggggcaaccatttcagggggcctatttagaaataaacaagaatcccaagtataaaaagctgaaggatgcgatagaagagaaaatcatcatcgcggaggtcgtgaataagatcaaccgtgcaaatggaaagtctacgtcccggatatttctgctcactaacaataatcttctcctcgccgaccagaagagcggtcagataaagagcgaagtgccacttgtggacgttactaaagttagcatgtccagtcaaaacgatgggtttttcgccgttcatttgaaggagggatcagaggccgcttccaaaggcgactttttgttcagcagcgaccacctgatagagatggcgactaagctctatcggacaacgctgtcccagactaagcagaaactgaacatcgagatatcagacgagttcctggtccagtttagacaagataaggtctgcgtgaagtttatccagggaaaccagaaaaatggcagcgtgcccacatgcaaacgaaaaaataacagattgctagaggtggccgtgccgtag

SEQ ID NO: 196176 - DNA, 3411 bp, Artificial Sequence
  Description of Artificial Sequence: Synthetic coding sequence
atggccaagatggaggtgaagaccagcctgctggacaacatgatcggtgtaggggacatggtgctgcttgagcctctgaacgaagaaacttttatcaataacctgaagaagcgcttcgaccacagcgagatctacacctatattggcagcgtcgtgattagcgtgaatccctataggtcgcttccaatctattcaccagaaaaggtcgaggagtaccgcaacagaaacttctatgaattgtctcctcacattttcgctctttccgatgaggcatacaggagtctgagagatcaggacaaggatcagtgtattttgatcactggagagtccggcgcaggaaagaccgaggcgagtaaactggttatgagttatgtggctgccgtttgtggcaagggggcagaagtaaatcaggtcaaagaacaacttctccaaagtaacccagtgctggaggcctttgggaacgccaagaccgtgaggaatgataatagtagcaggtttggaaaatacatggacattgaattcgattttaaaggagacccactgggaggagtgatctctaactacctgctggagaaaagccgcgtggtgaagcagccaagaggcgaaaggaacttccacgtgttttatcagctgctctccggcgcaagcgaagagctccttaataaactgaagcttgaacgcgatttctcccgctacaattacctgtctctcgattctgccaaggttaacggtgtggacgacgcggccaattttaggacggtacgaaatgctatgcaaatcgtgggattcatggatcatgaggcggagtcagttctagcggttgtggccgctgtgctgaaacttggaaacattgaattcaagcctgaatctcgagtcaacggacttgacgagagtaagataaaagacaagaacgagctcaaagagatctgcgaactaacagggattgaccagtccgtgttggagagggccttctcattccgaacggttgaggctaagcaagaaaaggtgtccacaactttgaatgtggcccaggcatattacgcaagagatgctttggcaaaaaacctctattccagactcttctcttggctagtaaatcgcatcaatgagagtatcaaagctcagacaaaggtgcgtaagaaagtgatgggcgtgctggacatctacggcttcgaaattttcgaggacaacagttttgagcagtttattataaattattgtaacgagaaattgcagcagatttttattgaattgactttaaaggaagagcaagaagaatacatacgtgaggatatcgagtggacacacatcgattacttcaacaacgcgatcatttgcgacctgatcgagaacaacaccaacggcattcttgctatgctggacgaggagtgcttgcgaccaggaacagtgactgacgagaccttcttggagaagctgaatcaggtttgcgcaacccatcagcacttcgaatcgcgtatgtcgaagtgcagccgatttcttaatgacacctcactcccgcattcctgcttcaggatccagcattatgctggaaaagtcctttaccaagttgagggtttcgttgataagaataacgacttgctgtaccgcgatttatctcaggccatgtggaaggctagtcacgctctcatcaagtccttattccctgagggaaatcctgctaagatcaatctgaagaggccaccaacagccggctctcagtttaaggcgagcgtcgccacactgatgaagaatttgcagacaaagaacccaaattacatccgctgtatcaaaccaaatgacaaaaaggccgcacatatcttcaacgaagccctggtgtgccaccaaataaggtatctgggtttgcttgagaatgtgcgcgttcggcgggctggatatgcatttcgacaggcttacgaaccctgcctggagcgctacaagatgctgtgcaagcaaacatggccacattggaaaggcccggctaggagtggcgtggaggtgttgtttaacgaactggagatccccgtggaagagtacagctttgggcgctcaaaaatctttatcagaaacccccgtactctgtttaagctggaggatttgagaaaacagcggctggaggacctggctaccctcatccagaaaatctacaggggatggaagtgtagaacacacttcctcctgatgaaaaaaagccagatagtgatcgccgcttggtacagaagatatgctcaacagaaaagataccagcagacaaaatcaagcgcacttgtcattcagagctacattcgaggatggaaagcacgtaagatacttcgcgagttaaagcatcagaaaaggtgcaaagaggctgtgaccaccatcgcagcatactggcacggcacccaggccagacgcgagctgcggcggttgaaggaggaggccagaaacaagcacgcaatcgcagtgatctgggcctactggctgggaagcaaagcaaggcgagaactgaaaagactcaaggaagaagcccgtagaaaacacgccgtcgctgtgatttgggcatactggcttggactaaaggtgcggagagagtacaggaaattctttagggccaacgccgggaaaaagatctacgaattcaccctgcaaaggattgtccagaaatactttcttgaaatgaagaataagatgccgtctctgtcccccatcgataagaactggccatccaggccctacctcttcctcgactccacccataaagagctgaaaagaatctttcacctgtggcgttgcaagaaataccgggaccagttcacggaccagcaaaaactgatctacgaagaaaaactggaggcttccgagttgtttaaagataaaaaggccctgtaccccagctccgttggccagcccttccagggggcgtaccttgaaattaacaagaatccaaagtacaaaaagttaaaggacgccattgaggagaagatcatcatcgccgaggtcgtgaacaagattaaccgcgccaacgggaaaagtacttccagaattttcttgctgaccaacaacaatttgctcctcgccgatcagaagagcggacagattaaatctgaggtgcctctggtcgatgttacaaaagtatctatgtcttcacaaaatgatggtttttttgccgttcacttaaaagaaggctcagaagctgccagcaagggggactttctgtttagttccgatcatctgatcgagatggctactaaactgtaccgcactactctcagccagactaagcagaaattgaacatagagatttcagacgagttcctagtccagtttagacaggataaagtttgtgtgaagttcatccaaggaaatcaaaaaaacggtagtgtaccaacatgtaagaggaaaaacaatagactcctcgaggttgccgttccatag

SEQ ID NO: 196177 - DNA, 492 bp, Artificial Sequence
  Description of Artificial Sequence: Synthetic coding sequence
atggccaagatggaggtgaagaccagcctgctggacaacatgatcggcgtcggcgatatggtgctgttagagcctctcaatgaggagactttcattaacaatctcaaaaagaggtttgaccactcagaaatctacacttacatcggctctgtcgtgatcagtgttaacccatacagatcgcttcctatctacagccccgaaaaagtggaagagtacagaaacagaaacttttatgaactgtccccacacattttcgctctgtccgatgaggcctacaggagtcttcgggatcaggacaaggaccaatgtatcctaatcactggcgagtcaggcgccggcaagaccgaagcctccaagctggttatgagctacgtcgctgcagtctgcggcaaaggagccgaagttaatcaggtgaaagagcaactcctgcagagcaatcccgtcctcgaggcctttggcaatgctaagacagttcggaatgacaattcctag

SEQ ID NO: 196178 - DNA, 252 bp, Artificial Sequence
  Description of Artificial Sequence: Synthetic coding sequence
atggccaagatggaggtgaagaccagcctgctggacaacatgatcggggtgggggatatggtcctgctggaacctttaaacgaagagacatttatcaacaaccttaaaaagcgatttgaccatagtgagatttatacatatatcggatctgtggtgatttcggtgaatccatacagatccctgcccatttatagtcctgaaaaggtggaggagtataggaaccgaaacttctatgaactgtcaccgcattag

SEQ ID NO: 196179 - DNA, 450 bp, Artificial Sequence
  Description of Artificial Sequence: Synthetic coding sequence
atggccaagatggaggtgaagaccagcctgctggacaacatgatcggagtgggcgatatggttctgctggaaccccttaacgaagagacattcatcaataatctaaagaagcgctttgaccactccgagatctacacttatattggatctgtggttatttccgtgaacccctaccggtccctaccaatctatagccccgagaaagtggaagagtatagaaatagaaacttctatgagctgagtccccatatcttcgctctttccgacgaagcttataggagcttaagggatcaggataaagaccaatgtattctgattacgggcgagtccggcgcaggcaaaacagaagcctcaaaactggttatgtcatacgtggccgccgtttgcggcaagggagctgaggttaaccaggttaaagaacagctgttacagagcaaccctgttctatag

SEQ ID NO: 196180 - DNA, 1146 bp, Artificial Sequence
  Description of Artificial Sequence: Synthetic coding sequence
atgaagaagagccagatcgtgatcgccgcctggtaccggcggtacgcccagcagaagagataccagcaaacaaaatcgagtgccttggtgattcagtcctatatcaggggctggaaagcaagaaaaattcttagggaactgaagcatcagaaaagatgcaaagaggcagtaacgaccattgctgcttattggcatggaactcaagccaggagggaactgaagagacttaaagaggaagctcgtcgaaagcacgcggtggccgtgatttgggcatattggctcggactgaaggtgagaagggaataccggaaattttttagagcaaatgctggcaagaagatttacgaattcacgctacagcgtatcgtacagaaatacttcctggagatgaaaaacaagatgccatccctaagtcctatcgataaaaattggccatcaagaccttacctgtttctggatagcacgcacaaagaactgaaaaggatcttccatctttggcgctgtaagaagtacagagatcagttcacggaccagcagaaactaatctacgaagaaaaattggaggccagcgagttgttcaaggataaaaaagctctttatcccagctcagtggggcagcccttccagggtgcgtatctcgagatcaataagaatccgaagtataaaaagttgaaggatgcgatagaagaaaaaataattattgcggaagttgtcaataagattaaccgcgcaaacggcaaatccacctccaggatttttctcctgaccaacaacaacctgctgctggccgaccagaaatctggacaaataaaatcagaggttcccctggtggacgtgaccaaggtgtcaatgagctcccagaatgacggcttttttgccgttcatcttaaggagggatctgaggcagcctcaaagggggactttttattctcctcagaccatctcattgagatggcaacaaagctgtataggacaacactgtcccagaccaagcagaagctcaatattgagataagtgatgaattcctcgtgcagtttaggcaggacaaggtatgcgtgaagtttatacaaggaaatcaaaaaaatggttccgttcccacgtgtaagcggaagaataatagactgctggaagtcgcagtgccgtag

SEQ ID NO: 196181 - DNA, 924 bp, Artificial Sequence
  Description of Artificial Sequence: Synthetic coding sequence
atggccaagatggaggtgaagaccagcctgctggacaacatgatcggcgtgggggatatggttcttctagagccactgaacgaagagactttcatcaacaacctgaagaagcgttttgaccatagtgagatctacacctatatcggtagcgtcgtcattagtgtgaacccttatcggtcactgcctatctatagccccgaaaaggtggaggagtataggaatcgaaatttttacgaactgtccccacacatttttgcactttctgacgaagcttatagaagtctgcgagatcaggacaaggaccagtgtattctgattacgggtgaaagcggtgccggaaagaccgaagcctccaagttggtcatgtcctacgtcgcagctgtgtgtggaaagggggccgaagttaatcaggtgaaggaacagttgctgcagtccaacccagtactggaggcttttgggaacgctaaaactgttaggaacgacaattcaagtcgattcgggaaatatatggacatagaattcgacttcaaaggcgaccccctcgggggagtgatatcgaattacctgcttgaaaagtcgagggtcgttaaacagcctaggggcgaacgcaattttcacgtattttaccagctgctgtccggtgcatctgaagagctgctgaataaactgaagctggagagggactttagcaggtataactacctgtccctggatagcgcgaaagtcaatggcgtggatgatgctgcaaacttcagaaccgtccggaacgcaatgcagatcgtcgggttcatggatcacgaggcagagtccgtgttagcagtggtggccgctgtcctcaagctcggcaatatagagttcaaacccgagtccagagtgaacggcctggacgaaagcaagatcaaggacaagaatgaatccaagtag

SEQ ID NO: 196182 - DNA, 912 bp, Artificial Sequence
  Description of Artificial Sequence: Synthetic coding sequence
atggccaagatggaggtgaagaccagcctgctggacaacatgatcggagtaggcgacatggtgctgcttgagcctctgaatgaggagacgttcattaataatctgaaaaaacggtttgaccattctgagatctatacatacatagggtctgtcgttatctctgtgaacccttaccggagcctgcctatttatagccccgaaaaagtggaggaatataggaatagaaacttttatgagcttagtccacatattttcgccctatccgacgaggcataccgctctctgcgcgaccaggacaaggatcagtgtattctgataacgggcgagtctggggccggcaagactgaagcgagtaagcttgtgatgagctatgtggccgcagtgtgcggtaaaggcgctgaagtcaaccaggtgaaggagcagctcttgcagtccaatcctgtgctggaagcgtttggcaatgctaagaccgttcgcaatgacaacagcagtcgcttcggaaagtacatggacatcgaattcgatttcaagggggacccgctcgggggcgtaataagtaattacctgctagaaaaatctagggtcgtgaaacagcccaggggtgagagaaacttccacgttttctaccaacttttaagcggagcctccgaggaactgttgaacaagttaaaactagagagggatttctcccgctacaactacctgtctcttgactctgccaaggtgaatggagttgatgacgcggcaaacttcagaaccgtcagaaatgcaatgcaaattgtcgggtttatggaccatgaagcagagtctgtgttggcagtggtggccgccgtcttgaagcttggcaacatcgagtttaagcccgaaagcagggtgaatgggctcgacgagtcaaagatcaaggataaatag

SEQ ID NO: 196183 - DNA, 3192 bp, Artificial Sequence
  Description of Artificial Sequence: Synthetic coding sequence
atggccctgcaggtggagctggtgcccaccggcgagatcatccgggtggtgcacccccaccgaccctgcaaattggcgctaggcagcgatggcgtgagagttacaatggagagtgcattaacggcccgggatagagttggggtccaggatttcgtcctgctggagaatttcactagcgaagctgcatttatcgaaaacctgcgccgaaggtttagggaaaatttgatatacacatatatcggacctgtgctggtgagcgtcaatccctatcgggatctgcaaatatattctcgacagcatatggagcggtaccgtggtgtttctttttacgaggtccctccccacttgttcgccgtggccgacactgtgtatcgcgccttgagaactgaacggagagaccaggccgtgatgatttccggtgagagcggcgccggtaaaacggaggccacaaagagactcctccagttctacgctgagacctgccccgcaccagaacgaggtggcgcagtgcgcgaccgcctgctgcagagcaaccctgtcctagaagctttcggcaatgccaaaactctgcgtaacgacaactcctctagattcgggaagtatatggatgtacagttcgatttcaaaggcgcacctgttggaggacatattctgagttacctgttagagaagagcagggtggtgcaccagaaccacggggaaaggaatttccatatcttttatcaactcttagaagggggtgaggaggaaactctgcgccgcttgggactggagcgtaatcctcagtcctacctgtatctggtgaagggacagtgtgcaaaagtctcctccatcaatgacaaatccgattggaaagttgtgcgtaaagctctgactgtaattgactttaccgaggatgaggtagaggatctgctcagtatcgtcgctagcgtgctgcacctgggcaatatccactttgccgcaaacgaggagtcaaatgctcaggttactaccgagaatcaactgaagtacttgacccggcttctgtctgtagagggctccactctgcgggaggctctgacacatcggaagataatagcgaagggtgaagagttactaagtcctctcaatctcgagcaggccgcttacgctagagacgccctcgcaaaagccgtttattctcgcacatttacatggttggttgggaagataaaccggtcactggctagcaaggatgtggaaagcccctcttggcgcagcaccactgtccttggtctactagatatctacggctttgaggtattccagcacaattcttttgagcagttttgcatcaactattgtaacgaaaagttacagcagctgttcattgaattgactctaaagtctgagcaggaagagtatgaggccgaaggtatcgcctgggagccggtgcagtactttaataacaagattatttgcgatcttgtggaagaaaagtttaagggtatcatcagcattctcgatgaggagtgtttgcgtccaggcgaagcgacggacctcaccttcttggagaaactggaggacactgtgaagcatcacccccatttcctgacgcataaactggctgaccagcgcactcggaagtctctgggaaggggtgaatttcgtcttttgcattatgctggtgaggtcacttactccgtgactggcttcctggacaaaaacaatgatctattgttccgcaacttgaaagaaacaatgtgttccagtaagaacccgattatgtcacagtgtttcgaccggtctgagttaagtgacaagaaacgccccgaaactgttgcaacacaatttaaaatgtcccttctccagctagtggagatcctgcagagtaaagagcctgcctacgtgaggtgcattaagccaaacgatgctaagcaacctgggcgattcgatgaggtgctcattagacatcaggtcaagtatctggggctcctggaaaatctgagggtgaggcgggccggcttcgcttataggaggaagtatgaggcttttcttcagcgctacaagagcctatgtcccgagacttggcccacttgggccggtaggccgcaggacggggtggccgtgctcgtgcgacatttggggtacaaaccggaagagtataaaatgggaagaacgaagatctttatccggtttcccaaaaccctctttgccactgaagacgctctggaagtgcggagacagagccttgctacaaaaatccaagctgcctggcgcgggtttcactggaggcagaagttcctccgcgttaagcgttctgccatctgcatccaatcttggtggcggggcacgttaggacgcaggaaagctgccaaacgcaagtgggcggcccaaaccatccgacgcctgattaggggattcgtgttgcgccacgcacccaggtgtcccgagaacgccttctttttagatcacgtgcgcacatcattcctgctgaatctccgccggcagctcccgcaaaatgtgctcgataccagctggccaactcccccccccgcactgcgcgaagcatccgagctgttgagagagctctgcattaagaatatggtctggaagtattgtaggagcatctcgcccgaatggaagcagcaattgcaacagaaggctgtggccagcgagatcttcaaaggcaagaaggacaactatccgcagagtgtaccacgactgttcatttcaaccagactggggactgatgagatcagtcccagagtattacaggcactcgggtcggagcctatccaatatgctgttccagtggtgaagtacgatcgcaagggctacaagcctaggtcacggcagttactcctaacccccaacgcagtggtgatagtcgaggatgctaaggtgaagcagagaattgattatgctaatctgaccgggatttccgtgtcatctctcagcgactctctttttgtcctgcatgttcagagagctgacaataaacagaagggcgatgtcgttcttcaatccgaccacgtcattgaaacgctgaccaaaacagctctgagcgccaaccgcgtgaacagtatcaatatcaaccagggtagcatcaccttcgctggaggaccaggcagggatgggaccattgatttcacaccagggtccgagctgctgataaccaaggcgaagaatggacacctggcagtagttgcaccgaggctcaacagccgctag

SEQ ID NO: 196184 - DNA, 3087 bp, Artificial Sequence
  Description of Artificial Sequence: Synthetic coding sequence
atggagagcgccctgaccgcccgggaccgggtgggcgtgcaggacttcgtgttactggaaaattttacgtccgaagccgcattcatagagaatctgcggcggcgttttagagagaacctgatatacacctacattggtcctgttttggtttctgtgaacccgtaccgggatctgcaaatctacagccgtcagcatatggaacgctatcgcggagttagcttctatgaggtccccccccacttgtttgccgtcgcagacacagtgtaccgcgctttacgaacggaaagacgagatcaggctgtaatgatctctggggagagcggtgcaggcaagaccgaggcaacaaagcgtctgctacagttctatgctgaaacttgtccagctccagaacggggtggcgctgttagggatagacttctccagtctaatccggtgctggaagccttcggaaacgcaaaaactttgcgcaatgataacagctcccggtttggcaaatatatggacgtgcaatttgacttcaagggcgctccagtgggcgggcacattctaagctatctcttagagaagtcccgggtggtgcatcagaaccacggagaacgaaactttcacattttttatcagctgttggagggcggcgaagaggagactctgcggcgccttggactcgagcggaacccccagtcttatctctacctggtaaaggggcagtgtgccaaagtgtcttctattaacgacaaaagtgactggaaagtggtgcgtaaagcacttacagtcatcgatttcacggaggacgaggttgaagacctactgtctatcgtggccagcgtcttgcatttgggcaacatccactttgccgctaacgaagaatctaacgcacaagtgaccactgagaaccaactgaaatacctgacccggcttctgtcggtcgagggctctaccctgagggaggctttaacccacaggaagattatcgcaaaaggagaggagcttctgtctcccctcaatttagagcaggcagcatatgcccgggatgcactcgctaaggctgtctattctaggaccttcacatggctggtggggaaaatcaatcgttccttggctagcaaggatgttgaaagtccctcatggcgtagcaccacagtactcggcctgttagacatttatggctttgaagtgtttcagcataacagtttcgagcagttttgtatcaactactgcaacgaaaagcttcagcagctttttattgagctcaccctcaagtcggaacaggaggagtatgaagcagaggggattgcttgggaacccgtacagtattttaataacaaaatcatctgtgatcttgtcgaggaaaagtttaaagggatcatctctatattggacgaagagtgtttgcgtcccggtgaagcgacggaccttaccttcctagaaaagctggaggatacggttaaacaccatccccacttcctgactcacaagctcgccgatcagcggacccggaagagtttgggtagaggcgagtttcgcttgctccactacgccggcgaggttacatactctgtgaccggttttctggataagaacaacgatttactcttccggaatctgaaagagaccatgtgcagttctaagaatcctatcatgagccagtgtttcgaccggtcagaactgtcagacaaaaagaggcccgagaccgttgccactcagttcaagatgagcctactgcagctggtggaaatcctgcagagcaaagaaccggcctatgtccgctgtattaaaccaaacgatgctaaacagccaggcaggttcgatgaggttcttatccgacaccaggtgaagtacctgggactcctcgaaaatttgcgggtgagacgtgcaggttttgcttaccgaagaaagtacgaggcgtttttgcagaggtacaaatccttatgtcccgagacgtggcccacctgggccgggcggcctcaggacggagttgcagtgttggtacgccacctgggttataaacccgaagaatacaagatgggccggaccaaaattttcattcggtttccaaagactctgttcgccacagaggatgcgttggaggtcagacgccagtcattggctacgaagatccaggccgcctggaggggattccattggcggcagaagttcctacgcgtgaagcgctcagcaatatgcatccagagctggtggagagggactctgggccgtaggaaggccgctaagaggaagtgggctgcgcagaccatacgccgcctgatcaggggattcgtccttcgacatgccccccggtgccctgaaaatgctttttttttggatcacgtccggacaagttttctcttgaatcttagaagacagttaccccagaacgttttggatacatcctggccaacaccacctcccgctctccgcgaagcaagcgagctgttgagagagttatgtatcaaaaatatggtctggaagtattgccggtccattagcccggaatggaaacagcagttgcagcaaaaggcagtagccagtgaaatattcaaagggaaaaaagataattatccacaaagcgtgccacggctgtttatctctacacgcctgggcaccgatgaaatcagcccccgggtattacaggctttgggaagtgaacctatacagtatgccgtgccagtcgttaaatatgatcgaaagggatacaaacctcgatcacggcagctgcttctaacaccaaatgccgtggtgatagtggaagacgccaaggtcaaacagcgcattgactatgcaaatctgacagggatatccgtgtccagcttgagtgactccctgtttgtactccacgttcagagggcggacaacaaacagaagggggatgtggtcctgcagtcggaccacgttatagagaccctcactaagacagctctgagcgctaatagggtcaatagtatcaacatcaatcagggctctattacatttgccgggggaccagggagggacgggaccatcgatttcacacctggttctgagctgctaattacaaaggccaaaaatggacatctggctgttgtggccccacggctgaactcacggtag

SEQ ID NO: 196185 - DNA, 3135 bp, Artificial Sequence
  Description of Artificial Sequence: Synthetic coding sequence
atgcggtaccgggccagcgccctgggcagcgacggcgtgcgggtgactatggagagtgctttgacagccagggacagggtaggggtccaagacttcgtgctactcgaaaatttcacgagcgaagcggccttcatcgagaacctccgaaggcggttcagagagaatcttatttacacatatattggtcctgtgctcgtgagtgtaaatccatatagggatctgcagatctatagtcgccagcacatggaacgatatagaggggtttcattctatgaggtgccacctcatctcttcgccgttgccgacactgtgtaccgcgccctgcgcaccgaacgacgggaccaggcagtaatgattagtggagaaagcggggccgggaaaacagaggctacaaaacgcctcttacagttttacgctgagacgtgtcctgctcccgaaaggggcggagcggttagagatagacttcttcagtcgaatcccgtgcttgaagccttcggcaacgccaagacattaagaaatgataactcatctagattcggcaaatatatggatgttcagtttgacttcaagggcgccccagtgggcgggcatatcctgagttacctgctggagaagagcagggtcgtgcatcaaaaccacggggagagaaactttcacatcttctatcagcttctggaagggggcgaggaggaaacactcaggaggctggggttggagcggaacccacagagttacctctacctagtaaaaggccagtgtgctaaggttagctctatcaacgataaatccgactggaaggtggtaagaaaagcgctcaccgtcatagactttacagaggacgaggtagaggatctgctgtccatagtagcctccgtccttcatctcggcaacatacactttgccgctaacgaggaatcaaatgcacaggtgacaactgaaaaccagctgaagtacctgacacgactgctgtctgtcgaaggaagcaccctgagggaagctttaactcatcgcaaaataatcgccaagggtgaggaactcctctctcctttgaatctggagcaagccgcctatgcccgagacgcgctggccaaggctgtctactctcgaacttttacttggctcgtgggcaaaattaacagaagcttagctagcaaggacgtggagtccccttcttggaggtcaaccactgttttggggctgctcgacatttatggtttcgaggtgtttcagcacaatagcttcgaacaattttgcatcaattattgtaatgaaaaactgcagcagctgttcatcgagttaacccttaaatctgaacaagaggagtatgaggctgaggggattgcttgggaacccgtgcagtacttcaacaacaaaattatttgtgatctcgtggaagagaagtttaagggcatcatcagcatattggatgaggagtgtctaaggcccggggaagccaccgatctcacattcctggagaagctggaagatacggtgaaacaccatcctcacttccttacacataaactggcagaccagcgaaccagaaagtctttgggacgtggagagttccggctgcttcactatgctggcgaggtaacatactccgtaacaggatttcttgacaaaaataacgatctgctgttccgaaatctcaaggaaaccatgtgtagctcgaagaacccaatcatgtcacagtgttttgaccgaagtgaactgagcgacaaaaagaggcccgagactgttgcaactcagtttaagatgtctttgctccagctggtggaaatcctgcagtctaaagaacccgcctacgtgcgctgtattaagcccaacgatgcgaaacaacccggcaggtttgacgaagtactgatccggcatcaggtgaaatacctagggctgttggaaaatttaagggtgcgacgcgcagggtttgcataccggcggaaatatgaggccttcctgcagcgttacaaatctctgtgtcctgaaacttggcccacatgggcagggcgaccccaggacggtgtggctgtccttgttagacacctggggtataagcctgaagaatacaaaatgggcaggaccaaaatcttcatccggttcccaaaaacactgttcgccactgaagatgccctcgaggtgcggagacagtcactggccaccaagatccaggctgcctggcgcggattccactggcgacagaagtttttaagggtaaaacggtctgcaatctgcattcaatcttggtggagaggtacattggggcgcaggaaggctgctaagaggaagtgggcagcccagacaatccgaagactgattcgaggattcgtcttgaggcacgcaccccggtgtcctgagaacgctttcttcttagaccatgttcggacctcattcttgctcaatttaagaagacagctgccacagaatgttctcgatacaagctggccaactccaccccccgccctgagagaagcgtctgaattgctgcgcgaactgtgcattaaaaacatggtgtggaaatactgcaggtccattagtcctgagtggaaacaacaattgcaacagaaagcagtggcgagcgagattttcaagggaaagaaagacaactacccccagtccgttcccaggctcttcatcagcactagactgggcacagacgaaattagcccacgtgtcctccaggccctggggagtgaacctatccagtacgcagtgcccgttgtcaagtacgatcggaaaggatataagccgcgctcccggcagcttcttctgacccccaatgcggtggtgatcgtggaggatgcgaaggtcaagcaaagaattgactacgcaaatttgactggcatatcggtctctagtctcagcgacagcctgttcgtgctgcacgtacaacgcgctgacaataagcagaagggtgatgtagttctgcagtcagaccacgtgattgagactctgactaagactgcgctgagcgctaacagggtaaattccatcaacattaaccagggtagcatcacgttcgcgggcgggccaggccgagatggtactatagatttcacgcctggaagtgagctgctaattaccaaagccaagaatggccacctggctgtggtcgcccccagacttaattctcggtag

SEQ ID NO: 196186 - DNA, 2418 bp, Artificial Sequence
  Description of Artificial Sequence: Synthetic coding sequence
atggagagcgccctgaccgcccgggaccgggtgggcgtgcaggactttgttcttcttgagaattttactagcgaagccgccttcatcgagaatttgagacgtcgctttcgggagaacctaatctacacttacatcggacccgttctggtctcagtcaatccctatcgagatctgcagatctatagtcgacagcacatggagcgatacaggggcgtcagcttttacgaagtcccaccccacctgttcgctgtggcggacaccgtctatcgcgcactaagaacagaacgaagggatcaggccgtgatgatttcgggggagagcggtgctggcaaaacagaagcaacaaagcgtctcctgcagttttatgccgagacgtgccctgcgccggagagaggcggggctgtacgggaccggctgttgcagagtaaccccgtgttggaggccttcggcaacgccaagacccttcgtaatgataattcatcaagatttggcaaatacatggacgtgcagtttgactttaaaggcgctcctgtcggaggccacatcttgtcgtatctgctggagaaatcgcgggtggtccatcagaaccacggagagcgcaattttcacattttttaccagctattggagggtggagaggaggagacactgcggaggctgggtctcgaaaggaacccccagagttatctgtacctcgtcaaaggccagtgcgctaaagtgtcttcgataaacgataaaagcgactggaaggttgtgcgaaaggccttgaccgtcattgatttcaccgaggacgaggtcgaggatctcctcagtattgtggcatccgtgttgcacttgggaaacatacattttgccgccaatgaagaatccaatgctcaggtcacaactgaaaaccagttgaaatatctcaccaggctgttatctgtggagggatctacattacgcgaggccctgacccatcgcaaaataatcgccaagggagaggaattactctcccctctgaacctggagcaggctgcttacgcccgcgacgccctggcaaaagccgtgtattcaaggacttttacctggctggtgggcaagatcaataggtctctggccagtaaagacgttgaatctccatcttggcgctctacaacagtcctcggcctgcttgacatctatggcttcgaggtctttcagcataacagctttgaacagttctgcataaactattgtaacgagaagctccagcaactgtttatcgagctgacactgaagagcgagcaagaagaatacgaggccgaaggaatcgcgtgggagcctgttcaatatttcaataataaaattatttgcgaccttgtggaagagaaattcaagggcatcatctccatcttggacgaagagtgcttgaggcctggcgaggcaacggatctgaccttccttgaaaagttggaggatactgtaaagcaccatccccacttccttacacacaagctagctgatcaacgtaccagaaaaagcctcggacggggagagtttcgcctgctgcactatgccggggaggttacctactctgtgacggggtttcttgacaaaaacaacgatctcctgtttaggaacctgaaggaaacaatgtgttcctcaaagaatccgatcatgagccagtgcttcgaccggtcagaacttagcgacaagaagcgaccagaaaccgtggcaactcagttcaagatgagccttctgcaattggtcgaaatcctgcagtccaaagagccggcctatgtgagatgtattaaacccaacgatgctaaacagcctggaaggttcgacgaagtcctgattcgccatcaggtgaagtatctcggtcttctcgaaaacctgcgagtgaggcgtgcgggtttcgcctacaggaggaagtacgaggcatttctacagagatacaaatcgctctgtcctgaaacatggcccacttgggcaggtagaccccaagatggcgtggccgtgctcgtcagacatctggggtataaaccagaggaatataagatgggaagaacgaaaattttcattagatttcccaagacgttatttgccaccgaagacgccttggaggtgcgcagacagtccttggctacgaagatccaggccgcgtggaggggatttcattggcgccagaaatttctgagggtgaaacgctccgccatctgtatccagtcatggtggagaggcacactgggcagaaggaaagccgccaaggaagtgggtgggacagaccatcccgcggcccaccctcggctccgccctgcccctcggccaccattgcccagggaacggttgctgcccgggccatgtgcccacctgttcttcgccaaacctgaggccgccgccgcacccgaatgccctgggcaccttgttgcccacgcccccacctgccctgcctag

SEQ ID NO: 196187 - DNA, 3135 bp, Artificial Sequence
  Description of Artificial Sequence: Synthetic coding sequence
atgcggggccgggccagcgccctgggcagcgacggcgtgcgggtgacaatggagtcagcgctgactgcccgggaccgtgtcggcgtccaggattttgtgctacttgagaacttcacttcagaagccgcctttatcgagaatttgcgtcggcggttcagagaaaatctcatttatacctacatcggccctgtgctggtctcggtcaacccatatcgtgatctacagatatatagccggcagcacatggagcggtacaggggtgtttcattttacgaggtgcctccacacttgttcgcagtcgcggacacagtttatcgcgcactccggaccgagaggcgcgaccaggctgtgatgatatccggagagagcggggccgggaaaaccgaagcaactaagcgccttctccagttctacgcagagacgtgccccgcgccagagcggggcggagcagtgcgggaccgcctcctgcaatcaaatcccgtgctcgaggctttcgggaacgccaagaccctcagaaacgacaattcaagcaggttcggcaaatatatggatgtccagtttgactttaagggtgcccccgttggggggcacattctttcgtatctgctggaaaaatcccgagtggttcatcaaaaccacggcgagagaaactttcacatattttatcagttgctggagggcggagaagaagagaccctaaggagactgggacttgaaaggaatccgcagtcctatctctatttggtcaaaggccagtgtgccaaggtgagctccatcaacgataaaagcgactggaaggtggtgcgcaaagcacttaccgtcattgatttcacagaagacgaggtggaggacttgttgtccatagtagcctcagttctgcaccttggcaatatccatttcgcagctaatgaagagtccaatgcccaagtgacaacagagaaccagcttaagtacctgactaggttacttagtgtcgaaggctcaaccctgagagaagcactgacacacagaaaaattatcgctaagggcgaggagcttctctctccactaaacctcgaacaggccgcctacgcacgggatgccctggccaaagcagtttacagcaggacttttacatggctggtgggaaagattaatagaagcctagcaagcaaagacgtggagagcccttcctggaggagcacaaccgttctggggttgcttgatatttacggcttcgaagtcttccagcataatagcttcgaacaattctgcatcaattattgtaatgaaaaactgcagcagctctttatagaattaacgctaaagagcgaacaggaggagtatgaggctgaaggcattgcctgggagcctgtgcagtatttcaataacaagatcatttgcgatctagtggaagagaagttcaagggcatcatttcaatactcgacgaggagtgtctgcgccccggcgaggctacagatctgacttttctggaaaagttagaggacacagttaagcaccatccacactttctcacccacaaactggctgaccagcgaactagaaaatccttagggcggggcgaattcaggctgttacattatgccggggaggtgacctactccgtgaccggatttttggacaaaaacaatgatctcctgtttcggaacctgaaggagactatgtgctccagcaagaatcccatcatgtcacagtgtttcgacaggagcgaactcagtgataagaagagaccagaaacagtggccacacagttcaagatgagtttgttgcagttagtggagatccttcagagcaaggagcctgcatatgttcggtgcatcaaacccaacgacgccaagcagcccgggcgtttcgatgaggtcctgatcagacaccaggttaaatatcttgggctgttggagaacttgagagtccggcgcgccgggtttgcctacaggaggaagtatgaagccttcttgcagcgctacaaaagcctgtgccctgaaacttggccaacttgggccggaaggccccaggacggcgtcgcggtcttggtgaggcatctaggatataaacccgaagagtacaaaatgggcagaactaagatattcatccggttccccaaaacattatttgccacggaggatgccctcgaggtccgacgacagtctctggcaactaaaatccaggctgcttggcgaggcttccactggcggcaaaaattccttagagtgaagcgatctgcaatttgcatccagtcatggtggcgtggaaccctcggacgccgaaaggctgccaaaagaaagtgggcagcacagacgattcggcgccttatcagaggtttcgtgctgcgccatgctcctagatgtccagagaatgccttcttcctcgaccatgttagaacttcctttttgctcaacctgcgacggcagcttcctcagaatgtcctcgatacttcatggcctactcccccacctgctctgcgggaagcttcagaactgctccgagaactgtgtataaaaaacatggtgtggaagtactgccggtcaatctcaccagaatggaagcagcagctccagcagaaagctgtcgccagcgaaatcttcaaggggaaaaaagacaactaccctcagagtgtaccacgactcttcataagcacacggctgggtacggacgagatttctccacgggtccttcaggccttgggcagcgagccgattcagtatgctgtgcctgtggtcaagtacgaccggaaaggttataagcctcgttctaggcagctgttactgacgcccaacgccgtcgtaatcgtcgaagatgcgaaagttaaacagagaattgattatgccaacttaaccggcatctctgtcagcagcctcagtgatagcttatttgttctccacgtacagcgggccgacaacaaacaaaagggcgacgtcgtcttgcaaagcgaccacgtcattgagactttgaccaagactgctctgtcagctaatagagtgaattctataaacatcaaccagggcagcattacattcgctggaggccctggcagagacggcaccatagacttcacccccgggtctgagctccttatcactaaagcaaaaaatggtcacctggcagttgtggcccctagactgaacagtagatag

SEQ ID NO: 196188 - DNA, 3120 bp, Artificial Sequence
  Description of Artificial Sequence: Synthetic coding sequence
atggccctgggcagcgacggcgtgcgggtgaccatggagagcgccctgacagcccgggacagagtgggagtccaggactttgtgctccttgagaattttacgtcagaggcagcctttatcgaaaacctgagaagaagattcagagaaaatcttatctacacctacataggccctgtcctcgtttccgtaaatccctaccgtgatttgcagatttatagcagacagcacatggagaggtatcgcggcgtctccttctatgaggtgccaccacatctgttcgctgtggctgacacagtgtaccgggctctgagaaccgagagacgggaccaagcagtgatgatatccggtgagagcggggccggaaagacagaggcaacaaaaaggcttctccagttctacgctgagacatgtcccgctcctgagcggggcggggccgtacgcgatcgactgctgcaatctaatcccgtgttggaggcatttggaaatgctaagactctgagaaatgataattcctcacgctttggcaaatacatggatgttcagttcgatttcaaaggcgctccggtgggcgggcacatactgagctacttgttggaaaagtcacgggtggtccatcagaaccatggggaacggaatttccacattttctatcagctgcttgagggaggggaggaggaaacactgcggcgtctagggctggagcggaatcctcaaagttacctgtatttagtaaagggccagtgcgctaaggtgagcagcatcaatgacaagagcgattggaaggtggtgcggaaagccttgacagttattgattttacagaggatgaggttgaagacctactttctatcgtcgcctcggttctgcacttgggaaacatacatttcgcggccaacgaggaatctaacgctcaggtgacgaccgagaatcaacttaaataccttaccaggctcctgtcagtggaagggtccactctgcgcgaagccctaactcatagaaaaattatcgccaaaggagaagaacttttatccccactgaacctagaacaggccgcgtatgctcgtgatgccctggctaaggccgtgtacagtcgcacttttacttggctcgtgggtaagataaatcggagtctggcctctaaggatgtggaatctcctagttggagaagcacaacagtgttgggcctgctggacatttacggcttcgaggtctttcagcacaactccttcgagcaattctgtatcaattattgtaatgaaaaactacaacagctttttattgagcttactcttaaaagtgagcaggaagaatacgaggcagagggaattgcctgggagccagtccagtatttcaacaacaagattatctgtgacctcgttgaagaaaagttcaaagggattatctctatcctcgatgaagagtgcctgagacccggcgaggccactgacctgaccttccttgagaagctggaggacacagtgaagcatcatccccacttccttactcacaagctcgctgatcagcgaactaggaaaagtctcgggagaggggaattccgactactgcactatgccggagaagtgacttattccgtcactggtttcctggataagaataacgacctacttttcaggaatttgaaggagactatgtgcagcagtaaaaacccaatcatgtcacagtgttttgatcggtccgagctgagtgataagaaacgccccgaaaccgtggcaacccagtttaagatgtccctactgcagctggtcgaaatcctgcagtcaaaagagcctgcctacgtccggtgcattaagcctaacgatgcaaagcagcccggccgcttcgatgaggtcctgattagacaccaggtcaagtacctgggcttgcttgagaacctcagggtgcggagggcagggttcgcatacaggaggaagtatgaggccttcctccagaggtataaaagtttgtgccccgagacgtggcccacatgggctggtaggcctcaggacggcgtagccgtgctcgtgagacacctcggatataaacccgaggaatataagatgggaagaacgaagatctttatcaggttccctaaaactctattcgctactgaggacgctctggaggtcagaagacagtctctggcaactaaaattcaggccgcttggcgggggttccactggcggcaaaagttcctcagagtcaaacgctccgcgatttgcatacaaagttggtggagaggcaccctgggaagacggaaagcagccaagagaaaatgggctgcacaaacaatccggcggctgattagaggcttcgtgctgagacatgcgcctcgatgtcccgagaacgcgtttttccttgatcacgtccgcacatcttttctcttaaacttaaggcgccagctaccccaaaacgtcttggacacttcctggccgactccgccgccagcattaagagaagcctccgagttgcttcgggaactctgcattaagaacatggtttggaagtactgccgctccatcagtccagaatggaaacaacagctgcagcagaaggctgttgcttcagagattttcaagggcaagaaagacaactatccacagtccgttccacggctgtttatatctacccggctaggcaccgatgaaatatctccccgagtgctgcaggctctgggaagcgagcccattcagtatgccgttcccgtggtgaagtacgataggaaggggtataaaccgcgctccaggcagctgctgcttactcccaacgcggtggtaatcgtggaagacgcaaaagttaaacagcgcatcgactatgccaacctgacaggcatcagcgtctcctccctgtctgattcactatttgtccttcacgttcagcgcgccgacaataaacagaagggagatgtggtgctgcaaagcgatcacgtgattgaaaccctgacaaagacagctttgagtgcaaacagggtcaactccataaacattaaccaagggtctatcacctttgccggaggcccggggcgtgacggaaccatcgactttacccccggaagcgaactcctgattaccaaagcaaagaatggccacctggccgttgttgctccacgcctgaattcccgttag

SEQ ID NO: 196189 - DNA, 3021 bp, Artificial Sequence
  Description of Artificial Sequence: Synthetic coding sequence
atggccgagcaggagagcctggagttcggcaaggccgacttcgtgctcatggataccgttagcatgccagagttcatggctaacttacggttgaggttcgaaaagggtcgcatttacacatttataggagaggttgtggtatctgtcaacccctacaaactgctgaacatctacgggagggacactatcgagcaatataaaggccgtgaactttacgaacggcccccccatcttttcgccatcgccgacgccgcatacaaggcaatgaagcggagaagcaaagatacttgtattgtgattagcggcgaatctggggccggtaagacagaagcaagtaagtatatcatgcaatacatcgctgctatcacgaatccctcccaaagggcagaggtagagagagtgaagaatatgctcctgaaatcgaattgtgtactcgaggcattcgggaacgcgaagacgaatcgcaatgacaactcgtctcggtttggcaaatacatggacatcaatttcgactttaagggagaccccattgggggacacatcaataattatctgctggagaaaagccgcgttatcgtgcagcagccaggcgaacgatcctttcatagtttttaccagcttctgcaggggggaagcgagcagatgctgcgctcgctgcacttacagaagagcctgtcatcttataactatatccatgtcggagcacaactgaagtcctctattaatgatgccgctgaatttagggttgtggctgatgctatgaaggtcatcgggttcaagcccgaggaaatccaaaccgtatacaagatactggcagctatcctccacctgggaaacttgaaattcgtagtcgacggcgacactccactgattgaaaatggaaaagtggtctccatcatcgccgaactcctgtctactaagaccgacatggttgagaaagctctgctgtatagaacagtagctaccgggagagacatcattgacaagcagcatactgaacaggaagcgagctacggacgagatgcattcgctaaagccatatacgagaggctgttctgttggatcgtgacaagaattaacgacataatcgaggtgaagaactacgacacaacaattcacgggaaaaacaccgtgatcggtgtcctggatatttatgggtttgagatctttgacaataatagcttcgagcagttttgcataaattattgcaatgagaagctgcaacaactgtttattcagcttgtgttgaagcaggaacaggaggagtaccaaagggaaggtatcccctggaagcatatcgattatttcaacaatcaaatcattgtcgatcttgtcgagcagcagcacaaagggattatcgccatcctagatgacgcatgtatgaacgtcggcaaggtcacagatgagatgtttttggaggccttgaactctaaactcggcaagcatgctcacttctcctccaggaaactatgtgctagcgacaaaatcctggaatttgaccgcgacttccgtatccgtcactacgctggagacgtagtctattctgtgatcggcttcattgataaaaacaaggacaccctgtttcaggactttaaacgtctgatgtacaactccagcaacccagtcctaaaaaatatgtggcctgagggcaaactcagcatcacagaagtgaccaaaagaccactgaccgctgccacactctttaaaaactctatgattgctcttgtggataatctcgccagtaaagaaccatattacgtgagatgcatcaagcctaatgacaaaaaaagccctcaaatatttgatgacgagcggtgccggcatcaggtggaatacctggggcttctcgagaatgtaagggtgcgtagagctgggttcgcctttcgacagacctacgagaagtttctgcatagatacaagatgattagcgagttcacttggccgaaccacgacctgccctctgacaaagaggctgtaaaaaagctgatcgaacgatgcggattccaggatgacgttgcttacgggaagactaaaatcttcatcaggactccacgtacactctttactctggaagaacttcgcgctcagatgctgattaggattgtcctcttcctgcagaaggtgtggcgtgggaccttagcacgcatgcgctataagcgcacaaaagctgcacttacaattattcggtattaccggaggtacaaagtgaagtcgtatattcacgaggtggcccgccgcttccatggggtaaaaactatgcgagactacgggaagcacgtgaagtggccaagcccacctaaagtcctgagacgctttgaggaagccctgcaaaccatatttaacagatggcgcgctagtcagctaatcaaatcaattcctgcaagtgacctgccccaagtcagggctaaggttgctgctgtggagatgctgaaaggccaacgagctgaccttggcctgcagagggcgtgggagggaaactatctcgcatcaaaacccgatacgccgcaaacatccgggaccttcgtgcccgttgctaacgaacttaagaggaaagacaagtatatgaacgtgctgtttagttgtcacgtccggaaagtaaaccggttctctaaagttgaagaccgcgcaatctttgtgacagaccgtcacctgtataaaatggacccaacaaaacaatacaaggtgatgaagaccatcccactctacaatctgaccggattgtcagtgtccaatggtaaggaccagctcgtcgtgtttcacaccaaggacaacaaggacctgattgtctgtttgttctccaaacagcctacccatgagtccagaattggcgaactggttggagtattggtgaaccatttcaaaagcgagaagaggcatctccaggttaatgtgactaatcctgtacagtgttctctccacggcaagaagtgtacagtctccgtggagaccaggctgaatcagccacagccggatttcaccaaaaatcgttctggcttcatcctgtccgtgcctgggaattag

SEQ ID NO: 196190 - DNA, 597 bp, Artificial Sequence
  Description of Artificial Sequence: Synthetic coding sequence
atgctgaagggccagcgggccgacctgggcctgcagcgggcctgggaaggcaattatttagccagcaaacctgacacaccacagacttctggcactttcgtgcccgtggccaacgaactgaagcggaaggataagtatatgaatgtactcttctcctgtcacgttcggaaggtgaacagattttctaaagtagaggatcgcgctatattcgtgaccgatcgccatctctacaagatggatcctaccaaacagtacaaagtgatgaagacaatcccactatataacctgaccgggctgtcagtttccaacggtaaggatcagctggtggtgttccacaccaaggacaacaaagacctaatagtttgtctgttttccaagcaacccacacacgagagcagaatcggagagctggtgggggtgttggtgaatcatttcaagtctgagaagcgacaccttcaggtaaacgtgaccaatccagtgcagtgcagtttacatggcaagaagtgcacagtgtccgtcgaaacaaggctgaaccagcctcagccagatttcacaaaaaacaggagcggtttcatcctcagcgttcctggaaactag

SEQ ID NO: 196191 - DNA, 3327 bp, Artificial Sequence
  Description of Artificial Sequence: Synthetic coding sequence
atgggcagcaagggcgtgtaccagtaccactggcagagccacaacgtgaaacactccggggtcgacgacatggtattactttctaagattacagagaactctatcgtggagaacctgaagaagagatacatggacgactatatctttacttatatcgggtcagtgctgatttccgtgaatcctttcaaacagatgccctatttcggggaaaaagagatcgaaatgtatcagggagccgcccagtatgagaaccctcctcacatctacgccctggcggacaacatgtataggaatatgattattgaccgcgaaaatcagtgcgtaattatctccggggagtctggtgccggcaagacggttgcagctaaatacatcatgagctacatctctcgggtatcaggcggtgggacaaaggtgcagcacgtcaaagacataattctgcaaagcaaccccttgcttgaagctttcggaaacgcaaaaaccgtgaggaacaataactccagtcggtttggtaaatattttgagatccagtttagtcccggaggcgagcccgatggcgggaaaatctcgaactttctgttagagaagagtagggtggtcatgcggaatcccggggagagatcgttccacatattttatcagttgatcgagggagcctcagctgagcagaagcattccctgggaatcactagcatggactactattactacctctcactctctgggagctacaaagtggacgacatcgacgaccggcgagagttccaggagaccctgcacgcaatgaacgtgatcgggatctttgcagaagaacagacgctggttctgcagatcgtagccggcatactgcacctgggaaacataagctttaaggaggttggtaactatgccgcagtggaatctgaggaatttctcgctttcccagcctatttattgggcatcaatcaggacagattaaaggagaaactgaccagtcggcagatggactctaagtggggcgggaaatctgagagtatccatgtgaccctgaacgtcgagcaggcctgctacacccgagatgctctggccaaagccttgcacgcacgcgtattcgattttctggtcgactccatcaataaggccatggagaaagatcacgaggagtacaatatcggagttttggatatatatggctttgaaatctttcaaaagaacggctttgagcaattttgtataaacttcgttaatgagaaattacaacagattttcatagaactgaccctcaaggctgaacaggaagaatacgttcaggagggcatcaggtggactccaatcgagtatttcaacaacaaaattgtatgtgacctgatcgagaacaaggttaatcccccgggcatcatgagcatacttgacgatgtctgtgccacgatgcacgcagtcggcgaaggagcagatcaaactttgcttcagaagctgcagatgcagattggaagtcacgagcacttcaactcttggaaccaaggcttcataatccaccactacgctggtaaggtgtcctacgacatggatggcttctgcgagcgcaatagggacgttctcttcatggatctgatcgaactgatgcagtcatcagaactgccctttatcaagtctctcttccctgagaacttgcaggccgataaaaaggggagaccaaccacagccggaagcaagattaaaaagcaggctaatgatctggtttctacgttaatgaagtgcacccctcattacatcagatgcatcaagcccaacgaaaccaagaagcccagggattgggaagagtctagggtgaagcatcaggttgaatatctggggctgaaagaaaacatcagagtgaggcgggccggttatgcctacagacgcattttccagaagttcctacaaagatacgccattttgacgaaggccacgtggccctcatggcaaggagaggaaaagcagggagtgctgcatctcctccaaagcgttaatatggattctgaccagtttcagctcggcaggtcaaaagtgtttattaaagctcccgaaagcctcttcctgcttgaagagatgagggagagaaaatacgacggctacgccagagttattcagaagagctggaggaaattcgttgccaggaaaaaatacgtccagatgcgagaagaggcctcggatttgctgcttaataaaaaagagcgcaggcgcaactcgataaacaggaacttcattggagactacattgggatggaagagcatccagaactccagcaattcgtcggaaagcgtgagaaaattgacttcgcagatactgtcacgaaatacgacaggcgatttaagggggtgaaaagggacttactcttgacccctaaatgcctttatcttatcggcagggaaaaagtgaaacaggggccggacaagggtctggtcaaggaagttctgaaaaggaaaatcgagatagagcgtatactctcggtctccctgagcacaatgcaggacgatatatttattctgcacgaacaggaatacgattcgctcctcgaatcggtgttcaagacggagtttttgagtctgttggccaaaaggtatgaggagaaaactcagaagcagctgcccttgaagttttccaacacattggagttgaagctaaaaaaggagaactggggcccatggtctgccgggggctctcggcaggtacaattccatcaaggttttggcgacctggccgtgctcaagcccagtaacaaagtgctacaggttagtatcggccctggcttgcctaagaactctaggccaacacgccggaatacaactcaaaacaccggatattcgtctggcactcagaatgcgaattaccccgtgcgcgcagcacccccacctcccgggtaccaccaaaatggcgtaattaggaaccagtacgtaccatatccacacgcccccggaagccagaggagcaatcaaaagtcactctatacttctatggctcgtcctcccctccccagacaacaaagtacttcgtccgaccgcgtgtcccaaactccagagtcactcgattttcttaaagtaccagaccagggggccgccggcgtgcggcgacagactacttccaggccaccacctgccggaggcagaccaaaaccacagcccaagcccaagcctcaagttccgcagtgtaaagccctctacgcttatgatgctcaggataccgacgaattatccttcaatgctaatgacatcatcgatatcattaaggaggacccttccgggtggtggacagggagattgagaggtaagcagggtctttttcctaacaattacgtgacaaaaatttag

SEQ ID NO: 196192 - DNA, 3312 bp, Artificial Sequence
  Description of Artificial Sequence: Synthetic coding sequence
ggcaccaaggccggcagccccgtgaacggccagaagcagggccacgcccaggctaccccaaagattcctctaaacctgcacctccaccacgatcccttccgctctctccaagagcccaggcatcagccccctacaatgggctctaaggagcggttccactggcagagtcacaacgtcaaacagtcgggggtagacgacatggtcctgttgccccaaatcactgaggatgcgatcgctgcgaacctgaggaagcggttcatggacgactacatctttacctatatagggtcagtgctgattagcgtgaaccccttcaaacagatgccctactttactgacagggaaatcgatctctaccagggtgcagctcagtatgaaaacccgccccacatctacgcacttactgacaatatgtatcggaacatgctgatagattgcgaaaaccaatgtgtcattatctccggggagagcggcgctggaaagacagtggctgccaaatacatcatgggatacatcagcaaggtcagcggtggaggcgagaaagtccaacatgtgaaagatattatcctgcagtctaatcctctgcttgaagcctttgggaacgccaaaaccgtaagaaacaataactcttcccgctttggaaagtacttcgagattcaattcagtagggggggagaacctgatggtggtaaaatctctaatttcctcctagagaaaagcagggtggtgatgcagaatgaaaacgagcggaattttcacatctattaccagctgctggagggcgcaagccaggagcagcggcaaaacctggggctgatgacccctgattactactattacttgaatcagtccgacacctatcaagtcgacggaacagacgatcgtagtgacttcggagaaacacttagcgccatgcaagtgataggaatccccccatctatacagcagctggtgctgcagctcgtggctgggatcttgcatctagggaacatttcgttctgtgaggatggcaactatgcccgcgtggagtccgtggatctcctggcttttcctgcctacctattaggaattgactctggaaggctgcaggaaaagctgacatccaggaagatggactcaaggtggggtggccgcagtgaaagtatcaacgtgactctgaatgttgagcaagcagcctacacaagagatgctttggcaaaaggcctatatgccaggctttttgattttctggtggaggccatcaatcgtgcgatgcaaaaaccccaagaggagtattccatcggcgtcctcgacatctacggatttgagatcttccaaaagaacggtttcgagcaattctgtatcaactttgttaacgagaagctccagcagattttcattgagctgacccttaaagccgagcaggaggaatatgtccaagagggcatccgatggactcctatccaatattttaataacaaagtagtgtgtgacctgatagagaataagctgagtccccccgggattatgtccgtactggacgatgtatgcgctactatgcacgccaccgggggcggggctgaccaaacgctgctacaaaagttacaagcagccgttggaactcacgagcacttcaacagttggtcggcgggattcgtgatccatcattacgctggcaaagtgagttatgacgtctccggcttttgcgagaggaacagggatgtgctctttagcgatctaatcgaattgatgcagacctccgaacaagcctttttgcggatgctgttccccgaaaaactggatggagataaaaaaggaaggccatccaccgccggctctaagattaaaaagcaggccaacgacctggtggcgacgttgatgagatgcacgccccattatatccgttgcatcaaacctaatgagacaaaaaggcccagagattgggaggaaaacagggtaaagcatcaggtagagtacctggggttaaaggaaaatatacgtgtgagaagagcggggttcgcctaccggcggcaattcgccaagtttctgcagaggtatgccatcctgaccccagaaacttggcccaggtggcgtggagacgagaggcagggtgtgcagcacctgctccgggcagttaacatggaaccggaccaataccaaatgggaagtaccaaggtattcgtgaagaaccccgaaagcctatttttattggaagaagtgcgggagcgcaaattcgatggttttgcacgcaccatacaaaaagcatggcgccggcacgttgctgtaagaaaatatgaggaaatgagagaggaggcctccaatatcctcctgaataaaaaggaacgcaggcgcaacagtattaatcggaattttgtgggagattacttagggctcgaggagcggcccgagctgagacagttcctgggcaagcgggaacgggttgatttcgctgactcagtcaccaagtacgaccggcggttcaagccaattaaacgggacctgatcctgacccccaagtgtgtctacgtgatcggccgcgaaaaggttaagaaggggccagaaaagggccaggtgtgtgaggttctaaagaaaaaagtggatatccaggcgttgcgaggggtgtccttgagcacacggcaggacgacttctttattctccaggaagatgctgcagattctttcctggagtcagtgttcaaaactgagtttgtgagtctgctgtgcaagagattcgaagaggccactaggcgcccactccctttgaccttctcagatactctgcagttccgggtgaagaaggagggctggggcgggggcggaaccagatcggtgacattcagcaggggctttggtgatctcgctgtccttaaagtaggcggccggaccttgaccgtttccgtgggcgatggcctacctaaatcttccaagcccaccaggaaggggatggccaaaggaaagcctaggcgctcatctcaggcaccgacacgagcagcccccgctccaccgcgcggtatggaccgaaacggagtgcctcccagtgctaggggtggcccgctgcccggggaccatgtgtggcggggtcatccccaggcttcacctgggttacgaccccacccctgggaacccgcagatgaccctggacatgttcgacctcagtcaactacacagaattcctcgacttgtcttacacgggcatggcccgcgtgccgcggctccgctgcttggggcaacggtcaatgtctggtctgggccgatccaagcccttctttgggccacatggttcctggagccggtccgtatacatcaacttgggctaaaatgtggaccagctag

SEQ ID NO: 196193 - DNA, 3297 bp, Artificial Sequence
  Description of Artificial Sequence: Synthetic coding sequence
atgggcagcaaggagcggttccactggcagagccacaacgtgaagcagagtggtgttgacgacatggttctcctgccacagattacagaagatgccatcgctgcaaacctgcgtaagcgtttcatggatgactatatattcacctacattgggtccgtcttaatctcagttaacccattcaaacagatgccgtactttactgatagggagattgatctctaccagggggccgcacaatatgagaaccctccccacatctatgcactgacggataatatgtaccggaatatgcttatcgactgcgagaaccagtgtgttattatcagcggggagtctggggctggaaaaacggtggccgccaaatacataatgggatatatcagcaaggtctccggcggaggagagaaggttcagcacgtcaaggacatcattctgcagtccaatccactccttgaagcttttggcaacgccaagaccgtaagaaacaacaactccagtaggtttggcaaatacttcgaaatccagttttcacgtggcggggaacccgacggcggaaaaatttctaacttccttctagagaagtcccgagttgtcatgcagaatgaaaatgagcgaaacttccatatttactatcagttgttagaaggggctagccaggaacagcgccagaacctaggcttaatgacccccgattactattattatctaaaccaatctgacacctatcaggttgatggcactgatgaccgctccgattttggtgagaccctcagcgcaatgcaagtcattggcattcccccgtctatccagcagttagtcttgcagttggtcgctggcatacttcatcttggtaatatctccttctgtgaggacgggaactacgcccgggtcgaatcggtcgatctcttagcgttccctgcttaccttctgggcattgattctggcaggctccaggaaaagctgacctcccggaagatggattcccggtggggagggaggtcagagtctattaatgtgactttgaacgtggaacaagctgcttatactagggacgcccttgcgaagggactctacgctagattattcgattttcttgtggaggccattaacagggccatgcagaaaccacaggaggagtactccattggcgtgctcgatatctacggcttcgagatttttcaaaagaatggctttgaacagttttgtataaactttgtgaacgagaaattgcaacagatcttcatcgagctcacattgaaggccgagcaagaggaatatgtccaagagggtatcagatggaccccgattcagtatttcaacaacaaggtcgtgtgtgacttgatcgagaacaaattatcacctccgggaatcatgagtgtccttgatgacgtgtgtgctacaatgcacgccaccgggggtggggcagaccaaactcttctgcaaaaactccaagccgccgtcggtacccatgaacacttcaatagctggagtgccggctttgtaatacaccactatgcgggcaaggtgtcatacgatgtgtctggattctgcgagcgtaaccgcgatgtactcttcagcgatctcatcgaactcatgcaaactagcgaacaggcctttcttagaatgctttttccagaaaaattagatggggataaaaagggccgccccagcactgcaggctcaaaaattaaaaagcaagcaaacgatcttgttgctaccctgatgagatgcaccccccactatatacgctgtatcaaacccaatgaaaccaaacggccgcgggactgggaggagaatagagtgaagcaccaggtagaatatcttggactcaaggagaacataagggtgcgtcgggccgggttcgcgtatagacgccagtttgcgaaatttctacaacgctacgcgatactgacaccagaaacttggccccgctggcgcggggatgaaaggcagggagtgcagcacctcctcagggccgtgaatatggagcccgaccaataccaaatgggatccaccaaagtattcgtgaaaaaccccgaatccctgtttttactggaggaggtgcgggagaggaagttcgacggctttgccaggacaattcagaaagcatggagacggcacgtcgccgtcagaaaatacgaggagatgcgcgaggaagccagtaacattctgcttaacaagaaggaaagacgccgcaactccatcaatcgcaacttcgtcggggattacctaggcttagaggagagacctgagcttagacaattcctgggtaagagggagcgcgttgactttgccgacagcgtcactaaatatgaccgacgctttaagccaatcaaaagggatctcattttgacgccaaaatgtgtgtatgtgattggcagagagaaggtgaaaaaggggccagagaaggggcaggtttgtgaagtgcttaagaaaaaagtggatatccaggccttaagaggcgtttccctcagcacacggcaggacgatttctttattctgcaagaagatgccgccgatagtttcttagagtccgtctttaaaaccgaatttgtctctctgctgtgcaaaaggttcgaagaagccacaaggcgcccgctacctctgacatttagcgacactctccagttccgtgttaagaaggaagggtgggggggtggtggcacccggtcagtcacattcagccgcggcttcggggaccttgcagtgctcaaagtgggaggacgtacactgaccgtgagcgtgggcgacgggttaccaaaatcttcaaagcccactcgtaaagggatggctaagggaaagccacgcagaagctctcaagctcctactagggccgcgccagctcctcctaggggcatggatcggaacggagtacctccatctgcgagaggtggcccgctgcctctcgaaataatgtccggtggtgggacacaccgccctcctagaggaccgccctctacctccctgggagcctctagacggccaagagcccgcccaccgagtgagcataataccgagtttctgaacgttcccgatcagggcatggctggtatgcagcgcaaacgaagtgttggacagcgtcctgtcccgggcgttggccgacccaagccccaacctcggacccacggcccacgatgcagggcgctgtaccagtatgttggacaagacgtagacgaactgagttttaatgtcaacgaagtgatcgagatcctgatggaagatccctctggatggtggaaggggcgcctgcatggacaggaaggccttttcccgggcaattacgtggagaagatctag

SEQ ID NO: 196194 - DNA, 3057 bp, Artificial Sequence
  Description of Artificial Sequence: Synthetic coding sequence
atggaggacgaggagggccccgagtacggcaagcccgacttcgtgcttctggatcaggtgactatggaggattttatgcgaaacttgcagctgcgcttcgagaaagggcgaatatacacctacatcggcgaggtgctcgtcagcgtgaacccctatcaagaactgccactgtatgggccggaggcaatcgctaggtatcagggcagggagttgtacgaaagacctccccacctctacgcagtcgccaatgctgcctacaaggcaatgaagcaccggtctcgggacacatgcattgtgatttcaggggagtctggcgctggcaaaacagaagccagcaaacatattatgcagtatatcgccgccgtgaccaatcctagccagagagctgaggttgaacgagtgaaagacgtgctcttgaagtccacttgtgtcctcgaagcctttggcaatgctaggaccaatcggaaccacaactccagccgattcggaaagtacatggatatcaacttcgactttaaaggtgaccctatcggggggcacattcactcctatctgctggaaaaatctcgagtgttaaagcagcacgtgggtgagcggaattttcacgctttctatcaactccttaggggctctgaggataaacagctccatgaactccacttggaaaggaatcctgcggtgtataatttcacacaccagggagccggccttaacatgaccgtccattctgctctcgactctgatgagcagtcacaccaagctgtcaccgaagctatgagagtcataggattctcccccgaagaggttgagtcagttcaccgaatcctggctgcaatcctccatcttgggaacatagagtttgtggagactgaggagggcggattgcagaaggaagggctggccgtcgcagaagaggcactcgttgaccacgtggcggagttgaccgccactcccagggacttagttttgaggagcctgctggcccgcacggtggcaagcggaggcagagaacttattgagaaggggcacactgctgccgaagctagctacgcacgagatgcctgcgccaaggccgtgtaccaacgcttgttcgagtgggtggtgaaccgcataaattccgtgatggagccccgtggtcgtgacccgaggcgcgacggcaaagacaccgttataggtgtgctggacatctatggattcgaggtgttcccggtgaactcatttgaacagttctgtattaactattgcaacgagaaactgcagcagttgttcattcagctgattctgaaacaagaacaggaagagtacgaaagggaaggcattacatggcaatcagtggaatactttaataatgccacaattgtggacctggtggaacgaccccatcggggaatccttgctgtcttggatgaggcatgttcgtctgccggcactataacagacagaatcttcctgcaaacactggacatgcaccaccgtcaccacttgcactatacttcccgacaactctgtcccaccgacaagactatggagtttggaagagactttagaattaaacattacgccggagacgttacctactccgtggagggcttcatagacaagaatagggacttcctgtttcaggactttaaacggttgctctacaactccacagatccgaccttgcgagcaatgtggcctgatggccagcaggacataactgaagtgacaaaacgccccctaaccgccggcaccctgtttaagaatagcatggtcgccctcgtcgagaacctggcctccaaagagcccttctacgtgcggtgcattaaacccaatgaggacaaggtggccggcaagcttgatgagaatcactgcagacaccaggtggcttacctagggttgctggagaacgttcgcgtgcgtagggcaggatttgcaagccggcaaccctatagtaggttcctgctccggtataagatgacttgtgaatacacctggccaaatcatctgttgggctccgacaaggccgctgtcagcgctctcttggagcagcatggtcttcagggcgacgttgcctttggacacagcaagctgttcatacggagtccgagaactctggtgacgttggagcagtctagagccagacttattcccattatagtacttctgcttcagaaagcatggcggggtacactggctaggtggagatgtcggaggctgagggccatctatacgattatgcgttggtttcgccgtcataaggtgcgcgctcacttggctgaactccagcggcgttttcaggccgcccggcagccaccactgtacggcagggatctggtgtggccattgcccccggcggtcctacaaccatttcaagacacatgccacgccctgttttgcaggtggagagctaggcaactagtgaaaaacatccccccctccgatatgccacagatcaaagctaaagtagccgccatgggggcacttcaaggattgcggcaggactggggttgtcgccgggcttgggctagagactatctctcgtctgccacagataatcctaccgcatccagcctcttcgcccaaagattgaagacactccaagataaggacgggtttggcgcagttctcttctcttcccatgtgcgaaaggtgaaccgttttcataagatacgaaaccgggctctcctcctaaccgatcagcacctgtataagcttgatcccgacagacagtacagagtcatgcgggcagtcccactggaagcagtcactggactgtctgtaactagcggcggagaccagctcgtggttttacacgctcggggccaggatgatctcgtggtgtgtcttcatcgctctagaccgcccctcgataatagggttggcgagcttgttggagtgctcgcagcccactgccagggggagggcagaacactggaggtgcgggtatcagactgcatccctttatcacatagaggtgtgagaagattgatttcagtcgaaccacgcccagagcagcccgagcccgattttaggtgtgccagagggtcttttactctattatggccaagcagatag

SEQ ID NO: 196195 - DNA, 4851 bp, Artificial Sequence
  Description of Artificial Sequence: Synthetic coding sequence
atgttccccctgatcggcaagaccatcatcttcgacaacttccccgacccaagtgacacttgggaaattactgaaacaattgggaaagggacctatggcaaagtattcaaagtgttgaataaaaagaacgggcagaaggctgccgtgaaaatcctcgatcctatccacgacatagatgaggaaatcgaagcagaatacaatattctcaaggcactgtctgatcaccctaacgttgtccggttttacggaatttacttcaagaaggacaaggttaacggtgacaagttgtggttagtgctggagctctgctcaggcggttctgtgacagatttggttaagggcttcctgaaaaggggcgaacgcatgagtgaaccgttaatcgcttatatcctgcacgaagccctgatgggtttgcagcatcttcacaacaacaagacaatccatcgagatgtcaagggcaacaacattctcttaactacagagggaggcgtcaagctcgtggacttcggcgtctccgcccagctgactagcacacgtcaccgcagaaacacgtctgtgggtacccctttctggatggccccagaggtgatcgcctgtgagcagcaactagacaccacttatgacgctcggtgcgatacgtggtccttaggaatcactgccattgaactgggcgacggcgacccacctctggccgacctgcaccccatgcgggccctatttaagattccaaggaatccacctccaaagctgcgacaaccagaactatggagtgcagagttcaatgatttcatcagcaaatgcctcaccaaagattatgaaaaacgaccgacggtaagcgagctgctgcagcataaattcataacacagattgagggcaaagatgtcatgcttcagaaacagttgacagagttcatcggcatccaccagtgcatgggtgggacggagaaggcacgacgggaacgtatccatacaaaaaagggaaatttcaacagacccttgatttctaacctgaaggacgtggatgaccttgctacgctggaaatcttggacgaaaatactgtgtctgagcagttggaaaagtgctattctcgagaccaaatctacgtgtatgtgggggatattctgatcgctctaaacccgtttcagtctctcgggttatactccacgaagcactcaaaactgtacattggctctaagcgcactgcctcccccccccatatttttgctatggctgacctcggataccagtccatgattacatacaatagtgatcaatgtatcgttatcagcggggagtctggagccggaaagacggagaacgcccacttgttggtgcaacagcttaccgtgctgggcaaggccaataataggacgcttcaggagaagatcctgcaggttaacaacctcgtggaagcttttgggaacgcctgcacgatcatcaacgacaactcttccaggttcggaaagtatctcgagatgaaattcactagctccggcgctgtggtcggagcacaaatctctgagtacctgctagaaaaatcgcgcgtcatccaccaagccatcggggaaaaaaacttccatatattttactatatatacgccgggctggcagagaagaagaaattggctcattataaactcccagaaaataagcccccaagatatcttcaaaatgatcatctgcgcacagtgcaggacattatgaacaacagcttctataagtctcagtacgagctgatcgaacagtgctttaaagtcattggcttcaccatggagcagttaggctctatttattcgattctcgctgccattctgaatgttggaaacatcgagttctcttccgtagcaacagagcatcagattgataagtctcacatctcaaatcacacagcattagagaattgtgctagtctgttatgcattagggcagacgagcttcaggaggcccttaccagtcactgtgtagtgacccgcggtgagaccattattcgcccaaacactgtagagaaagccactgatgtgagggatgccatggccaaaacactgtatggaaggctgttcagctggattgtaaactgtattaactccctcctgaagcacgacagtagtccctctgggaatggcgatgaattgtccatcggcatactggacattttcggcttcgaaaacttcaaaaagaactctttcgaacaactgtgcattaatattgccaatgaacaaatccagtattactacaaccaacatgttttcgcctgggaacagaatgaatatctgaatgaggatgtggacgcgcgagttatagaatatgaagacaactggccattgttggatatgttcctgcagaagcccatgggcttacttagtttacttgatgaagaatcgaggtttccaaaggctacagaccagactctggtcgagaaatttgaaggcaatctgaagagccagtacttctggagacccaagagaatggagctgtcatttggcattcaccattacgcgggtaaggtgctgtataacgcctccggtttcctcgccaagaacagggacaccttaccaacagacattgtattactgctcagaagttccgacaattcagttatcaggcagctggtgaatcacccactgacaaagactggcaaccttccacattcaaaaactaaaaacgtgattaactaccaaatgcgcacctctgaaaaactgataaaccttgcaaaaggcgatactggagaagccacaaggcatgcaagggagaccaccaatatgaaaacccagaccgttgctagctactttagatatagcctcatggacctgctgtcaaaaatggtggtggggcagccccactttgtacgctgcatcaagcctaacagcgaaagacaggcgaggaagtatgataaggagaaggtgttgctccagctgagatatacagggattttggaaacggccaggattcgacggttaggattttctcatagaatcctttttgccaatttcattaaacggtactatctgctttgctataagagctccgaggaacctagaatgtcccccgatacctgcgccaccatacttgaaaaagccggactggataattgggcccttggaaaaaccaaagtattcctaaaatactaccacgttgagcaactgaatttgatgcgaaaggaggccatcgataagttaatacttattcaggcatgcgtgcgcgctttcctctgtagtcgtcgctaccaaaaaattcaggaaaagcgaaaggaatcagcaatcattattcagagcgcagccaggggccacctcgtgagaaaacagcggaaggagatcgttgatatgaaaaacacagctgtaactacaattcagaccagcgatcaggagttcgactacaaaaagaatttcgagaacacaagggaatcattcgtcaaaaagcaggcggagaacgcaatatctgctaacgagaggttcatatccgcccctaataataagggcagcgtgtccgtagtgaagacctcaacattcaagccagaagaggagaccaccaatgcagtcgaatccaataatagagtgtatcagacacctaagaaaatgaataatgtgtatgaggaggaagtaaagcaggagttctatctggtggggcctgaggtgagccccaaacaaaagtcagtaaaagatctggaggagaacagcaaccttcgcaaagtcgaaaaggaagaggccatgatccagtcttactatcagcgttatacggaggagcgaaactgtgaggagagcaaggccgcctatctggaacggaaggcaatcagcgaacgcccatcctacccagtaccctggctggcggagaacgaaaccagctttaagaagacactggagcccaccctgtctcagaggagcatttaccaaaatgccaattcaatggagaaagagaagaagacgtccgtggtgacgcaaagggcccctatctgttcccaagaagaaggaagaggccggctgagacacgaaacagttaaggaaaggcaggttgagcccgtcacacaggctcaagaggaagaagataaggcggctgtatttatccagtcaaagtataggggctataagagaagacagcaacttcggaaggacaagatgagttcttttaaacatcagcggatcgtgactactcctaccgaagtcgctaggaatactcataacttatactcctacccgactaaacacgaggaaataaacaatatcaagaaaaaagacaataaggactccaaggccacttctgaaagggaagcctgcggcctggcaattttttccaaacaaattagtaagcttagcgaggaatacttcatcctgcaaaagaaactgaatgagatgatcttatcgcagcagctgaaatccctttatctgggggtgagccaccataaaccgattaacagacgtgtatcgagccagcagtgcttgagcggggtgtgtaagggcgaggaaccaaaaatcctgcgccctccccgtaggccacgaaaacccaagacacttaacaatcccgaagactcaacatattactacttgttgcacaagtcaatccaggaagagaagaggcgccctcgtaaggatagccagggaaagctcttggacctggaagacttctactataaagaattcctcccttcaaggtcaggccctaaagaacactctccatctctgcgggagaggaggccccagcaggagctccaaaaccaatgcatcaaggcgaacgaacggtgttgggctgccgagagccccgaaaaagaggaggaaagggaacctgcggcgaacccttacgactttcggagactgctgcgtaaaactagtcagcgcagaagattggtgcagcaatcttag

SEQ ID NO: 196196 - DNA, 594 bp, Artificial Sequence
  Description of Artificial Sequence: Synthetic coding sequence
atgttccccctgatcggcaagaccatcatcttcgacaacttccccgatcctagcgacacgtgggagataacagagacgattgggaaaggtacttacggcaaggtttttaaggttctgaacaaaaaaaatgggcagaaggccgctgtgaagattctcgatccaatacatgacattgacgaagaaatcgaggccgagtacaatatactgaaagctttgagtgatcaccccaacgtcgtgagattttacggaatctacttcaaaaaggacaaggtgaatggtgacaaactttggcttgtccttgaactctgctcaggtggctcagtgacagatctcgtgaagggttttctgaagaggggcgagagaatgagtgagcctcttatcgcatatatcctgcacgaagccttgatgggcttgcaacatctgcataacaacaagactatacaccgcgatgtcaagggcaacaatatcttactaaccacagaaggaggcgtcaagctagtggacttcggagtcagcgctcagctgacctccacaagacatagacgtaacacttctgtggggacacctttctggatggctcctgaggttaggtag

SEQ ID NO: 196197 - DNA, 744 bp, Artificial Sequence
  Description of Artificial Sequence: Synthetic coding sequence
atgttccccctgatcggcaagaccatcatcttcgacaacttccccgacccatcagatacctgggaaatcaccgagacaattggcaagggcacctatggaaaagtcttcaaagtgctcaataagaaaaacggccagaaggctgcagtgaaaattctggaccccatccatgatatcgacgaggagattgaagctgaatataacattctgaaagcacttagcgatcaccctaatgttgtgcggttctatggaatatattttaaaaaagataaggtgaatggtgataaactttggctggttctggaactgtgctctgggggcagcgtgacagaccttgtgaaggggttcttgaagcggggagaacgaatgtcagagccacttatcgcatatatactgcatgaggcacttatgggtttacagcacctacacaataacaagaccattcacagagacgtcaagggcaacaacattctattgacgacagagggaggtgtaaaattagtggattttggtgtatctgctcagctgactagtacacgacaccgccgtaacacatctgtaggcactccattttggatggccccagaggttatagcttgtgaacagcagttagatacaacatacgacgccagatgcgatacttggtcacttggcatcacggcaattgaattaggtgatggagacccaccactggcagaccttcaccctatgcgcgctttgttcaaaattccacgctctgacgattag

SEQ ID NO: 196198 - DNA, 1995 bp, Artificial Sequence
  Description of Artificial Sequence: Synthetic coding sequence
atgttccccctgatcggcaagaccatcatcttcgacaacttccccgatccgtctgacacctgggaaatcactgagaccataggcaaagggacttatgggaaggtgtttaaagtcctgaacaagaaaaatggacaaaaggccgcagtcaaaattctggatcccatccatgatatcgatgaggaaatcgaagctgagtataatattctgaaagcgctatctgatcacccgaatgtggtccgattctacgggatctacttcaagaaagataaggtgaatggagacaagctgtggctcgtgttagagctttgttcaggaggcagtgtaaccgacctggttaagggttttttgaagagaggggagcgcatgtctgaaccccttatagcatacattttgcacgaggccttgatggggctgcagcatctgcacaacaacaagacaattcaccgtgacgttaagggaaacaacatcttgcttacaacagaggggggagttaagctggtggacttcggcgttagcgctcagctgacgagtactcgccaccgacgcaacacatccgtgggtacccctttctggatggcaccagaagtcatcgcgtgcgagcagcagttggataccacatatgacgccaggtgcgatacatggtcccttggtattacggctatagaactgggagatggagatccaccgctggcggacctgcaccccatgagagcactttttaaaatccctcggaatccgcctcctaagctcaggcagcctgagctgtggtctgccgaattcaatgacttcatctcaaagtgcttaaccaaagactacgaaaagcgcccaaccgtttcggaactactgcagcataagtttatcacacaaattgaaggtaaggatgtcatgctgcagaaacagctcacagaattcattggaattcaccagtgcatgggaggaacagagaaagcaaggagggagcggatccatacaaagaagggaaacttcaatcggccattgatctcaaatctcaaggatgtggatgacctggccacacttgaaattctggatgaaaacacagtcagtgagcagcttgaaaagtgctactctcgggatcagatatacgtgtatgtgggcgacatcctcattgctctgaacccctttcagtccctaggcttatactcaaccaagcactctaagctttacattggctccaagaggactgcgagccccccacacatttttgccatggccgatctaggataccagagcatgattacctacaatagcgatcaatgtattgtcattagtggcgaaagtggcgccggaaagacagagaatgcacatttattagtgcaacaacttacagttcttggaaaggcaaacaaccggacgcttcaggaaaagatattgcaagtcaacaatctggtggaagcctttgggaacgcatgcactatcataaacgataattcttctcgctttggaaagtaccttgagatgaagtttactagctcaggagccgttgtgggtgcgcagatatctgagtatctgctcgagaaaagtagggtgatacaccaggcaataggggagaaaaactttcacattttttattatatatacgcaggactggcagaaaagaagaaactggcccactataagctgccagaaaacaagcctccaaggtacttgcagaacgatcatctgcgaaccgtgcaggatatcatgaataacagcttttacaagtcccaatatgaactcattgagcaatgtttcaaagtcatcggcttcaccatggaagtcctcggcggaggggagcctagggagggaggaggagaacgggctagctcccagcctctgcggctccaggaggcccctgctcagaacctgccggctccagcacccaggcccgccgtgctcacggtgcagcggggttcacataggcgtcgcaaagcacttgagccagcaggccagcagggcccgtctagacatagcggcgcaggaaccagccggcactag

SEQ ID NO: 196199 - DNA, 3834 bp, Artificial Sequence
  Description of Artificial Sequence: Synthetic coding sequence
aagcacctgtacggcctgttccactacaaccccatgatgctgggcttagaatccctgcccgatccaacagatacatgggagattatcgagactatcgggaaagggacttatggtaaggtgtacaaggtgacgaacaaaagagacggatccctcgcggcggtgaaaattctagatccagtgagcgacatggacgaggaaattgaggctgaatacaatatcttacagtttctacctaaccaccctaacgttgtaaagttttatgggatgttctacaaagcggaccactgtgttggcggtcagctgtggctcgttctggaattgtgtaacggtggctccgttacagagttggtgaagggactgcttcgctgcggtcagagactcgatgaagcgatgatttcatacatcctgtacggagcactgctcggcttgcagcatctgcataataataggattatccaccgggatgtgaaaggaaacaatattctcctgaccacagagggcggcgttaaactggtggactttggcgtgtccgcgcaactcactagcactagactccgtcgtaatacaagcgtcggcactcctttctggatggcacctgaggtgatcgcctgcgagcagcagtacgactcaagctacgacgcccgatgcgacgtttggtctctcggaatcacagccattgaactgggggacggagatccccccctgtttgatatgcaccccgtcaagaccttattcaagatcccccggaaccccccgcctaccctgctccacccagaaaagtggtgtgaggagttcaaccacttcatctctcagtgcctcatcaaggactttgagaggcggccttctgtgacccacttgttggaccatccgtttatcaagggcgttcacgggaaagtactcttcctgcaaaaacagctcgctaaagtgctacaagatcagaagcaccagaatcctgtggcgaagacacggcacgaaagaatgcatactagacggccataccacgtcgaggatgctgaaaagtactgcctcgaggacgacttagtgaacctggaggtcctcgatgaggatactatcattcatcaacttcagaagaggtacgcggacctcctgatttatacgtacgtgggtgacatcctgatcgcactgaacccctttcaaaacttgagtatttactctccgcaattcagcagactgtatcacggagtcaaacgcgcctctaacccaccacatatctttgcctccgccgatgcagcctaccagtgtatggtcacccttagtaaggatcagtgcatcgtgatctctggagagtcgggcagcggcaaaaccgaaagcgcccatctgattgtgcagcatttgacttttctcggtaaagcaaataatcaaacattacgggaaaagattctccaagtgaacagcttggttgaggcgttcggaaactcctgcaccgccatcaacgataattcttcccggtttggcaagtacctagagatgatgttcacacctactggggtggtcatgggggctaggatttctgagtaccttctcgagaaatctagggtgatcaaacaggcggccagagagaagaacttccacatcttttattatatatacgccgggctgcatcaccaaaaaaaattatctgattttcgactccctgaggagaaaccaccacggtacatcgccgacgaaacaggtcgggtcatgcacgacataaccagcaaggagtcttaccgtcgacagtttgaggctatccagcactgttttaggatcattgggttcaccgacaaggaggttcactctgtttacaggatcctggccggaattctcaacatcggaaacattgagttcgccgccatatcttcccaacaccagaccgacaagagcgaagtgcctaacgccgaggctttgcagaacgcagccagcgtcctgtgcatttcacccgaggagttgcaggaagccctgacctctcactgtgtggttacacgtggagaaactatcatccgagctaacactgtcgatcgcgctgccgatgtgagagatgccatgtctaaagctctgtacggtaggctgttcagctggatcgtgaacaggataaataccctccttcagcctgatgaaaacatctgctccgctggggggggtatgaatgtgggaatcctggacattttcgggtttgagaactttcagaggaatagctttgagcaactctgcattaacattgccaatgaacagatccagtattactttaaccagcatgttttcgccctcgagcagatggagtaccagaatgagggcattgacgcagttcctgtagagtacgaggataatcgaccccttctggatatgttcctgcagaagccactgggactgttagccctgctggacgaggaatcacgctttccgcaggccacagatcagacattagtggataagtttgaagataatctgcgatgcaagtacttctggcgcccaaagggagtcgagctttgctttggcattcagcattacgctgggaaggtgctatatgacgcttcaggagtcctggagaaaaatagagacacccttcccgccgatgtggtagtggtgctgcggacaagcgaaaataagcttctgcagcaactgttcagtatacctctgacaaagacagggaatctggcccagacgcgggcccggattaccgtggcctcatcgtccctgccaccccacttcagtgccggcaaagccaaggtagacactctggaagttattcgccaccctgaggagacaactaacatgaagcggcagactgtggctagttattttcgttattccctgatggacctactgagtaagatggtggtcgggcaaccacactttgtccgatgtataaaacccaatgatgaccgtgaggccctccagttcagcagagaaagggtgctggcacagctccggtctacagggattctggagactgtctcgatccgtcgccaaggctacagccatcgaatcctgtttgaggaatttgtcaaacgttactactacctggcatttacagcacaccagaccccacttgcttcaaaagaatcttgcgtagccatcctggaaaagagccgccttgatcactgggtcctgggtaagacgaaggtttttctgaagtactaccacgtagagcagctcaatctgctcctccgagaggtgattggcagagtagtggtactccaagcgtacactaaaggatggctgggtgctcgacgctacaagagagtgagagaaaagcgcgagaagggagcaattgccatccaatccgcttggagggggtacgatgcgagacgcaagtttaaaaaaatcagtaatcgcaggaatgaaagcgccgcgcataatcaggcgggcgacacatctaatcaatccagcggcccccacagcccagtcgctgccggcacaagggggagtgccgaagtgcaggattgtagtgaacccggggatcataaggtgttgagaggttctgtgcacagaaggtcccattctcaagccgaatccaataatgggcgcacccaaaccagctccaactcccctgccgtgaccgaaaagaacggacattcacaggcccagagttctccaaagggctgtgatatcttcgcaggacacgccaataagcatagtgtctcaggcacggatttattgagctcaaggatctgtcatcccgcacctgatcagcagggactgagcctgtggggagcaccacagaaacccgcctttccacattacggctgtaacttttatggatttaggaagtggtcctgtaccgaggctagcaacaccagcccaacaatgtcagcagctcagaatgcagaatag

SEQ ID NO: 196200 - DNA, 4053 bp, Artificial Sequence
  Description of Artificial Sequence: Synthetic coding sequence
atgctgcagagcgccctgctgagcacccggaagcacctgtacggcctgttccattacaatccaatgatgctgggcctggagtctctcccagatcctaccgacacttgggaaatcattgagactattgggaagggaacatatggaaaagtttataaggtgacaaataaaagagatggtagcctcgccgctgtcaagatcttggaccctgtgtcagatatggatgaagagatagaagctgagtataacatcctgcagttcttacccaatcatcccaatgtggtgaagttctatggcatgttctacaaggccgaccattgtgtcggaggccagttgtggctcgtactggagctgtgtaatggcggctctgttaccgagctggtcaagggtttactgcggtgcggccagcgcctcgacgaagccatgatatcttacattctctatggagcacttttgggcctgcaacatctgcacaacaacaggatcattcaccgagacgtgaaggggaacaacatccttctgactaccgaggggggtgtcaagctcgtggatttcggcgtgtcagctcagctcacttccacccggctaaggcgcaacacttccgtggggacccccttctggatggctccagaggtgatcgcctgtgaacagcagtatgacagtagctatgatgctagatgtgacgtgtggtccctggggatcacagccattgagctgggggatggggatccccctctttttgacatgcaccccgtcaaaacgttgtttaagatccctcggaatccccctcccactctcctgcatcccgagaaatggtgcgaggagttcaaccactttatcagccaatgtctcatcaaggattttgagcgacgcccaagcgttactcatctcctcgatcatcctttcatcaaaggagtgcacggcaaagtactgttcttgcagaagcagctcgctaaagtcctgcaggaccaaaaacatcagaaccccgtcgccaagactagacatgaacggatgcacacgagaaggccataccatgtggaagacgcggagaaatactgcctcgaggacgatctggtgaatctggaggtgctggatgaagataccattatccatcagctgcagaagcggtacgctgatcttctaatatacacatacgtcggggacattttaatagccctgaacccattccagaatctgtctatttacagtccgcagttttctaggctgtaccatggtgtaaaacgagctagcaaccctcctcacatcttcgcaagcgctgacgccgcttaccagtgtatggtgacattgtcaaaggatcaatgcattgtcatctcaggagagtcaggctccggaaaaacagagtccgcgcacctcatcgtgcaacacctgacatttcttgggaaagcgaacaaccagacgttgagagagaagattctgcaggtgaacagcctagtcgaggcgtttggcaactcttgcaccgctattaacgacaacagttcaagattcgggaaatacctggagatgatgtttacgcctacaggagtagttatgggagcccggatctctgagtatttgctcgagaaaagccgtgtgatcaagcaggctgctcgggagaagaattttcatatcttctattatatctacgccggcctgcaccatcagaagaaactatcagatttcaggcttccagaggagaaacctccacgctacattgccgacgaaactgggagagttatgcacgacatcacctctaaggagtcctaccggaggcagtttgaggctattcagcactgcttcagaattattggatttacagataaggaagtgcattccgtgtacagaattcttgccggcatccttaatatagggaacatcgagttcgcagccattagctcccaacaccagaccgataaatctgaggttccaaacgctgaggcgcttcagaacgctgcttctgtgctatgtatatcacccgaggagttacaggaggccctgacaagccactgtgtagtgacgcgtggggaaactattattcgggccaacactgtcgaccgggccgccgatgtcagggatgccatgtctaaagcactttatggcagactcttcagctggatcgtgaaccgtatcaatacgctgctccagccagacgagaacatttgctctgctggggggggaatgaatgtggggatactggatatcttcggttttgagaatttccagcgcaacagcttcgagcaactttgcatcaatattgcgaacgaacagatccagtattatttcaatcagcacgtgtttgctcttgagcagatggagtatcagaacgagggcatcgatgcggtaccggtagagtacgaagacaaccgacctctgctcgatatgtttcttcagaaaccactcgggctgctggccctgctggatgaagaatcccggtttcctcaggctaccgaccagacactcgtggacaagttcgaagacaatttaaggtgcaagtacttttggcgccccaaaggggttgaactatgctttggcatccagcactatgccggcaaggtgttgtacgatgcgtcgggtgtgctggagaagaaccgcgacaccttgcccgccgacgtggtggtggtgctgcgcacttcagaaaataaactcctgcagcagctcttctcgattcctctgacaaagaccgggaatctggctcagacccgcgcgagaatcaccgtcgcaagcagcagccttccaccacacttcagcgcggggaaggctaaggtggatactcttgaagtcattagacatcccgaggagaccaccaatatgaaacgccagacggtggctagttattttcggtactctctgatggatctcctgagtaaaatggtagtgggacagccacacttcgtgcgttgtattaaacccaatgatgacagggaagccctccaattctcacgggagcgggtgctagctcaattgcgatcgactggcattttggagaccgtgtccatcaggcgacagggctactcgcatcggatcctgttcgaagagttcgtcaagagatattactatcttgcctttaccgcacatcagacccccctggcgagtaaggagtcttgcgtagcgattctggaaaaatcccggctggatcattgggtcctaggaaagacgaaggtattcctgaaatactatcacgtggagcagcttaatttgctgctccgggaagtgatcgggcgggtggttgtactgcaggcctatactaagggatggctgggagcaaggagatacaagcgtgtgagagagaagagggaaaaaggggccatcgctatccaatcagcgtggagaggctatgacgcacgaagaaagtttaaaaagattagtaacagacggaatgagagtgctgctcacaatcaggcaggcgacacttccaaccagtcttctggcccccacagccccgtcgcagctggaacacgggggtccgccgaggtgcaggactgttccgagccaggcgatcacaaagttctcagggggagcgtacacaggagaagtcacagtcaggcggagagtaataacggccgcactcaaactagttccaactctcccgcagtgaccgagaagaatggacattcccaggcccagagtagcccaaaggggtgtgacattttcgcggggcacgcaaacaagcatagtgttagcggaacagatttactgtcctctagaatctgccaccctgctcctgaccaacaaggactttcactgtggggtgctccgcagaagcctggatccgaaaacggtctcgcacaaaaacaccggacaccccggcgtaggtgtcagcaacccaagatgctgagctccccagaagatacaatgtactataaccagctgaatggaaccctggagtatcaggggtccaagagaaagccaagaaagctgggtcagataaaagtgttagacggggaggacgagtactataaatccctgtcacccgttgactgcatcccagaggagaacaactcagcacacccgtcttttttcagctcttcctccaagggggattcgtttgctcaacattag

SEQ ID NO: 196201 - DNA, 4026 bp, Artificial Sequence
  Description of Artificial Sequence: Synthetic coding sequence
atgaagcacctgtacggcctgttccactacaaccccatgatgctggggttggagagtctgccggaccctactgatacatgggagataattgagacaattggcaaggggacctacggaaaagtctataaggtaacaaacaaacgtgatggctcactggctgcagtcaagatcttggatcctgtgtctgatatggatgaagaaatcgaggcggagtataacattcttcaattcctgccaaaccacccgaatgtcgtgaagttctacggtatgttctacaaagccgaccactgtgtcggggggcagttgtggcttgttctggagttatgcaatggtggaagcgttaccgaactggtgaaagggctcctgagatgtgggcagagacttgacgaggccatgatttcatacatactgtacggagccctgctcggattgcagcatctgcacaataacagaataattcaccgcgacgtgaaggggaataacattctactcacaaccgagggtggagtcaagctggtggattttggtgttagtgcccagctaacaagtacacgattgcggcggaacacaagtgttgggacccctttttggatggcccctgaggttattgcatgcgagcagcagtatgatagctcttacgacgcaagatgtgatgtgtggtctctggggatcactgcgattgaactgggggatggtgatcccccgttatttgacatgcaccccgtcaaaactctgttcaaaattccgcggaacccaccacccaccctgctgcaccctgagaagtggtgcgaggagtttaaccatttcattagtcagtgtctgatcaaagactttgagaggcgcccttccgtaacacacctattagaccatcctttcattaaaggagttcatggaaaggtcctgttcctccagaaacaactcgccaaggtcttgcaggaccagaaacaccagaacccagtcgccaaaaccaggcacgagcggatgcacactagaagaccgtatcacgtagaggatgctgagaagtattgtcttgaggacgacttggtgaacctcgaggttttggacgaggataccataatccatcagctccaaaaacggtacgccgacctccttatctatacgtatgtgggcgacatccttatagccctgaacccctttcaaaatctgtctatctactcaccccaattctcccgactgtaccacggggtcaagcgcgcctcaaacccgccacacattttcgccagtgctgacgctgcctatcagtgcatggtgacgctgtccaaggatcaatgcattgtgatttccggagaatccgggtcgggcaagactgagtccgcccacttaatcgtgcagcacctgacttttctgggaaaagctaacaatcaaaccctcagagaaaagattctgcaagttaactctctggtggaagcattcggtaacagttgtactgccataaacgacaacagttctaggttcggtaagtacttggaaatgatgttcactcccaccggggttgtcatgggggccaggatcagtgaatatctgttggagaaatcgagggtgattaaacaagccgcccgagaaaagaacttccacatcttttactatatctacgccggattgcaccatcagaagaaattgtcggatttcagactgcctgaagagaagcccccgagatacatcgccgacgagacaggccgcgtcatgcacgacatcacatctaaggaaagctaccggcgacagttcgaagcaatccagcattgtttccgaattatcggattcaccgacaaagaggtgcattctgtctatagaatcctggcagggatcctgaatatcggaaacattgaatttgcggccattagtagtcagcaccagacagacaaatcggaggtacccaatgctgaagccctgcagaatgcagcgagtgtcctgtgtattagtcccgaagaactgcaagaagccctcacttcccattgcgtggttactcggggtgagaccattatcagagcaaacaccgtagatagagcagcagatgtgagggacgcgatgagcaaagctctatacggcagacttttctcatggatagtgaataggatcaacactctgctccaaccagacgagaacatttgtagcgcggggggcgggatgaatgtggggatcttagacatattcgggtttgagaattttcagcggaactccttcgaacaactctgcatcaatattgccaacgagcagatccagtactactttaaccagcatgtcttcgctctggaacagatggaataccaaaacgaagggattgatgcagtgcccgtcgaatatgaagacaaccgccctctgctagacatgttcctgcagaagccacttgggctgctggccctacttgacgaagagtcacgtttcccccaggcaaccgaccaaacattggtggacaaatttgaggacaacctgcgctgcaaatatttttggagacccaaaggcgtggagctgtgtttcggtatccagcattatgcaggaaaagtgctgtatgacgcaagcggagtcctggaaaagaatagggatacactgccagccgatgtggtggtggtgttgcggacctccgaaaacaaactgctgcaacaattgtttagcatccccctgaccaagacaggcaatctggcccaaacccgcgccaggatcaccgtggcttccagctcgttgccaccacatttcagtgctgggaaagcgaaagtggacactttggaagtgatacggcacccagaggagacaactaatatgaagagacagacagtggcatcgtactttcggtacagcctgatggacttgctgtccaagatggtagtgggacagcctcatttcgtgcgctgcattaagccgaatgacgatcgggaagcattacagttctcccgagagagagtgttggcccagctaagatccactggtatcttagaaacagtcagcatccgccgacagggatactcccatagaatcctgttcgaggagtttgtgaagcgttattactacctggcctttactgcacaccagacacctctcgcatctaaggaatcgtgtgttgctatcctcgaaaagtctcggttggaccattgggtgctgggaaaaactaaggtttttctcaaatactaccatgtcgaacagttaaatctgctgctgagggaggtaataggcagggtggtcgtgctccaagcgtatacaaagggatggctcggagctaggcgttacaagcgcgtgcgggaaaagcgtgagaaaggggctatcgccattcaatcagcgtggaggggatacgacgctcggcggaaatttaagaagatctccaatcggcggaacgagtcagctgctcataatcaagccggggatacttctaaccagtcttccggacctcactcacccgtcgccgccgggacccggggcagcgccgaagtgcaggattgtagcgagccaggtgaccacaaggtgcttcgaggatcggtccatcgccgctcacacagtcaagctgaatcgaacaatggcagaacgcagaccagttctaattcacccgcagtgaccgaaaagaacggccactctcaagcacaatcctccccaaaaggttgtgatattttcgccggccatgctaacaaacacagtgtgagcggtacagacttactaagcagccgtatctgtcaccctgcccccgaccagcaggggttgtctctttggggggcgcctcaaaagccagggtccgaaaatgggctcgcccaaaaacacagaaccccaagacgacggtgccaacagcccaaaatgctatcttctcccgaggacactatgtactataaccagctaaacggcactctcgagtatcagggcagtaagcggaagccgcgaaagctggggcagattaaggtgcttgacggcgaagatgagtattacaaatccctgtctcccgtagactgtattccagaagagaacaattccgcccaccctagttttttctcctccagctcaaaaggcgattctttcgctcagcactag

SEQ ID NO: 196202 - DNA, 3945 bp, Artificial Sequence
  Description of Artificial Sequence: Synthetic coding sequence
atgaagcacctgtacggcctgttccactacaaccccatgatgctgggcctggagtccctgcctgacccaactgatacttgggagatcatcgagacaataggtaaaggtacatatgggaaagtttacaaagtcacaaataaacgggacggtagcctggcagccgtcaagatcctggatccagtgtcagacatggatgaagagatcgaggcagagtacaatattcttcagttcctgcctaatcacccgaatgtggttaagttttacggtatgttttacaaagccgaccattgcgtcggaggccaactttggcttgtgttggagttgtgtaatggcggatcagtcaccgagctcgtcaagggactgctcaggtgcggccagaggctggacgaagcgatgatttcttatatcctgtacggagcacttctgggactgcaacacctccataacaatcgtataattcatagagacgtgaaggggaacaacatcctgctgactactgagggtggagtgaaactagtggacttcggggtttccgcgcagcttacatcaacacgcctgcggcgaaatacctcggttggcacacctttctggatggcccctgaagtgatcgcctgcgaacaacagtacgattcttcctacgatgcacgatgtgatgtttggtcattaggaattacggccattgagctaggggacggtgatccccctctgttcgatatgcatcccgtaaagacgttgtttaaaatcccccgtaacccaccccccactcttctgcatcccgagaagtggtgcgaggaattcaatcacttcatttcccagtgcctaatcaaggatttcgaaagacggccgtccgttacacacctccttgatcacccatttataaaaggtgtgcatggtaaagtattattcctgcagaagcaacttgccaaggtgttacaggaccaaaaacaccagaatcctgttgccaaaacaagacacgagaggatgcacacaagaaggccctaccacgtcgaagacgccgagaagtattgtctggaggatgatttagtgaatctcgaagttctagacgaagataccataattcaccaattgcaaaaaagatatgcagacttgctgatctatacttacgtcggtgatatcctcatcgcgttaaatccgttccaaaacctctctatttactcccctcaattttcacgcctgtatcatggcgtgaagcgcgctagcaaccccccacacatcttcgcctcagccgacgctgcataccagtgtatggtcacgctctcgaaggaccagtgcattgttattagcggggaaagtgggtccgggaagacggagagtgcccaccttatcgtgcagcacctgaccttcctgggtaaagcaaataatcagaccctgcgagaaaagattctccaggtaaactctctggttgaagccttcggaaatagctgcactgcaattaatgataacagtagcagattcggcaagtacctggagatgatgttcactccgacgggcgtggttatgggggccaggatctctgaatatctgctcgaaaaatctcgagtgatcaagcaagctgcaagagagaagaactttcatattttttattatatctacgcgggcctgcaccatcaaaagaaactgtctgactttcgtctacctgaggaaaagcccccaaggtacatcgcagacgagacgggcagggtgatgcacgatattacttccaaggagtcataccgacggcagtttgaagcaatccagcattgtttcaggattattggatttacagacaaagaggtacactctgtgtaccgtatcctggcagggattcttaatataggtaacattgaatttgcagcgatcagttctcaacaccaaacggataagtctgaggtacctaacgctgaagcactacagaacgccgccagcgtcctctgtattagccctgaagaactgcaagaggctctgacttcccactgtgtggtcacgcgcggagagaccattatccgcgccaacaccgtggaccgagcagctgatgtaagagacgccatgtcaaaggcactgtatggaaggctgttctcatggatcgtaaatagaattaacactttgctgcaaccagatgaaaatatttgttcagccggaggcgggatgaacgtcgggatcctcgacatctttgggttcgaaaatttccagagaaacagttttgagcaattatgcattaatatcgccaatgaacagattcaatattattttaatcagcacgttttcgctttggagcaaatggagtatcagaatgaggggatcgacgccgtgccagtggagtatgaggataatcggccgctactggacatgtttcttcagaaaccattaggcctcctggccctgcttgacgaagagagccggtttccgcaggccaccgaccaaacactggttgacaaatttgaggacaacctgagatgtaaatatttttggaggcccaaaggggtagaattatgctttggtatccagcactacgccggcaaggtgttatatgacgcaagcggtgtgttagagaagaatcgagacactttacccgctgacgtagtagtcgtcttgcgtaccagcgaaaacaagttactccagcaacttttcagtatacctcttacaaagactgggaatctggcccagaccagggccaggatcacagtcgctagctcttccctgcctccacatttcagcgcaggaaaggctaaggttgatacattggaggtcatacgccaccccgaagaaaccacaaacatgaagcggcagacagtggcgagctatttcaggtacagtctcatggatcttctgagcaaaatggtggtcgggcagccgcactttgtccgctgtattaaaccaaatgatgatagggaggcgctgcagttcagtcgggagcgcgtattggcccagttgcggagtaccgggattctcgaaaccgtctctattcgaaggcagggctatagccacaggatcttattcgaggaattcgtgaaaagatattattatctggcatttacggcccaccagactcccctcgccagtaaggagtcttgtgtggccatccttgagaagtcccgattggaccattgggtgctggggaagaccaaagtctttcttaaatattaccacgtcgagcaactgaatctcctgttgagggaagttatagggagggtggtggtgctgcaggcttacacaaaagggtggctaggggcaaggcgatataagcgggtgagggaaaagcgagagaaaggggcaattgcaattcaaagtggcgacacatcaaaccagagctctggtccacattcccctgtggcagctggcactaggggctccgcagaggtccaggactgcagtgagccaggtgaccacaaggtgctcagggggtctgttcacagaagatcccactcacaggctgaaagcaataatggaaggacccagaccagctctaactctcctgccgtgactgaaaagaacgggcacagccaagctcagtctagccccaagggatgcgacattttcgccgggcacgccaataagcacagcgtatccggtacagatctgctgagctctcgaatctgccatccggccccagaccagcaaggtctgagcttatggggcgcccctcaaaagcccggctccgagaacggcctcgcacaaaaacaccggacacctagaaggcgctgtcagcagcccaagatgcttagtagcccagaggatactatgtattacaatcagttgaacggcaccctagagtaccagggaagcaagcgcaaaccaagaaagctcggccagattaaggttctggatggcgaggacgagtactataagagcctcagcccagtggactgtattcctgaggaaaataatagcgctcacccctcctttttctccagttcatctaagggggacagcttcgcccagcattag

SEQ ID NO: 196203 - DNA, 3390 bp, Artificial Sequence
  Description of Artificial Sequence: Synthetic coding sequence
atgaacatcaacgacggcggccggcggcggttcgaggacaacgagcatacactccgcatctacccaggcgctattagtgagggcaccatctattgccctattccagcacggaagaattcgactgctgccgaagtcattgaaagcctgataaataagttgcacctggataagactaagtgttatgtgttagcggaagtgaaagaatttgggggagaagagtggatactgaaccccacagattgccccgtgcagagaatgatgctgtggccccgcatggcactggagaatcggctctcaggcgaggattatcgcttcctattacgcgaaaagaacctggacggaagcatacattacgggagtctgcagagctggctgagggtcactgaagagcggcggaggatgatggaacgagggtttctgccccagcctcaacagaaggattttgatgatttgtgttcacttcctgacttgaatgagaaaacgcttttggaaaacttgagaaatagatttaaacacgaaaagatctacacttacgtgggctccatccttatcgtgatcaacccattcaagtttctgccaatatataatccaaaatacgtgaagatgtacgataaccaccagctggggaaactagaaccacatatctacgctgttgccgatgtggcttaccatgcaatgctgcaacgcaagaagaatcagtgtattgttatctcaggagagtccggaagcggtaaaactcagagcaccaattttcttattcatcaccttaccgccctctcacagaaaggattcgcctccggcgtcgagcagatcatactcggtgctggccccgtgctggaggcctttgggaatgcaaagaccgcccataataataactcttcacgattcgggaaattcattcaggttaattaccaagagacaggcaccgtgctgggggcctatgtggaaaagtatcttctcgagaaatctcggctcgtgtatcaggaacacaacgagaggaattaccacgtgttttactacctactagctggtgccagtgaagatgagcggtcagcatttcatctaaaacaaccagaagagtatcattatctaaatcaagattgctttaccgttgagggagaggacctgcgacacgatttcgagcgcctgcagctggcgatggagatggtggggtttttgcctaagactcgcagacagatttttagcctcctttccgccatcctgcacctggggaacatctgctacaaaaagaagacctaccgtgatgatagcatcgacatatgcaaccctgaggttctcccaattgtgagtgaactgctcgaggtaaaagaggagatgctgttcgaggccttggtaacacggaagaccgttactgtgggagagaagctgatcttgccgtataaattagccgaagcagtaaccgtgcgaaattcgatggcaaagtctctctactctgctctcttcgattggatagtgttccggattaatcatgcactgctcaactccaaagacttggaacataacaccaaaacactgtccattggtgtgctggacatcttcggcttcgaggactacgaaaacaactcatttgaacagttttgtatcaattttgctaacgaacgtttacagcattatttcaatcaacacatcttcaaactggaacaggaggagtatcggacggaaggtattagttggcataacatcgattacattgacaacacctgttgcataaaccttatctccaaaaagcctactgggctgctccatttgctggatgaggagagtaattttccgcaagctactaaccaaacgttactggataagttcaagcatcagcacgaggataatagttatatcgagttcccagcagtgatggagccagcattcattattaagcattacgccggaaaagtgaaatacggcgtgaaggactttcgcgaaaagaataccgaccatatgcgccctgatattgtggctctgttacgatctagcaagaacgcattcatttcaggcatgattgggatcgacccggtggccgtttttagatgggctatcctgagagctttttttcgtgccatggtagcattccgggaggcggggaagcgaaacatccatcgcaaaactggccacgatgatacggctccttgcgctatattgaagtccatggactcattttcatttctacagcatcctgtgcatcagcgctcattagaaattctacaaaggtgcaaagaagaaaagtactccattactcgcaagaatccacgtacccccctgtccgacctacagggaatgaacgccctaaacgagaaaaatcagcatgatactttcgacatcgcttggaatggacgcaccggcattaggcagtcacgcctgagttctgggacttccctgcttgacaaggacgggatttttgccaactccacttcgtccaaacttttggaaagggcacatggcattcttacccgtaataagaactttaaatcaaagcctgcgttacccaaacaccttctggaggtcaactcactgaagcacctaacccgtttgactctccaggaccggattaccaagtcactgctccacttacataaaaaaaagaagcctccgagtattagcgcccagtttcaggcctccttgagtaagctgatggagactctaggacaggctgagccttacttcgtgaagtgtatccggagcaatgccgaaaaattacctctgcgcttctcagatgtcttagttctgcgtcagctacgctacactggcatgctggaaacagtaagaattagacagagcggttattctagcaagtattcattccaggacttcgtttctcattttcatgtattgctaccgcgaaacattattcccagcaaattcaacatacaggatttctttcgaaagatcaacttgaatcctgacaactaccaggtgggaaagactatggtgttccttaaggaacaggagcgacagcacctgcaggatctgctccaccaagaggtacttcggcgcataatactattgcagcggtggttccgtgtgttgttatgtaggcagcactttctccacctccgtcaggccagcgtgattatccagagattttggcgcaactatctgaatcagaagcaagtacgagatgctgcagtacaaaaggatgcctttgttatggcctccgcagcagcccttctccaggcgagctggagagcacacctggagcggcaaagatatctggaattacgcgccgccgccattgtgatacagcagaagtggcgcgattattataggagacggcacatggccgccatctgcatccaggctagatggaaggcgtacagagagtctaaacggtatcaggaacaaaggaagaactaccccttcgccatcaatatgtag

SEQ ID NO: 196204 - DNA, 7647 bp, Artificial Sequence
  Description of Artificial Sequence: Synthetic coding sequence
atgaacatcaacgacggcggccggcggcggttcgaggacaacgagcatactttacgtatttatccaggagctatcagtgaaggcacgatctattgcccaatcccggcccgcaagaatagcaccgccgctgaggttatcgaaagcttaatcaacaaacttcatctggataaaaccaaatgttacgtacttgcagaggtgaaagaatttggcggcgaggaatggattctgaaccctacagattgtcctgtgcaacgtatgatgttatggcccagaatggccctggaaaacagactgagtggcgaagattatagatttcttctccgggaaaaaaacctagatggctctatccactacggcagcctccaatcgtggttgagggtgaccgaggagcgacgtagaatgatggagaggggatttttgccccagcctcagcagaaggactttgacgacctttgttcactgcccgatctgaacgagaaaaccctgttggagaatcttagaaatagatttaagcatgaaaagatctatacttacgtgggatccattctgatcgtgataaaccctttcaagttccttccaatctacaatcctaaatacgtgaaaatgtacgataatcatcagctaggcaagctcgagccccatatctacgccgtcgcagatgtcgcctatcatgcaatgctgcagcgcaagaaaaaccagtgcatagttatttccggcgaaagtggatcagggaagacacagtcaactaacttcttgattcaccatcttacagcactgtcccagaaggggttcgcctctggtgtcgaacaaatcatcctgggtgcagggcctgtcctagaagctttcggcaatgctaaaaccgcccacaataataattcaagccgtttcggaaaatttattcaagtgaattatcaggaaacaggaacggtgttgggcgcatacgtcgaaaaatacttgctggaaaaatcacgattggtttatcaggaacacaatgaaaggaactaccatgtattttactatctcctggccggggcgagcgaggacgagcgctcagccttccatctgaaacagcctgaagagtatcattacctgaaccagataacaaagaagcccctgaggcaatcatgggacgactactgttacgatagtgaacccgattgtttcaccgtggaaggggaggacctgagacatgattttgagagacttcagctcgccatggagatggttgggttcctgcccaaaacgcggaggcagattttctccctgctgagtgccatacttcatctgggtaacatctgttataagaaaaagacgtatagggacgatagcatcgatatatgcaaccctgaagttctgcccattgtgagcgagctattggaggtcaaggaagaaatgctgtttgaagccctggttactcgaaagacagtgaccgtaggggagaaactgatcctgccctacaaactggccgaagccgtgaccgtgaggaacagcatggctaagagcctgtacagtgcgttgttcgattggattgtctttcggatcaaccacgctctcctgaattctaaggacctggagcacaacaccaagacgctcagtatcggagtgcttgacatcttcgggttcgaggactatgaaaacaacagctttgagcagttctgcataaattttgctaatgaacggctccagcattactttaaccaacacattttcaaacttgaacaggaggagtatcggactgagggtatcagctggcacaatatcgactacatcgacaatacttgctgtatcaacttaatcagcaaaaagccaaccgggctattacatctcctggatgaggaatcaaacttcccacaggctacgaaccagactcttctcgataaattcaagcatcagcacgaagacaattcttacatcgagttcccagccgtcatggagcccgctttcatcatcaaacactacgcaggaaaggtgaaatatggtgtaaaagactttcgcgagaagaacaccgaccatatgcgtcccgacatcgtggcccttctgaggtcatctaagaatgccttcatcagcgggatgataggcatagaccctgtagctgttttccgatgggccattcttcgggcttttttccgggctatggtggccttccgtgaagcgggaaagcgtaatatacacaggaagaccggccacgacgataccgccccgtgcgctattcttaaaagtatggatagctttagctttttacaacaccccgttcatcagcgcagtcttgagattctgcaaagatgcaaggaagaaaagtattctataactaggaagaaccctaggactccactctccgacctccagggtatgaacgccctgaatgaaaaaaaccaacatgatacgttcgacattgcctggaatgggcggacagggatcagacagtctcggctgtcttccggtaccagtctcctcgacaaggacggcatttttgctaactcaacatctagcaaactcctcgaaagggcccacggtatactgacacgaaataaaaattttaaaagtaagccagcattaccaaaacacttgcttgaagtgaattccctgaagcatcttacgagactgacactgcaggacaggatcactaaatcgttgttacatctgcataaaaaaaaaaagcctccttccatctcggctcagttccaggcttcactatcaaagctaatggagacgctggggcaggcagagccttacttcgttaagtgcataaggtccaatgctgagaaactaccgttgaggttctccgatgtgctggttctgaggcagcttaggtacaccggaatgttggagaccgtccggatacgccagtcagggtattcatccaagtattcctttcaggacttcgtaagtcatttccacgttctcctcccaaggaacatcatcccgagtaaatttaacattcaggacttcttccgtaaaatcaatttgaatcccgataattaccaggtgggtaaaacaatggtttttttaaaagagcaagaacgacaacatctccaggaccttttgcaccaggaagttctgaggcgtatcatcctgttacagagatggtttcgcgtcctgctatgtcggcagcactttctgcacctgcgacaggcctccgtgatcatccagcgattctggcgaaattacctgaatcagaagcaagtgagagatgcagctgttcagaaagacgccttcgtgatggcttctgccgctgcgcttcttcaagctagttggcgtgcccatctggaaaggcaacggtatctggaactgcgagctgcagcgatcgtcatccagcagaagtggcgcgattattataggagacgacacatggcagcaatctgcatccaggcccgatggaaagcttaccgtgaaagcaagagataccaggagcagcgtaaaaagattattctactacagagtacctgtcggggattccgcgcgagacagcggttcaaggccctcaaggaacagagactgcgcgagaccaaaccagaagtgggcctggtgaacatcaaaggctacggcagcttagagatccaagggtcagatccttctgggtgggaagattgttcctttgataaccggatcaaagcgatcgaagagtgtaagtctgtcatcgagtcaaaccgcatctctagagaaagtagtgtggactgcctcaaggagtcacccaacaaacaacaggagagggctcaaagccagagcggagtcgacctacaggaggatgtgctggtgagagagcgcccgaggagcttagaggacctgcaccagaaaaaggttggccgcgccaaacgtgaaagccgaaggatgcgggagctggagcaggccatcttctcattagaactattaaaggtgagatccctagggggcatcagccccagcgaagataggcgatggtcgacagagctggtccccgaagggctgcagtcacctcggggcactcccgatagtgagagcagccaagggagcctggagttgctgtcttatgaggaaagtcagaaaagtaaactcgaaagcgtcatttctgacgaaggagacctgcagtttccttctcctaaaatctcctcatcaccaaagtttgatagccgcgacaatgctctgtccgcctccaacgagactagctccgcggaacacctgaaggacggaaccatgaaggagatggttgtgtgtagttctgagtccattacttgtaagcctcaactcaaagacagctttatttcaaactcactgcccacatttttttacattccacagcaagatcctcttaagaccaactcccagttagatacttcgatccagagaaacaagctcctggagaatgaagacaccgcgggggaggcactgaccctggacatcaacagggagactagaaggtatcactgcagcggaaaagatcagatagtaccctcgttaaacaccgaatcttctaatcctgtcctgaaaaagttggaaaagcttaacactgaaaaggaggaaagacaaaagcagctgcagcagcagaacgaaaaggaaatgatggaacagattagacaacaaacagacattctggagaaggagaggaaggcttttaagaccatcgagaagcccaggattggcgagtgcctggttgcaccctcatcctaccagtctaagcaaagggtagagagacctagttctctcctgagcctgaacacatccaacaaaggcgaactcaacgtgcttgggagtctgagtctgaaggacgcggctctggctcaaaaagacagttcctcagctcacctcccgccgaaagatcgaccagtgaccgttttcttcgaaaggaaaggctctccctgccagtctagtactgtcaaagagctgtctaaaactgataggatgggcacacagctgaatgttgcatgcaagttgtctaacaatcgaatttccaagcgagagcactttagacctacccagtcttactcccataacagcgatgacttgtctcgggaagggaatgcccgccctattttctttacacctaaggacaacatgtctataccactggtgagcaaggaagccttgaactctaaaaacccccagctgcacaaggaggacgaacccgcctggaaaccagtgaaactagcgggcccagggcagagagagacgagccagcgctttagtagtgtggacgagcaggcgaaactccataaaacaatgtctcagggtgaaattaccaagctggccgtgcgccagaaagccagtgactcagacatcaggccccagcgtgcaaaaatgcgattttgggctaagggcaaacagggagaaaagaaaacaacccgggtcaagcctaccacgcagtcagaggtatctccactgttcgccgggacggacgtgatacccgcccaccaatttcccgatgaattagcggcatatcacccaacacctcccttgtccccggaacttccaggaagctgcagaaaggagtttaaggagaataaagagccctctcctaaggccaagcgcaagcgatcagtcaagatctctaatgtcgctctagattccatgcattggcagaacgactccgtgcagattattgctagcgtatctgatctgaaaagcatggacgaattcttgctgaagaaagtgaacgacttggataacgaagacagcaaaaaagatacattagttgacgtagtctttaagaaagcgctcaaggaatttcgacaaaacatattcagcttttatagttcagctttggctatggacgacggtaaaagcataagatacaaggacctctacgctctgttcgaacagatcctggagaagaccatgagactggagcagagggattccctaggcgaatccccagtgagagtgtgggtgaatacttttaaagtgttcttagatgaatacatgaacgaatttaagacatccgactgcaccgcaacaaaggtacccaaaactgaaaggaaaaaaaggagaaagaaggagaccgatctagttgaagaacataacggccacatcttcaaggctacccagtactccatcccaacatactgcgagtattgttccagcttgatttggattatggatcgtgccagtgtctgtaaactgtgtaaatacgcctgtcacaagaagtgttgcctcaagacgactgcgaagtgttctaaaaaatacgaccccgaattgtcctcacggcagtttggcgttgagctcagtcggctgacctctgaggacagaactgttcctctcgtggtggagaaacttattaattacatcgagatgcatggactgtatacagagggcatttaccgcaaatctggcagtaccaataagatcaaagagctgcgtcaggggctagacaccgatgctgagagcgtgaatctggacgactataacatccatgtgattgcgagcgtcttcaagcagtggctgcgtgatctcccaaaccctcttatgaccttcgagttgtacgaagaattcttacgagccatggggctgcaagagcgcaaggagaccattagaggagtgtatagtgtcatcgatcagctgtcaaggacccatctgaacactttagaacgacttatttttcatctggtccgcatcgctctacaagaggataccaatagaatgtcagccaacgccctggccattgtattcgctccctgcatcctgaggtgtcccgacacaaccgaccctcttcagtcagttcaggacatctcaaagactacaacctgtgtcgaactaatagtggtggaacaaatgaacaaatacaaggcgcgcctcaaagatatcagttcattggagtttgccgaaaacaaagccaagactcggttgtcactgattcgtagaagtatggggaaaggcaggattagaagaggaaactatccaggtccctctagccccgtggtagttagattacccagcgtgagcgatgtatccgaggaaacactcacttcggaagccgccatggagaccgacatcacagaacagcagcaagccgctatgcagcaggaagagagagtcctaactgaacagatcgagaatctccaaaaagaaaaggaggagctgacctttgagatgctagtactcgagccacgtgcttccgacgacgagaccctggaaagcgaggcatccatcggaacggccgattccagcgagaacctcaacatggagagcgagtatgctatctctgaaaagtctgaaaggagcctggctctctcatctctgaagacagccggcaagagcgagccaagcagcaaactgcgcaagcagctgaagaaacaacaggacagcctggatgtggttgactcctcagttagtagtctttgcctgagcaataccgccagcagtcacggcacacgcaaactgtttcagatatactctaagagccctttttatagggcggcctccggaaacgaggccttgggcatggaggggccactcggccagaccaaattcctagaagataagccccagtttatctctcgtgggacttttaacccagagaaaggaaaacagaagctgaaaaacgttaagaactccccccaaaagactaaagaaaccccagagggcactgtgatgtctggtcgacgcaaaacggtggatccggactgtactagcaatcagcagcttgcgctgttcggcaacaacgaattcatggtgtag

SEQ ID NO: 196205 - DNA, 7860 bp, Artificial Sequence
  Description of Artificial Sequence: Synthetic coding sequence
atgaacatcaacgacggcggccggcggcggttcgaggacaacgagcacactctcagaatctatccaggagctattagcgagggtacgatttattgcccaattcctgcaaggaagaattccactgctgccgaagtcatcgaatccctgattaacaaactgcatctggacaagacgaaatgctatgtcctcgccgaagtgaaggagtttggcggggaagagtggattctgaaccctaccgattgtccagtacagaggatgatgctgtggccccggatggcacttgagaacagattgtcaggggaggattaccggtttttactgagagagaagaacctagacggcagtattcattacggatcgcttcaatcatggctgcgcgtgacagaagagcgaagaagaatgatggaaagaggttttctgcctcagccgcagcaaaaggattttgacgacttgtgctcactgccggatttaaacgagaagaccctccttgaaaatctgcgaaaccgctttaagcatgagaagatctacacctatgtgggtagcatactgatcgtcataaaccctttcaagtttctacctatctataatcccaagtatgtaaagatgtatgataatcaccagttaggcaagctggagccgcacatctatgccgtggccgatgtggcctaccacgctatgctgcagcggaagaaaaatcagtgtatcgtgatttcaggggagagcgggagtggcaagacccagagtacgaacttcctcatccatcatttgaccgcgcttagtcaaaagggcttcgctagcggcgtggaacagattatcctgggtgcgggtcccgttctagaagcctttggcaatgctaagaccgcccataataacaacagtagccgtttcgggaagttcattcaggtgaattaccaagagaccggtacagtgctcggagcctatgttgagaaatatcttcttgaaaaaagccgcctcgtctatcaggagcataacgagagaaattatcacgtgttttattatctcttagcaggtgcttcagaggacgaacgcagcgcttttcacctcaaacagcctgaggaataccactatctgaaccaaattaccaagaaacctttgcgtcaatcctgggacgattattgttacgacagcgaacctgactgttttaccgtagagggcgaggatctcaggcacgatttcgagcggctacaacttgctatggagatggtcggctttctgccaaagacccgacgccagatcttttctctgcttagtgccattctccatcttggaaacatttgctacaagaaaaaaacgtaccgcgacgatagtattgacatctgtaaccctgaagtcctgcccatagtaagcgaactgctggaggtgaaagaagaaatgctgtttgaggccctggtcactagaaagacagtgaccgtgggagagaagttgatcctaccctataagctcgctgaggcagttaccgtaagaaatagcatggccaagtcactctactccgctctgtttgactggatcgtgttccgaattaaccacgcactgttgaacagtaaggatctggaacataacacgaaaacccttagcattggcgtgttggatatctttgggttcgaagattacgaaaataactccttcgagcaattttgcatcaatttcgcaaacgaaaggcttcagcactacttcaatcagcatatcttcaaattagagcaggaagagtaccggactgaagggatttcctggcacaacatcgattatattgacaacacctgttgcatcaatttaatcagtaagaagcccactgggctattgcatttgttagacgaggagtctaacttcccgcaggccacaaaccagaccctgctcgataaattcaagcaccagcacgaggacaactcctacatcgaatttccagccgtcatggaacctgcgttcataattaagcactacgctggcaaggttaaatacggcgttaaggatttccgggagaagaatacagatcacatgcgcccagacatagtagccctgctgcgatcctccaaaaacgcatttattagtgggatgatcggcatcgatccagtggctgtttttcggtgggctattttgcgggctttttttagagcgatggtggctttcagagaagcagggaaaagaaacattcaccgcaaaacggggcatgatgacacagccccatgcgccattctgaagagcatggactcgttttcgttcctgcagcatccagtccaccagcgctctctggagattctgcagcgatgcaaagaagagaagtactctattacccgcaagaacccaagaactccactctccgacttacaaggtatgaatgcactcaacgaaaaaaaccaacatgacacttttgacatagcatggaatggcaggacggggattaggcagtccaggttaagctcagggacttcccttcttgataaggacggtatttttgcaaacagcactagctccaaacttttggagagggcccacggcatcctaaccagaaacaaaaactttaaatcaaagcccgccttgcctaagcacctgctggaagtgaattcgcttaagcatttgaccaggcttaccctccaagataggatcaccaagagtttactgcacctgcacaaaaaaaagaagcccccctctatttcagcccaattccaggcgtctctatcaaagctcatggaaaccctcgggcaagccgaaccttatttcgtaaagtgtatacggtcaaacgcggagaagctgcccctgcggtttagtgacgtgctcgtgttaagacagctacgatacactgggatgctggaaaccgttcggatccgtcaatccggctattctagcaagtattcatttcaggacttcgtcagccatttccatgttctacttccacgtaacattatcccttcaaagtttaatatccaggactttttccggaaaataaaccttaatccagacaactaccaggtgggaaagaccatggtttttctgaaggaacaggagagacagcacctccaggatttgctacaccaggaggtgcttagaagaatcatactactgcaacgctggttcagagtgctactgtgccggcagcattttctacatctgagacaggcctcagtcatcatccagcggttttggcggaactacctgaatcagaagcaggtgcgagatgcagcagtgcaaaaggatgccttcgtaatggcatctgcagctgcactgctgcaggcgagctggcgcgcgcatctggaacgccagcgctacctggaactccgcgctgctgccatagtgatccagcaaaagtggagagattactaccggagaagacacatggctgcgatctgtattcaggcccgatggaaagcctatagggaatccaaacggtaccaagagcagagaaaaaagataatcctactgcagagtacctgcagaggtttccgggccagacagcgcttcaaagcactcaaggagcagcgattgcgtgagacgaagcccgaagtcgggctagtcaatatcaagggctatggtagtctggagatccagggctccgatccttccgggtgggaagattgcagctttgacaacaggattaaagcaattgaagagtgcaaatccgtcatcgagtccaaccggatctctcgggaatcttctgtggactgcttaaaagagtcaccgaacaagcagcaggagagggcccagagtcagtcaggcgtggatttacaggaggatgtgctcgttagagaacggcctagatccctcgaggacctgcaccagaagaaggtgggtagggctaagcgtgaatcccgcaggatgcgagagcttgaacaagccattttctctctcgagttactaaaagtgaggtccttgggcgggatttccccaagcgaagatcggcggtggagtaccgagctagtccctgaaggtctgcagtccccaagaggaacgcctgatagtgaatcttcccagggtagccttgagctgctgagttacgaggaatctcaaaaatcaaagttagaaagcgtgatctccgacgaaggcgacttgcagttccctagtcccaagatatcttcaagccctaagtttgactccagagacaacgctctgagcgcaagcaacgagacctcaagcgcagagcacctcaaggatggcactatgaaggaaatggtcgtatgctcgagcgagagcatcacttgcaagccccagctgaaagatagctttatatcaaactcccttcctacattcttttacataccgcaacaggaccctctcaaaacaaactcccagttggatacttctatacagcggaataaactgttggaaaacgaggataccgctggagaggccctcacacttgacatcaacagagaaaccagacgctaccactgttccgggaaggatcagattgtgccaagcctcaatactgaatcctccaatcctgtgctaaagaaactggaaaaactgaacaccgagaaagaagagcgccagaagcagctgcagcagcaaaatgaaaaagagatgatggaacagataagacagcaaactgacatactggagaaagaacgtaaagcatttaaaaccattgagaagccaaggatcggcgagtgtcttgtcgccccgtcttcctaccagagtaaacaacgtgtcgagaggccatcatccctgctgtcactgaatacttcaaacaaaggagaactcaacgtcctggggtccctgagtcttaaagatgcggcactcgcacagaaggactcctcgagcgcgcacctgcctcccaaagaccggcccgtgactgtcttttttgagagaaaaggaagcccatgtcaatcttcaaccgtgaaggagctgtccaagaccgaccgcatgggaactcaactaaacgttgcctgcaaactcagcaataaccggattagcaaaagagagcatttccggcccacccagtcctacagccataactccgacgatctctccagagaaggtaacgcccggccaatcttctttacacctaaagataatatgagcattcccctggtatccaaagaggcgttgaatagtaaaaatccccaactacataaagaagatgagccagcgtggaagccagtgaaactggccggccccggccagagggaagtggctcgtcccgctcacaaaaagaaggctaggatggctaggacccgaagcgactttctcacccgaggcacctttgcagacggagaaggcgacacagaagaagatgactatgacgatatcatcgaaccgctcttgagcctggatcaggcttctcactgtgaactgggacccgccccatccctgggccaggcctctcactctgatagtgaaatgacaagccaaaggttcagcagcgtggatgaacaagccaagctgcacaagacgatgagccaaggtgaaattaccaagctggcagtccgacagaaggcttcagattcagatatcaggccacagagggccaaaatgcggttctgggctaagggcaagcagggcgagaagaagactacccgcgtgaagcctactactcagtccgaagtttctcccctattcgccggaacggacgtcattcccgctcaccagttccctgacgagcttgctgcctaccatcccaccccccctctgtcccctgagctaccaggatcctgccgtaaggagtttaaggagaataaggagccttccccgaaggcaaagcggaagcgttccgttaagatttccaacgtcgcccttgattcaatgcactggcagaacgacagtgtgcaaatcatcgcctctgtaagcgatttgaagtctatggatgagttcctccttaagaaggttaacgatctggataatgaggactcaaaaaaagacacattagtagacgtcgtgttcaagaaggcattaaaggaattcagacagaacatcttctccttctacagttccgcactggctatggacgatggcaaaagcatacgctacaaggatctctatgccttatttgagcaaatattagagaagaccatgaggctggagcagagagattcactgggcgaatcacccgtgcgtgtgtgggtgaatactttcaaggtgttcctggatgagtatatgaacgagttcaagacatcagattgtaccgccacaaaggtgccaaaaaccgagcgtaaaaaacgtcggaaaaaagaaactgaccttgtcgaggagcataatggccatatatttaaagcaactcagtactctatacctacgtactgcgagtactgtagcagtctcatatggatcatggatcgagccagcgtgtgtaaactctgtaagtacgcctgtcacaagaagtgctgcctgaaaaccactgctaaatgttcaaaaaagtatgaccctgagctgagttcgcgacagtttggggtggaattgtctcggctgacctctgaggatcgtaccgtccctctcgtggtcgaaaagttgataaactacattgagatgcacggcctgtataccgaggggatatatcgaaagtctggatccacaaataagataaaggagctgcgtcagggtctggacacagacgcggagtcagtgaacctcgatgactacaacatacacgtgatcgcgagtgtattcaagcagtggctgcgggacctgcctaatcctctcatgaccttcgagctctatgaagagttcctccgagccatgggtctacaggaacgtaaagaaacaataaggggggtgtacagcgtgatcgaccagctcagtagaacccatctgaacactctcgagagactcatatttcacctcgtccgcatagcactgcaggaggatacgaataggatgagtgctaatgcactagcgattgtattcgcaccctgtatactgcgttgtccagataccaccgaccctttacagtcggtgcaggatatatcaaagaccaccacatgtgttgagctaatcgtagttgagcagatgaataagtacaaagcaaggctaaaagatatatctagcttggagtttgcagagaacaaagcaaagacacggctgagcctcatccgtcggtcaatgggcaaggggcgtatccggaggggtaactatccaggtccctcttccccagtggtcgtgaggctgccctccgttagtgatgtgagtgaggagactctcaccagcgaggcagccatggaaacagacataactgaacagcagcaagccgccatgcagcaggaagaacgggtcctgaccgagcagattgaaaacctccaaaaggagaaggaggaactgactttcgagatgctggttttggagcctcgagcctccgatgacgaaaccttggagagcgaggcaagcatcggaacagctgatagcagcgagaatctcaacatggagtctgagtatgccattagcgagaagtctgagcggtccctcgccctgtcctccttgaagactgctggaaagagcgagcctagcagtaagcttcgaaaacagctgaagaagcagcaggactcactggatgtggtggatagctccgtctcgagtttgtgcctcagcaataccgccagcagtcacggaaccagaaagctgttccaaatttacagcaagtctcccttctatagggcagcatctggcaacgaggccctgggcatggaggggcccctgggacagaccaaattcttagaggataaaccgcagtttattagccggggcacattcaaccctgaaaaggggaaacagaaactcaagaatgtcaagaacagcccacagaagacaaaggaaacaccggagggaaccgtaatgtcaggtaggcgcaaaaccgtggaccccgattgcaccagtaaccagcagctggctttgtttggcaataatgaattcatggtgtag

SEQ ID NO: 196206 - DNA, 7590 bp, Artificial Sequence
  Description of Artificial Sequence: Synthetic coding sequence
atgaacatcaacgacggcggccggcggcggttcgaggacaacgagcatactctccggatatacccaggagccatttctgaggggaccatttattgtcccattccggcccgtaaaaattccacagcggcagaagttatcgaaagtcttatcaataaattgcatctcgataagacaaagtgctatgttctggccgaagtgaaggagtttggaggagaagagtggattttaaatccaacagattgtcccgtgcagcgaatgatgctgtggcctcggatggccctcgaaaaccgcctttccggagaggactaccggtttcttctgcgcgagaagaacttggatgggagcatccattatggaagcctccagagctggttacgagtgacagaagaacgcaggaggatgatggagcggggtttccttcctcaaccccaacagaaagactttgacgacctgtgctcactgcccgacttgaacgaaaagacactgttagaaaacttgcggaacaggttcaaacatgagaagatttacacatacgtggggtctatactcatcgtgattaatccgttcaagttcctgcctatttataaccctaagtacgttaaaatgtatgataatcatcagctgggcaagctggagccgcatatctatgcagtcgccgacgtggcttatcacgcgatgctgcaacgaaaaaaaaaccagtgcatcgtgatcagtggtgagtctggctcgggaaagacccaatccacaaatttcctaattcaccatctgactgcattgtcacagaagggctttgccagtggcgtagagcagatcatcctcggtgctggaccagtccttgaggcttttggtaatgccaaaacagctcacaacaacaatagctcccggttcggtaagttcatccaggtgaactatcaggagaccgggacagtgctcggcgcatacgtggagaagtatctgctcgaaaagagtcgcctcgtgtaccaggagcataatgaacgcaactatcatgtgttttactatcttctggcgggtgcctctgaagatgagaggagcgccttccatctcaagcagccggaagagtatcactacctaaaccaggattgcttcactgtggagggagaggacctgcggcacgattttgagagattgcagttggcaatggagatggtgggattcctgcctaagacacggcgtcaaattttctctctgctttcagccatcctgcacctgggcaacatctgctacaaaaaaaagacgtaccgtgacgattccatagacatctgtaatcccgaagtgctccctatcgtgtctgaactgctggaagtaaaggaagagatgttgttcgaggcattagtgaccagaaaaactgtgacagtgggcgaaaagcttatactcccctacaaactggcagaggctgtgaccgtcaggaacagcatggccaagtccctgtactcagccctgttcgactggattgtcttcagaataaaccacgctctgctaaactccaaggacttagagcataatacaaaaaccctgagtattggagtcctagatattttcggattcgaagactatgaaaacaacagttttgaacagttctgcattaattttgctaatgaacgtctgcagcattacttcaatcaacacattttcaaactggaacaagaagagtaccggacagagggaatcagctggcacaacatcgactatatagataatacatgctgtattaacctaatcagcaagaagccgactggactgcttcatctcctggacgaagagtctaatttcccccaagctacaaatcagactctgctggataaattcaagcatcagcacgaagacaactcttacatcgaatttcccgccgtgatggagcccgctttcattatcaagcactatgcaggcaaggtcaaatacggggtgaaagacttccgggagaaaaacacggatcacatgaggccggacatcgtagctctcttaagatctagtaaaaacgctttcattagtgggatgataggcatcgatccggtggctgtttttcgttgggccattctccgtgccttcttcagagccatggtagcttttagagaggctggaaagcgcaacatccataggaaaaccgggcatgacgacacagccccatgtgctatcctcaaatccatggattccttttcctttctgcaacatcccgtgcaccagagatccctcgaaattctgcagcggtgcaaggaggaaaaatacagcatcacaagaaaaaatcccaggactcctctatctgatctgcaggggatgaacgccctcaatgagaagaatcaacacgacactttcgatatcgcgtggaacggccgcacaggaattcgccagagtaggctgtcatccggcacttctctgttagacaaagatggcatttttgctaattcaacttctagcaagctgctcgagcgcgctcatggcatacttacccgcaataagaactttaagtctaaaccggccctgccaaagcatcttctagaggtcaactccttaaagcatctcacaagattgaccctgcaggaccggatcaccaagtcactccttcacctccacaagaagaaaaaaccgccgtccatcagtgcccagttccaggccagtctatcaaaactgatggagaccctgggccaggcagaaccttatttcgttaaatgcatccgcagcaacgccgagaagctccctctgaggttctcagatgttctcgtgctacggcagttgcggtatactggcatgttggagacggtccgtattcggcagtcaggctactcgagcaagtactcctttcaggacttcgtgtcccattttcatgtgttgctacctcggaacatcataccatctaagtttaatattcaggacttctttcggaagatcaatctgaaccccgacaactaccaagttgggaaaacaatggtatttctcaaagaacaagagcggcagcacttacaggacctacttcatcaagaagtgttaaggcggattatcctcctgcagaggtggttcagagtgctcctgtgtaggcagcattttctgcaccttcgacaggcctccgtcatcatccaaaggttctggaggaactacctaaaccagaagcaggtgcgagatgcagcggtgcaaaaggacgccttcgtgatggcgtcggcagcagcgcttctccaggctagctggcgtgctcacctggaacgacaacgctatctcgaattgcgggccgcagccattgttatccaacaaaaatggagggactactatcggcgccgacacatggccgcgatctgcatccaggcacgatggaaggcttaccgagagagcaagagatatcaagaacagaggaagaaaattattctgctccagtcaacatgtaggggatttagagccagacagagattcaaagctctgaaggagcaacgcctacgggagaccaagcccgaagtgggcctcgttaacatcaagggctatggctctttggaaatacaggggtcagatccctctgggtgggaagactgctctttcgacaacaggattaaagctatcgaggaatgcaagtctgttattgaatccaatagaatctcccgggagagcagcgtggactgcctgaaggaatcacctaacaagcagcaggaacgggcccagtcacaaagtggggtcgacttgcaggaagacgtcttggtccgcgaacgtccacgttcactggaggaccttcaccagaaaaaggtcggcagagctaaacgggaatccaggagaatgcgcgagttagaacaggccattttcagcctagagctcttgaaggtgaggtccctgggcggtatttcaccctctgaggataggcggtggtccactgaactggttccagagggcctgcagtcccctcggggcactcccgactctgaaagctcccagggatcactggagcttctctcttatgaagagtctcagaagtcaaagctagaaagcgtgatttctgacgaaggagatctacaatttcctagtcccaagatttcatcatcccctaagttcgacagccgcgataacgccctaagtgcttctaacgaaacatcctcagctgagcacctcaaagacggcactatgaaagagatggtcgtctgcagttcagagtccatcacttgtaaaccccagctgaaagactcctttatttctaacagcctcccaacctttttctatatacctcaacaagacccactgaaaacaaactcccaacttgacacgtcaatacaaaggaacaaacttcttgaaaatgaagacaccgcaggtgaagcactcacactggatatcaaccgggagactaggcggtatcattgttcaggaaaagaccaaatcgtgccctcactgaacactgaaagttccaaccccgttctaaaaaaattggagaaattgaatacagagaaagaggagcgacagaaacagttgcaacaacagaacgagaaggagatgatggagcagattcggcagcagaccgacatcctggagaaggaaagaaaagcgtttaagaccatcgagaaaccaagaataggtgagtgtctcgtagcgccatcatcctatcagtcaaaacagagggtcgagcggcctagctctttactctctttaaatactagtaataagggggaactcaatgtgctgggaagcctcagcttgaaggacgcagcgctggcccagaaagactccagcagtgctcacttacctcccaaggacagaccagtgaccgtgttttttgagcgcaagggtagcccctgccagtcttccaccgtcaaggaactttctaaaacggaccggatggggacacagctaaacgtagcgtgtaaactgagcaacaataggattagtaaacgcgagcattttcggccaacccaaagttattcccacaatagcgacgaccttagtcgggaagggaacgctcggccgatctttttcacacctaaagataatatgagcataccactggtaagtaaagaagccttgaacagtaaaaatccccagttacataaggaggatgaacctgcctggaaacctgtaaaactggccggccccggccaacgagagacttcccagcgattcagctccgtagacgaacaggcaaaattgcacaagactatgtctcagggggaaataacaaagttagcagttcgtcaaaaggcctcagacagcgatattagaccacaaagagcaaagatgcgattctgggctaaggggaagcaaggcgagaagaagaccactagggtgaagcccactacccagtccgaggtctctcccttgttcgccggaacagacgtgatcccggcacatcagttcccagacgagctggcagcgtaccatccaaccccgcccctttcacccgagctcccaggttcatgcagaaaagaattcaaggagaacaaagagccctcacccaaagccaaacggaaacgctcagtcaaaatctcgaacgtcgccctggactctatgcactggcagaatgatagcgtccagatcattgcttctgtgagtgacttgaagagcatggacgagtttcttctcaaaaaagtcaacgacttggacaatgaggactccaagaaagacactttagtcgatgtggttttcaaaaaagccctgaaagagttccgccagaacatcttcagtttctattcttcagcattggccatggatgacggaaaaagtatcaggtacaaagacctctatgccctgtttgaacagatactcgaaaagacgatgagattagaacagcgagattcgttaggggagagtccagtgagagtctgggtgaatacctttaaggtgtttctagacgagtacatgaatgaattcaagacctccgattgtacagctaccaaggtcccaaagactgaaagaaagaaacgccgtaaaaaagagacagatctggtagaggagcacaatggtcatatctttaaagcaacacagtacagcatccctacttattgtgagtactgctccagtttgatttggattatggacagggcgagcgtatgtaaactttgtaaatacgcatgccataagaagtgctgtctcaaaacaaccgccaagtgtagcaaaaagtacgatcctgaactgtcttcaaggcagtttggcgtggagctgagtagactgacttctgaggatcgcacggtgcccctggtggtagaaaagctgatcaactatatcgagatgcatgggctgtatactgaaggcatataccggaagtctggtagcaccaacaagatcaaagaactccgccagggcctggatacagatgcagagtctgtcaacctcgatgattataatattcatgtgatcgcgagcgtgtttaagcagtggctgagagaccttcccaaccccctaatgactttcgaactgtacgaagaattcttaagagctatggggctccaggagagaaaagagacaatccggggggtctacagtgtgatcgatcagttatcgagaacgcatttgaacacgttggaaaggcttatctttcacctagtacgcatcgctcttcaagaggacacaaaccggatgtctgcgaatgccctggccatcgtgtttgcaccctgtatccttcgctgtcctgatacaactgatcctctccaaagcgtgcaggatattagcaagacgactacttgcgtcgagctgatcgtggtcgaacaaatgaacaaatacaaggcccgtttaaaggacatttcttccctggaattcgccgagaataaggcaaaaactagattatcactcattcgccggagcatggggaaaggccggattcgccgggggaattaccccgggccctcatccccagtggtcgtgagactgccttcagtttcggacgtgagtgaagaaacacttacctctgaagctgcaatggagaccgatatcacagaacagcagcaggctgctatgcagcaggaggaaagggtccttaccgagcagattgaaaacctccagaaggagaaagaggagttaacgtttgagatgttggtgctcgaacccagagccagcgatgacgagaccttggagagcgaggccagcatcggcaccgcggacagtagtgaaaacttgaatatggagtcagaatatgccatcagcgaaaaatcggaacggtctctcgcactgagcagtctcaagacggctgggaagtccgaaccatccagcaagttgcgtaaacagctcaaaaagcagcaggactccctagatgtggttgattcatccgtttcaagcctatgcctgtcaaatacagcgagttcccacggtacccggaaactgttccagatctactccaagtcacctttctatcgtgcagcgtcaggaaacgaggcactgggtatggaaggccccttgggtcagacaaagttcctggaagacaagccacagtttatcagtcgtggaacgttcaatccagagaagggaaaacagaaattaaagaacgtcaagaactcacctcagaaaaccaaagaaaccccagaaggcacagtgatgtcaggccggaggaaaacggtcgatccagactgtaccagcaaccagcaactggctttgtttggtaacaatgaatttatggtctag

SEQ ID NO: 196207 - DNA, 2190 bp, Artificial Sequence
  Description of Artificial Sequence: Synthetic coding sequence
atgaacatcaacgacggcggccggcggcggttcgaggacaacgagcataccctccgtatttatcccggcgccatctcagagggaaccatctactgccccataccagcccgaaagaactccactgcagccgaagtaatcgaatccctcatcaacaagctgcacctggataaaacgaagtgctacgtactagccgaggttaaggagtttggcggagaagaatggatcctcaaccctactgactgcccagtgcagcggatgatgctttggcctcggatggcactggaaaatcgcctgagcggtgaagactaccggttcttgctgagagagaagaatcttgatggatctatccactatggttcgctacagagctggctgcgtgtgacggaggagaggaggaggatgatggagagggggttcttgccacagcctcagcaaaaagactttgatgatctgtgctctctgcccgatttgaacgaaaaaacactgttagagaacctcagaaatcgcttcaaacatgagaaaatttacacatacgtgggctcgattctgattgtgattaatcccttcaaatttttacccatctataaccccaaatatgttaagatgtatgacaatcaccagctcggcaaattggaacctcatatctacgcggtggccgatgtggcttaccatgccatgctgcaacgcaagaaaaaccaatgtatcgtaatctctggggaatccggttccgggaagacccagagcactaatttcctcatccatcatcttaccgcgctgtcccagaaagggttcgcctccggggtagaacagattatcttgggagccggaccagtgttggaggccttcggcaacgctaaaacagcccataataacaattctagtcggttcgggaaatttatccaggtaaactaccaggagacagggaccgtgctgggagcttatgtggagaaatatctgctggagaagagcagacttgtttatcaggagcataatgaacgaaactaccatgtgttctactacctcctggccggtgcaagtgaggacgagaggtctgccttccacctgaaacagcccgaggaatatcactacctcaaccagattacgaaaaaacctttgcgccaatcttgggacgactattgctatgattctgaacctgattgttttacagttgaaggggaggatctccggcacgacttcgagaggctgcagttggccatggaaatggttggatttttgccaaagaccaggcgccagattttttccttgctcagtgctatattgcacctggggaacatctgctataagaagaagacttatcgggatgattccatcgatatctgcaatcccgaagtgttgccaatagtgtccgaattgctggaagtgaaggaggagatgctgttcgaagccctggtcaccagaaaaactgtcaccgtgggggaaaagctgatcctgccgtataaactcgcagaagccgtcacagttcgtaacagcatggccaagtccctgtattctgcactgtttgactggatcgtgtttcggatcaaccacgccctcctgaacagtaaagatctcgaacacaacactaagactctgtctatcggcgtgctggacatattcggttttgaggactatgagaacaatagtttcgaacagttctgcattaactttgctaacgagagattacagcattatttcaaccaacacattttcaagctcgagcaggaagagtaccggactgagggaatttcttggcataatattgattatattgacaatacctgttgcattaatctgatctctaagaaacctacgggcctccttcatctgctcgacgaagagagcaattttccccaggccactaaccagacactgctggataagtttaagcatcagcacgaagataatagttacatcgagtttcccgcagtgatggaacccgccttcatcataaagcactatgcagggaaggtgaagtatggcgttaaggattttcgagaaaaaaacaccgaccacatgagaccggatatcgttgcgctcttgagatcttcaaaaaatgcgttcattagcggaatgattggaatagaccctgtggccgtcttccgctgggctattttacgcgctttctttagggctatggttgctttcagggaggctggcaaacgcaatatccataggaagacaggtaagtag

SEQ ID NO: 196208 - DNA, 1509 bp, Artificial Sequence
  Description of Artificial Sequence: Synthetic coding sequence
atggacaaggccctgctgtgcagcgtgtgcaagatgacctgccacaaaaaatgtgtgcacaaaattcaatcacactgttcatacacctacggcagaaaaggcgaaccaggcgtggagcccggacactttggtgtgtgcgtggactccctcactagcgacaaggcatcagtacctatcgtgcttgagaaactgctcgagcatgtagaaatgcatggcctgtatacagaagggctgtacagaaagagcggcgccgcaaataggactagagagttgagacaggccctacagactgatccagctgccgtaaaactggaaaattttcctatacatgcaattacaggtgtgctgaaacaatggctgcgcgagctcccagagcctctgatgacatttgcccagtacggcgatttcctgcgcgccgtagagctgcccgagaagcaggagcagctggccgccatttatgctgtcctagagcaccttcccgaggctaatcacaatagcctcgaacgtctgatattccatctactagctgtagctctgctggaggacgtgaatagaatgtctcctggggcccttgctattatcttcgctccctgcctactaagatgcccggacaactccgacccgttgacttcgatgaaggatgtactcaagattacaacgtgtgtggagatgttgataaaagagcagatgcgaaagtataaggtgaaaatggaagaaataagtcagctcgaggctgctgagtccattgcttttcggcggttgagcctattgcgacagaacgccccatggcctctcaagctggggttttcaagtccttatgaaggcgtcctcaataagagtcccaagacccgcgacatccaagaggaggaacttgaggtcttgttggaagaggaagctgccggcggggacgaagacagagaaaaggagattctgattgagcggatccagtcaatcaaggaagaaaagcaagacatcacctataggctgccggaactggatcctagaggcagcgatgaagagaacctcgactccgaaacctcggcctccactgaaagtctgctcgaagaaagagcgggacgcggcgcttccgagggaccccctgcaccggccctgccttgcccaggagcaccgacacctagccccctgcctactgtcgcggctccccctcgtcgccgaccaagttccttcgtgaccgtccgtgtgaagacacctcggcgcactcccattatgcccacggcgaacatcaaactccctccaggtctccccagccacctacctcgctgggccccaggcgcccgagaggctgctgcaccggtgagaaggagagagcccccagcaaggcgcccagatcaaatccatagcgtttacataaccccgggagctgaccttccggtgcaaggagccttagagccactggaggaagacggacaaccacccggggcaaagcgcagatactccgatccccctacctactgtcttcccccagcatcagggcagaccaacggttag

SEQ ID NO: 196209 - DNA, 6069 bp, Artificial Sequence
  Description of Artificial Sequence: Synthetic coding sequence
atgagcgtgaaggaggccggcagcagcggccggcgggagcaggccgcttatcatctgcatatttacccgcagctgtccactactgaaagccaggcaagctgccgggttacggccacgaaggactccactacctccgatgttataaaagacgccatcgccagtctccgactggacgggactaagtgctacgtgttggttgaagtaaaggagtctggcggtgaagagtgggtgctggacgcaaacgattcccccgtgcacagggtgcttctttggccgcgaagagcacaagatgagcatcctcaggaagatggatattacttcctcctacaggagagaaacgccgacggaacgattaagtatgtgcatatgcaattggtcgcccaagctacagccacacgccgcctcgtcgagcgcggactgctcccgagacaacaggcagacttcgacgacctctgcaacctcccagagctgacggagggaaacctcttaaagaatttgaagcatagatttcttcagcagaaaatctacacatacgcaggcagtatcctggttgctataaatccctttaagtttctgccaatctataaccctaaatacgtaaaaatgtacgaaaatcagcagctggggaagctcgaaccccacgtctttgctcttgcagatgtcgcctattacacaatgctgaggaaacgtgtcaaccagtgtatcgtgatcagcggagaatctggatccgggaagacccagtcgactaactttcttattcactgcctcaccgcactctctcaaaaaggctacgcttccggtgtcgagcgaacgatcctcggggccggccctgtgctggaggcctttggaaacgcaaaaactgcacacaacaacaacagctctcgttttggcaagttcatccaggtgtcataccttgaaagtgggatcgtgaggggggccgtggtggaaaagtacctgttagaaaaaagtaggctggtgtctcaggaaaaggatgagcggaactatcacgttttctattacctgttgttgggggtgtcagaggaggagcgtcaggaattccagctgaaacagcccgaggactatttctatctaaaccagcataacctgaagattgaggatggggaagacctcaaacatgatttcgaacggctgaagcaagccatggaaatggttggtttccttcccgcaactaaaaagcagatctttgcagtcttgtctgccatattatatttgggcaacgtgacctataagaaaagggctacaggcagagaggagggactggaagtgggacctcccgaggtgctcgatactttgtctcagttactgaaagtaaagagagaaatcctggtcgaagtgctgacaaaacggaagactgtgaccgtgaacgacaagctgattctgccttactctctgtcagaagctattaccgctcgggacagtatggctaagtcactgtactccgcactgtttgactggatcgtactcagaattaatcacgctcttctcaacaagaaggatgtagaggaggctgtgagttgcctctccatcggcgtgctcgacatctttggttttgaagattttgagcgcaactcttttgaacaattttgcatcaattacgccaatgagcaactacagtattactttaatcaacacatctttaaactggagcaggaagagtatcagggagaggggatcacatggcacaatatcggctacacagacaatgttggctgcatccacctaatttccaagaaaccaaccggtcttttttacctcctggacgaagaatcaaacttcccacatgccacatcccagacactgctggcaaagttcaagcagcagcatgaggataataagtacttcctgggtacacctgttatggaaccagcttttataatccagcacttcgccggcaaggtcaagtaccagatcaaagacttccgtgagaaaaatatggactatatgcgtcctgacattgtggcccttctcagaggctcggactcgtcatatgtgcgggaattgatcggaatggacccggtggcggtatttcggtgggctgtcctgcgggctgctatacgcgccatggccgtcctcagggaggccggacggctgcgcgccgaacgtgccgaaaaggcggccgggatgtcctcccccggggcccaatcacaccccgaagagttgcctcgcggtgcatcaactccaagtgaaaaactgtacagagacctccataatcagatgataaagagcatcaaagggttgccatggcagggagaggacccccggtccctcctgcagtcactgagtcgactgcagaaaccacgggcgttcatattgaaaagtaaaggaattaaacagaaacagatcatccctaagaatctgttggactctaaatcactaaagctgatcatctctatgacactgcatgaccgaacaacaaagtcactgctgcacctgcataagaagaagaaaccccctagtatcagcgctcagttccagacaagcttgaataagctgctcgaagctctgggtaaggctgagcctttttttattcgctgcatccggagcaacgccgagaagaaggaactctgctttgatgacgaacttgtgctgcagcagctacggtatactgggatgcttgaaactgtgcgcattcggcgcagcggatactccgctaagtacaccttccaggacttcactgagcaattccaagtattgctgcccaaggatgctcagccttgcagggaggtgatttccactcttctggagaagatgaaaatcgacaaacgaaattaccagattggtaagactaaggtcttcctgaaggagactgagcggcaagccctgcaggagactcttcatagagaggtggtgcgcaagatcctcttgttacagtcttggttccggatggtgcttgagcgcaggcacttcctgcaaatgaaacgggccgccgtgacgattcaagcctgctggagatcttatagggtcaggagggctctcgaacggacccaagcggccgtatatctgcaggcatcctggaggggatactggcagcgcaagttgtaccggcatcagaagcagtccatcatccggcttcagagcctttgtcgcggccacctgcaacgtaagtccttctcccaaatgatctctgagaagcagaaggcagaggagaaagagagagaagccttagaggccgcacgagccggggccgaggaaggcggccaaggccaagctgccggggggcagcaggttgctgagcaggggcccgagccggcagaagatggtggacacctggccagtgagccagaagtgcagccaagtgacagaagcccactggagcattctagtcccgagaaggaagcgccttcccctgaaaagacgctgccacctcagaaaaccgtcgctgcagagtcccacgagaaggtcccttcttctagggaaaagagagagagtcgtaggcaacgcggactcgaacacgtgaaattccagaacaagcacatacagtcttgcaaggaggaaagtgcactacgcgagccctctcgccgggtgacacaggaacagggcgtttccctgttggaggacaagaaggagtcccgggaggacgagaccctgctagtggtggagactgaggccgagaacacaagtcagaagcagccaacggagcaacctcaggcgatggccgtgggcaaggtttcagaggagacagagaagactctgccttccgggagcccacgacccgggcagttggagcggccaacaagcctcgccctcgattccagggtctctcccccggccccaggatctgcccccgaaacaccggaggacaagtcaaaaccttgtggttctcccagggtccaagagaaacccgatagccccggcggaagcacacagatacaacgctatctggatgctgaaagactggccagtgcagtcgagctctggcgcggtaaaaaattagtggccgcagcatcaccttctgcaatgctctcgcagagcttggacctgagtgacagacaccgggccactggcgccgctctgactccaacagaggagagacgcacttctttctcgacttccgatgtgtccaaactcctgccttccctggctaaggctcagcctgctgcggaaaccaccgatggagagaggagtgcaaaaaaacctgctgttcaaaagaagaaaccaggtgacgcctcctctctccctgatgccggcttgagtccagggagccaagtggatagtaagagcaccttcaagagactctttctgcataagacaaaagataaaaagtacagtctcgagggggccgaagaactagaaaatgccgtctcagggcacgttgtgttggaagctaccaccatgaaaaagggtctggaggctccttcagggcagcagcatagacacgccgccggggagaagcggactaaagagccaggcggaaaaggtaaaaaaaaccggaacgtcaaaataggcaagataacagtgtcagaaaaatggcgtgaaagcgtgttccgacaaattactaacgccaacgaactcaagtacttggatgagttcctgctgaataagatcaacgacctgagatcacagaagacccccatcgagagtttgtttatcgaggccacagagaaattccgcagtaatattaagacaatgtacagcgtccccaacggcaaaattcacgtgggatacaaggaccttatggagaactaccagattgttgtgtccaacctggccaccgaacgggggcagaaggataccaacctggtgctgaatttgttccagtccctgctggacgagtttactcggggatacacaaagaacgattttgaaccagttaagcaaagtaaggcacagaagaaaaaacggaagcaggaaagagcagtccaggagcacaatgggcacgtttttgcctcttatcaggttagtatcccacaatcatgcgaacagtgtcttagctatatctggctcatggacaaggccctcctatgctcagtctgcaagatgacatgccataaaaagtgtgtgcacaagatccagtcccattgcagctacacatacggacgcaaaggtgaaccaggagtcgagcccgggcattttggggtctgtgtagacagtctcacaagcgacaaggcctctgtgcccattgttctcgagaagttacttgaacacgtcgaaatgcacggcctatacaccgaagggctgtatcgtaagtcaggcgcagcaaacaggaccagggaacttaggcaggccctgcagactgaccccgccgccgtaaaattggagaattttcctattcacgctatcaccggggtcctgaagcaatggctgcgcgaacttccagagccactcatgacgtttgctcagtatggggacttcctgcgggccgtggagctgcccgagaaacaagaacagttggcagccatctacgcggtgctggagcatttgcctgaggccaaccacaacagtctggagcggttgatcttccacctggtgaaggtagcccttctcgaggacgtgaacagaatgagccctggggccttggctatcatcttcgctccttgcctgttgcgctgtccagacaactctgacccactgacctccatgaaggatgtgctcaaaattacgacttgtgtcgagatgctcatcaaagagcaaatgaggaaatataaagttaaaatggaggaaatcagccagctggaggcggcggaatccatcgccttcagacggctttccctactgcggcagaacgcaccttggcccctaaagctcggcttctcttcaccctatgaaggagtacttaacaaaagccctaaaactcgcgacatccaggaggaggagcttgaagtgttgctcgaagaggaggcagccgggggggatgaggatagagagaaagagatccttatagagcggatccagtctataaaggaagagaaggaagatatcacctaccgactgcccgagctcgacccacggggctcggacgaggagaacctcgatagcgagacttccgctagcaccgagtccctgctggaggagcgcgccggccggggcgcgagtgagggccagtattag

SEQ ID NO: 196210 - DNA, 6069 bp, Artificial Sequence
  Description of Artificial Sequence: Synthetic coding sequence
atgagcgtgaaggaggccggcagcagcggccggcgggagcaggccgcgtaccacctccatatttaccctcagcttagcactacagagtcacaggctagctgccgagtgacagccaccaaggactccaccacttccgacgtaataaaagatgcaatagcaagtttacgacttgacggcaccaaatgctatgtgttagttgaggttaaagaatcaggcggcgaggagtgggtgctggatgcaaacgactcccccgtgcatcgggtgttactgtggcctcggcgggcacaagacgaacatcctcaggaggatggatattatttcctgctgcaggaacggaatgccgacgggactatcaaatacgtgcatatgcaactggtggcccaggccaccgccaccagacgcttagttgaaagaggtttactcccgagacagcaggctgatttcgacgatctatgcaatttgcccgagcttactgaagggaacctgctgaagaacctaaagcaccgattcctccaacagaagatatacacatacgccgggtctattctggtcgccatcaatccattcaagtttctgcccatttataatccaaaatatgttaagatgtatgaaaaccagcagctgggaaagctggagcctcacgtcttcgctctggcagatgtcgcttactatacaatgcttcgtaaaagagttaaccaatgcattgtcatctccggagagtccgggtccggaaagacccagtcaaccaacttcttaattcactgtttgacggcgctgtcgcaaaaaggctacgcatccggggtcgagaggactattcttggggccggtccagtgttagaggctttcgggaacgccaagactgcacacaacaacaattctagccgcttcggaaagtttattcaggtgagttatctggagtcgggaatagttcgtggcgcggtagttgaaaagtatctgcttgagaagagtaggcttgtgagtcaagagaaagatgaaaggaactatcacgtgttttactacttgctgttaggagttagcgaggaggagcgccaggagtttcaattaaaacagccggaagactatttttacctaaaccagcacaacttgaaaattgaggacggcgaagacttgaagcatgattttgaaaggctcaaacaggccatggagatggttgggtttctccccgccacaaaaaaacagatctttgccgtgctttctgcgatcctttacctggggaatgtgacttacaaaaaaagggcaacagggagagaagaagggttggaggtgggccccccggaggtcctagacaccttgagccagctcctcaaggtcaaaagagagatcctggtggaggttctgacaaagcgaaaaaccgtgaccgtaaatgacaaactaatcttgccctacagcttatccgaggcgatcacagccagagactctatggcgaaatctttgtactctgcactgttcgactggattgtactcagaataaaccacgcgctgctaaataaaaaggatgtggaagaggctgtgtcatgtctctccattggggtcttggatatttttggcttcgaggattttgagaggaatagttttgaacaattctgtatcaactacgccaatgagcaactccagtattacttcaatcaacatatttttaagctggaacaagaagagtatcagggggaaggtatcacatggcacaacatcggctacaccgacaacgtcgggtgtatccacctgatcagcaagaaaccaacagggttgttttatctgttggacgaggagtctaacttcccacatgctacttctcagaccctgttagccaaattcaaacaacaacacgaagataacaaatactttctgggtacccccgtgatggagccagcttttattattcaacacttcgccgggaaggtcaaatatcagattaaagacttcagagagaaaaatatggactatatgcgtcctgatatcgtagcgttactgcgcgggagcgacagcagctatgtgagagaactgatcggaatggatcctgtcgccgtcttcagatgggccgttctgcgagcagccatccgagcgatggctgttctgagagaggccggccgcctgagagctgaaagggccgagaaggccgctggtatgagttcccctggggcacaatcccacccggaggaacttccaagaggtgctagcacaccttcagagaagttatatagagacctgcacaatcaaatgatcaagagcatcaagggcttgccctggcaaggtgaagacccccgatctctcctccaatccctgagccgcctgcagaagcctagagccttcattctgaagtctaagggcatcaaacagaaacaaattatacccaaaaatctccttgatagcaagagccttaagttgatcatctctatgacacttcacgataggactactaagtccctgctgcacctgcataaaaagaagaagccacctagtatctctgctcagttccagactagcctgaataaactgctcgaagctctgggtaaggcggagccttttttcattagatgcattagatccaacgctgaaaaaaaggagctgtgctttgacgatgagcttgtgttacagcagttgaggtacaccgggatgctggagaccgtgagaatacggagatccggctattcggcaaaatacacattccaggacttcaccgagcagtttcaggtcctgctgcccaaggatgcccagccctgccgtgaggtgatatcaaccctgctcgaaaagatgaagatcgataagcgaaactaccagatcggaaagactaaagtgtttctgaaggagaccgagagacaggccctgcaggagaccctacacagggaagtggtgagaaagattctacttctccagagctggttccgcatggtgctcgaacggaggcatttcctgcagatgaagagggcggccgtgacaatccaggcgtgttggcgctcatatagagttaggagggctctggagaggacgcaggctgcagtgtaccttcaagcttcctggagagggtactggcagcgcaagctataccgtcaccagaaacagagtattattcggctgcagagcctctgcaggggccatttgcagaggaaaagttttagccaaatgattagcgagaagcaaaaagccgaggagaaagagcgggaagcgctggaagcagcccgcgccggggcagaggagggaggtcaaggacaggcagccgggggccagcaggtggcagagcagggtcccgaacccgccgaagacggcgggcatctagcatcagaacctgaggttcagccatcggacaggtctccactcgagcactcctcacctgaaaaggaagcaccctctccggaaaagacactgcccccccaaaagaccgtagcggcagaatcccacgaaaaagttccttcctctcgagagaaaagagaaagcagacgccagagaggtttggaacacgtaaaattccagaacaagcatattcagtcttgcaaagaggagtccgctctgagggagccatcccggcgggtgacacaggagcagggcgttagcctcttggaagacaaaaaagagtctcgggaagatgagactctgctggtcgtggagactgaggccgagaacactagccagaagcaacccacagagcagccccaagcgatggccgtggggaaagtctctgaagaaacggaaaagacactcccttcgggctctcccagacctggacagctggaacgtccgacctccctcgctctggacagccgggtttctccgcccgctcccggaagtgccccggagacacccgaggacaaaagcaagccatgcgggtcaccacgcgttcaggaaaagcccgatagccccggcggatcgacccagatccaacgttacctggacgcggaacggctggccagtgcagtggagctctggcgtgggaagaaactggtggccgcagctagcccgagcgcgatgctgagccaaagcttagatctgagcgaccggcaccgcgcaacaggcgcggcccttactcccaccgaagaacgtagaactagcttcagtacatctgacgtgagcaaactgctgccatcgctggccaaagcccagcccgcagctgagacaacagacggggagcggtcagccaagaagccagccgtgcagaagaagaagcccggcgatgctagcagtctgcctgacgctggcctctccccaggcagtcaggtggactccaagagcaccttcaaacggctctttctgcataaaacaaaggacaagaagtacagcctcgagggggcagaagagctagagaacgctgttagcgggcacgtcgtactggaagccaccaccatgaaaaagggcctcgaggccccaagcggccagcagcacaggcacgcagccggtgaaaagcgaactaaagaacccggcgggaagggtaagaagaatcgtaatgtgaaaattggcaaaatcacggtgtccgagaaatggagggagtctgtcttcagacagattactaacgcgaatgaactgaaatatctcgacgagttcttgttgaacaaaataaatgatctgcggagtcagaagactccaatcgagtctctgtttatcgaagctactgagaagtttaggagtaatatcaaaacaatgtatagcgtacccaatgggaaaatccacgttgggtacaaggacctcatggagaactatcagattgttgtaagcaatcttgctacagagcgcgggcagaaagacacgaatctcgtactgaaccttttccagtcactcctagacgaattcactagggggtacactaaaaatgacttcgaacccgttaaacagtcgaaagcgcaaaagaagaagagaaagcaagagcgggccgtacaggagcataatggccacgtcttcgcctcctatcaggttagcattccacaaagctgtgagcaatgcctgagttacatctggttaatggacaaagccctcctgtgttctgtttgcaagatgacgtgtcacaaaaaatgcgtccacaagatacagagccattgttcttatacctacggtcggaagggcgaacctggagtcgagccaggccactttggcgtctgcgttgatagcctgacgagcgacaaggcctccgtacccatcgtcctcgagaaactcctggaacatgtcgaaatgcatggtctgtatactgaaggcctgtatcggaaatccggcgctgctaatcgtactcgtgaacttcggcaagcactgcagactgatcccgcggctgttaaattggagaactttccgatccacgcaattacaggcgtgctgaaacaatggcttcgtgagttacctgaacctctgatgacatttgcccagtatggtgacttcctacgagcagtggagctccccgagaagcaggagcaactggctgccatctacgcagttcttgagcaccttcctgaggcaaatcataattctttggaaagactaattttccaccttgtcaaggtagcattactggaggatgttaacagaatgtccccaggcgctctcgcaattatttttgctccttgcctgctgaggtgccctgataatagcgaccctctcacctccatgaaagacgtcctgaaaatcacaacctgtgtggaaatgctgattaaagagcagatgcgaaaatacaaagtgaagatggaggagatatcacagttggaggccgctgaaagtatcgcgtttcggcgcttgagcctgctccgccagaacgcaccctggcctctgaagctgggattctcatccccctacgagggcgttctcaacaagtccccgaagactcgcgacatacaggaggaagagttggaggtgctcctagaagaggaggctgcaggtggtgacgaagaccgagagaaggaaattctgattgagcgcatacaatcaattaaagaagagaaagaagatatcacatatagactgccagaattagaccctcgtggctctgacgaggaaaacttagactcggagacatcagcaagcaccgaaagcctattggaagagcgggctggtaggggggcatcggaaggccagtactag

SEQ ID NO: 196211 - DNA, 519 bp, Artificial Sequence
  Description of Artificial Sequence: Synthetic coding sequence
atgagcagcaagaaggccaagaccaagaccaccaagaagcggccccaaagggcaaccagtaacgtcttcgctatgttcgatcagtctcaaatacaagagttcaaggaggctttcaatatgatcgaccagaaccgggatgggttcattgacaaggaagatctgcatgatatgctggcgtcactcggcaagaacccaactgacgcatatctcgatgctatgatgaatgaggcccccggccccattaactttactatgtttctcactatgttcggtgaaaagcttaacgggactgaccctgaagacgttatccgaaacgccttcgcatgttttgatgaagaggctacagggaccatacaggaagactatctcagggagctgttaaccacgatgggggaccgcttcactgacgaggaggttgacgaactatatcgagaagccccgatcgataagaagggcaattttaactatatagaatttacgagaatcctgaagcatggagctaaggacaaagacgattag

SEQ ID NO: 196212 - DNA, 1791 bp, Artificial Sequence
  Description of Artificial Sequence: Synthetic coding sequence
atggccaccgagaacggcgccgtggagctgggcatccagaacccctctacagacaaggccccgaagggtcctacgggggagcggccacttgcagctgggaaggatcctggaccccctgacccaaaaaaggcacctgacccgcccacactgaagaaggacgccaaggcacctgcctcggagaagggcgacgggactctcgcccagccttctactagcagtcagggacctaagggcgagggggatcggggcgggggtccagccgagggctcagccggcccccctgctgctctgccccagcagacggctactcccgagacatctgtgaaaaaacccaaggctgaacagggtgcctcaggaagccaggatcccgggaaaccacgtgtgggcaagaaggccgctgagggtcaagccgccgcccgccgcgggagccctgcatttctgcacagcccaagttgcccagcaattatctcttcctctgaaaagctgctggcaaaaaaacctcctagcgaggccagcgaactcaccttcgagggggtgccgatgacccactcccccacagacccgagaccagctaaggccgaagaaggtaagaatatactggcagagtcccagaaggaggtaggcgagaaaacccccgggcaggccgggcaggcaaagatgcagggtgacacatcacgggggatcgaatttcaagcagtccctagcgagaagtctgaagtgggccaggctttgtgcctaacagcccgggaagaggattgctttcagattttagacgactgtccacctccccctgccccatttccccaccgcatggtcgagttacggactggcaatgtcagttctgaatttagcatgaatagtaaggaagccctgggcgggggaaagttcggcgccgtgtgcacttgtatggaaaaggcaaccggcctgaagctggcggctaaagtaatcaagaaacagactcccaaggacaaggaaatggtgctcttggaaattgaggtcatgaaccaactaaatcaccggaatctgatacagctatatgctgcaattgagacaccacatgaaatcgtcctttttatggagtatattgagggaggagagctcttcgaacgtatcgtggatgaagattatcacctgacagaagttgacacaatggtgttcgtcaggcaaatctgcgacgggatcctattcatgcacaagatgcgggtgttgcacctcgacctgaaaccagaaaacattctgtgtgtgaacacaactggtcacttggtgaagatcatagacttcggcctggctcgccgatacaacccgaatgaaaaactaaaagtgaactttggtaccccggaatttcttagtcccgaggtggtcaactacgatcagatctcagataaaacggatatgtggtcaatgggagtaatcacttacatgctactttctggcctgagcccattccttggcgacgatgacacagagaccctgaacaatgttctgtccggcaattggtattttgacgaagaaacattcgaggctgttagcgacgaggccaaagacttcgtgtccaacttaatcgtgaaagatcaacgcgctcggatgaacgccgcacagtgcctggcccacccctggctgaacaacttagccgaaaaagccaagcggtgcaatcggaggctgaagtcccagatcctccttaagaagtacctgatgaagagaaggtggaagaagaactttatagcggtatcagccgcaaatcggttcaagaagattagttcttctggtgccttgatggccctgggtgtatag

SEQ ID NO: 196213 - DNA, 1791 bp, Artificial Sequence
  Description of Artificial Sequence: Synthetic coding sequence
atggccaccgagaacggcgccgtggagctgggcatccagaacccctctactgacaaagcacccaaggggcccactggggaacgtcccctagcagcaggaaaggatccaggacctcctgatccaaaaaaagcaccagatccgcctacactgaaaaaagacgccaaggccccagccagtgagaaaggagatggcaccttggctcagccgagcaccagttctcagggacccaaaggggaaggggaccgcggcggcggtcccgctgaggggagcgctggaccacctgcagctctgccccagcaaaccgcaaccccagagacgtccgtcaagaagcccaaagccgagcagggggccagtggatcccaggaccccggaaagccacgagtggggaagaaggccgccgaaggacaggctgccgcaagacgcggatcaccagcattccttcacagtccaagctgtcctgccatcatatcttcctcggagaaactgctggccaaaaagccccccagtgaggccagtgagcttactttcgagggggttcccatgactcattcccccacggatcccagaccagcaaaagccgaagaaggcaagaatatcctggcagaaagccagaaggaagtgggggagaaaacacctggccaggcaggacaagcgaagatgcagggagacaccagccgagggatagaattccaggctgttccctcagaaaagagcgaagtgggccaggcgttatgcctgactgctcgggaagaggattgcttccagatccttgacgactgcccccctccgccagctcctttccctcaccggatggtggagcttcggacaggcaacgtgtcatccgagttctctatgaacagtaaagaggccctaggaggaggcaaattcggtgccgtctgtacctgcatggaaaaggcaaccgggctgaagttggccgcaaaggtcatcaagaagcagaccccgaaagataaggaaatggtgctgctggagatagaagtgatgaaccagctgaaccaccggaacctcatccagctgtacgctgcgatcgaaacaccccatgagatcgtcctgttcatggagtatatagaggggggtgaactatttgaacgtattgtagacgaggactaccacctaactgaggtggatacaatggtgtttgtccgtcagatctgtgatgggatactgtttatgcacaaaatgagagtactgcacctcgacctgaagccggagaacattctgtgcgtgaacaccacagggcaccttgtgaagatcatcgacttcggtcttgctcgccgttacaatcctaacgaaaagttaaaagtgaattttggtacgccagagtttctgtcgccagaggtagtgaactacgatcagatctctgacaaaactgacatgtggtcaatgggcgtaatcacatatatgcttctcagcgggctcagccccttccttggcgacgacgatacagaaactctcaataatgttctctctggaaactggtatttcgatgaggaaacgttcgaggccgtatctgacgaagctaaggattttgttagcaacttaatcgtgaaggaccaacgcgcccggatgaacgccgctcaatgcctagcgcatccatggcttaataaccttgccgaaaaggccaagaggtgtaacagaaggctgaaatcccaaattcttctgaagaaatacctgatgaagaggagatggaagaaaaactttatcgccgtgtctgccgcaaaccggttcaagaagatttcgtcttcaggagcgctgatggctctgggcgtgtag

SEQ ID NO: 196214 - DNA, 2460 bp, Artificial Sequence
  Description of Artificial Sequence: Synthetic coding sequence
atgagcggcaccagcaaggagagcctgggccacggcggcctgcccggtctggggaaaacttgcctcacaacaatggatactaaactaaacatgctgaatgaaaaagtcgaccaactacttcattttcaagaagacgtgacagaaaaactccagagcatgtgcagagacatgggacatttagagaggggcctgcaccggcttgaggcctcgagagcccctgggccaggaggggccgacggcgtcccccacattgacacccaagccggctggccagaagtgctcgaactggtgcgtgccatgcagcaggatgccgcgcaacacggcgcaagacttgaggcattgttccggatggtggccgcagtagaccgcgctatagccctcgtaggagccacattccagaagtctaaagtagccgatttcctgatgcaaggcagggtgccatggcgacgagggagtcccggcgactctcccgaggagaacaaggaaagagttgaggaagaagggggcaaaccaaagcacgtgctctccacttccggagtgcagtctgatgctagggaacccggggaggagtcacagaaggccgacgttcttgagggcaccgccgagcgtcttccacccatccgcgctagcggtctgggagctgaccctgcccaggctgtagtttctcctgggcaaggcgatggcgttccaggcccagcacaagccttccctgggcatctccccctgccaactaaagtggaggcaaaggctcccgaaacgccttcagagaacctgcgaacagggctcgagttggcccccgcacccggacgggtgaatgtcgtgtcgcccagtcttgaggtggcgcctggggctggtcagggggcaagttcttctcgacctgatccagaaccactggaagagggaactcgcttgactcctgggccaggaccacagtgccctggcccccccggcctgcccgcacaggctagagccacccactcggggggggagaccccaccaagaatttccattcacattcaggagatggatactcccggagaaatgttaatgaccggcaggggtagcctggggcctacactgacaactgaggctccagctgctgcccaaccgggcaaacaggggccccccggcactgggcgctgcctgcaggcacctggcaccgaaccaggtgagcagacacctgagggcgccagagagctgagtccactccaagagtctagctctcctggaggtgtcaaggcagaggaggaacaacgcgcaggggcggagccgggcacccggccatcactcgcccggagcgatgataatgaccatgaggttggggctctgggtctacagcaaggaaagagccctggagccggtaatcccgaacccgaacaggactgtgctgcgagggcacccgttcgggcagaagccgtgaggcggatgccacctggagcagaggccggcagtgttgtgctggacgatagtccagctccacctgccccctttgaacatcgcgtagtgtctgttaaggaaacaagtatttccgccggctacgaagtatgccagcatgaggtcctgggcggaggtcgatttggccaggtgcatcggtgtactgaaaagtctacaggtctccccctagctgctaagattataaaagttaagtctgctaaggatagagaagatgttaagaacgagattaacattatgaaccagttgtctcacgtaaatctgatccagttatatgatgcgtttgagagcaaacactcatgcacattggtcatggagtatgtggatggtggggagctatttgatcgtattacagacgagaagtaccacctaacggagctggatgtggtactgttcactaggcagatctgtgaaggcgttcactatttgcaccagcattacatactgcaccttgacctcaaaccagagaatattctgtgcgtaaaccagaccggacaccagatcaaaatcattgactttggcctagcacgccggtacaaacctagggagaaattgaaagttaactttggcaccccagaatttctcgctcctgaagttgtgaactatgagttcgtttccttccctacggatatgtggtcagtcggagtgataacctacatgcttctcagtggactctcgccatttctgggagagaccgacgctgaaaccatgaactttatcgtcaattgcagttgggatttcgatgccgacacgttcgaggggctgagcgaggaggccaaagatttcgtgtccagactgttggtgaaggagaaatcttgccggatgtccgcaactcagtgtctgaaacatgagtggctgaacaaccttcctgctaaggcatcaagatccaagacccgcctcaaatcccaacttctgctacaaaagtatatcgcacagagaaagtggaaaaagcacttctacgtggtaacagcagctaacaggctgcgcaaattcccaaccagcccctag

SEQ ID NO: 196215 - DNA, 1437 bp, Artificial Sequence
  Description of Artificial Sequence: Synthetic coding sequence
atggacacccccggcgagatgctgatgaccggccggggcagcctgggcccgactctgacgaccgaggcaccggctgctgcccagccaggcaagcagggaccgccaggcacagggaggtgtctccaggcaccgggcacagaacctggggagcagaccccggagggagccagagaattgagccccctgcaagaatcgagctcacctggcggcgtgaaagcagaggaggaacagagagcaggtgccgaacctggtactagaccctctctggccagatcggatgacaacgaccacgaggtaggcgccctcggcctccagcaaggaaaatctccaggggccgggaacccagagcccgaacaggattgtgcggccagggctcctgtaagggccgaggctgtgagacgcatgccccctggcgcggaagccgggtccgtagtgcttgatgattcccccgcgcctcctgccccttttgaacacagagtggttagcgtgaaagagacaagcatcagtgccgggtatgaagtctgccagcatgaggtgttaggcggcggcagatttggccaggttcatcggtgcacagagaaatcgactggtctgccgctcgcagcaaagattataaaggtgaagtctgctaaggaccgcgaggatgtgaaaaacgagatcaatatcatgaatcagctcagccatgtgaaccttatccagctgtacgacgcttttgagtctaagcattcctgtaccttggttatggaatatgtcgatggcggggaactgtttgataggatcactgacgagaagtatcacctcaccgagttagacgtggtactttttactaggcagatttgcgaaggtgtgcactacctgcatcagcactatatcctgcatcttgaccttaaaccagagaacatcctgtgtgtcaatcagactggccaccaaatcaaaatcatcgattttggcctggcccgcagatacaaacccagagagaaattaaaggtcaacttcggaaccccagaattcttggcaccggaagtagtgaattacgagtttgtgtccttccccaccgacatgtggagcgtgggagtgataacatacatgctactttcagggctcagcccttttcttggggagactgatgcggaaactatgaactttattgtgaattgtagttgggactttgatgccgacacctttgagggtttaagcgaggaagccaaggatttcgtatccagattgctcgttaaagagaagagttgccgaatgtccgcgactcagtgcctaaaacacgagtggcttaacaatctccccgcgaaagctagtagatctaagacgaggctcaaatctcaactgttgctccagaagtacatcgcccagcgcaagtggaagaaacacttttacgtggtgaccgctgcaaacaggcttcggaaatttccaactagcccctag

SEQ ID NO: 196216 - DNA, 4212 bp, Artificial Sequence
  Description of Artificial Sequence: Synthetic coding sequence
tgactgctgctggagagctgcgagaaggagaagcaggccctgctgcagaacttgaaagaggtggaggacaaggcttcagcgtacgaggatcagctgcaggggcaggcgcagcaagtagaaacgctgcagaaggagaaactaagcgcaacttttgaggggtcagaacaggtccaccagcttgaggaacagctggaagcccgggaagccagcgtcagaagattggcggaacacgtacagagtctctgcgacgagcgggatctgctcagacagcgttttcaggagctcaccgaaagggtcgcgactagcgacgaggacgtggccgagctgcgcgagaaactcagacggagagaggctgacaatcagtcattagaacattcttaccagcgtgtgtcatcacagctgcaatccatgcacacattattacgagagaaggaggaagaacttgaacggatcaaagaagcccacgagaaagtccttgaaaagaaggaacaggatctcaacgaagccctcgtgaaaatggtggccctgggttcatcactcgaggagacagaaatcaaactgcaggcgaaagaagaaattctccggaaattcgcctcagagtctccaaaggacatggaagaacctcggtcaacccctgaagaaaccgaacgggatgggacactcttgccggggcaacctgtccaggccacacgcgccccactcggcctgcctcacacacggcttgaggacgaagacgaagaccttggggcccctcctggcgaggaatatggagatggaagcccaagccgcgaagactctatggtgcccccaaagagcgtagaagtacttgatcgggaagggcatcaacagggaacagctaaactggaccagggggcacccggcgtcaagcggcagagaatacggttcagtacgatccaatgtcagcggtatatccaccccgaaggaagtgaaaaaacctggacttctagtacttcttcagatacatcccaagaccggtcaccatctgaagaaagtatgtcgtcagagcctgcccctagcgtcttgcccgccaccggagactccgacacttacctcagcatcattcattcccttgaaaccaaactgtacgtgaccgaggagaaattgaaggacgtgaccgttagactggaatctcagcaggggcaaagcagggaagccctgctggcattacaccaccagtgggcagggaccgaagcccagctacgcgagcagcttcgggcctccctcctgcaggtaggcgcgctagcgtcgcagcttgaacaggaacggcaggaacgggcacgcagagttgaagggcatgtgggagaactcggagacttccaggtaaagaatagtcaggccctgatgtgtctggaaaattgccgagagcagttgcgctcactccccagggcatcccaggaggacgagcaggacgctagggccgccagcctggcctccgtggagtctgccctggtgtccgccatccaggctctgcagcactggcccgcacctgctcacggcggagccagggcccaactggaaaccgggggaaccgaggaaaacggtaaacccgccagcctccagcagtgttcccagtccgaacttactgaacaggagcaggttcgactcctgagcgatcagatcgccctcgaagcgtccctgatttcccaaatcgcagattctctcaagaacaccacaagcgacgtctcccgcatgcttcatgaaatttcttggagtggtcagcccccaatggagagcgctggggcaccagtcgacacttgggcaagaaaggtcttggtcgacggggagttctggagccaggtcgaaagcttgcggaagcacctggggacgctcggaggagaagcagtgggcgcctcgggcgatggacaacagagcataccacagggcttagcccccattctggccaatgctacctgggtcagagcggagctttctttcgctactcaatctgttcgcgagagcttccataggcgcctacagtcgatacaagaaacactgcgaggcacacagacagcgcttagacagcacaaatgtttactcagagagatcctgggcgcgtaccagacacctgatttcgagcgcgtgatgcaacaggtactggaagctttaagactcccagctggacacgaggacggagtgcaactctcttgggacctctccccactcggcgaagtcctcgggagggactcagattccagccaggaacctttcgacgtgtctgatcaaagccccggcgcctttgtcgctatccaggaggagctcgcccagcaattgaaggagaaagcaagcttactggaagagatcgcagccgccctgccatctttaccccctgttgagtctctccgagactgccagaaattgctgcaggtttcccagtccctctcttataacacctgcctgggtggactgggtcagtatagcagccttctggtgcaggatgctattattcaggcacaggtgtgttatgcatcctgccgcatcagattagaatacgaaaaggagttacagctgtgcaaggagagttggcaaacaagggaaccctcttgttccgaacaggcccaggcagcgagagccctacgggaagagtatgaggaattgctacgtaagcaaaagtccgagtatctggatgtaatcgcgatcgtcgaacgggaaaatgcagagttgaaggcaaaagctgcccagctggatcaccagcagcaatgcctcgaggatgctgagtctaaacattccatgagcatgtttactctgaggggtagatacgaagaggagatccgctgtgtagtggagcagctgaccagaaccgagagcactctgcaggctgaacgaagtcgagtactttcacaactagatgctagtgtgcgtgatcgccaggacatggaaaggcaccacggggagcagatccagacgttagaagatcgctttcaattgaaagtgagggaactgcaaacaatccacgaagaagaactgcggacgctacaggagcattatagccaaagcctccgctgtctacaggataccctctgcctacaccaggggcctcatccaaaggctttgcctgctccggcacccaactggcaagcaacccagggtgaagcggactcaatgacggggctcagggagaggattcaagaactcgaggctcagatggacgtgatgagagaggaactgggccacaaggatctcgagggagatgctgccacactgagagagaagtaccagagagacctggagagcctgaaagcaacatgtgagagagggttcgcagccatggaggagacacaccagaaaaaaattgaggatctgcagcgccagcatcaacgggagcttgaaaagctacgcgaggaaaaggaccgcctcctggccgaggaaactgccgctacaatttccgccatagaggcgatgaagaacgcccatagggaagagatggagcgggagctggagaagtcacagaggtctcagatttctagcgtgaattctgacgttgaagcattaaggaggcaatacctcgaagagcttcagtctgtgcagagagaactggaagtacttagcgaacagtactcgcagaagtgtctcgaaaacgctcatctagcacaggcactagaggctgagagacaggcccttagacagtgccagagagagaaccaggagctgaatgcccataatcaggagctgaacaacaggttggctgcggagatcacaaggttacgcacattgcttaccggcgacggaggtggcgaagcaactggctctcctctggcccagggcaaggatgcctatgagttggaggtcctcctgcgagtcaaggaatcagaaatacagtatctaaaacaagagatcagctctttgaaagacgagcttcagacagcactccgggataaaaagtatgcctccgataagtataaggatatttacactgaactgagcattgccaaggccaaggccgactgcgacattagcagattgaaggagcagctgaaagctgctactgaagccctcggggaaaaatctccagatagcgctactgtgtccggctacgacataatgaagagtaagtccaaccccgactttctaaagaaggatcgatcctgtgtcaccagacagctccggaatatcagatcgaaaagcctgaaggagggattgacagttcaagagaggctgaagctgtttgagagcagagatctcaagaaggactag

SEQ ID NO: 196217 - DNA, 3078 bp, Artificial Sequence
  Description of Artificial Sequence: Synthetic coding sequence
atgagcgccgccaaggagaacccctgccggaagttccaggccaacatctttaacaagtctaagtgccaaaattgcttcaaacccagagagtctcatttgcttaatgatgaggatcttacacaagccaaaccaatttacggcggatggctgctgctggctcccgacgggacggacttcgataaccctgtgcaccgttccagaaagtggcagcgccgattctttatcctgtatgaacacggcttactcagatatgccctggatgaaatgccaactacccttccgcaggggacaatcaacatgaaccagtgtactgacgtggtggatggggaaggtcgaacagggcagaagtttagcctctgcatactgacacccgaaaaggaacactttattcgcgccgagacgaaggaaattgtaagcgggtggctggagatgcttatggtctacccacgcacaaacaagcagaatcaaaaaaaaaaaaggaaggtcgagccccccacacctcaagagcccggccctgccaaagttgccgttacgtcctcaagctcctcatccagctcctcgagctcaatcccatccgcagaaaaggtgcctacaacaaagtctaccctttggcaggaggagatgcggacgaaagatcagcctgacggaagttcattgtcccctgcccaaagcccgtcccagagtcagccgcccgctgcctcaagccttcgggagcccgggctggaaagtaaggaggaggagtccgccatgtcatccgacagaatggactgtggacgaaaggtgcgagtggagagcggctacttctcactggagaaaacgaagcaggacctcaaagctgaggaacaacaactgcctccaccattatcacccccgtcaccttccactccaaaccacagacgatcccaggtaatagagaaattcgaagcattggatattgagaaagcagagcatatggagaccaatgcggtaggacccagcccaagttccgacaccagacagggccgctcagagaaacgggctttccccagaaagcgcgatttcactaatgaggcgccaccagcccctcttccggacgccagcgccagcccgctgagtcctcacagaagagcaaagtccctcgatcgtaggtccacagagccatctgtgacacctgacttacttaattttaaaaaaggatggttaactaagcagtatgaggatgggcagtggaaaaagcactggttcgtgcttgccgaccaatctctgcgatactatagggattccgttgccgaggaggcggcggacttggacggcgagattgatttatctgcatgttacgacgttaccgaatacccggttcaacggaactatggatttcagattcataccaaagagggagagtttacactgtcggctatgacctccggcatccgcaggaactggatccagaccattatgaagcacgttcacccaaccacggcacccgatgttacatcttccctgccggaagaaaagaataagagttcctgctccttcgaaacctgccctcggcctactgagaaacaggaggcagaactcggcgagcccgacccggaacagaagcgttcccgcgcacgagagcgtaggagagaggggaggtccaaaacattcgattgggcggaattcagaccaattcaacaggccttggctcaggagcgtgtgggcggtgttggacctgcggacacccacgagcctctgcgcccagaggcagaaccgggagagttagagcgggaacgggcacgccgtcgggaggaaagacgcaagcggttcgggatgctagacgccactgacggtccaggcacagaggacgctgccctacgaatggaagtggatcgatcccctgggctgcctatgagcgatttgaagactcacaatgtgcatgtggaaatcgagcagcgctggcaccaggtcgagacgacccccctccgggaggagaaacaggttccaatcgcacctgtccatctgagtagtgaggacggaggcgaccgtcttagcacgcacgaactgacatccctgctcgaaaaggagctcgaacagagccagaaggaggcaagtgatctcttagaacagaatcgcctcctgcaggaccagctgagggtagcgctggggagggaacagtccgcccgcgaggggtacgttctgcaggctacctgcgagcggggatttgctgcgatggaggagactcaccagaaaaagatagaagacctccaacgtcagcatcagcgtgaactggagaagttgcgggaagagaaggatcgactgctcgcggaggaaacagccgcaacgattagtgccatcgaggctatgaagaatgcacaccgagaggagatggaacgggaactcgagaagagtcagcgttcgcagatttccagtgtgaacagtgatgtggaagcactacgacgccagtatctggaggagttacagagcgttcaacgagagcttgaagtgttgtcagagcagtatagtcagaagtgtcttgagaacgcccacctcgcccaggccttggaagctgagaggcaggcactgcggcagtgccaaagagaaaaccaggagctgaatgcccacaaccaagagctgaataataggctggccgccgaaattacaagattaaggacactgcttaccggcgacggcgggggagaggccactggtagtcctctagcccagggcaaggacgcttatgagctcgaagtgttactgagggtgaaagagtcggaaattcagtacctgaaacaggaaatctcaagtctgaaagatgagctgcagactgccctacgggacaagaagtacgcgtccgacaagtataaggacatctataccgagctgagtatcgctaaagctaaggctgactgtgatatcagcagactgaaagagcagctcaaggccgccaccgaggctctgggggagaagtcccctgacagtgccaccgtgtccggctatgacatcatgaaaagcaaatcaaaccccgacttcctcaaaaaagaccgctcatgcgtgaccaggcaactcagaaacattcggtccaaaagtgtgatcgagcaggtgagttgggacacgtag

SEQ ID NO: 196218 - DNA, 3078 bp, Artificial Sequence
  Description of Artificial Sequence: Synthetic coding sequence
atgagcgccgccaaggagaacccctgccggaagttccaggccaacatatttaacaaatctaagtgtcaaaattgctttaagccaagagagtcccatttattaaatgatgaagacctgactcaggcaaaaccaatctacggcggctggctactgctggctcctgatggcactgactttgacaacccagttcaccgctctcgaaagtggcagcgtcggttcttcattctgtacgaacatggacttctacgctatgccctagatgaaatgcctacaaccctgccacagggcaccatcaacatgaaccagtgcacagatgtagtggatggggagggaaggacaggacagaaattctctctgtgcatacttacacccgagaaagagcatttcatcagggccgagaccaaagagatcgtcagcggctggctggagatgctcatggtttatccgcggaccaacaaacagaaccaaaaaaaaaagcgcaaagtggaacctccaacccctcaggagccagggccagcaaaagtggccgtgacctcgagtagctcgagctctagctcctccagctccattcccagtgctgaaaaggttccaacaacgaagtcaaccctctggcaggaagagatgcgtaccaaagatcaacccgatggaagctcactgagccctgctcaatcacctagccagtctcaacccccagccgcgtcatctctgagggaaccaggactggaatccaaggaggaagagtccgccatgtcctccgacagaatggactgcgggcggaaggtacgcgttgagtccggctacttcagcctggagaaaaccaaacaggaccttaaagccgaagaacagcagcttcccccacctctctcacccccatcaccgtctacccccaaccaccggagaagccaggtaatcgagaagttcgaggcgcttgacattgagaaggctgagcacatggaaacgaacgccgttggtccctcacccagtagcgacacccgtcagggacgctctgaaaaacgggcttttcctaggaaaagagacttcaccaacgaggccccccccgccccgttaccagacgcctccgccagtccactgtctccacatagaagggcgaaaagcctggaccggcgatctaccgaaccctcggtgacacctgatcttctgaactttaagaagggctggttgaccaaacaatacgaagacggccagtggaagaagcattggttcgtgctggccgaccaaagtctaagatactatagggactcagtggccgaggaggccgcagatctcgatggagaaatcgacctgtccgcatgttacgatgttacagaatatcccgtgcagcggaattacggatttcaaattcacacaaaagaaggggagttcacactctcggctatgacaagcgggattcgtcgcaactggatccagaccatcatgaaacacgtgcatccaaccaccgctcctgatgtcacatccagtttgcccgaagaaaagaacaagagttcatgcagctttgagacgtgtcctaggcctaccgagaagcaggaggccgagctgggtgaacccgatccggaacagaagagatcccgcgccagggagagaagacgagagggacgcagcaaaacattcgactgggcagaattcaggcccatccagcaggcgttggcgcaagaacgggtgggcggagtggggcccgcagacactcacgagcccttacgccccgaagccgaaccaggggaactcgagagagagcgtgcccgtcgtagggaggagaggaggaaaaggttcggcatgctcgacgccacagacggccctggcacagaagatgccgccctacgaatggaagtggatcggagccctggcctgccgatgagcgacctgaaaacccacaatgtacacgttgagatcgaacagaggtggcaccaagtggagaccacccctctgcgtgaagagaagcaagtaccaattgcccctgtgcatctgtccagtgaggatggaggtgacaggctcagcactcacgaactgaccagtctactagagaaagagctggagcagtcgcaaaaagaagcctccgatcttctggagcagaaccgcctgctgcaggatcagcttagggttgcactaggcagggagcagagcgccagggaagggtatgtgttgcaggccacctgtgagcggggcttcgccgcaatggaagagacccaccagaagaaaatcgaggatctccagcggcagcatcagcgtgaactcgagaaattacgcgaagagaaggaccggctgctcgctgaagagaccgccgcaactatctcagccatagaggcgatgaaaaacgcacatcgtgaggagatggaacgcgaactggagaaaagccagcgatcccaaatcagctcagttaactccgatgtggaagctttgcgcaggcagtacttggaagaactccagagcgtgcagagagagctggaggtgctgagtgagcagtacagccaaaaatgtctggaaaacgcccatctggcccaggccctcgaggctgagcggcaggctctccgccaatgtcagagagaaaatcaggagctgaatgcccacaatcaggaattaaataaccggttagccgcagagattacacgattaagaacgctactgacgggagatggaggaggtgaagcaaccggcagccccctggctcaggggaaagacgcttacgaactggaagtacttttgcgcgtcaaggagtccgagatccagtacctcaagcaggagataagttccctgaaggatgaacttcagactgcactcagggacaaaaagtacgcttcagataagtataaagacatttacacagagctctcaatcgcaaaggccaaagctgactgcgatatcagtagactcaaagagcaactgaaggccgccactgaagctctgggcgaaaagtcacccgattccgctacagtcagtggttacgacatcatgaaatccaaaagcaacccagacttcttgaagaaggacagatcttgtgtgactcgccagctgaggaatattaggagcaagtccgtaatcgaacaggtgagctgggatacctag

SEQ ID NO: 196219 - DNA, 192 bp, Artificial Sequence
  Description of Artificial Sequence: Synthetic coding sequence
atgagcgccgccaaggagaacccctgccggaagttccaggccaacatcttcaataaatctaaatgccagaattgctttaaaccacgggagagccacctactgaacgatgaagatctcactcagcaaaacacccaccctcttgaaatgaaacgcggggctcacatttacgatgctcggatgttttcctgctag

SEQ ID NO: 196220 - DNA, 282 bp, Artificial Sequence
  Description of Artificial Sequence: Synthetic coding sequence
atgagcgccgccaaggagaacccctgccggaagttccaggccaacatcttcaacaaaagtaagtgccagaactgcttcaagcctagggagagccacctgctgaacgatgaggatttaacccaggcaaagcccatctatggcggttggctgctcctggcaccagacgggaccgatttcgacaaccccgtgcaccggtccagaaaatggcagcgacggttcttcattctgtacgaacatgggctactgcgctacgctctcgatgaaatgatgagctcgcagtag

SEQ ID NO: 196221 - DNA, 3117 bp, Artificial Sequence
  Description of Artificial Sequence: Synthetic coding sequence
atgagcgccgccaaggagaacccctgccggaagttccaggccaacatcttcaataaaagtaaatgccagaactgcttcaagccgcgagagtctcaccttcttaacgatgaggaccttacacaggccaagccgatttatggcggatggctgttgttagcgcccgacggtactgacttcgataatcccgtccatcgttctcggaagtggcagcgaagatttttcattctgtacgagcatggcctattgaggtacgctctcgacgaaatgccaaccactctcccccagggtactattaatatgaaccagtgcaccgatgtcgtcgacggagaaggaaggaccggccaaaagttctcattgtgcattctgacaccagaaaaagagcattttattagggccgaaaccaaggagattgtctcgggctggctcgaaatgctgatggtgtatccgcgaacgaataaacagaaccaaaaaaaaaagcgcaaggtcgagcctccaacgccccaagagcccggtcctgccaaggttgcagttacaagcagctcctcaagttcgagctcaagctcatctattccctcagcagaaaaggtgccgactaccaagagtacgctctggcaggaggagatgagaacaaaagatcagcctgatggcagcagcttgtcacctgcacagagtcctagccagtcgcaacctcccgcagcttcgagcctcagggagcctggcctggagagcaaggaggaggagtccgctatgagtagtgatcgtatggactgcggaagaaaagtcagagtcgagagcggttattttagccttgaaaagactaaacaggacttgaaagcagaagagcagcagctcccccctcccctgagccctcctagtccctcaactccaaaccataggagatctcaggtcattgagaagtttgaagctctcgatattgaaaaagctgaacatatggagactaacgccgtcggtccctccccatcatccgataccagacagggacgttccgagaagcgggctttcccccgcaagcgtgatttcaccaatgaggcacccccagctcccctgccagatgcctctgcaagccccttgtcaccccacaggcgcgccaagtcactggaccgcagaagcaccgagcctagcgttaccccagacctgttgaattttaaaaagggatggctcacaaagcagtacgaagatggccagtggaaaaagcactggtttgtgctcgccgatcagtctcttaggtactacagggactccgtagctgaagaggccgccgacctggatggggaaatcgatctgtctgcctgttacgatgtcaccgagtatcccgtgcaaaggaattatggatttcaaatacacacaaaagagggagagtttactctcagcgctatgacatccggcatacgtagaaactggattcagaccattatgaaacatgtccacccaactacagcgcctgacgtaacaagttcgctacctgaagaaaagaacaaaagctcatgctcattcgaaacctgtccccgacctacagaaaaacaagaagcagaattgggagagcctgatcctgagcagaagaggtctagggcacgggagcgccggagggaaggaaggtcaaagaccttcgactgggcggaattcagacccatccagcaggccctggctcaggagagggtgggcggcgttggccccgctgatacccacgaaccgttgcgcccggaagccgagcctggggagcttgagcgggagcgggcaaggcgaagagaggaacgcaggaagagatttggaatgttggatgccactgacggacctggcaccgaggacgcggctttaagaatggaggttgaccggtctcccggactcccaatgtctgacctcaagactcacaacgtgcacgtggagatcgagcagagatggcatcaagtggagacaacaccccttcgggaagagaaacaggttccaatcgctccagtgcatctgtccagcgaagatggcggcgataggctgtccacgcatgagctgacatcactattggagaaagaactggagcagtcgcagaaagaggcttctgatttattagaacagaacagattactgcaggaccaactgcgtgtggccctgggtagagagcagtctgcccgcgaaggctatgtcctccaagcaacttgcgagcgaggctttgccgcgatggaggaaactcaccagaaaaagattgaagacctacagagacagcaccagcgcgaactggaaaaactgagggaagaaaaggatcggctactggccgaggagaccgccgctactatctcagcgatcgaggcaatgaaaaatgcacatagggaggaaatggagagggaactggagaagagtcagagatcccaaatttcgtcggtcaattcagacgtggaagcactccggcggcagtatctggaggaattgcagagcgttcagcgggagctggaggtcctgtctgaacagtactcccagaaatgtcttgagaatgctcatctcgcgcaggcactggaagcggagcggcaggctctcaggcagtgccaacgagagaatcaggagctgaatgcccataaccaagaattgaataacagactggccgccgagataacaagactgcgcacattgctgaccggcgatggaggtggtgaggccaccggttcacctcttgcacaaggcaaggacgcttatgaactggaggtcctgcttcgggtgaaggaaagtgaaatccagtacctcaaacaggagatatccagcctcaaagatgaactgcagactgcactcagggataaaaagtacgcttcggacaagtataaggatatctataccgagctgtctatcgccaaggccaaggctgattgtgatatctcgagactgaaggaacagcttaaagctgcaactgaggccctcggagaaaaatctcccgatagcgctactgtgagcggctacgacatcatgaagagcaagtcaaatcccgacttcctgaaaaaggataggagttgtgtaacacgccagctgagaaacattcggtctaaatctcttaaggaaggcctgacggtgcaagagcggcttaagctgttcgagagccgcgacctgaagaaggactag

SEQ ID NO: 196222 - DNA, 3276 bp, Artificial Sequence
  Description of Artificial Sequence: Synthetic coding sequence
tgacggttcagcaccatccagtgccagcggtacatccaccccgagggctccgaaaagacctggacctcatccacgagcagtgacacgtcgcaagatagatcaccctccgaagagtctatgtcaagcgagcctgccccctccgtcctccctgccaccggggattctgacacgtacttgagcatcatacattctcttgaaacaaagctatatgtgacagaggagaagctaaaagacgtgacggtccggcttgaaagccagcaggggcagtcccgggaggcccttctggccctccaccaccagtgggccgggaccgaagcccagctgagggaacaactgagagccagcctactgcaggtgggagcactggcgagccagctggagcaggagcgtcaggaaagagcccgcagagtcgaaggccacgtgggagagttgggcgactttcaagttaaaaatagtcaggcactaatgtgtctggagaattgccgggaacagttgcggtcactgcctagggcctctcaggaagacgaacaagacgctcgagccgcgagcctggcgtcagttgaatcggccctagtgtccgctatacaggctctgcagcactggcctgctcccgcgcatgggggcgcccgagcacagctggagaccggtggcaccgaggaaaatggtaaaccagcaagcctccagcagtgctcacagagtgagcttacagagcaggaacaggttaggctcctctcagatcagatcgcccttgaggccagcctgatttctcaaattgctgactcactcaaaaataccacgtccgacgtgagtagaatgcttcacgagatctcctggtcgggccagccaccaatggagagtgcaggtgctccagtggatacgtgggctcggaaggtattggtagacggggagttctggagccaggtagagagtcttaggaagcaccttggcaccctgggaggggaggccgtcggggcgagtggagacggtcagcagtccatacctcaagggctggcccctatactcgcaaacgcaacatgggttagggctgagttgtccttcgctacccagagtgtcagggaatccttccaccggcggttgcagtctattcaggaaactctgcgagggactcaaacggcactgcggcagcataaatgtctgttgagggagattctcggagcatatcaaacaccagattttgagcgggtgatgcagcaggtactcgaggccctgagactgcccgcaggacatgaggacggcgtgcaactgagctgggacctgagccctcttggtgaggtgttaggacgggacagtgacagttcccaggaaccattcgatgtctctgaccagtctccaggcgcattcgtggctattcaggaggagctggctcagcaactgaaggaaaaagcatcacttcttgaagagattgccgcagccttgcctagcctgccacctgtggaatccctgcgcgattgccagaagcttctacaggtgtcgcagtctctgagctataacacttgcttgggcgggttgggccagtattcttccctgttggtacaggatgcgatcatacaggcccaggtgtgttacgcatcctgcagaattcgcctggaatacgagaaggaattacagctgtgtaaggagtcctggcagaccagggaacccagttgcagcgagcaggcccaggccgcacgtgccctccgtgaggagtacgaagagctgttgcgtaagcaaaagagtgaatacctggacgtgatcgctatcgtagagagggaaaatgcagagctgaaagccaaggccgctcaactggaccaccaacaacagtgcctcgaggatgccgagtctaaacactcaatgagcatgtttactctccggggacgatacgaagaagaaatccggtgcgttgtggagcagctgactcgcaccgaatcaacactgcaggctgagaggagccgggtgctgtctcagctggacgcctcagtgagggatcggcaggatatggaaaggcatcacggggagcagatccagacactggaggatcgctttcagcttaaagtgcgagagctgcaaaccatccatgaggaggaacttcgaaccctgcaggaacattatagccagtccttgcggtgcctacaggacacactttgtctccatcaaggtccccaccctaaggcacttcccgccccagcgccaaactggcaggccactcagggtgaagcagactctatgaccggcctcagagagcgaattcaggaacttgaggcccagatggatgtcatgagggaagagctggggcacaaggatctggagggagatgctgctactctgcgtgaaaagtatcagcgtgatctcgaaagcctgaaggctacctgcgagagggggtttgccgcgatggaggagacccaccagaaaaagatcgaagacttgcaaaggcagcaccaacgggagctggagaagctcagggaagaaaaggacagactgttagccgaagagactgccgctacaattagtgctatagaggctatgaagaacgcacacagagaagaaatggaacgggagctggagaaatctcagaggtcacagattagctccgttaattctgacgtagaagcccttcggaggcaatatcttgaggaattgcagtccgtgcagcgggagctagaggtgctctccgaacaatacagccagaagtgcctggaaaatgcacatctagcccaggctctggaagctgaacggcaggcccttcggcaatgtcagcgagaaaaccaggagctcaatgctcacaaccaggaactaaataatagattggccgcagaaattacaaggctgcgaacactgctcactggtgacggcggtggggaagcaactggatcacccctggctcagggcaaggacgcctacgaattggaggtgttgctgcgcgtgaaggagagcgagattcagtatctaaaacaggagatctctagcctcaaggatgagttgcagactgctctgagagacaaaaagtacgcgtccgacaagtataaagacatttataccgaattaagcatcgcaaaggctaaggctgattgcgatatctctaggctgaaagagcagctgaaggccgcaaccgaggcattgggcgagaagtcccctgactccgccacggtgagtggctacgacattatgaaatcaaagagtaacccagactttctgaaaaaggaccggtcatgcgtcacccgtcagctccggaacataagaagcaaaagtgttatcgaacaagttagttgggacacctag

SEQ ID NO: 196223 - DNA, 840 bp, Artificial Sequence
  Description of Artificial Sequence: Synthetic coding sequence
tgacaggaggccgagctgggcgagcccgaccccgagcagaagcggtctcgagcgcgggagaggcggagggagggcagatctaagaccttcgattgggctgagtttcggccgatccaacaagccctcgcacaggagcgggtcggtggggtgggaccagctgacacacacgagcctctcagacccgaagcagagcccggcgagctggagcgcgaacgagcacggagacgcgaagaacggcgcaaaagattcggtatgctagatgcaactgacggacctggcactgaagatgcagcactgaggatggaagtggacaggagtcccgggttacccatgagcgacttgaaaacccataatgtgcacgtcgaaatcgaacaaaggtggcaccaagtggaaacgactcctctgagggaagagaagcaagtccccatcgctcctgtacacctctcttcagaagacggaggcgatcgactttctacccacgagctcacatccttgctggagaaagaattggagcagtcacagaaagaggctagcgaccttttggaacagaaccggcttctgcaggaccagttacgcgtggcgctgggcagagagcagagcgccagagaaggttatgtgcttcaaaccgaagtcgccgcgtctccgtctggggcttggcagcgcctgcatagagttaaccaagatctccagtctgagctggaagcccagtgtcagaggcaggagctgattacccaccagatccagactcttaagcgctcttacggcgaggctaaggatacaattcgacaccatgaagccgagatacgcagcttgcaggcccgcctcagcaacgccgcttag

SEQ ID NO: 196224 - DNA, 585 bp, Artificial Sequence
  Description of Artificial Sequence: Synthetic coding sequence
ctgcggcagcagaccgtggaggagctgcagagcgtgcagcgggagctggaggtcctgtcggaacaatattctcagaagtgcctggagaacgcacatctggcccaagcactcgaagctgagcggcaggccctcaggcagtgccagcgtgaaaaccaggagctgaacgctcacaaccaagtattgcttcgtgtgaaggagagcgagatccagtacctcaaacaggaaatcagcagccttaaggatgaacttcagactgccttgcgggataagaaatacgcaagcgacaagtataaagacatctacaccgagctgagcatcgcgaaggcgaaagccgactgcgacatcagcagactgaaggaacaactgaaagcggcgacagaggcgttgggagaaaaatcccccgactccgcgacagtttccggctatgacattatgaagtccaagtcaaatcctgatttcctgaagaaagatcgctcctgtgtgaccaggcagttaagaaatataaggagtaagagcttaaaagagggtttaaccgtccaggagagactaaagctgtttgaatcccgtgacctgaaaaaggactag

SEQ ID NO: 196225 - DNA, 3003 bp, Artificial Sequence
  Description of Artificial Sequence: Synthetic coding sequence
atgagcgccgccaaggagaacccctgccggaagttccaggccaacatttttaataaatccaagtgtcagaattgcttcaaaccacgagaatcgcatctgctcaacgacgaggacctgacccaggccaaaccaatctatggaggatggctgctgttagccccagacggaacagactttgataatcctgtgcaccgcagtaggaaatggcaacggagattttttatcctctacgaacatgggctgcttagatacgcgctggatgaaatgcctactaccctaccacagggtaccatcaacatgaaccagtgcacagatgtggtcgatggtgagggtaggacaggacaaaagttctccttgtgtattttaaccccggaaaaagagcatttcattagagcggagactaaagaaattgtgtcggggtggctcgagatgctgatggtgtatccgcgtacaaataaacagaatcaaaaaaaaaaaagaaaagtggagccgcctacccctcaggaacccgggccagctaaagttgctgttaccagttcttcaagctcctcttcatcgagcagctccattccaagtgccgaaaaagtgcccactactaaaagcacactctggcaggaggaaatgcgaactaaggatcaacccgacggttcctcactctcccccgctcagtccccaagccagagccagccacctgcagcaagctctctgagggaaccggggctcgagagcaaggaggaagaatctgcgatgtcgtccgatcgtatggattgtgggcgcaaagtacgggtcgagagtggctacttctccctggagaagactaagcaggatcttaaagccgaagaacaacagctgccccctcccctgtcaccaccatccccgtcaacgcctaatcaccggcggtctcaggtgatcgaaaagttcgaggctttagatattgagaaggcggaacatatggaaacgaacgccgttggacccagcccgtcgagcgacaccaggcagggacgatctgaaaagcgggcatttccacggaaacgcccggacctgctcaattttaaaaagggttggctcaccaagcagtacgaagatggtcagtggaaaaagcactggttcgttctggctgaccagagccttcggtactaccgcgattccgtagccgaggaggcagctgatttggatggagaaatagatttgagcgcatgttatgacgttaccgagtatccagtgcagaggaattacggcttccagatacacaccaaagagggtgagtttactctttccgcaatgacgtctggcatccgccgaaattggattcagactatcatgaagcatgtgcacccgacaacagccccagacgtcacttcctccctaccggaggaaaaaaataagagttcgtgttccttcgagacttgcccccgacccactgagaagcaagaggccgagctgggcgaacccgatcctgaacaaaagagatcgagggctcgcgagaggcgtagggaaggacgctcgaagacctttgactgggcagaatttcgcccgatccagcaagcactcgcgcaggagagggtcggcggagttgggcctgcagatacccacgaacccctgcgccccgaggctgaacccggcgaacttgagcgcgagcgcgcccgtcggagagaggaacgacgcaagcggttcggtatgctagatgccaccgacggacctggcactgaagacgccgctcttaggatggaagtggaccggtcgcctgggcttcctatgagcgatttaaaaacacacaacgtccatgtggagatcgaacagcgctggcaccaggtcgagactactcccctgagagaggaaaaacaggtccctattgctcccgttcacttatccagcgaggatggaggggaccgcctgtccacccacgaactgaccagcctgttggagaaagaactggaacagagccagaaggaggcatcagatctcctggagcagaacagactcctccaagatcagctaagagtggctctgggtagggagcagtccgcccgcgagggctacgtgctgcaggccacatgtgagcgcggctttgcagcaatggaggaaacccatcagaaaaagattgaagacctgcagaggcagcaccagagggaactggagaaattgagagaagaaaaagatcggctgctggcagaggagactgcggccacgatttccgctattgaagctatgaagaacgcgcaccgcgaggaaatggaaagagaactggagaaaagccaacggagtcaaataagcagtgtgaattccgatgttgaagctcttagacgccaataccttgaggagctccaatcagttcagcgtgagctcgaggtcctgagtgagcaatattctcagaagtgcctggagaatgcccaccttgctcaggctctggaagcagaaaggcaggctctccgccagtgtcaacgagaaaaccaggagctgaatgcccataaccaggagcttaataaccgcttggccgctgaaatcactcggcttcgcacgctgcttacgggagacggaggcggtgaagccacaggaagcccactggcacagggcaaggacgcgtacgaacttgaggtcttgcttcgagtgaaggaaagtgaaatccaatatctaaagcaagagatctccagtctgaaagacgaactgcagacagcacttcgggataagaagtacgctagcgataaatataaagatatttacactgaactgtcaattgccaaggctaaagccgattgcgatattagtcggttgaaggagcagctgaaggcagccacagaggctctcggtgagaagagtcctgactccgcaacagtgtcaggctacgatattatgaaatcaaagagtaatcccgacttcttaaagaaagacagatcttgcgtgacgcggcagttgcgtaatatacggagtaagagcctcaaagagggcttgactgtccaagaacggctgaagttgttcgaaagtagagacttgaaaaaggactag

SEQ ID NO: 196226 - DNA, 795 bp, Artificial Sequence
  Description of Artificial Sequence: Synthetic coding sequence
atggagaactacggcatcgagtggcacagcgtgcgggacagcgagggtcagaagcttttaattggtgtcgggccggagggcatctcaatctgcaaggacgacttcagccctattaatcgaatagcataccccgtggtgcagatggctacacagtccggcaaaaacgtgtacctcaccgttacaaaggaatccggtaactctatagttcttctattcaagatgatctcgactcgggctgcaagtggactgtatagagctatcacggaaacgcatgccttctaccgctgtgacacagtcacaagtgctgtgatgatgcagtattcccgcgatttgaaagggcacttggccagccttttcttaaatgagaatatcaatttgggtaaaaagtacgttttcgacatcaaaagaactagtaaagaggtctatgatcacgccagaagggccctttataacgccggagtggtcgaccttgtcagcaggaacaatcaatcccccagccattcccctctgaaatcatcggaatcttccatgaactgcagttcctgtgaagggctgtcttgccagcagaccagagtcctgcaggagaagcttcggaagcttaaggaggccatgctgtgtatggtgtgttgcgaggaagagatcaattccactttttgcccgtgcggccacacagtctgttgtgagtcatgtgcagcccagcttcagagctgccctgtctgtaggtctcgcgtggagcatgtccagcacgtttatctccccacacacacctcattgctgaacctcaccgtcatttag

SEQ ID NO: 196227 - DNA, 1338 bp, Artificial Sequence
  Description of Artificial Sequence: Synthetic coding sequence
atgctgtgctacgtgacccggcccgacgccgtgctgatggaggtggaagtagaagccaaggcaaacggtgaggactgcctgaaccaagtttgccgtcgccttgggatcatcgaggtggattactttggcctgcagtttacaggctctaagggggagtccctgtggctgaacttgaggaatcgtatttctcaacaaatggatgggctggcaccatataggctcaagttgcgagtaaagttttttgtcgaaccacacctaatccttcaggagcagacaaggcatatattcttcctgcacatcaaggaggctttgttggcaggccatctattgtgctccccagagcaggccgtcgagctctccgcgctcctcgcccagaccaaatttggagactataatcagaacacagcgaagtacaactatgaggaactctgcgctaaggagctgagcagcgcgactttaaattctatcgtggccaagcacaaggagttggagggaacctctcaagcatcagcggaataccaggtcctccaaatcgtttcagccatggaaaactatggaatagaatggcactccgtgcgtgactcagagggccaaaagctattgatcggcgtcgggccggaaggtatttccatttgcaaggatgatttttcccccattaaccggatagcttaccctgtcgtgcagatggcaactcagtctggcaagaatgtgtacctcaccgttacgaaagagagtggtaactccatcgtactgctgttcaagatgatcagcacacgcgccgcgtcggggttgtatcgggctattaccgagactcatgcgttctaccggtgcgacacagttacttctgccgtcatgatgcagtacagcagagatctaaagggccacctggcttctctgtttctcaatgagaatataaacctgggtaagaagtacgtctttgatatcaagcggacttctaaggaggtgtacgatcatgcccgtagagccctctacaacgcaggggtagtggaccttgtgagccgcaacaaccagtcccctagccattccccattaaagagctctgagtccagcatgaactgttcaagctgcgagggattatcttgccagcagacacgagttctccaagagaagctgcgaaagctcaaggaggcgatgctgtgtatggtttgctgtgaagaagaaattaactcgacattttgcccttgtggacacaccgtctgttgtgagagctgcgctgctcaattgcaatcttgtccagtttgccgctcgcgtgtcgagcacgttcagcacgtgtacttgccaacgcacactagccttctcaacctgaccgtgatctag

SEQ ID NO: 196228 - DNA, 5487 bp, Artificial Sequence
  Description of Artificial Sequence: Synthetic coding sequence
atggccgccagcgagctgtacaccaagttcgcccgggtgtggatccccgaccccgaggaggtttggaagagcgcggagctcctgaaagactataaacccggggataaggtgcttttgctgcacctggaggaaggtaaggatttagaataccatttggatccaaagactaaggagctaccccatctaaggaaccctgacatactggtaggggagaatgatctgaccgccctcagctacctgcatgagcccgcggttctgcataacctgagagtcaggtttatcgattctaaactgatctatacctattgcggcatcgttttggtggccatcaatccttatgagcagctccccatttatggcgaagatataattaatgcttattcggggcagaacatgggggatatggatcctcatatcttcgcagtagcagaagaggcgtataaacagatggcaagggatgagcgaaaccagtctattattgtttccggagaaagtggggctggtaagaccgtcagcgctaagtatgctatgcggtactttgccactgtctccggaagtgcgagcgaagctaatgtcgaagaaaaggtcctcgcaagcaacccgatcatggaaagtataggcaatgccaagacaacacgcaacgataactcctcccgcttcggtaagtatattgagattggcttcgataaacgctatcgcattataggcgctaacatgcggacgtacctgctcgaaaaatcacgagtggtgtttcaggcagaggaagagcggaactatcacattttctaccagctctgcgcgagcgccaagctgcctgagtttaagatgctgcgtctggggaatgctgataactttaattacacgaaacagggaggatctcccgtgatagagggcgtggacgacgcaaaggaaatggcgcacacccgccaggcctgtacactcctgggaatatcagaaagtcaccagatgggcatttttcggatcctggcaggtatcctgcacttgggcaatgtagggttcacatctagagatgccgattcctgtacaattccacctaaacacgagccgctctgtattttctgtgagttgatgggggttgactacgaggaaatgtgccactggctatgccaccggaaactggccactgcaactgagacctacattaagccaatttctaagctacaggctaccaacgccagagacgctctggctaagcacatctatgccaagctgttcaattggatcgtggataacgtgaaccaggctctccattctgccgtgaagcaacattctttcatcggggtgttggacatatatgggtttgaaacatttgagattaatagttttgagcagttctgcataaattatgccaacgagaaactgcagcagcagtttaatatgcacgtgtttaagctggaacaggaggagtatatgaaagaacagatcccgtggactctgatagacttttacgacaatcagccgtgtatcaatctgatcgaatccaagctgggaattttggacctcttggatgaggagtgtaagatgcctaaggggacagacgacacctgggctcaaaaattgtacaacacacatttaaacaaatgcgccctcttcgagaaaccccgtctgtctaacaaggcattcataattcagcactttgcagataaagtcgaatatcagtgtgaggggtttctggaaaagaataaagacaccgtgtttgaggagcagatcaaagtactgaaaagttccaaatttaaaatgctgcctgaactcttccaagatgatgagaaggccatatcccctacgagcgctacatctagcggcaggacccctctcacccgcacccccgcgaaacccacaaaggggagacctggacagatggcgaaggagcataaaaagacagtgggccaccagttccgtaatagcctgcatctcttgatggagactctcaacgccaccacgccacattacgtcagatgcataaaacccaatgatttcaaattccctttcacatttgacgagaagcgagctgtacaacagctgagggcctgtggagtgttagagaccattcggatcagcgcggccggctttccctcaaggtggacttaccaggagtttttctcaaggtacagggtactcatgaaacaaaaggacgttttgtcggacagaaagcagacgtgtaagaacgtgttagagaaactcattttggacaaagacaaatatcaattcggtaagaccaaaatcttcttcagggccggccaagtggcttacctcgaaaagctacgcgccgacaaactacgcgctgcttgcattagaatccaaaagacgatacgcggttggctcctaagaaaaaaatacctgcggatgcggaaggctgcgatcacgatgcagcgatatgtccggggatatcaggctagatgctacgctaaatttctacggagaacaaaggcggcaactattatccaaaagtactggcgtatgtacgtggtccgacgacgatataagatccgccgcgccgccaccattgtgctgcagagctacctgagaggcttcctcgcgcgaaaccgctaccggaagattctgcgagaacataaagcagtgatcatccagaagcgcgtacggggatggctagcacgtacccattataaacggagtatgcatgccatcatctacctgcagtgttgcttccggcgcatgatggcaaagagagaattgaagaagctcaagatcgaggccagaagtgtggaaaggtataagaaactacacataggcatggaaaacaagatcatgcaactgcagaggaaggtagatgagcagaacaaggattataagtgtctcgtggaaaagttaactaacctagagggaatctacaacagtgaaacggagaagctgagaagcgacctagagcgtctccaattgtccgaagaggaggccaaggtcgcgacggggcgggtgctcagtctgcaggaagagatcgccaagctcaggaaagatctggagcagacaaggtccgagaagaagtgcatagaggagcatgccgacagatacaaacaagagacagaacaattggtgtccaacttgaaggaggagaacacacttctaaaacaggagaaggaggcccttaatcaccgaatcgttcagcaggccaaggagatgactgagactatggagaagaaactggtggaggagaccaagcagctcgagctcgacctcaacgatgaacgactgaggtaccaaaatctcctcaacgaattctcccggcttgaagaaagatatgacgacctcaaagaggaaatgactttaatggtgcacgtccccaaacctggtcacaaaagaacagacagcactcactcatctaatgagtcagaatatattttctcatccgaaattgccgagatggaggatattccatctcgtacggaagagccttccgagaaaaaagtgcccctcgacatgtcactgttcctaaaactgcagaaaagagtgaccgaactggagcaggagaagcaagtgatgcaagacgagctggataggaaggaagagcaagttctgagaagcaaggctaaggaggaggagcgtccccagatcagaggggcggaactggaatacgagtctctcaagcgacaggagctcgaaagcgagaacaagaaactcaaaaatgagcttaacgagctcaggaaggccctgtctgaaaagtctgcccccgaggtaaccgcaccgggcgcgcccgcttacagagtactaatggagcagctgactagcgtctcagaggaactggatgttagaaaggaagaagtgctgattttacgcagtcagttggtaagccagaaggaggcaatccagcctaaagacgataagaatactatgactgattccaccatcctgctggaggacgtgcagaagatgaaggataaaggagagatcgctcaggcgtacattgggttaaaagaaactaaccgactactggaatcacaactgcagtcccaaaagcggtctcacgaaaatgaggctgaagccctacggggagagatccagtctctgaaagaggaaaataaccgccagcagcagctgctggcacagaacttgcagctgccaccagaggcccgaattgaagcgtcattgcagcacgagatcaccagacttactaatgagaatttggacctgatggaacaactagaaaagcaggataaaacagttaggaagctgaagaagcagctgaaggtatttgcaaagaagataggtgaactagaggtgggacagatggagaacatctcgcctggacagataatcgatgaacctattagacccgtcaatatccccaggaaggagaaagattttcagggaatgctggaatacaagaaggaagacgaacagaaactggttaagaacctaatcctggagctcaagcccagaggggtggcagtgaacctgataccagggttgcctgcctacatcctgttcatgtgcgtacgccacgctgattacctcaacgacgaccagaaggtgagaagtctcttgaccagcacaattaactccattaaaaaagtgctcaagaagcgtggcgacgatttcgagaccgtatcgttttggctcagcaatacgtgtagattcctgcactgcctgaaacaatatagtggagaggaggggttcatgaaacataatactagccgccagaacgagcattgtttaacgaatttcgacctggcagaatatcggcaggtactgtcagatttggcaatccagatctatcagcagctggtaagggtcctagagaatatcctgcagccaatgatcgtttcaggcatgcttgaacatgaaaccatccaaggggtgtctggcgtaaaacccacagggctgcggaagaggactagctcaatcgcagatgaaggcacctacactttggatagtattctgcggcagcttaactcatttcactccgtcatgtgccagcacggtatggatccagagcttataaagcaggtggtgaagcagatgttctatattataggagccattaccctgaataacctgctcctaagaaaggatatgtgcagctggtctaagggcatgcagattcgctataatgtttctcagctggaagagtggcttagggataagaacctgatgaattcaggcgcgaaagagacgcttgaacccttgatccaggcggctcaacttctccaggtgaaaaagaaaactgacgacgatgccgaagctatctgttcaatgtgtaatgccctgacaactgcgcagattgtcaaagtgcttaatctttacacaccagtcaacgagttcgaggaaagagtgtccgtttcctttatcagaacaatccagatgagattacgggatcggaaagacagcccacagttattgatggacgccaaacacatcttccctgtgactttcccgttcaacccatcctcattagctcttgaaacgatccagatccccgcgtctctgggactgggtttcatatctcgggtgtag

SEQ ID NO: 196229 - DNA, 5643 bp, Artificial Sequence
  Description of Artificial Sequence: Synthetic coding sequence
atgaagagcagcagcctggagaccatgttcgcccgggtgtggatccctgatcctgaggaagtgtggaaatctgcagaactccttaaggactacaagcctggtgataaggtgcttctcctccacttggaggagggcaaagatcttgaataccatttggatccaaaaactaaggagctaccgcacctacggaatcctgacatacttgtgggagaaaatgacctgactgccctgtcatatctgcatgaaccagctgttctgcacaacctgcgggttcgcttcatcgactcaaagctgatatatacgtactgcggtatcgtcttggtggctatcaatccatacgaacaattgccaatttatggagaggacatcataaatgcatactctgggcaaaatatgggggacatggatcctcacatttttgcggtagcagaggaggcctataagcagatggctcgggacgaacgtaaccagagtatcatcgtgtctggtgagtctggggcggggaagaccgtgtctgccaagtacgccatgcgctatttcgctacagtcagtggctccgccagtgaagcaaatgtggaggagaaggtcctggcttccaaccctatcatggaaagcataggcaacgcgaaaactactcgcaatgataactcctcccggtttggcaaatacattgagattggctttgataagaggtatcgaatcattggcgccaatatgcgcacctaccttctcgaaaagagcagggtggttttccaggcagaagaggaacggaattatcacatattctaccagctgtgcgcgagcgcaaaactccccgagtttaaaatgctgcgcctgggaaacgcagacaacttcaactacactaagcaggggggatctccagttattgagggagttgatgatgcaaaagagatggcacacacaagacaggcgtgtactctcctggggatcagcgaatcccaccagatggggatcttcagaatcctggcaggcattctacacttgggtaatgttggttttaccagtcgggatgccgacagctgtacgatccctccaaaacatgaacctttatgtatcttctgcgagctcatgggtgtggattacgaggagatgtgccactggctttgtcatcgcaagcttgcgacagccacagaaacatacattaaacctatatccaagctccaggccactaatgcaagagatgccctcgcgaaacatatttacgccaaactgttcaactggattgttgataacgtgaaccaggctctgcactcagccgttaagcagcattcttttatcggcgtgctggacatctatggctttgaaacatttgaaataaacagtttcgaacagttttgcattaattacgcaaacgagaagctacaacagcagttcaacatgcatgtcttcaagttggagcaggaggaatatatgaaggagcaaattccctggacgctcatagacttctacgataaccagccatgcataaaccttatagaatccaaattaggtatcttggacctgctagatgaagagtgtaagatgcccaagggtaccgacgatacctgggcccagaaactgtataacacccacctgaataagtgtgcattgtttgagaaacctaggctgagtaacaaggcttttatcatccagcatttcgctgacaaagtggaatatcaatgtgaaggcttcctggagaaaaacaaagatacagtgttcgaggaacaaattaaagtgctcaaatcaagcaagtttaagatgctgccagaattatttcaggatgacgagaaagctatcagcccaactagtgcaaccagttcagggcggaccccactaacccgaactccagccaagcccaccaagggacgacctggtcaaatggctaaggagcacaaaaagaccgtgggtcaccagttccggaactctttgcacctactgatggaaacactgaacgctactactcctcactacgtccgatgtataaagccaaacgactttaaattcccgttcacctttgacgaaaaacgggcggtccagcagttaagagcttgcggagtcctcgagacaatccggatctctgctgccggattccctagccgctggacttatcaggaatttttctctcgatatcgcgtactgatgaagcagaaggacgtcctgagtgaccgaaagcagacatgcaaaaatgtactggagaagttgattcttgataaagataaataccagtttggtaaaacaaaaattttctttagggctggtcaggtagcctacctggaaaaactccgggcagacaaattgagggcagcttgcatcagaattcagaaaacaatacgcggctggctgctgcgcaaaaaatatcttaggatgcgcaaagccgcaattactatgcagcggtacgtgaggggctaccaggctcggtgctacgccaagttcctccggcgcactaaggctgccacaatcatccagaaatactggcggatgtatgttgttcggcgcagatataaaattcgcagggcagccacaatagttttacagagctatttaaggggatttttagcccgcaaccggtacagaaagatactgcgcgaacacaaggccgtgatcattcaaaaaagagtccggggatggttggcgcgaacacactacaaacgaagcatgcacgctatcatctatttgcagtgctgtttcaggagaatgatggccaaacgcgagttgaaaaagctgaaaatcgaagcgcgtagcgtggaacggtataagaaactccacattggaatggaaaataagattatgcagctgcagaggaaggttgacgaacagaacaaggattacaagtgtcttgtggaaaaactcacaaacttagaaggtatatacaactcagaaactgaaaagctgcgatctgatctggaaagacttcaactctctgaggaggaggccaaagtcgctacagggagagtgttgtccctccaagaggagatcgccaagctgcggaaggatctggaacagacccgatctgagaagaaatgtattgaagagcatgccgatcggtataagcaggaaacagaacagctcgtgtcaaatcttaaggaagaaaacaccctcctgaaacaagagaaggaggccctcaatcacaggatagtccagcaggctaaagagatgaccgagaccatggagaagaaattggtcgaggaaacaaaacagttagagctggacctgaatgatgagcgcctacgttaccaaaacctgctgaatgagtttagcagacttgaggagcggtacgacgacttgaaggaggaaatgaccctgatggtccacgtccccaagccaggccacaagcgcacggacagcacccattcgtcgaacgagtcagaatatattttctcaagtgagattgcagaaatggaagacatccccagccgcacagaggagccaagtgagaagaaagtgcccctggacatgtcactgttccttaagctacagaagcgggtgactgaactggagcaggagaaacaggtgatgcaggatgaactggatcggaaggaggaacaggtgctgagatccaaagctaaggaagaagagagaccccagattcgtggtgccgagcttgagtacgagtcgctgaaacgacaggaactggaaagtgagaataaaaaactgaagaatgaactgaacgagttgcgtaaagccctttcagagaaatcagcccccgaagtcacggcccccggggcccctgcatacagggtcttgatggagcagctcacatccgtgtctgaagagcttgacgtccggaaggaagaagtcttgatactgcggtctcagctggtgagccagaaggaggcaatccagccgaaactgcacgagaacaccatgactgattccacaatcctccttgaggatgttcagaagatgaaagacaagggtgagattgcccaggcctacattgggctgaaagaaactaataggtctagcgcgctggactaccacgagctgaacgaagacggtgaactttggctagtctatgagggcctgaagcaagcaaacaggttgcttgagtctcagctgcagtcacagaaacgcagccacgagaatgaagcagaagctctcaggggagaaattcagtcactgaaggaggaaaacaacagacaacagcaacttctggcgcagaatctgcagctccctccggaagcgaggatcgaagcctctctgcagcatgaaataaccaggttgactaacgaaaatctatatttcgaagagctttacgcagatgacccgaaaaagtaccagtcctatcgaatttctctttataagcgcatgatcgatcttatggagcaattagaaaagcaggacaagacagtgcgcaagcttaaaaagcagttaaaggtgttcgccaaaaagatcggggagctggaggtagggcaaatggagaacattagccccggccagatcattgatgagcccattcggcccgttaatattccgcgaaaggagaaggatttccaggggatgctggagtacaaaaaagaggatgagcaaaagctggtcaagaacctaatcctcgaactgaaacctagaggtgtcgcagtgaacctgatcccgggtctaccagcatatattctgttcatgtgcgtgcggcacgcagattacctcaacgatgatcagaaggtaagatccctgctcacgtctactatcaactctatcaaaaaagtactcaagaagcggggagatgacttcgagacagtaagcttctggttgtctaacacatgcagattcctccattgcctcaagcaatatagtggcgaggagggattcatgaaacataacacatcaaggcagaacgaacactgcttaactaacttcgaccttgccgagtacaggcaggtgctgagtgacttggcgatccaaatatatcagcaactggttagagtactagagaacatcctccagcccatgatcgttagcggaatgctagaacacgagacgatccagggagtttccggagttaagcctacaggcctgcgaaagagaaccagcagcattgccgacgaaggcacctataccctggactcgatcttgcggcagctgaactcctttcactcagtgatgtgccagcacgggatggatcctgaactgataaaacaggttgtgaagcagatgttttacattattggggccattactctgaacaacctgcttcttaggaaggatatgtgtagttggtccaaggggatgcagatccgctataatgtgagccaacttgaggagtggctacgcgataagaatctaatgaattccggggctaaggaaactttggagcccctaatccaggcggcacagctcctccaggtgaagaagaaaaccgatgacgatgccgaggccatatgttcaatgtgtaatgctctgacaactgctcagatagttaaggtgctgaacctgtatacacctgtaaacgaattcgaggagagagttagcgtgtcatttatcaggaccatccagatgcggctgagagacaggaaggactctccacagctgctcatggatgcgaaacatatttttccagtcacctttccttttaacccctcaagccttgctttagagaccattcagatccctgcatctctggggctggggttcatatccagagtgtag

SEQ ID NO: 196230 - DNA, 4089 bp, Artificial Sequence
  Description of Artificial Sequence: Synthetic coding sequence
atgcacgtgttcaagctggagcaggaggagtacatgaaggagcagattccatggactttaattgacttctacgacaaccaaccctgcattaacctcatcgaatccaaactgggcatactggacctgcttgacgaagaatgcaagatgcctaagggcaccgatgatacctgggcccagaaactgtacaacacacacctgaacaaatgtgccttgtttgagaaaccccgactgtccaataaggcctttatcatccaacacttcgccgataaggtcgagtaccagtgtgaagggtttctggagaagaataaagacacagtgttcgaggagcaaatcaaagtgcttaagtccagcaagttcaaaatgcttcccgagctttttcaagacgatgaaaaggcgatctcacccacctctgccaccagttccgggcgtacacctctcacccgcacaccggctaaacccacaaaaggccgccccggccagatggctaaagagcacaagaagacagttggccaccagttccgtaattctctccacctactgatggagactctgaacgctacgactccacattatgtccgctgcataaaacccaatgacttcaaattcccctttacatttgatgaaaagagggccgtacagcagctgcgagcctgcggcgtcctcgaaacaatcagaattagcgccgcagggtttccaagccgctggacgtatcaagaattcttttcacggtaccgggttctgatgaagcagaaggacgtgcttagcgacaggaaacagacctgtaaaaatgtgcttgagaagttaatcctcgacaaggataagtaccagttcggcaaaacgaaaattttttttagggcagggcaggtggcctaccttgagaagttgcgggctgacaagctcagggcagcatgcatacgcattcagaaaacgattcgcggctggctgttacgcaaaaagtacctgagaatgaggaaggcagcaattaccatgcaaagatatgtgcgaggataccaggcccgctgttacgcaaagttcttgcgacggacgaaggccgcgacaatcatacagaaatattggaggatgtacgtggtgcggaggcgatataaaattcggagagcagccacgatagttttgcagtcttatctgcgcggctttctagcaagaaacagatatcggaaaattcttcgcgagcacaaagccgtgatcattcagaagagagtgcgcggctggttggctcggacccattacaagaggtccatgcatgccatcatctatctgcaatgttgtttcagaaggatgatggccaaaagggaattgaagaagctgaaaattgaggcacggtctgtggagcggtataaaaagctccacatcggcatggaaaacaagatcatgcagcttcaaaggaaagtggacgaacagaacaaagattataagtgcctggtggagaagctgaccaatctggaggggatctataacagcgaaactgaaaaactcagatctgacctcgagcgtctccaacttagcgaggaagaggcaaaggtcgctaccgggagagttctctctcttcaggaggaaatagcgaaactccggaaagacctcgagcagacgcggtcggagaaaaagtgtattgaggagcacgcggataggtacaagcaggaaacggagcaactggtatcaaacctaaaggaagagaacactctgctgaagcaggagaaggaagcccttaaccaccgcatagtccaacaagccaaggaaatgaccgagactatggagaagaaactggtcgaagaaaccaagcagctggaactggatctgaacgacgagcgattaaggtaccaaaaccttctgaatgaatttagccgcttggaagaaaggtatgatgaccttaaagaggaaatgacactgatggtgcatgttccaaagccgggccataaacgaacggattcaacacattctagcaacgagtccgaatacatcttctcatcagagattgctgagatggaggacatcccttcaagaactgaggaaccttccgagaagaaagtgcccctggatatgagcctattcctaaaactccaaaaacgggtcaccgagctcgaacaggaaaaacaggttatgcaggacgaactagatagaaaagaggaacaggttctgaggagcaaagcgaaagaggaagaaaggccccagatccgaggcgccgagttggaatatgagagtcttaaaagacaggaactggagagcgagaataagaaacttaagaatgagctgaacgagttgcgcaaggcgctgagtgagaagtctgcccccgaagttaccgcaccaggcgctccagcataccgggtcctcatggagcagctgacgtcagtgtcagaggaactcgacgtaagaaaggaagaggtgctgattctgcgatcgcagctggtgtcgcagaaagaggccatccagcccaaggacgataagaacaccatgacagacagtaccattcttttggaggacgtacaaaaaatgaaggacaagggagaaattgcgcaggcctacatcggactgaaggaaaccaataggctcctagagtcacagctgcaatcccaaaagcgcagccatgagaacgaagccgaagccttgcggggggagatccaatctcttaaagaggagaacaaccgacagcaacagctcctggctcagaatttgcaactgccccctgaggctaggattgaggctagcctacagcatgagataacccgcctgacaaatgagaacctggatctgatggagcaactcgaaaagcaagataagactgtccgcaagcttaagaaacagctcaaagtgttcgccaaaaagatcggcgagctcgaggtgggacagatggagaatatttcccctgggcaaatcatcgatgagcccataaggccagtcaatattcctaggaaggagaaggacttccagggaatgctcgagtacaaaaaggaggatgaacagaagctcgtgaaaaatctcattctcgaactcaagcctagaggggtcgccgttaatctgattcctggactgcccgcctatatcctttttatgtgtgttcgccatgctgactacctaaacgacgatcaaaaggtgcgcagtctgttaacaagcaccattaacagcattaaaaaagttctcaaaaaacggggagacgacttcgaaactgtgtctttctggttaagtaacacctgtcgcttcctgcattgtctgaagcagtattcgggggaagagggctttatgaagcacaacacctcccgccagaatgagcactgtctcaccaacttcgatctcgccgagtacaggcaggtgctgagtgacctggccatccagatatatcagcagctggtgagagtgctcgaaaatatcctgcagcctatgatcgtgtctggaatgttggagcacgagacaatccagggggtatcaggggtgaagccgactggcttaaggaagaggacctcctccattgccgatgaggggacctatactttagactcaatactgaggcaactcaactcattccattccgtgatgtgccagcatggcatggacccagaattgattaagcaggtggtcaagcagatgttttacataattggcgcgataacactaaataacctgctgctgcggaaggacatgtgctcttggagcaagggtatgcagatccgatataatgtgagccagctcgaagaatggctgagagacaagaatttaatgaattctggcgctaaagagactctagaacccctcattcaggccgcccagctgctccaggtcaaaaagaaaacagatgacgatgctgaagctatatgcagcatgtgtaatgccctgactacagcccaaatagtcaaagttctgaacctctacacccccgtcaatgagtttgaggagcgagtgtccgtatcattcatccgcacaattcagatgcgacttcgagaccgcaaagattctccacaactactcatggatgccaagcatatttttccagtcaccttccctttcaacccgtctagcttggctctcgagacaatacagattcctgcttcgttgggcctcgggtttatctcacgggtctag

SEQ ID NO: 196231 - DNA, 5568 bp, Artificial Sequence
  Description of Artificial Sequence: Synthetic coding sequence
atggccgccagcgagctgtacaccaagttcgcccgggtgtggatccccgatcccgaagaagtttggaaaagtgccgagctcctgaaggattacaagccaggagataaggttctactactgcatcttgaagagggtaaagacctcgaatatcatctggatcctaaaactaaggagttgcctcatctccggaatccggatattctcgtgggcgaaaacgaccttacagccctctcttacttacacgagccagcggtgctgcacaacctccgggtccgcttcattgattctaaacttatttacacgtactgcggtatcgtgctcgtggccatcaacccgtatgagcagctcccaatttacggggaagatataattaatgcttactccggacagaacatgggcgacatggacccccatatctttgccgttgccgaggaggcgtacaaacagatggcccgtgatgagcgcaatcagtctatcattgtctccggagagtcaggagctggcaagacagtaagcgccaaatacgcaatgcgctactttgcgaccgtttctggaagtgccagcgaggctaatgtcgaagagaaagtcctggcatccaacccgataatggagagtatagggaacgcaaaaaccacgagaaatgacaattcctcccggtttggcaagtacattgagatcggctttgataagcggtaccggattattggtgccaatatgaggacttatctgcttgaaaagtctcgggtggtgtttcaagcagaggaggagcggaattaccacattttctatcagctctgtgcgtccgctaagctccctgaatttaagatgttgcgtctggggaatgcagacaactttaattatacgaaacagggtggcagccccgtaatagagggggttgatgatgccaaggagatggcacacacccgtcaggcctgtacattgctagggatctccgagagccatcagatggggatattccgaatcctggcaggcattctgcatcttgggaatgtggggttcacctcacgcgatgcagacagttgtactatcccccccaaacacgagcccctgtgtattttctgtgaactgatgggggttgattacgaagagatgtgccactggctctgtcaccgaaaactggcaactgccactgagacatacatcaagccgatctccaagcttcaggcgaccaatgcccgggacgctctcgccaagcacatctacgccaaactatttaattggatagtggataacgtcaaccaagcccttcatagcgccgtgaagcagcattccttcattggggtgcttgacatatatggcttcgagacctttgagatcaacagcttcgagcagttttgtatcaactatgccaatgagaaactgcagcagcagtttaacatgcacgtgtttaaactggagcaggaggaatatatgaaggagcagataccgtggacactgattgacttctacgataatcagccttgcataaaccttatagagtccaagttgggaatacttgatctgcttgacgaggaatgtaagatgccaaaggggacggacgatacgtgggcacagaaactgtataatacccatcttaataagtgcgcgctgtttgagaagccaagactgagtaacaaagccttcataatccagcacttcgcggataaggttgagtaccagtgtgaaggctttcttgagaaaaataaagacactgtgtttgaggagcagatcaaagtcctgaagtctagtaagtttaagatgctacctgagctattccaggatgatgaaaaggccatcagccccacttcagccactagttccgggcgtacgccattgactcgtacaccagccaaacctacaaaagggcgtcctggccagatggcgaaggagcataagaagacggtggggcaccagtttcggaattccctacacctcttgatggaaacactcaatgccaccacacctcattacgtgagatgcattaaacccaacgactttaagtttccttttaccttcgatgagaagcgggctgtccagcaactgagagcatgcggcgtgctagagaccatacggatatccgctgccggcttcccatctaggtggacatatcaggagttcttctcgaggtatagagtcctcatgaagcagaaggacgtgctgtccgacagaaaacaaacctgcaagaacgtactggaaaagctcatcctcgacaaggacaagtatcagtttggcaagaccaaaatcttctttcgcgccgggcaggtcgcttatctggaaaagctgcgggcagataaactacgagccgcctgcattagaattcagaaaacgatcagaggatggctcttaaggaaaaagtatttgaggatgcgcaaagccgccattacgatgcaaaggtatgtgagggggtatcaggcacgttgctatgcgaaatttctgcggagaacaaaagccgcaactataattcagaagtattggaggatgtacgttgtgcggcgccggtataagattagacgcgccgctactattgtattacagtcctacctccgtggctttttggcacggaataggtaccgcaagattctccgtgaacacaaagcagtgatcattcagaaacgggttaggggttggttagcaagaacacactacaagcggtctatgcatgcaattatttatctgcagtgctgcttcaggaggatgatggccaagcgggaacttaagaaattaaaaatagaggctaggtctgtcgagcgctacaagaagctgcacatcgggatggagaataaaatcatgcagttgcaaagaaaagtcgacgaacagaataaggattacaagtgcctagtcgagaaactcactaacttggaggggatttacaactctgaaactgagaagcttcgttcggatttggagcgcctacagctgtctgaagaggaagcaaaagtagctactgggagggtactctcgctccaggaagagattgcaaagttgcggaaagacctcgagcagaccaggtcggaaaaaaaatgcatcgaggagcatgctgatagatataaacaggaaacagaacagctcgtttctaatttaaaggaagaaaacacactacttaagcaggagaaggaggcgttgaatcaccgcatcgtccaacaggctaaggagatgaccgagacaatggagaaaaagctcgtggaagagaccaagcaattggagctagatttgaacgacgaacgcctgaggtaccagaatctcctgaatgagtttagccgcttggaagaacgatacgacgacctaaaagaggagatgaccctcatggttcatgtccccaaacctgggcacaaacgaactgacagtacacactcttccaacgaatcggagtacattttcagcagcgagatcgccgaaatggaggacataccgtctagaaccgaggagccttctgaaaagaaggtccccctggatatgtccctgtttctgaaacttcagaaaagggtgaccgagctggaacaagagaaacaggtgatgcaggacgagcttgaccgcaaggaagaacaagtgctaaggtcaaaggcaaaagaagaggagaggcctcagatcaggggcgctgagctggagtatgaaagcctgaaaagacaagaactcgaaagcgaaaacaagaagctaaaaaacgagctgaacgaactgcgcaaagccctttctgaaaaaagtgctcccgaggttaccgcgcctggcgctccagcctatcgggtgctgatggaacagcttaccagtgtgtcagaggaattggatgttagaaaggaagaggtgctcatactgcgctcgcagttggtcagtcagaaggaggctattcagcccaaggacgataagaacacaatgaccgattctactatcctgttggaggacgtacaaaaaatgaaggacaagggagagattgctcaggcatatatcggactgaaggaaaccaatcgatcttccgccctggactatcacgaactgaacgaggatggagaactgtggctcgtgtacgaggggctgaaacaagctaatcggctcctcgaatcacaactgcagtctcaaaaaaggagtcatgagaacgaggctgaggctcttaggggcgaaatacagtccttaaaggaggagaacaacaggcagcagcagctgctagcccaaaatctgcaactgccacccgaagccagaatcgaagcttcgctgcagcatgagatcacgcgcctaactaatgaaaatctggacctgatggagcaattagaaaaacaggacaagaccgtacggaagctgaaaaaacagctaaaggtttttgctaagaagattggcgagctcgaggttggacagatggagaatatttccccagggcagatcattgatgaacctatccgtccggtgaacatcccacggaaggaaaaagattttcagggaatgcttgagtacaagaaagaagacgaacagaaactggtgaagaacctgattttggaattgaagcctcgtggagtggcggtcaacttgatccctggcctgccagcctatattctgtttatgtgcgtccggcacgcagattatctgaatgatgaccaaaaagtacgcagccttctgacatcgactatcaactctatcaaaaaggtgctcaaaaagcgcggcgacgattttgagactgtctctttttggctgagcaacacctgtagattcttgcactgcctcaagcagtactccggcgaggaaggcttcatgaagcacaatacatcccgacagaacgagcactgcctcacaaacttcgatttagcagaatatagacaggtgctgtcagatctggcgatccagatctatcagcaacttgttagggtgctcgagaacatccttcagccgatgatagtcagtggtatgctggagcacgaaacgattcagggagtgagtggcgtcaagcctactgggcttagaaagagaacctctagcattgctgacgaaggtacttatacactcgactctattctgaggcagctgaattcctttcacagcgtgatgtgccagcatggtatggatcctgaactgatcaagcaggtagtgaagcagatgttctatattattggggctataactctgaacaacttgctccttcggaaggacatgtgctcttggtctaaaggaatgcagattcgatataatgtgagtcaactggaggaatggctgagggataagaacctaatgaactctggagccaaggaaacacttgaaccccttattcaggccgctcagctgcttcaggttaagaagaagactgacgacgatgcggaagcaatctgctctatgtgtaacgccttaacgacggcccagatcgtgaaagtgctgaatctgtacactcccgtcaatgaatttgaggaacgggtcagcgtctcatttatacgtactatacagatgagattgcgggaccgcaaggattccccgcagctccttatggacgccaaacacatttttcctgtcacattcccgttcaaccccagttctctggctctggaaaccattcagatccctgcgagcctgggactcggctttatctctagggtatag

SEQ ID NO: 196232 - DNA, 5559 bp, Artificial Sequence
  Description of Artificial Sequence: Synthetic coding sequence
atggccgccagcgagctgtacaccaagttcgcccgggtgtggatcccagatccagaagaggtgtggaagtctgcggagctgcttaaagactacaaacccggggacaaggtcttgttgttgcatctggaggagggcaaggacctcgaatatcacctggatcctaaaaccaaagagctgcctcatctgcggaaccccgatatactggttggcgagaatgacctgaccgcactctcttatttacacgagcccgctgtgctgcacaatctgagggtgcgatttattgacagcaagttgatttacacctattgtgggatcgtcctcgtggctattaatccctacgaacaattgccaatctacggggaggacattattaacgcctactctggccagaacatgggcgatatggacccccatatctttgccgtcgcagaggaggcatataaacagatggcccgagacgaaagaaaccagtccatcatcgtgtctggcgagtccggcgccggcaaaaccgtctctgcgaagtacgcgatgagatacttcgcaaccgtctccggatcagcatctgaagctaacgtcgaggaaaaggtacttgcttctaacccgattatggagtcaatcggtaacgccaaaacgacacgaaatgacaattcatcgcgctttggtaagtatatcgaaataggctttgacaaacgctatcgaattatcggcgccaatatgcggacttacctgcttgaaaaatctcgcgtggtcttccaggctgaagaggaacggaactatcacatcttctatcagctgtgtgcttcagctaagctccctgagtttaagatgctgcggttaggaaatgcggacaattttaattacaccaagcaaggcggctcccccgtgatagagggggtggatgacgctaaggaaatggcacacacaagacaagcctgtacgctcctgggaatctccgaatctcaccagatgggcatctttagaattctggctggcatcctccacctggggaacgtcggtttcacttccagggacgctgattcgtgcaccatccccccaaaacacgagcccctgtgtattttctgcgaattaatgggtgtcgactatgaggagatgtgtcattggctatgtcaccgcaaactggcaacagctacagagacatacatcaaacccatctctaaactccaagccactaacgcaagggatgcactcgcaaagcatatctacgccaagctttttaactggattgtggacaacgtgaaccaggccctgcactctgcggtgaaacagcattcttttataggagtactcgacatttacgggttcgagacttttgaaattaattctttcgagcagttctgcatcaattacgctaacgagaagctgcagcaacagtttaatatgcatgtgttcaagctggaacaggaagaatacatgaaggaacagatcccatggacactgatagatttctacgataatcagccatgcattaatcttatcgaatcaaaacttggcatccttgacctcctcgatgaggaatgtaagatgccaaaggggaccgacgacacatgggcgcagaaactttacaatacccatctaaacaaatgtgccctattcgagaagcctcggctgtccaataaagcttttattattcagcatttcgcagacaaggtcgagtatcagtgtgaggggttcttagaaaagaataaagacactgtgttcgaggagcagatcaaggttctcaagtcaagtaaattcaagatgctgcccgagctgttccaggacgacgagaaagcgatttctccgaccagtgctacatcatctggcaggacccccttgactcgcacacccgcgaagccaaccaagggccgcccaggccaaatggccaaggagcacaaaaaaaccgtcgggcaccagttcaggaatagtttacatctgctgatggaaaccctgaatgccaccacccctcactacgtgcggtgcatcaaacctaacgacttcaagtttccctttacattcgatgagaagcgcgctgtgcaacaattacgggcctgtggcgtgcttgagacaatcaggatctctgccgctggttttccttctcgctggacttatcaagaattttttagtagatatagggtccttatgaagcagaaggatgtgctgtctgatagaaaacaaacttgtaaaaacgtgcttgagaagctgattttggacaaagataagtatcagtttgggaaaacgaaaattttctttcgcgcaggccaagtggcatacctcgagaagctgagagccgacaagttgagggcagcatgcatcaggatccagaagactataaggggttggctcctgcggaagaaatacctgaggatgcggaaggcggcaattaccatgcagagatacgtaagagggtaccaggcgagatgctacgccaagtttctgaggagaacaaaggctgccacaatcatccagaaatactggaggatgtatgttgtgcgcagacgatataaaattcggagggccgccactattgtcctccaaagttaccttcggggattcctggcccgtaatagatatcgcaagatactccgggaacacaaggccgtgattatccagaagcgggtacgcggttggcttgcaagaactcactacaagcgtagtatgcatgctatcatttaccttcagtgttgtttccgcaggatgatggccaagcgcgaactaaagaagctgaagatcgaggcacggtctgtggagaggtacaaaaaactgcacattggtatggagaataaaatcatgcagctacagagaaaggtcgacgaacagaacaaggattataagtgcctcgtggagaagctgacaaatctggagggaatctataattctgagaccgagaagcttaggagcgatctggagagactgcaattgtccgaggaagaggccaaggtggcgaccggtagagttttatccctgcaggaggaaatcgcaaagctgaggaaagatctggaacagaccaggtcggaaaaaaaatgtatagaagagcatgccgatcgctacaagcaggaaacagagcagcttgtcagcaatctcaaagaggaaaacacactccttaaacaggagaaagaagcacttaaccaccggatcgtccaacaggctaaggaaatgaccgagacaatggagaaaaaactggttgaggaaacaaaacagttagagttggacctgaacgatgagagacttcgctatcaaaacctgctcaatgaatttagtcgactggaggagcggtatgacgatctgaaggaagagatgaccctgatggtccatgtcccgaaacccggtcataaaaggactgacagtactcatagcagcaatgagagtgaatacattttctcttctgagatcgccgaaatggaagatatcccttcacggacagaggagccctccgaaaaaaaggtgccgctggacatgagtctttttctgaagctgcaaaaacgagtaactgagttggagcaggaaaaacaggtgatgcaggacgagttggaccgaaaagaagagcaggtgctgagatcaaaagccaaggaggaagagagaccccagattaggggtgccgagcttgaatacgagtctctgaaaagacaggaactcgagagtgagaacaagaagctgaagaacgagctgaatgagctgcgaaaggccctcagtgagaaatcggctcccgaggtgacagccccaggagctccagcgtacagagtgctgatggaacagctaacatccgtcagtgaggagctggacgtgcggaaagaggaggtgttgattcttcgctcccagctggtttctcagaaggaagctatccagccgaaaaataccatgactgactccactattttgctggaagacgtgcaaaagatgaaggataaaggggaaattgcccaggcttatatcggactcaaagagaccaatcgatccagcgccctggactatcacgagctcaacgaggacggggagctctggttagtgtacgaggggctcaagcaggcaaatcgactgttggagtcgcaattgcaaagccaaaagagaagccatgaaaatgaggcagaagcgcttcggggtgagattcagtctctgaaggaagagaataatcgacaacagcagcttctggctcaaaatctgcagcttcccccagaggccaggattgaagcatcactccaacatgaaattacacgcctgacaaatgaaaacttggacctaatggagcagctcgaaaagcaggacaaaactgtacggaaacttaaaaagcagttgaaagtcttcgcaaaaaagattggtgagcttgaggtggggcagatggagaatatcagccctggtcagataattgatgaacccatccggccagtgaatataccacggaaagagaaagatttccagggaatgctcgaatacaagaaagaagacgagcaaaagctcgttaagaatctgatcctggagttgaaaccaaggggcgtcgctgtgaatctgatacctggcctccctgcgtatatcttgttcatgtgcgtacgccatgctgattacctgaacgatgatcagaaggtacggagcctccttacctcaaccatcaatagtatcaaaaaagtgctgaaaaagaggggcgatgactttgagaccgtgagtttttggctgagtaacacctgtcggtttctgcattgtttgaagcaatattctggggaagagggatttatgaaacacaatactagcagacagaatgaacattgcttaaccaacttcgatcttgccgagtatcgacaggtcctctctgatctggccattcagatataccaacaactagtccgcgtgctcgagaacatcctgcagcccatgattgtgtccgggatgctggaacacgagaccatacagggcgtgtccggggttaagcctacggggctcaggaagcgcacgagcagtattgccgatgaaggcacctacacactagattcaattcttaggcagttaaactcattccattccgtgatgtgccagcacggcatggatccggagctcatcaagcaagtcgtgaagcaaatgttctatataatcggcgcaataacactcaataacctgctcctgagaaaggacatgtgctcatggagtaaagggatgcagatacgatataatgtctcccagttagaggagtggctccgggataagaatctgatgaatagcggcgccaaagagacacttgagcctcttatccaagccgcccagctgcttcaagtaaaaaaaaaaactgacgatgatgccgaagctatatgctctatgtgtaacgctctgacaactgctcagatagtgaaagtactcaacttatacacacccgtaaacgagttcgaggagagagtttccgtgagcttcatccgcactattcagatgcggctgcgcgaccgcaaggattctcctcagctgttgatggatgccaaacatatttttcccgtgactttcccgttcaatcctagttccctggccctcgagacaattcagattccagcatcactcgggcttggtttcatcagtcgggtgtag

SEQ ID NO: 196233 - DNA, 4377 bp, Artificial Sequence
  Description of Artificial Sequence: Synthetic coding sequence
atgtgccactggctgtgccaccggaagctggccaccgccaccgagacgtacataaaacctatcagcaagctgcaggccacaaatgctcgagatgcgttggcaaagcatatctacgccaagctgtttaattggatcgttgacaatgtcaatcaagcactccattccgccgtcaaacagcattcctttatcggggtgctggacatttatggctttgagacattcgagataaacagcttcgaacagttttgcatcaattacgccaatgagaaattacagcagcagttcaacatgcacgtttttaaactggagcaagaggaatatatgaaggaacagatcccctggacactgattgacttctacgacaatcaaccatgcatcaacctaatcgaaagcaagctgggcatcttggacttgttggacgaggagtgcaagatgccaaagggcactgacgacacttgggcgcagaaactctataacacccacttgaacaaatgtgccttgtttgagaagcccaggttatcaaacaaggcctttattattcagcactttgctgacaaggtggagtatcagtgtgaagggttccttgagaagaacaaagatacagtgttcgaggaacagattaaagttcttaaaagctctaagttcaaaatgcttcccgagctgttccaggacgatgaaaaggccatctcacctactagcgccacaagcagcggccgtacccctctgactcgaacccccgcaaaacctaccaaaggaagacccggacagatggctaaggaacataaaaaaacagtggggcatcaatttcggaactccctccacttattaatggaaacattgaatgccaccaccccccactatgtgcggtgcataaagcccaacgacttcaaattccccttcacatttgacgagaagagggccgttcagcagctgcgagcatgcggagttttggagacaattaggatcagtgctgcagggtttccctcacgttggacgtaccaggagttcttctctaggtatcgcgtactgatgaaacagaaggacgtcctgtccgacagaaagcagacatgtaaaaatgttttggagaagctgatcctggacaaggacaagtatcagttcggcaagacaaagatattcttccgagccggacaggtggcatacctggaaaagctccgcgccgacaagctacgcgccgcctgtatccgcatccagaaaaccatccgcggatggctgctccgcaagaaatatctgcggatgagaaaggcagctatcaccatgcagaggtacgtcagaggataccaagcgcgttgctacgcaaagttcctgcgccggaccaaagctgcaacaattatccagaaatattggagaatgtacgtcgtgaggaggagatataaaattaggagggccgctaccatcgtgctgcagtcctacctacgtggctttttggctagaaacagataccggaaaattttgcgcgaacacaaagccgttatcatccagaaacgcgtcagaggctggctagctagaactcactataaacggtccatgcacgccataatttacctgcagtgttgctttcggcggatgatggccaaaagagagcttaaaaagctgaagattgaggctaggagtgtggagagatacaaaaagttacacattggaatggaaaacaagataatgcagctccagcgtaaagtcgacgagcagaataaagactacaaatgcctcgtggagaagctcactaatttagagggcatttataactctgaaacagaaaagctgcgtagcgacctggagagacttcagctgtcagaggaagaggcgaaggttgcgactggtagagtgttatctttgcaggaagagatcgcgaaactcagaaaagatctcgagcagacacgaagtgagaaaaaatgcattgaagaacatgcagatagatacaaacaggagaccgaacagctcgtctctaatctgaaggaagagaacactctcctcaagcaggagaaggaggcactcaatcaccgcatcgtccagcaggcaaaagagatgaccgagacgatggagaagaagttagtggaagaaactaaacagcttgagctcgatcttaatgatgaacgactccgctaccagaacctgcttaatgagttctcccgcctggaggagagatatgacgatctcaaggaggaaatgaccctgatggtccatgttccgaagccagggcacaagcggacggacagcactcactcatccaacgagtccgagtatattttctcttctgagatcgccgagatggaggatattccctcacgcacggaagagcccagtgagaaaaaggtacctctagatatgtccctctttctgaagctgcagaagcgggtgaccgagttggaacaagaaaaacaggttatgcaggacgagctggaccggaaagaggaacaagtgctgaggagcaaggcaaaagaagaggaacgccctcaaatccgtggggccgagctggaatacgagtctctgaagagacaggaactggagtcggagaacaagaagttgaagaatgagcttaatgaacttcggaaggcacttagcgaaaaatctgctccagaagtaaccgccccgggtgcgccagcctaccgcgtactcatggagcagctaacctcagtcagcgaagagctggacgtgaggaaagaggaggtgctgattttgaggagtcaacttgtaagccagaaggaagctattcaaccaaaactgcatgaaaacacaatgaccgattccactatcctcttagaagacgtgcagaaaatgaaagacaagggagaaattgctcaagcatatatcgggctcaaagagacaaacagattgcttgagtctcagttacagagccagaaacgctcacacgagaacgaggcagaggcccttcgtggagagattcagagcctgaaggaggagaataacagacagcagcaactgctggcgcagaacctccagctgccaccggaagctcgaattgaagcctccctccagcacgagattactaggcttaccaacgagaaccttgacctgatggaacagctggagaaacaggacaaaaccgtgcgcaaacttaaaaaacagcttaaagtcttcgccaagaagatcggggagttggaagttgggcagatggaaaacatcagtcccggccagataatagacgagccaataagacctgtgaatattcctcgaaaagagaaggatttccagggcatgctcgaatacaagaaagaggatgaacaaaaactggttaaaaacctcatcctcgagctaaaacctcggggtgtggcggtaaaccttatcccaggactgcccgcctacatcctgttcatgtgcgtgcggcatgccgactacttgaacgatgatcaaaaggtccggtccctgctcacttcaactattaactcaatcaaaaaggtcctaaagaagcggggagacgacttcgagaccgtgtccttttggctgtcaaatacatgccggttcctacactgcctcaagcagtacagtggtgaggaggggttcatgaaacataacacttctcgtcagaatgagcactgcctgaccaatttcgatctggccgagtatagacaggttctgagcgatctcgctattcagatctatcaacagctggtacgggtgctggagaatatccttcaacccatgatagtttccggtatgttagaacatgagactatccagggcgtttctggagtgaaaccaactggtctacgcaagcggactagttcaatagcagacgaaggaacttatactcttgactctatccttagacaactgaattcctttcatagcgttatgtgccagcatggtatggatcctgaactgattaaacaggtcgtgaagcagatgttttatattatcggggcaatcacactgaataacttgcttttgcgcaaggatatgtgtagctggagcaaaggcatgcagatacgctataatgtatcacagctagaggagtggctgcgcgacaaaaaccttatgaattcaggcgcaaaagagacattggaacccctgatccaggccgctcagcttctgcaggtcaaaaaaaagaccgacgacgacgccgaggccatttgttccatgtgtaatgccctcacaactgctcagattgttaaggtccttaacctttacacccctgtaaatgaattcgaggagcgtgtgagcgtctcctttattagaacaatccaaatgagactgcgggatcgcaaggacagccctcagttgttaatggacgcgaagcatatatttccagtgaccttcccctttaatccctcatccctcgctttagagaccattcagattcctgcctccttaggtctgggcttcatttcacgagtgtag

SEQ ID NO: 196234 - DNA, 5562 bp, Artificial Sequence
  Description of Artificial Sequence: Synthetic coding sequence
atggccgccagcgagctgtacaccaagttcgcccgggtgtggatccctgatcctgaggaggtgtggaaatcagctgagcttttaaaagattacaaaccaggggacaaagtgctgctacttcacctggaggagggaaaggacctggaataccacctggacccgaagacaaaagagctgccacacttacggaaccctgacatcttggttggggaaaatgacctaaccgccctcagttacctgcacgagcctgcggtcctgcacaatcttagggtacgcttcatcgattcaaagctcatttacacgtattgtggaattgtgcttgtggctattaatccatacgagcaacttccaatctacggtgaagacatcatcaacgcctatagtggacagaatatgggagatatggacccccatatattcgcagtggctgaagaggcttacaagcaaatggcccgggatgagaggaatcagtccattatagtttcaggcgagagcggcgctggcaaaacggtgagcgccaagtatgcaatgagatacttcgctacagtcagtggatcggcatctgaggctaatgttgaggagaaagtcctggcatctaacccgattatggagtctatcggtaatgcaaaaaccacccgtaatgacaattcttcacgttttgggaagtatattgaaatcgggtttgataaacgatacagaataattggagctaatatgcgcacttacctgctggagaaaagccgcgtagtgtttcaggctgaggaagagcggaattaccacatcttctatcaactctgcgcgagtgcgaagcttccagagttcaaaatgctgcgactgggaaatgcagataacttcaattacactaagcaaggaggaagccctgtcatcgagggcgtggatgacgccaaggaaatggcgcacactcggcaggcttgtactctccttggtatttctgagtctcaccaaatggggatattcagaatcctcgcaggaatcctgcatctcggaaatgtaggcttcacttctcgggatgctgattcgtgtaccattccacccaaacacgaaccactctgcattttctgcgagcttatgggcgtggactacgaagaaatgtgccactggctgtgccacaggaagctcgcaaccgccaccgagacatatatcaagcctatctctaagcttcaggccacgaatgcgagggacgcattggcaaaacacatttacgctaagctgtttaactggattgttgacaacgtgaatcaggccctacatagtgccgttaagcagcacagctttataggagtccttgatatttatggtttcgaaacgttcgaaatcaattcatttgagcagttctgtatcaactacgcgaacgagaagctgcagcagcagttcaacatgcatgttttcaagctcgagcaggaggaatacatgaaagagcaaataccctggacactgatagacttctatgataaccaaccatgcatcaacctgatcgagagcaagctaggcatcctggatcttctcgacgaagagtgtaagatgccgaaggggacagacgatacatgggcccagaaattatataatacacatcttaacaaatgcgccctattcgaaaagcctcggttgtcaaataaggcctttataatccaacattttgccgacaaggtggaatatcaatgcgagggtttcctcgagaagaacaaggatacagtctttgaagaacagattaaggtgctgaagtcatccaaatttaaaatgttacccgaactgttccaggatgacgagaaagcaatttcccccacctctgctacaagctccggccgcacaccgttgacccgtacccccgccaagcccactaaaggtagacctgggcaaatggcaaaagaacacaaaaaaacagtggggcaccagttccgcaacagcctgcacttgttgatggagacgctaaacgccaccacaccccattatgtgaggtgcattaaacccaatgattttaagtttccgttcaccttcgacgagaagcgcgccgtccaacagcttagagcatgtggcgtgctcgagactatacggattagtgctgccgggtttccgtcccggtggacataccaggaattcttcagtagatacagggtcctcatgaagcagaaagacgtccttagcgacagaaaacagacatgcaaaaacgttttggaaaaacttatcctagataaagacaagtaccagtttgggaagaccaagatctttttcagagctggtcaagtggcttacctagagaagctgcgagccgacaagcttagggcggcctgtataaggattcaaaaaacgatcagaggctggctactgcggaagaagtacctgaggatgcgtaaggccgcaataactatgcaaaggtacgtccgagggtatcaggccagatgctacgccaaatttttaagaagaactaaagcagccacaattatccagaaatactggagaatgtacgttgtcagaaggcgttataaaattcgacgggccgccaccatcgtactgcagtcttacctgagggggtttctcgcgcggaataggtacaggaagatactccgggagcacaaagccgtcattattcaaaaacgcgtgcgcggctggctagcgaggacccactataaacgcagcatgcatgccattatttacctccagtgctgttttcggagaatgatggcgaaaagggaactgaagaaactcaaaatcgaggccaggtcggtggaaagatataaaaaattacacatcgggatggaaaacaagatcatgcaactgcagcggaaggttgacgagcagaacaaggactataaatgcctggttgagaaactgaccaacttggagggcatttataacagcgaaaccgaaaaactccggtccgatctggagcggcttcagctttcagaggaagaagccaaagttgccacaggaagggtgcttagcttacaagaggaaatcgctaagctgcgcaaggatcttgagcagaccaggtctgagaagaagtgtatcgaggagcacgcagaccgctataagcaagaaacagagcagctggtctcaaatctgaaggaggagaacacactgctgaaacaggaaaaggaggcattgaatcatcgtattgtccagcaggcaaaagaaatgaccgagacaatggagaaaaagttggttgaggagaccaaacagttggagctggatctgaacgacgaaagacttcgctatcagaatctactgaacgaattcagcagactcgaagagcggtatgacgatttaaaagaagagatgaccctgatggtgcacgtgccgaagcctggacataaacgcaccgactccactcatagcagcaacgagtctgagtacatatttagtagcgaaatcgcggaaatggaagatattccaagccgcacagaagaaccatcggaaaaaaaagtcccgctggatatgtctctgtttctgaagttacaaaagcgggttaccgaacttgagcaggaaaagcaggtgatgcaggacgaactggatcgcaaagaagagcaagtgctgagaagtaaagcaaaggaagaggagaggcctcagatcaggggagctgaactcgagtatgagagcctgaaacggcaggaattagagagcgaaaataagaagctaaagaacgaactaaatgagctgcggaaggccctgtctgaaaagtctgctcctgaggtcacggcccccggagccccagcgtacagagttttgatggagcagttaacttcagtatctgaggaacttgacgtgcgcaaagaagaggtcctgattctgcgctcccagctcgtgtctcagaaggaagctattcagccgaaagacgataagaacacaatgaccgacagtacaatattgttggaagacgtgcagaagatgaaggataagggtgagatagcgcaggcgtatatcggcttaaaggaaaccaatagactgttggaaagccagcttcagagccagaagagatctcatgagaatgaagccgaagccctgcgcggtgaaatccagtctttaaaggaggagaacaatagacagcagcagttgctggcccagaatctccagttgcctccggaagcccgtatcgaagcaagcctccagcacgaaataacacgattaacaaatgagaacctgtacttcgaggaactgtatgcagacgatcccaagaagtaccagtcctatcgaattagcctgtacaaacgtatgatagacctgatggagcaactggaaaagcaggataaaacggtaaggaagctgaagaagcagctgaaggtcttcgctaagaagattggtgagttagaggttgggcagatggaaaatatctctccaggccaaatcattgacgaacctatccgacctgtcaacatcccgaggaaggagaaggacttccaagggatgttagaatataagaaagaagacgagcagaagctggttaagaacctgattttagagctgaagccccgaggagtagcggttaatcttatcccaggcttgcccgcctatatcctgttcatgtgtgttcgccatgccgactaccttaatgacgatcaaaaggtgaggtccctcctgacttcaacaattaactccattaagaaagtacttaagaaacggggggacgacttcgaaaccgtgtcattttggctgagtaatacctgccggtttctccattgcttaaaacagtactccggtgaggagggctttatgaagcataacaccagccgacagaatgagcactgtctgacgaatttcgatctggccgaataccgacaggtgctgagcgacctagcaattcaaatttaccagcagcttgtccgggtgttggagaacattctgcaacccatgattgtgagtggcatgcttgagcatgaaacaatccagggcgtgtccggcgtgaagcccactggcctgcgaaagcgtacctcgtcaatcgctgacgaggggacatataccctcgattcaatcctgagacaattgaactctttccactctgtaatgtgtcaacacggtatggaccccgagttaatcaaacaagtagtgaagcagatgttctacatcatcggcgctattaccctaaacaatttgctgctgaggaaggatatgtgcagctggtcaaaggggatgcagattaggtataacgtgtctcagctcgaggagtggttaagggacaagaatctgatgaacagtggggcaaaagagaccctggagcccttgatccaggcagcacagctgctgcaggtcaagaagaagaccgacgacgacgctgaggctatttgcagcatgtgtaacgccctcaccactgcccagatagtcaaggttctgaacctgtacacaccggtgaatgagttcgaggaacgggtctccgtgagcttcatcagaaccatccaaatgcggctacgagataggaaagattccccgcagcttttaatggatgccaagcacatcttccctgtcaccttcccatttaacccgtctagcctcgcgttagagaccattcagatcccagcatctctgggtctgggctttatctcccgggtgtag

SEQ ID NO: 196235 - DNA, 5547 bp, Artificial Sequence
  Description of Artificial Sequence: Synthetic coding sequence
atgagcgtgggcgagctgtacagccagtgcacccgggtgtggatccccgacccagacgaggtgtggcggtctgccgagctgaccaaggattacaaggagggagataagtcattgcaactgagactggaagatgagaccattctggagtatcctatagatgtccagcgcaaccaactcccatttctccgtaacccagatattctggtcggcgagaatgacctaactgctctgtcctatctgcatgagccggcagtactgcataatctcaaagttcggtttctggagtccaatcacatttacacctattgcggtatagtgcttgtggctattaatccatacgaacagttgcctatctatggccaggacgtcatctacacctactccggacagaatatgggtgacatggacccgcacatattcgccgtagcagaagaggcatacaaacaaatggctagggacgagaaaaatcagagcattatcgtgagcggagagagtggtgctggaaaaaccgtgagcgcaaaatacgccatgagatacttcgccaccgtgggcggcagtgctagcgaaaccaatatcgaggaaaaagtgctggccagttcacctatcatggaagcgatcggaaatgctaagaccacccgcaatgataacagctctcgctttgggaagtacattcagatcggctttgacaagagataccacataatcggcgctaacatgagaacttatctgctggagaagagcagggttgtctttcaagccgatgatgagcgaaattatcacattttctaccaactgtgcgctgctgctggcctccccgagtttaaggagttggcactgacttctgcagaagactttttctacacttcacagggcggggacacttcgatagagggtgtcgacgatgccgaagacttcgaaaagacccggcaggcttttacactgctgggtgtgaaagagagtcatcaaatgtccatattcaagatcatcgcatccattttacacctgggttctgtggcgattcaggcagagagggacggcgactcctgctccatttcgccacaagacgtatatctatcgaacttctgccgcttattgggggtggaacacagccagatggaacactggctgtgtcatagaaagcttgtgacgacctcagaaacatacgttaagacgatgtcattacagcaggtgattaacgcacgcaacgcgctcgcgaaacacatttacgctcagctgttcggttggatcgtggagcacatcaataaggcgctgcacacatctctgaaacagcactcgttcattggagtgctggacatctacggatttgagacgtttgaggttaactcatttgaacaattttgtatcaattacgccaacgaaaagcttcagcagcagttcaatagccacgtattcaaactggaacaggaggagtatatgaaggagcaaattccctggacactgattgacttctacgataaccagccatgcatcgaccttattgaagctaagcttgggattctagacttgttggacgaggaatgtaaagtgccaaagggaaccgaccaaaactgggcccagaagctttacgatcgacatagctctagtcagcattttcaaaagcctagaatgtcaaacaccgccttcataatagttcattttgcagataaggtggagtatctgtccgacggattccttgaaaagaatcgtgacacggtctacgaggagcagatcaacattctaaaggctagtaagtttcccctggtggctgatctctttcatgacgataaagatccggtgcctgcaactaccccaggaaaggggagttcttccaagatttctgtcagaagtgcacgtcctcccatgaaagtgtcaaataaggaacacaaaaagacggtgggccaccaatttcggacgagtctgcacctgctgatggagacactcaacgctaccacaccccactacgtccgctgtattaagccgaatgacgagaagctccctttccactttgatcccaaaagagccgtgcagcagcttcgcgcctgcggggttctggagacaatcaggatttccgccgccggttacccctccaggtgggcctaccacgactttttcaataggtatcgcgtcctggttaagaagagggaactggctaataccgacaaaaaggccatctgtcgctcagttcttgagaatctgatcaaggatccagacaaattccagtttggtcggacaaaaattttctttcgcgctggtcaggtggcctatcttgagaagttacgggcagacaagtttaggactgccaccatcatgattcagaagactgtaagaggatggctacaaaaggtcaagtatcaccggttaaaaggggcaaccctgacactgcaaaggtactgtcgagggcacctcgcacggcggttagccgagcacctgcgaagaattagagccgccgtagttctgcagaaacactaccgcatgcagcgagcgagacaagcttaccagcgtgtgaggagggctgctgtcgtcattcaggctttcactcgtgctatgtttgtgcgacggacctacaggcaggtactgatggagcacaaagccacaaccattcaaaagcacgtccggggctggatggcccgtcgccattttcagcgcctgcgcgatgctgccatcgttatccaatgtgcctttcgcatgctgaaggcccgcagagaactcaaagcactgagaatcgaagcgcggagcgctgagcatctaaaacgcctgaacgtcgggatggaaaataaggtggtccagctccaacgcaagattgacgagcagaataaagagtttaagactctctctgagcaattatcagttacaacctctacatacaccatggaagttgagcgattgaaaaaggagctcgtgcattaccaacagagccccggagaggataccagtttaaggctacaagaagaagttgagtccttaagaacggaactgcagcgagcccactctgagagaaagattctcgaggatgcgcatagtcgggagaaggacgagcttagaaagcgtgtagcagaccttgagcaggagaatgctctcctcaaggacgaaaaggagcagctgaataaccagatcctctgccagtcgaaggacgagtttgctcagaacagcgtgaaggaaaatctcatgaaaaaggagctcgaagaggaaaggtctcggtaccaaaatttggtgaaggaatattcgcaactggagcagcgctatgataacctccgtgacgaaatgaccattattaaacagacacccggccatcgaaggaatccttccaaccagagtagtttagagtccgattcaaactacccatccatatcaacaagcgagatcggggatacagaagatgcactgcaacaagtggaggagatcggacttgaaaaagcagccatggacatgactgtgtttctgaaactgcagaagagagtcagggaactggaacaggagcgcaagaaactccaggtgcaattggagaagagggagcagcaagattcaaagaaagtgcaagcagagccaccacagaccgacatagatctggatcctaatgcagatctggcctataactctctgaaaagacaggagctggaatctgaaaataaaaagctgaaaaacgatctgaacgagctgcggaaggctgtcgcggatcaagccacgcagaacaacagtagtcatggaagtcccgatagttattcccttctcctcaaccagttaaaacttgcacacgaggaactggaggtgcgcaaagaagaagtgttgatactcagaactcagattgtcagcgcagatcagcgaaggttggcggggcgtaatgccgagcctaacataaacgcgcggtcgagctggcccaattctgagaaacacgtcgaccaggaggacgctatagaggcttatcacggtgtgtgccagactaattccaagacagaggattgggggtacctgaatgaagacggtgagcttggactggcctaccagggcctcaagcaagttgccaggcttctcgaggcacagcttcaagcacaatctcttgagcatgaggaagaggttgagcaccttaaggcccagcttgaggctcttaaagaagagatggacaagcaacagcaaactttctgtcagacattgcttctcagtccagaggcccaagttgaattcggagtgcagcaagagatcagtcggctgacaaacgagaatctggacctgaaagagctggtggagaagctggagaaaaacgaacggaagctgaaaaaacagctcaaaatttatatgaaaaaggcccaagacctggaagcagcccaggcgctggctcagagtgagcggaaacggcacgagctgaatagacaggtgactgtccagcgtaaggagaaagattttcaggggatgctagagtaccacaaggaggacgaagccctacttatacggaaccttgtgacagatctcaagccccaaatgctgtccggcacggtgccatgccttccagcctatatcctttatatgtgcataaggcacgcagattacactaatgacgatctgaaggtgcacagcctgctcacttctactatcaacggcataaaaaaggttcttaaaaagcacaatgacgactttgaaatgacctccttttggctgagtaacacctgtaggttgctccactgtctgaagcagtactccggagacgagggttttatgacccagaacactgctaagcaaaacgaacactgcctgaaaaacttcgacctgacagagtatagacaggttctgagtgacctgagcattcagatttaccagcaactcatcaagattgctgaaggtgtcctgcagcctatgattgttagtgcgatgttggaaaacgaatcaatccagggactgtccggcgtgaagcctacagggtatcggaaacgctccagcagtatggctgatggagacaattcttactgcctggaagcgattatccgacagatgaatgctttccatacggttatgtgtgaccagggtttggaccctgagatcattctccaagtgttcaaacagctcttttacatgattaatgccgtcaccctcaacaatctgttgctgagaaaggacgtctgcagctggtccaccggaatgcagctgagatacaatattagccaactcgaagagtggttgcgtggccgaaatttgcatcagtcgggtgccgtacagaccatggaaccgctcattcaggccgctcagctgctgcagttaaagaagaagacccaagaagacgccgaagccatatgctccctctgcacgagtttgagtacacagcaaattgtgaagattctgaacctgtacaccccactcaatgaattcgaagagcgtgtgacagttgctttcatccgaacgattcaggcccaactccaggaacggaatgatccacagcagctgctgttggacgccaagcatatgttccctgtgctgtttccctttaacccgtcttccttaaccatggatagcatacatattcctgcatgtttaaatctggagtttcttaatgaggtatag

SEQ ID NO: 196236 - DNA, 2892 bp, Artificial Sequence
  Description of Artificial Sequence: Synthetic coding sequence
atggagcacaaggccaccaccatccagaagcacgtgcggggctggatggcgcggaggcactttcagagactccgggacgccgctatcgtcattcagtgcgcgtttcggatgcttaaggcccggagggagctgaaggcgctgaggatcgaagcccgctctgctgagcatctcaagagacttaacgtgggtatggaaaacaaagtggtccagctgcagcgcaaaatcgacgagcaaaacaaagaatttaagacactgtccgaacaactgtctgtaacaaccagcacctacacaatggaggtggaacgattgaagaaggagcttgtgcactatcagcagtctccaggagaggatacatcacttagattacaggaagaggtcgagtctctgcgcacagagcttcagcgggcccactccgagcgcaagatcctggaagatgcccactcacgtgaaaaagatgagctgcgaaagcgagtggccgaccttgaacaagagaacgccctcttaaaggatgagaaagagcaactgaataatcagatcctgtgccagtccaaagatgaattcgcacaaaatagcgttaaggagaatctgatgaagaaggagctggaggaagaacggtcaagatatcagaatctggtgaaagaatacagccaacttgagcagcgatacgataacttgcgggatgagatgactatcataaagcagacaccaggccataggagaaatccctctaaccagagctcccttgaaagcgattcaaattacccaagcatctcaacatcagaaatcggtgatactgaagacgccctgcagcaggtagaggagattgggctggagaaggcagccatggatatgacagtgttcttaaagttgcagaagcgggtcagggagctggagcaggagaggaagaagctccaggtgcaactagaaaaaagagaacagcaggactcgaagaaagtgcaagccgaacctccccagaccgacattgacctcgacccaaacgccgacctcgcctataacagcttgaagaggcaggaactggagtccgagaacaagaagttaaaaaacgacctgaacgagctgaggaaagccgtcgccgatcaggcaacccagaacaactcttcccatggtagcccggacagttacagtttactactgaaccagcttaaattagcccatgaagagctcgaagttagaaaagaagaagtgctcatcctgcgtacccagattgtcagcgcagaccagcgaaggctggccggcagaaacgccgagcctaacatcaatgctcgcagtagctggcccaactcagaaaagcatgttgatcaggaggatgccattgaagcataccacggagtgtgtcagacaaacagactgcttgaggcacagcttcaagcccagtcactcgagcatgaagaggaagtggaacaccttaaagcgcagctggaggccctaaaagaagaaatggacaagcagcagcaaacattctgtcagacactgctcctcagcccagaagcccaggtagaatttggcgtgcagcaagagatctccagactgacaaacgaaaacctggatttgaaggaattggtggaaaaactagagaaaaacgaacgaaagctgaagaaacagctgaaaatttatatgaagaaagcccaagacctggaagctgctcaggccctcgcacagtccgaaagaaagaggcacgaactgaaccgtcaagtgaccgtacagcgcaaggaaaaagactttcagggaatgctagagtaccacaaggaggatgaagcgcttttaattcgtaacctcgttactgacctcaagcctcagatgcttagtgggacagtgccatgcttgcctgcgtacattctctacatgtgcatccggcacgccgactacactaacgacgatcttaaggtccatagtcttctgacaagtactattaacggaatcaagaaggtcctgaaaaagcacaatgacgatttcgaaatgactagcttctggctgagtaacacgtgcagactgttgcactgtctgaaacaatactccggcgatgaaggctttatgacacaaaacacggcaaagcagaatgaacattgtctcaagaacttcgatttgacggaatataggcaggtgctgtctgatctgagcattcagatatatcagcagctgatcaaaatcgctgagggggtactgcagcccatgatcgtgagcgctatgctggagaacgagagtatacaaggcctgtctggggtcaagccaacaggctaccgcaaaagaagcagcagcatggcagacggtgacaactcttattgtctcgaagctatcattaggcagatgaacgccttccataccgtgatgtgcgaccagggtctcgacccagaaatcattcttcaagtgttcaagcagttgttttacatgatcaacgcagtgactttaaataatttgttactgaggaaggacgtctgttcttggagtactggaatgcagctgcgttataacatatctcagcttgaggagtggctgcgcggccgcaacctacatcagagcggcgccgttcagacgatggaacccctaattcaggcagcgcagctcttgcaactgaaaaaaaagacccaggaggacgcagaagccatctgtagcctgtgcacctctctcagtacgcagcagatcgttaagattctgaatctctatacaccactcaatgagtttgaggagcgagtcaccgtcgctttcattagaaccattcaagcccaattgcaggagcgaaatgacccacagcaattgctgttggatgctaaacacatgttcccagtgctctttccattcaacccaagttctctgaccatggatagtattcacatccccgcctgcttgaaccttgaattcctgaatgaggtctag

SEQ ID NO: 196237 - DNA, 2163 bp, Artificial Sequence
  Description of Artificial Sequence: Synthetic coding sequence
atgcactggcccgtgacccgggagtgcacccgggtgtggatccccgacccagatgaagtgtggcggtccgctgagttgaccaaggactataaagaaggcgataagtcactccagttgcgtctggaggacgaaacaatactagagtatccaattgatgtccaaaggaatcagttgcctttcctccgtaatcctgatatactcgtgggggagaacgatcttactgcactcagttatctgcatgaacccgcagtgctgcacaatctaaaggtgcggttcctagagagcaatcatatctatacctattgcggaatcgtcctcgtggctataaatccgtacgaacagcttcctatctatggacaagatgtgatttatacgtacagtgggcagaatatgggagatatggatccccatattttcgccgttgctgaggaggcgtacaagcagatggctagagacgagaagaaccagagtattatcgttagtggagaatccggtgccggcaaaactgtgtctgccaagtacgccatgaggtattttgcgactgtggggggatccgccagcgagacgaacatagaagagaaagtactggctagtagcccgattatggaagccatcggcaatgcaaagaccactcgtaatgacaacagtagtcgatttgggaagtatatccagatcggcttcgataaaaggtaccatattatcggggcaaacatgagaacctaccttctcgagaaaagtcgggtggtcttccaagccgatgatgaaagaaactaccacatattctatcaactctgtgctgctgctgggctgcccgaattcaaagaactggctctgactagcgctgaggattttttctacacctctcagggcggagatacttccattgaaggggtcgacgatgccgaggactttgaaaagacaagacaggcattcacacttctgggagtgaaggagagccaccaaatgtccatttttaagataatcgcctccattctccatttaggctctgtggccattcaagctgagcgtgacggggactcctgctccatcagcccccaggatgtgtacctctccaatttctgccggctcctgggtgtagagcactcacagatggagcattggctgtgccaccgcaagctggttaccacatccgagacttacgtgaagaccatgagcctgcaacaggtgattaacgctaggaacgctctcgcgaagcatatctacgcacagttgttcggctggatcgtagagcacattaacaaagccctgcatacatcactgaagcaacattctttcattggagtactggacatttacggctttgaaacttttgaggtgaattctttcgaacagttctgtattaattacgccaacgagaagttgcaacagcagtttaattctcatgtgttcaaactcgaacaggaggagtatatgaaggaacagataccatggaccttgatcgatttctacgataaccagccatgtatagaccttatcgaggccaaactcggaatcctcgatctgctagatgaggagtgcaaggttcccaagggaaccgatcagaattgggcccagaagctatacgacagacatagctcctcacagcactttcagaagccacgcatgtctaatacggcttttataattgtgcacttcgccgataaggtggaatatttgtccgatgggttcctcgagaagaatcgtgatacagtgtatgaggagcagatcaacatcttgaaggcatctaagttccctctggtggccgacctatttcacgacgacaaagacccggtgcctgccactacaccggggaagggatcaagttccaaaatatccgtcagatctgcacgacccccaatgaaggtgagcaataaggaacataagaagacagtcggtcaccagtttcggacatctctcagcactcaacaaattgtaaaaattttgaacctatacacacctctgaatgagttcgaagagcgcgttaccgtagccttcataaggactatacaggcacagttacaggaacggaatgacccccagcagctgctcctggacgctaaacacatgttccctgtcctcttcccattcaacccatcatctcttactatggatagcatacatattcctgcctgtctgaacttagagttcctcaatgaagtatag

SEQ ID NO: 196238 - DNA, 5229 bp, Artificial Sequence
  Description of Artificial Sequence: Synthetic coding sequence
atggccgtggccgagctgtacacccagtacaaccgggtgtggatcccagatcccgaggaagtctggaaaagcgctgaaatcgctaaggattacagggtaggggacaaagtgctccgcctgctgcttgaagacggcaccgagcttgactacagcgtaaatccagagtccctcccaccacttcggaatcccgatattctagttggtgagaatgaccttacagcacttagttacctgcacgaacctgcagttcttcataacctgcgtatccggttcgcggagagtaagttgatctacacttactccggcattatcctcgtagcaatgaatccctacaaacagctgcccatctatggtgatgcaatcattcatgcatacagcggtcaaaacatgggtgacatggacccccacattttcgccgttgcggaggaggcctacaagcaaatggcgcgtaataaccgcaaccaaagtataatcgtgtccggcgaatcaggggccggtaagactgtcagtgctaggtacgcaatgagatacttcgccacagtgagtaagtcggggtctaatgcccatgttgaggacaaagtgctggcctctaatcccattacagaggctgtaggcaatgctaagactacccgtaatgataactccagccgctttggcaaatacactgagatctcatttgatgagcagaatcaaattatcggagctaatatgtccacctatctgctagagaaatctagggtagtcttccagagcgaaaatgagaggaattatcacattttctatcagctctgcgcgtccgcccaacagtcagaatttaagcacctcaagctggggagtgccgaagagtttaattatactaggatggggggcaacacggtgatcgaaggtgtgaatgatagggctgagatggtggagacgcagaaaacatttacgcttcttggcttcaaggaggatttccagatggacgtgtttaagatcctcgctgccattctacatttgggcaatgtccagataaccgccgtggggaacgaaagatccagtgtgtccgaggacgactcccatttaaaggtgttttgtgaactgctggggctggaatcaggccgcgtagcccagtggctctgcaacagaaaaattgtgacatcctccgagaccgtggttaagcccatgacccggccccaggccgttaatgctcgcgacgcacttgccaagaaaatatatgcccatctgtttgacttcattgtagaacgcatcaatcaagctttacaattttccggcaaacagcataccttcatcggggtcctggacatctacggatttgagacctttgatgtgaacagttttgagcagttctgcattaactatgccaacgaaaaactccagcagcagttcaatatgcatgtgttcaagcttgaacaggaggagtacatgaaggaggacattccatggaccctgattgatttctatgataaccagccagttatcgacctcattgaggccaaaatgggaatcctagaactcctggacgaggagtgcctactgccccatggcaccgacgaaaattggctgcagaaactgtacaataatttcgtgaacaggaatccattgtttgaaaaaccaagaatgagcaatactagttttgtcatccagcatttcgccgataaggtggagtataaatgcgaaggctttttggaaaagaacagagataccgtgtacgacatgcttgttgaaattctccgggctagtaagttccacctgtgcgctaatttttttcaagagaaccccaccccacctagcccttttggatctatgattacagttaagtcggctaagcaggtcatcaagccgaactcaaaacattttcgcacaactgtggggtccaagttccggtcatccttatatctattgatggagactcttaacgccactaccccacactacgtgcggtgcataaagcctaatgacgaaaaattaccatttgagttcgattccaagcgtatcgtgcagcagctcagggcatgcggcgtcctcgagacgattagaatcagcgctcaatcatacccaagccgttggacctacattgaattctactcacgatacggtattttgatgacaaagcaagagcttagcttttcagacaagaaagaggtttgcaaggtagttctgcacagactgatccaagatagtaatcagtatcaattcggtaaaaccaagatcttctttcgtgcaggccaagttgcctatctggagaagttaagactggacaaactccggcagtcgtgcgtgatggttcagaagcacatgcgtggctggttgcagcggaagaagttcctgcgggagaggagggccgccctcattattcaacagtacttccgaggccagcagactgtccgcaaggccattacggccgtcgccctgaaggaggcttgggccgctattatcatccagaaacattgtagaggctacctggttcgctctctctatcagctgatacggatggctacaatcaccatgcaggcctatagccgagggttcctggcacgcaggcggtaccggaaaatgcttgaagagcacaaagcagtgatacttcaaaagtacgctagagcctggctggcccgccggagatttcagtcaatacggagattcgtgttgaatattcagttgacgtacagggtgcagaggctgcaaaaaaaactcgaggaccaaaataaggaaaaccatggcctggtggaaaagctcacaagcctcgctgccttgcgcgcgggtgatgtcgagaagatccagaagctcgaagccgaacttgagaaagccgccactcatagacgcaactacgaggagaaggggaagcgataccgtgatgccgtagaagaaaaactggccaaactgcagaaacacaacagcgagctggagacccagaaggagcagattcagctaaaactgcaggagaagacagaagagctaaaagaaaagatggacaacctgaccaagcaactgtttgacgatgttcagaaggaggagcgccaaaggatgctcttggaaaagagctttgaactcaaaacacaagactatgagaaacagatacagagcctaaaggaagagataaaggccttaaaggatgaaaagatgcagctgcagcaccttgtggaaggcgagcacgtcacttctgatggacttaaggcagaagtggctcggttgtcaaaacaggtcaagaccatcagtgaatttgaaaaggagatcgaattgctgcaggcgcaaaagatcgatgtcgagaaacacgtgcagagccagaagcgtgagatgagagagaaaatgagtgaaatcaccaaacagctgctggagtcttacgacatagaagacgtgagatcgcgtttgtctgtggaggatctggagcatttgaatgaagacggcgaactctggttcgcttacgaaggactgaagaaagcaacacgggtgctggagagtcactttcagagtcagaaagactgctacgaaaaagaaatcgaggctctcaatttcaaggtcgtccacctctctcaagagataaaccatctccaaaagctcttccgggaagagaacgacatcaatgaatccatccgtcacgaggtgactaggttaactagtgagaatatgatgattcccgactttaaacaacagatctccgagctggagaaacagaagcaagatctcgaaatccggctgaatgagcaggccgaaaagatgaaaggtaaattggaagagctttctaatcagttgcacagatcacaggaagaggagggcactcagcgcaaagccttagaggctcagaatgaaatacacaccaaagagaaagagaaactaattgacaagatccaggagatgcaggaggcttccgatcacctgaagaaacagtttgaaacagagtcagaggtcaaatgcaatttcagacaggaagctagccgcttaactcttgagaacagagatctcgaagaggagctggatatgaaggaccgcgtcattaaaaagctacaggatcaggtgaaaactctttctaagacaattggaaaggctaatgacgtgcatagtagctctggaccaaaggaataccttgggatgctgcaatacaaaagggaggacgaggctaaactgattcagaatctgattctggatttgaagccaagaggagtcgtggtgaacatgattcccggattacccgcccacattctgttcatgtgtgtgagatacgccgactctctgaatgatgctaatatgcttaaatcacttatgaattccactatcaacgggatcaaacaagttgtgaaagagcatctggaagattttgagatgctatctttttggctatccaacacatgtcattttctgaactgtctgaagcaatattccggcgaagaagaattcatgaaacacaactccccacagcagaataagaattgtttgaataattttgacctcagcgaatatcggcaaatcctctccgacgttgctataagaatctaccaccaattcatcatcattatggaaaaaaatatccagccaattattgtgcccggtatgctggagtacgaaagccttcagggcatcagcggtctgaagccaacggggttccggaagcgctcctccagcatcgacgacactgacggctacacaatgacatctgtcttacagcaacttagctatttctacactactatgtgtcagaatggactggatcccgagcttgtgcgacaggctgtcaaacagcttttctttttaattggggcagtgacccttaatagtctgttcctgcgaaaagacatgtgcagctgtcgcaagggcatgcagattaggtgtaacatctcctatctcgaggagtggcttaaggacaagaatctgcaaaattcactggcaaaagaaaccctagagcccttgagtcaagccgcatggcttctgcaggtcaagaagactacagactcagacgccaaagagatctatgaaagatgtacttcactgtccgctgtgcaaatcattaaaattctgaacagttataccccaattgacgattttgaaaaacgggtgacgccctcattcgttagaaaagtccaggccctgttaaattcccgagaggactcatcccagctcatgcttgatacaaagtacctatttcaggtgacattccctttcaccccctctccacatgccctggagatgatccagatccccagctcgtttaaactgggatttcttaataggctatag

SEQ ID NO: 196239 - DNA, 1122 bp, Artificial Sequence
  Description of Artificial Sequence: Synthetic coding sequence
atgcccagcagcacccccaccgccggccggacctgggccatctggactcacacatatttaccatggcaaaagcggcacacttcaagatggcctgatggcaagagcgaagcgcaagaccttgatctgcttaccctttacctgaatctgtattgtattactcctgcagccgccccggaactgcctccactctacgtgttcgtctgcgagctcgacagtcaaagagccccaattcccggttccgacgcctacaacgagggcgccggcggcgcttacatgaggaataaccggaatcagtctataattgtttcgggggaatccggagcagggaagactgtgagcgcccgctatgcgatgcggtactttgccaccgtgagcaagagtggcagtaatgcccacgtggaggacaaggtcttggcctctaatcccatcaccgaagctgtgggaaacgccaagactacacggaatgacaactcttctaggtttgggaaatatactgagatttcgttcgatgagcagaaccagattattggcgccaatatgtccacttacctactagagaagagcagagtcgtgtttcaatctgagaatgaacggaattaccatatattttaccagctgtgcgcaagcgcccagcaatccgaatttaagcatctgaagctaggctcggcagaagaattcaactacacaagaatgggcggtaatacggtgattgaaggggtcaacgaccgagcagagatggttgagacacaaaagacgttcacactgctcgggttcaaagaggactttcaaatggacgtcttcaaaatcctggcagctatactacacttgggaaatgtacaaatcacagcagtgggaaacgagcgctccagcgtgagcgaagacgactcccacctgaaggtattttgcgaacttctgggcctcgaatctggaagggtcgcacagtggctgtgtaaccgcaagatcgtaacctccagtgagactgtcgttaagccgatgactagacctcaggcagtcaacgccagagacgctttagcgaagaagatctacgctcatttgtttgatttcatcgtggagaggattaaccaggcactgcagttcagcgtgctgaaacctctaatgtag

SEQ ID NO: 196240 - DNA, 321 bp, Artificial Sequence
  Description of Artificial Sequence: Synthetic coding sequence
atgaacccctacaagcagctgcccatctacggcgacgccatcatccacgcttacagtggtcagaatatgggagacatggacccgcatatctttgctgtcgcagaggaagcttacaagcaaatggcacgcaataataggaaccagtcaatcatcgtttctggagagtctggcgcagggaagaccgtgtcagcaaggtacgccatgagatatttcgctacggtgagcaaatcggggtccaatgcccacgtcgaagacaaagtgctggccagcaacccaatcactgaggcagtgggtaacgctaaaacaacacgcaatgactag

SEQ ID NO: 196241 - DNA, 1293 bp, Artificial Sequence
  Description of Artificial Sequence: Synthetic coding sequence
atggccgtggccgagctgtacacccagtacaaccgggtgtggatcccggatcccgaagaagtgtggaagtctgccgaaatcgcaaaggattacagggtaggcgataaagtcctcaggctgctgttggaagacggtacagaactggactacagcgtgaatcctgagtccttgccgcccctcagaaacccagatatccttgtgggcgagaacgacctgacagccctgtcgtacctgcacgagccggcagtccttcataaccttcgcattcgctttgccgaaagcaaacttatttacacttattctgggattatcctcgtggcaatgaacccctataaacagctccctatttacggggacgctattattcacgcttactcaggccaaaatatgggcgacatggacccccacatctttgctgtggctgaggaagcatacaagcagatggcccgaaacaatcgaaaccagagtataattgtgtctggcgagtctggtgccgggaagacagtatccgcccggtatgctatgagatatttcgcaacagtttcaaagtcagggtcaaacgcgcacgtcgaggacaaggtgctggcttccaatcccattacagaagccgtggggaatgctaaaacaactaggaacgataactctagtcgctttgggaagtacaccgaaattagttttgatgaacagaatcagataatcggagctaacatgagcacgtatttgctcgagaagtcgcgcgtcgtctttcagagcgagaatgagcgcaattaccacattttttatcaactctgtgcatctgcccaacagagcgaattcaaacatctaaaactgggtagcgccgaagaattcaattacactcgtatgggaggcaacactgtgattgaaggagtgaatgacagagccgagatggtagagacccaaaaaacattcacgctgctgggatttaaggaggatttccaaatggatgtattcaagatccttgccgctatcctgcacctgggaaacgttcagataaccgcagtagggaacgaacgaagttcagtgtccgaggatgatagtcatctgaaggtgttttgtgaattgctcgggctggaatccggacgcgtcgctcagtggctctgcaacaggaaaattgtaacatcttctgagaccgtggttaagcccatgacacggcctcaggcggtcaatgccagagacgccctggccaagaaaatctacgcccacctttttgatttcattgtcgagagaatcaatcaggcactgcagttctctgtgctgaagccactgatgtag

SEQ ID NO: 196242 - DNA, 810 bp, Artificial Sequence
  Description of Artificial Sequence: Synthetic coding sequence
atggccgtggccgagctgtacacccagtacaaccgggtgtggatccccgaccctgaggaggtatggaagtccgccgagatcgccaaggactacagggtgggggacaaagtgctcagactgctgcttgaggatggaaccgagctcgattactcagtgaatccagagagccttcctcccctgaggaacccagatattctcgtcggcgaaaacgacctgactgcgctgagctacttacatgaaccagccgttctccacaacctgaggatccggtttgctgagtctaaactcatctatacttactctggaatcattttagtggctatgaatccctacaagcagttgcctatttacggggacgccattattcacgcttatagtgggcagaatatgggagatatggatccccacattttcgccgtcgcggaagaagcatataaacagatggcccgaaataaccgaaaccaaagcatcattgtgtctggcgaaagtggggctgggaaaacagtttctgccagatatgcaatgcggtacttcgctacagtctccaagtcaggatctaacgctcacgtggaggataaggtgctcgcaagtaatcccataacagaagcggttggcaatgcaaaaacgacaagaaacgacaattcaagtcgcttcgggaaatatacagagatttccttcgatgagcaaaatcagattattggcgctaacatgtccacatatctgctagagaaatcccgtgtagtgttccagggcgtacctaagaacctgatcattcaagaatgggaagcaatccttagcctccgggtgtag

SEQ ID NO: 196243 - DNA, 3762 bp, Artificial Sequence
  Description of Artificial Sequence: Synthetic coding sequence
atggaggacggcaagcccgtgtgggccccccaccccaccgacggctttcagatgggtaatattgttgacataggaccagacagtctgactatcgaacccctgaatcaaaagggcaaaacatttctggctctgatcaatcaggtcttcccagccgaagaggattccaagaaagatgtggaggacaactgctcacttatgtacctgaacgaagctacccttctccataatattaaggttaggtacagcaaagatagaatatatacctatgtggcgaatattctaatcgcagttaatccgtacttcgatatcccaaagatatactcctctgaagctatcaagtcttaccaaggtaagtccctggggacacggcctccgcacgtattcgctatcgcggacaaagccttccgggatatgaaagtcctgaagatgtcgcaatctattatcgtgagcggggagtcgggcgccgggaagacagaaaacactaaattcgtactgcgatacctgactgagagctacgggaccggtcaggatatagacgataggattgtcgaggccaatccgctgctggaggcattcggtaacgccaaaacagttaggaataacaattccagcagattcggtaaattcgtagaaattcacttcaatgagaagagttcagtagtcggagggtttgtgagccactatctgctggaaaaaagcagaatatgtgtgcagggcaaagaagaacgaaattaccatattttctatcgtctgtgcgcgggggccagcgaagacattcgggaaaaactgcatttgagttccccagataacttccggtatttaaacagagggtgtacacgctatttcgctaataaagagacagacaagcagatcctccagaacaggaagtctcctgaatacctcaaggccggaagcatgaaggatccactgctggacgatcacggagacttcatccgcatgtgtacagcaatgaagaagattggcttagatgacgaagaaaaactcgatttgttccgagtcgtggccggggtccttcatttgggaaatatcgacttcgaagaagccgggtcaacttctgggggctgtaacctgaagaataaaagtgcacaaagcctggagtactgtgccgagctgctgggactcgatcaggacgacctgcgtgtgagtttaaccacacgtgttatgctgactacagcagggggaacaaagggtactgttattaaggtgcctctcaaggtcgaacaggccaataacgctcgggacgcattggccaagactgtgtatagccacctgttcgatcacgtcgtgaatagggtgaaccagtgcttcccattcgagaccagctcctatttcattggagtgcttgacatcgctggcttcgagtacttcgaacacaactcctttgaacagttttgcatcaactattgcaatgagaagctccaacagtttttcaatgaacgtatcctcaaagaggagcaggaactgtatcaaaaggaaggacttggcgtcaacgaggtgcattatgttgacaaccaggactgcattgacctcattgaggccaagcttgtggggatactggatatcctggatgaggagaacaggctgccgcagccatctgatcaacattttactagcgctgtccaccagaagcacaaagatcattttaggctcactatcccgcgaaagtccaagctggccgtgcataggaatattagggacgacgagggcttcataattcggcacttcgcaggagcagtctgttatgagacaactcagtttgtggaaaaaaataacgatgcactgcacatgtctctcgaatctctgatatgcgagagccgcgacaagtttatccgcgagcttttcgaaagctctaccaacaataataaagacaccaaacagaaggcggggaaactgtcctttatttctgtgggaaacaagtttaaaacccagctgaatctgcttctggacaaactgcgatccactggcgcctcctttattcgttgcatcaaaccaaacctgaaaatgacttcccaccactttgaaggcgcacagattctaagccaactacagtgctccggcatggtgtccgtgctggatctgatgcagggtggctatccatctagggcttctttccacgagctttataatatgtataagaagtatatgcctgacaagttggccaggctggacccaagattattttgcaaggcattatttaaggcactcggcctgaacgagaacgattataaattcggactgactaaagtgttctttagacccggaaaattcgctgagttcgaccagataatgaagtctgatccagatcacttggccgagcttgtaaagcgggtgaatcattggctcacttgttcgaggtggaagaaagtccaatggtgctctctgtcggtcattaagctgaaaaacaagattaagtacagggcagaagcttgtataaaaatgcagaagacaattagaatgtggttgtgtaagagacggcacaagcctaggatcgacgggttggtgaaggtgggaaccctcaaaaaacgactggacaaattcaacgaagtcgtttccgtgctgaaggatggaaagcctgaaatgaacaagcaaataaaaaacctggagatctcaatcgacaccctgatggcaaagatcaagtctaccatgatgacccaggagcagatccagaaggagtacgacgcactcgtcaagtcgagtgaggagcttctgtctgctttgcaaaagaagaagcaacaggaggaggaagcagagagactgcgccgcatccaggaggagatggagaaagagcgaaaacggagagaggaggacgaaaagcgccgacgtaaggaagaggaagaacggcggatgaagctggagatggaggctaagaggaagcaggaggaggaggaacgaaaaaagcgggaagatgatgagaagagaatccaggcagaagtcgaggcacaactggccagacaaaaggaagaagaatctcagcagcaggccgtccttgaacaggagaggagggaccgggaactcgctctccgtatcgcccagtcagaggccgaactgatctctgacgaggcacaggcagatctagccttacggcgtgggcccgccgtgctggcgaccaaagcggcagctggcacaaaaaagtatgacctgtctaagtggaaatatgccgaactacgggacacaataaacacaagctgcgatatcgaattactcgcagcctgtcgcgaggagttccataggaggctgaaagtatatcatgcatggaagagcaagaataagaaaaggaacacagagactgagcagagagccccgaagagtgtcacagactacgcccaacagaacccggccgcccagatacccgctcggcagagagagatcgagatgaaccgccaacagagatttttccgaatccccttcatcagaccggctgaccaatataaagacccacagagtaagaaaaagggctggtggtacgcacactttgatggtccatggatcgcgcggcagatggagctgcatcccgataaacccccgatactgttggtggctggaaaagacgacatggaaatgtgcgagttaaatctggaggaaacaggtcttactaggaagcgcggcgccgagatcctgcctcgccagttcgaggaaatctgggaacgttgcggagggatccagtaccttcagaacgccattgaatcacgccaggcccgccccacatatgcaaccgccatgctgcagagtctgctgaagtag

SEQ ID NO: 196244 - DNA, 3858 bp, Artificial Sequence
  Description of Artificial Sequence: Synthetic coding sequence
atggaggacggcaagcccgtgtgggccccccaccccaccgacggctttcagatgggcaacattgttgacattggacccgactctctaactatcgaaccactgaatcaaaagggaaagacattcctggctctcatcaatcaggtgtttccagctgaggaagacagtaagaaagatgtggaggacaactgtagcctgatgtaccttaatgaggctaccctgctgcacaacatcaaggtgcgctactcgaaggaccgtatctatacatacgtcgccaacatcttgatcgctgttaatccatactttgatatcccaaagatctactctagcgaggcaattaagagctatcaagggaagagtctgggcactcgcccccctcacgtgtttgccatagctgacaaggcatttcgcgatatgaaagttctcaagatgtctcaaagcattatcgtgagcggcgagtcaggagctgggaaaacagagaataccaaattcgtgctgcgctatctaaccgagagctatggaactggccaagatatcgatgaccggatagtagaggctaaccctctgctggaagcattcgggaacgctaaaacagttagaaataataacagttccaggtttgggaaattcgtcgagatacactttaatgaaaagagtagcgtggtgggggggtttgtatcccattacctgctcgaaaaaagtagaatctgtgtgcagggtaaagaagagcggaactatcacatattctacaggctatgcgccggcgccagtgaagatatcagagaaaagttacacctgtcgtcaccagataactttcgctatttgaatcgaggatgcacaagatacttcgccaacaaggaaaccgacaagcagatcctccaaaatagaaaatctccagagtatctaaaggcaggttctatgaaagatcctctgctggatgatcatggagattttatccgcatgtgcacggctatgaagaagatcggcttagacgatgaagaaaaactggatctctttagggtggtcgccggcgttctgcacctcggaaatattgatttcgaggaagcgggaagtacatctgggggctgcaacctcaaaaataagagcgcccaatccttggaatactgcgctgagttgctgggcctggatcaagatgacctgcgggtgtcccttacgacccgcgtgatgctgacgactgctgggggaactaagggcacggtaattaaggtgccattgaaagttgaacaggctaataacgcacgggatgccctggctaaaaccgtttattcccaccttttcgaccacgtggttaacagggtgaaccagtgcttccctttcgaaacaagtagttactttataggagtcttagatattgccggctttgaatactttgagcacaattcttttgagcagttctgcatcaattactgtaatgagaaactccagcagtttttcaacgagcggattctgaaggaggaacaggaactctatcagaaagagggtctgggcgtgaatgaggtacactacgtagacaatcaagactgtatcgaccttatcgaagccaaactggtggggatcttagacatcctcgacgaggaaaataggttacctcagcctagcgatcagcatttcaccagcgccgtccatcagaaacacaaagaccactttcggcttacaatcccccgcaaaagcaagctagcggtacaccgaaacatccgagacgatgaaggctttatcattcggcacttcgcaggggcagtatgctacgaaacaacgcagtttgttgaaaaaaataatgacgcactccacatgagtctggagtctttgatctgcgagtcacgcgataaattcattagggaactctttgagtcaagtacaaacaataacaaggacacaaagcagaaggctggcaagttgagtttcattagtgttgggaataaattcaagacacagcttaatttgcttctggacaaactgcggtcaactggagccagcttcatacgctgcattaagccaaaccttaaaatgacctctcatcactttgaaggcgcacagattctctcacagctacagtgttcgggtatggttagcgtactggatcttatgcagggcggctacccgtctcgcgcctcctttcatgagctctacaacatgtataagaagtatatgcccgacaagttggcaagactcgaccccaggctattctgcaaggctctgttcaaggcactgggtctcaatgagaatgactataagttcggattgacaaaagtcttttttaggcccggcaagttcgcggagtttgatcaaatcatgaagagcgatccagaccatctcgccgagctagtaaaacgagtgaaccactggctaacatgttcccgctggaaaaaagtgcagtggtgttccttgtccgtaattaaattaaagaacaagattaagtatcgggcggaggcttgtatcaaaatgcagaaaactatcagaatgtggctgtgcaagagaagacataagcctaggattgatgggctggttaaagtcggaactttgaaaaaacgtctggataagtttaatgaagtcgtatccgtcttaaaggatggcaaaccagagatgaacaagcagattaagaatttggaaatcagcatcgataccctgatggccaagataaaaagcactatgatgacccaagaacagatacagaaagagtacgatgctctggtcaaatccagtgaggagctcctttcagcccttcagaaaaagaaacagcaggaggaggaggctgagagattacgcaggattcaggaggaaatggaaaaagaacgaaaaagaagagaggaagatgaaaaaagaagaaggaaggaagaggaagagcgccgaatgaagttggaaatggaggccaaacgtaagcaggaggaggaggaaaggaagaaacgggaggacgatgaaaagcgaatccaggccgaggtcgaggcacaactcgctaggcagaaggaagaggaatcacagcaacaggccgtgctggaacaggaacgccgtgatcgtgagttggctttaaggatcgctcagtccgaggctgagctgatttctgacgaggcacaggctgatcttgcactgcgtcgcaatgatggcaccaggccaaagatgacaccagagcaaatggcaaaggaaatgtccgaatttctgtcacgggggcccgccgtgctggccaccaaggccgctgccggaacaaagaagtacgatttaagtaagtggaaatatgctgagctgagagacaccatcaacactagctgtgacattgagctgctggccgcatgtcgggaggaatttcaccgtcggctgaaggtttaccacgcctggaaaagtaaaaataaaaagcgaaataccgagactgaacagcgtgccccaaagtccgttactgattacgatttcgcaccatttttgaacaacagtccccagcaaaacccagctgcccagatccctgctcggcagagggagatcgagatgaatagacaacaacgtttctttcggatacccttcattcgccccgccgatcagtataaggacccccagagcaaaaaaaagggctggtggtatgcccattttgacgggccgtggatcgcccgacaaatggagcttcaccctgataagccgcctatcctactcgtggccggaaaagatgatatggaaatgtgcgaactgaacttggaagaaaccgggcttacccggaagcgaggggccgaaattcttccacgtcagtttgaggagatctgggaacggtgtggaggcatacagtacttacagaatgctattgaatccaggcaggcgaggccaacgtacgctactgctatgctgcaaagcctactgaagtag

SEQ ID NO: 196245 - DNA, 3861 bp, Artificial Sequence
  Description of Artificial Sequence: Synthetic coding sequence
atggaggacggcaagcccgtgtgggccccccaccccaccgacggcttccagatgggcaacatagtggacataggcccggactctttgactatcgaacctcttaaccagaaggggaagaccttcctcgctctgattaaccaagtatttccagccgaagaagattcaaagaaggacgtggaagacaattgcagtctgatgtacttgaacgaggcaaccttgctgcacaatatcaaagtccggtactccaaggatcggatttatacatacgttgccaatatcttaatcgccgtcaacccctattttgatatccctaaaatatactctagtgaggccattaaaagctatcaaggcaagagcctgggaacccgcccacctcatgtgttcgctatagctgacaaggccttccgggatatgaaggtgcttaaaatgtcccagtctatcatcgtatcgggcgagtcaggcgcagggaagacagagaacactaaatttgtgctgagatatctcaccgagagctacgggaccgggcaggatatcgatgatcgcatagtagaggcgaatcccctcttggaggctttcggaaatgcgaagacagtcagaaataataattcctccagatttgggaaattcgttgagatccacttcaatgaaaagtcaagtgttgttggtggcttcgtctctcactatctgctcgagaaatctcggatttgcgtacagggcaaggaggagagaaactaccatatcttctatagactgtgcgctggtgccagtgaagacattcgcgagaagcttcatctgagctcacccgacaactttaggtacctgaatagaggctgtactaggtatttcgccaacaaagagactgataaacagattctgcagaaccgtaagtcgccggagtaccttaaggctggatctatgaaagaccccctacttgatgaccacggggacttcatccggatgtgtactgccatgaaaaagattggtctggatgacgaagaaaagctcgacctctttcgggtggtcgcgggggtcctgcaccttggcaatatcgactttgaggaagcgggatccacatccggcggatgcaacttgaaaaataagtccgcccagtcattagagtattgcgctgaattgctcggactcgaccaggatgatctgcgagtgtccctgacgaccagggtcatgctgacaactgcaggaggtacaaagggcactgtgattaaggtaccgctgaaagtggagcaagccaacaacgcgagggatgcactagcgaagactgtctacagccacctcttcgaccatgtcgtcaatcgggtgaaccagtgtttcccttttgaaaccagctcctatttcatcggggtcctcgacatcgctgggtttgaatacttcgagcataacagcttcgaacaattttgtataaactattgcaatgagaagctccagcaattcttcaacgaacgtatcttaaaggaggaacaggagctttaccagaaggaaggcctcggcgtgaatgaagtacactacgtggataaccaggattgcatcgacttaatagaagcaaagctggttggtattttggacatactggatgaggagaacagattaccccagcccagtgaccaacatttcacatccgcggtgcatcagaaacacaaagatcactttaggctgaccattcccaggaagagtaagctcgccgtgcatagaaacatccgcgatgacgaggggtttataataaggcatttcgcaggcgccgtgtgctacgagacaactcaatttgttgaaaaaaacaacgatgccctgcacatgtccctggagtctctgatttgtgagtcaagagataagtttatcagagagctcttcgaatcttctaccaataataacaaagacaccaaacaaaaggccggcaaacttagttttatcagcgtgggcaataaattcaagacacagctgaacttgcttctggataaattacgctcaactggcgctagcttcatcaggtgtattaaacccaatctgaagatgacatcacaccattttgagggcgcccagattttatcccaactgcagtgttccggcatggtgtcggttttggacttgatgcaaggcggatatccttcaagagccagttttcatgagctctacaacatgtacaagaagtacatgccagataagcttgcccgactcgacccaaggctcttttgtaaggccctcttcaaagcccttggcctgaacgaaaacgactataaattcggcttaactaaggtcttctttcgacctgggaagttcgccgaattcgatcagattatgaagtcagaccctgaccacttggccgaactggtgaaaagagttaatcattggctgacatgcagccgctggaaaaaagtgcagtggtgctccctgtctgtgattaagcttaagaataagatcaagtatcgggcagaggcatgtattaagatgcagaaaacaattcgcatgtggctgtgcaagcgacgacataagccaagaatagatggcctggtcaaagtgggtacactgaagaagcgcctcgataagtttaatgaagtcgttagcgtgttgaaggatggtaagccagaaatgaataagcagatcaaaaacttggagatctccatagatacactgatggccaagatcaaatccacgatgatgacgcaggaacagatccagaaggaatacgacgccctggtaaagtccagtgaggagctgttgtctgccctgcagaaaaagaagcagcaggaagaagaggctgaacgcctgcggcgcattcaggaagagatggaaaaggaaaggaagcggagagaggaagacgagaagaggcgacggaaggaggaggaagaaaggaggatgaagttagagatggaggcaaagagaaagcaggaggaggaagaacgcaaaaaacgcgaggacgacgagaaacgaatccaagcggaggtcgaagcacagctggcccgccagaaagaggaggagtcccagcagcaggcagtgcttgagcaggagcgcagggaccgtgaactcgcccttcggatagcccaatctgaggccgagttgatcagcgacgaagctcaagctgacctggccctacggcggtacctggatagctacccagtgacaagcaagaacgatggcacacggcccaagatgactcccgaacaaatggccaaggagatgtcagaatttctgtccagagggcccgcagtgctggcgacaaaggcagccgccggtactaagaagtatgatttatccaagtggaagtatgccgagctgagggatacaattaacacctcatgtgacatcgagctgttagccgcctgtcgggaagaatttcatcgcaggttgaaggtgtatcatgcttggaagtcaaagaacaagaagcgcaacaccgaaactgagcagcgcgcgcccaagagtgttacagattatgcccagcagaaccctgctgcccagataccagctaggcagcgcgagattgaaatgaatcgtcagcagcgcttctttcgcatccccttcatcaggcctgccgaccagtacaaggaccctcagtcaaagaaaaaggggtggtggtacgcacactttgacggaccttggatcgcaagacagatggagttgcaccctgacaagccacctatcctgcttgtggctgggaaggatgacatggagatgtgtgagctgaacttggaggagacaggactgacacgcaaaaggggcgcagagatcctgcctagacagtttgaggaaatttgggaaagatgcgggggaatccagtatcttcagaacgctatcgagtccaggcaggcccgccctacctacgccaccgccatgctgcagagcctgctgaagtag

SEQ ID NO: 196246 - DNA, 3789 bp, Artificial Sequence
  Description of Artificial Sequence: Synthetic coding sequence
atggaggacggcaagcccgtgtgggccccccaccccaccgacggctttcagatggggaacattgtggatatcgggcccgactctctgactatcgaacccctgaaccagaaaggcaagacttttctggccctgatcaatcaagtgttccctgcggaagaggattctaagaaggatgtagaagataactgttctcttatgtacttaaacgaagccactctcttgcacaacatcaaagtgcggtatagtaaggataggatctatacctacgtggcgaatattctgatcgcagtgaacccatacttcgacattccgaaaatctattcaagcgaggctattaaatcctatcaggggaaatcactcggaaccagacccccccatgtatttgcgatagcagataaggccttcagagacatgaaagtcttgaaaatgtctcagtccattatcgtgtctggcgagagcggcgccggaaagactgagaataccaaattcgttctgaggtatctgaccgagtcctatggcacaggtcaagatatcgatgataggatcgtcgaggccaatccgctactagaggccttcggaaatgctaaaaccgtcaggaacaataactcctcgagatttggcaaattcgttgagatacacttcaacgagaaatctagcgttgtgggcggattcgtttcccactacttactagaaaaaagtcggatttgcgtccaaggtaaagaagaacggaattaccatattttctaccggctttgcgcgggagcttcggaggacatacgcgagaagttgcatttaagctcccctgacaactttcgatacctgaatagaggctgtaccaggtatttcgcaaacaaagagaccgataagcagatcctgcagaacagaaaaagccctgagtatctcaaagccggttccatgaaggacccccttctggatgaccacggggattttattagaatgtgcactgctatgaagaagatcggcctcgacgatgaggagaaacttgatctgttccgcgtggtggcaggagtactacatctgggtaacatagacttcgaggaggccggatcgactagtggcggatgtaatctgaaaaataagagcgcacagtctctcgaatactgtgccgaattattgggactcgatcaggacgacctgcgtgtgtccctgacgaccagggtcatgctcactaccgctggaggcaccaagggcactgtgatcaaggtgcctcttaaagtggaacaggctaataacgctagagacgctcttgcaaagaccgtttacagccacctctttgaccacgtggtgaacagggtgaatcagtgctttccattcgagacaagttcctactttatcggcgtgctggatatagcaggtttcgagtattttgagcataatagcttcgagcagttttgcataaactactgtaacgaaaagctccagcagtttttcaatgagcgtatcctaaaagaagagcaagagttgtatcagaaagaagggttaggagttaacgaggtgcactacgtcgacaaccaggactgtatcgacttgattgaggcgaagctggtcgggatccttgatatccttgatgaggaaaacaggcttcctcagcctagcgaccagcatttcacatcagccgtccaccagaaacacaaagaccacttcaggctgacaatccctcggaaatcaaagctggctgtgcacagaaacattcgtgacgacgaagggtttatcattcggcatttcgccggtgctgtctgctacgagaccacgcaattcgtggaaaagaacaatgatgcgctacacatgtcactggagtctttgatttgtgaatcacgggataagttcattagggaactatttgaaagttccactaacaataataaggacaccaaacaaaaagcgggcaagcttagttttatcagcgtgggcaacaaattcaagactcagctgaacttgctgctggataagctgcggtcaaccggtgccagtttcatccggtgcataaaacctaacctgaagatgacctcacaccattttgagggcgcgcagatcctgagccagctacaatgctccgggatggtttccgtgcttgatttaatgcaaggaggctatcccagtcgagctagcttccatgagctgtacaatatgtacaaaaagtatatgcccgacaagctcgcccgactcgatcctaggctgttctgtaaggcactgttcaaagccctcgggctcaacgaaaacgattacaagtttggactgaccaaggtgttttttcgtccaggcaaattcgcagaattcgaccagatcatgaagtcagaccccgatcacctggctgagctggtcaaacgggtgaaccactggctgacttgctccaggtggaagaaagtgcagtggtgttccctgagtgtaatcaaactcaagaataaaatcaagtatcgcgccgaggcctgcattaagatgcagaaaactatccgaatgtggctgtgtaagaggagacacaagcctagaatagatgggctggtgaaagtcggtaccttgaagaagcgcctggacaagttcaatgaggtggtcagcgtactgaaggatggcaagcccgaaatgaacaaacaaatcaaaaacctggaaatatccatcgacacgctcatggccaaaattaaatcaacgatgatgactcaggagcagatccaaaaggagtatgatgcactggtgaagtcctccgaagagctgctaagcgctctacagaaaaaaaaacaacaagaggaggaagcggagcgcttgcgccggatacaggaagaaatggaaaaggagcgcaagaggcgcgaagaggacgaaaaaagaaggcgcaaagaggaggaagaacggagaatgaagctggagatggaggccaaaagaaagcaagaggaggaagaaagaaagaagagagaggatgacgaaaagcgcattcaggcagaagtcgaggctcagctcgcaaggcagaaagaagaggagagccagcagcaggccgtattagagcaggagagacgggaccgggaattggccttgcgtatcgcacagtccgaggctgagctcatctcagatgaggcacaggcagacctggccttacgcagggggcccgccgtgttagcaacgaaagctgcagccggtacaaaaaagtatgacctgagcaagtggaagtatgccgaattgcgggacacgatcaatacctcttgtgatatcgagctgttagccgcctgtcgggaagaatttcacagaaggttgaaggtctatcacgcctggaaatcaaaaaataagaaaaggaacacagagaccgaacagcgtgctcccaagtcggttactgactatgacttcgcccccttcttaaacaattcacctcaacaaaatcccgcagcacagatacccgccagacaacgggagatcgaaatgaacaggcagcagagattctttcgtattcccttcatccgacccgccgaccaatacaaggacccacaaagcaagaagaagggttggtggtatgctcactttgatggtccctggattgcccggcagatggaactgcatccagataaaccgcctatcttgctggtggccggtaaggatgatatggagatgtgtgagcttaacctggaggagacaggattgacccgcaagagaggcgctgagatcctcccgcgccagttcgaggagatttgggagcggtgcggagggatccagtacctgcagaatgctatcgaatcgcgacaagcccgccctacatacgcgacggccatgctgcagagtttgcttaagtag

SEQ ID NO: 196247 - DNA, 3888 bp, Artificial Sequence
  Description of Artificial Sequence: Synthetic coding sequence
atggaggacggcaagcccgtgtgggccccccaccccaccgacggctttcagatgggcaatatagttgacatcggcccagactcactgacgatcgagcctttgaatcagaaaggaaaaacgtttctggctctgattaatcaggtgttccctgccgaagaggattctaaaaaggatgtggaggataactgcagcctcatgtatttaaatgaggccaccctccttcacaacatcaaagtgagatatagcaaggatcggatctacacttatgtcgccaatatactcattgcagtcaacccgtacttcgatatccccaagatctattctagtgaggctattaagtcgtaccaggggaaatccctcggcactcgcccccctcatgttttcgccattgccgacaaagctttcagagacatgaaggttctgaaaatgtctcagtcaataatcgtaagcggtgagtccggagctgggaagacggaaaatactaagtttgtgctgagatatctcacggagtcatacggaacagggcaagatatcgatgaccgcatcgtggaagccaaccccctgctggaagctttcggaaatgctaaaaccgtgcggaacaacaacagcagccgattcgggaagtttgtggaaatacacttcaacgagaagagtagcgtggtcggaggttttgtctcacattatctgttagaaaaatccaggatctgcgttcaagggaaagaggaaaggaattaccacatcttttacagactctgtgcgggggcgtctgaagacatccgggagaaacttcacctgagctcacctgataacttccggtatctgaaccgggggtgcacaaggtatttcgcgaacaaggagaccgacaagcagattttacagaatcggaagtctccagaatatctcaaagcaggcagcatgaaggatccactgctcgatgaccacggggatttcattagaatgtgtactgccatgaaaaagatcggcctcgatgatgaggaaaagctcgacctctttagggtggtcgctggggtgcttcatctggggaatatcgacttcgaggaggccggaagcacttccggcggctgcaatctgaagaataaatccgctcagagtctcgaatactgcgccgaactcctcggtctagatcaggatgacttacgcgtgtccctgacgactcgcgtcatgcttacaacagctggcggcacaaagggcacagtgatcaaggtccccttgaaagttgagcaggctaataacgctcgagacgctctagcaaagactgtctactcacatttgtttgatcacgtagttaaccgagtgaatcagtgcttcccgtttgaaacatccagctatttcattggcgtgcttgacattgcaggctttgagtatttcgagcataactcttttgagcagttctgcataaactattgcaacgagaaactccagcaattctttaacgagcgtatactgaaagaggaacaagagctataccagaaagagggcttgggcgttaatgaagtacattatgttgataatcaggactgcatcgacctaatagaagccaaactggtgggaattttggacatcttggacgaagagaatagactgccacaacccagcgatcagcactttacaagtgcggtacaccagaagcacaaagaccacttccgcctcaccatccctagaaagagcaaactggcggtgcaccggaatatacgggatgacgagggtttcattatccgacacttcgctggggccgtgtgttacgagactacacagtttgtcgaaaagaataacgatgctctgcatatgtccctcgagtctctgatatgtgagagccgggataaattcattagggagctatttgagtctagcacaaacaacaacaaagatactaagcagaaggcagggaagctgtctttcataagtgtgggtaataagtttaagacccagctgaatctgctcctcgataagctgcgtagcaccggcgccagctttatccggtgtatcaaaccaaacttgaaaatgaccagtcaccactttgaaggggctcagatcttgtcacagttacagtgctcaggtatggtgagcgttctggatctgatgcaaggcgggtacccaagtcgggcgtcctttcatgaactttataacatgtataaaaaatatatgcctgataaattggcgagactagacccaagactcttctgcaaggctctgttcaaagccctgggtcttaatgagaatgactataaattcggtctgaccaaagtgtttttccgacctggcaaattcgctgagttcgaccagattatgaagagcgaccccgatcacttggccgagcttgttaagcgggtgaaccattggctcacttgctcccgctggaaaaaggtgcagtggtgtagtttgtcagttatcaaactgaaaaacaagatcaaatatcgagcagaggcctgcataaagatgcagaaaaccatccggatgtggctctgcaagaggcggcataagcccagaatcgatggactggtcaaggtggggaccctgaagaagcgtctggataaatttaacgaggtggtgtctgttctcaaggatgggaaacctgagatgaacaagcagatcaaaaatcttgaaatctccattgataccctgatggctaaaataaagtcgacaatgatgactcaagagcagatccagaaagagtacgacgccctggtgaagagtagcgaagaattgctctctgctctgcagaaaaagaaacagcaagaggaggaggccgagcgcctcaggcggatccaagaggagatggagaaggaaagaaagaggagggaggaggacgagaaacgcagaagaaaggaagaagaagaacgacgcatgaagctagaaatggaggctaaacggaaacaggaagaggaagaaaggaagaagagggaggatgacgaaaagcgaatccaggccgaagtggaagcgcagttagcacggcagaaagaggaagaatcgcaacagcaggcagtgctggaacaggaacggagggacagggaactggcgctcagaatcgcacaatcagaggctgagctgattagtgatgaagctcaggccgacctcgccctgcggagatatcttgattcctaccctgtcacctctaagaacgacggcaccaggcctaaaatgacgcctgagcagatggctaaagaaatgtctgaattcttgtcaagaggtccggctgtgttggctacaaaggccgcggcaggcaccaaaaaatatgatttgtctaaatggaagtacgcagaactcagagataccattaatacaagctgcgatatcgaattgctagctgcctgtcgcgaggagttccaccgaagattgaaggtctaccacgcgtggaaatccaaaaacaagaagaggaacaccgagactgagcagcgtgcccccaagagtgtcaccgattatgacttcgcacccttcctgaacaactcaccccaacagaatcctgccgctcagatccccgccaggcagagggaaatcgaaatgaaccgacaacagaggtttttcaggatccctttcatccggccggccgaccaatacaaggaccctcagtctaagaagaaagggtggtggtacgcacactttgacggtccgtggatcgcccgccagatggaacttcacccagacaaaccaccaattctcctggtggcaggcaaggacgatatggaaatgtgtgagctcaatctggaagagacaggcctcacccggaaacgaggtgccgagatcctgcccaggcagtttgaagaaatctgggagagatgtggaggcatccagtatctacagaatgctatcgaatccagacaggcgagaccaacatacgcgaccgctatgctacagagtttgttgaagtag

SEQ ID NO: 196248 - DNA, 525 bp, Artificial Sequence
  Description of Artificial Sequence: Synthetic coding sequence
aagcggcgggaggaggacgagaagcggcggcggaaggaggaggaggagcgcaggatgaaactcgaaatggaggccaaacgaaagcaggaggaagaggaaaggaaaaaacgggaagacgatgaaaaacgcatccaggccgaagtcgaggcccagctcgccagacagaaggaagaagagtctcaacagcaagccgtgcttgagcaggaacgccgagaccgtgagcttgctctgcgtatcgcccagtccgaggccgaactaatttcggacgaggctcaggcagatctcgccctgagaagtctcgattcatacccagtcacttcaaagaacgacggcactaggcccaaaatgacccccggccccgcagttctcgccaccaaggcggcagctggaacaaagaaatatgacctgtcaaaatggaagtacgctgaactcagggatactattaacacatcatgtgacatcgagctgttagccgcctgtcgggaggaattccataggcggttgaaagtctaccacgcgtggtag

SEQ ID NO: 196249 - DNA, 6276 bp, Artificial Sequence
  Description of Artificial Sequence: Synthetic coding sequence
gccctgctgcagaagggcgaccacgtgtggatggacctgcggctgggacaggaatttgacgtgcccattggcgccgttgtaaaactgtgcgattccggtcaagtacaggttgtggacgatgaggacaatgaacactggatcagtccccagaacgccactcacataaaacccatgcatccaacgtcagtgcacggtgttgaggatatgattaggctcggcgaccttaacgaagcaggaattctgcggaacctcttaattaggtaccgtgaccatctcatctatacttatacagggagtatcctggtcgctgtaaatccctatcagttgctctccatctatagcccagagcacataaggcaatacactaataagaagatcggggaaatgcccccccacatttttgcgatcgccgacaactgttacttcaacatgaagcgaaattcccgggatcagtgctgtataatttccggcgagtctggcgctggcaagacagagtctacaaaacttatactgcagtttttggctgctatctctgggcagcactcatggatagaacagcaggtgcttgaggccacacccattctagaggccttcggaaatgcgaaaactattaggaatgataactcgtcaagatttggtaaatacatcgatatccacttcaacaaaagaggcgctatcgaaggtgcaaaaattgaacagtacctgttggaaaaaagcagggtgtgtcgccaggctctggacgagcgaaactatcatgtgttctattgtatgttggaaggcatgtccgaggatcaaaagaaaaagctcggcctgggtcaggcctcagactacaactatcttgctatggtaaaccctccagatctgatgtcttgtctgacgagcaggaccctcattactagaggggagactgtttccacgcccctgagccgagagcaggctctcgatgtcagggatgccttcgttaaaggaatctacggtagactcttcgtttggattgtagacaagatcaatgctgccatatataagcctccttcacaggatgtcaagaactcacgacggtcaattgggttacttgatatctttggcttcgagaattttgccgttaattctttcgaacaactctgcataaattttgccaacgaacaccttcaacagttcttcgtaagacacgtctttaaactggagcaggaggagtatgatctggagtccattgactggctacacattgagttcacagacaatcaggatgcacttgatatgatcgctaacaagcccatgaacattatatcgttaattgacgaagaatcgaagtttccaaaattcctggagaaaaatcgtgatacccttcacggtgatattatccagttggtgcacagcagcaggaacaagttcatcaaacagatcttccaggccgacgtcgccatgggtgccgagaccagaaagaggtctccaaccctgagcagccagttcaagaggtccttggaactcctgatgcgcacactaggagcgtgtcaaccattctttgtgcgatgcatcaaacccaacgaattcaaaaagcctatgctgttcgacaggcatctgtgcgtacgccagcttcggtatagcgggatgatggaaaccatcagaattagaagggccggttatccgatcagatatagctttgtggaatttgttgagaggtaccgggtgctactgcccggagtgaaacccgcttataagcagggcgatctgcggggcacgtgccagaggatggcagaggcagttttgggcacacacgacgattggcaaatcgggaagaccaagatattcctgaaagaccaccatgacatgcttttggaggtcgaacgggacaaggcgataactgaccgggtgatcttattacaaaaagttattcgaggcttcaaggaccgttcaaatttccttaaactgaagaacgccgctacactgattcaacggcattggcgaggccacaattgtcggaagaattacgggctgatgcggttgggatttcttaggctccaggcgctgcacaggtcaagaaagttacatcagcagtataggctcgctaggcagagaatcatccagttccaagccaggtgtagggcatatctggttcgcaaggcattcaggcacagattgtgggctgtgcttaccgtccaagcctacgctcgggggatgatcgccaggcggcttcaccaacggctgagggccgaatatctgtggagactggaagcagagaagatgaggcttgccgaagaagaaaagttgaggaaagagatgtcagctaaaaaagccaaggaggaagctgaacgcaaacatcaagagaggctggcacagttggcaagagaagatgcagagcgcgaactcaaggagaaggaagctgccaggcgcaagaaggagctgttagagcagatggagagagcacgccacgaacctgtgaatcattccgatatggttgataagatgttcggcttcctgggcacctctggagggttacctgggcaggagggtcaagccccttctggctttgaagacctggaaagaggtagaagagagatggtcgaggaggatctggatgctgctctacctctgccagatgaggacgaagaagacctgtcagagtacaagtttgccaagttcgccgccacttactttcagggtactaccactcactcttatacccgaaggccgttgaagcagccattgctataccatgatgacgagggcgaccaacttgccgcactggccgtgtggatcaccattttaaggtttatgggggatctgccagagccgaaataccacaccgctatgagtgacgggtcggagaagatccctgtcatgaccaaaatttatgaaacattaggcaaaaagacctataaaagggagcttcaggcgctgcagggtgagggcgaggctcagttgccggaggggcagaagaaatcgtccgtgagacacaagttggtgcaccttactctgaaaaagaagtctaaactcactgaggaagtgaccaagaggctgcacgatggtgaaagtacagtccaaggtaattcgatgctcgaggatcggccgacttccaatttggaaaagttgcactttatcattgggaacgggatcctgcgaccggctttaagggacgaaatctactgccagatttccaagcagttaacccacaatccatccaagtcctcttatgctcggggatggattctggtgtccctgtgtgtcgggtgttttgcccccagcgagaaatttgttaagtacctcagaaattttatacatggggggcctcccggatacgccccatactgtgaagaaagactgaggcgaacatttgtgaatggtaccaggactcagccaccgtcatggctcgaactgcaggctactaagagtaagaagcccattatgctcccagtgacctttatggatggcacgaccaagacccttcttactgactctgctacgaccgctaaggagctatgtaatgctctagccgacaagatcagcctcaaggaccgtttcggcttttcgttatacatagcgctttttgacaaggtaagttctctgggatcgggatccgaccacgtcatggatgccattagccagtgcgagcagtatgcaaaagaacagggtgcacaggagcgcaacgccccttggcggttgttcttccggaaggaggtttttacgccttggcattcacccagtgaagataatgttgcgaccaacttgatctatcaacaagtcgttcggggagtcaaatttggagaatacaggtgcgagaaggaggatgacctcgcagagctcgcgtcccagcagtattttgtggactatggtagcgagatgatcctggaacggctcctcaacttggtgccgacatatatcccagatcgcgagattactcctctgaagacacttgaaaagtgggcgcagttagctatcgccgcacataaaaaaggaatctacgctcagcggagaaccgacgcgcagaaggtgaaagaggacgtggtttcctacgccaggtttaagtggcccttgttgttcagccgcttctatgaggcttacaagttctcaggcccatcattgcccaaaaacgatgttatagtagctgtgaattggaccggcgtatacttcgtagacgaacaggagcaggtcttattggaactgagcttccctgagattatggccgtgtctagctcacgagagtgtcgggtgtggcttagcttgggttgttctgacctcggctgcgctgccccccatagtggatgggcagggttaaccccagccgggccctgctcgccttgttggagctgcaggggagcaaagacgactgcgccttccttcacactcgctaccatcaagggcgacgagtataccttcacaagttcgaacgctgaggacatccgggacttagttgtaacatttctcgagggtcttcggaagcgctcgaaatacgtcgtggccctacaagataatcctaaccctgcaggggaagaatcaggctttttgtcctttgcaaagggggatcttatcattttagaccatgacacgggagagcaagtgatgaactccgggtgggccaatggaattaacgaacggacaaaacagcgtggagactttccgacagactctgtgtacgtcatgccaactgtgactatgcccccaagagagattgtggccctcgttacaatgacacctgatcagaggcaggatgtcgtaagactgcttcagttacgcaccgctgaaccagaagtacgcgccaaaccctatacccttgaggaattctcttatgattatttccgacccccacctaaacataccctttctagggtgatggtgagcaaggctcgaggcaaagataggctgtggagccatacccgagagcctctcaagcaggcgctgctaaaaaaactgcttggatccgaagagctgtctcaagaagcgtgcctcgcattcatcgcggttcttaaatatatgggtgactatccgtccaagaggacccggtctgtgaatgagctgacagaccagatttttgaggggcctctgaaggcagaacccctgaaagatgaagcatacgtgcagatccttaagcagctgaccgataaccacattagatattctgaggaacgcggctgggagttgctgtggttatgcaccggcctttttcccccaagcaatattctgctaccacacgtgcagcgattcctgcagagccgcaagcactgtccattagcaatcgactgtctgcaacggctgcaaaaggcgttgcgcaatggctcccggaagtatccccctcatctcgtcgaggttgaagcgattcagcacaagaccacccagatcttccataaagtctattttccagatgacacagacgaggcattcgaggtggagagcagcaccaaggcaaaggatttctgtcagaatattgccacccgattactcctgaagagcagcgaaggattcagcttgttcgtcaaaatcgccgataaggtgctgtcagttcccgagaacgatttctttttcgacttcgtcaggcaccttacagattggatcaagaaggcacgtccaatcaaggacggcatcgtgccctccttaacgtatcaagttttttttatgaaaaaactgtggaccactaccgtgccgggcaaagacccaatggccgacagcatcttccattattaccaggaattgccgaaatatctccgcggctaccataaatgtacaagggaagaagttctccagttaggagccctcatttaccgtgtgaagtttgaggaagacaaatcttattttccatccatacccaaacttttaagggagctggtcccacaggacctgatacgccaagtctcacccgatgattggaagcggagcatagtggcctatttcaataaacatgcaggcaaatctaaggaggaggctaagctggccttcctgaagctgattttcaagtggccaactttcgggtccgcttttttcgaggtaaagcagactaccgagccaaatttcccagagatcctgctcattgccatcaataagtatggggtttccctgatagaccccaagaccaaggatattctgaccactcatccatttaccaagatttcaaattggagttcaggcaatacttattttcacataacgatcggcaacttggtgcgggggagtaagctcctttgtgaaacatctctgggttacaagatggatgacctgctgacctcttatatcagccagatgctcactgcaatgtccaagcagaggggttcccgctccggcaagtag

SEQ ID NO: 196250 - DNA, 6555 bp, Artificial Sequence
  Description of Artificial Sequence: Synthetic coding sequence
gccctgctgcagaagggcgaccacgtgtggatggacctgcggctgggacaggagttcgatgtcccgattggcgccgtggtcaaactgtgcgattccggacaagtgcaggttgttgatgacgaagacaacgagcattggataagtccacagaacgctacacatattaagcctatgcaccccacttccgtgcacggggtcgaagatatgattcggctcggcgatcttaacgaggccgggatactgagaaatctgctgatccggtacagagaccatttgatctacacttacactgggagtatcttagtagccgtgaacccgtatcagctactgtctatatattccccagaacatatcaggcagtataccaataaaaagataggggagatgcctccgcatatcttcgccatcgctgacaattgttacttcaacatgaaaagaaactcacgagaccagtgctgcattatttcgggcgaatccggggcaggtaagactgagtctactaagctcatattacagttcttagccgcgataagcggacagcactcgtggatcgaacaacaggtacttgaagccacaccaatattggaggccttcggcaatgccaagaccattaggaatgacaactcatcaaggtttggaaagtatatagacattcatttcaacaaacgcggagcaatcgaaggcgccaaaatcgagcagtacctgctggaaaagtcacgggtgtgtagacaagctctggatgaacggaactaccacgtcttctattgtatgctcgagggtatgtcagaagatcaaaaaaaaaaactggggctgggccaggcctcagattacaattacctggccatgggcaactgcataacttgcgagggacgcgtcgattcacaggagtatgcaaatatacgctcagcaatgaaggttctaatgtttaccgacaccgaaaactgggaaatcagcaagctcctggccgcaattctgcaccttgggaatcttcagtacgaggctcgcacgttcgaaaatttagatgcatgtgaggtgctgttctccccttctttggccaccgccgcctcattgttagaggtaaacccaccagatctaatgagctgtctgaccagtcggaccctaatcactagaggggagacggtaagcacaccattgagtcgcgaacaagctctcgatgtaagggatgcctttgtgaaggggatttatgggagactttttgtgtggatcgtggacaaaattaatgcggcgatctacaaacctccttctcaggacgtgaagaacagcaggcggtccataggccttctagatattttcggatttgaaaacttcgccgtcaacagcttcgagcagctgtgtatcaactttgctaacgaacacctgcagcagttctttgtgcgtcacgtctttaaactggagcaggaggagtacgacctagaatcaattgattggctacacatagaatttactgataatcaggacgccctggacatgatcgccaataagccaatgaatatcatctctctgatcgatgaagagtcgaaattccctaagggaactgacactacgatgttacataaattaaacagccaacataaactgaatgctaactacataccacctaagaacaaccacgagactcagttcggaatcaaccacttcgctgggatcgtgtattacgaaacccagggattcttggagaaaaatagggataccctccacggtgacatcatccagctggtgcactccagcaggaacaagttcatcaaacagatatttcaggctgatgtcgctatgggggccgaaacgaggaaacgctctcccactctgtcttcccagtttaagcgctccctcgaactgctgatgcgcaccctgggagcctgccagccatttttcgtccgctgtatcaaacccaatgaatttaagaaacctatgctgttcgatcggcacttgtgcgttcgccaattacgatatagcgggatgatggaaaccatccgcatccgcagggcgggctatcctatccgctattccttcgttgagttcgtcgaacgctatagagtattgctgcctggggtcaaacctgcatacaagcagggtgacctccggggcacctgtcagcgaatggcagaggccgtgctgggcacccacgacgactggcagattggaaagactaaaattttcttaaaggaccaccacgacatgctcctcgaagtagaacgcgataaggctatcaccgaccgagtgatcctcctgcaaaaggtgattagaggttttaaggatcgctctaattttttaaagctgaagaatgcggcaacactcattcagcggcattggcggggccacaactgcaggaaaaattatggtctgatgaggttaggattcctccggttacaggcgctgcatcggtcgcgtaaactacaccagcagtacagattggctagacagcggattatccagttccaggcccgctgtcgcgcatacctggtgcgaaaggccttcagacatcgtctttgggctgttctgactgtccaggcttatgccaggggaatgattgcacgtaggctgcatcagagactaagggcagaatacctctggcggctcgaggctgagaagatgcggctggccgaagaagagaaactccgcaaagagatgtccgccaaaaaggccaaagaggaggcggaaaggaagcatcaggagcgccttgcccagcttgcccgcgaggatgctgagagagagctcaaagagaaagaggccgcgaggagaaagaaggaactgctggaacagatggagcgcgcgcgtcatgaacccgtgaatcattctgacatggtcgataaaatgtttggctttctcgggacatctggcggtttgcctgggcaggagggccaggcgccaagcggattcgaggatctcgaaaggggacggagggagatggtggaggaggatcttgatgctgcactccccctgcctgatgaagacgaggaggatctgagcgagtacaagtttgccaagttcgccgctacttattttcagggcacaaccacccacagttacacacgtagaccgttaaagcaaccactactgtatcacgacgacgaaggtgaccagttagccgccttagccgtctggattaccatcctgaggttcatgggagatctgcccgagcctaagtatcacactgccatgtctgacggaagcgagaagatccccgtgatgaccaaaatctatgagactctgggcaagaagacgtacaaacgcgagctccaggccctgcagggagaaggtgaggtgaccaagcgcctccacgatggggaatctactgtgcaaggcaattccatgctagaagatcggcccaccagcaacctagagaagttgcacttcatcattgggaatggaatcctgcggcccgcacttagagatgaaatctactgccaaatctccaaacagctaacgcacaacccctctaaatcatcttatgctcgcggatggatcctggttagcctatgcgtgggatgctttgccccctcagagaaatttgtcaagtacctgcggaactttatacatggcggtccccccggatacgcaccttactgtgaagaacgactgcgaagaaccttcgtgaacggcactagaacacagcccccttcctggctggaactccaagctactaagtccaaaaagcctattatgctcccggtgacttttatggatgggacgactaagacactccttaccgacagcgccaccacagcaaaagagctgtgcaatgctctggcagacaaaatcagcttgaaggaccggttcggattttcattatatatcgccctctttgacaaagtgtcctcattaggctcagggtcagaccacgttatggatgccattagccagtgtgaacagtatgccaaggaacaaggcgcacaggagagaaacgccccgtggcgactgtttttcaggaaggaagtgttcacgccctggcactccccatccgaggataatgtggccacaaatctgatctaccaacaggtggtgcggggcgttaaatttggagagtaccgctgtgagaaggaggatgacctggctgagctggcatcacaacagtactttgtcgattatgggagtgagatgatcctcgagcggctgctgaatctcgtcccaacctatatccccgatcgcgagattactcccctgaaaactctggaaaagtgggcccagctcgccattgccgcccacaaaaagggcatctacgctcaacggcggaccgacgcccagaaggtgaaggaggacgtggttagctatgctcgctttaagtggcccctgctcttcagcagattttacgaggcctataagttctccggaccctctctccccaaaaatgatgttatcgtggccgttaactggaccggggtgtattttgtcgacgagcaggaacaggtcctcttagaactatctttcccagagattatggctgtgagctcatcccgggaatgtcgggtgtggctgagtttagggtgtagtgacctgggctgtgctgcgccccatagtggctgggccggtttgaccccagcaggcccgtgttccccatgctggtcctgccgtggggccaagactactgcaccatcttttacactagctactataaaaggagatgaatacaccttcacgagctcaaacgccgaggacatcagagacctggtcgtcacgtttctcgagggtctgaggaaacgatctaaatatgtggtcgctttacaggataaccctaatccggcaggggaggagtcaggtttcctgtcctttgcaaagggcgacctcattattctggaccacgacacaggcgagcaggtaatgaacagcggatgggccaacggcataaatgagcgaacaaaacaacggggggattttccaaccgactcagtgtatgtgatgcctactgtgaccatgccaccacgcgaaattgtggctctggtgactatgacgcctgaccagcggcaggacgtggtgcgcctactgcagcttcgaaccgccgaacctgaggtaagagccaagccctacaccctagaggaattttcctacgattattttcgccccccccccaaacacaccctttcaagagtgatggtcagcaaggctagagggaaggaccgcctgtggtcgcatacaagagaaccactcaagcaggccctgcttaaaaagttactcgggagtgaagagctgtcgcaagaggcctgtctggcctttatagcagtacttaagtatatgggggattacccttctaaacgcaccagatctgtgaacgagttgaccgaccagatttttgagggacccctaaaggccgagccgctcaaggacgaagcctatgttcagatccttaagcaactgactgacaaccatattcgatattcggaggaaagggggtgggagctattatggctctgcactggtctgttcccaccctccaatatcctgttacctcacgtacagcgatttctgcagagtagaaagcactgccctcttgccattgactgtctccagcggctgcagaaggcgttgaggaacggttcacgcaagtatccacctcacttggttgaggttgaggccattcagcataagacgacacagattttccataaagtgtatttccctgatgacaccgacgaggcctttgaggtggagagcagtacaaaggctaaggatttttgccaaaacattgctactcgactcctccttaagtcctcagagggattctctcttttcgtgaagatcgccgacaaggttctaagcgtgcctgagaacgatttttttttcgactttgtccgccatctcaccgactggataaaaaaagcacgtcctattaaggatggcatcgtgccctcactgacttatcaggtgttttttatgaagaagctgtggacaaccaccgtgcctgggaaggacccgatggcggattctatatttcattactaccaggagctgccgaagtacctgagaggataccacaagtgcactcgagaggaggttcttcagcttggggctctcatctacagggtgaaatttgaagaggacaaaagctactttccttctattcccaagctcctcagagagttggtgcctcaggacttgattcgccaggtaagccctgatgactggaaaagatctatcgtggcgtactttaacaagcacgcgggtaaatcaaaagaagaggctaagctcgcctttctaaaattgattttcaaatggcctacatttggatcggccttcttcgaagtcaaacagactaccgagccgaattttccagagatcctgcttatcgcgataaataagtatggggtgagtctgatcgatcccaaaactaaggatatactgactacacaccccttcactaagataagtaactggtcctcagggaatacgtattttcatatcacaatcggtaaccttgtgaggggctctaagctcttgtgcgagactagtctgggctacaagatggatgaccttttgacctcgtatatatcgcagatgctgacagccatgtccaaacagagagggtcacggtccggtaagtag

SEQ ID NO: 196251 - DNA, 3609 bp, Artificial Sequence
  Description of Artificial Sequence: Synthetic coding sequence
gccctgctgcagaagggcgaccacgtgtggatggacctgcggctggggcaggaattcgacgtgccaatcggcgctgtggttaagctgtgtgattcgggtcaggtacaggtggttgatgatgaagacaatgagcattggatctcaccgcagaacgcaacccacattaagcccatgcatcccacttcggtccatggggtggaggacatgatacggttaggcgacctgaacgaggccggtatattgcgtaacctactaattcgctatagggatcatctgatctatacatataccggctccattctcgtcgctgtgaatccatatcagctgctgagtatttactcccccgagcacattagacaatatactaacaagaaaatcggagagatgccaccacacatatttgccatcgccgacaattgctatttcaacatgaaacgaaattcacgcgatcagtgttgtatcatctctggggaaagcggagcagggaaaaccgagtcaacaaaactgattttgcagtttctggccgccattagcggacagcacagctggattgagcagcaggtgctcgaggccactcccattttggaagctttcggtaatgccaaaaccattaggaatgataattctagccgtttcggaaaatacatagatatccactttaataaacgcggagcgattgaaggcgccaaaatcgagcagtatctactggagaagagtcgtgtgtgcagacaggccctggacgaaaggaactaccacgtgttttactgcatgctggaggggatgtccgaggatcagaagaagaaattaggtttggggcaggcttcagactacaattacctcgctatgggtaattgtattacgtgcgaagggcgagtggattctcaggagtacgccaatatcaggtccgcaatgaaggttctgatgttcactgacacggagaactgggagatatccaagctcctcgccgcaatcctgcacctgggtaacctgcagtatgaagctaggacttttgagaatttggacgcatgtgaggtactgttctcaccttccctggcaaccgcagcctcactgctggaggtaaaccctcctgatctgatgtcttgcctcacaagtcgaactctgattactcgcggagaaaccgtatcgaccccactgtcccgggaacaggccctggatgtgagagatgccttcgtgaagggaatttatggaagattgtttgtttggatagtggataaaattaatgccgccatttacaagcctcccagccaggacgttaagaacagcaggaggagcattggccttttagacatatttggatttgaaaattttgctgtgaacagttttgagcaactctgtatcaatttcgctaacgaacacctgcagcagttcttcgtgcgccacgttttcaaattagagcaagaagaatatgacctcgagagtattgactggctccacattgagttcacagacaatcaggatgccttggatatgattgcaaataaacccatgaatatcatttcattgatcgacgaagaaagtaaatttccaaaaggtactgacactaccatgctgcacaaattgaatagccagcacaagttgaacgcgaactacattcctccaaaaaataaccacgagacccagtttggaattaatcatttcgctggaattgtatattacgagactcagggctttctcgaaaagaatagagatacacttcacggcgacatcatacagctagtccattccagccggaataagtttatcaaacagatttttcaagcagatgttgccatgggggccgagactagaaaacggagtcctaccctgagcagtcagttcaagagaagtttagagttgttgatgaggaccctcggtgcctgtcagccattcttcgtccgctgcataaagcccaacgagttcaaaaagcctatgctgttcgataggcacctatgcgttagacagctgcggtactcaggaatgatggagacaattcggatcagaagagccggctaccccataagatactcattcgtcgaatttgtcgagcgctacagagtgctactgcctggcgttaagcctgcctataaacagggagacctcagaggaacttgccaaaggatggctgaggccgtgcttggcacccatgatgattggcagataggaaagactaagatcttcttaaaggaccaccatgatatgctgctagaagtagaacgcgacaaggcaattacagacagggtgattctgttacagaaggttattagggggttcaaagatcggtctaactttctgaagctgaagaatgcagctaccttgattcaaagacactggcggggtcacaattgtcgtaagaactatggactcatgaggcttggcttcttgcgcctgcaggctctgcacaggtcgcgtaagctgcaccagcagtacaggctggccagacagagaattatacagtttcaggccagatgccgggcttatctggtacgaaaagcttttagacataggctgtgggctgtgttgacagtgcaggcctatgcccgcgggatgatagctcgaaggttgcatcaaagacttagagccgagtacctttggcggttggaagccgaaaagatgcgtctggcggaggaagagaagctgcggaaggagatgtcagccaaaaaggcaaaagaggaagccgagaggaagcaccaggaacggttagcacagctcgctagggaggatgccgagcgagaactcaaggaaaaggaagctgctagacgcaaaaaggaactgctcgaacagatggaacgagcgaggcatgagccagtcaatcacagcgatatggtggataagatgtttgggttcctgggaacaagcggcgggttgcctgggcaagaaggtcaggccccgtcggggtttgaagatttggagaggggaagacgtgagatggtggaggaggacctagacgctgcactgcccttacctgatgaggacgaagaggatctaagtgaatataaatttgccaagttcgccgccacctatttccaggggacaacaactcactcatacaccagaagacctctgaagcagccactgctgtatcacgatgacgagggggatcagctagctgccctcgccgtttggatcaccattctcaggttcatgggagacttacccgagcctaagtaccacaccgccatgtctgacggatctgaaaagatccccgtcatgaccaaaatctacgaaacgctggggaagaaaacttacaaacgtgagctgcaagccctgcagggggagggggaagtgttacaggctcagttgccagaaggacagaaaaaatcctccgtgcggcacaaactggttcatctcactctaaaaaagaagtctaagcttactgaagaggtaacgaagagacttcacgatggggaatctacagtgcagggcaacagcatgttggaggaccggcctacctccaatctggagaagctgcatttcataatcggaaacggtatccttagacccgccctgagaagcgttccgcctgagagtctacttgttgctgaatggtgcctgtgccagcccagcaaacgtctgtcccaggcacctggctttgggttcgccgcttcatag

SEQ ID NO: 196252 - DNA, 6645 bp, Artificial Sequence
  Description of Artificial Sequence: Synthetic coding sequence
gccctgctgcagaagggcgaccacgtgtggatggacctgcggctggggcaggaattcgatgtccctataggcgccgtcgtcaaattgtgtgattctggtcaggtccaagtggtggacgatgaggataacgagcactggataagcccccagaatgcgactcacattaagccaatgcatcccacatcagttcacggcgtggaggacatgatcagattgggtgatttgaacgaggccggcatcctacgaaacttactaatccgctaccgcgaccacctgatttacacctacactggctctatcttggtggctgtgaatccttaccagctgctgagtatttattcaccagaacatatccgccagtacaccaacaagaagattggagaaatgccgcctcacatctttgcaatcgccgacaattgctattttaatatgaagcgcaactctagagatcagtgttgtattattagcggggaaagtggcgccggcaagacagaatcaacaaagctgattcttcaatttcttgcggccattagcggacaacatagttggatcgaacaacaggtgctggaagccactccaattcttgaggccttcgggaatgccaagacgattaggaacgataactcaagtcgatttgggaaatacatagatatacatttcaacaagcggggggcgatcgagggtgccaaaatcgaacagtatctgttggaaaaaagcagagtgtgtcgccaggcactggacgagcgaaattaccacgttttctattgtatgctggagggtatgtccgaggatcaaaagaaaaagcttggtctagggcaagcctcagattacaactatctggcaatgggcaactgcatcacttgtgaagggcgtgtggactcccaagagtacgctaacatccgctccgctatgaaggtcctcatgtttaccgacacagaaaattgggaaatcagcaagctgctcgccgcaatattgcacctgggaaatctgcaatacgaggctcggacatttgagaacttagacgcatgcgaggtcctcttctctccatctctggctactgcggcctctctactggaagtgaatccaccagatcttatgagctgcctgacctcacgaacgttgatcacgagaggcgagacggtatcaactcccctgagtagagaacaggccctggacgttcgcgacgcctttgtaaaaggtatttatgggcgcttgttcgtctggatcgtagataagattaacgctgctatctacaaaccccccagtcaggatgttaagaatagcaggcggtcaattgggttgttagacatatttggttttgagaactttgccgtgaacagctttgagcaactctgcatcaacttcgcaaatgagcatttgcagcagttcttcgttagacacgtgtttaagttggagcaggaagaatacgacttggagtccatcgattggctgcatattgaattcactgacaaccaagatgcccttgatatgatcgccaataagcctatgaatatcatttcactgattgacgaggaaagtaagttcccgaaaggaactgataccactatgctgcacaaattgaacagtcagcacaaactcaatgccaattatatcccaccaaagaataatcatgagacccagttcggcattaaccactttgcgggtatcgtttattacgagacccagggcttcctggaaaaaaatagggatactttgcacggagacattatccaactggtacattcgtcaagaaataagttcatcaagcagatttttcaagccgacgtggctatgggcgccgaaacgcggaaacgcagccccaccctaagctcccaatttaagcgttctctcgagctacttatgagaacactgggagcctgccaacctttctttgtaaggtgtattaaaccaaacgaattcaaaaaaccaatgcttttcgaccgccacctttgcgttcgtcagttaagatatagtgggatgatggagactatccggattaggagggccggataccccatcaggtacagtttcgttgagttcgtcgagaggtaccgtgtgctcctcccgggcgtgaagcccgcgtacaagcaaggggatcttcggggcacctgccagaggatggccgaagccgtccttgggacccatgacgactggcagattggcaagaccaagatctttctcaaggatcatcacgacatgctcctggaagttgaacgagacaaggcgatcacagaccgagtgattctgctacaaaaggtaattagagggttcaaggaccgcagcaatttcctcaaactgaagaatgctgctacacttatccagcgccactggagaggccataattgtcgaaaaaactacggcctgatgaggctgggattcctgcgactccaagctctccaccgttcccggaagttgcatcagcagtataggctggcccggcaaaggattatccagttccaagcaaggtgcagggcatatctagttagaaaggctttccgccaccgtctgtgggctgtgctaaccgtacaggcatacgctagaggaatgatcgcacggcggttgcatcaacgacttagggctgaatacctgtggagactagaagctgagaagatgaggttggctgaggaagaaaaactgagaaaggagatgtcagccaagaaagcaaaagaggaagcggaaagaaaacaccaagaacgactggctcagctcgcaagagaggatgctgagagagagctgaaggagaaagaagccgcccgaaggaaaaaggagttgctggagcagatggagagggccagacacgaacctgtgaatcattctgacatggtggacaaaatgtttggattcctggggactagtggcggtctgcccggccaggagggccaagctccatccggtttcgaagacctcgaacgaggaagacgcgaaatggtggaagaagacctggatgccgccctgcctctacctgatgaggacgaagaggacctgagcgaatacaaatttgccaaattcgctgctacttacttccagggcacaaccacccactcttatacgagaagaccattgaagcagccccttttataccacgacgatgagggagaccagttagctgccctcgccgtttggatcaccattctgcgcttcatgggggatctccccgagcctaaataccatactgcgatgtcggatggaagtgagaagatccccgtgatgacgaagatttacgaaaccctcggtaagaagacctataagagagaattgcaggcattgcagggcgagggggaggcacagctgccggagggccaaaagaagagctctgtgcgccacaagctggtgcacctgactttaaaaaaaaaatctaagttaactgaagaggtgaccaagaggctgcacgacggagagtcaacggtgcaagggaatagcatgctcgaggacaggcctacctcaaatctggaaaagctgcacttcattattggcaacggaattcttcgcccagcactgcgtgatgaaatctactgccagatcagcaaacagctgacccataaccccagcaagagctcatatgcacgcggctggatcctcgtgtcattgtgcgtcggttgtttcgccccatccgagaagttcgtgaagtatctgagaaattttatccacggtgggcctcctggttacgccccgtattgtgaagagagactgcggcggacgtttgtgaatggaacgaggacccagccaccttcatggctcgagcttcaggccacaaagagcaagaagccgatcatgctacctgtcacattcatggatggaaccacaaagacactactcacggatagtgccaccaccgcaaaagaactctgtaacgcgctcgcagataagatcagcttaaaggatcggtttggcttttctttatacatagccctgttcgataaagtgtcaagcctaggcagcgggtcagatcacgtgatggacgcgatttcgcagtgcgagcagtacgcaaaggaacagggagctcaagaaagaaacgccccatggcgtctgttttttcgcaaggaggttttcaccccttggcactcaccatccgaggataatgttgccacaaacctgatataccagcaggttgtcagaggcgtgaaattcggagagtatcgctgtgagaaggaagacgatctcgccgagctagcttcccagcagtacttcgtggactacggttcagagatgattctggaacgtcttcttaatttagtccctacctacatccctgatcgagagatcactccacttaagacattggagaaatgggctcagctcgcgatcgctgcacataagaaggggatatacgcccaaagacgcaccgatgcacagaaggtcaaagaagacgttgtgtcttatgctcgcttcaaatggccactgctattttccaggttctacgaggcatataaattttccgggccgagtctgcccaagaacgatgtaattgtggctgtgaactggacgggtgtttattttgttgatgaacaggagcaggtgctgcttgagctgtcttttcccgagatcatggccgtcagcagcagccgcgaatgcagggtttggctctccctgggctgcagcgacctgggctgcgcagccccacacagtggctgggcaggtctgacccctgctggtccatgtagtccgtgctggtcatgtcggggggcaaagacaaccgcaccctctttcacactcgccactattaaaggtgatgagtataccttcacctccagcaacgctgaggacataagagaccttgtagtgacctttcttgagggtctccggaagcggagcaaatacgtggtggccctgcaggacaatcccaacccagccggagaggaatctggcttcttgtccttcgccaaaggcgacctaataatccttgatcatgacacaggcgagcaggttatgaacagtgggtgggctaacggaatcaatgaaaggaccaagcagcggggagactttcctaccgactcggtgtatgttatgccaactgtgacgatgcccccacgtgagatcgttgccctcgttaccatgactccagaccaacggcaagacgtagtgcgtttgctgcagctgagaacagcagagcccgaggttagagctaaaccatataccttggaggagttctcttatgattactttcgtcccccccctaagcacaccctgtcccgagtgatggtcagcaaggcaagaggcaaggacaggctttggtcccacacccgcgaaccgctgaaacaggccctgctgaagaaactcttagggtcggaagaactctctcaggaggcctgtctggcttttattgctgtgctaaagtacatgggcgactatccctcaaagcgcacaaggagtgtgaacgagttgaccgaccagatcttcgaagggcccctgaaagccgagccgttgaaagatgaagcctacgtccagattttaaaacagctgacagataaccatattcgctactcggaagagcgaggctgggaactgctttggctgtgcaccggcctgtttcctcccagtaatattctgctgccacacgtgcagcggtttcttcagtctcgaaagcattgcccgctagctatcgactgtctgcagcgtctgcagaaagcattacgaaatgggtcccggaagtatcccccacacctcgtcgaggtggaggccatacagcataaaactacccagatctttcataaggtttacttcccagacgataccgatgaggctttcgaggtcgaaagctcaaccaaggccaaagacttttgtcagaatatcgcaacgcgcttgctgctaaagtcctctgagggctttagcctctttgtgaaaattgccgacaaggttctttccgtgccggagaacgatttttttttcgattttgttcgccacctcactgactggatcaagaaggctcgccccattaaggatggcatcgtcccgtccctgacatatcaggttttcttcatgaagaagctgtggacaactactgtccccgggaaggatcctatggctgatagcattttccactattatcaggagcttcccaagtacctaagaggctatcacaaatgtacccgcgaggaagtcttacagcttggcgccttaatctacagggtgaaatttgaagaagataaaagttacttcccctcaatccccaagctgttgagggagctggtcccccaggacctgattcggcaagtctctcctgacgactggaagaggtccattgtcgcgtacttcaataaacacgccggaaaatccaaggaagaggcgaaacttgccttcctaaagctcatattcaagtggcccacttttggcagcgctttctttgaggtgaagcaaaccaccgagcctaacttccccgaaattctgttaatcgccattaacaagtatggcgtctcgctgatcgaccctaaaacaaaggacatccttacgacacacccctttaccaagatatccaactggtccagtggcaatacttacttccatatcactatcggaaatctggtcagaggtagcaaactgctgtgcgaaaccagtctcgggtacaagatggatgatctgctgaccagctacatttctcagatgttgaccgcaatgtccaaacagcgtggttcaagaagcggaaagtag

SEQ ID NO: 196253 - DNA, 6648 bp, Artificial Sequence
  Description of Artificial Sequence: Synthetic coding sequence
atggtgatcctgcagcagggcgaccacgtgtggatggacctgcggctcggacaggaattcgacgttcccataggcgccgtcgtaaagctgtgtgatagcggacaggtacaggtggtagacgacgaggataacgagcactggatatccccacaaaatgcaactcatatcaaaccaatgcatcccacatccgttcatggggttgaggacatgatacgtctcggcgatctgaacgaggccgggatcctgaggaatttactgataagatatagagaccatctgatttatacctatactgggagtatcctggtggcagtgaatccttaccagctgctgtctatttattcgcccgagcatatacggcagtacacaaataaaaaaatcggggagatgcctccacatatcttcgctatcgctgacaattgttatttcaatatgaagcggaactcaagggatcagtgctgcatcatcagtggcgagtcaggagcgggaaagaccgaatcaacgaagctcatcttgcagtttctagccgctatcagcgggcagcacagttggatcgagcagcaggtcctagaagccaccccaatccttgaggcttttggcaacgcaaaaaccatcaggaacgacaactcttctagattcggcaaatatattgacattcacttcaataagaggggcgcgattgagggtgcgaagattgagcagtacctgctggagaaatcccgtgtgtgcaggcaggccctggacgaaaggaactatcatgtgttctactgcatgttggagggcatgtctgaggaccagaagaaaaaactcggactcggccaggccagcgattacaactacttagccatggggaattgtatcacttgtgaaggaagagtggactcacaggaatacgccaacattagatctgctatgaaggtcttgatgttcactgatacagagaattgggagatctcaaaactgctcgctgcgattttgcatctaggaaacctacagtatgaggccaggacattcgaaaatctggacgcgtgtgaggttctattctcaccatcactggccacggctgcttccttgctggaggttaacccacccgaccttatgtcctgtcttacatcaagaacgcttatcaccaggggcgagacggttagcacacctctgagtagggagcaggccctggatgttagagacgcttttgttaaagggatttacggccggctatttgtttggatagtggacaagatcaacgccgctatctacaagcctccgagtcaggacgtgaaaaatagcagacgatccatcggactgttggatatctttgggttcgagaacttcgctgtgaacagttttgaacaattgtgtatcaactttgctaatgagcatctccaacagttttttgtgcgccacgtgttcaagctggaacaggaggaatatgatctggagtcgattgattggctgcatatagaattcaccgataaccaagacgccctcgatatgatcgccaacaaaccgatgaacatcatctctctcattgatgaagagtctaagtttcccaaaggtaccgacactacgatgctacataaacttaacagtcaacataagttgaacgcgaattatattcctcccaagaataatcacgagactcagttcggaatcaaccactttgccggtattgtttactacgagacacagggtttcctggagaagaatagagacacacttcacggagacattatccagctggtacatagttcgagaaacaagttcatcaagcaaatttttcaggcagatgtggccatgggcgcagagacccgcaaaagatctcccacgctgagcagccagtttaaacgatctttagaacttctgatgagaacactgggagcttgccagccctttttcgtcaggtgcatcaaacccaacgagttcaagaaaccaatgctctttgaccgccacctctgtgtgcgccagctgcggtattctggtatgatggagacaatccgtatcaggagagcaggctatccaatcagatactcctttgtggagtttgtcgagcggtaccgggtgctcctacccggggtgaaacctgcttacaaacaaggtgatcttcgggggacatgccagagaatggcagaagcagtgctgggcacccacgacgattggcagattgggaaaaccaagatcttcctgaaggaccaccatgacatgctgctggaagtcgaacgggacaaggctatcaccgatagagtcattctgctacaaaaagttatccgaggcttcaaagaccgatccaacttcctcaagctgaagaatgctgccacgctcattcaacgccactggcggggacataattgtcgcaagaactatggtctgatgcgcctcggctttttacgactccaggccctgcacaggagtcggaagctccatcaacagtacagactcgccaggcagcggatcatacaatttcaggccagatgcagagcatacctcgtgcgaaaagcgttccgacatcgtctatgggccgtgcttacagtgcaggcttatgcccgcggtatgatcgcacgtagactccaccagcggctgcgagctgagtacctgtggaggttagaagcagaaaaaatgcgactagcggaggaagaaaagctacgaaaagagatgtccgcaaagaaggctaaggaggaggccgagcgcaagcaccaggaaaggctggcccagctggcacgggaggatgccgaacgcgagctgaaagagaaggaggcagccagacggaagaaggaactgctcgagcagatggagcgggcccgtcacgagccagtgaatcattctgatatggtggataaaatgttcggctttctgggcacaagtggcggtctgccaggacaggaaggacaggctccatctggtttcgaggacctggagagagggaggagggaaatggtggaggaagaccttgacgcagcattacctttgccagacgaggacgaagaagacctctccgaatataagtttgccaaatttgccgctacttactttcagggaacaactacacattcatacactcggcgtcccctgaaacaacccctgctgtaccacgacgatgaaggggaccaactcgctgcactagcagtgtggattacaatccttcgcttcatgggagacttacccgaacccaaataccacacagccatgtctgatgggtcagagaagattcccgtgatgaccaagatttatgagaccctcggtaaaaagacctacaaacgagaactgcaggcacttcagggcgaaggggaggcacagctgccagaagggcaaaagaagtcctcggtcaggcacaagctcgtccacctcacacttaagaaaaaatcaaagctaacagaggaggtaacaaagcgactgcacgatggtgagagcaccgtgcaaggcaactccatgctcgaagaccgccctacttccaacttagagaagctccactttatcatcggcaatggcatccttcggccggcactgcgggatgaaatctactgccagatcagtaagcagctcactcataatccctccaaatcatcctacgccagaggctggatcctcgtctccctgtgcgttggatgtttcgctccaagcgagaagttcgtcaagtatctgcgcaactttatccacggcgggccgccaggatatgcaccttattgcgaggagagacttcggcgaaccttcgtaaatggcaccagaacccagcctcccagctggttggaactgcaagcgaccaagtccaaaaagcctattatgctccccgtgacgttcatggacggcacaacaaagactttgctgaccgattccgcaactaccgccaaggaactctgcaacgcactggccgataaaatctctcttaaggataggtttggtttctcgctgtacatcgccctctttgacaaggtgagctctctaggctcagggtccgatcacgtgatggacgcaattagtcagtgtgagcaatatgccaaagaacagggtgcccaggagcgcaacgccccatggcggttgttctttagaaaggaagtatttaccccctggcattctccctctgaagacaatgtggcgaccaacctaatataccaacaggtcgtgaggggcgtgaagttcggagagtatcgttgcgaaaaggaggacgatctggcagagctggccagccagcaatacttcgttgattatggaagcgagatgattctggagagactactgaatcttgtgccaacctatattcccgatcgggaaattacccccttgaagactctggagaagtgggcccaactggctattgcggcccacaaaaaaggaatctacgcacagaggcggactgacgctcagaaggtgaaagaagacgtggtgtcttatgcccggttcaaatggccactgctgttctcccgtttctacgaagcatataaattttccggccctagcttacctaagaacgatgttatcgtagctgtgaactggactggcgtctatttcgtggatgaacaggagcaggtactcctagaattgagctttcccgagataatggccgtatcctccagccgagaatgccgggtgtggcttagcctcggctgttctgatctgggctgtgccgctcctcatagtggttgggcggggctaacaccagcaggtccctgcagtccctgctggagttgtagaggggccaagacaactgctccctcattcacgctggccacaattaaaggagatgagtacaccttcacctccagcaatgccgaagacatcagagatctggtcgtgacctttctggagggattacggaagaggtccaaatatgtggtagccttacaggacaacccaaatcctgctggggaagagtccggatttttatccttcgcgaagggcgatttgatcattctcgatcatgatactggtgaacaggtcatgaactctggctgggctaatgggattaacgaacggaccaagcagcgaggggactttccaaccgatagcgtctacgtgatgccgactgtgacaatgccccctcgggagatcgtggctctggtgaccatgacacctgatcaacgccaggatgtggtcaggttgctgcaactgcgaaccgcggagccagaggtgagggccaaaccttacacgttggaggagttctcatacgattattttcgacctccgccaaagcacactctgagccgcgtgatggtctctaaggcccggggtaaagaccgtctttggagccacacgcgagaaccactgaaacaagcactcctcaaaaagcttttggggtcagaagaactgtcacaggaagcatgcttagcctttatagccgtgctgaagtacatgggagactatccttcaaaaagaactagatccgtgaatgaactgaccgatcaaatttttgagggccccctcaaggccgagccgcttaaagacgaagcctacgtgcagattctcaagcagcttacagataatcacattagatattcagaagaacggggttgggagctcctatggctgtgcactggtctcttcccaccttccaacatcctgttgccccacgttcaaaggttcttacaaagcagaaagcattgcccccttgccatcgattgcctgcagagactgcaaaaagccctacgcaatggatcccgaaagtaccctcctcacctggtagaagtggaggcaatccaacataaaactacacagatattccacaaggtctacttccctgatgacacagacgaggccttcgaggtggaaagttccacaaaggctaaggatttctgtcagaatatcgccaccaggctccttcttaagagttcggaaggattctccctttttgtgaaaattgctgataaagtactttccgtgcccgagaacgattttttcttcgattttgtgaggcatctaaccgactggattaagaaggcgcggccaatcaaggatggtatcgttccaagcctgacctaccaggtctttttcatgaaaaagctatggaccacaaccgtccccgggaaggatccaatggcagatagtattttccactattaccaggaactgcccaaatacctgagaggataccacaaatgtacccgggaggaagtactgcaactgggtgccctgatttaccgcgttaaattcgaggaggataagtcctactttccatctatccccaagctactgagagagctggtaccacaagacctgattagacaagtgtctcccgatgactggaaacgcagtatagttgcatacttcaacaagcacgctggcaagtccaaggaggaggctaaactggcctttttgaaactcatctttaaatggcccaccttcgggagcgccttctttgaagtaaaacagacaacagagccgaattttcccgagattctgctgattgccataaacaaatacggagtgagcctcatagatcccaaaactaaagacatcctgacaacccaccccttcaccaagatctccaattggagctccgggaacacatatttccacattaccattgggaatttggtacgaggcagtaaactactgtgtgagacgtcccttggttacaagatggatgatctgctgaccagttatatctcgcagatgttgactgccatgtcaaagcagcggggcagcaggagcgggaagtag

SEQ ID NO: 196254 - DNA, 3537 bp, Artificial Sequence
  Description of Artificial Sequence: Synthetic coding sequence
atggtgatcctgcagcagggcgaccacgtgtggatggacctgcggcttgggcaggagtttgatgtgcctatcggggccgtggtgaaactttgcgacagcggccaagttcaagttgtcgatgatgaggacaacgaacactggatcagccctcaaaacgcaacccacatcaagccaatgcacccaacatcagtgcatggggttgaggacatgattcgcctcggtgacctgaatgaggcggggatcttgaggaatctgctcatccggtatagggaccacttaatctacacctataccggcagcattctggtcgcagttaatccttaccagctgctgtcaatctattcacccgaacatatacgccagtacacaaataaaaagataggcgaaatgccaccccatattttcgctatcgctgataactgttacttcaacatgaagagaaactctcgggaccaatgctgtatcatctccggagagagcggcgcaggaaaaacagaatcgaccaaacttatactgcagtttctcgcagctatctccggccagcacagctggattgaacagcaggtgcttgaggctaccccaatactggaggcatttggcaatgccaagactatccgtaacgacaattcatcccgattcgggaagtacattgacatccatttcaataagaggggcgctatcgagggggcaaagatcgaacagtatctcctggaaaagtctagggtctgtcggcaggcacttgacgagaggaattaccacgttttctattgtatgctggaagggatgtccgaagaccagaaaaagaagctcggcctaggacaagcaagtgattataattatctggccatgggcaattgtataacttgtgaaggaagagtcgactcccaagaatatgcgaacatccgcagcgccatgaaagtcctgatgttcactgataccgaaaactgggagatcagcaagctgctcgccgccattctccatctgggcaatctccagtacgaggcccgtacattcgagaacttggacgcttgcgaggttctcttctcacccagtttagccactgcggcctctctactggaggtgaatccgccagatttgatgtcatgtcttacatctagaacgctgattacccggggagagaccgtgtctacccccctttccagggagcaggctctggacgtccgtgacgcttttgtgaaaggcatatacggcagattattcgtgtggatcgttgacaagatcaatgccgctatttacaagccgccctctcaggacgttaagaactcacgacgcagcatcggactgctcgacatattcgggtttgagaacttcgccgtaaatagtttcgagcagctgtgcatcaatttcgccaatgagcacctccagcaattttttgttcggcacgtgttcaaacttgagcaagaggagtatgacctggaaagtatcgactggctgcacatcgaatttactgacaatcaagacgccctggatatgatcgcaaataagcctatgaatattatctctttgatcgacgaagagtccaagttcccaaaggggaccgacacaactatgcttcataaactgaactcacagcataaattgaacgccaattacatccctcctaagaacaaccacgagacacagttcggaatcaaccacttcgccggcatagtgtactatgagacccaggggttcttggagaagaatcgagatacactgcacggtgacataatccagcttgtccatagtagtagaaacaagtttataaagcaaattttccaagccgatgtggctatgggagcggaaaccagaaaacggtctcccacactctcgtcccagtttaagaggtctctggagctactcatgagaacccttggggcctgccagcccttttttgtgcgctgcatcaaacctaatgagtttaagaaaccaatgctctttgaccgccatctctgcgtgcggcagctgagatatagcggtatgatggagactatccggataaggagggcggggtacccaataagatatagcttcgtcgagttcgtggagcggtacagggtgttactgccaggggtgaagccagcttacaagcaaggggacctgaggggaacctgccagcgcatggccgaagcagtgcttggcacacacgacgattggcaaatcggcaagacaaaaatattcctgaaagaccaccacgatatgttgctggaggtggaacgagacaaagctatcaccgatcgagtcattctgctgcagaaggtgatccgcgggttcaaagatcgcagtaactttctgaaattgaagaatgctgcaacactgatccagaggcactggagaggccacaactgccgaaaaaattacggtttgatgcggctcgggttcctcaggttacaggcgttacacaggagcaggaagttgcatcaacaatatcgcctcgcaagacaacgcatcatccagtttcaagcacgttgccgagcctatcttgtccgcaaggccttcaggcaccggttgtgggctgtgctcaccgttcaggcgtacgctcgtggaatgatcgcccgccggctgcaccagagattgcgggcagaatacctctggagattagaggccgagaagatgcgtctggcagaggaggagaagctccggaaggaaatgagtgccaagaaagccaaggaggaagctgaacgcaagcatcaagagcggctggcgcagctggcgcgagaggacgccgagagggagttaaaagaaaaggaagccgctcgcaggaaaaaggagctgctcgaacaaatggaacgtgcgagacatgaacctgtgaaccactctgatatggtcgataaaatgttcggtttccttgggacatcgggcggtttgcctgggcaggaaggtcaggcccccagcggcttcgaggaccttgaaaggggccgcagagagatggtggaagaagacctggacgctgcgctccccctgccagacgaagatgaggaggatctttctgaatataagttcgccaaatttgccgccacatattttcaggggactacaacccactcctacactcgccggccgctgaaacagcctctcctctatcatgacgatgagggcgaccagctggcggctctggcagtgtggattacgatcttgcgattcatgggggatttgcccgagcccaaatatcacactgccatgtccgatgggagcgagaagatccccgtcatgaccaaaatttacgaaacccttggtaaaaagacttacaagcgggaactccaggccttgcagggcgagggagaagcccagctcccggaaggccaaaagaagagttccgtcagacataagctggtgcacctcacactgaaaaagaagtcaaagctgaccgaggaagtcactaagcgcctgcacgacggtgagtccacagtgcaagggaattccatgcttgaggaccggcctacatctaatctggaaaaactgcatttcattattggaaacggaattctccgcccggctctgaggagcgtccccggaggcggagatacccgggcctag

SEQ ID NO: 196255 - DNA, 6528 bp, Artificial Sequence
  Description of Artificial Sequence: Synthetic coding sequence
atggtgatcctgcagcagggcgaccacgtgtggatggacctgcggttgggccaagagtttgatgttcctatcggcgctgtcgtaaagttgtgcgacagcggtcaggttcaggtagttgacgacgaggataacgaacactggatttcaccccagaacgcgacacacataaaacctatgcatcctaccagcgtccacggcgtggaggatatgattcgcctcggagatctgaacgaggcaggaatcctcaggaatttattgatacggtacagggatcacttgatctatacctacaccggtagcatactcgtcgccgtgaacccttaccagctgctgagtatctatagccccgaacacataaggcagtacaccaacaagaaaataggtgagatgccaccacacatcttcgctattgctgataactgctattttaacatgaagcggaattcccgagaccagtgctgcataatcagcggggagagcggcgcgggaaaaacagagtcaactaagttgatcctgcaattcctggccgctatttctgggcaacactcctggatagagcaacaggtgctagaggccacacccatacttgaggcttttggcaacgccaaaaccattagaaacgataatagcagtagatttggcaaatacatcgacatccacttcaacaaaagaggcgccatcgaaggcgccaaaattgagcagtatctcctggaaaaatcccgggtatgtagacaggctcttgacgaaaggaactaccacgttttctactgcatgcttgaagggatgtctgaggaccagaaaaaaaagcttggactgggccaagcgtctgattataactacctcgctatgggtaactgcataacgtgcgaagggcgcgtcgacagccaagaatacgcaaatatccggtcagccatgaaagtactgatgttcactgacaccgaaaattgggaaatctccaagctgctggcagccatacttcacctaggaaatttgcagtacgaagcacgcacctttgagaacctcgatgcatgcgaggttttgttttcccccagtctggcaacagctgccagcctgctggaggtgaatcctccagacctgatgtcttgcttgacatcccgcaccctgatcacccgaggggaaaccgttagtacccccctgtcacgagaacaggctctcgacgttcgcgatgcattcgtcaaaggaatctacgggaggctgtttgtgtggattgtggataaaattaacgcggcaatttataaacctccttcgcaagatgtcaagaatagccgccggtccattggcctccttgacatttttggctttgagaattttgccgttaatagcttcgagcagctttgtatcaattttgctaacgaacaccttcagcagttcttcgtcagacacgtgttcaaactggagcaagaggagtacgatctagaaagcattgattggctgcacattgagttcactgataaccaggacgcactcgacatgatcgctaataagcctatgaacattatatccctgattgacgaggagagcaagtttcccaagggtactgatacgaccatgttgcataaattgaattcacagcacaagctcaatgcaaattacattcctccgaagaacaatcacgagactcagtttggaattaaccacttcgcaggcatcgtctactatgagactcagggctttctagagaaaaacagagacacgttacacggcgacatcatccagctcgtgcattcgagcagaaataaatttatcaagcagatcttccaagcagacgtagccatgggcgctgagaccagaaagcgttctcccactctgagctcacagtttaagaggtctctcgaattattgatgcggaccttaggagcctgccagccattttttgtaaggtgcatcaaaccgaatgagtttaagaagcccatgctttttgatcggcacttgtgtgtgcgtcagttgagatactcgggaatgatggagactattaggatccgaagggctgggtatcccatccgctactctttcgttgagttcgtggaacggtaccgtgtccttctacctggggtcaaacctgcatacaagcaaggagacctgaggggaacctgccagcgaatggcagaagccgttctgggaacacatgacgattggcagatcggtaagactaaaatcttcctcaaagatcaccatgacatgctcctcgaagtggagagggataaggctatcacagatcgcgtcattttacttcagaaggtgattagaggattcaaggaccgctctaacttcctcaaactaaaaaatgccgccaccctgatccagcgccactggcgcggacacaattgtagaaaaaactatggactgatgagactaggcttcctgagactacaggctttacatcgctcccgcaagctgcaccaacagtacagactcgcccgacagagaattattcagtttcaagcccgttgccgcgcttaccttgttaggaaagccttcagacaccgcctgtgggctgtcctgaccgttcaggcatacgcgcgaggtatgatcgcccgaagactgcaccagcggttgcgggcagagtatctctggcgccttgaggccgaaaaaatgcgcctggcggaggaggagaagctgcggaaggaaatgtccgcaaagaaggctaaagaagaagctgaacgcaaacatcaggagcggttggcccagctggcgcgcgaggacgccgagagggagttgaaggaaaaggaggccgcgaggcgtaagaaagagctgctggaacagatggaacgcgcgcgccacgaaccagttaatcattcagatatggtggacaaaatgttcggttttctgggaaccagtggcgggctgcctggtcaggagggccaggcgccaagcggttttgaggatctggagcggggccgccgcgaaatggttgaggaagatctggatgctgcacttcccctgccagacgaggatgaagaagacctgagtgagtataagtttgctaaatttgcagccacttacttccagggaactactacccacagctacacaaggcggcccctcaaacagccgctactgtatcatgacgacgagggagatcagttggccgcattggccgtttggattaccatccttcgattcatgggcgacctcccagagcctaagtatcacaccgctatgagcgatggctcagagaaaatacccgttatgaccaaaatatacgaaacccttggaaagaagacatacaaacgagaactgcaggcacttcagggtgaaggcgaggctcagctgccagaaggccagaaaaaatccagtgtgagacataagttggtccacctcacactaaaaaagaagtctaaactgacagaagaagtcacgaagaggcttcatgatggcgaaagcacagtgcagggaaattctatgctcgaggatcggccgactagtaatctcgagaaattgcattttatcattggaaacggaatactgcgcccagcactgcgagatgaaatctactgtcagataagtaagcagctgacccacaacccgtctaaatctagctacgcccggggatggatcctggttagcctgtgcgtgggctgctttgctccttctgaaaaatttgttaagtatctccgaaattttatacatggaggcccgccgggatacgctccatactgcgaggaacgtctccgcaggacttttgtgaatgggactcgaacacagcctccctcatggctggagctacaggcaacaaagtccaagaagccaatcatgctgccggtgactttcatggacggtacaaccaagacactcctcacagattctgctaccaccgccaaagagctatgcaatgccctggctgataagatttccctcaaagaccgctttggctttagtttgtacatcgcactttttgacaaagtttcgtccctggggagcggctccgaccacgtgatggacgccatcagtcagtgtgagcagtacgctaaagaacagggtgctcaagagcgcaatgcgccatggagactctttttccggaaggaagtgtttaccccatggcatagcccctcagaggacaatgtggccacaaatctcatctaccaacaggtagtgagaggcgtgaaatttggggaatatcgatgtgaaaaggaagatgacctcgccgaactcgctagccagcaatatttcgtagactacggtagcgaaatgattttagaacgcctgttaaacctggtacccacctacattcctgatagagagattacccccctcaaaaccctggaaaaatgggcccagttggcaatcgctgcacataaaaaaggcatatacgcgcagagacggacagacgctcagaaggtaaaagaggatgtcgtttcttacgcacggttcaaatggccccttctattcagtcggttctacgaagcctacaagttctccggaccctccctcccgaagaatgatgtgattgtggcagtcaattggacaggtgtgtatttcgtcgatgagcaggagcaggtcctcctagaacttagctttccagaaatcatggccgtcagctcctctagaggcgcaaagacaactgccccctcgtttactcttgccaccattaagggggatgaatacacgttcacctccagcaacgccgaggacatacgggatttggtagtaacttttcttgagggcctgcgaaaaagaagcaaatatgttgtggctctccaggataacccaaaccccgccggcgaagagtccggctttctgtctttcgctaaaggtgacctgataattctcgaccacgatacgggggagcaggtaatgaactctggatgggccaatggaataaacgaacgaaccaagcagcgcggggactttcctaccgattcggtctacgtgatgccaactgtaacaatgcctcctcgagaaatcgtagctttagtgaccatgacccccgaccagcgccaggacgtggtgaggcttctgcagttgcggactgcagaaccagaggtacgggctaagccatatactcttgaagaattcagctatgattactttaggccgcctcctaagcacaccttgtctcgagtgatggtgtctaaggcccggggaaaggaccggctttggtcccataccagggagccactgaagcaggcacttttgaagaaattactgggctccgaggagctatcccaagaagcctgcctggccttcattgccgtgcttaagtatatgggggactacccgtctaagaggactcgcagtgttaatgaacttaccgaccagattttcgaaggcccactgaaggctgagccgctgaaggatgaagcctatgtccaaatattgaaacagctcacggataatcacataagatatagcgaggaacgagggtgggagctgctatggctttgtacaggcctcttccctccgtcgaacatcctgctcccgcacgtccagcggttcctgcagtccaggaagcattgcccccttgctattgactgcttgcagagactgcagaaagctctaaggaatggttcacgcaagtatcccccacacctggtcgaggttgaagcaatccagcataaaactacccagatctttcacaaagtctattttcctgacgacacagacgaagcatttgaggtcgaatcgtctacaaaggcgaaagacttttgccagaatattgccaccagacttttgctaaaatcttctgagggcttcagcttgttcgtgaagatcgccgacaaggtgttgtccgtgccagagaatgatttctttttcgactttgttcgtcacctcaccgactggatcaagaaagcccgtcctattaaagatggcattgtaccttctttaacctatcaggtgtttttcatgaagaagctgtggacaaccactgtcccgggcaaagatcccatggcagatagtatattccactactaccaagaactgcccaagtacctgagggggtatcacaagtgtacccgcgaggaggtgctgcagcttggcgccctgatctatcgtgtcaaatttgaggaagacaagtcctactttccctccatacctaagcttctacgcgaactggtgccacaggacttaatccgtcaggtgtcccccgatgactggaagcgttctatcgtggcttactttaataagcacgccggtaagtccaaggaagaagctaagctcgctttcttgaagcttatctttaaatggccaacctttggcagtgctttttttgagcagacgacagagccaaatttccctgagatcctcctgatcgcgattaataagtatggagtatccctgattgatcctaaaacaaaggatatactgaccacacacccctttaccaaaatatccaactggtcatcaggcaatacctactttcatatcacgatcggaaatttagtcagagggtcgaaactgctgtgcgaaaccagcctgggatacaaaatggacgatttactgacaagttacataagtcagatgttgacagcaatgagcaagcagcgggggagccgatccgggaagtag

SEQ ID NO: 196256 - DNA, 2532 bp, Artificial Sequence
  Description of Artificial Sequence: Synthetic coding sequence
ggcctgagcgtgcagtggctgctggacggcctggcctgcttcttcgcaagcctgcacgttcccctcgggcgggtacaactgcacgccagcgcaagagggatccaggagaaggaggatgacttggcggagctcgcatctcagcagtacttcgtggattacgggtccgagatgatccttgagcggctgctaaacctggtgcccacatacatccccgaccgcgagataactcccctgaagacgttagagaagtgggcacaacttgctatcgccgctcataagaagggaatctacgcccagcggcggacagacgcacagaaggtgaaggaagatgtggtttcctatgcccggttcaagtggcctcttttattctcacggttttacgaggcatacaaattctcaggacccagcctcccaaaaaacgacgttatcgtagcagtcaactggaccggagtatactttgtagatgagcaggagcaagtgctgctggagttgtcttttcctgaaatcatggccgtctcatcctctagaggggcgaaaacgacagctcccagttttaccctcgcaacaataaagggtgatgaatatacatttacaagttctaatgcagaggacattcgcgatctggtggtgacgttcttggaaggcttgagaaaacggtccaaatacgttgtagccctgcaggacaatccaaaccccgcgggcgaggagtcaggttttctaagtttcgctaaaggcgatctgattatcctggatcatgataccggcgagcaagtcatgaactctgggtgggcaaatggtattaacgaacgtacaaaacaacggggagactttccaaccgatagcgtgtatgtcatgcctacggttacaatgcccccccgcgagatcgtggctctggtgacaatgacccccgatcagagacaggatgtggtcagacttctccagctgaggacagccgagccagaggttcgtgccaaaccctatacactggaggagtttagttatgattacttcaggcctcccccgaagcacactctgagtagagtgatggtttcaaaggccagagggaaggatcggctttggtcccatacacgagagcctctcaaacaggcattgttgaagaaactcttagggagcgaggaactgtcccaggaggcttgccttgcattcattgcagtgctaaaatacatgggcgactatcccagcaagcgtactagaagtgtcaacgaactgactgatcagatcttcgaggggcccctgaaggcagaaccgctcaaggacgaagcctacgtgcagattctcaagcagcttacagataaccacattagatatagcgaggagcgaggctgggagctcctgtggttatgcacaggactgtttccgccatccaacattctcctcccacatgtccagcgttttcttcagtcgcggaagcattgtcctctggccatcgactgtcttcagagactacagaaggccctccgtaatggtagtcgaaagtatccacctcacctggtggaggtggaggctatccagcataagaccactcaaatcttccacaaggtgtactttcctgacgacacagatgaggctttcgaagtggaaagctcgacgaaagctaaagacttctgtcagaacatagcgacccgcctcctgttaaagagctctgagggcttcagtctgttcgtgaaaattgccgataaggttctgagcgtccctgaaaatgattttttttttgattttgtgaggcacctgaccgattggattaaaaaggcccgtcctattaaggatggcatcgtgcctagcttaacttaccaagtattctttatgaagaagctttggactactaccgtccctggcaaagaccccatggccgactctatcttccactactatcaggagcttccgaagtaccttagaggttatcacaagtgcactcgggaagaagtgttgcaactcggcgccttgatctacagagttaaatttgaggaagacaaatcttacttcccgtctattcccaaactgctgcgggagctggtgccacaggatcttatccgtcaagtcagtccagacgattggaaaagatctattgtggcctacttcaataagcacgccgggaagagtaaggaggaggcaaagctggctttcctgaaactgatcttcaaatggcccacctttggatctgccttttttgaagtgaaagtgcaccacggacttttacgagccgaggaggaaggaaacagagctttgattaagcaccgagactctagcctcggcctttgggagcgtgccatggctctcgatacctgccctggtgaaggcaggagagctgccccctccgccttgtctcagctgtctgtcctggccggcgtcagtccgggagacaggggtactcggcggtcctctgcatggcagtggagacagacatgtaaacaggcgggcgtcatggaggacggcctgtgctcggatacaggggaaccatcccccaggtggcagtcatccggcggatcagcggggtgtgagaaggcatcctag

SEQ ID NO: 196257 - DNA, 4167 bp, Artificial Sequence
  Description of Artificial Sequence: Synthetic coding sequence
atgcggctgggcttcctgcggctgcaggccctgcaccggagccggaaactgcatcagcagtacaggctcgcacgacagagaataattcaattccaggctcgctgtagggcctacctggttcggaaggcatttcgtcataggctctgggccgtcttgaccgtccaggcttacgcgcggggcatgattgctaggcggctccaccagcggctcagggccgagtatctatggcgtctcgaggctgagaaaatgcgcctggccgaggaggagaaactgcgcaaagagatgtccgccaaaaaagcaaaagaagaggccgaacgcaagcatcaagagcgcctggctcaactggcacgcgaagatgcagaacgggaactgaaagagaaggaggccgcccggagaaagaaagagctgttggaacaaatggaacgggcccgtcatgagccagtgaatcactcagacatggtagataaaatgtttggcttcctcggcaccagcggaggccttcctggtcaagaaggtcaagccccatccggctttgaagacctcgagcgcggcagaagagagatggttgaagaagatcttgacgccgctctccctctgcccgatgaggatgaagaagatctttccgaatataagtttgccaagtttgctgcaacctattttcagggtacaaccactcacagctataccaggaggccactgaaacaacccctcctgtaccacgatgatgaaggtgatcagttggctgctctcgcagtgtggataacaatccttcgtttcatgggcgatttgcccgaacccaagtaccataccgccatgtctgatggctctgagaaaattcccgtaatgaccaagatctatgaaacactaggtaagaagacgtacaagcgggagctccaggcgttgcagggagaaggcgaagcccaactccccgaaggccagaagaaaagtagcgtgcgtcataaacttgttcacctcaccctcaaaaagaaatcgaagctcacggaggaagtcactaagcgccttcacgatggtgagtccaccgtccagggcaatagtatgctcgaagatcggccaacgtctaacttagagaaactgcacttcatcatcggaaacgggattttgaggcccgctctgcgagacgaaatctattgccagatttcaaaacaactgacccataacccgtcgaaatcctcctatgcacgtggatggatcctcgtctcactgtgcgttggctgtttcgcgcccagcgagaagttcgtaaaatacctccgcaactttatccacggaggccccccagggtacgcgccttactgtgaagagaggctccgccggacctttgtcaacggcacgcggacccagcctccctcttggcttgagcttcaagctaccaaatccaaaaagccaatcatgctccccgttactttcatggatgggaccacaaaaacccttctaacagattccgccactacagccaaggagctttgtaacgccttagccgataaaatctctctgaaagataggtttggattcagtctgtatatcgcactcttcgacaaagtgagtagcctcggatccggaagcgatcacgtcatggacgccatcagccagtgtgaacagtatgcaaaagaacaaggggcccaggaacgcaatgcaccgtggcggctgttttttcgtaaggaggtctttacgccctggcactccccatccgaggacaatgtagctacaaatctgatttaccagcaggtggtgcggggagtgaagtttggagagtaccgctgtgagaaggaggatgatctggccgagttggcaagccaacagtacttcgttgattacgggagcgaaatgatcctggaaaggctgctcaacctagtgcccacctacatccctgatagagaaataactccgctgaagaccctcgagaaatgggcacaactagcaattgccgcgcacaagaagggcatatacgctcaacgcaggactgacgctcaaaaagtgaaggaagatgtcgtgagttacgccagatttaagtggcctctgctgttctctagattctatgaggcctataagtttagtggtccctcactccccaaaaatgacgtcatcgtggctgtgaattggactggcgtgtacttcgtggatgagcaagagcaggtgctgcttgaattgtcgttccctgagatcatggctgtatctagcagccggggggccaagacaaccgcgccgtcttttaccctggccactataaaaggggacgagtacacattcacaagtagcaatgctgaggacatccgcgatctggtggtgacgtttcttgagggtctgaggaagcgctctaaatatgtagtcgccctgcaagataatccaaatcccgctggggaggaaagtggattcctctccttcgccaagggcgatttaatcattctggaccatgatacaggtgagcaagttatgaactctggatgggctaatggaattaacgaaagaaccaagcagcggggcgacttcccaacagattcggtatatgtcatgccaactgttacaatgccaccacgcgagatagtcgcattggttaccatgacacctgaccagcgtcaggacgtggtgagactgctccagctgaggactgcagagcctgaggtgcgcgctaagccttacactctcgaggagttttcttatgactattttcgtcctccccccaaacacacactgtcccgcgtgatggtatccaaagccagaggcaaggaccgactgtggtcgcacaccagagagcccctgaaacaggcactcttaaagaagctcctggggagtgaggagctatcccaggaggcttgcctggcctttatcgcggtgttgaaatacatgggtgattatccaagcaaaaggactcggtcagttaacgaactgaccgaccaaatttttgaggggcccctgaaggccgaaccacttaaagatgaagcatatgtacagatactgaagcaactgactgacaatcatatcagatatagcgaggaaaggggatgggaactactgtggctctgtaccgggttattcccaccaagtaacatcctactcccccatgttcaacgctttttgcaatcacggaagcactgtcccctcgccatagactgtttgcaaagacttcaaaaggctctgagaaacggctcacggaagtaccctccacacctggttgaagtggaggccatccagcacaagacaactcagattttccacaaagtctactttcctgatgacactgacgaagccttcgaagtcgaaagcagcacgaaagccaaagacttctgtcaaaacattgccacacggctgttattaaagtcgtccgaagggttttctttgtttgtgaagatcgccgacaaagtgctttctgtccccgagaatgactttttctttgattttgttaggcatctgacggattggatcaagaaagctaggcccatcaaagatggaatagtgccctctttgacttatcaggtgttctttatgaagaagctatggaccaccacggtgcctggcaaggatcccatggccgatagcatctttcattattatcaggagctccccaaatacctccgaggctaccataaatgcacccgcgaggaggtgctgcagttgggagctctgatataccgagtgaagtttgaggaagacaaaagctattttccttctatccctaaactattacgagaactcgttccccaggacctgattcgtcaggtgagtcctgacgattggaaaaggagtattgtggcttattttaacaaacatgcgggtaagagcaaagaggaagccaaattggccttcctcaaactcatcttcaaatggccaacctttggtagtgctttctttgaagtaaagcagacgaccgagccgaattttccagaaattctgcttatcgccatcaataagtacggagtgagtctgatagatcccaagacaaaagatattctgacaacacatccgttcaccaaaatctccaattggagcagcggaaatacttactttcatatcaccattggcaacctagttcggggtagtaagctgctgtgcgagacaagcctaggttacaagatggacgatttgctgactagctacatcagtcagatgctaaccgcaatgagcaagcagagggggtccaggtcaggaaaatag

SEQ ID NO: 196258 - DNA, 2580 bp, Artificial Sequence
  Description of Artificial Sequence: Synthetic coding sequence
atgggccggaagctggacctgagcggcctgaccgacgacgagaccgaacatgtgctccaagtggtgcagagagactttaaccttaggaagaaggaggaggagcgattgtctgagctaaagcagaaactcgacgaagaaggctcaaagtgcagtatccttagtaaacatcagcaattcgtggagcactgttgcatgaggtgctgtagcccatttacatttttagtcaatactaagcggcaatgcggagactgtaagtttaatgtatgcaagagctgttgtagttaccaaaaacacgaaaaggcttgggtgtgctgcgtttgccaacaggcacggcttctcagggcgcaaagcctggagtggttttataacaatgtcaaatcccgcttcaaacgatttggctcagcaaaagtgctcaaaaacctgtacaggaaacacagactggagtccggtgcgtgctttgacatcctgggagggtcattgttcgagtccaatctggagaatgaaggatctatttctggaagcgacagcactttttataggcaatccgaaggccattctgtaatggacacgctcgcagtggcgctgcgcgtggcggaggaagcgatcgaggaagctatctccaaggcagaggcctacggggattccctcgacaaacagaacgaagctagctatctgcgtgaccataaggaggagttgactgaagaactagcaacgaccatcctgcagaagatcatcagaaaacagaaatctaagagcgagcagcaggtggaagaggagcccggatggccgcaccctcagtcttgcagtacgaaggtagcagatgaaggaacatcggcctctccaggtggctaccgtgctccggccgcgctgtggaggagccagagtgcattttccattaccggggaggaagctctcaaaacaccacccgtggaagcgccttctcgacaacccagggaccagggacagcaccccagagctgagtcggccctgccttcctggaaatccgtcgatcgcctggatgagacaaacctggccccagtgctgcagagccctgatggtaattgggttgccctgaaagacggtgctcccccaccgacccggctactggctaaacccaagtcaggcacctttcaggcattggaggtcgctagttcagtggcaagtgcctacgatgaaatggggtccgactccgaggaagattttgattggagtgaggctctttccaagctttgcccgcgttctagggcgctcccccggaacccacagccgcagcctacccaggctcagtcatcagaccagggacctatcgctgcaagcccctcctcagctctctcaccaaacccagaggcaatgtgttcagattccgaaacgtcttccgccgggtcttcgcgtgaagtgggacaccaggctagactgtcatggctccagcgaaaggcccctcggaacccagccgcagagaaaatgcggctccatggagagctggatgtaaatttcaatcctcaactcgcctcccgcgagaccagcgactccagcgagcccgaggaggctccacacaccaccgatcgtagagctcgacgctggcggagggctaggctcgggtctgaggaaccgagtaaagagcctagttcgcccagtgcccagctcagggatctggatactcatcaagtgagtgatgatctttcagaaacggacatttccaatgaggcccgcgatccacagacgctgacagataccaccgaagaaaagaggcgtaacagactgtatgagctcgccatgaagatgtctgagaaggagaccagttcgggcgaagatcaggagagcgagccgaagaccgaaagcgaaaatcagaaggagagtctctccagcgaagacaactctcagagcgtccaagaggaactgaagaaaaaattctccgccgtatctctttgcaatatttcaactgaagttctcaaggtgatcaacgccacagaggaattgatcgccgggtcaaccggaccatgggagagcccgcaggtcccacccgatcggcaaaagggtatgtttccccggggaactgatcaggttcgcttagacgagcaacttacctccctggaagaaaatgtctatttggctgccgggactgtgtacggtctggaaactcagttaacagagctggaagatgctgccagatgcatacactcaggtacagacgagactcatctggccgatctcgaggatcaggttgcaacagcagctgcccaggtgcaccacgccgaattacagatttctgacatcgagagtcggatttcagcattgacaatcgccgggctaaacattgcgccttgtgtgcgcttcacaagacgccgagatcaaaagcagaggacgcaggtccaaaccatcgatacaagccgccagcagcgacgaaagctccccgctccaccagtgaaggccgagaagattgaaacatcatctgtcacgaccatcaagactttcaaccataactttattttgcagggatcctcgacaaatcgaacaaaagagagaaagggcaccacgaaggatctcatggagcctgccctcgaatccgccgtgatgtattag

SEQ ID NO: 196259 - DNA, 2313 bp, Artificial Sequence
  Description of Artificial Sequence: Synthetic coding sequence
atgcggaaggccgccagcgccgccagcagccggagcaccagcagcctatggagcaccgccgcttgtgctgcggcaaggccatcacccagttcttcaacccccagtgccagcgtcgaaatagcaaattcgatgtccgccagggccgccgcccctaccaggagtacaaagcggccaggaagcgctgcctcagcgagcaagcggggaggctctttattcgaatccaacctcgagaacgaggggtctatttccggctcagactcaaccttctatcgccagagcgaaggccattccgttatggataccttggctgtcgccctgagagtcgccgaggaggctattgaggaggccatcagcaaagccgaggcctacggggactccctggataaacagaacgaagcatcctatctccgcgatcacaaggaggagcttactgaggagctggccactacaatactccagaaaatcattcggaagcagaaatccaagagtgagcagcaggttgaggaggaacctggttggcctcacccccagtcttgcagcacgaaggtggctgatgagggtacttccgcatcccctggcggttacagggcaccagcagctttgtggcgcagtcagagtgcattctcaataacaggggaggaggcactcaagacaccgccggtggaggccccatcccggcagcccagggatcagggacagcatcctcgcgctgagagcgccttgccaagttggaaatctgtggaccgcctggatgagacaaacctagccccagttctgcaatcgccagatggtaactgggtcgctctgaaggacggtgctccaccccctacgcgacttttagctaagccaaaaagcggcacatttcaggcactggaggttgccagttccgtggccagtgcgtacgatgaaatggggagcgatagcgaggaggacttcgattggtccgaggcattgtcaaagctgtgccctcggagccgggcgctgcctcgcaacccgcagccacagcccacccaggcccagagctccgaccagggccccatcgccgcctcaccatcctctgcgctaagccctaatcccgaggccatgtgtagtgactcagagaccagttcagctggatcttctcgggaagttgggcatcaggcacgtctctcttggctgcagaggaaggcccctcgaaacccagcagccgagaagatgcggctccatggtgaactcgacgttaattttaaccctcaactggcttctcgtgaaacctccgatagttctgagcccgaagaagcaccccacacgacagaccgcagggctaggaggtggcgccgggcgagacttgggagcgaggaacctagcaaggaaccaagttctccctctgcgcagttacgggatctcgacacgcatcaggtcagtgacgatctgtcagagacggacatttcaaatgaggcccgcgatccccagacactgacggataccacggaggaaaaacgcaggaatcgactgtacgaactggccatgaaaatgtccgaaaaagaaacctcctctggagaagatcaggaatctgagccaaaaacggaatccgagaatcaaaaagaatcactatcgtccgaagacaactcccagtctgtgcaggaggaacttaagaagaagttctccgccgtgtcactgtgcaatatctcgacggaggtgttaaaggtgattaatgcaacggaagaattgattgctggaagcaccggtccatgggagtctccccaggttccccctgaccggcagaaaggaatgtttcctcgggggaccgaccaggtacgactggacgagcagttgactagtctagaggaaaacgtgtatttggctgctggcacggtttatggactagaaacccagctgaccgaattggaagacgccgcccgctgtatccatagtgggactgatgaaacccatctggctgaccttgaggatcaggtggctacggccgctgcacaggtccaccatgccgaactccagatcagcgatatcgaaagccgcatttctgctttaactatagctggactcaacatagctccatgtgtccgcttcacccggcggagggaccagaaacagaggactcaggtccagacgattgacacgagtcggcagcagaggaggaagctgcctgcaccccctgtaaaggcggagaagatcgaaacctcttctgtgacaaccatcaagacattcaaccataattttattctacagggctcttcaacgaatcggacaaaagagcggaaagggacaaccaaggacctgatggagcccgcgctagaaagcgccgtcatgtactag

SEQ ID NO: 196260 - DNA, 2580 bp, Artificial Sequence
  Description of Artificial Sequence: Synthetic coding sequence
atgggccggaagctggacctgagcggcctgaccgacgacgagaccgaacatgtgctccaagtcgtgcaacgcgacttcaaccttaggaagaaggaagaggagcgtctctctgagctaaaacagaaactcgacgaagaaggctctaaatgctctatcctctcaaaacatcagcagtttgtggagcattgctgcatgcggtgctgttcaccgtttacttttctggtgaacaccaagcgacagtgtggtgattgcaaatttaacgtctgtaagtcgtgctgctcatatcagaagcatgagaaagcctgggtatgttgtgtctgccagcaagcgcggctgctccgggcccagagcctggagtggttctacaataacgtaaagtcccgcttcaagcgattcggctccgctaaagtgttgaagaacctctacaggaaacaccgtcttgagtctggcgcctgtttcgacatactgggggggagcctattcgaatccaatttggaaaatgagggcagtatctcaggatcagactcgactttctatcgtcaaagcgaggggcacagcgtgatggataccttggctgttgcattgcgcgtggccgaggaggctatagaggaggccatctcaaaggcagaggcatatggcgattccctcgataaacagaacgaggcttcatatttgagagaccataaagaggaactgacagaagagctcgctacaacaatcctgcagaaaataattagaaaacagaaatccaagtccgagcaacaggtagaggaggagccaggctggcctcacccccagtcatgcagcacaaaggtggccgacgaagggacatctgcatcaccgggcggataccgcgcaccagccgctctttggcgcagccaaagcgctttctctattactggcgaggaagctctcaagactcctcccgttgaggcaccttctcgccagccccgagatcagggccagcatccaagggctgagtctgcactcccaagctggaagtctgtggacagacttgacgaaaccaatctggcccccgtgctgcagtctccagacggaaattgggtcgctcttaaggacggggcccctcccccaacgcggctcctggctaagcctaagtccgggacattccaagccctggaggtggcatcatctgttgctagcgcctatgacgaaatggggtccgattctgaggaggatttcgattggtctgaggccttgtcgaagctgtgcccccgaagcagagccttgccgagaaatccgcagccccagccaacccaggctcagagctccgaccaggggcctattgccgccagccctagctctgcgctgtccccgaatccagaggctatgtgcagtgacagcgaaaccagctccgcaggttcttctcgagaggtggggcatcaggctcgcctctcctggttacagcgaaaggccccgcggaacccggcagcggaaaagatgcggttgcatggggagctggatgtaaactttaacccacagctggcttcacgggagactagtgactcaagcgaaccagaggaggccccacataccacggacagacgagcccgccgttggcggagggcgcggctcggcagcgaagagccctcaaaggagccttctagtccatccgctcagctgagggacttagacacccaccaggtctctgacgacctctccgagactgacatttccaatgaagcccgagaccctcagactttgaccgacaccacagaggagaaacgacgaaatcgtctttacgagctggccatgaaaatgtccgagaaagaaacctcttcaggcgaggaccaagaatcggagcccaaaaccgagtcggaaaatcaaaaggagagcctgtcaagcgaagacaattctcagagcgtgcaggaggaactcaaaaaaaagtttagtgccgtgagcctgtgtaacatctctactgaagtgttgaaggtcattaatgccactgaggagctgattgcaggcagcacaggcccctgggaatctccccaagtcccgcccgacaggcagaagggtatgtttcctcgggggaccgatcaggtccgcttggatgaacagctcacgagcctggaggagaacgtgtacctcgccgcgggaactgtctacgggcttgagactcagttgactgagctggaggatgctgcaagatgcattcactccgggacagacgagacacacctggctgatctggaggatcaggtggcgactgcagctgcacaagtgcaccacgcagagctgcagatcagcgacatcgagagcaggatcagcgccttgactatcgctggcctgaatattgccccctgtgtgcgcttcactagacggcgagatcaaaaacagcggacgcaggtgcagacaatcgacacctcaagacaacagcggcggaaactgccggccccacccgtcaaggctgagaaaatcgagactagcagcgtcactactatcaaaacatttaaccacaatttcatcctgcaaggcagctcaaccaatcgtaccaaggagcggaaaggcacaaccaaggatcttatggaaccagccctcgaaagcgccgtgatgtattag

SEQ ID NO: 196261 - DNA, 2019 bp, Artificial Sequence
  Description of Artificial Sequence: Synthetic coding sequence
atggacaccctggccgtggccctgcgggtggccgaggaggccatcgaggaagccatctctaaagccgaggcctatggcgacagcttagacaagcagaatgaggcctcctaccttagggatcataaggaggagctgactgaggaattggccactactattctgcagaagatcatcaggaaacaaaagtccaagtccgagcaacaagtggaggaggagcccggatggccccacccccagagttgtagcaccaaagtggctgacgagggcacaagtgcgagccctggaggttatcgtgcccccgccgcactctggcgatcacagagcgcgttctcaatcaccggagaggaagccctaaaaacccctcctgtggaggccccttcacgtcagccccgggatcagggacagcatccgcgggctgagagcgctctgcctagctggaagtcagtcgataggttggatgaaacaaatctagcgccagtgctgcagagccctgacgggaattgggtggcccttaaggacggcgcgccaccgcccacacgcttgctggccaaaccaaagtccggaacttttcaagccctggaggttgctagtagcgtcgcctcagcctacgatgagatgggatctgatagcgaggaggacttcgattggtccgaggcgcttagcaagctgtgtcctcgcagccgcgcactcccccgaaacccccagccccagcccacacaggcgcagagtagtgaccaggggccaatcgccgcaagcccaagttctgccctcagtcctaatcctgaagctatgtgtagcgactctgagactagcagcgctggcagtagtcgtgaggtgggccaccaggctcggttgtcttggctccaaagaaaggcgccacggaaccctgctgctgaaaagatgaggctgcacggggagttagacgtaaacttcaacccgcagctggcgtcccgggagacaagcgattcttcagagcctgaagaggctcctcatacaacggataggcgggcgagacggtggcgaagagcaaggctagggtccgaggaaccctctaaagaacctagttccccgtcggcccaattacgggaccttgatactcatcaggtatctgacgatctgagcgagaccgacattagtaacgaagccagagatccacagacgctgacggacacgaccgaagaaaagcggaggaacagactatatgaactcgcgatgaagatgtctgaaaaggaaactagttccggcgaagaccaagagtctgaaccgaagaccgagagtgagaatcagaaggagtccctgagttctgaagacaacagtcaatcagttcaggaggagctgaagaagaaattctcggcagttagcctgtgtaatatctctacagaagtactcaaggttataaacgccaccgaggagctaatagccggctccacaggcccgtgggagtctcctcaggtgccacccgatcggcaaaagggaatgttccctaggggcacagatcaggttagactggacgaacagctaacttccctggaggagaatgtctatttagctgctggcactgtgtatggcctggagacccagcttacggaacttgaagatgctgccagatgtattcacagtggcacggatgaaacccatcttgcagacctcgaagatcaggtcgcgacggcagccgcgcaggtgcatcacgccgaactgcagataagcgacatcgagtcgagaatcagcgccctgaccatcgccggactcaatatagctccctgcgttcgatttactaggagacgtgaccagaaacagcgtacccaggtgcagaccattgatacgtcaaggcaacaacgccggaagctcccagctccccccgtgaaagcggagaagatcgaaactagtagcgtaaccaccatcaagacctttaatcacaatttcatcttgcaaggatccagtacaaaccgcacaaaagagaggaagggcactactaaggatctgatggagcctgccctagaatccgcagtgatgtattag

SEQ ID NO: 196262 - DNA, 2886 bp, Artificial Sequence
  Description of Artificial Sequence: Synthetic coding sequence
atgaagtacctgctgaacttcatcggccagggccccgccacctacggtcctttctgtgctgaacgactgcgccgcacctatgcaaacggagtgagagctgagccacctacatggctggagctccaggcagttaagtcaaagaagcacatccccatccaggtgattctggccactggcgaatcgctgacagtgcctgtcgattccgctagcacatctcgcgagatgtgcatgcatatcgcacacaagcagggattgtctgaccatcttggctttagcctccaggttgctgtctacgacaagttctggtctctcgggagtggacgggatcatatgatggacgccatagccaggtgcgaacagatggcccaggaacgcggcgagagtcagaggcagagtccctggaggatctattttagaaaggagtttttcactccatggcacgacagccgcgaggatcccgtctcaaccgaactcatctatagacaggtgcttagaggtgtatggagtggcgagtactcattcgagaaagaggaggaactggtcgagctcctggcccgccactgttatgttcagcttggggccagtgccgaatctaaagccgtccaggaattactcccctcctgcatcccacataagctttaccgcaccaagccacctgataggtgggcatcactcgtgactgccgcatgcgccaaagccccatatacccagaagcaggtgacgcccctggccgtgagagagcaggtggtggacgccgcccgcctgcagtggcctctcctgttcagcagactgttcgaggtcattacccttagcgccttcactttgcctagcctgctggcaaggccgcctcctgcccaggatgccggaccagcaggagaggatgccgctgggacactctttcccagaggacatggtagtggccaccagcaggtcagagcactgcgagaggacttattcctacacacggagccccacccgcctgccccaggaagaacggctcatgaggtgctgcactggggcatcacaagatgcaccggatctttcagcctgaaaccaaggtctacccggaaaggacagggctcagtgcaacccctcgctggaacataccttgaagggtcattcctgtgccacgggcgtgaacttgtcgcatggagagtgcaggtcgtgtgggagggcgataagggccagtgtctggccggggctgacccgcactctcatggctctccctggattagcttaacggggaacttcagtatgccctttggaaagtctacgcagcagagcggcacttgtattagtggactatgccaagtgtactcaggtcatcatagccccctggcaacctcccccagaagtaccgacagcatcactcatagcgctgacgagagaatgtcaaagctaaaacacgccgaagtccgctggctgagggtctcaacctggcagtcccgacaactgatctccgccttgacattcgcagtttcattaaggtgtcactgtacccccgctacatccctgtcagcccatagccagcctcacacctgggcagcgcctttgtcagcttcagagaggccaaccgtggtcagcggcttggttctggcattggccgagcagctctgcgttcttattcgctggcgcggactcttggttaccctgtcgtttatatcccgcgaggcccagggaggacaaagactgctactgtctacaatgcatgaagagtacgagtttgtcagcccaagctcagtagctatcgccgagctcgtggccctgtttctggaaggcctcaaagagcgcagtatctttgctatggcattgcaggacagaaaggcgactgacgacacaacccttctggccttcaaaaaaggcgacttactcgttctgaccaagaaacaggggctgctcgccagtgaaaactggacacttggacagaacgaccggaccgggaaaaccggtctggtccccatggcgtgcctgtataccatccccacagtcaccaagccttcagcccagctgcttagtctactggcgatgtcaccagagaaaagaaagcttgctgcccaggaaggccagttcacggaaccacggccagaggagcccccgaaagagaaattgcacacactggaggagttttcatacgagtttttcagagccccagaaaaagacatggttagtatggcagtgcttccattggccagggccaggggtcacctgtgggcgtactcctgtgagccccttcggcaaccactactcaaaagagtgcacgcaaacgtggacctgtgggatattgcatgccaaatttttgctactcccatacttagatacatgggagactatccctcccgccaggcatggcccactctggagctcaccgaccagatttttactctggctctgcaacaccccgctttgcaggacgaggtctactgtcagattcttaaacaactgactcataactcgaaccgacactccgaggaacgtgggtggcagctgctgtggctatgtaccggactctttccgccttcaaaaggtctgttgccacacgcacagaagttcatcgataccagacgcgggaagctgcttgccccggattgctcacggcggatacaaaaagtgctcagaaccggccccaggaaacagcccccacaccaggtcgaagtcgaggccgccgaacagaacgtaagccgcatctgccacaaaatctattttccaaacgatacctccgaaatgcttgaggtagtagccaacacgcgggtcagggacgtttgcgactctatcgctactcgactgcagcttgcttcctgggagggctgttcactcttcattaagatctcagacaaggtgatctcccagaaggagggggatttttttttcgattccctacgcgagtag

SEQ ID NO: 196263 - DNA, 6354 bp, Artificial Sequence
  Description of Artificial Sequence: Synthetic coding sequence
atgagcggcttccggctgggcgaccacgtgtggctggagcccccctccactcataagaccggagtggctattggggggataatcaaagaagcaaaacctggtaaagtgctggttgaggacgacgaaggtaaggaacactggatcagggctgaagattttggtgttctctcccccatgcacccaaatagcgtccagggagtcgacgacatgattcggttgggggacctcaatgaagcaggaatggtgcataaccttctgatccgttaccagcaacacaagatttatacctacacgggatctatcctcgtggccgtgaatcccttccaggtgctgccgctttataccctcgagcaagtccaactgtactattcaagacacatgggggagcttccacctcacgtcttcgctatcgctaataactgctatttcagtatgaaacgcaacaagagggaccaatgttgcattatctcgggcgaatccggggctggcaagacagagaccactaaactgatactccagttccttgcaaccattagcggccaacacagttggatcgagcagcaggttttagaagctaatcctatcctggaggcctttggcaacgccaagacaatccggaatgacaacagctctcgattcgggaagtacattgacatttattttaatccctctggagtgatcgaaggcgcccgtattgagcagttcctgctggaaaaatccagggtttgcagacaggcacccgaagaacgcaattaccacatcttctactgtatgctaatgggagtatccgctgaggataagcaactactgtcgctcgggactccctcagaataccactacctcacaatgggcaactgcaccagctgtgaaggactgaatgatgctaaggactacgctcacattcggtccgctatgaaaatactacagttctccgatagtgaatcatgggatgtgatcaaattattggcggcgattctccatctcggcaacgtggggttcatggcatcagtgttcgagaacctggatgcatctgatgtgatggagacacccgcattcccgactgtgatgaagctgctggaggtgcaacaccaggagctgcgggattgcctgatcaagcacactattctgatcaggggtgagtttgttacaagaagcttgaatattgctcaggccgcagaccgcagagatgcctttgtaaaggggatatatggtcatctgtttttgtggattgttaagaaaataaacgccgcgattttcacgccaccggcccaggaccctaagaacgttcgccgtgcaatcgggctcctggacatcttcggtttcgagaactttgagaacaatagcttcgaacagctgtgcattaacttcgcgaacgagcacctccaacagttttttgtccagcacgtgttcaccatggagcaggaggagtaccgaagcgagaacatctcttgggactatattcattataccgacaaccgcccgaccttagacctgctagccctgaagccaatgtccattatctccctgctcgacgaagagtccaggtttccccagggtacagacctcaccatgctgcagaaacttaatagtgtccacgcaaataacaaagcatttttgcagccaaaaaacatccacgatgccaggtttggaatcgcccatttcgcgggcgaagtgtactaccaggctgaggggttcctggaaaagaacagggacgtgttgagtaccgatatcctcactttagtgtactcctcaaagaacaaattcttaagggagatcttcaatctggagctggcggagacgaagctgggccatggcacgatccggcaggccaaagctggcaatcacctttttaagtctgctgactctaataagcggccttctacgctgggttctcagtttaagcagtctctcgatcaattaatgaaaatccttacaaactgccagccttatttcattcgctgtataaagcctaacgagtacaagaagccgctcctttttgacagggaactgtgcctgcggcagctgcgctatagcggcatgatggagaccgtccatatcagaaaaagcgggtttcctataagatacactttcgaggaattctctcaacgtttcggagtcttgttgccaaatgccatgaggatgcagcttcaggggaagctccggcagatgaccctggggatcacagatgtatggttacggactgataaggattggaaggccggcaagactaagatctttctgcgggatcatcaggatacgctcctcgaggtccagcgttctcaggtactggaccgggccgccttgtccatccagaaggtgctgcggggttaccgctatcgcaaagagtttctgaggcagagaagagccgccgtaaccttgcaggcttggtggagaggatattgtaatagacgcaatttcaagctcatcctggtcggattcgagagactccaagcaattgcgagatctcagcccctcgcccggcagtaccaagcaatgaggcagagaaccgtccagcttcaagccctgtgtagagggtatctggtgaggcaacaagtgcaggcaaagagaagagcggtcgtagtgatacaggcacacgctagaggcatggccgccagaagaaacttccagcagagaaaagcgaacgctcctttggtgattcccgccgagggccagaagagccagggcgcgctgccggccaagaagcgacggagcatttacgacactgtgaccgatactgaaatggtggagaaggttttcggctttctaccggcaatgatcggtggccaggaggggcaagctagcccacactttgaggacctcgagagtaagacacaaaagttactcgaagttgacctggatactgtgccgatggcagaagagcctgaagaagatgtggatggattggctgagtacaccttccctaagtttgccgttacctatttccagaagagcgcctcacatacccacattcgaaggccactgcgctatcccctgttataccacgaggatgatacagactgcctggctgccctagtgatctggaatgtgatcctccgatttatgggagatctccctgagcccgttctgtacgccaggagttctcagcaggggtcgagcgtaatgcggcagatacacgacactctgggaagggagcatggtgcccaggtgccccagcatagccgctccgcccaggttgcatctcaattaaatattggcgaggaagctcttgagcccgacggacttggcgctgataggcctatgtccaacctggagaaggtacattttatcgttggttatgccatcctcagaccgagcttgcgggatgaaatttattgtcaaatatgtaagcaactgtcagaaaatttcaagactagttccctcgcaagggggtggatcctcctatctctgtgtctggggtgtttcccgccctccgaaaggttcatgaaatatctcctgaatttcattggccaggggcctgccacatacggaccgttttgcgctgagcggctaagaaggacgtacgccaacggcgttagagccgaacctccaacctggctagaattgcaagctgttaagagcaagaaacacatacccatacaagtgatcctggccaccggagagtccttgacagtccccgtggacagtgcatctacgtcccgtgagatgtgtatgcatattgcccataagcagggattgagtgatcacttaggcttctcccttcaggtggctgtttatgacaagttctggagcctaggtagtggcagagaccatatgatggacgctatcgcacggtgcgaacagatggctcaggaacgtggtgaatcccagagacagtccccgtggcgcatatattttagaaaggagttcttcaccccctggcatgactcccgggaggaccccgttagcacggagctaatctacaggcaagtgctgaggggggtgtggtcaggtgaatactcgtttgagaaggaggaggagctggtagaactgctggccaggcactgctatgtgcaactgggagccagcgcagagtccaaggcagtccaggaactactcccatcatgtattcctcataagctgtacaggactaagccgcccgatcgttgggcctccctggttacagcagcatgtgcaaaggctccgtacactcagaagcaagtgacccccctggcagtgagagagcaagtcgttgacgccgctcggttgcaatggcccttactttttagccgcctgttcgaggtgattaccctgtctggccctcgtctgcctaagactcagctgattttggccgtcaattggaagggactctgttttctggatcagcaggagaagatgttgctagaactctcattcccagaggtcatgggactggcaaccaacagagaggcccagggagggcaacgattactcctgtccaccatgcatgaggaatacgaatttgtctctccttcctccgtggctatcgctgaactggttgctttgttcctcgaagggttgaaggagaggtcgatattcgcaatggcactgcaagaccgcaaggctactgatgataccacacttctggccttcaagaaaggcgacctattggtgctcaccaagaagcagggactccttgccagtgagaactggactcttgggcagaacgatagaacagggaagactgggttggtgccgatggcttgcctgtacaccattccgactgtgaccaagccctccgcacagctgctgagcttacttgccatgtctccagagaagaggaagctggcagcccaggaaggacagtttaccgagccccggccagaagaaccacccaaagaaaagctgcatacacttgaagaattctcatatgagttcttccgggccccagaaaaagacatggtttccatggccgtgcttccgctggcaagagctcgcggccatctctgggcttactcctgtgaacccctccggcaacccctgctcaagcgtgtccatgccaacgtcgacctgtgggacatcgcttgccagatcttcgccactcctatccttcggtacatgggggattacccatctaggcaggcatggccgactctcgaactgaccgatcaaatctttaccctcgcgctacagcacccagcactgcaggatgaagtctattgtcagatcctgaagcagctgactcacaatagcaaccggcattccgaagaaaggggatggcagctgctgtggctctgcacggggttgttccctccatcgaagggactcctgccccatgcccagaagttcatagatacgagacgcggaaagctgctggcaccagactgctcgaggcgaattcagaaagtactgcgtactgggccccgcaagcaacccccccatcaggtcgaagtggaggccgctgagcagaacgtgtctcgcatatgccacaaaatctacttcccgaatgatactagcgagatgctggaggttgtagcaaacaccagggtcagggatgtgtgtgactcaattgccacgcgactgcaactggcctcttgggaagggtgctccttgtttatcaaaatcagcgacaaggtcatttctcagaaggagggcgacttcttctttgactctttgcgcgaggtgtcagattgggtaaaaaaaaacaaaccccaaaaagagggggctccagtcactcttccataccaggtttactttatgagaaagctttggctaaatatttcacctggcaaggacgtcaacgctgatacaatcttgcactaccaccaggagctgcccaagtatctgcgtggatttcataaatgtagtcgggaggacgcaatccatctagccggtcttatctataaggcccaatttaacaatgatcgcagtcagctcgcttcagtgccgaagatcctccgcgagctcgttcctgaaaacctgacccgactgatgtcctcagaggagtggaagaaatcaatcctcctggcctacgacaagcacaaggataaaaccgtggaggaagccaaggttgcgtttctcaagtggatttgccgctggcccaccttcggatcggccttctttgaagtaaagcagaccagcgaaccttcataccccgacgttattcttatagcaatcaacagacacggggtgctcttgattcaccccaagacaaaagacctcttgacgacgtaccccttcacaaagattagttcgtggagtagcggatctacttattttcatatggctctcgggtctctcgggagaggatcaaggctactgtgcgagacatctctgggatataagatggacgacttgcttacgagttatgtgcaacaactgctgagcgcaatgaataaacaaaggggttctaaggcacctgctttggcttctacatag

SEQ ID NO: 196264 - DNA, 6351 bp, Artificial Sequence
  Description of Artificial Sequence: Synthetic coding sequence
atgagcggcttccggctgggcgaccacgtgtggctggagcccccctctacacacaagacgggggtggcgattggagggatcattaaagaggcaaagcccggcaaggtgctggtagaggacgacgagggaaaggaacattggattcgggccgaggatttcggcgtcctctcccccatgcatccaaactcagtgcagggcgtggacgatatgatccggctcggcgatctcaacgaagccggcatggtgcataatctgcttattaggtaccagcagcacaagatatacacctataccggaagcatcctggtagcagttaatcccttccaagttttgccgctatatacgctcgagcaggtccagctgtactactccagacacatgggggagctgccaccccatgtgtttgctatagctaacaactgctacttttccatgaagagaaacaaaagggatcaatgctgcattatttctggggaatccggcgccgggaagactgaaaccacaaagttgattctgcagttcctcgccacgatctccggtcagcatagctggatcgagcaacaagtgcttgaggccaatccgattttggaggcttttgggaacgcaaaaacaattcggaacgacaatagctctcgcttcggcaaatacatcgatatctacttcaatccatctggggttattgagggcgctcgcattgagcagtttctgttggagaagagccgcgtgtgccgccaggcccctgaagaacgtaattatcatattttttattgcatgctgatgggtgtgtcagcagaggacaagcaactgctgagcttagggacaccatctgagtatcactatctaaccatgggaaactgtacaagctgcgagggcctaaacgatgcgaaggactatgcgcatatccgttcagccatgaaaattctccagttttccgactcagaatcctgggacgtaatcaagctccttgctgccattctgcacctgggaaatgtgggcttcatggccagcgtattcgaaaatctagatgcctccgatgttatggagaccccagcatttcctaccgtgatgaaactccttgaagtccagcaccaggagctcagggactgccttatcaagcacacaatcctgatacgaggtgaatttgtgacaagatcactgaatatcgcccaggccgcggacagacgggatgccttcgtgaagggtatctacggccacctgtttctctggatcgttaagaaaatcaacgctgccatctttactcccccggcgcaagacccaaaaaacgtgagaagggccatcggcctcttggatatcttcggctttgaaaacttcgagaataacagttttgagcagctgtgcatcaactttgccaacgaacaccttcaacaatttttcgtgcagcacgtgttcacaatggaacaggaagagtatcgatcggaaaacattagttgggattatatccattatacagacaaccgtcccaccctcgatctcttggcactaaaaccaatgagcatcatatccctgctggacgaggagtccagattcccgcaagggacagatcttactatgctgcagaaacttaattccgttcacgccaacaataaagccttcttacaacctaagaatattcacgacgcccgttttggtattgcccacttcgctggagaggtgtattaccaagctgaaggctttctggaaaagaacagggacgtgctcagcaccgatattcttacccttgtttactcaagcaaaaataagtttctccgagagatctttaatctggaactggccgaaaccaagctgggccacggcacaattcgccaggctaaagctggaaaccacttattcaaatccgccgactcgaacaagcgcccttccacactgggcagccagttcaagcaaagtctcgatcagctgatgaagattctgacaaattgccagccgtactttatccgctgcatcaaacccaatgagtataagaaacccctgctgttcgatagggaactgtgcctgaggcagctccgatattctggaatgatggaaacagtgcatatcagaaagtcagggtttcccataaggtacacatttgaggaattttctcagagatttggggtgctgttgccgaacgccatgcgaatgcagctccaggggaagctgcggcagatgaccctcggaatcacagatgtgtggcttcgaacagacaaggactggaaggcaggcaagaccaaaatcttcctcagagaccatcaggacaccctacttgaggtgcagaggagccaagtgctcgacagggctgctctgtcaattcaaaaagtgctccgtgggtatagataccggaaggagtttctacgtcaacgaagggcggctgttacattgcaggcatggtggcgcggatactgtaacagaaggaacttcaagttgattctcgttggttttgaaagactgcaggcgatcgcaaggtctcagcctctcgcaaggcagtatcaggccatgcggcaacgcaccgtgcaacttcaggcactgtgtcgaggctatctggttaggcagcaggtacaggcaaaaagacgcgccgtcgttgttatccaagctcacgcacgggggatggctgctaggagaaacttccagcagcgtaaggctaacgctcctttggtcatccctgctgaaggtcagaagtcgcaaggtgcgcttcctgcaaagaaacggcgaagcatatacgacaccgtgaccgacacagagatggtggagaaggtctttgggtttctgccggctatgatcggtgggcaggagggtcaggcttccccccattttgaggacctggagtctaaaactcaaaagctgctggaggttgatctcgacaccgtgccaatggctgaggaacctgaggaggatgtcgatggcctggccgaatacactttcccaaaatttgcagtgacatacttccaaaaaagtgcctcccacacccatataaggcgccccctgcggtatcccttgctataccacgaagacgataccgactgcttagccgcactggttatttggaacgttattcttcggttcatgggcgatctgccagagcctgtgctgtacgccaggtcctctcaacagggatcttcggttatgcgccaaatacatgacacactgggtagggagcacggcgcacaggtaccgcagcattctcgaagcgcgcaggtcgccagccaactcaatatcggcgaagaggctctggaacctgatggccttggcgccgacaggcctatgtccaatctggaaaaagtccactttattgtggggtacgccatactacgtccctctctgcgggacgaaatctattgtcagatatgtaaacagctctccgagaactttaaaacgtcatctctggccagaggttggatacttctctcactgtgtctgggctgctttccgccgtccgagcgttttatgaaatacctgctgaacttcattggacaaggccctgccacatacggacccttttgtgcagagcgactgcggcgaacttatgcgaatggcgttcgcgctgaaccaccgacgtggttggagctgcaagctgtgaagtccaaaaagcatattcctatacaagttatcctggctacaggtgaaagcctcacagtgcccgtcgatagcgcatccacctcaagagagatgtgtatgcacattgctcataagcaggggctgtcagaccatctgggattcagcttacaggtcgcagtttatgacaagttttggtctctaggaagtggccgtgatcacatgatggatgccattgcccggtgtgagcagatggctcaggagaggggagagtctcagagacagagcccatggcgcatttatttcaggaaagagttcttcaccccgtggcatgattcacgggaagatcctgtttccaccgagctcatctaccgacaggttcttcgtggcgtttggtcaggcgaatattcattcgagaaggaagaagagctggtagaactgctggccaggcattgctacgtacaactgggcgcaagcgcagaatctaaggcagtacaggaactactgccctcctgtataccgcacaagctgtataggactaaacctccagacagatgggctagccttgttacggccgcgtgtgctaaggctccctacacgcagaagcaggtgacacccctggctgtgcgtgagcaggtcgtggatgctgccagactccagtggccgctcctattttccagattgttcgaggtgattacattgtctggtccccgcctgcctaagactcagctgatcttggccgtaaattggaaagggctctgtttcctcgaccagcaggaaaagatgctcctggagctctctttccctgaagtcatgggactggcgactaatagggaagcccaaggaggacagcggcttctcctttctactatgcatgaagagtacgagtttgtgtctccctcctccgtcgccatcgcagagctcgtggctcttttcttggagggcttgaaagagcgctcaatttttgcaatggccctgcaggatcgaaaagccaccgacgacacaactctactggcgttcaaaaagggcgatctcctcgtgctaaccaagaaacagggactgctcgccagcgagaattggacgctggggcagaacgacagaactggcaaaaccggactcgtgccaatggcctgtctctacaccatccccaccgtaacaaaaccttcggctcagttgctgtcgctgttggccatgtcacccgaaaagcggaagctggccgcccaggaggggcaatttacggagccacggccggaggagcctcctaaagagaagcttcatacccttgaagagttctcgtatgagttctttcgagctccagagaaggatatggtctctatggccgtgctacccctggcgagggcacgcgggcacctgtgggcatatagttgcgagcccttgcggcagcccctgctcaagcgggtgcatgcaaacgtggatctgtgggatatagcctgtcagatctttgtggccattttacgttatatgggcgattaccctagtagacaggcctggcccacgctggagttgaccgaccagatattcaccctcgccttgcaacaccccgctttgcaggatgaggtctattgtcagattctcaaacagctgacacacaattctaaccgacattcagaagaaaggggctggcaacttctgtggctttgcacaggtttgttccccccctcaaagggacttctgccccacgcacagaagtttattgatacacggcgggggaaacttctggcccccgactgtagtaggaggattcaaaaggttctccgaaccggaccaaggaagcagcctccgcaccaggtggaggtcgaggcagcagagcagaatgtctcgagaatttgtcacaagatctatttccctaatgacaccagtgaaatgctagaagtagtggccaatacacgcgtgagagacgtgtgcgattcaatcgctacacgactgcagctcgcttcctgggagggatgctcactgttcataaaaatctctgacaaggtgatctcccagaaggagggtgattttttcttcgacagtctccgcgaagtctctgactgggtgaaaaaaaataagccacagaaggaaggggcgccagttacactgccgtaccaggtttacttcatgcgcaagctgtggcttaacattagtccaggcaaagacgtgaacgcagatactattctacactaccatcaggagctgcccaaatacttgagagggtttcacaagtgctccagagaggatgccattcacctcgccggcttgatctacaaggcacagtttaacaacgatcgcagccagctggcaagtgtgccaaaaatactcagggagcttgtgcctgaaaacctgacacggctgatgtcgtccgaagagtggaagaagtccatcctcctcgcttatgacaagcacaaagataagactgttgaggaggctaaggtggcattccttaaatggatttgccggtggcctactttcgggtcagcattcttcgaggtcaagcagaccagcgagcccagttaccccgatgtgatcttaatcgctataaatcggcatggagtgctgcttatccacccaaaaaccaaggacctgttaacaacatacccgttcaccaaaattagctcctggtcaagcggttccacctacttccacatggcattgggaagtctgggccgggggtccagattgctgtgcgagacaagtctgggatataaaatggatgaccttcttacaagctatgtccagcagctcctgagcgccatgaacaagcagcgcggaagcaaggctcctgcactggctagcacttag

SEQ ID NO: 196265 - DNA, 6351 bp, Artificial Sequence
  Description of Artificial Sequence: Synthetic coding sequence
atgagcggcttccggctgggcgaccacgtgtggctggagcccccctcaacacataagacaggcgtggcaatcgggggcataatcaaggaagcaaagcccggtaaagttctcgtagaggatgatgagggcaaggaacattggatcagagcagaagactttggggtgcttagccctatgcacccaaatagcgtacaaggagtggatgatatgatccgtctgggcgacctgaacgaagcggggatggtgcacaacctcttgatcaggtaccagcaacacaagatctatacatatactggaagcatcttggtggcagtgaatccctttcaagttctgcctttatacaccctggaacaggtgcaattatattactctagacacatgggagagttaccgccacatgtctttgctattgctaataactgctatttctcaatgaaacggaataagagggaccaatgctgcattatttctggagagtctggcgctggaaagaccgaaacaacaaaattgattctgcaattcctggccactatttcaggccagcacagttggatcgaacagcaggtcctcgaggccaaccccatcctcgaggcttttggtaatgctaaaaccatcagaaacgataactcatctagattcggaaaatacatagacatttacttcaatccttctggcgtgatcgagggagcccggattgagcagttcctcctcgagaaatctcgcgtctgtaggcaagcccctgaggagcgaaactaccatattttttactgcatgttgatgggcgtcagtgcagaagacaaacagctcttgtctttgggaaccccatccgaatatcactatctcacgatgggcaactgcacgagttgcgaaggactgaacgatgccaaggactacgcccacattagaagtgctatgaagatactgcagttttctgatagcgaatcatgggatgtgattaaactcctggccgccatcctgcatcttgggaatgtcggcttcatggcatctgttttcgagaacctggatgcctctgatgtgatggagaccccggcatttccgaccgtcatgaaactgctggaagttcagcatcaggaacttcgcgactgcctaattaaacacacaattctgattcgcggcgaatttgtgacccgatctctcaacatagctcaggccgcagatcgcagggatgctttcgtcaaggggatctacggacatctcttcctatggatcgtgaagaagatcaacgccgccatattcaccccgcctgctcaagatcccaagaatgtgcggcgggctattggattgttggacatcttcggctttgaaaacttcgaaaataatagctttgaacagctttgcatcaattttgcgaacgagcacctgcaacagtttttcgtccagcatgtgtttacaatggaacaggaagagtacagatctgagaacatatcatgggattatatccattacaccgacaatcggcctactttagatttgcttgccttgaaacctatgtccattattagcttgctcgacgaagagtcacgctttccccaagggacagaccttacaatgcttcagaagctcaattcagttcatgcgaataacaaggctttccttcaacccaaaaacattcatgacgctaggtttggcattgcccatttcgctggcgaagtgtactatcaagcagaaggtttcctggaaaaaaaccgggatgtgttatccaccgacattttgacgctggtctattcttcaaagaataagttcctgcgggagatctttaacttagagttggccgagaccaaactggggcatggaacaattaggcaggccaaggctggtaaccacctgtttaagtcagccgactctaacaaaaggccgtccacccttggaagccagtttaaacagagcctggatcagctgatgaaaattctgactaactgccagccttattttattcggtgtattaagcctaacgaatataagaaacctcttctattcgatagagaattgtgtctgaggcagctccgatacagcggaatgatggaaacagtgcatatcagaaaatccgggttcccgatcaggtatacttttgaagagttttcacagcggtttggcgtgctgctgcccaatgctatgcggatgcagctccagggaaaactgagacagatgacactcggcatcaccgacgtgtggttacgaacagacaaggactggaaagccggtaagaccaaaatttttctgcgtgatcaccaggacactcttctggaagtccagcggtcccaggtactggacagggctgcattgtctatccaaaaagtcctgaggggttacagataccgcaaagagtttctgaggcagagacgggccgcagtcactttgcaagcttggtggcgtggctactgtaatagacggaactttaaactgattcttgttggatttgaacgcctacaggccatagcccgtagccagccgctggctcgccagtatcaggccatgaggcagcgcacagtgcagctgcaggcgctctgtcggggctatttagtacggcagcaggtccaggctaagcggagagcggtggttgtgattcaggcccatgcccgtgggatggcagcccgtcgcaatttccaacagaggaaggccaatgctcccttggtgatccctgccgaggggcaaaaatctcaaggcgcactaccagctaaaaagcgccgctccatttacgacacagtgactgatactgaaatggtggagaaagtgttcggatttcttccggccatgattggcggccaggagggccaggcctccccccactttgaggacctcgagagcaagacacagaagctgttggaggtggatctggataccgtgcccatggcggaagagcctgaggaggatgtcgacggattagctgagtacacatttccgaagtttgctgttacttatttccagaagtctgcctcccacacccacatccgaaggccactgcggtacccacttctatatcatgaagacgatacggattgtttagccgcactcgttatctggaatgtaatactgcgcttcatgggggacttgcccgagccggttctttacgcgcggtcgtctcagcagggcagttcggtgatgagacagattcatgacaccctgggtcgggagcacggcgcccaagtgccacagcattccaggtccgcccaggtggcttcacagctgaatattggcgaggaggctctggaaccagatggacttggtgccgaccgccccatgtccaacctagagaaggtccactttattgtgggatatgccatactcaggccctccctgcgtgatgagatctactgtcagatatgtaaacagctgtctgaaaattttaagacctcatccctcgccagagggtggatcctgctcagcctttgtttaggttgctttccaccatctgagagatttatgaaatacctattgaacttcattggtcagggcccagccacctacggccctttctgcgctgaacggttgagaagaacatacgctaacggagttagagcagagccgcccacctggctggaactccaagcagtgaaatcaaagaagcatatcccgatccaggtgattctcgccactggcgagtcccttaccgtccctgtggactctgcatctacctcaagagaaatgtgcatgcacatcgcacacaagcaaggcctgtccgatcatttgggcttctccctacaggtggccgtatatgacaagttctggagtctgggcagcgggagagaccacatgatggacgcgatcgcacgctgtgaacagatggcccaggagcgcggcgagtcacagcggcaaagtccatggcgtatctactttcggaaagagttcttcaccccttggcacgatagtcgcgaagatcctgtttcaacagagctcatatataggcaggtgctcagaggcgtgtggagtggggagtacagctttgagaaagaggaagagctggttgaactgctggcgagacattgctacgtgcagctaggagccagtgctgagagcaaagcagtgcaggagctcctcccctcctgcattccccacaagctgtaccgcacaaagcctccagaccggtgggcctctctggtcactgctgcctgtgcaaaagccccgtacacacagaagcaagtaacaccactcgctgtacgggaacaagtggtcgatgcagcacgcctgcagtggccccttctcttctcccgactgtttgaggtgatcaccctgtcaggccctcgactccccaaaacacagcttattcttgccgtgaattggaaaggattatgtttcctggatcagcaagagaagatgctcctcgagctttcattccctgaagtaatgggattggcaaccaaccgggaagcacaagggggccagcgattgctgctgagcacaatgcatgaggagtacgaattcgtcagcccttcctccgttgcgatcgccgagctggtggcgctgtttcttgaaggtttgaaagaaaggtcaatctttgccatggcactgcaggacaggaaggctacagatgacaccactctgctagctttcaaaaagggcgatttattggttctgaccaagaagcaggggctcctagcgtcagaaaattggactctgggacaaaacgatcgaacaggcaaaacaggcctcgtccccatggcttgtttatatacgatcccgaccgtcacaaaaccctccgctcagctcctgagtcttctcgcaatgtccccagagaaaaggaagctggcggcgcaggagggacagttcaccgaaccacgccccgaggaaccccctaaggagaagcttcacacgctggaagaattttcctacgaatttttcagggcacccgagaaagatatggtgtcgatggccgtcctacctctggccagagcgcgcggtcacttgtgggcgtattcttgtgaacccctgcggcaaccccttctcaagagggtccacgctaatgtcgacctctgggacatcgcctgtcagatcttcgtggctatccttaggtatatgggggactacccaagtcggcaggcttggcccacactagagctgacagaccagatattcactctggccctgcagcacccagcactgcaggatgaggtgtactgtcaaatcctgaagcagctaacacacaattccaacaggcactcggaggaacgaggctggcagcttctgtggctgtgtactgggctctttcctccgagtaaaggattactgccccacgctcaaaaattcattgacactaggcgaggcaagctgctcgcgccagactgcagtcgacggatccaaaaagtactgagaacggggcctaggaaacaacctcctcatcaagtggaagtggaagcagccgagcaaaacgtgagccggatttgtcataagatctacttcccaaacgataccagcgagatgctggaggttgtggctaacacaagggtaagagatgtttgcgactccatcgcgacacgtctgcagctggcatcttgggaggggtgctccctgtttataaagattagcgacaaggtgatcagtcagaaagagggagatttttttttcgatagtcttagggaagtgagcgactgggtgaagaaaaacaaacctcagaaggagggagctccagtcaccttaccttaccaagtgtactttatgcgcaagctgtggctgaatatcagccccgggaaagatgtcaatgccgacaccattctccattaccaccaagagctgcccaaatatctcagaggtttccacaaatgctcccgtgaagatgcaattcacctcgctggattgatatacaaggctcaatttaacaacgacaggagccagctagcctctgtgcccaagatcctaagagagttggtccccgagaacctcacacggctgatgagttccgaagagtggaaaaagagcatcttactggcatacgacaagcataaggataagacagtggaagaggcgaaagtggcattcctgaaatggatttgccgctggcccacttttggttcggccttcttcgaggtgaaacagacatctgagccttcataccctgacgtgattctgatcgccattaaccgccacggggtcttgttgatccaccccaaaaccaaagatttacttacaacgtatccttttaccaaaatttccagttggtcttcaggcagcacctactttcacatggccctcggctccctcggtcgtggctccaggcttctgtgcgagacatcccttggctataagatggatgatctgctgacatcctacgtgcaacagctgttatccgcgatgaacaagcaacgcggtagcaaggccccagcgctcgccagtacctag

SEQ ID NO: 196266 - DNA, 4248 bp, Artificial Sequence
  Description of Artificial Sequence: Synthetic coding sequence
atgcccgaccagttcgaccaggccgtggtgctgaaccagctgcggtacagcggcatgttggaaaccgtacgaatccgcaaggcaggttacgcggtacgaagaccatttcaggacttttacaagcggtacaaagtcctcatgaggaacctcgctctgccagaagacgttcgtgggaagtgtaccagcctgctccagctgtacgacgccagtaactccgagtggcaacttggtaagaccaaagtgtttcttagagaatcgttagaacagaagctggaaaagagaagagaggaggaagtgtcacatgccgccatggtcatacgcgcccacgtcttgggctttctggcgaggaaacaataccgtaaagtgctgtattgcgtcgttattattcaaaagaactatcgagcatttctgctaaggaggaggttcctgcacctgaaaaaagctgctatcgtgttccagaaacaactgcgcggccagatagcacgcagagtgtacagacagcttctggccgaaaagagggaacaggaagaaaaaaaaaaacaagaagaggaggagaaaaaaaagagagaagaggaggaacgggagagagagcgggagcgcagagaggccgagctccgcgctcaacaggaagaggagacccgaaagcagcaggaattggaggctctgcagaagtcccaaaaggaggcagaactgacccgggaactcgagaagcagaaggaaaataagcaggtggaagagattctgagacttgagaaagagatcgaagatcttcaacgcatgaaggagcagcaggagctatccttgactgaggcctcccttcagaagctgcaggaacgccgtgaccaggagctcaggcgactggaagaggaagcctgtagggctgcccaggagttcctagagtccctgaactttgatgaaatcgacgagtgcgttagaaatattgagagatcattgtcagttggaagcgaattctcaagtgaactagctgaaagtgcctgcgaggagaagcctaacttcaacttctcgcaaccctatcctgaggaggaagttgacgagggcttcgaagccgacgatgacgccttcaaggacagccccaacccgagcgagcatggacactctgatcagagaacgtcgggaatccggacaagcgacgattcctctgaagaggacccctacatgaatgatacagttgtccctacgagccccagcgctgactctacagtcctgttggctcctagcgttcaggactccggatctttacacaatagttccagcggcgaaagtacgtactgtatgccgcaaaacgctggagacctgcccagcccagatggtgactacgattacgaccaggacgactacgaggacggtgccataacctccggatcaagtgttacatttagcaactcctacggttcacagtggtctcctgattaccggtgttcggtcggtacctacaacagttcaggagcctaccgtttttctagtgagggcgcccagtccagtttcgaggattcagaggaggactttgattctcgctttgatacagacgatgagttatcctaccggagggattcagtttattcatgcgttaccctcccttatttccatagtttcctgtatatgaaaggcggccttatgaattcttggaagcggcgatggtgtgtgctgaaggacgagacgttcctgtggtttcggtctaagcaagaagccctgaagcagggttggctgcacaagaaaggcggaggatcttctacgctctctaggcggaattggaagaagagatggttcgttctccgacagtctaagctcatgtatttcgagaatgactctgaagagaagctgaaagggactgttgaggtgagaacggccaaagagatcatcgacaataccactaaggagaacggcattgacatcattatggccgacaggaccttccacctgattgccgaaagtcctgaggacgcaagtcaatggttctctgtgctatcacaggttcacgccagcacagatcaagagatccaggagatgcatgacgagcaggccaacccccagaacgcggtgggaaccctggatgtcgggctgattgattccgtgtgtgctagtgacagcccagatagaccaaactccttcgtaatcatcacagcaaatagagttctgcactgcaacgccgatacccctgaggagatgcatcactggatcacccttctccaaaggagcaaaggggacacgcgtgtcgaggggcaagaattcatagtgaggggatggctccataaggaggtaaagaactctcccaaaatgtcttctctgaagctgaagaagagatggttcgttttaacccacaactccctggattactacaagagctcagagaaaaatgctctcaaactggggacactggttctaaattctctctgcagcgtggttcctcccgacgaaaaaattttcaaggaaacaggctactggaacgtgaccgtgtacggaagaaagcactgctataggctgtataccaagcttctgaacgaggcaacccgctggagctccgccatccaaaatgtgacagataccaaagctcctatcgatactcccactcagcaactgatccaggatattaaggaaaactgcctcaacagcgacgtcgtcgagcaaatatacaagaggaatccaattcttagatatactcaccatcccctacattcaccactccttccattaccttacggcgacatcaacctcaatctgctgaaggacaagggctatactacactccaagacgaagctattaaaatcttcaattcactccagcaactggaatccatgtccgacccaatcccgatcattcagggcatcctgcagaccggtcacgatcttcgcccccttagggatgagctgtattgccaactgattaaacagactaacaaagtcccccacccagggagcgttggcaacctgtattcatggcaaatcctgacctgtctgagttgcacatttctgccttcacgaggcattttgaagtatcttaaattccacctgaaacgcattcgtgaacagttccccgggagcgagatggagaagtatgccctattcacatacgaaagcctcaaaaaaacgaagtgccgagagtttgtgccttccagagacgagattgaagccttaatccataggcaagaaatgacttcaacagtgtattgccacgggggaggaagctgcaaaataaccataaattctcacactacggctggcgaagtggtggagaagctgattcggggcctcgcaatggaggactcaaggaacatgttcgcactttttgaatacaacgggcacgtggataaagcgatcgagtcccgaacagttgtggccgatgtgctagccaaattcgagaagttagcggccaccagcgaggttggagacctcccttggaaattttatttcaagctctattgcttcctggacacggataatgtgccaaaggatagcgtggagttcgcttttatgtttgagcaggctcatgaggccgtgattcacggccaccatcctgcccccgaagagaacctccaagtgctggccgcactgcgcctccagtatttacagggtgactataccttgcacgctgccatcccacccttggaagaagtttattcccttcagaggctaaaggctcgcattagccagtcaacaaagaccttcaccccctgcgagcgactggagaaaaggaggacctcatttctggagggtactctccgcagatcattccgcaccggctcagtagtccgtcagaaggttgaggaagaacaaatgctcgacatgtggataaaagaggaggtatcttcagccagggctagcatcatcgataagtggcgaaaattccagggcatgaaccaggaacaggccatggcaaagtatatggccctgataaaggagtggccggggtatgggagtaccttgtttgacgtcgagtgcaaagagggagggttccctcaggaattgtggctaggcgtttccgcggatgctgtttctgtgtataagagaggagaggggcgcccgctcgaagtttttcaatatgaacacatcctaagctttggagcccctttggccaatacttataaaattgtggttgacgagcgggagctgttgttcgagacctccgaagtggtagatgtagcaaagctgatgaaagcctatattagcatgatcgtaaagaaaaggtatagcactactcgcagcgcttccagccagggttcgagcaggtag

SEQ ID NO: 196267 - DNA, 4248 bp, Artificial Sequence
  Description of Artificial Sequence: Synthetic coding sequence
atgcccgaccagttcgaccaggccgtggtgctgaaccagctgcggtattcggggatgctcgaaacagtacggatcaggaaggcagggtacgccgtgcgtcgaccttttcaagatttttacaagcgctacaaggtcctcatgagaaacctcgccttgcctgaagatgttcggggtaagtgtacttcattactgcaactttacgatgcaagcaacagtgagtggcaacttggcaagaccaaagtctttcttagggaaagcctcgaacagaaactagagaagcggcgcgaggaggaagtcagtcatgcggccatggtaatccgggctcacgtgcttggcttcctggctcgcaaacagtatcgtaaggttctgtattgtgtggtcattatccagaaaaattatagagcttttttacttcggaggcggttcctgcacctgaaaaaggcagcgattgtttttcagaaacaattgcgggggcagatcgcacggcgtgtgtatcgccagcttctggccgagaaacgcgaacaagaagaaaagaagaagcaggaagaagaggagaagaaaaaacgggaggaagaggagcgcgaacgggaacgggagcggagagaggctgagctgcgcgcacaacaagaggaagaaactagaaaacagcaggaactcgaagccctccagaaatcccagaaggaagcagaactgacaagagagttagagaaacaaaaggaaaacaagcaggtggaagagattctgagacttgaaaaagagatcgaggacctgcaaagaatgaaggagcagcaggagttaagcctgaccgaagcatccctgcagaagttacaggagaggcgggaccaagagctcagaaggctggaggaggaggcgtgccgcgccgcccaggaattcttggagagccttaacttcgatgagatagatgagtgcgtgagaaacattgagagaagtctgagtgtgggttccgagttctcttcagaacttgctgaatctgcttgtgaggagaaacctaatttcaatttctcccagccataccccgaggaagaggttgatgaagggttcgaagctgacgacgacgctttcaaggattccccaaatccctcagaacacggtcatagcgaccagcgcacaagcggcattagaactagcgatgacagtagcgaggaggacccatatatgaatgatacagttgtcccgacttctccttctgctgactctacagtgctgctagcaccatcagttcaggatagtggtagcttgcataattcaagttccggcgagtcaacgtattgtatgccacagaatgctggtgacttgccctccccagacggcgattatgattacgaccaagacgattacgaagacggagctattaccagtggatcttctgttacattctccaactcctatggcagtcaatggtcccccgactatcgatgtagcgtcgggacatataacagttctggagcgtatcggtttagctccgaaggcgctcagtcgtcttttgaagactcagaggaggatttcgactccaggtttgacactgacgacgaactgtcttatcggcgcgattccgtttacagttgtgtgactctgccttactttcactcattcctgtacatgaaagggggactcatgaatagctggaagcgtaggtggtgtgtcctcaaggatgagacatttctatggtttcgaagcaaacaggaagctctaaagcagggctggctgcataagaaaggaggcgggtcctcaacgttgagccgaaggaattggaagaaacggtggtttgtgctgaggcagagcaaacttatgtactttgagaatgatagcgaggagaaacttaagggaacggtggaagtgaggacggccaaagagattattgacaatactaccaaggagaatggcatcgacattatcatggctgaccggacattccatctgatagctgagtctcccgaggacgcaagtcaatggttctccgttctctctcaagttcatgcatcaacagatcaggagattcaggaaatgcacgatgagcaagctaacccccagaatgcagtagggactttggacgtgggactgattgactctgtctgtgcttccgacagccctgaccggccaaatagttttgttattataactgctaaccgtgtcttgcattgcaacgcagacacacctgaggagatgcatcattggatcacccttcttcaaaggagtaagggcgacactcgtgtggagggccaagagtttatcgttaggggttggctgcataaggaggtcaagaactcgcctaagatgtcctccttgaaactgaagaaacgctggtttgtgctcacacacaattctttggactattataagtcttctgaaaagaacgcccttaaactcggcacactggtactgaacagcctatgttcggtcgttccccccgacgagaaaatttttaaagagacgggatactggaacgttactgtgtacggaaggaagcattgttatagactctacactaaattactcaacgaagcgaccaggtggagttcggccatacagaacgtcacagacaccaaggctcccattgacacccctacccaacagctgatacaggacattaaggagaactgccttaactcggacgttgtcgagcagatatacaaaagaaacccaattcttcggtatacccatcaccccttgcactccccgttgctcccactgccgtacggcgatatcaatcttaatctgctcaaagacaagggttacacgactctgcaagatgaagctataaaaatcttcaattctcttcaacagctcgaatcaatgtccgatcccattcccatcatccaaggcatcttacagaccggccacgatttgcgccccctgagggatgaactatactgccagttaattaaacagacaaataaggtgccccaccccgggagcgttgggaacctgtacagctggcagatcctaacttgccttagttgcacttttctgcctagccgtggtattctgaaatacctgaagtttcatcttaagaggataagagagcagtttcccggcagcgaaatggagaagtacgccctgtttacatatgaatctctcaaaaagaccaaatgcagagagttcgtgccaagcagagatgaaatcgaggccctcattcaccgccaggagatgaccagtactgtgtattgccacgggggcgggagttgcaagattactattaattcacataccaccgcaggagaggtcgtagagaaattgattcgcgggctggctatggaagattccaggaacatgtttgccttgtttgagtacaacggtcatgtggataaagctatcgaaagccggacagtcgtcgccgatgtgctggctaaattcgagaaactggccgctacaagtgaagttggggaccttccatggaagttctattttaaactttattgttttctagacacagacaacgtcccaaaggattctgttgaattcgcctttatgttcgagcaggcgcatgaggctgtgatacacggacaccacccagcaccggaggagaatctgcaggtgcttgcggcactgcggttacagtacctacagggggattatacactccatgctgccattcctcctctcgaggaggtctactctttgcaacgcctcaaagcgaggataagccagagtacgaaaactttcactccatgtgagcgcctggaaaagaggcggacctccttcttagaggggactctgcgtaggagcttccggacgggcagcgttgtaagacagaaagtagaggaggaacagatgctggatatgtggataaaggaggaggtgtcgagcgcgagagcctcgattatagataaatggcgaaagtttcagggtatgaaccaagagcaggccatggccaaatacatggccctcattaaagagtggcctggctacgggagcactctgttcgacgtggaatgcaaggagggcgggtttccacaggaattgtggttgggtgtgtctgccgacgcggtctcagtgtacaagcggggagaggggagaccactggaggtgtttcagtatgaacatattctctctttcggcgctcctctagccaacacatataagattgtggtggacgagcgcgaactgcttttcgaaaccagtgaggtcgtggacgtggcaaaactcatgaaagcgtacatctccatgattgtgaagaaaaggtactccaccactagatctgcaagctcccaggggtccagccggtag

SEQ ID NO: 196268 - DNA, 4194 bp, Artificial Sequence
  Description of Artificial Sequence: Synthetic coding sequence
atgctggagaccgtgcggatccggaaggccggctacgccgtgcggagaccctttcaggatttctacaagcgctataaagttctcatgcgcaatctggctttgccggaagatgtccgagggaagtgcacctctctgctgcagttgtatgatgcctctaattccgaatggcagctgggcaaaaccaaagtattcttaagggagagcctggagcaaaagttagagaaaaggcgcgaagaggaggtttctcatgctgctatggtgatccgggcgcacgtcctgggattccttgccagaaaacaatatcgtaaagttctctactgtgtggtgattatccagaagaactaccgggcatttttgctccgacgccggtttcttcatcttaagaaggcggcaatcgttttccagaaacagctaaggggtcaaatcgctaggagagtgtaccgtcagctgttggcagaaaagcgagaacaggaagagaaaaaaaagcaagaggaagaggagaagaagaaaagggaagaagaggagagggagcgcgagagggaacgcagagaggctgagctgagagcccaacaggaggaagaaacgcggaagcagcaggaactggaagccctccagaagtcacagaaagaagccgagctcacgcgcgagctggaaaaacagaaggaaaacaagcaggtggaagagatcctgcggttggaaaaggaaatcgaggatttgcagcggatgaaggagcaacaggaactgtcactgacggaagcgtctcttcaaaagctccaggagcgccgggatcaggagttgaggcgcctggaagaagaggcctgtagagccgcacaggaattcctagaaagtcttaactttgacgaaatcgacgagtgcgttagaaacattgagcgatccttgagcgtgggctcagaattttctagcgagctagcagaatccgcatgtgaggagaagccaaactttaacttctcccagccatacccagaagaggaggtggacgagggtttcgaggcggacgacgatgccttcaaagattctcccaacccatccgaacacggccactcggatcaacgcaccagcggcatccgaacctctgatgatagctcagaagaggatccttatatgaatgataccgtggttccaaccagccccagtgcagactcaacagtcctgttggccccctccgttcaggacagtggtagcctgcacaactctagcagcggcgagtccacctactgcatgccgcaaaatgctggcgacctgccctctcccgatggggactatgattatgaccaggatgactacgaggacggagcgattacaagtggatcttccgtgaccttctcgaatagctatggctctcagtggtctcctgattaccgttgttccgtgggtacatataattcatctggcgcttataggttttcaagcgagggtgcacagtcaagctttgaagattcggaggaggactttgactctcgctttgacaccgacgatgagctatcctacaggcgggactctgtgtactcatgtgttactcttccatatttccactctttcctgtacatgaaaggcgggctgatgaactcctggaagagacggtggtgtgttctcaaggatgaaacttttctgtggttcagatctaaacaagaagccctgaaacagggatggcttcataaaaagggcggtggatctagcacgctgtcgagaagaaattggaaaaagagatggttcgtcttaagacaaagcaaattaatgtattttgagaatgattctgaggagaaactgaaagggaccgtcgaggtgcgcacggccaaggagattatcgataacactactaaagagaacgggattgatataataatggcagacagaacgtttcatctgatcgcagaaagtccggaagacgcatctcagtggttcagcgttctttcccaggtccatgcgtccactgaccaggaaatccaggagatgcatgacgaacaggccaacccgcagaatgcagtcggcaccctggacgtgggcctgatcgatagcgtctgcgcctctgacagcccagatcgacccaacagcttcgttattattactgccaatagggtactccattgtaatgccgatactcctgaggaaatgcaccattggatcacattgctacaaagaagtaagggagacactagagtagaaggacaggagttcattgtgagggggtggctgcataaggaggtgaagaacagccccaagatgtcaagcttaaaactgaagaaacgctggtttgtgttgacccacaatagtctggactactataagtccagcgaaaaaaatgctctgaagctgggcacactggtgctgaattctctgtgtagtgtggtccctcctgatgaaaagatctttaaagagaccgggtactggaatgtgactgtatacggcaggaagcactgttacaggctgtacacaaagctgctgaacgaggccactagatggtctagcgcgatccagaatgtgaccgatacaaaagcccccattgacacccccacgcagcaactcatccaggacatcaaggagaactgcttaaactcagacgtcgtagagcaaatttacaagagaaaccccattctgagatatacgcaccatcctctgcactccccgctgctgcctttaccctatggcgatattaacctcaatttgctgaaggataaaggatatacaacgttacaggatgaggccatcaaaattttcaattcacttcaacaactagaaagcatgagtgaccccatccccatcatccaagggattttacagaccggccatgatctccgaccactgagggacgagctgtattgccagttgataaaacagaccaacaaagtgccccacccgggttcagttggcaatctgtacagttggcagattttgacgtgtctcagttgcacatttctcccaagccgaggcatcttgaagtacttgaaattccatctcaaacgaatccgcgagcagttccccgggtctgaaatggagaagtacgctctgtttacttatgaaagcttgaagaaaactaaatgcagagaattcgttccctccagggatgaaattgaggcgctcatacatcgccaggagatgaccagcaccgtatactgtcacggagggggcagctgcaagattacaatcaattctcacacgacggccggagaggtggtggaaaagttaatcaggggcctggccatggaggacagcaggaatatgttcgctctgttcgagtataatgggcacgtggataaggcaattgagtcaagaactgttgtggccgatgtgttggcaaaattcgaaaagctggccgcaacaagtgaagtcggggatcttccatggaagttttactttaagctatattgtttcttggacaccgacaacgtgccaaaagacagtgtggagttcgcattcatgtttgaacaggcccatgaggcagtgatccacgggcatcatccggctcccgaagagaatctgcaggtgttggcagccttgagattacaatatctgcagggggattataccctgcatgcggccatcccccctctggaggaagtgtacagcctccaacggttgaaagccagaatctcgcaaagcactaagacgtttacaccttgcgagagactggagaagagaaggacctcattcctggagggcacacttcggagaagcttcagaactggatctgtggtgcgtcagaaagtagaggaggagcagatgctggacatgtggattaaagaagaggtgagtagcgctcgcgccagtatcatagataagtggcgcaagttccagggaatgaaccaggagcaggcgatggctaaatatatggccctcataaaagagtggcccggctatgggtccaccttatttgatgtggagtgcaaggaaggtggatttccacaggagttgtggctgggggtgagtgccgacgctgtgagcgtgtacaagcgcggcgagggtaggcctttagaagtgttccagtatgagcatatactgagtttcggtgctcccctagctaatacttacaagatagtggtcgatgagcgggaactcctgttcgagacatcagaggtagtcgacgtggcaaaactcatgaaagcttacatttccatgatagttaagaagcggtatagcactactcgatccgcctccagccagggatcgtcccgatag

SEQ ID NO: 196269 - DNA, 6177 bp, Artificial Sequence
  Description of Artificial Sequence: Synthetic coding sequence
atggacaacttcttcaccgagggcacccgggtgtggctgcgggagaacggacagcactttccctctaccgtgaattcttgcgccgaggggattgtggtgttccgaacagactatggccaggtctttacttataagcaaagcaccatcacgcaccagaaagtcaccgccatgcacccgacaaacgaggagggagtcgacgacatggcctcactgacagaactccacggaggctccataatgtacaacctgtttcagcgctataaaagaaaccagatctatacctacataggttccatactggcttccgttaatccttaccaacccatcgcgggtttatatgaaccagccaccatggaacaatattcccgcaggcatctgggcgagctgccaccccacatctttgctattgccaacgagtgctatcgctgtctctggaagcgccacgacaatcaatgtattctcatcagcggcgagtcaggcgccggcaagacggaaagcacaaagctgatcctgaagttcctgtctgtgatctcacagcagtctttagagttatcccttaaggagaaaacatcatgtgttgaacgcgctatattggaatcatcgccaatcatggaggcattcggcaacgcaaaaactgtctacaacaacaactcctcacgctttggaaagttcgtccaacttaacatctgtcagaaggggaatatccaaggcggaaggatcgtcgactatctgctggagaaaaatcgcgtggtgcgtcagaaccccggcgagagaaactaccatattttttacgcactgctcgcaggtttagagcacgaggagcgtgaggagttctatctttctactccggaaaattatcactatttgaatcagagtggctgcgtcgaggacaaaactatctccgaccaggagtctttcagagaagtgatcaccgccatggatgttatgcagtttagcaaggaagaagtgagagaagtctcccggctgctcgccggcatattgcacctggggaacatagagtttattaccgcaggaggtgctcaggtgtcattcaagactgccttgggaagatctgccgagctgctgggccttgatccaactcaattaaccgacgccctgacgcagcgctccatgtttctgcggggagaagagatcctcactccacttaacgtgcagcaggcagtagacagtagggattctctggcaatggccctgtatgcgtgctgttttgagtgggtaattaagaagatcaattccagaatcaagggcaacgaggattttaaaagcataggaattctcgacatattcggtttcgagaacttcgaggttaatcacttcgaacagttcaacatcaattatgctaacgagaaattgcaggaatacttcaacaaacatattttttctttggagcagctggagtattcgcgtgaagggttagtctgggaagacattgattggatagataacggcgagtgtttggacttgattgaaaagaagctgggcctcctagcactgattaatgaagagtcacattttcctcaggccaccgactctacactcctggaaaagctccactcccagcacgccaacaaccacttttacgtcaaaccacgggtcgctgtcaacaactttggagttaagcactacgcaggtgaagtgcagtatgacgtgaggggtatccttgagaagaacagagataccttccgggacgatctgctgaatctgttgagagagtctaggttcgattttatatatgacctgtttgagcacgtgagctctcgaaataatcaggacacacttaagtgcggaagcaagcatcggcggcccactgtctcgagtcaatttaaagactctctgcatagcttgatggcaactctgagttcttctaacccgttcttcgtgagatgcatcaagcctaatatgcagaagatgccagatcagtttgatcaggcagtcgtcctcaaccaattgaggtacagtggaatgctggagaccgttaggatcagaaaagcagggtacgctgtccgacgcccatttcaagacttttacaaacggtataaagtactaatgcggaatcttgccctccccgaagatgtcagggggaaatgtacttctctattgcagctgtatgatgcctccaactcagagtggcagctcggaaaaaccaaggtttttctgagagaatcactcgagcagaaactggaaaagcgtagggaggaagaggtctcccatgccgcaatggtcatccgagcccatgtcctaggctttctggcccgtaagcagtacaggaaagtcctatactgcgttgttatcatacagaagaattaccgagcgtttctactgagacggcgcttcctccacctcaagaaggctgcaatagtgtttcagaaacagctcagaggccagatcgcacggagagtatacagacaactgctagccgagaagagggaacaggaggagaaaaagaaacaggaggaggaagagaagaaaaaacgtgaggaagaagagcgcgaacgcgaacgggaacgcagagaagccgaactccgcgcccagcaggaagaagagaccaggaaacagcaagaactggaagctctccaaaaaagccaaaaagaggccgagctcaccagggagctcgagaagcagaaagaaaataagcaggtggaggaaattctcaggctggaaaaagagatcgaggatttgcaacggatgaaagaacagcaggagctatccctgactgaggcctctctgcaaaagctgcaggaacgtcgtgaccaggaattgcggagactggaggaagaagcctgtagggcagcccaggaatttctggagtctctcaacttcgatgaaattgacgagtgcgtgaggaatatcgagagaagcctgagcgtcggcagtgaattcagttctgagctggccgagtctgcgtgcgaggagaagcccaatttcaatttctctcagccgtatcccgaggaggaggtagacgagggatttgaggctgacgacgacgcgtttaaagactctccaaacccatccgaacacgggcactccgatcagaggacatccggtattcgcacatctgatgattcctccgaggaagatccttatatgaatgacacggtggttccaactagtccatctgccgactcaaccgtactgctagctccatcagtgcaggattctggaagccttcataacagctcctcaggcgagtcaacctactgcatgcctcagaacgctggagacctgccaagccctgacggggactatgattatgaccaagatgactacgaagacggggctatcacttctggttcttcggtgaccttctcaaacagttatggttcacagtggagtcctgactatcgatgcagcgtcggtacttacaatagcagtggggcctacagattcagctcagaaggcgcacaatcttcctttgaggacagtgaagaggatttcgactcacggttcgacactgatgacgaactttcctaccggagagactccgtttactcttgcgtgaccctgccatattttcacagctttctgtacatgaagggtgggctgatgaattcttggaaacgcagatggtgtgtcttaaaggacgagactttcctgtggttccgatcaaagcaggaagcactgaaacagggttggctgcacaaaaaaggcggggggtcatcaaccttatcgagacggaactggaaaaagaggtggtttgttctgcgtcagtctaagctgatgtactttgaaaacgactccgaggagaaactaaaggggacagtggaggttcggacagcaaaggaaattatagataacacgactaaggagaacgggatcgacatcatcatggctgaccgcacgtttcacctgattgccgagtcgccagaggacgcttctcagtggttttcagtgctaagccaggttcacgcaagtaccgatcaggagatccaggaaatgcacgacgaacaggctaacccacagaatgccgtaggaacccttgacgtgggcctgatagactctgtgtgtgcgtctgacagtccagataggcctaattcatttgtgatcatcaccgcaaatagggtactgcattgtaacgctgataccccagaagagatgcaccactggatcacgctactccagcgttccaagggagatacccgtgtggagggacaggagtttatcgtgcgcggatggcttcacaaggaggtgaaaaattccccgaagatgtcttctttgaaactcaagaagaggtggtttgtgttgacccacaactccctggactactacaagagttccgaaaagaacgccttaaagctgggcacacttgtgcttaactcactgtgctccgttgtaccccccgatgagaaaatattcaaggagaccggttactggaacgtgacagtgtacggacgcaagcactgctacaggttgtacacaaaactactgaatgaggcgacacgatggtcatccgcgatccagaacgtaacagacacaaaagcgccaatcgatacgcccacccagcagcttattcaggacatcaaggagaattgcctgaattccgatgtggttgagcagatatacaagagaaatccaattctcagatacactcaccatccactgcactctcctctgctgccattaccttatggtgatatcaacctcaacttactcaaagacaagggttatacaaccctgcaggacgaggcaataaaaatctttaactctctccaacaattagaatccatgagtgatccaattcctatcattcaggggattctgcagaccggccatgacctgagaccgctgcgcgacgagctttattgtcagctgatcaagcaaacaaataaagttcctcatccaggctctgtcggtaacctgtacagctggcagatcctcacgtgtctgagttgcacatttctgccatcgaggggtattttaaagtatttgaagttccacctgaaacggataagggaacaatttccaggatcagaaatggaaaagtacgccctctttacctacgagagtctgaaaaagacaaaatgtcgggagtttgtcccctcccgtgacgagattgaggccctaatccacaggcaggagatgaccagtactgtgtactgccatggaggtgggtcctgcaagattactataaactctcatactacggcaggggaagtagtggaaaagctgattcggggacttgcaatggaggattcaaggaatatgtttgctttgttcgaatataatggacatgtagataaggctattgagtcaagaaccgtagttgctgatgtcttggccaagttcgagaaactcgctgccacttccgaagtcggcgatctgccctggaaattttatttcaagctgtactgcttcctggataccgacaacgtccccaaggacagcgtggaattcgccttcatgttcgagcaagcacacgaggcagtcatccatgggcatcaccctgcacctgaggagaacctgcaagtgcttgcagcactaagactgcagtacctccaaggggactacacactccatgccgctatccctcccctggaggaggtttatagcctacagcgcttgaaggctaggatatctcaatccactaaaacattcaccccatgcgagcgactagaaaaaaggaggacttcttttctggagggcaccctcagaaggtcctttagaacaggatctgtcgtgcgtcaaaaagtggaagaagagcaaatgctcgacatgtggattaaagaggaggtgtcatccgcaagagcttcgatcatagataagtggcgtaagtttcagggtatgaaccaggagcaagccatggccaagtacatggctctgattaaggagtggccggggtatggctctacgcttttcgacgtcgaatgcaaggagggcgggttcccccaggaactgtggttaggcgtgtcggctgacgccgtgtcagtgtacaaaaggggcgagggtaggcccttggaagtctttcaatacgagcatattttgagttttggagccccactggctaacacgtacaagattgtggtggacgaacgcgagctgcttttcgagacatccgaggtcgttgatgtcgccaagctcatgaaagcttacatatccatgatagtaaaaaagcggtattccactacccggagcgcctcttcccagggcagttctaggtag

SEQ ID NO: 196270 - DNA, 4194 bp, Artificial Sequence
  Description of Artificial Sequence: Synthetic coding sequence
atgctggagaccgtgcggatccggaaggccggctacgccgtgcggcgcccgttccaagacttctacaaacgttacaaagtgcttatgcggaatttggctctccctgaggacgtcaggggaaaatgtacctctctgctccaactgtacgacgcatccaattccgagtggcagctcggcaagacgaaagtgtttctgagggagtcactagagcagaagctggagaagagacgagaggaggaagtgtctcacgccgcgatggtgatccgggcccacgtactcggttttttagctcgcaaacagtaccgtaaggttctatactgcgtcgtcattatccagaaaaactatcgcgcctttctcctgcggaggcgtttcctgcatttgaagaaggccgcaatcgtatttcagaagcagctgcgtggtcaaatcgcaagacgagtgtataggcagctcctggccgaaaagagggagcaagaagagaaaaagaaacaggaggaggaggagaagaagaaaagagaggaagaagagagggaacgtgaacgagagagacgtgaggcggagttaagggctcagcaagaggaagagacacgaaagcaacaagaactggaggccctccagaagtcccagaaagaggcagaattgaccagagaattggagaaacagaaggagaataagcaggtggaggagattcttcgtctcgaaaaggagattgaggacctccagcgtatgaaagagcagcaggagttgagtcttaccgaggccagcctgcagaagctccaggaacgccgggaccaggagttgaggcgcttagaggaggaggcctgccgcgcggcccaagagttcctggagtctctaaactttgatgaaattgacgagtgcgttcgaaacattgagaggtccttgtcggttggctctgagtttagctccgaactcgccgaaagcgcttgtgaggagaaaccaaacttcaatttcagtcaaccttacccagaggaggaagtggacgagggatttgaagcagatgatgatgctttcaaggattctcccaacccgagtgagcatggacacagcgaccagagaacgtctggtattcgcacaagcgacgactcttcggaggaggacccatatatgaacgatactgtggtacccacctccccatccgctgactctacagtcctgctggctccaagtgtgcaggattccggatcactgcacaacagttctagcggcgaatctacgtattgcatgccccagaacgcaggagacctccctagtcctgatggggattacgattatgatcaggacgattacgaggatggcgccatcacatccggctcttccgttaccttctccaatagttacggctcccagtggtcgcctgattataggtgttctgttggcacgtacaacagcagcggcgcctatagattctccagcgagggggctcagagcagcttcgaggattccgaggaggatttcgactccaggttcgacaccgatgatgagctgtcttaccggcgcgattcagtgtatagctgtgtaacactgccttacttccactcctttttatacatgaagggagggctcatgaactcctggaaacgcagatggtgtgtccttaaggacgagacgttcctctggtttcggtctaagcaggaggctctaaaacagggatggctgcacaagaaaggcggcggcagcagcaccctcagccgtaggaactggaaaaagaggtggtttgtcctcaggcagtccaaactgatgtatttcgaaaacgattccgaagaaaagctgaagggaacagtcgaggttcggaccgcaaaggaaattatcgacaacactactaaggagaacggcatcgacattatcatggctgatcggacctttcacctgatcgctgaatcccccgaagatgcttcccagtggttttctgtgctgtctcaggtgcatgctagcaccgatcaggagatccaggaaatgcatgacgaacaagccaaccctcagaatgctgtgggcaccttggatgtgggcttaatagattccgtctgtgcttccgatagtcccgatcggccaaatagtttcgtgattatcactgctaaccgcgttttgcattgcaacgcagatacgccagaggagatgcaccattggattaccctgctgcagcggagcaagggcgacacccgagttgaggggcaagaattcattgtccgcggctggctgcataaagaagtgaagaacagcccaaagatgagctctctgaagctgaagaaaaggtggttcgtgcttactcacaatagcctggactactacaagagctcggaaaagaacgcgctgaagctgggtacattagtattaaacagtctttgttcggtcgtcccgccagacgaaaaaatcttcaaagagacaggctattggaacgtcaccgtttacggaagaaaacattgctacaggctgtacacaaaactcctgaacgaagccacacggtggtctagcgccatccagaacgtgaccgacacgaaggcaccaatcgacacccctacccagcaactcattcaggatattaaagagaattgcttaaactcagatgttgtcgaacagatctacaagcgtaacccaattctgaggtacacacatcaccccttgcactccccattgctgcccctcccttacggcgacatcaacctgaacctcctgaaggataaaggctatacaactctccaagacgaagctatcaagattttcaattccctgcagcagcttgaaagtatgtcagatccaattcccataattcagggcatcctgcagaccggccacgatctgcgccctctgagggatgagctctactgtcagctgattaaacaaacgaataaggtcccacatcctggcagcgttggaaatctgtattcttggcagatactgacctgcctgagttgtaccttcctgccctctaggggtatcctgaaatatttaaagttccaccttaaacgcatcagggagcagttccctgggagcgagatggaaaaatacgcccttttcacatacgagagtctgaaaaaaaccaagtgccgggagtttgtcccatctcgggatgaaattgaagccctcatccatagacaagagatgacctctacggtatattgccacgggggcggctcatgtaaaatcaccataaacagtcataccaccgccggcgaagtggtggagaagctaatccgcggcttggcaatggaagactctcgcaatatgtttgccctttttgagtataatggccacgttgataaagccattgaaagtcgcaccgtggtggctgatgtgcttgcaaagttcgaaaaattggcagctacgtccgaagtaggggacctgccctggaaattctatttcaagctgtactgtttcctggatacagacaatgtccccaaagactcggtcgagttcgcattcatgtttgaacaggctcatgaggcagtgattcatggacatcacccggcaccggaggaaaacctacaagtgctcgcagctctgaggctccagtatttacaaggtgactacactcttcacgccgcgatcccacccttggaagaggtctacagcttgcagcgcctgaaggctcgtatttcccagtcgacaaagacttttacaccctgtgagcggcttgaaaagaggcgcacctcattcctcgaaggaacgcttcgaagaagcttccgaaccgggtctgtggtcaggcaaaaagtcgaagaagagcagatgttagacatgtggattaaggaggaggttagctccgcacgagccagtatcatcgacaagtggcggaaatttcagggaatgaaccaggagcaagccatggcaaaatacatggcactcatcaaagaatggccaggttatggcagcaccctgttcgatgtggaatgcaaggagggcggcttccctcaggaactctggctgggtgtctccgccgacgctgtgtctgtgtataaaaggggggagggacggccattggaggtattccagtacgagcacattctcagctttggcgctcccttagccaatacctacaagatcgtggtcgacgagcgcgagttactttttgagactagtgaagttgttgatgtggctaagttaatgaaggcttacattagtatgattgtcaagaaacgctatagtacaacgcggagcgcctcttcacagggcagcagtcgctag

SEQ ID NO: 196271 - DNA, 552 bp, Artificial Sequence
  Description of Artificial Sequence: Synthetic coding sequence
atggagaacggcgccgtgtacagccccaccaccgaggaggaccccggcccggcccggggaccacgttcaggactagccgcatatttctttatgggcagactgcctctgctcaggagggtgctgaagggcctgcaactgctcttatcactcctggctttcatttgcgaagaggtggtgtctcagtgtacactttgtggtggattgtactttttcgaattcgtcagttgttctgcgttccttctgtccctgttgatcttgatcgtgtactgcacaccattttatgaaagagtggatacaactaaggttaaatcatctgatttctacataacactgggcaccggctgtgtcttcctgcttgcgtcaatcatcttcgtgtcaacccacgaccgtaccagcgctgaaatcgccgcaattgtctttggtttcatagcctcattcatgtttctcctggactttattactatgctctacgagaagcgacaggagtctcaactgaggaagcccgaaaatacaacgagggccgaagcgctgactgaaccgcttaacgcgtag

SEQ ID NO: 196272 - DNA, 1437 bp, Artificial Sequence
  Description of Artificial Sequence: Synthetic coding sequence
atgctggagttcgcccagaagtacttccgggacccccagcggcggccccaggacggactccgtttgaaaagcaaagaaccaagagagtcgagaacgctggaagacatgttatgctttactaaaactcctctgcaagaatctctgatcgaactgtcagattcctctctgagcaagatggccacggacatgtttcttgccgtcatgaggtttatgggtgatgcacccctgaaaggccagtccgacttggacgtgctgtgtaatctcttaaagctgtgcggcgaccacgaggtgatgcgtgatgaatgttactgtcaggtagtcaagcagattacagacaacacaagttcgaaacaggacagctgccagcgaggctggaggctgctctacatcgttacggcttaccatagctgctcagaggtactgcacccacatctgacaaggtttttgcaggacgtgagccggaccccagggctcccattccaaggaatagccaaagcctgcgagcagaacctccagaagactctccgctttggaggccggctggaactgccgagttcaatagagctgcgcgccatgttggcaggccgcagctccaaaagacagcttttcctgctcccagggggcctggagcgacacctgaagataaagacctgcactgtcgctctcgatgttgtagaagagatctgcgctgagatggcattgactcgcccagaggccttcaacgagtacgtaatttttgtggtcacaaatcgggggcaacatgtgtgtcctttaagtaggcgcgcctatattttggatgtggctagcgagatggagcaggtagacggggggtacatgttgtggtttagacgagtcttgtgggaccagccccttaaattcgagaatgagctgtacgtgaccatgcactacaaccaggtcctccctgactacctcaaggggctcttcagctccgtgccagcatccagacccagtgagcagctgctgcaacaggtctccaagctggctagcttacagcacagagcaaaggatcatttttacctgccatctgtccgggaggtgcaggagtatatcccggcgcagctgtaccgcacaacagcaggatcaacttggctcaaccttgtgtcccaacatcgacaacagacgcaggctctgagtccgcaccaggctagggcgcagtttctgggactgctatcagcgctcccaatgttcgggtcctcctttttcttcatccagagctgcagtaacatcgctgtgccggccccctgtatattggcaatcaatcacaatgggctaaactttttgagcaccgaaacacacgtctctggattatctctggcactccctagccctccatcagtaccctggtcccccacccctagtaagcgtccacgcccccccgccgcggaggcccagttccactgcttaccaccctcctag

SEQ ID NO: 196273 - DNA, 555 bp, Artificial Sequence
  Description of Artificial Sequence: Synthetic coding sequence
atgaacatgctgagcagcctgagccccaccgtggtgctgcccgactacctcaagggattgttttccagcgttccagcatctcgtccttccgagcaactgttgcagcaggtgtctaaactggcatcactgcagcatcgagcgaaagaccacttctacctgccgagcgtgcgcgaggtccaagaatatatcccagctcagctatatagaaccaccgccggctccacatggctgaacctcgtgtcacagcaccgtcaacaaactcaggccctgagtcctcatcaggcaagagctcaatttctgggactgttgtcagccttgccgatgtttggaagctcatttttttttatacaaagctgcagcaatattgccgtacccgccccctgcattttggcgattaaccacaacggattgaacttcctgtccaccgaaacacacgtctccgggctttctttggcactgccctcacccccttctgtgccctggtcaccgactccaagcaaacgaccccgtccacccgccgctgaagcacagttccattgcctgcccccttcatag

SEQ ID NO: 196274 - DNA, 735 bp, Artificial Sequence
  Description of Artificial Sequence: Synthetic coding sequence
atgcgggacgagtgctactgccaggtggtgaagcagatcaccgacaacacatcttcaaagcaagattcgtgccagagggggtggaggctgctttacatagtgaccgcttatcactcgtgttctgaagtgctgcacccacacctaacgagatttctgcaggatgtctcccggaccccaggccttccattccagggtatcgcgaaggcgtgcgaacagaacttacaaaaaacacttcgctttggcggaagattagaattaccctcaagtatagagctgagggctatgctggctggtagatcttcaaaacgtcagctgttcctcctgccgggcgggctggagagacatctcaaaatcaagacctgtaccgtggcattagacgtcgtagaagaaatctgtgcagaaatggctctgactcgaccagaggccttcaatgaatatgttattttcgtcgtgacaaatcgcggggggaaaagccggtcgaccagtcaaccaagctcaactgtgcagcggcaggcacgaccgggctctacttggtccgctagcaccggatctaggcacaggcgaagtgccccaacccggccggttccatccttctgggcgtcatctgccccctacctgtgcagcgctcccccctcgtcttctagccgcgccgccgctactctcctgtgtcagccgttggcctcgcttccttccaccactatggcctctaccttcagcgctcaacgtcttatgtag

SEQ ID NO: 196275 - DNA, 429 bp, Artificial Sequence
  Description of Artificial Sequence: Synthetic coding sequence
atggtgaagggcggccaggaggccggcggccagctgcgggtgctgcgtgcctattccttcgccgatattctgtttgttactatgccatcccagaacatgttggagtttaacctcgccagcgagaaggtgattttgttcagcgcaagggcccatcaggtcaaaaccctagtcgacgacttcatccttgagcttaaaaaagacagcgactacgtcgtggcagtgcgaaattttctgcctgaagaccccgctctgcttgcattccacaaaggagatattatccacctccagcccctggagcctcctcgcgtaggctatagcgctggttgcgtcgtccgaagaaaagtggtgtatctcgaagagttacgaaggcgaggcccagattttggcgtctgtccacgcacgtggaaccccattcgaggagcttcctag

SEQ ID NO: 196276 - DNA, 6165 bp, Artificial Sequence
  Description of Artificial Sequence: Synthetic coding sequence
atgttcaacctgatgaagaaggacaaggacaaggacggcggccggaaagaaaagaaggaaaaaaaggagaaaaaggagagaatgtccgctgcagagttgcgatctctggaggagatgtccctcagaagagggtttttcaacctgaataggagctccaaacgggaaagcaagactaggctcgagatatcgaacccgattcctatcaaggttgcgagcgggtcggacctgcatctgacggatattgacagcgacagtaataggggatcagtgattttggattctggccaccttagtacagcatctagctccgatgatcttaaaggtgaggagggttcttttagaggatctgtgcttcaacgtgctgccaagttcggatcattggctaaacagaatagccagatgattgttaagaggttttcatttagtcagaggagcagggacgaatcggcatccgagacatctaccccgtctgaacacagcgcagccccttctccccaggtcgaggtgcgcaccctggagggacagctcgtccagcaccctgggccaggcatccctcggcccggtcacagatctagggccccggagctcgtcaccaaaaagttccccgtggacctgaggcttccaccagtggtaccactccctccgcctacattgcgggagctcgaactccaaagacgacctactggagatttcggtttttcgcttcggcgcactactatgttggatcgtgggccagaggggcaggcttgccggcgggttgtccatttcgccgagcctggcgcaggcacaaaggatctggccctggggctcgttcctggggaccgcttggtggagataaacggccataacgtggagtcaaagagccgggatgagattgtcgagatgatccgacagtcaggggactcagtgcgcttaaaggttcaaccgatccctgagctctccgagttgagccgctcttggttgcgaagcggagaaggaccccgcagggaaccctccgatgcaaagaccgaagagcagatcgccgctgaggaggcatggaacgaaactgaaaaagtgtggctggtgcaccgggacgggttttctctcgcttcacagctcaagagcgaggaactaaatctgcccgaaggtaaggtacgggtaaagctcgatcacgatggggcgattctggacgtggatgaagacgacgtcgagaaggctaacgcgccaagctgcgaccgtttagaagacctcgcctccttggtttatctaaatgagtcttccgtcctccatacactccgccagcgttacggagcaagtctgctgcatacctacgctggtcctagccttctggtgttgggcccacgcggtgcccctgccgtttactctgaaaaggtcatgcatatgtttaaaggatgcaggcgcgaagatatggccccacatatctatgcggttgcccagaccgcataccgagcaatgttgatgtcccgtcaagatcagtcaatcatattgttaggatcttcagggagtggcaaaactacttcttgccagcaccttgtacagtacctggccacgatcgccggtatctcagggaataaagtgttttctgtcgaaaaatggcaggcgctgtacacattgctcgaggccttcggcaactcaccgactataatcaacggcaatgccacgcgcttttcgcagatactctccttggacttcgaccaagctggccaggtggcatcagcctcgatccagactatgctgctggagaagctgagggtcgcacggaggccagcctctgaagccacatttaacgtgttttattatctgctggcatgtggcgacggcactcttagaactgagctccacctcaaccaccttgcagagaacaatgtttttggtattgttcccctcgcgaaaccagaagaaaaacagaaggcagctcagcagttctccaaactccaggccgcgatgaaagtgctgggcatatctccagacgagcagaaggcctgttggtttatccttgccgcaatctaccacctaggcgccgccggcgccaccaaagtccactctaccgcaggaagaaagcaattcgccaggcacgagtgggcccaaaaagcagcctacctgttaggatgttcacttgaggaactctcatcagccatttttaagcaccaacataagggtggaaccttgcagagaagtacttcgtttcgacagggacccgaggagagcggtctgggagatggtacaggccctaaactgtctgccctggagtgtctggagggcatggccgcgggtttgtacagcgaactattcaccctgctggtgagccttgttaacagggcactgaaatctagccagcactccctctgttcaatgatgatagtggatacacctggcttccaaaatcccgaacagggcggatctgcaagaggtgccagcttcgaagagctgtgtcacaattatacacaggacagactgcagcgcctgttccacgaaaggacttttgttcaggaacttgagaggtataaggaggagaatattgaactagcatttgacgacttagaaccccctacggatgattccgtggcagctgtagaccaggcgagtcatcagagtctggttagaagcttagccaggactgatgaggcacgcggtctcctgtggcttctcgaagaagaggcgttagttccgggagcttcagaagacaccttgttggaaaggctgtttagttactatgggccacaggagggcgataaaaaagggcagtcgccactccttcacagcagcaagccacaccatttcctgttgggccacagccacggcaccaactgggtggagtacaatgtcaccggctggttgaattacacaaaacaaaatccagcgacacaaaatgccccccggctactccaagattcacagaaaaaaatcatcagcaatctgtttctcggcagggcaggcagcgccacagtactatcaggatctattgccggtctagaagggggctctcagctggcactgcgtcgtgcaacgtccatgcgtaagacgtttactacggggatggccgcagtgaagaaaaaatcattgtgcattcagatgaagttgcaagttgacgcgctcatagacacaattaagaaatccaagctccattttgtccactgctttctccccgtcgctgaggggtgggccggggagccacgcagtgcatccagtcgtagggtgagctcatcatcggagttggatctgccatccggcgaccactgtgaggccggtctcctgcagcttgatgttccattgctgcgaacccaactcagaggaagcagactactggacgccatgagaatgtataggcagggatatcctgaccacatggtgtttagcgagttccgcagacggtttgacgttttggccccacacctgaccaaaaaacacgggagaaactatatagtcgttgacgaaagaagagccgtagaagaactgctcgagtgtctggatcttgaaaaaagtagttgttgcatggggctgagtcgagtattctttcgtgccgggacccttgctaggctggaggaacaaagggatgagcagacttcccgcaacctgaccctgtttcaagccgcatgtcggggctacttggcccgccagcactttaaaaagcgcaagatccaagatttagctatccgttgtgtccagaagaacattaagaagaataaaggtgtgaaagattggccctggtggaagttgtttaccaccgtgcgacccctaatcgaagttcagctgtccgaggagcaaataaggaacaaagatgaggagatccaacagctgcgaagcaaattagaaaaggctgaaaaggaaaggaacgagctgagacttaacagcgaccgccttgaatcaagaatcagcgagctgacaagtgagttaacagatgagaggaataccggtgagagcgccagtcagctcctcgatgccgaaactgctgagcggctgcgcgcggaaaaggaaatgaaagaacttcaaacacagtacgacgctctgaagaaacagatggaagttatggagatggaagtcatggaagctcggctgatacgtgccgcagagattaacggcgaggttgacgacgatgacgctggcggggagtggagactgaaatacgaaagagccgtccgggaggttgattttaccaaaaaacgactgcagcaggagttcgaggacaagttagaagtcgaacaacagaataaacgtcagttggagaggcgcctaggcgacctccaagccgattctgaagagtcgcaacgtgccctgcaacagctcaagaaaaagtgccagcgactaactgccgagctgcaggatactaaattgcatctggagggccagcaggtgcgcaatcatgagctggaaaagaagcagcggcgcttcgactcagaattgagccaggcacacgaagaggcccagagggagaagttacagagagagaaattgcagagagaaaaagacatgctgcttgctgaggccttcagtctgaaacagcagctcgaggagaaagatatggacatcgctggttttactcagaaggtcgtgtccttggaggctgagctccaggatattagttcgcaggagtcaaaggatgaggctagcctagccaaggtgaaaaaacagctccgggacttggaggccaaggtgaaagatcaggaggaggaactcgatgagcaggcaggtaccattcagatgctggagcaggccaagttacgtctggaaatggagatggaacggatgagacagactcacagcaaggaaatggaatctcgtgatgaggaagttgaagaggcccgccagtcgtgccagaaaaagctcaagcagatggaggttcagcttgaggaggagtatgaggacaagcagaaggtgttgcgtgagaaacgggaactggaagggaagctggctacactgagtgatcaagtgaatcggcgcgactttgagagcgagaagcgtctgcgaaaggatctgaagaggacgaaggcactgttagccgacgctcagttaatgctggatcacctcaaaaactccgcgccttctaagagagagattgcccagctgaagaatcagctagaagaaagtgaatttacttgcgcagcggctgttaaggcccgcaaggccatggaggttgagatcgaagacctgcacctccagatcgatgacatcgccaaggctaaaacagccctggaagaacaactgtctagactgcagcgcgagaagaatgaaattcaaaacaggcttgaggaggaccaggaagatatgaacgagcttatgaaaaagcacaaagcagcagtggctcaagcctcaagggatcttgcacaaataaacgatctacaggcccaactggaagaagcgaacaaggaaaagcaggagctgcaggagaagctgcaggccctccaaagccaggttgagttcctggaacagtctatggttgataaatccttagtctcacgtcaggaagctaagattagggagttggagacgcgcctggaatttgagcggacacaggtgaagcgactcgagagcctcgcatccaggctcaaagagaatatggagaagcttacagaagagagagaccagcgaattgcagctgaaaatcgcgagaaagagcagaataaacgcctccagcgtcagctccgggacactaaggaggaaatgggcgagctggcccgcaaagaagcggaagcatcaagaaagaaacacgagctcgagatggacctcgagtctctcgaggccgcgaaccaaagcttacaggctgatcttaagcttgcattcaagcgcattggagacctccaggccgctatcgaggatgaaatggaatccgacgagaatgaagatctgataaactctttacaggacatggtgacaaagtatcagaagcgcaagaataagcttgagggagacagtgacgtcgacagcgagctggaagaccgggtagacggggtaaagtcatggttgtctaagaacaaaggcccctccaaagcagccagcgacgacgggtcacttaagtcctctagccccaccagctattggaagtcacttgctccagaccggtcagacgatgaacacgaccctctggacaacacttcacggccaagatattcccatagttacctgtcagacagcgataccgaggcgaaactgaccgagaccaatgcatag

SEQ ID NO: 196277 - DNA, 6009 bp, Artificial Sequence
  Description of Artificial Sequence: Synthetic coding sequence
atgttcaacctgatgaagaaggacaaggacaaggacggcggccggaaggaaaaaaaggagaaaaaagagaagaaggaaagaatgagcgctgcagaattgcgctcgctggaagaaatgtcattgcgccggggcttctttaaccttaataggtcaagcaagagagaaagcaagacccggctcgagatcagcaaccccatccccattaaggtcgcgagcgggtcagatctgcatctcaccgacatagactctgatagcaaccgcggctccgttatcctcgattctggacatctgtcgactgcaagtagttccgacgacttgaagggagaagaagggagtttccggggttcggtgctgcagagggcggccaagttcggttccctggctaagcagaacagtcagatgattgtaaaacggttctcattctcacaacgtagtcgcgacgagtctgcctccgaaacctccaccccttcagagcacagtgcggctcctagccctcaagttgaggtacggacgctcgagggtcagctcgtacaacaccctggccctgggattccacggccgggccatcgctcaagggctccagagctggtgacaaagaaattccccgttgacctacgcctgccccctgttgtgcctctgccgccacccactctgcgggaactagagctgcagcgcaggcctaccggtgacttcggctttagtctgcgtcgaacaaccatgttggaccgaggtcctgagggtcaggcctgcagaagagtggtgcattttgctgaacctggggcaggcacaaaggacttagccctggggctggtgcccggtgaccggctggtggagatcaacgggcataacgtggagtctaaatcccgggatgagattgtcgagatgatccgccagagcggcgactccgtgaggctgaaagtgcagcctattcctgagcttagcgaactctcaagaagctggctcagatccggcgaaggccccagacgggaacctagcgacgccaaaacagaggaacagattgctgccgaggaagcatggaacgagaccgaaaaagtttggttagtgcaccgcgacggcttctccctagcgtcacagctgaagagcgaagagttgaatttgcccgaggggaaagtccgtgtcaagttagatcacgacggtgcaatcctagatgtggatgaagatgacgtagaaaaggccaacgccccgagctgcgaccgacttgaggacctggcctccctggtatatctcaacgaaagctctgtcctgcacaccttgaggcagcggtacggcgcaagccttctccacacttatgctggaccaagtttgctagtgctgggccctaggggtgctccggcagtgtacagcgaaaaagttatgcacatgtttaaaggatgtaggagggaagatatggctccccatatttacgccgtggcgcagaccgcctacagggccatgctgatgagtcgccaggatcagagcatcatcctgctggggagtagcggctcgggaaagacaacgagttgccaacacctcgttcagtatcttgccactatagccgggatcagcggaaataaggtgttctcagtggagaagtggcaggcactgtatactctgttggaagctttcggcaatagccccacaatcattaatggtaacgcgacccgcttctctcagattctgtccctggatttcgatcaggcgggccaggtggcttcggcatcaatacagacaatgttgctagaaaaactgcgggtggcaaggaggccagcttcagaggccacattcaatgtattctattacctgttggcctgcggcgacggcacgttgcgtacggaactccacctcaaccatcttgctgagaacaatgtgttcggcatcgtgcctctcgctaagcccgaagagaagcagaaagcggcccagcagtttagtaagctgcaggccgcaatgaaagtcttaggcattagtcccgacgagcagaaagcctgctggtttatcttggcagccatttaccacctaggtgctgcgggggctaccaaggtacacagcaccgccggtcggaagcagttcgcgcggcatgaatgggctcaaaaagccgcctacctgctcgggtgcagcctggaggaactgagctcagcaatctttaaacaccagcacaagggaggaacactgcagcgcagtacaagcttcagacagggcccagaggagagcggcctgggcgatgggactggacccaagttgagcgcccttgagtgcctggaaggtatggccgcaggcctctacagcgaactgtttactctgcttgtctccttggtcaacagagccctaaagagttctcaacacagcctgtgcagcatgatgatcgtggacactcccggttttcagaacccagagcagggtgggtccgctcggggcgctagtttcgaagagctgtgccataactatacacaggacaggttacagcgcctcttccatgagagaaccttcgtgcaagaactcgagcgttacaaggaagaaaacatagaactagccttcgacgaccttgagccccccactgatgatagcgtcgccgccgtggaccaggctagtcaccagtctctggtgcgtagtctggcccgcacagatgaagcacgcgggctgttatggctattagaggaagaggcgctcgtccctggagcctcagaggatacactgttagaacgactattttcatactatggaccccaggaaggagacaagaaggggcagagccccctgctgcactcgtcaaagccgcaccattttctgctaggccactcacacgggaccaactgggtggagtataacgtgacaggctggctcaactacactaagcagaatccagctacacagaacgctccccgcttgctgcaggactcccagaaaaagatcattagcaacctcttcttaggcagggccgggtcagccaccgttctgtctgggtccatcgctggtctcgagggagggtcacagctcgccctccgtcgcgctacaagtatgagaaagacatttaccacagggatggctgcagtcaagaagaagagtctgtgcattcagatgaagttgcaggtggatgccctgatagacactattaagaaatccaaattacatttcgtgcactgcttcctaccagtggccgagggctgggccggggagccgagatctgcctctagtagacgcgtatcctctagttccgagctcgacctaccctctggggaccattgtgaagccggcctgcttcagctcgacgtgccattgctgagaacgcagctgcggggttcacgactcctcgacgctatgcggatgtataggcaggggtatcccgatcatatggtgttcagtgagtttcgtcggagatttgacgtgctagcccctcatctgaccaaaaaacacggccggaattacatcgtggttgacgaaaggagagctgtggaggagctgctggaatgcctggacctggaaaagagcagttgttgtatgggactctcccgggtcttttttcgtgctggcactttggcaaggcttgaggaacaaagagatgagcaaacctcaagaaacctgacgctgtttcaagcggcgtgtcggggctacctcgcccgacagcacttcaagaagcggaagattcaggacttggcaatcaggtgtgtccagaagaacattaagaagaataaaggagtcaaggactggccgtggtggaaactcttcactaccgtccgccctctcattgaagtccaactgtctgaggagcagattcgaaataaggacgaggagatacaacagttaaggagcaagctggagaaggctgagaaagaaagaaacgagctcaggttgaattcagaccgactggagagcaggatctcagaattaacctctgaattaaccgatgagcgaaacacaggggagtcagcttctcagttgttggacgcagagaccgccgaaaggctcagggcagagaaagagatgaaagaattacagacccaatatgacgccctgaaaaaacagatggaggtgatggagatggaggtgatggaagccagactgatccgggctgcagagatcaatggtgaagtggacgacgacgatgctgggggtgaatggcgacttaagtatgaacgggcggtcagagaggtcgattttaccaagaagcgcttacagcaagagttcgaggacaagctggaggtggagcaacagaacaaaagacagcttgagaggcgcctaggggacttgcaggcggacagcgaagaatcccagagagccctgcaacagctgaaaaagaaatgccagcgacttacagccgaacttcaggataccaagctacatttggagggtcagcaggtcaggaatcacgaattagagaaaaaacagcgaaggtttgatagtgagctgtcccaggctcacgaagaggcccagagagagaaattgcaaagggagaaactccagcgcgagaaggacatgctactcgccgaggccttctctctcaaacaacagctggaggagaaggacatggatattgcgggcttcacacaaaaggtcgtctcccttgaagccgagttacaggatatttcttctcaagagtcgaaagacgaggcatcactcgccaaggtgaaaaagcaactacgcgatctggaggccaaagtaaaggaccaggaggaagaactcgacgagcaggccgggactattcagatgctggagcagctcaagcagatggaggtacagctagaggaggaatacgaggacaaacagaaagtcttacgggagaagcgagagctggaggggaagctggcgaccctgagtgatcaggttaaccggcgggacttcgagagcgagaaaagacttcggaaagatttgaagagaactaaggcactcctcgccgacgcacagctcatgttggaccacttgaaaaattctgcgcccagcaagagggagatagctcagcttaagaatcaactcgaggagtctgagtttacatgtgcagcggctgtcaaagcaagaaaggcaatggaagtggagatcgaagatctgcacctacagatcgacgacatcgctaaagcaaagaccgcgcttgaagaacagttgagtcgcctgcaaagggagaagaacgagattcagaaccgcttggaagaagatcaggaagatatgaatgaactgatgaaaaaacacaaggcagctgtggctcaggccagtcgggatctagcccagatcaacgaccttcaagctcagctcgaggaagcaaacaaggaaaaacaggaattacaggaaaagttgcaagcactccagagtcaggtcgagtttctggaacagagcatggtggacaagtctttagttagcagacaggaggccaagatacgcgaattggagactcgcctcgagtttgaaaggacacaggtgaagcgcctggagtcactggctagtagactgaaggagaatatggaaaagctcactgaggagcgagaccagagaatcgcagcggaaaatcgagagaaagaacagaataagaggcttcagagacagctcagagatacgaaagaggagatgggggaattggccaggaaggaggcggaggccagtcgcaagaaacatgaactggaaatggatctggagagcctagaggccgccaatcagagcctccaagcagatttgaaactggcattcaagaggattggagacttgcaggcagccattgaagacgaaatggaaagcgacgagaatgaggatctgattaattcagagggcgatagcgacgttgattctgagttagaggatagggtggatggcgtgaagtcttggttaagcaaaaacaaggggccttcaaaagcagccagcgatgatggtagtctaaagagcagtagccccacaagctactggaaatcactggccccggacagatcagatgacgagcatgaccctctggacaacacgagtcggccacggtattcccactcttatctgtccgacagcgataccgaggcaaaactgacggaaacaaatgcctag

SEQ ID NO: 196278 - DNA, 4929 bp, Artificial Sequence
  Description of Artificial Sequence: Synthetic coding sequence
atggagggcccccggaccaccaagctggagggcagcagcaaggagggctccggtccctcacgatcaccccagcctccgacttcgcctatccctcccgaaacgtcccagcgggcaagatcacctgctccaaccttggctatgaacggacccggcgccgctaccgcagaagggttatccgaggaagcgccagcggtttattccgaaaaagtgatgcacatgttcaaaggatgtcgcagggaagatatggccccccatatctacgctgttgctcagactgcttatagggcgatgcttatgtctcggcaggatcagagcattatcctgttggggtcctcaggctcagggaagaccaccagctgccaacatctggtgcagtatctcgcaaccattgctggaatctccggcaataaagtcttttctgtggaaaagtggcaggcattgtacacactcctggaagcattcggtaattcacctactataatcaatggcaacgctacgagattttcgcagatcctctctcttgactttgatcaggctgggcaagtcgcgagcgcaagcattcagacaatgctcctagaaaaactgcgcgttgccaggagaccagcaagtgaggctacctttaacgttttctattatctgctggcctgtggtgacggcaccctcagaaccgagctacatctgaaccacctggctgagaacaacgtgttcggaatcgttcctctggccaaaccagaggaaaagcagaaagcagcccagcaattctcaaagctgcaagctgcaatgaaagttctcggcatcagccctgatgagcagaaggcttgttggtttattctggctgccatttaccatctgggtgccgcaggcgcaacaaaagaggccgccgaggctgggaggaagcagttcgcccggcacgaatgggcacagaaggcagcgtatcttctgggctgtagcttggaagaactgtcttcagccattttcaagcaccaacacaagggcgggaccttgcagcggtccaccagtttcagacagggccccgaagagtcaggacttggcgatggcaccggacccaaactgtccgctctggagtgtctggaaggtatggccgcagggttatatagcgaacttttcactctgttagtgtccttggtaaatcgtgccctcaagagctcacagcactcactttgcagcatgatgatcgttgacacacctggatttcaaaaccccgagcagggtggatcagccagaggcgcttctttcgaagagctttgccacaactatacgcaagatagattgcaacggctcttccacgagagaacattcgtacaggagctcgagagatataaagaggagaatatcgaactggccttcgacgacctcgagccccccacagatgattctgttgccgctgttgatcaggcaagtcatcagtcactggtgaggagcctggccagaaccgatgaagcacggggtctactttggctgctcgaagaagaggccctcgtccccggcgcttcggaagacaccttattggagcggctgttctcctactacgggcctcaggagggagacaaaaaaggccagagccccctgctgcactcttcaaagccacatcattttctgctgggccattctcacggcaccaactgggtcgagtacaatgttacagggtggctaaactacaccaagcaaaatccggctacacagaatgccccaaggctgttacaggatagccagaagaaaatcattagcaatctcttcttaggcagagcaggatccgcgaccgtgctgtctggaagtatcgctggtctggagggcggaagccagctcgcattaagacgggccactagtatgaggaaaacctttaccacaggcatggccgctgtcaaaaagaagtcactgtgcatccagatgaaactgcaggtggatgctctaattgacaccatcaagaaatctaagctccacttcgttcactgcttcctgcccgtcgccgaaggctgggcaggcgagccacgatccgcatcttctagacgcgtgtcctctagtagcgagctggaccttccttcaggcgaccactgtgaggctggccttctccagctcgatgtaccccttctacgcacccagctgcgtgggagcagactgctggacgctatgcgcatgtaccgccagggctatcctgaccacatggtgttcagtgaattcagacgccgtttcgacgtgcttgccccccacttgaccaagaagcacggcagaaattacattgtagttgatgagcgccgggccgtagaagagttgctcgaatgccttgatctcgagaaaagcagctgctgcatgggtctgtctagagttttctttagagccggcacgcttgccagattggaagagcagcgggatgaacagacctcccgcaatctcacgctgttccaggcggcttgcagggggtacctggccagacagcatttcaagaagaggaaaattcaggatctagctatcaggtgtgttcagaagaatatcaaaaagaataaaggtgtgaaagattggccctggtggaaattgttcaccacagtgagacccttaattgaggtgcagttatctgaggaacaaatccgtaacaaggatgaagaaatccaacagctgagatctaaactcgagaaggccgagaaggaacggaacgagctgcggttgaacagcgatagactcgagtcacgaatttctgagctgacgagcgagctgactgatgagcgcaacaccggggagtccgcctcccagcttttagatgcagaaactgccgagcgactccgcgccgagaaggagatgaaggagttacaaacccagtacgacgccctcaaaaagcagatggaagtcatggagatggaagttatggaggcaaggctgatccgcgctgcagagataaacggcgaggtggacgatgacgacgctgggggggagtggcgcctgaagtacgagagagctgtgagggaggtcgatttcactaagaagcggctgcagcaagagtttgaggataaactggaggtggagcagcagaataagagacagctagaacggcggcttggagacttacaggcagattcagaagaatcacagagagctctccagcagctgaagaaaaagtgccagcggctaacggccgaactgcaggatactaagttgcatctggagggccagcaggttaggaatcatgagctggagaagaagcagagaagattcgattcagaactctctcaggcacatgaggaagctcagagagaaaagttgcagcgagaaaagcttcagagagagaaagatatgcttctagctgaggcattcagtctgaaacagcaactggaggaaaaggacatggatatcgccggattcacgcagaaggttgttagtctagaagctgaactacaggatatctcctcccaggagtcgaaggatgaggccagcctggctaaagttaaaaagcagctgcgagatcttgaggccaaggttaaagatcaggaagaggaactcgatgaacaggccaagcttaggcttgaaatggaaatggagaggatgcgacagacgcacagcaaggagatggagtctcgagacgaagaggtggaagaagcccggcagagctgccagaaaaaactgaaacagatggaggtacagctggaagaagagtacgaggacaagcaaaaggtactgcgagaaaagagggaactggaaggtaagctggctaccctaagcgatcaggtgaatagaagagactttgaatccgagaagcgactgcggaaggatctgaaaaggacaaaggccctcctggccgacgcgcagctaatgttagaccatcttaagaacagcgctccaagtaaacgcgaaattgcccaattaaagaatcagctggaggaatccgagttcacgtgtgcggccgcggtgaaggcacgaaaagcaatggaggtggagattgaggatctgcatcttcaaattgacgatattgcaaaagcaaaaactgctttggaagagcagttaagcagactgcagagggagaaaaacgaaatccagaacagactggaggaggaccaggaagacatgaacgaactcatgaagaagcacaaagctgccgtcgcacaggctagcagagacctggcacagattaatgacctgcaggcccagctcgaagaggcaaataaggaaaagcaggaactgcaggagaagctgcaggcgctccagagccaggtggaattcttggagcagagcatggttgacaagtcactggtgtcccggcaggaagctaagattcgtgagttggagactcgtctggaattcgaacgcacacaggttaagagactggaatcgcttgcatcacgcctaaaagaaaacatggaaaagttaaccgaagaacgggatcaaagaatagccgcggagaatcgagagaaggaacagaacaaacgtctgcaaaggcagcttcgagacacaaaagaagagatgggagagcttgcaagaaaggaggctgaagcttcacgcaagaaacatgagctggaaatggacctcgagagcttagaagctgccaatcagtccctccaggccgatttaaagctggcgttcaaacggattggtgatctccaggccgctattgaagatgaaatggaatctgacgagaacgaggatctgatcaactctgagggtgacagcgacgttgattctgaactcgaggatcgggtcgatggagtgaagagttggctgagcaaaaacaaaggtccctcaaaggccgccagcgatgacggatcccttaagtctagcagtcctacatcatactggaagtctctggctcccgataggtccgatgacgagcatgacccactagacaacaccagtagaccccgttactctcatagctacctatcagatagcgacacggaagccaaacttacagagacaaacgcatag

SEQ ID NO: 196279 - DNA, 6165 bp, Artificial Sequence
  Description of Artificial Sequence: Synthetic coding sequence
atgttcaacctgatgaagaaggacaaggacaaggacggcggccggaaggaaaagaaggaaaagaaagaaaaaaaagaaaggatgtctgccgctgagctgaggtcactggaagaaatgagcttgcgtcggggattctttaacctgaaccggtcttccaaacgcgagtccaaaacacgcttggaaatttctaatccaattccaattaaagtcgcttctgggagtgatcttcatcttactgatattgatagcgactctaaccgaggctctgttatcctggatagcggccacttgagcaccgcgtcctctagcgatgatcttaaaggtgaagaaggatcctttcgaggatcagtgctgcaacgtgccgccaagttcggttcgttagcgaagcagaactctcagatgattgtgaaacggttctccttttctcagcgttctagggacgaatcagccagcgagacaagcacgccctcagagcacagtgctgctccaagccctcaggtagaggtgagaaccttggaggggcagcttgttcaacaccccggacctggaataccgcgccctggccaccggagcagggctcccgagctagtaaccaagaaattccccgtagatttgcggctgccgccagttgtgcccctgcccccccccacacttagggagctcgaacttcagcgcaggccaacaggggactttggatttagcctacggcggactaccatgctggatcgcggccctgaagggcaagcttgccgccgggtggtgcatttcgccgagcccggagccggtactaaagacctggcactaggcctcgttcccggggatcgtctggttgagatcaacgggcacaacgtggagtctaagagcagagatgagattgttgagatgatccgccaaagcggagacagtgtgcgtctcaaggtacagcctattcctgagctgtccgaactgagcagatcctggctacgttcaggagaagggcccaggcgtgagcctagcgatgcgaagaccgaagagcagatcgccgccgaggaggcttggaacgaaaccgaaaaggtgtggcttgtgcacagagacggcttttcacttgctagtcagcttaagtctgaggagctgaatttgccggagggaaaggttagagtcaagctcgaccatgacggagccattttagacgttgacgaagatgatgtggagaaagctaacgccccctcctgtgatcgcctggaggacttagcctcgttagtgtaccttaacgagtcttccgtgctccatacacttcgtcagcgctacggtgctagcttgctgcatacatatgctgggccctccctgctggtcctcggcccacggggagccccagcagtgtacagcgagaaggtgatgcacatgttcaagggatgccgtagggaagatatggccccacatatttatgctgtggcacagactgcctacagagccatgctcatgtccagacaggatcagtctataatcctgttaggttccagtggctcaggtaagaccaccagttgccaacatcttgtacaatacttagccaccatagccggcattagcggaaataaggtcttttctgttgagaaatggcaggcgctgtacaccctgctcgaggcgttcggtaactctccaaccattatcaatggaaacgctacacgctttagccagatcctctctttagatttcgaccaggcaggtcaggtagcgtccgcctctatccagacaatgctgctggagaagttgcgagtggcacggcggcctgccagcgaagccacctttaatgtcttctattatctgctggcatgcggagatggaacacttagaaccgaactgcaccttaaccaccttgccgagaacaatgtgttcgggattgtgcctctagcaaaacccgaggagaaacaaaaggccgctcagcaattttctaagctgcaggccgccatgaaggtactgggaattagtccagatgagcaaaaggcctgctggtttattctggccgctatctatcacttgggtgctgcaggggcgacaaaggaggccgctgaagccggccgcaaacagttcgctagacatgaatgggctcagaaagctgcctacctgctgggctgtagcctcgaggagctcagttctgccatcttcaagcaccagcacaagggtgggaccctacagaggagcacatcctttagacaagggccagaggagtcaggcctcggggacggaaccgggccaaagctctccgcactcgaatgcctggaggggatggccgcaggtttgtacagcgagttgttcaccctgcttgtttccctggttaatcgggctctaaagtcttcccagcacagcctgtgttcaatgatgatagtggacacccctggttttcagaacccagaacaaggcggctcggctcggggcgcctcttttgaagagctgtgccacaattacacccaagatcgtctgcagaggctttttcacgagcggacgtttgtgcaagagcttgaacgctacaaggaggaaaacattgagctggcctttgatgatcttgaaccgcccactgatgactccgtggccgccgtagaccaagcttcccatcagagcctagtgcgttctctggccagaaccgatgaggctcgcggcctgctttggctcctggaagaggaagcgctcgtacccggagcctcagaggacaccctgttggaacgcctattttcgtattacggtccccaggaaggggataagaagggccaaagtcccctgttacatagctctaaaccccaccacttcctgctgggccactcacatgggacaaactgggtcgagtataatgtgacagggtggctgaactacaccaagcagaaccccgctactcaaaatgctcccaggctactgcaggactcacagaaaaaaattattagcaatctcttccttgggcgcgcaggatcagccacagtcctcagcggcagcatcgcaggacttgagggcggaagccagttggctctgcggagggcaacgagcatgaggaaaacctttacaaccggcatggcggcagtaaagaaaaagtcactctgcattcagatgaagctgcaagtcgatgccctgattgacactatcaagaagagcaagttgcattttgtacattgttttttgcccgtggcagagggatgggctggggaaccgaggtcagcttcctcccggcgggttagctcttccagtgagctagacctgcctagtggagaccattgtgaggccggcctcttacagctggatgtccctctgctaaggactcaactcaggggaagtcgacttctagatgcgatgcggatgtacagacaaggttatccagaccacatggtgttttcagagtttagaagaagattcgatgttctggctccacacctgaccaaaaagcacggacggaactacatcgtcgttgacgagcgcagggctgttgaggaactgctggagtgcctggacctggagaaatccagttgctgtatggggctctccagggtgttcttccgggctggaacattggcccgactggaggagcagagagacgaacagacttcaaggaatttgaccctttttcaggctgcatgtcgggggtacctggccaggcagcattttaagaagagaaagattcaagatcttgctatccgctgtgtccaaaagaatattaaaaaaaacaaaggcgtcaaggattggccctggtggaaactctttactacagtacggccactgattgaagttcagttaagtgaggagcaaatccgcaacaaggatgaggaaatccagcagctacggtccaaactcgaaaaggctgaaaaggaacgaaacgaactgcgccttaattctgaccggctggaatccaggatctcagagctgacctcagaacttaccgacgagcgtaacacaggagagtctgcaagccagctgctggatgctgagaccgcagagaggttgcgcgccgagaaagaaatgaaagagctgcagacacagtacgacgcactgaagaagcagatggaggtgatggagatggaagtgatggaggccagactaatccgtgccgcagaaataaacggggaggttgatgacgacgacgcaggaggcgagtggaggctaaagtacgaacgcgcggttcgagaggtagattttaccaaaaagcggctgcagcaagaattcgaagacaaattagaggtcgagcaacagaataagaggcaactggagaggaggctgggtgatctgcaggccgatagtgaggagtcacaacgagctttgcagcaattgaaaaaaaagtgccaacgcctgacagccgaactccaggatactaagctccatctcgaaggtcaacaggtcaggaaccacgaactcgagaaaaagcagaggaggttcgattccgaactgagtcaggcgcacgaagaggcccagcgagagaaactgcagagagagaagctccagcgcgaaaaagacatgttgttggcagaggctttttcgcttaagcagcagttggaagagaaggatatggatatcgccggcttcacacaaaaggttgtctcgctcgaggccgaactgcaggatatttcatcacaggagagcaaagacgaggcttctcttgcgaaggtgaagaaacaactcagggacctggaggctaaggtgaaagaccaagaggaggagctcgatgaacaggccggaacaatccaaatgctcgagcaggcaaaacttcggctggagatggaaatggagcgaatgcggcaaacgcacagtaaagagatggagagccgtgacgaggaagtggaggaggcaagacaaagttgtcagaagaaactcaaacagatggaggttcagctcgaggaggagtacgaggacaaacagaaggtgctcagagagaagagagaactagaaggcaagcttgctacgctgagtgatcaggtgaatcgccgagatttcgaatcagagaaacggctgcggaaagacctgaaaagaacaaaagctctcctcgccgacgcacagctgatgctggatcacttgaagaatagtgccccaagcaaacgagaaatcgcccagttaaagaatcagctggaagaaagcgaatttacgtgtgccgccgccgtgaaagccaggaaagcaatggaggtggaaatcgaggatctgcatttgcagattgacgacatcgcaaaggcaaaaacagctttggaggagcaactctctaggctacagcgtgagaagaacgagatacagaacagactggaagaagatcaggaggatatgaacgaactgatgaaaaagcataaggccgctgtcgcccaggcttcccgggatctggcgcagataaacgatttgcaggcccagctggaggaggccaacaaggaaaaacaggagcttcaggagaagctacaggccctgcagtcccaggtcgagttcctagaacagagtatggtcgataaatctctagtgagtagacaagaggccaagatccgggaattggaaactagactagagttcgagcgcacacaagtgaaacggctggagtcactggcttcaaggctgaaggagaatatggagaaactgacagaggagagggatcagagaatcgcagctgagaaccgcgaaaaggagcagaataaacggctccagaggcagctgcgcgacacgaaggaggaaatgggcgagttggctaggaaagaagcggaggccagcagaaaaaagcatgagttggagatggacctagagagcctggaagccgcaaaccagagtctgcaggccgatctcaagcttgctttcaaaaggatcggcgacctgcaggccgcaattgaggatgagatggagagtgatgaaaacgaggacttgataaatagcctgcaggacatggtgactaaatatcagaagcggaaaaacaagctagaaggggattccgacgtggactcagaacttgaggatcgcgtggacggtgttaagtcctggctcagcaaaaacaaagggccatctaaagccgccagcgacgacggctcccttaagtcgtcatcccctactagctactggaaatcgttggcaccagacaggagtgatgacgagcacgacccgctggacaatacctcccgtccacgatactcacacagttacctctccgacagcgatactgaggcaaagctcacagaaaccaatgcctag

SEQ ID NO: 196280 - DNA, 2808 bp, Artificial Sequence
  Description of Artificial Sequence: Synthetic coding sequence
atgcggatgtaccggcagggctaccccgaccacatggtgttcagcgagtttcggcgaaggttcgatgtcctggccccccaccttacaaaaaagcacggccgaaattacattgtagtcgacgagcgaagggctgttgaggagttgctcgaatgccttgatctggagaaatcctcttgctgcatgggcttgtccagagttttttttcgggccggaacgctggcacgactggaggaacagagagacgaacagacctccagaaacctaaccttgttccaggcagcatgtagaggttatctggcacgacaacattttaagaagaggaagattcaggatcttgccatccgatgcgtgcagaagaacatcaagaaaaataaaggcgtaaaagattggccctggtggaagctgttcacaactgtgaggccattgattgaggttcagctgtccgaggagcaaatccgtaataaggatgaagagatacagcaactgaggtctaaattagaaaaggctgaaaaagagaggaatgagttgcgactcaatagtgacaggctggagagcagaatttctgagctaactagcgaattgaccgacgagaggaacaccggcgagtctgccagccagttgctagacgccgaaactgccgagcgtctcagagcggagaaggagatgaaagaactccagacccagtacgatgccctgaaaaagcagatggaagtcatggagatggaagtgatggaagcacgattaattcgtgccgctgagattaacggggaggtcgatgacgacgacgcaggaggggaatggcggcttaagtatgagagggctgtgcgagaagtggacttcaccaaaaagcggctacagcaagagttcgaagataagctcgaagttgagcaacaaaacaaacggcagcttgaacggcgactgggggacctccaggccgactctgaagagtcccaaagggctttacagcaactgaagaagaaatgtcagcgacttaccgccgagttgcaagacaccaaactgcatctggaggggcaacaagtccgcaatcacgagctggagaaaaaacagaggcgcttcgactcagagctgtctcaggcccatgaggaagcccagcgtgagaaactgcaacgggagaaactgcagagagaaaaggatatgctgctcgccgaagccttcagtttgaaacaacagctcgaggaaaaagatatggacattgcaggtttcacacagaaggtcgtgagcttggaggcggagctgcaggatattagttcccaggagtcaaaggatgaagccagcctggctaaggtcaagaagcaactgcgcgacttggaggcaaaagtcaaagatcaggaagaggagctggacgaacaggccggaaccattcaaatgcttgaacaggcaaagctccgactggagatggagatggagcgtatgagacagacccattctaaggaaatggagtctcgggacgaggaggtcgaagaggctcggcagtcctgtcagaagaaactgaaacaaatggaggtgcagctcgaagaagaatatgaggacaaacagaaggttttgagagaaaaacgcgagctggaggggaagctggctactctgtccgatcaggtgaaccgccgggacttcgagtcagagaaacgcttaagaaaggacctcaagcgcaccaaggctttgctggctgatgctcagctgatgctggatcatctcaagaactccgccccctccaaacgggagattgcccagcttaagaatcagctggaggagtccgagttcacatgcgccgctgccgtgaaggcaagaaaggcaatggaggtggagatcgaagatcttcacctccagatcgacgatatagccaaagcaaaaaccgctctggaggagcaactgagccgactgcaacgcgaaaaaaatgaaatccagaatcgcctggaggaagatcaagaagacatgaacgaactcatgaaaaagcataaagccgccgtcgcgcaggcgagcagggacttagcccaaattaatgacctgcaggcgcagctcgaagaggctaataaggagaaacaggagttgcaagagaagctacaggcccttcagtcacaggttgagtttctggaacagtcaatggtggataagtcccttgtgtctcgacaagaggctaaaatcagggagctcgagacgagactggagtttgagcgaacgcaggttaagcgtttggagtctctggcctcacggctaaaggagaatatggagaagctgactgaggagcgcgatcaaaggatagctgccgagaaccgggagaaggagcagaacaagaggttgcagagacagctcagggacaccaaggaagagatgggagagctggcacgcaaggaggcagaggcctcacgtaaaaagcacgagctggagatggatcttgagagcctggaggctgctaaccagtccctccaggccgacctgaaactggcctttaaacggatcggggacctgcaggccgccattgaagacgagatggaatctgatgaaaatgaagacctgatcaacagcgaaggagactccgatgtggattctgaactcgaagatagggtggatggtgtgaagtcatggctgtccaaaaacaaaggtccctccaaggctgctagcgacgacggcagcctgaaatctagttcccctacatcgtactggaagagtcttgcccctgatcgctcagacgatgagcatgatcccctcgacaacacttctagacctcgctatagccactcttatctgtctgactccgacacagaggcaaaattaacagagaccaacgcatag

SEQ ID NO: 196281 - DNA, 6120 bp, Artificial Sequence
  Description of Artificial Sequence: Synthetic coding sequence
atgttcaacctgatgaagaaggacaaggacaaggacggcggccggaaggaaaaaaaagaaaagaaggaaaagaaggagcggatgagtgcggccgaactgaggtccctggaagagatgagcttgagacggggtttcttcaatctgaataggagttccaagagggagagcaaaactcggctggagatctccaatcctatccccataaaagtggcctccggctcagatctgcacttaacagatatcgacagcgattccaatcgaggctcagtaattctggacagtggccatctgagcacagcttcttccagcgatgatctgaaaggggaggagggctctttccgggggagcgtgctgcagcgcgccgcgaagttcgggagcttggccaagcagaacagtcagatgatagttaagcgcttcagctttagccagagatctcgcgatgaatcagctagcgagaccagcaccccttctgagcacagcgctgcaccttctccacaggtggaagtccgcactctggagggacagctcgtccagcaccccggaccaggcatccccagaccaggccaccgctcaagagccccagaattggttactaagaaattccctgtggatctgcgcttgccacccgtggtccctcttcctcctccaacgctccgggagctggagctacaacgacgccctaccggcgacttcggtttctcgttgagacgaactactatgctggaccggggaccagagggacaggcctgccggcgagtcgtccatttcgccgagccgggagccggcactaaagatttagcgctgggcttggtccctggagatagattggtagagattaatgggcacaatgttgagtccaaaagccgggatgaaatcgttgagatgatacgccagagcggcgactcagttcgcctgaaagtccaacctatccctgagctttcagaactgagcagatcctggctgaggagcggcgagggtccgaggcgtgagcccagtgatgcaaaaaccgaggaacagattgccgcagaggaggcatggaatgagacagagaaagtgtggctggtgcacagggacggatttagcttggcttcccagctgaaaagcgaggagctgaatctgcctgaggggaaggtgagggtgaaactggaccatgatggagccattctggatgtcgatgaggatgacgtggaaaaagccaacgcaccgtcttgtgatcgacttgaagatctcgcttctctggtttacctgaacgaatcctcagttcttcacactctgcgccagcggtacggcgcgtctctgctgcacacctacgcgggaccttccctccttgtgttagggccccggggcgcacccgccgtgtactctgaaaaagttatgcacatgttcaaaggatgtcgacgggaggacatggccccacacatatatgcagtagcccagacggcttatcgcgctatgctgatgtccaggcaggatcaatctattatccttctggggtcatctgggtctggtaagacaacttcctgccaacaccttgtccaataccttgcaaccatcgccggtatttctgggaacaaggtgttttcagtcgagaagtggcaggcactctataccctcctggaagccttcgggaacagtcccaccatcatcaacggcaatgccactcggtttagccagatcttgagtctcgatttcgatcaagctgggcaggtggcatccgcttcgatccaaaccatgctgttagaaaaactgcgcgtggcaagacggcccgcaagtgaggccacattcaatgtcttttattatttgctggcttgtggggacggcacactgcgcaccgaactgcacctgaaccatttggcagagaacaacgtatttggaatagtgcccctggctaaacccgaggagaagcaaaaagcagcccaacagttcagtaagctgcaagccgccatgaaagtgctgggcatttctcccgatgagcagaaagcctgttggttcattctggctgcaatttaccatctcggagctgccggtgccacgaaagaagcggcagaagcagggagaaaacagttcgcccgccacgagtgggcgcagaaggccgcgtatttgctggggtgctccctggaggagctctcttccgccattttcaagcaccagcacaagggaggaactctacagcgctccacaagcttcagacagggcccagaagagagcggacttggagacggaaccggacccaaacttagcgccctggagtgcctcgagggcatggcagctggtttgtacagcgaactgtttactctcctggtctcgctcgtgaatcgagcccttaaaagctcgcaacacagcctttgctctatgatgatcgtggacactcccggcttccagaacccagaacaaggcgggtccgcacgcggagcatccttcgaagaactgtgtcataactacacacaggatcggctacaacggcttttccacgagcggactttcgtgcaggaactcgaacggtataaagaggagaacattgagctggcattcgacgatctagaaccacctacagatgactccgtggcagcggtggatcaggcaagtcaccagtccctggtgaggtccctggctaggaccgacgaggccagggggctactgtggctgctagaggaagaagcattggtgccaggagctagcgaagacactctgctggaaaggctcttcagctactacggcccccaagaaggggataagaagggccaaagtccactgctgcactcctccaaacctcatcatttcctcctcggccattcccacggcacaaattgggtggaatataatgtcacaggatggctcaactacacaaagcagaaccccgccactcagaacgccccacgcttgcttcaggatagccagaagaaaatcatttctaacctcttcctgggacgagccggttccgccaccgtgctgagtggttccatcgcaggattagagggcggatcgcagcttgctctgcggagggctacttcaatgaggaaaacatttactacaggcatggccgccgtgaaaaaaaagtcgctgtgtatccagatgaagctgcaggtggatgccctaatcgacacaatcaagaagagcaagctgcattttgtgcactgcttcctccccgtggccgagggttgggccggggaacctagaagcgcgagtagccgcagggtgagttcaagtagcgaactcgacctcccttccggggatcattgcgaagccggcctcctacagctggatgtgcccttactccgcacgcagctgcgtggcagccgactgctggacgctatgcgtatgtaccgccagggctatcccgaccacatggtcttcagcgaatttagaaggaggttcgatgtcctcgctccccatcttactaagaagcacggacgcaactacatagtggttgacgagcgcagagccgtggaggaactgctggaatgcctggaccttgagaagtcttcatgttgcatgggcttatcaagggtcttctttcgggctggtacactcgcacggctggaagagcagagggacgagcagacctccaggaacttaactctgtttcaggccgcttgtcgcggatacctcgcccgacagcacttcaagaagcggaagattcaggacctcgcgatccggtgcgtccagaaaaacattaagaaaaacaaaggcgttaaggactggccatggtggaaattgtttactacagtgagaccactgattgaagtgcagctgtctgaggaacagatcagaaataaagacgaagagattcagcagctgagaagtaaacttgaaaaggcggaaaaagagaggaatgagctacggctaaattccgaccggttggagagcaggatatcagaactcaccagcgagctgactgatgagcgaaacaccggggaatcagcttcccagctgctggatgctgagacggcggagagacttagagctgaaaaggagatgaaggagctacagacacaatacgatgcactgaaaaagcagatggaagtcatggaaatggaggtgatggaggcacggctgattagagcagctgagattaacggagaagttgacgatgacgacgcagggggcgagtggcggctcaagtacgagcgagcagtgagggaggtggattttacaaagaaaaggttacagcaggagtttgaggataagctggaggtggaacaacagaacaaaaggcaactggaaaggcggcttggggacctgcaggccgattcagaagagagccagcgggctctacaacaactgaagaaaaagtgccagaggcttaccgcggagctgcaagacacaaagctccacctggaagggcagcaggtgagaaatcatgagcttgagaagaagcagcgccggtttgattctgaactgagtcaggcccatgaagaggcccagagggaaaagctgcagagagagaagctgcagcgggagaaagatatgctgctcgccgaggctttctccctgaagcagcagctggaggaaaaagacatggatatcgccggatttactcaaaaggttgtgtccctcgaagccgagcttcaggacattagttcccaggaatcaaaagatgaggcgagcttggccaaggtcaagaagcagttgcgggacttagaagcaaaggtcaaggaccaggaggaagagctcgatgaacaggccggcaccatccagatgctggaacaagcgaaactgcgccttgaaatggaaatggagagaatgcggcagacacactctaaagagatggaatctcgtgacgaggaggttgaggaagcccggcagtcttgccagaaaaagctgaaacagatggaagtgcagttggaagaggagtacgaggataagcagaaagtgcttcgggaaaagagagagctggaaggcaagcttgccactcttagcgatcaggtgaatagaagagactttgagtctgagaagaggttacggaaagacctcaagcgtacaaaagctttgctggcagacgctcagctgatgcttgatcacttgaagaattcggctccgtccaaaagagagattgctcagctcaagaaccaactggaggagtctgagtttacttgcgcagctgccgtcaaggcacgcaaagctatggaggttgagatcgaggacctgcatctgcagatagatgacattgcaaaggcaaaaaccgcacttgaagagcagcttagcagattgcagcgcgaaaagaatgaaatacaaaaccgcttggaagaggatcaggaggacatgaatgagctcatgaaaaagcacaaggctgcagttgcccaggcttcccgcgatctggcccagatcaacgacttgcaggcccagctcgaggaggccaataaggaaaaacaagagctccaggagaagctacaggctttacagtcacaggtcgagtttttggaacagtcaatggtcgataagagtctggtatctaggcaggaagccaagatacgtgagcttgaaactagactggagttcgaaaggacgcaggtcaaacgtctggagagtctggcgagcaggctcaaggagaatatggaaaagctcacagaggagcgggatcaaaggattgcggcagagaaccgggaaaaagaacaaaataagcgcctccaacggcagttacgagacactaaagaggagatgggcgagcttgcccggaaagaagcagaagcgtctcgcaaaaagcacgaacttgaaatggacctggaaagcctggaggcagctaaccagtctctccaggctgacttgaagctggcgttcaaacggatcggggacttgcaggccgccatcgaggatgaaatggagtcagacgagaacgaagatctgatcaacagtgagggtgacagcgatgtagattcggagctcgaggaccgggtcgatggggtgaaaagttggctctctaaaaacaaaggcccctcaaaagccgccagcgacgacgggtccttgaagagcagttcccctacctcttactggaagtctctggcccctgatcggagtgacgatgaacacgatccactggataacactagtcgcccccggtattcccactcatacctcagtgattcagataccgaagccaagctcacggaaacaaacgcttag

SEQ ID NO: 196282 - DNA, 6009 bp, Artificial Sequence
  Description of Artificial Sequence: Synthetic coding sequence
atgttcaacctgatgaagaaggacaaggacaaggacggcggccggaaggaaaaaaaggaaaaaaaagaaaaaaaagagcggatgtctgccgccgagttacgtagccttgaggaaatgtcacttagaagaggatttttcaatctcaacagatccagcaaaagggagtcaaagacacgcttagaaatcagtaaccccataccaatcaaggttgcatcaggctccgatcttcacttaaccgacatcgactctgattctaatcgaggttccgtgatcctcgactccggccatttgagtaccgcctcctcgtccgacgatctaaaaggcgaggaggggagcttcagaggatccgtcctgcagcgcgcagccaagttcggatccttagccaagcagaattcccagatgatcgttaaacgcttttccttctcgcagcggagccgcgacgagagtgcctctgagacctccactccctctgagcattcagcagcgccttctccgcaagtagaagtgcgaaccctagaaggacagctggtgcaacacccgggccccggaatccctcgcccgggccacagatctcgtgcgcccgagcttgtgactaagaagtttccggtggacctgcgccttcctccagtcgtaccgcttccacccccaaccctgcgagaactcgaacttcagcgcagacccacgggggattttggcttttcactgagacggacaaccatgcttgaccgtggccctgaagggcaggcgtgtagacgtgtagttcactttgcggagcctggagccggcactaaggatctggcactggggctcgtgcctggggacagattagtcgaaataaatgggcataatgttgagagtaagagcagagatgagatcgtggaaatgatccggcagtccggagacagcgtgcggttaaaggttcagcccattccagagctttctgaactatcccgctcttggcttaggtccggggagggccccaggcgcgagccctccgacgctaaaaccgaagagcaaatcgcggcggaggaagcttggaacgaaaccgagaaggtctggcttgtgcatcgagatggcttcagcctggcctcccagctgaagtccgaggaacttaacctccctgagggaaaagtgagagtgaagctggaccacgatggtgcaatcctggacgtggacgaagatgacgttgagaaagcaaatgctcccagttgtgatcggctggaggacctcgcatctctggtatacctcaatgagtccagtgttctgcataccctgaggcaaaggtacggagccagcttgttgcatacatacgctggcccatccctgcttgtgctcggccctcgcggagcacctgccgtctactccgagaaggtgatgcatatgtttaagggctgtcggagggaagacatggctccacacatatatgcagttgcccagactgcttatagggccatgctgatgagtagacaggatcagtcaataatcctcctcggatcatctggctctgggaagacaacttcatgtcaacacctggtgcagtatttggccactattgctggtatttcaggtaataaagtgttttcagtcgagaagtggcaagccctgtacaccttgctggaggcttttgggaactcacccacgatcataaatggcaatgcgacgcgctttagccagatactctcactggactttgaccaggcaggacaggtggcctctgcctccattcagaccatgctccttgaaaagcttagggtagccaggagacctgccagcgaggcaactttcaatgtgttttactatctgctcgcatgcggagacgggacgctgcggacagagttacatctcaaccatctagctgagaacaacgtctttgggatcgtgcctttagcaaagcctgaggagaaacagaaagcagcacagcaattctccaaactccaggcagccatgaaagtcctgggcatttctcccgacgaacagaaagcctgctggttcattctagctgccatctaccatctgggtgctgccggcgcaaccaaagaagctgctgaagcaggccgaaagcagttcgcgaggcacgagtgggcccagaaggccgcctatctgctaggatgttcacttgaggagctctcttctgccatcttcaagcaccagcataagggcgggaccctgcagagaagcacatcctttagacagggaccagaggagagcggcctgggcgatggtactggaccaaagttgagtgccctcgagtgtctggaaggaatggcagccgggttgtattccgagctgttcactttactggtttcgttagtgaatcgagccttaaaaagttcccagcattccctgtgctccatgatgatcgtggatacacccggcttccagaaccccgaacaagggggttctgccaggggagcttccttcgaggagctgtgtcataattacacccaagaccgactccagaggctcttccacgaacgaacatttgtccaggaattagaacgttataaagaagaaaacattgaactggctttcgatgacctggaacccccaaccgacgactctgtggctgctgtcgaccaggcctctcatcagagcctggttcgctctctcgccaggacggacgaggcaagggggctactgtggctgctcgaagaggaggcactcgtgcccggggcgagtgaagacaccttgttggagcggctgtttagttactacgggccccaggagggcgataagaagggccaaagccctttgctccatagttctaaaccgcaccatttcctactcggacactcccatgggactaactgggtggagtacaatgtgacgggatggctgaattataccaagcagaacccggctacgcagaacgctcccaggctgctacaggactcccaaaaaaaaattatctctaacctctttttaggacgcgccggtagcgccactgtgttatcgggtagcatcgcaggcttggaaggaggatctcaattggctctgcggcgggccacatccatgaggaagacttttaccaccggtatggccgcagtgaaaaagaaatctctgtgcattcagatgaagttgcaggtcgatgccctgattgacacgattaaaaagtctaagttgcattttgtgcattgtttcttacccgtggctgagggatgggctggtgaacctcgctcggcctcctccagacgcgtgtcaagctcctccgagttagatcttcccagcggcgatcattgtgaagccgggttacttcagttggatgttcctctgctgcgcacgcagctaaggggaagtcgcctactggacgccatgcggatgtaccgccaaggatacccggatcacatggtgttctccgaattcagacgtcggttcgatgtcctcgccccacatctgaccaagaaacacggccggaactacatagtggtggatgaaaggagagctgtggaagagctcctggagtgccttgatttggagaagagctcctgctgcatgggactctcacgtgtattctttcgggccggcaccctcgcacgactcgaagaacaaagggacgagcagactagccgcaacctgacactgtttcaggccgcatgccgcgggtatctggctagacaacattttaagaagagaaagatacaggatctggctatcagatgcgtccaaaaaaacataaagaagaacaagggcgtcaaagattggccatggtggaagctcttcaccaccgtccgtccattgatcgaagtgcagctcagtgaggagcagattcgcaacaaggatgaggaaattcagcaactcagatctaaacttgaaaaagccgaaaaggagcggaacgagctcaggctcaattctgataggctggagtcgcgaatctcggaacttacaagtgaactcaccgatgaaagaaataccggagagtcagcgtcacagctgctcgacgccgaaaccgcagaaaggctcagggccgaaaaagagatgaaggaattacaaacccagtacgatgctctgaagaaacagatggaagtgatggaaatggaggtcatggaggccagactcatcagggcagctgaaatcaacggtgaggtcgacgatgacgatgcagggggggagtggcgtctaaaatacgagagggctgttagagaggtcgacttcacaaagaagcgactgcagcaggaatttgaggataaactcgaagtcgagcagcaaaacaaacgccagctcgaacggcggctcggcgatctgcaggctgacagcgaggagagccagagggcactccagcagctgaaaaaaaagtgtcaacgcttaacagccgaacttcaggacaccaagttacatctcgagggtcagcaggtacgcaaccatgagctggagaaaaagcaaagacgattcgactcagagctaagccaggcgcacgaagaggcccagagagaaaaacttcagagagagaagttgcagcgcgaaaaggatatgctgctggccgaagccttttcgttgaagcaacagctggaggagaaggacatggacatcgccggcttcacccagaaggttgtgtctctcgaggccgagcttcaagacatatctagtcaggaatccaaggatgaggcttcactggccaaggtgaaaaagcagctgcgcgacctcgaagccaaagtcaaagatcaggaagaggaactggatgaacaggctgggaccatccaaatgctggagcaactaaagcagatggaagtgcagctagaggaggagtatgaggataagcagaaagtgctcagggagaaacgagagctggaaggaaaacttgccacattaagcgaccaggtgaatcggcgggacttcgagtcagaaaagagactgagaaaagacctgaaaagaactaaggcccttctagctgacgctcagctgatgctggatcatctcaaaaacagcgcaccatcaaagcgtgaaatagctcagctgaaaaaccagctggaggagtccgaatttacctgcgctgctgcagtgaaggcccgtaaagccatggaggtggaaattgaggacctgcatctgcagatagatgatatagcaaaagctaagacagccctggaggagcagctgtctaggttgcagcgagagaagaacgaaatccagaacagacttgaggaggatcaggaagacatgaacgagcttatgaagaagcataaagccgcagttgctcaggcatccagggatctggcacaaataaatgacctgcaggctcagctggaagaggcaaacaaggaaaaacaagagctccaggagaagctccaggctctccagtcccaggttgagtttctggagcagagtatggtcgacaaatcactggtgtccaggcaggaggccaagatcagagaacttgaaaccaggcttgagtttgaaagaacacaggtgaagagactggagagcctggcgtcgagactgaaggaaaatatggaaaaactgactgaggagagagaccagaggatcgccgccgagaacagggaaaaagagcagaataagagattacagagacaactgcgggacacaaaagaagagatgggcgaacttgccagaaaggaggccgaagcgtcgcggaagaaacacgagctggagatggacctcgaatctctggaggccgctaaccagtctttgcaggcagacctgaagctcgcgttcaagcgcataggagacttgcaagccgccattgaagacgagatggagtccgatgaaaacgaggatcttatcaactccgagggcgattcagatgttgactcagagctggaggacagagttgacggcgtgaaatcctggctctctaagaacaaaggccctagcaaggccgcaagcgacgatgggagcttgaagtcctcaagtcctaccagttattggaaatctcttgcccctgaccgctcagacgatgagcatgatccattagataatacatctagaccccgatattctcacagctacctcagcgactccgatactgaggccaaactgactgaaactaacgcttag

SEQ ID NO: 196283 - DNA, 2808 bp, Artificial Sequence
  Description of Artificial Sequence: Synthetic coding sequence
atgcggatgtaccggcagggctaccccgaccacatggtgttcagcgagttccggcgcaggtttgatgtgctcgcacctcatctcactaagaagcatggaaggaactatatcgttgtagacgagcggagagctgttgaagagttgttggaatgtctggacctggagaagtcttcatgctgcatggggctcagtcgcgtctttttccgcgctggcacgcttgccaggttggaagaacagagggacgagcagaccagcaggaatctcacgctgtttcaggcagcctgtcgtggatatctcgcacgccagcactttaaaaagcgaaagattcaagacctagccattcggtgcgtgcagaagaacataaaaaagaataagggcgtcaaggattggccttggtggaaactattcacaactgtgagaccactgatagaggtccagttatcagaagagcagatcaggaataaagatgaggagattcagcaactcagatccaaactagaaaaggcagaaaaagagcggaacgaactgagactcaattctgaccggctagaatctcgcatcagcgagctcactagcgaacttaccgacgagcggaataccggggagtctgcaagtcaactgcttgacgccgaaaccgcagagagactgagggcagaaaaagaaatgaaagaattacagactcagtacgacgcattaaaaaaacaaatggaagtgatggagatggaagtcatggaagcccgtttgatacgagccgccgagatcaacggggaggtggacgacgatgatgccgggggtgaatggcgtttgaagtatgaaagagccgtgagggaggtcgattttacaaaaaagcggctccagcaggagtttgaggacaagttggaagtcgagcaacagaacaagcggcaactggagcggcgccttggagatcttcaggccgactccgaggagtcccagcgggccttgcaacagctcaaaaaaaagtgtcagcgcttgacagccgaattgcaggacaccaaattgcatctggaggggcagcaggtgagaaaccacgagctggagaagaaacagcgcaggttcgactctgagctttctcaagctcacgaagaggctcagcgcgaaaagctccagcgagagaagctgcagcgggagaaagacatgcttctggctgaggcttttagcctcaaacagcagctcgaagaaaaggatatggatatagccggatttacgcagaaagtggtgtctctggaggccgagctccaggatatttcaagccaggagagtaaagacgaggcgtcactcgccaaagtgaagaaacagttgcgcgatttagaagcaaaggtcaaagatcaggaagaggagttggacgaacaggcgggcaccatccagatgctagagcaagccaagctgaggctagagatggaaatggaaaggatgaggcaaacacactcaaaggagatggaatccagggacgaagaagtggaagaggcgcgccagtcgtgtcagaaaaaacttaaacagatggaggtgcagctggaggaggagtacgaggacaagcagaaagtgctgagggagaagcgggagctggagggcaaactggccactctgtcagatcaggtgaaccgaagagacttcgagagtgagaaacggctacggaaagatcttaaaagaactaaagccctgcttgcagatgcccagttaatgctcgaccatttgaagaattcagctccctcaaaaagggagatagcccagttgaagaaccaactagaggaaagcgagtttacttgcgccgcagcagtgaaagcaagaaaggccatggaggtggaaatcgaagacctgcatctgcaaatcgacgatattgcaaaggccaaaaccgctctggaggagcagctatctaggctacagcgtgagaagaatgagattcagaatagactggaggaggatcaggaagacatgaacgaattgatgaagaaacacaaagcagctgtcgcacaggcgtccagggacttggcgcagattaacgacctgcaggcccaactcgaggaggcaaataaggaaaaacaagaattgcaggaaaagttacaggcattgcaatcacaggttgaattcctggaacagagcatggtcgataagtccctcgtgtcgagacaggaagctaaaattcgcgagttggagacccgcctcgaattcgagaggacacaggtgaagcgactggaaagcctggcctccaggctgaaggaaaacatggaaaaactgactgaggaaagggaccagcgcatcgccgccgaaaaccgagagaaagaacagaacaagaggcttcagcgccagctgagggatactaaagaagagatgggggaactggccaggaaagaggcagaggcatcaaggaaaaagcacgagcttgagatggatctcgaatctttggaggccgccaatcaaagcctccaggccgacctcaagcttgcatttaaaagaatcggagacctccaggcagcaattgaagatgagatggagtctgatgagaatgaagatctgatcaattcagagggggatagcgacgtggattctgagttggaagaccgggtcgatggcgtcaaatcttggttgagcaaaaacaagggtccctccaaggccgcatccgacgatggttcccttaaaagttcttcccccaccagttactggaaaagtttggcccccgatcgttcagacgatgagcacgacccgcttgacaatacctctcggccgagatactcacacagctatctctccgacagcgataccgaggctaagctcactgagaccaatgcctag

SEQ ID NO: 196284 - DNA, 963 bp, Artificial Sequence
  Description of Artificial Sequence: Synthetic coding sequence
atgaccttcgtgctgctgagcagcagccagctggaggagcagctgtcccgtcttcagagggagaagaacgagatccaaaaccggctggaggaagatcaagaggacatgaatgaactaatgaagaaacataaggccgcagtcgcccaggcctcccgcgatctggcacagatcaacgatcttcaagctcagctcgaagaggccaataaagaaaaacaggaattgcaagagaaattgcaagcactgcagagccaggtggagttcctggagcagtccatggttgataaatcccttgtatctagacaggaggctaaaatacgggaactcgaaactaggctggaatttgagagaactcaggtcaagcgtctggaatcgctggcaagcagactgaaagaaaatatggagaaactgacagaagagagggatcagcggattgcagccgagaatcgtgaaaaggaacaaaacaaaaggctgcagcggcagctgagagatactaaggaagagatgggtgaactcgcacggaaagaggcggaagctagtagaaagaaacacgaactcgagatggacctggaaagtctggaggccgccaaccaaagcctgcaggccgacctgaagctggcttttaagagaattggtgacttacaggcggccatcgaggatgaaatggaatccgatgagaacgaggacctgataaactcagagggagactcggacgtggatagtgagctcgaggaccgagtggacggagttaagagctggctctctaagaataagggaccctctaaagccgcgagtgacgatggttccttgaagtccagttcaccaacctcttattggaagtccctggccccagatcggagtgacgatgaacatgacccgcttgataatacaagcagacctagatattcccattcatatctgtctgactccgacactgaagcaaagctgaccgaaacaaatgcatag

SEQ ID NO: 196285 - DNA, 7704 bp, Artificial Sequence
  Description of Artificial Sequence: Synthetic coding sequence
atggccatcagcagccggctggccctgtgggagcagaagatccgggaggaggataaatcccctcctccctcttcaccgccccctctctttagcgtgattcccggggggttcataaagcagctggtgcgtggcactgaaaaggaagccaaggaggcacggcagaggaagcagttggccgtcgccagcccagaaagagaaatccctgaaatatctatctcccagcctaactctaagtcatcgtcagggacaaggtcagggtcccaacagatatcccaggatgaccagagctccagtcctggctcatcggacatcttagggaaggaatctgaaggcagtcggagtcccgatccagaacagatgacttctatcaatggcgaaaaagcacaggagctcgggtcgagtgctacacccacaaaaaagacagttcctttcaaaaggggcgttcgcagaggggatgttctgctcatggtggccaagctggatcccgacagcgcaaaacctgaaaaaacccaccctcacgatgcccctccctgcaagacatctccccccgctactgacaccggaaaagaaaagaaaggagaaacctctcggacgccctgcggttcccaggcaagtaccgagatcctggctcccaaggctgagaaaacccgcactggaggactgggtgatcctggccagggtacagtggctttaaagaaaggcgaggagggccaatccatcgtgggcaaggggcttggcacccctaagaccaccgaactgaaggaggcggagcctcagggcaaggaccggcagggcacccgccctcaggcccagggccctggagaaggtgtacgccccggcaaggccgagaaggagggcgccgaacccactaatacagtcgaaaagggaaatgtttccaaggacgtgggcagcgagggcaaacatgtgaggcctcagattcctgggagaaaatgggggggctttctagggagacgttccaagtgggacggaccccaaaataaaaaggacaaggagggggttttgctgtccaaggccgagaagaccggagaaccacagacgcaaatggaaaaaacaagtcaagtgcagggggaactgggggatgatttgagaatgggggaaaaggcgggcgaactcaggtctaccaccggtaaggctggagaatcctgggataagaaggagaaaatggggcagccccagggaaagtccggcaatgctggcgaagctcgaagccaaaccgagaaagggtgcgaggcacccaaagaggtctcgacaatggttgagagccctgccgcaccaggaaaaggtggttggccgggaagtagaggccaagaagctgaagagccctgctcacgcgctggggacggcgctggcgctctggagactgagctggagggcccatcccagcctgcgttagagaaggatgccgagagaccacggatccggaaggagaatcaggacggccccgctccccaggaggagggcaagggcggccagtcgcgagactcagatcaggcacctgaggacagatggtatgaggctgaaaaggtgtggctcgctcagaaggacggttttactctggcaacggtgctcaagccggacgaggggacagcagatctccctgcagggcgagtgcgactgtggattgatgccgataaaactataacggaggttgatgaggagcacgtgcaccgagctaacccccctgagctggaccaggtggaggatcttgccagcttgatctcagtgaacgagtcaagcgtcctgaatacgcttctgcagcgctataaagcccagttgctccatacctgcaccgggccagacttgattgtcctgcagccgcggggcccgtcagtcccctccgcagggaaggtgccgaaaggaagacgggatggcctcccggctcacattggaagcatggcccagcgggcttactgggctctccttaaccagagaagggatcaatccatcgttgccctggggtggagtggagcgggcaaaactacgtgttgtgaacaagtgctggaacacctggtaggaatggctggatccgtcgatggcagggtgtctgtcgaaaaaatccgggccacctttacagtgctcagagcctttgggagcgttagcatggcccattcgaggtccgctacaagattctcgatggtaatgtcccttgatttcaatgcaacgggtagaatcactgccgcccagcttcagaccatgctgctggaaaagtctcgtgtagcgcgccaacccgagggggagtccaactttctggtattttctcaaatgctggctgggctggatttggatttgcgaacggagctcaatttgcaccagatggcagactccagctctttcggcatgggcgtttggtctaaaccagaggacaagcagaaagccgccgccgctttcgcccagctgcagggggctatggaaatgttgggaatatctgagtccgagcaaagggccgtgtggcgcgtactggccgccatctaccacctgggtgctgccggagcctgtaaagtgggccggaagcagttcatgcgttttgagtgggctaactacgccgcggaagcgctggggtgcgagtacgaggagctgaatacagccaccttcaagcaccacctccgacaaattatccagcagatgactttcgggcccagccgttggggcctcgaagatgaggaaacctcttccgggctgaagatgaccggggttgattgtgttgagggaatggccagcggactctaccaggagttgtttgcagccgttgtgtccctaattaataggagtttttcttctcatcatcttagtatggccagcatcatggttgtggactctcctggctttcagaatccccggcaccagggcaaagacagggccgcaacctttgaagagttatgccacaattacgctcacgaacggcttcagttactcttctaccagcgcacatttgtgagcacgttgcagcgttatcaggaggaaggagtgcctgtgcagttcgaccttccagatccctcccctgggaccaccgtagccgtcgtggaccaaaacccgtcacaggtgagattaccagccggcggcggtgcacaggatgccaggggactattttgggtccttgacgaagaagtgcatgttgaaggcagtagtgactcagtggttttggaacggctatgcgctgcatttgaaaaaaagggggccggaacagagggatcttccgcgctgcgcacatgtgagcagcccctgcagtgcgaaatctttcatcagttaggctgggatcctgtgcgttacgatttaaccgggtggctgcaccgggccaagccaaatctttcagcattagacgcgcctcaggtgctgcaccaatccaagcgggaagagttacggtctctcttccaggcacgtgcaaagctgcctccggtatgcagagctgtagcaggcctggagggcacttctcagcaggccctgcagagaagcaggatggtgaggcgaacctttgcatctagcctggccgcagtgcgcagaaaagccccttgttcccagatcaagctccagatggacgctttgacaagcatgataaagaggtcacggttgcactttatccactgtctggtcccaaatcccgtggtggagtcccgttctggccaggagtcacccccccccccgcagcccgggagggataagccaggtgctgggggccctctggcactggatatccccgccctcagggttcagctcgctggttttcatattttggaggccctacggctgcaccgcacaggttacgccgatcacatgggcttgacccggtttaggcggcagtttcaagtgttagatgcccccttgctgaagaagctaatgtccacatccgaaggcattgatgaaaggaaagcagtagaggagttattagagaccctggacttggagaagaaggctgtggccgttggtcattcccaggtttttttgaaggccggggtgatctctcgactcgaaaaacaacgggaaaagctcgttagtcagagtattgtgctcttccaggctgcatgcaagggctttctgtcacgccaggaatttaagaaactgaaaatcaggcggttggccgcacaatgtatacagaaaaacgtcgcggtcttcctcgcggtgaaagactggccctggtggcaactgctgggttctttgcaacctcttctctccgccacgataggtaccgagcagttgcgagctaaagaagaggaactcactacacttcgccgcaagctagaaaaatcagaaaaactgcgtaacgagcttagacagaataccgacttattggaatccaaaattgccgatctgacgtctgacctggccgacgagagattcaagggcgatgtagcatgccaggtgctcgagagcgagcgcgcggaacgcctgcaggcattccgtgaagttcaggagctgaagagcaaacacgagcaagtgcagaagaaactgggcgacgtgaataagcagcttgaagaagctcaacaaaaaatccagctgaacgatctggaaaggaatcccacgggcggagccgacgaatggcagatgaggttcgactgtgctcagatggagaatgagtttctgcgcaaaagactgcagcagtgtgaggaaagattagattccgagctcacggcccggaaagagctcgagcagaaactgggtgaactacagagcgcgtatgatggtgctaaaaaaatggcgcaccaattaaaacgcaagtgccatcacttaacctgcgatttagaagacacctgcgttttgctggaaaaccaacaatccagaaaccatgagctggagaagaaacaaaaaaagtttgatttacaactcgcccaggctctgggggaatctgtgtttgagaagggtctgagagaaaaggttacccaggagaataccagcgtcaggtgggaactgggccagctccaacaacagctgaaacaaaaagagcaggaagcctctcaattgaagcaacaagtcgaaatgctgcaggatcacaagagggagctgctggggtcaccgagcttgggcgaaaattgcgttgccgggctgaaagaaaggctgtggaaactggaaagctccgccttggagcagcaaaagatacagagccagcaggaaaataccatcaaacagctggagcaactcaggcagaggttcgaactggagatcgagcgaatgaagcagatgcaccaaaaagatcgtgaggaccaagaggaggagctcgaggacgtgcggcagtcttgccaaaagagactgcatcaactcgagatgcagctagagcaggagtacgaagagaaacagatggtgctgcacgagaagcaggatctcgagggcctgatcggcactctgtgtgaccaaattggccacagggatttcgacgtagaaaagaggctgcggcgtgatttgcgccgaacacacgccctgctgtccgacgttcagctgctcctgggaaccatggaggatggcaagacatctgtcagcaaagaggaactggagaaagtccactcccagctggaacagagtgaggccaaatgcgaggaagcactgaagacccagaaagtgctaaccgctgacttggaaagcatgcattcagaattagaaaacatgactcgtaacaaaagcctggtggatgagcagttgtacagactccagtttgagaaggccgatcttctcaagagaattgatgaagaccaagatgacctgaatgagttgatgcagaaacataaagacctgatcgcccagtccgccgccgacatcgggcagattcaggaactccaactgcaactggaagaggcaaagaaggagaagcacaagctccaagagcagctgcaggttgcccagatgcgtatagagtacctggagcaatccacggtagatcgcgccattgtctccaggcaagaagcagttatttgcgacctcgagaacaaaacagagtttcaaaaggtccaaattaagcggttcgaggtccttgtgatccggcttcgagactcccttattaagatgggggaggagctgtcacaggcagctacctcagaatcccagcagagggagtcctctcagtattaccagaggagacttgaggaactgaaagctgacatggaggagctggtccagagagaggccgaagcttcccgccggtgtatggagcttgagaaatacgtagaggagttggccgccgtcagacagacgctgcagactgacctggaaacctcaattaggcggatcgccgatctgcaggctgctctcgaggaggtagctagcagcgactccgataccgagtcagttcaaacagctgtggactgcgggagcagcggacggaaagagatggacaatgtgagcattctcagcagccaacccgagggctccctccagtcttggttgtcgtgtactttaagtctggccactgacaccatgcgtacacccagtcggcagagcgcgacctcgagccggattctatccccccggatcaatgaggaagcgggtgacaccgaacgaactcaaagtgccctggccctgtcacgcgcccggtccactaacgtgcacagtaaaacgtcaggcgataagccggtgtctccccacttcgttaggcggcaaaagtactgtcacttcggcgacggggaagtcctcgcagtgcagcggaaatccactgagaggctcgaaccagccagctcccctctggcctctaggtccaccaatacatcacctttgtccagagagaaactgccctcaccgtcagccgccctgtctgaattcgtagaaggcctcaggagaaagagagcccagagaggccagggttccaccctgggtcttgaggattggcctacactgcccatctaccaaaccacaggggctagcaccctcagaaggggtcgcgccggatcagatgagggcaatttgtcactcagggtgggtgcgaaaagtccactggagattgaaggcgccgcgggcggcctcctgcgctcaacatccttaaagtgcatctccagtgacggagtgggcggcacaacgctgctgcctgaaaaaagcaagacccaattttctagctgtgaaagtctcctcgagtcaaggcccagtatggggaggaaacttagtagccctaccactccacgggatatgttgctctctccaactttaaggccacgcaggcgctgtctcgagagcagcgtagacgacgcaggatgtccagatctgggaaaagagcctctggtctttcagaatagacagttcgcccacttgatggaggagcccctgggttctgacccctttagctggaagttaccgtcattagattacgagcgcaagaccaaggtggatttcgatgactttctcccggccattcggaagccccaaactccaacctcactggctggatcagccaaaggtggacaggacggcagccaacggagcagtatccatttcgaaaccgaggaagctaacaggtcctttctgagtggtatcaaaacaattttgaaaaagtcacctgagcccaaagaagatccggcgcacctgagcgactcttctagctcctcaggttccatcgtgtcatttaagtcggccgacagtataaaatctcggcccgggatcccacgactagctggggacgggggcgagagaacgtccccagagcggagggagcctggcacaggtcggaaagacgatgatgttgcttccattatgaagaaatatcttcagaaatag

SEQ ID NO: 196286 - DNA, 7707 bp, Artificial Sequence
  Description of Artificial Sequence: Synthetic coding sequence
atggccatcagcagccggctggccctgtgggagcagaagatccgggaggaggacaaatctcccccaccatcgtccccacctcctttattcagtgtgattcctggtggattcattaaacagctggttcgcggcactgaaaaagaggctaaagaagctcgccagcggaagcagttggccgtggcttcaccagagcgagagattcccgagatatcaataagccagccgaattcgaagtcttcgtccggcacaagatccggctcgcagcagatctcccaagatgatcaatcttccagtccagggtcaagcgacatacttggtaaagagagcgaaggatcccgctcacctgacccagagcagatgacgtccataaacggtgaaaaggcgcaagaacttggttccagcgccactcctaccaagaagacagttcctttcaagcggggggtgcgcaggggcgatgtgctgctgatggttgcgaagttagatcccgattccgccaagccggaaaaaactcatcctcatgacgccccaccatgcaagacatctccccccgctactgataccgggaaggagaaaaaaggagagacctcaagaaccccttgtggctctcaggcttccacggaaatcctcgctccaaaagctgaaaagacccggacggggggccttggggaccccggccagggcaccgtcgctctgaagaaaggggaggagggacagagcatcgtgggcaagggacttggcacccccaagactacggagctgaaggaagccgaaccacagggcaaagatcggcagggaacgcgtccacaggcccagggacccggtgaaggtgtcaggcccggaaaggccgagaaagaaggagccgaaccaaccaatacagtggaaaagggcaatgtgtccaaggacgtgggtagtgaggggaagcacgttcggccccagattccaggtagaaagtggggggggtttctcggcagacgctccaagtgggacgggccccaaaataaaaaggataaagagggggtgctgctgtcaaaagcagaaaagacaggcgaacctcaaacccaaatggagaaaactagccaggttcagggggaactgggtgatgacctccgaatgggcgagaaggcgggtgaactgagatcgacaaccggaaaggctggcgaaagctgggataaaaaggagaagatggggcagccacagggaaagtcgggtaacgcaggcgaagctcgtagtcaaaccgagaaggggtgcgaggcccccaaggaagtgtccactatggtggagtcgccagccgcacctggaaagggcgggtggcctggttcccgcgggcaagaagccgaggagccatgtagtagggctggagacggagcgggggccttggagacagagcttgaggggccgtcacagcctgcgctggaaaaggacgcagaaaggcccagaatacgcaaagagaaccaggatgggccggcccctcaagaggaggggaaggggggtcagtctcgcgacagcgaccaggcaccagaagaccggtggtatgaagcggagaaagtgtggctcgcacaaaaggacggctttactctggccacagtgctgaagcctgatgagggcactgccgacctgcccgcgggacgcgtgcggctgtggattgatgcggataagacaatcacagaggttgacgaagaacatgtccatagggccaaccctccggagctagatcaggtagaagacctagcctccctgatctccgtcaacgagtctagcgtgctcaacactctcctgcagaggtacaaggctcagcttctacacacctgcaccggcccagatcttatcgtcttgcaaccaagaggcccctcggtgccaagcgccggaaaggtgccaaagggtcggagggacgggctccctgcacatatcgggtcaatggcacagcgcgcttactgggctctgctaaaccagcggagagaccagtccatcgtggctctgggttggtcaggcgctggaaaaaccacctgctgcgaacaggttctggagcatttagttgggatggcgggctccgttgatggccgagtatcagttgagaaaattcgtgccacgtttaccgtgctgcgagctttcgggtctgtgtctatggctcactcaaggtcggccacccgcttcagtatggtaatgtcactggattttaatgccaccgggcgcatcacagctgcacagctgcaaaccatgctcctggaaaaaagtcgggttgcgcgccagccagaaggcgagtccaacttccttgttttcagtcagatgttggcaggcctggacctggacctacgtacagagcttaacctacaccagatggccgactcctcatcctttgggatgggcgtctggagcaagccggaggacaaacagaaggcagctgctgccttcgcccagctgcagggtgctatggagatgttaggcataagtgagagtgaacagcgcgccgtgtggcgcgtattagccgctatttaccatcttggtgccgctggtgcctgcaaggtcggacggaagcagtttatgcggttcgaatgggcaaactatgccgccgaggcattaggctgtgaatacgaagagcttaacactgccacgtttaaacaccacctgagacagatcattcagcagatgacctttgggccatcccgttggggactggaagacgaggaaactagctccggcctcaaaatgacaggagtggactgcgtggagggaatggcctctggactgtaccaggaactatttgcagcagtagtgtccttaattaaccgctccttctcttctcatcacttgtccatggccagtattatggtcgtggacagccctggcttccagaatccacgacatcaaggaaaggaccgcgcagctaccttcgaggaattgtgccacaattacgcgcacgagcggctccagctgttgttctaccaacggacttttgtaagcaccctgcaaagatatcaagaagagggcgtcccagtgcagttcgatctgcccgatccttcccccggaacgaccgtggccgtggtggatcagaacccttctcaacaggtacgcctccctgctggcggtggcgctcaggatgctcgcggactattctgggtgctggacgaagaggtgcatgttgaaggtagtagtgatagcgtggtactcgagaggttgtgtgccgctttcgagaagaagggagccgggacggagggtagctctgcacttcggacctgtgagcaaccactacagtgcgagatcttccaccagctgggctgggaccccgtgaggtacgatctgaccggttggttgcaccgcgccaaaccgaacctaagcgcgctggatgcccctcaagtgctgcaccagagcaaacgagaggaactgagaagcctgtttcaggccagggcaaaattgcctcccgtgtgtcgcgcagttgcgggtctggaaggaaccagccagcaagccctccagaggtcccgcatggtcagacggactttcgcttcctccctggccgctgtcagaagaaaggctccttgtagccagatcaaactccagatggacgcgttaacatccatgatcaagcggtcgagactgcatttcatacattgccttgtgccgaatccagtcgtcgaaagccgaagcggacaggagagtcccccccccccccagcccgggcgcgataaaccaggggccggtggccctctcgctctggacattcctgccctgagggtccagttagcgggtttccatattctggaggccctgaggttacataggacgggatacgcggatcatatggggctgacccggtttaggaggcagttccaggtgctggatgcccctctgctaaagaagctaatgtctacgtctgagggcattgatgagcggaaggcggtggaggagctactcgaaacccttgacctcgagaaaaaggcggttgccgttggccactcccaggtcttcctcaaggccggcgtgatctcacgtctcgagaaacagcgggagaagcttgtatcacagtctattgtgctctttcaggccgcttgcaagggttttctcagtagacaagaattcaaaaagctcaaaatcaggcggctggccgcacaatgcattcagaagaacgtggccgtgttcctcgctgtcaaggactggccatggtggcagctcctgggtagcctgcagcctctgctcagcgcaactataggcactgaacaactgagagcgaaagaagaggagttaacaacccttcgtagaaaattagaaaaatctgagaaactgcgaaatgagctgcggcagaacacggatctgcttgaaagcaagattgctgacttgacttcagatttagctgatgaacggtttaagggtgacgtcgcatgccaggtcctcgaatcggagagggccgagaggctgcaggcctttcgcgaagtgcaggaacttaagagcaagcacgagcaggtccagaaaaaattgggcgatgtgaataagcagctggaagaggcccagcagaaaatacagctgaacgacttggagagaaatcctaccgggggcgcagacgagtggcagatgcggttcgattgcgcacagatggagaacgagtttctccgaaaacggctccagcagtgcgaggagaggctagatagcgagctgactgctcgaaaagagctggagcaaaaactgggagagctccagtctgcgtacgacggcgcaaagaaaatggcacaccagctcaagcgaaaatgccaccacctcacgtgcgacttagaggatacgtgcgtgctgctcgaaaatcaacaaagccggaatcatgaactggaaaaaaagcagaaaaaattcgacctccaattggcacaagccttgggggaatccgtgttcgagaaaggcctccgcgagaaggtcactcaggagaacaccagtgtccggtgggaacttgggcagttgcaacagcaactcaagcagaaggaacaagaggccagtcagctgaagcaacaggtggagatgctgcaggaccataaacgagagctgctggggtccccaagccttggtgagaactgtgttgcgggcctgaaggagagactctggaagcttgaaagctcagccctggagcagcagaagatacagtcccagcaggagaacacgatcaaacagctggagcaactgcggcagcgtttcgaattggagattgagaggatgaagcagatgcaccagaaagatagggaagatcaggaagaagagctcgaagatgtccggcaatcttgtcagaagcgcctgcatcaactggaaatgcaactggagcaagaatacgaggagaagcagatggtcctgcatgagaagcaggacctcgaggggctgatcgggacgttgtgtgatcagattggacatcgggactttgacgtcgaaaaaaggctcagacgcgacctgcggcgcacccacgcacttctgtctgatgttcagttactgttagggacaatggaggacggcaagaccagtgtgtccaaagaggagctggaaaaagtccattcacagctcgagcagagcgaggcaaagtgtgaagaggctttaaagacccaaaaagtgttaacagctgacctggagtcaatgcatagtgagctcgaaaatatgactaggaataagtctctcgttgacgagcagctctaccgtctccagttcgaaaaggctgatttgttaaaacggatcgacgaagatcaagacgacctaaacgaactgatgcagaaacacaaggatctcattgctcagtccgctgcagatatcggtcagatccaggagctccaactccaactggaggaggcaaagaaagaaaaacataagttacaggaacagctccaggttgcccaaatgcgcattgagtatttggagcagtccaccgtggaccgtgccatcgtgtcaaggcaggaggcggtgatctgtgacttggagaacaagaccgagttccagaaggtgcagatcaagcgcttcgaggtgttagtcatccgcctgcgcgatagcctaatcaaaatgggagaggagctgtcacaggctgccaccagcgagtctcagcaacgtgaaagcagccagtattaccagcgccgtttggaagagctgaaagccgatatggaagagttggttcagcgtgaggcggaagcctctagacgatgtatggagctggagaagtacgtcgaggaactggcagccgtcaggcagactcttcagacggatctggagacatccatccggaggatcgccgacctccaggctgccctcgaggaagttgcctcatcagattctgataccgagagcgttcagacagccgttgattgtggcagttcaggaaggaaagagatggacaatgtgtcgatactgtcctcccaacccgagggctccttgcagtcctggctctcttgcactctctctttggccaccgacaccatgagaacgcctagcaggcagtcggcaacaagcagtcggatcctgagcccacggataaacgaggaagccggcgatacagagcgaactcagtccgccctggccctgtctagagcccgtagtacaaacgtacatagcaagaccagcggcgacaaacccgtgagtcctcactttgtgcgccggcagaagtactgccattttggtgatggtgaggtgctagcagtgcaacgcaagtccactgaaagactcgagcccgcttccagtcccctggcttcacgaagtaccaacacctctcctttgagccgagagaaactcccgagcccatccgcagcgctgtccgagtttgtcgaagggctgcgtagaaaacgtgcacagcgtggtcaggggtccaccttaggtcttgaagattggccaactcttcccatctaccagacaaccggagcttcaaccctgagacgcggacgcgctggctccgatgagggaaacttgtctctacgggtcggcgcaaagagcccattagaaatcgagggtgccgccggcgggctactgagaagcacttcactgaaatgtatatcctcagacggcgtaggaggcactacattattacccgagaagtctaaaacacaattctcctcatgcgaaagtttgttggagagtcggccgtccatgggccggaaacttagttctccaacaacaccccgcgacatgctgttgagccctactctgagacctagaaggagatgccttgagagctccgtggacgacgccggctgccccgacttgggcaaagagccattggtgtttcagaacagacaattcgctcacctgatggaagaacccctgggctcagacccattctcatggaaactccccagcctggattatgagcgaaaaacgaaagtcgacttcgatgattttctgccagcaatacggaaaccgcagaccccgaccagcctcgcaggatcagctaaaggcggtcaggacgggtcacaacgtagcagtattcacttcgaaacagaggaggcaaacaggagcttcctgtccggaattaagaccatcctgaagaagtcacctgagcccaaagaagacccagctcatctgtccgactcttctagttcttcaggaagtatcgtttctttcaaatccgccgactcaatcaagtcacggccaggcatcccacgtttagctggagacggcggggaacggacctctccagagagacgggaacccggtactggccgaaaggacgatgacgttgcaagtattatgaaaaagtacctccaaaagtag

SEQ ID NO: 196287 - DNA, 7704 bp, Artificial Sequence
  Description of Artificial Sequence: Synthetic coding sequence
atggccatcagcagccggctggccctgtgggagcagaagatccgggaagaggataagtctccccctccttcaagtccacctccactgttcagtgttattccagggggatttatcaagcagctggtccgtggcacagaaaaagaggcaaaggaagctcggcagaggaagcagctcgcagtggcaagccctgagagggaaataccggagataagtataagccaaccaaatagcaaatcctcctcgggcacacgcagcgggtcccagcaaatttctcaggatgaccaaagctcgtctcctggaagttcagacatacttgggaaagagtccgaaggcagccgaagccccgaccccgaacagatgacctcgatcaacggcgaaaaggcccaggaactcggttcctctgccaccccaacgaagaaaacagtcccctttaagcgaggcgtgagacgcggtgacgtgttactcatggttgcaaagctcgacccggacagcgctaagccggagaaaacacatcctcatgacgcaccgccctgtaagacatctcctcccgccacagatactgggaaggaaaagaagggcgaaacctccaggactccctgtgggtcccaggccagcactgaaatcctagccccgaaggccgagaagacccgcaccggaggactgggagaccccgggcaagggactgtggccctcaaaaagggagaggaaggacaaagtattgtaggtaaagggctgggaactcccaaaaccaccgaattaaaagaggctgaacctcagggtaaagacaggcagggtactaggccacaagcgcaggggccgggggagggggtgcgacctggaaaagccgagaaagagggcgcagaacctacaaacactgtggaaaaaggtaacgtgtctaaggatgtcggcagcgagggaaaacacgtgaggcctcagattcccggcaggaagtggggcggtttcttgggacggaggagcaagtgggacggaccacaaaacaagaaagataaagagggtgtccttttgtcaaaggctgagaaaaccggggagccacagacgcagatggagaagacctcgcaggtacaaggagagctgggcgacgacctcaggatgggagagaaggctggcgagcttcggtcaactaccggcaaggccggtgaatcttgggataaaaaagagaagatgggacagccacaaggcaaatccggaaatgccggagaggctagaagccagaccgagaaaggctgcgaggccccaaaggaagtgagcaccatggtcgagagcccagccgcacccggaaagggcggctggccgggatctcgggggcaggaagcagaggaaccgtgttccagagctggcgacggggcaggagcacttgaaacagaattggagggacctagccagcccgcactcgaaaaggacgccgaacgcccacgaatacggaaagaaaatcaggatgggcccgctccacaggaagagggtaagggaggtcagtccagggattcagatcaggcacctgaggacagatggtacgaagccgagaaggtctggctcgcacagaaagacggcttcactttggcgacagtcctcaaacctgatgagggcaccgcagatctgcctgccgggcgtgtcagattgtggatcgacgcggacaagacgatcaccgaagtggacgaggagcatgtgcacagagccaatccacccgagctggatcaggttgaggacctggcgtctctgatctccgtgaacgagtcgagcgtactcaacaccctcctgcagaggtataaagcacagttactgcacacttgcaccggacctgacttgatcgttttacagccccgaggtcctagtgtcccgtctgctggaaaggtccccaagggtcgaagggatggcctcccggcccacataggaagtatggcccaaagagcttactgggctctgcttaatcagcgtcgtgatcagtccattgtagccctggggtggtcaggcgccggcaaaacaacatgctgcgagcaggtattggagcacctggtagggatggcgggatctgtggacggtcgcgtgtccgttgagaagatacgggcaacttttactgttctgcgggctttcgggagcgtctccatggcccattctagatctgcaaccaggttttctatggtgatgtccctggattttaacgccactggtaggatcactgctgcccaattgcagacaatgctactcgaaaagagcagagtcgctcggcagcccgagggcgaaagtaactttctggtatttagtcagatgctagccggcctggatctagacttgcggacggaactcaaccttcatcagatggctgactcctcctcgtttggaatgggcgtgtggtctaaacctgaagataagcaaaaagcagccgctgcctttgcgcaacttcagggcgctatggagatgttaggaatatccgagtccgaacaacgtgctgtgtggcgggtcctggcggcaatctatcacctcggtgctgcgggggcgtgtaaagttggtcggaagcagttcatgaggtttgaatgggctaattacgctgccgaagccctgggctgtgagtatgaagagctaaacaccgctacatttaagcatcatctgcgacaaataattcagcagatgacttttggtccaagtaggtggggacttgaggacgaggagacctctagcggcctgaagatgactggggtggactgcgtagagggaatggcctctggtctgtaccaggaactcttcgccgctgttgtctccctgattaaccgcagcttctcgagtcaccatctgtccatggcatccattatggtagttgactcgcctgggttccagaatcctagacaccaggggaaagacagagccgcaacatttgaagaattgtgtcacaactacgcccatgagcggctccagctgttattttatcaaagaacattcgtgagtactttgcagcgctaccaggaggagggtgtgcctgtgcagttcgacttgcctgatccaagccccggcaccactgtggcggttgtggaccaaaatccgtcacaggttagactgcccgctggcgggggtgcacaggacgcccgagggctgttctgggtgcttgacgaagaggttcacgtggagggctcatctgactctgttgtccttgaaaggttgtgtgcggcgtttgagaagaagggggcgggcacagaaggcagctccgcgctgcgtacctgtgaacagccgctgcaatgcgaaatcttccatcagctggggtgggacccggtgaggtacgatttaacgggctggctgcacagagcaaagccaaacctcagcgcactggacgcacctcaggtcctccatcagtctaagcgcgaggagcttagatctctgttccaggcaagagccaaactcccccctgtctgccgggcggtggctgggcttgaggggaccagtcagcaggccctccagaggagtagaatggtaagaagaactttcgcctcatccctggccgctgttcggaggaaagccccctgttcccagatcaaactgcagatggatgccttaacatccatgatcaaacggtcaagactccacttcatacattgcctagtgccgaatcccgtggttgaaagccgaagcggccaagagagcccaccaccgccccagcctggacgcgataaacctggagccggcggccctctggcccttgatattccagcccttcgcgtgcaactcgctggctttcacatactggaggctttacggctgcacagaactggctacgccgaccatatggggctcacccgtttcagacggcagttccaagtgttggatgcaccattgcttaagaagttaatgtcaaccagcgaggggatcgacgagcgtaaagcagtcgaagaactgctggagacccttgatctcgaaaaaaaagccgtggccgtaggacacagccaagtgtttctgaaggccggagtgatatccagactagagaagcagcgcgagaaactcgtaagtcaatctatcgttctcttccaggcagcctgcaagggattcctcagtcgtcaggagtttaagaaactgaagattaggagactggccgctcaatgcatacagaaaaatgtcgccgtatttctggctgtgaaggactggccttggtggcagcttctgggctctctccagcctctgctgtcagcaactatcggaactgagcaactccgcgccaaagaggaagagcttactaccttgagacgaaaactggagaagtctgagaagctgaggaacgagctgaggcagaacactgatctgttggagagcaaaatagccgacctgacatctgacttggcggacgagcggtttaagggggacgtggcttgccaggtcttggagtcggaaagagcagagcgcctccaggcattccgagaggtacaggagctgaaatccaagcacgagcaagttcagaagaaacttggcgatgtgaataaacagctggaggaagcccaacagaaaatccaactgaacgatctggagagaaaccccacaggcggcgcagatgaatggcagatgcgttttgactgtgcccaaatggaaaacgaatttctgcgcaaacgtctccagcagtgcgaggagcgcctggactctgaactgactgcgcgtaaggagctggagcaaaagctgggggaactacagtccgcctacgatggagcaaagaaaatggctcatcagctcaagagaaagtgccaccacctgacctgtgacctggaagacacttgtgtgttgctcgagaaccagcagagccgcaaccacgagctggagaaaaagcagaaaaaatttgaccttcaactggcacaggcacttggagaaagcgtgttcgagaaaggccttagagaaaaagtgacgcaggaaaacacttccgtacgatgggaactgggacagcttcaacagcagctgaagcagaaggagcaagaagcatcccagctgaagcaacaggtcgagatgctacaagatcataagcgggaactcctggggtccccatctctgggggaaaattgcgtggccggtctgaaagaacgactctggaagctggaaagttctgcattagagcagcaaaagattcagagccagcaggagaacacaattaaacagcttgagcaattgagacaacgcttcgagcttgagattgaacgaatgaagcagatgcaccagaaagacagggaggatcaagaagaagaactggaggacgttagacagagctgtcagaaacggctgcaccagctggagatgcagttagagcaagaatatgaggaaaaacagatggtgcttcacgaaaagcaagacctggaggggctgatcggtacactctgcgaccagatagggcaccgggattttgacgtggaaaagcggctcaggcgggatctgcggcggacacatgctcttctctctgatgtgcaacttctgttgggaacaatggaggacggtaagacctctgtaagcaaagaggagctcgaaaaagtgcatagccagctggagcagtctgaggctaaatgcgaggaggcgcttaaaacacagaaggtattgacagccgatctggagtcgatgcattcagagctcgagaatatgacacgcaacaagtccttggtggatgagcagctgtatcgccttcaattcgaaaaggctgatctgttgaaacggattgacgaggatcaagacgatctcaacgaactgatgcaaaagcataaggatcttatcgctcagagcgccgcagacatcggccagatacaagagctgcaactccagttggaggaggcgaaaaaagaaaagcacaagctacaagagcaacttcaggtagcacagatgaggattgagtatttggaacagtcaacagtggatagagccattgtctctcggcaggaggcagtgatctgcgacctcgagaacaagacggaatttcagaaagtgcaaatcaagcggtttgaggtgcttgtgatccggctccgcgactccctcattaagatgggcgaggaattgagccaggcagccacatcagaatcccaacagcgtgagagcagccagtactaccagcgtagactcgaagagttgaaggcagacatggaggaattggtacaacgcgaagccgaagctagcaggcgatgcatggagctcgagaagtatgtggaagaactcgccgccgtacgccaaaccctgcagactgacctggagactagcatccgccgtattgctgacctacaggccgctctggaggaagtggcatccagtgacagcgacactgaaagcgtgcagacagcagtggattgcggttccagcggcagaaaagagatggataatgtgagtatcctatcttctcagcccgaggggtctctgcagtcctggctcagctgcaccctgagtttagccacagacacaatgaggaccccctcccggcagtctgccacctccagcagaatcttgagtccccgtattaatgaggaagcgggagacaccgagcggactcaaagcgccttggccctgagtagagctcgctctaccaacgtgcacagcaagaccagcggtgacaagccagtttctccccattttgtgcggcgtcagaagtattgtcatttcggggatggcgaagtgctagccgtgcagagaaagtctactgagcgactggagccagccagcagtcctttagctagtaggtccacaaacactagccctctctctcgcgaaaaacttccatccccttccgcggcgttgagcgaatttgtcgagggcttaaggaggaaacgagcacagaggggacagggatctacactcggattagaagactggccaactctcccaatttaccagaccacaggtgcctcaaccctgcgacggggaagagctgggagcgacgagggcaacctgtctctgcgagtgggagcaaagtcacccttagaaattgaaggagctgctggaggactgcttcgtagcacatctctaaaatgtatatctagtgacggggtgggcgggacgaccctgctaccagagaagagcaagacacagttttctagctgtgaaagtctgcttgaatcccgcccaagcatgggtagaaagctatcatctcctaccacacccagggacatgctattgtctcccactttgcgaccccgcagacgctgcctcgagtcaagcgtcgatgatgccggctgtcccgatcttgggaaagagccgctggtgtttcaaaatagacagttcgcccacctcatggaggaacccctcggctccgacccgttctcctggaagctgccttcacttgattacgagcggaaaacaaaggtagactttgacgactttctcccagcaataagaaaacctcagaccccgacaagtttggccggatcagcgaagggcggccaagatggctcccagagatcctccattcatttcgaaacagaggaggcgaaccgaagctttttatctgggatcaaaacaatcctgaaaaaaagcccagaacccaaagaggatccggctcacttgtccgactcatcgtcttcttctggttctattgttagtttcaaatccgcggattcaattaagagccgccccgggatccccagattggcaggcgatggcggcgagcgtacatcacctgaacgcagggaacctgggaccggacgtaaggatgatgatgtcgctagcatcatgaagaagtatttacagaagtag

SEQ ID NO: 196288 - DNA, 603 bp, Artificial Sequence
  Description of Artificial Sequence: Synthetic coding sequence
atgggcaacagcaagagcggcgccctgagcaaggagatcctggaggagctacaactgaacaccaagttttcagaagaagagttgtgctcctggtaccagagcttcctgaaggattgtcctaccggccgcatcactcagcaacagttccagtctatctatgccaagtttttccctgacacggaccctaaggcctacgcccaacacgtatttagatctttcgacagtaaccttgatgggactttggactttaaagagtacgttatcgcgttgcacatgactacggccggcaaaactaatcagaaactggagtgggcctttagtctgtacgacgtagatgggaatgggacgatctctaagaatgaggtgttagagatcgtgatggctatctttaagatgataacccccgaagatgtgaagctgttgcccgacgatgagaacacccccgagaaacgggcagagaagatctggaagtattttggcaaaaatgatgacgataagctgaccgagaaagagttcatcgaaggaactctcgccaacaaagagatactccggcttatccagttcgaaccacaaaaagtcaaggagaaaatgaagaacgcgtag

SEQ ID NO: 196289 - DNA, 1884 bp, Artificial Sequence
  Description of Artificial Sequence: Synthetic coding sequence
atgagcagcgacagcgagatggccatcttcggcgaggccgccccctttttaagaaagtcagaaagggagaggattgaggcccagaataaacccttcgatgcaaagacaagcgtgtttgtggtggatcctaaggagtcattcgtcaaagccactgtccagtctcgcgagggtggcaaagtgactgcaaagaccgaggctggcgcgactgtgacagtgaaggacgatcaggtgttccctatgaatcccccgaagtacgataagatcgaagatatggccatgatgacacatttgcacgaacccgctgtgttgtataacctcaaggagcggtatgccgcctggatgatctatacgtacagcgggctgttctgtgtgaccgtgaatccttataagtggctgcccgtgtataacgccgaggttgttaccgcatatcgcggcaaaaaacggcaggaagctcctccccacatattctctatcagcgacaacgcctatcagtttatgcttaccgaccgcgagaatcagtccatcctgatcaccggcgagagtggggcaggaaaaactgtcaatactaaaagggtgattcagtattttgcaacaatcgcggtcaccggcgaaaaaaaaaaggaggaggtcacctctggcaaaatgcagggcactctggaggaccagattatcagcgccaatcccctgctagaagctttcggaaacgcgaaaactgtgcggaacgataattcgtcccgattcggaaagtttattcgcattcactttggaactacgggaaagctggcctcagccgacatcgaaacctatttgcttgaaaaatcacgcgtgaccttccaattgaaagccgagcggtcatatcatatcttctatcagatcatgagcaacaaaaaacctgatctcatcgagatgttgcttatcacaactaatccctatgattacgcattcgtcagccagggagagatcacggtcccatctatagatgaccaggaggagcttatggccactgattctgccattgaaattttgggattcaccagcgacgaaagagtgtccatatataaactgaccggcgctgttatgcattacggtaatatgaagtttaaacagaagcagagagaagagcaggccgagccggatggcacagaagtggcggacaaagcggcttatctccagaacctcaatagcgccgatttgctgaaggcgttatgttacccgcgtgtcaaggtgggaaatgaatatgtgaccaaaggccagactgtgcaacaggtctacaacgccgtcggagccctggccaaagcagtgtatgataaaatgtttctatggatggtgactcggatcaaccagcagcttgataccaagcagccacgcgccaacagtgaggttgcgcagtggcggaccaaatacgagactgacgcgatccagcggacagaggagctggaggaggcaaaaaagaagcttgcccaaaggctccaagatgctgaagaacacgtggaggctgtcaatgccaagtgcgcatcactggagaagactaagcagaggctgcagaacgaagtggaagatctgatgatcgacgtggagcgcacgaacgccgcctgtgccgccctcgataaaaaacagcgcaactttgacaaaattctggcagagtggaagcaaaaatgtgaagagacccatgcggagctggaagcctcccagaaagagagcaggtctctgtcaactgaacttttcaaaatcaagaacgcgtatgaggagagcctggatcaactggagaccctgaaaagagaaaacaagaacttacagcaagagataagtgacttaaccgaacagatcgctgaggggggaaagagaatccacgaactggagaaaatcaagaagcaggtggagtag

SEQ ID NO: 196290 - DNA, 5919 bp, Artificial Sequence
  Description of Artificial Sequence: Synthetic coding sequence
atggcccagaagggccagctgagcgacgacgagaagttcctgttcgtcgataagaatttcataaactcacccgttgcccaggcagattgggccgccaaacgtcttgtctgggtaccctccgaaaaacagggtttcgaggccgccagtattaaggaggagaaaggggacgaagtggtggtagagctggtggaaaatgggaagaaggtaacagtgggcaaggacgatatccagaagatgaatcctcccaaattctccaaggtggaggacatggccgaactcacgtgtctgaacgaagcaagcgttcttcataatctcagggaacggtatttttccgggctcatctatacctactcgggactattctgcgtggtggttaacccttacaagcacctgcccatctactctgagaaaatcgtcgacatgtacaaaggcaaaaaacgccacgagatgcctccccacatttatgccatcgcagacactgcctatcgctctatgctacaggatcgggaggatcagtcaatactgtgcaccggcgagagcggtgcgggtaagactgaaaatacaaagaaagtgattcagtatctggcagttgtcgcatcttcccacaaagggaaaaaagacacctctatcaccggggaacttgaaaaacagctccttcaggcaaatcctattctggaagctttcggtaacgcgaaaacagtgaaaaacgacaatagctcacgtttcggaaaatttattcggataaactttgatgtgacggggtacatcgtcggcgccaatatcgaaacgtatctcctggaaaaatcccgggcaattcgccaagcccgggatgagcgtactttccatattttttattacatgattgcgggagctaaggagaaaatgaggtccgatctgctgttagaggggttcaacaactacacattcctttcaaacggatttgttccaatccctgccgcccaggatgacgaaatgttccaagaaacagtggaggcgatggccattatgggattttctgaggaggaacagctgagcattctcaaagtcgtgtcgtcggtgctgcagctggggaatattgtgtttaagaaggagcgcaataccgaccaagctagcatgcctgacaacaccgccgctcagaaagtgtgccatctgatgggaatcaatgtgacggacttcacccgttctatcctcactcctcgcattaaggtgggccgggacgttgtgcagaaggcccagacgaaggagcaggctgattttgcggtggaggccttggccaaggctacctatgaaagactgtttagatggatcttgacacgcgttaataaggccctggacaagacacacaggcaaggagctagcttcctgggtatcctggatattgccggcttcgagatattcgaagtgaatagctttgagcaactctgcatcaattacaccaatgagaagctgcagcaactattcaatcataccatgttcatccttgaacaggaagaataccagagagaagggatcgagtggaatttcatagacttcggtctggacctgcagccttgtattgaattaatcgaacgacctaacaacccgccaggagtcctggcccttctcgatgaggagtgctggttcccaaaagcgactgataaaagttttgtagagaagctgtgcactgagcagggttcccatcctaagttccagaagccaaagcagcttaaagacaagaccgaattctcaatcattcattatgctggaaaggtagattacaatgcgtccgcctggttgaccaagaacatggatcctcttaacgacaacgttacatctctgcttaacgcatcatccgataaatttgtcgctgatctgtggaaagatgtggatcgcattgtgggactggaccagatggcaaaaatgaccgagtccagcctgccgtctgcttccaagaccaagaagggtatgttccgaacggtgggacagctgtataaggagcagctcggaaaactgatgacgaccctgcgtaacaccacaccaaactttgtgcgatgtattatcccaaatcatgagaaaaggtccggcaagcttgatgcctttctcgtcctggaacaactacgctgtaacggagtcctggagggcattcgcatctgtaggcaagggttccccaacagaatagtctttcaggagttccgccagaggtacgaaatccttgccgccaatgctatccctaagggtttcatggacgggaagcaagcctgcatactgatgatcaaagcattggagctcgaccccaatctttacagaattggccagtcgaaaatctttttcagaacaggcgtcctggcacacctagaggaagaacgagacctcaagatcactgatgttataatggcattccaggcaatgtgtcggggctacttggcccgaaaagcattcgccaaacgtcagcaacagctgactgccatgaaagtgatccagaggaattgtgctgcttaccttaaactgagaaactggcagtggtggcgcctctttactaaggtcaagccgctcctacaagtgacaaggcaggaggaggagatgcaggccaaggaggacgaattgcaaaaaactaaggaacgccagcaaaaagccgagaatgagttaaaggaactggagcaaaagcattctcagctaacagaggagaagaacctgctgcaggagcaactgcaggctgaaacggaactgtatgctgaggcagaagagatgagggtgagactggcagcaaaaaagcaggagcttgaggagatcctgcacgagatggaggcacgtctcgaagaagaggaggacagaggccagcaactccaggccgaaagaaagaagatggcgcagcagatgctggacttagaagaacagctcgaggaggaagaggctgcgcgacagaagctgcagttggagaaggtcaccgccgaggccaagatcaagaagctggaggatgaaattctagtcatggatgatcaaaataacaaactgagcaaggagcgtaaactgctggaagagcgcatctcagacctgacaacgaacctggctgaggaggaagagaaggcaaaaaatttgaccaagctgaagaataagcacgagagtatgatttcagaacttgaggtgagactaaagaaggaagaaaagagtcgccaggagctcgaaaaactgaagagaaagctcgagggggatgcatcagactttcatgagcaaatcgccgacctacaggcccaaatcgccgaacttaagatgcagttggccaagaaagaagaggaactccaggccgccctggcacgcctggacgacgaaatcgcgcagaaaaataacgctcttaagaagattagggaactggaaggtcatatctctgacctccaagaggacctcgacagcgaaagagctgcacgtaacaaagccgaaaaacagaagcgggacctgggggaagagctggaagccctcaaaaccgagctcgaggataccctcgactcaacagccacacagcaggagctaagagccaaaagggagcaggaagtgacggtactgaaaaaggccctggatgaagagacgcgatctcacgaggcacaggtccaggagatgcgccaaaagcatgcacaggcggttgaggagctgaccgagcagctggagcaattcaaacgcgcaaaggcaaacctggacaagaacaagcagaccctggagaaggagaatgctgacctggccggggagctcagagtcttgggacaagccaaacaggaggttgagcacaagaaaaagaagcttgaggcacaagtgcaggagctgcagtctaaatgttctgacggtgaaagggcaagggctgagcttaacgacaaggtgcacaagctccagaatgaggtggaatctgttactggcatgctaaatgaggccgagggcaaggcaatcaagttggctaaggacgtggcaagccttagctcccaactgcaggacacgcaggaattgttacaggaggaaacccggcagaagttaaacgtgtcaaccaagctccggcagctggaggaagagaggaactctctccaggatcagttggatgaggagatggaagccaagcagaacttggaacgccatatctctacgctgaacatacagctgtccgacagcaagaagaagttgcaggacttcgcaagtacggtggaggccctggaggaaggcaagaaacggttccagaaggagatcgagaatcttacccaacagtacgaggaaaaagctgcagcctacgacaaactggagaaaacgaagaacagactccagcaggaacttgacgacctggtagtcgacctcgataatcagcgacaattagtttcgaacttagagaaaaagcaaagaaaattcgaccagttgctggcggaggagaaaaatatttcaagcaaatacgcagacgagcgggatagagcagaggcggaggcgcgggagaaagaaacaaaggcattgagtctagctagagcgctcgaggaagcactggaggctaaagaggagctcgagaggaccaataagatgctcaaagcggaaatggaggatcttgtctcgtccaaggacgatgtcggcaagaacgtgcacgagctggagaaaagcaagagggctctggagacccagatggaggagatgaagacccagctggaagagctcgaagatgaactgcaagcaactgaggatgccaaactcaggctcgaagttaacatgcaggcactgaaaggacaatttgaaagagatctccaagcacgcgatgaacagaacgaggagaagcggcggcaactccagagacagctccatgagtatgagacagagcttgaagacgaacgaaagcagcgcgcactcgctgcagctgctaagaaaaaactggaaggtgaccttaaggatcttgagctgcaggccgactcagcaatcaaaggaagagaggaggccattaaacagctaaggaagcttcaggctcagatgaaggacttccagagagaactcgaggacgcgcgcgcgtcacgtgatgagatcttcgccacggcaaaagagaacgagaaaaaagccaaatctttagaggcagatcttatgcaactgcaggaggaccttgctgctgctgaacgggcccgcaaacaagcagatctggaaaaggaagagcttgcagaggagctggcaagttcccttagcggtcgcaacgcgcttcaggacgaaaaaagaaggctggaagcacgaatcgcccaactggaggaagagcttgaggaggaacagggcaacatggaggctatgtctgatagggttaggaaggcgacacagcaggccgagcagctcagcaacgagctggctactgagaggagcactgcccagaaaaatgagagcgcccggcagcaactggaacgccagaataaggagcttcggagcaaattacacgaaatggagggagcggtgaaatctaaattcaaaagcaccattgctgccctggaagccaaaatagcacagcttgaggaacaggtggagcaggaagcccgtgaaaaacaggctgctacaaaaagtctcaagcagaaggataagaaattgaaagagatcctgctgcaggtagaagacgagcgaaagatggccgaacaatacaaagaacaggccgaaaaggggaacgcccgggtcaaacaactgaagaggcaactggaggaggctgaagaagaatcccaacgaattaatgccaaccgccggaagttgcagagagagcttgacgaagcaacagagtccaacgaggccatgggacgcgaggtgaatgctctaaagtccaaattacgtcgaggcaacgagactagttttgtaccatcgcgtaggagcggagggcgcagggttattgaaaatgcagacgggagcgaagaggagaccgacacacgcgatgctgacttcaatggtacaaaggcgtcggagtag

SEQ ID NO: 196291 - DNA, 5817 bp, Artificial Sequence
  Description of Artificial Sequence: Synthetic coding sequence
atggcccagaagggccagctgagcgacgacgagaagttcctgttcgtggataaaaacttcatcaatagtcccgtggcccaggccgattgggcagccaagaggctggtgtgggtgccgtccgagaaacagggttttgaagcagcttcaatcaaggaagaaaaaggcgacgaagtggtggtcgaactcgttgaaaatggcaagaaagtgacagtgggaaaagatgacatccagaagatgaatcccccgaagttcagcaaggtggaagacatggcagagcttacatgtctcaacgaggcctccgtgctccacaaccttcgtgagcgctacttctcgggactcatttatacttacagcggtctgttttgcgtggtggtcaatccctacaaacacctgccgatctattctgaaaagatagtggacatgtataagggcaaaaaacggcacgagatgcctccccatatttatgccatcgctgataccgcttaccgatctatgcttcaagaccgagaagatcagtctatcctgtgcacaggagagagtggagccggaaagacggaaaatactaaaaaagtcattcaataccttgcagttgtcgccagttcacacaagggaaagaaggatacatccattactggtgaactggagaaacagctcttgcaagccaatcctatacttgaagcttttggcaacgccaaaaccgtcaagaacgataattcttcacgcttcgggaaattcatccggatcaacttcgatgtaactggttacattgttggcgccaacattgaaacgtacctcctggaaaaaagccgagctattaggcaggctcgcgatgagagaaccttccatatcttctactacatgatcgccggcgccaaggagaagatgaggtccgatcttttgcttgaaggatttaataattacaccttcctctctaacggttttgtgcccattcctgccgcccaggatgatgaaatgttccaggaaacagtggaagccatggccattatgggctttagtgaagaagagcagctctctatcctcaaggttgtgagcagcgtgctccagctggggaatattgtttttaagaaggagcggaataccgaccaggcttcaatgcccgacaatacagcggcacagaaagtgtgccacttgatgggtattaatgtaacagatttcaccagatctatccttacaccacggataaaggtggggagggacgtcgtgcagaaggcgcagactaaggagcaggcagatttcgccgtagaagctctggccaaggccacgtacgagaggctgtttaggtggattctcacgagggtgaacaaagctcttgataaaacacacagacaaggcgcctcattcctgggaatactggatatagccggattcgaaatctttgaagttaacagcttcgaacagctgtgcattaattacacgaacgagaagttgcaacagctatttaatcatacaatgttcattctggagcaggaggagtatcagagggagggcatcgagtggaacttcatcgatttcgggcttgatcttcaaccatgtatcgagctcatagagagacccaacaaccccccaggggtgttggctcttttagacgaggaatgttggttcccgaaggcaactgacaagagctttgtggagaaactctgcacggagcagggctctcatccgaagttccaaaaacccaaacagttgaaggacaagactgaattctccatcattcattatgctggcaaggttgattataatgcgtctgcttggttgacaaagaacatggatccgctgaatgacaacgtaactagcctgctcaatgcgtcgtcagataagtttgtagccgacttgtggaaggacgtggaccgcattgtcggtctggaccagatggcaaaaatgacggaatcatcgttgccctctgccagcaaaactaagaaagggatgttcagaaccgtgggccagctttataaagaacagcttggaaagctgatgacaacactacgaaataccacccctaactttgtgagatgtatcatacccaaccacgagaagcgttcaggcaagctcgacgccttcttggtgcttgagcaacttcggtgtaatggtgttttggagggaataagaatttgccgacaaggctttcctaatcggatcgtgttccaggaattccgccagagatacgaaatcctggccgccaacgcgattcccaagggatttatggacggcaaacaagcttgtattcttatgattaaggccttagagctggatcctaacctttatcgcattgggcaaagtaagatattcttcagaactggggtgctggctcatttagaagaagagagggatcttaagatcactgacgtcatcatggcgtttcaagcaatgtgtagaggctatctggcgagaaaggcattcgccaaaaggcagcaacagctgaccgctatgaaggttatacagcgtaactgcgccgcctacttgaagctccgtaattggcaatggtggaggctctttactaaggtcaagccattactacaggtcacacggcaggaagaggaaatgcaggcaaaggaagatgagctccaaaagaccaaggagcggcagcaaaaagccgagaatgagctcaaggagctggagcagaagcacagccagcttacagaagaaaagaacctccttcaggagcagctgcaggctgagactgaattatatgcagaagctgaggagatgagagtgcgtttggcggcaaaaaaacaagaattagaagaaatactgcatgagatggaagcccgactggaagaggaggaagaccggggacagcagctgcaggccgagcggaagaaaatggcgcagcagatgctcgacctggaggagcagctggaagaggaggaagccgcacgtcagaaactgcagcttgagaaagtcacagcggaagccaaaattaagaaactggaagacgaaatattggtgatggacgaccagaataataaattatccaaagaaagaaagctacttgaagagcgtatttcagacctcacaaccaatctggctgaggaagaggaaaaagcaaaaaacttgacaaaactgaaaaataagcacgagagcatgatcagtgaattggaagtgcgtttgaagaaggaagaaaagtcaagacaagagctcgagaagctcaagcggaagcttgagggagatgcctctgatttccatgaacagatcgccgatctgcaagcacagattgctgaactcaaaatgcaactggccaagaaagaggaagagctgcaggccgccctcgccagactcgatgacgaaattgcccagaaaaacaacgcgctaaagaaaattagggaactggaggggcacatttccgacttacaggaagatctggatagtgagcgcgcggctcgtaataaagcagagaaacaaaagagggacctgggggaagagctggaggccctgaagaccgagttggaggataccctcgacagcacagctactcagcaggagttgcgcgccaaacgcgagcaggaagtgacagtcctaaaaaaagccctggacgaggaaacccgaagccatgaggcccaggttcaagagatgcgacagaagcatgctcaagcagtggaagagttgaccgagcagttagagcagttcaaaagagcgaaggccaacttagataagaacaagcagactctggaaaaggagaacgccgatctggccggagagcttagagtgctcggccaggccaagcaggaagttgaacacaagaaaaagaaactagaagctcaagtgcaggaattacagtctaagtgctctgatggtgagcgcgcgcgtgccgagctaaatgataaggtccacaagctgcagaatgaagtggagtccgtgacgggaatgcttaacgaggctgaaggcaaagctatcaaacttgccaaggatgtggcctcactgtcatcccagttgcaggatacgcaggaactgctgcaagaggagacccggcagaagctgaacgtgtctactaagttgagacagttagaggaggagcgaaattcactgcaagaccagcttgatgaggagatggaggctaagcagaacctggagaggcatatctccactttgaatatccaactaagcgattccaaaaagaagctgcaggactttgcctctacggttgaggccttggaagaaggcaagaagcggtttcagaaggaaatcgagaacctgactcagcagtatgaagagaaagccgctgcttatgataagctggagaagacgaagaatagactgcagcaggaacttgatgatctcgtggttgatctggataatcagaggcagttagtgagtaacctggagaagaagcaacggaaatttgatcagttgctggctgaggagaaaaatatttcttctaaatatgcggacgagagggaccgcgctgaagcagaagctagagagaaggagacaaaagctctatcattagcccgggcattagaagaggcactggaggccaaggaggaactcgagcgcaccaataaaatgctaaaggccgaaatggaggacctggtctccagtaaggacgatgtaggcaaaaacgtccatgaacttgaaaagagtaagcgtgccctcgaaacgcaaatggaagaaatgaagactcagcttgaggaacttgaagacgagcttcaggccacagaggacgccaagctgagacttgaggtgaatatgcaggccctcaaaggccagttcgaacgagacttacaagcacgagacgagcagaatgaagagaagagacggcagctgcaaagacagcttcatgaatatgagacggagctcgaggacgagcgtaagcagcgggctctagcagccgccgctaaaaagaagcttgaaggagatctgaaagatctggagctgcaggctgacagcgctataaaggggagggaagaggctatcaaacagcttaggaaattacaggctcagatgaaggatttccagcgggagttggaagatgctcgagcttcacgggacgagatattcgctacagcaaaggaaaatgaaaaaaaagcaaagtctctggaggcagacctcatgcagcttcaagaggatctcgccgccgctgaacgagctagaaagcaggcggatctggagaaagaagagctggctgaagaactggcgagtagtctatccggaaggaacgccctgcaggatgaaaaacggcgtctggaagcgcggatagcccagctggaagaggaactggaggaagagcaggggaatatggaagcgatgagtgatagggtacgcaaagcgactcaacaagctgagcagttaagtaacgagttggccaccgaacggtcaactgctcagaaaaacgagagcgcgcgtcagcagctcgagaggcagaacaaggaattgcggtctaaacttcacgaaatggagggagccgtgaaatcaaaattcaaatcaacaatcgcggcactagaggcaaaaatcgcgcagctcgaggaacaagtggaacaggaagcaagagagaagcaggcagccacgaagtccctgaaacagaaggacaaaaagcttaaagagattcttctgcaggtggaggacgagcgaaaaatggccgaacaatacaaggaacaggccgaaaaaggcaatgcccgtgttaagcagcttaagaggcagcttgaggaggcagaggaggaatcacaaagaattaacgctaacagacgcaaactccagagggaattggacgaggcgaccgaatcaaacgaagctatggggcgcgaggtgaacgctctaaaatccaaattacgtggtccgccgccccaggagacaagtcaatag

SEQ ID NO: 196292 - DNA, 6090 bp, Artificial Sequence
  Description of Artificial Sequence: Synthetic coding sequence
atggcccagaagggccagctgagcgacgacgagaagttcctgttcgttgacaagaattttataaacagcccggtggctcaggctgactgggccgcaaagcgtctcgtatgggttcccagtgagaaacaagggttcgaagctgcctctattaaggaggaaaagggggacgaagtcgtggtggaactggtagaaaacggcaagaaagtgacagtaggtaaggacgatatccagaagatgaatcctcctaagttctcaaaagtagaggacatggcggagttaacttgtctgaacgaagctagcgtactgcataatctccgcgagaggtacttctccggactcatctacacctacagtggcctgttttgcgtcgtagtgaacccgtacaaacacctgccaatttactcagagaaaatagtagacatgtataagggcaagaagaggcacgagatgcctcctcacatttatgctatagccgataccgcgtaccgctctatgctgcaggatcgcgaggatcagtcgatactgtgtacaggggaaagcggggccggaaaaactgaaaacactaaaaaggttatccagtatctcgcagtcgttgcctcatctcacaagggtaagaaagacacctccattactgagggtcctagcttctggcggggcgaattggaaaagcagctcctgcaagcaaatcccattctggaggcattcggaaatgcgaagacggtgaagaacgacaactcaagccgatttgggaaattcatcagaattaatttcgatgtcaccggctacattgtaggcgccaacattgagacgtacctgcttgaaaagtccagggcgataaggcaggctcgggatgagaggacattccatatcttttactacatgatagcaggcgcaaaggagaagatgaggtcagatttattactggaaggctttaacaactatacttttctgtctaacgggttcgtgccgattcccgccgcccaggatgacgaaatgttccaggaaactgtcgaagccatggcaatcatgggtttctcagaagaagaacaattgagcatcctgaaggtcgtttcctctgtgttgcaactggggaacatagtgtttaaaaaggaacggaacacagatcaggctagcatgccagacaataccgccgcgcagaaggtctgtcatctgatgggaattaacgtgacagactttactagatctattcttactccgcggattaaagtgggaagggacgtggtgcagaaggcccagacaaaggagcaggcagacttcgccgttgaggccctggctaaggccacgtatgagagactttttcggtggatcctcacccgtgtgaacaaagcactggataagacccatagacaaggcgcctccttcttggggattctcgatatcgctgggttcgagatctttgaggtaaactcctttgagcagctatgtattaattatacaaacgagaagttgcagcagttgttcaaccacacgatgtttatcctagagcaagaggagtaccagagagaggggattgagtggaacttcatcgatttcggcttggacctgcagccatgcattgaactgatcgagagaccaaataacccacctggtgtgctcgccctgctggatgaggaatgctggttccccaaggctacagataaatcattcgtggagaagctgtgtacggagcagggctctcaccccaaatttcagaaacccaagcaacttaaggataagacagagttctctatcattcactacgccggcaaggtggattacaacgctagcgcatggctcacgaaaaatatggatcccttaaacgacaatgtgacctccctgttgaacgctagcagcgacaaatttgtagccgacctgtggaaggacgtagatcggattgtgggtcttgatcagatggctaagatgaccgaaagcagcctgcctagcgcctcaaagaccaagaaaggcatgtttcgaactgttggccaactttacaaagaacaactcggcaagctaatgacaacacttcgtaacactaccccaaattttgttagatgtattatcccgaatcacgaaaaacgatctgggaagctagacgctttcttggtattagagcagcttaggtgcaacggagtcctcgagggaatccgcatctgcaggcaagggttccctaatcgcattgtatttcaggaatttaggcagcggtatgagatactggcagctaatgccattcctaaggggttcatggacggcaagcaggcttgcatcctaatgattaaggccctggagcttgacccgaacctctatagaataggacagagtaagatatttttccggaccggtgtgctggctcacctcgaggaagagcgagacctcaaaattaccgatgtgatcatggcttttcaagctatgtgcagggggtacctggctcgcaaggcctttgcaaagcgccaacagcaactgaccgctatgaaagttattcaacgcaattgcgccgcctacttgaagctgaggaattggcaatggtggaggctctttacgaaggtaaaacccctgctccaagtcactagacaagaagaagagatgcaggctaaggaagatgaacttcagaaaacaaaagaaaggcaacagaaggccgaaaacgagctgaaggagctggagcagaaacatagccagctgactgaagaaaagaacttgctgcaagaacaactgcaggctgaaacagaactgtatgctgaggctgaagagatgcgggtgcgcctagcagccaaaaaacaagagctcgaggaaatactgcatgagatggaggcccgcctcgaagaggaagaagaccgtggacagcagttgcaagccgaacggaagaagatggctcagcagatgcttgatctagaagaacagctggaggaagaggaggccgctcgccaaaagttacagctggagaaggtcacggccgaggccaaaatcaagaaactggaggacgagatcctcgttatggacgaccagaacaataagctgtccaaagaaaggaaactgttggaggagcgcatcagcgatctgaccaccaacctggccgaggaggaagagaaagctaaaaacctcacaaaactgaaaaataagcacgagagcatgatcagcgaactggaagtaaggctgaagaaggaagaaaagagtaggcaggaattagaaaaactcaaaagaaagctggaaggtgacgcctcagactttcatgagcagattgctgacttacaagctcagatcgctgagctgaagatgcaactggccaagaaggaggaggagcttcaggccgctctagcccggctggacgacgaaatagcacaaaagaataatgctttgaagaaaattcgcgaactggagggccacattagcgatcttcaggaggacctcgattctgaacgggccgcaaggaacaaagccgagaagcaaaaaagagatctgggcgaggagctcgaagcccttaagaccgagctggaggacaccctcgactccacagctactcagcaggagctccgggcaaagagagagcaggaggttacagtactgaaaaaggcactggacgaggagaccaggtctcatgaggcacaggtgcaagagatgcgccagaagcatgcacaagcagtcgaggaactgacagagcagttggaacagtttaaacgcgccaaggctaacttagacaagaacaagcagactctcgagaaggaaaatgcagaccttgccggcgaacttagggtgttggggcaggccaaacaggaagtagaacacaagaaaaagaagcttgaggctcaagtgcaggagctccagagcaagtgctccgacggtgaaagggctcgcgccgagcttaatgataaggtgcataagctccagaacgaggtagagtctgtgactggaatgttgaacgaggctgaaggaaaggcaatcaagctcgcaaaggatgtggcaagcttaagcagtcagttgcaggatacccaggagctgttgcaggaggagacgcggcagaagctgaacgtgtccactaagctgaggcagctggaggaggaaagaaattccttgcaagatcagctggacgaagaaatggaagccaagcagaatttagaacgccacatctccacccttaatatccagctgtctgattccaaaaagaaactgcaggactttgcctccacagtggaagccttggaggaagggaaaaaaagatttcagaaggagattgaaaacctcacgcagcaatatgaagaaaaggctgccgcgtatgacaaactggagaaaaccaagaaccggctgcagcaggaactcgatgacctggtagtcgatttagataaccagcggcagttggtttcaaaccttgaaaaaaagcagcgtaagttcgatcaactgctcgcggaagagaaaaatatctcctctaagtacgctgatgagcgggaccgagccgaggcggaggcgagggagaaagagaccaaggctctgtcgttggctcgggcgcttgaggaggcgttggaagccaaagaggagctagaacgcactaacaaaatgctaaaggctgaaatggaggacctggttagctctaaggacgacgtgggcaagaacgtgcacgaactcgagaaatcaaaaagggcattagaaacacaaatggaagaaatgaagactcaattggaggagctcgaagacgagctccaggctacggaggacgccaaattacggctggaggtcaacatgcaagccctaaagggacagttcgaaagggacctccaagcacgagatgaacagaatgaagagaagagaagacagttacaaagacagctgcatgagtacgaaactgagttggaagatgaacgaaagcaacgggcgcttgcagctgcagcaaaaaaaaagctggagggggacctgaaagatctggagttgcaggctgacagcgcaataaagggacgggaggaggccattaagcagcttcgaaagcttcaggcccagatgaaagatttccagcgggaattggaagatgcccgggcgtcacgcgatgaaatctttgccaccgctaaggagaatgagaagaaggcgaagagtttggaagccgacctgatgcagttgcaagaggacctggccgctgccgagagagcgcgcaagcaggcggacctggagaaggaagagctggcagaagagctggctagtagcctgagcggtagaaacgctctacaggacgagaagaggagactagaagcccgaatcgcacaactcgaagaagaactggaagaggagcaaggaaatatggaagcgatgtccgaccgggtaaggaaagctacacagcaggccgagcagttgtccaatgagctcgcaaccgagcggtccacggcacagaaaaacgaaagcgcaagacagcaactcgagagacagaacaaggagctcagatctaagctgcatgaaatggaaggtgccgtaaagtctaaattcaagagcacaatcgctgcactggaagccaaaattgcccagctagaggagcaagttgaacaggaagcgcgggaaaagcaggctgcaacaaaaagcttgaagcagaaggataagaaacttaaagaaatcttgctccaggtggaggatgagcgcaaaatggccgaacagtacaaggaacaggctgaaaagggcaacgcgagagtgaaacagttgaaacgccagctagaggaggcagaagaagagtcacaaaggatcaatgcaaatcgcaggaagctccagagagagctcgacgaagccacagaaagtaacgaagccatggggcgcgaagtcaacgctctgaagtcaaagttaagagggcctcctcatcggaagctccggagcgatgctccaggggaagagactcggcctctgagttttctgctcgagggactagaggacgtggagcttctgaaaatgcaaatggtgctgcggcgcaaaagaaccctggaaacacaaaccagtatggagccccgaccagtcaataagcagctgagcacagtgctgcaccatgggaagaagacaaagaatcagaacaagcagaccaaaaaaactcagcagcagccacggactaagcagaacccggctgactgtacttag

SEQ ID NO: 196293 - DNA, 5940 bp, Artificial Sequence
  Description of Artificial Sequence: Synthetic coding sequence
atggcccagaagggccagctgagcgacgacgagaagttcctgttcgtagataagaatttcatcaacagcccagtggcacaggccgactgggcagccaagcggctcgtctgggttcctagcgagaagcagggctttgaagcagctagtatcaaggaggagaagggtgacgaggtggtggttgagctggtggaaaatgggaaaaaggtgactgtagggaaagatgacattcaaaaaatgaaccccccgaagttcagcaaagtggaagatatggcagaattgacctgtctcaatgaggccagcgtgctgcacaacctgagagagcggtatttcagcggactaatctacacttattcgggcctgttttgtgtagtcgtgaatccctacaaacacctgccaatctacagcgaaaagatcgtagacatgtataaaggaaagaagcgccacgagatgccaccccatatctacgccatcgccgacaccgcctataggagcatgcttcaagatcgtgaggaccagagtatcctttgtactggcgaaagcggcgccggaaagaccgagaacactaagaaggtcatacagtacctggccgttgtcgcctcttctcacaagggcaaaaaagacacgagtatcacacagggccccagcttcgcatacggagaactagagaaacagctcctccaggcaaaccctatcctggaagcgttcggtaacgctaaaaccgtcaagaatgacaattccagtaggtttgggaagttcattaggatcaacttcgatgtgacgggctacattgtcggtgcaaacatcgaaacttatttgctagagaaaagccgggcaatccggcaggctcgcgacgagcggacattccatattttttactatatgatcgcaggagccaaagaaaagatgagatccgacctgctgctcgaaggttttaataattacacgttcctgtctaatggattcgtcccaataccggcagcccaggatgacgagatgttccaagagacagtggaagcaatggcaatcatggggttctccgaggaggagcaactatctatactcaaagtggtatcttccgttcttcagctcggcaatatcgtgtttaaaaaagagcgaaatacggaccaggcgtctatgcccgataataccgccgcccagaaagtgtgtcacctgatgggtatcaacgttacggattttacccgtagtatcctgaccccaagaattaaggtgggtcgggacgtagtgcagaaagcccagacgaaagaacaggctgactttgccgtggaagctttggccaaagctacatacgaacggctgttccggtggatcctcacccgtgttaataaagccctggataaaacgcaccgacagggggcctcttttttgggtatcctggatatagctggcttcgaaattttcgaagtgaactcattcgaacagctttgtatcaactacaccaatgagaaactgcagcagttattcaatcataccatgtttatacttgaacaagaggagtatcagagggaaggaatagagtggaactttatagacttcggattagacctccagccctgtatcgagctgattgaaaggcctaataatccccccggcgtgctggccctcctggacgaggagtgctggtttcccaaggccaccgacaaatcatttgtggaaaaactttgtaccgaacagggaagccatcctaaattccagaagccaaagcagctgaaggataagacagagttttccataattcattatgccggcaaagttgactacaatgcttcggcatggttaaccaagaacatggatccattaaacgataacgtaacaagccttcttaacgccagttctgacaagttcgtggctgacctgtggaaggatgtagatcgcattgtggggctcgatcagatggcgaagatgactgagtcctccctgccatccgcaagcaagacgaaaaaagggatgtttcggacagttggtcagctgtataaagagcaattgggcaaattgatgactacattgaggaatacaacacctaatttcgtgaggtgcatcatcccgaaccatgaaaaacggtcgggcaaactagacgcgttcctcgttcttgaacagctgcgatgcaacggcgtgctcgaagggattcgcatttgtcggcagggctttcctaatcgtatagtttttcaggaatttcggcagcgatacgaaatcctggccgctaacgcaatcccaaaaggtttcatggacggaaagcaggcctgtatcctcatgatcaaagctttggagctagaccccaatctctacagaatcggtcaatccaaaatcttcttccgaacgggcgtgctggcccatcttgaagaggagcgagatctgaagatcaccgacgtcattatggcatttcaagccatgtgccgagggtacctagctcgcaaagccttcgcaaagaggcaacagcaactgaccgccatgaaagtgatccaacgcaactgcgctgcctacctcaaactccgaaactggcagtggtggagactgttcactaaagtgaagcccttgctccaggtgactaggcaggaagaggagatgcaggctaaagaggacgaactgcaaaagacaaaagaacggcagcaaaaagccgagaatgagctgaaggaactcgaacagaagcactctcagcttaccgaggagaagaacctgcttcaggagcaactacaggccgagaccgagttgtatgcagaggcggaggaaatgcgggtgcggttagccgccaaaaagcaggaactcgaggaaatcctccatgagatggaggctaggctcgaggaggaggaggaccggggacagcagttacaggccgagaggaagaaaatggctcaacagatgctggacctggaggagcagttggaggaggaagaggctgcgcgccagaaactccaactagagaaggtgacggcagaagctaaaatcaaaaagctggaggacgagattctagtgatggacgaccagaacaacaagctcagcaaggaaaggaagctgctagaagaacgcatctctgacctgaccaccaacctagccgaggaggaggaaaaagctaagaaccttaccaagctgaaaaacaaacacgagagcatgatttcagaactggaggtgcgcctgaaaaaagaggagaaatcccgccaggagctggagaaactcaagcggaagctggagggggacgcgtccgattttcatgagcagattgccgatctgcaggcccagatagccgaactgaaaatgcagctcgcgaagaaagaagaagaactccaggccgcgcttgcccgactggacgacgagatagctcagaagaataatgctctgaagaagattcgcgaacttgaggggcatatctctgatcttcaagaggacctggacagtgagcgtgccgctcgaaataaagccgagaagcaaaagagagatctgggcgaagagctcgaggcccttaaaactgagctggaagacacactcgacagtaccgcaacccagcaagagctgcgagctaagcgggaacaggaagtgacagtcctcaaaaaggctctggatgaggagacccgctcccacgaagctcaggtacaggagatgcgtcagaaacatgctcaggccgtggaagaactgactgagcaactcgagcagttcaagcgcgccaaggccaacctggataagaataaacagacacttgagaaagagaatgcggacctcgctggagaactgcgggtgcttgggcaggcgaaacaggaggtagaacataaaaagaaaaagttggaggcacaggtccaggagctccaaagtaaatgcagcgatggcgagagagccagggccgagttgaatgacaaagtacacaaacttcagaacgaagtcgaatccgtcaccggaatgctgaatgaggctgagggcaaagctatcaaactggctaaggacgtggcctcactgagttcccagctgcaggatactcaggagctgctgcaggaggaaactaggcagaaacttaatgttagcacaaagctcagacagttagaagaggagagaaatagcctgcaagaccagcttgacgaggaaatggaggcaaaacagaacctagaacggcatatctccacacttaatatccaacttagcgacagcaagaagaagctgcaggattttgcatccacggtggaagccttggaagagggaaagaagcgcttccagaaggaaatcgagaatctgactcagcaatacgaggaaaaagctgcggcttacgataagcttgagaagacgaagaatcgccttcaacaggagctggacgatctggtggtggacctcgataatcaacgccaactggtgagcaacctcgagaaaaaacagagaaaatttgaccagcttctggccgaggaaaaaaatattagttctaagtacgctgacgaaagagatagagccgaagctgaggccagagagaaagaaaccaaagctctgtccctggcgcgcgcactggaggaagccctggaggctaaagaggaactggaaaggacgaacaagatgctaaaagctgagatggaggatctagtgtcttccaaggacgatgtggggaagaacgttcatgagctcgagaagtctaagagagcactagagacccagatggaggagatgaaaacacaactggaggaattggaggatgagctgcaggcaactgaagatgccaaacttaggctggaagtgaatatgcaggcccttaaggggcagttcgaacgcgaccttcaagctcgggacgagcagaatgaggagaaaaggcggcagctgcaaagacagttgcacgaatacgaaacagagctggaggacgagcgtaaacaaagagcccttgcagcggcggccaagaagaagcttgagggcgatttaaaagatctggagctccaagcagatagcgccatcaagggtcgggaggaggccatcaaacaactccggaagctacaggctcaaatgaaggactttcagcgcgaattagaggatgcccgggccagcagagacgagatcttcgctacggcaaaggagaatgaaaagaaggccaagtcccttgaagccgacctaatgcagctgcaagaagatctcgctgcagccgaaagggcccgcaaacaagccgacctcgagaaggaggagctggccgaagaactcgcatcatctttgagtggcagaaatgctctgcaggatgagaaaagacgcctagaggcccgcatcgctcagctggaggaggaacttgaggaagaacaggggaacatggaagccatgagcgacagagtaagaaaggcaactcagcaggccgagcagctgtcgaacgagcttgcaaccgaacggtcaactgcacagaaaaacgagagtgcgagacaacagctagagcggcagaataaggagctccgcagtaagttgcacgaaatggagggggcagtcaagtcgaagttcaaaagcaccattgccgcattggaagcaaagattgcacagctcgaggagcaggtcgagcaggaagcccgcgagaagcaagcagcaactaagtccttaaagcagaaggataaaaaactcaaggagatcttactccaggtcgaagacgagcgaaagatggccgaacagtacaaagagcaagccgagaaaggtaatgcacgagttaaacagctgaaaaggcagctggaggaggcggaggaggaatctcaacgaatcaacgcaaatcgtagaaaactgcagagggaattggacgaagccactgaatccaacgaagcaatgggacgcgaagtcaatgcgcttaagagtaagctgcgcaggggaaacgagacttccttcgtaccttcccgtagaagtggagggcgaagggtgatagagaatgcagatggctctgaggaagaaactgatacccgcgatgccgatttcaatggaaccaaggcgagcgaatag

SEQ ID NO: 196294 - DNA, 5838 bp, Artificial Sequence
  Description of Artificial Sequence: Synthetic coding sequence
atggcccagaagggccagctgagcgacgacgagaagttcctgttcgtggacaaaaactttattaattctcccgtcgcccaagccgactgggccgcgaaaagactggtgtgggtgccatcagaaaagcaaggttttgaagccgcttctataaaagaggagaagggagacgaagtggtggtcgaacttgttgaaaacgggaaaaaagttaccgtgggtaaggacgatatccagaagatgaatcccccgaagttttccaaggtggaggatatggccgaattaacttgtctcaatgaggcatcagttctccataatctgagagagcggtacttctctggtctgatttatacctatagcggactgttctgcgttgtcgtcaatccctataagcatctcccaatatactccgaaaagatcgtggacatgtataagggcaaaaagaggcacgagatgcctccccacatttacgccatcgcagacacagcatatcgaagcatgcttcaagatcgcgaggaccagagcattctatgtactggtgagtcaggcgcaggcaaaacggagaatacgaaaaaggtgattcaatacctcgctgtagttgcatcatcccacaagggcaaaaaggataccagcatcactcaagggccctcctttgcatacggcgagctggaaaagcagctgctccaggctaaccccatcctggaagcatttgggaacgctaaaactgtcaaaaatgataactcttctcgctttgggaaattcattcggatcaatttcgacgttactggctacatcgtaggagccaacatcgaaacttatctcctggaaaaatcaagggccatccgtcaggctagggatgagaggacctttcatatattctactatatgatcgctggagcaaaagaaaagatgcgtagcgaccttctgctcgaaggtttcaacaattacactttcttaagtaacggctttgtgcccatcccagctgcgcaggacgatgagatgtttcaagagaccgtcgaggctatggctatcatgggatttagcgaagaggaacaactgtccattctgaaagtggtgtcttcggtcctccagctgggaaatatcgtgttcaaaaaagagcgcaatacagatcaggcatcaatgccagacaacacagcagcacagaaggtgtgccacttaatgggtatcaatgtcaccgactttactcggagtatactcactcctagaatcaaggtgggccgggacgtagtccagaaagctcagaccaaggagcaggcagattttgcagttgaagcgctagcaaaagccacgtacgagcgcctgttccgctggattctaacccgggtgaataaagccctagacaagacacatcggcaaggagcatcttttttgggtatcttagacatagcaggcttcgaaatcttcgaggtgaactccttcgagcagctctgcatcaactacaccaacgagaaactgcaacagttatttaaccatacaatgttcatcttagagcaggaagagtaccagagagagggcattgaatggaacttcattgacttcggtctggatctgcaaccctgcatagaactgattgaacgacctaacaacccgcctggcgtgttagccctgctcgatgaagagtgctggttcccaaaggccacggataagagcttcgtggaaaagctgtgcacagaacaaggctcgcatcctaagtttcaaaaacctaagcagctgaaggataagaccgaattttctatcatccactacgctggtaaggtcgattacaacgcctcagcttggttgaccaaaaatatggatccattaaacgacaatgtgaccagtttattgaacgcctcctctgataagtttgtggccgacctgtggaaggatgtggatcggattgtcggcttggatcagatggcaaaaatgacagagtcatccctcccatccgcatctaagacgaagaaggggatgttcagaacggtaggccagctgtacaaggaacagcttggtaagctgatgactacgctgaggaacaccactcctaacttcgtgaggtgcattatccctaatcatgaaaaaagatccggcaagttggacgccttcctggtgctcgaacaattgcggtgtaacggggtgctcgaaggaataagaatttgtcgacagggtttccccaatagaatcgtttttcaggagttcaggcagagatatgaaatcctcgctgcaaatgccatccctaaaggatttatggatgggaagcaggcctgcatactcatgatcaaagcgctcgagctggaccccaacctgtatagaataggtcaatccaagatattctttagaaccggagtgctggcgcatctggaagaggagcgggatctaaagatcacggatgtgattatggctttccaggccatgtgtcgaggatacctcgccagaaaagccttcgcaaagagacagcagcagcttaccgccatgaaggtgatccagcggaactgcgctgcttatctaaaactgcgaaattggcaatggtggcgcttgttcaccaaagtgaagcctctcttgcaggtaacccgtcaggaggaggagatgcaggctaaggaggacgagctccagaagaccaaggaaagacagcagaaggcagaaaacgagcttaaggagctagaacagaaacacagccagctgactgaggaaaaaaacctcctccaggagcagttgcaggccgagacagaactctatgccgaagccgaagaaatgagagtaaggctggctgctaaaaaacaggaattggaagagatacttcacgagatggaagcccggctggaggaagaagaagaccggggacaacaactgcaggctgagcgcaaaaagatggctcagcaaatgttagacttggaggaacagttggaagaagaggaggctgctcgacagaagcttcaattggagaaggtgactgcagaggccaagattaagaaactcgaagacgagattctcgtcatggacgatcaaaacaataagctgtccaaagaaaggaagctgcttgaggaacgcatctctgatctgacaacaaatctggccgaagaagaagaaaaggccaagaatctaacaaagctgaaaaacaagcacgagtccatgatctctgagttagaggttcgcctgaagaaggaggaaaagtcaaggcaggagctcgaaaagctgaagcggaaactggagggagacgcgtctgattttcacgaacagatagccgacctgcaagcccaaatcgctgagctcaagatgcagttggccaagaaggaggaagagctgcaggctgcattggcacgtcttgacgacgaaattgctcagaagaacaacgccctgaaaaagattcgagaactggagggacacatatccgatctgcaggaggaccttgattcagagcgggccgcccgtaataaagccgagaagcagaaacgcgacctgggcgaggaactggaggctctgaagacagaattagaagacactctggatagcacggctacccagcaggaactgcgggccaagagagaacaggaagtgacggtgcttaaaaaagctctggatgaggagactaggtcccatgaggctcaggtgcaggagatgcgccaaaagcacgcccaggcagtagaggagctgactgagcagcttgagcagtttaaacgagccaaggccaacttggacaagaacaagcagaccctggaaaaggaaaatgcagatctcgcgggcgagctgagagtgcttggtcaagccaagcaagaggtcgaacataagaagaagaaattggaagcccaggtgcaagaactccagagtaaatgctcagatggagagcgcgcacgggctgaactaaatgataaggtacataaactgcagaatgaggtagaaagtgtcaccgggatgctcaacgaggctgagggtaaggccataaagcttgcaaaggatgtggcctctctcagctcccaattacaggatacacaggagcttctgcaagaagagacccgacagaagctgaatgtcagcaccaaactacgacaattagaggaagagcgaaactcgctacaggaccagctggacgaggaaatggaagccaagcaaaatctggaaagacatatatccacactgaatattcaactgtcagactcaaaaaaaaagctgcaagatttcgcttctaccgtcgaagctctagaggaagggaagaagcgctttcagaaagaaattgagaacttgacccaacagtatgaagaaaaggctgctgcatacgacaagctcgaaaaaactaaaaaccggctacagcaggagctggatgatctcgttgttgatctggacaaccagcggcagctggtctcaaacctggagaaaaagcagcgtaagttcgaccagctcctggcagaagagaaaaatatctcttccaaatacgccgacgaaagggaccgagccgaggccgaggcgcgcgaaaaagagactaaggctctgtcactagcccgcgcccttgaagaggccctggaggctaaagaggagctcgaacgaacaaataagatgctgaaagcggagatggaggatctggtttctagtaaagatgacgtcggcaaaaacgtgcacgagttggagaagtctaagcgcgcgctcgagactcagatggaagaaatgaagacacagctcgaagagttggaggacgagttgcaggctacagaggacgccaaactccgactggaagtaaatatgcaggctcttaaggggcagttcgagagggatctgcaagcaagagacgagcagaacgaagagaagcgcagacagttgcagcgacaactccatgaatacgagaccgaactggaggatgaaaggaagcaaagagctctcgccgcagcagctaagaaaaaactcgaaggagaccttaaagacctggagttgcaggctgattccgccataaaaggcagggaagaggcgatcaagcagctgaggaaactccaggctcaaatgaaagatttccagcgggaactggaagacgcaagggcctcacgggatgaaatctttgctactgctaaagaaaacgaaaagaaggcaaaaagtttagaggccgatcttatgcagctacaggaagaccttgcagccgcggagcgggcgaggaaacaggcagacctcgagaaggaagaacttgctgaagagctagcgtcttcactcagcgggagaaacgcacttcaggatgaaaaacgtagactggaagcccgcatcgcacaactggaagaagagttggaggaggaacagggcaacatggaagccatgtcggacagggttcggaaggccacacagcaagctgaacagctcagcaacgagttggccacagagaggagcactgcacaaaaaaatgagtctgccaggcagcagctggaaagacagaacaaggagttgcgcagtaaactccacgagatggaaggcgcagtcaagtccaagtttaagagcaccattgccgcgctcgaggcaaaaatagctcagcttgaagagcaggtggagcaggaagctcgggagaagcaagcggctactaaatcactgaaacagaaggacaaaaagttgaaagaaattttgctccaggtcgaggatgagagaaagatggcagaacagtacaaagagcaggccgaaaagggtaacgccagagtcaagcagctaaagcgacagctcgaggaggccgaagaggagtcacaacggataaacgcgaacagacgcaagttgcaaagagagcttgatgaggctactgagtccaatgaggcgatggggagagaagtgaatgctctcaagagcaaattgcggggtcctccaccacaggagacgtcacagtag

SEQ ID NO: 196295 - DNA, 5817 bp, Artificial Sequence
  Description of Artificial Sequence: Synthetic coding sequence
atgagcagcgacgccgagatggccatcttcggcgaggccgccccctacctgcggaagcctgagaaagaaagaattgaggctcaaaatcgcccattcgactcaaagaaagcttgctttgtagctgacaacaaggagatgtacgtgaagggaatgattcaaacacgagagaatgacaaagtgatcgtgaaaacccttgatgataggatgctgacgcttaacaatgatcaggtctttccgatgaaccctcctaaattcgataaaatagaggatatggccatgatgacgcatctgcatgagccagccgtactctacaatcttaaggaacgttatgcagcctggatgatctatacatacagtggactgttctgcgttaccgtaaatccttacaagtggctccctgtttacaaaccagaggtcgtggccgcctataggggaaaaaagcgccaggaagcacctccacatatcttttctatctcagacaatgcatatcaattcatgctcaccgaccgggacaaccaatcaatcctaataaccggcgaaagcggcgctggcaagactgtcaacacaaagcgggtgatacaatacttcgccactattgctgtcaccggagacaaaaagaaggagacacagccggggaagatgcagggaacactggaagatcagatcattcaggcaaaccccttactggaagctttcggtaacgccaagacagtgagaaacgataacagcagccgcttcggcaagtttattcgtattcacttcggagctacaggcaaattggcctcggccgatatagaaacttacctgctcgaaaagtctcgcgtgacctttcagctttctagcgagagatcttatcatatcttttaccagattatgagtaataaaaaaccggagctgatagatctcttgttgatcagtaccaacccttttgatttcccatttgtcagccagggcgaagtcacagtagctagcattgatgactctgaggagttgctggccacagacaatgccatagatattttaggattttctagcgaggagaaagtgggtatatacaagctcactggcgctgtgatgcattatggaaatatgaaattcaaacagaagcagagggaggaacaggctgaacctgacggtaccgaggtggccgacaaagccgggtatctaatgggacttaatagtgccgagatgctgaaggggctgtgttgcccacgggtcaaagtgggcaatgagtacgtgaccaaggggcagaacgtgcagcaagttactaatagcgtgggtgcactcgccaaggccgtatacgagaaaatgttcttgtggatggtgacacgaatcaaccaacagttggataccaaacaaccaagacaatacttcattggagtactcgatatcgccggtttcgagatcttcgacttcaactccctcgaacagttatgtatcaactttacgaatgagaaattgcagcagttctttaaccatcacatgtttgtactggagcaagaggagtataagaaggaaggaattgagtgggagttcatcgacttcgggatggatctggcagcatgcatcgagctgattgaaaagcccatggggattttcagtatactagaggaggagtgtatgtttccaaaggctaccgacacttccttcaagaacaaactgtacgaccaacacctcggcaagtccaataatttccagaaaccaaagccggccaagggtaaagcggaagcccattttagcctcgttcactatgcaggaacagtggattacaacattgccggctggctggacaagaacaaagacccactcaacgagacagtagtgggcctctaccagaaaagctcgctgaaattattgagtttcttattttccaactatgcgggggccgagactggtgactctgggggaagcaaaaagggtggcaagaaaaagggcagcagcttccagaccgtcagcgccgtttttagagagaatctgaataagctcatgaccaacctgagatccactcacccccatttcgtgagatgcctgatccctaacgagacgaagactcctggtgtaatggatcactacctggtgatgcatcagttgcgttgcaatggggtgctcgaagggatccggatttgcagaaaaggattcccttcccgcatcctgtacgcagattttaaacaacgctatcgtatccttaacgcctcagctatccccgagggccagttcattgactctaaaaacgccagtgaaaagcttcttaactcgattgacgttgatagagagcagttcagatttgggaacacaaaggtgttcttcaaggcagggcttctgggcttgctggaggagatgagggatgagaaattagtcactctgatgacatcgacgcaggccgtgtgccggggttacctcatgagggtggaattcaagaaaatgatggagcgtcgtgattctattttttgtatccagtacaatataagatctttcatgaacgttaaacattggccctggatgaacttgttctttaaaataaagccacttttgaaatctgccgaggccgaaaaggaaatggctacaatgaaagaggactttgagcggacaaaggaagagctcgctaggtcagaagcacgccgtaaagagctggaggagaagatggtgtccctgttgcaggagaagaacgatctccagctacaggtgcagagtgagactgagaatctcatggacgcggaggaacgttgcgaagggctcatcaaaagtaagattttgctggaagctaaagtgaaggaactgaccgaacggctcgaggaagaggaagagatgaacagcgagctggtagctaaaaagcgcaacctggaggacaaatgtagtagtctgaagcgagacatagatgacttggagttaacactgacgaaagtggagaaggagaagcacgctaccgagaacaaggtgaaaaatctgagcgaagaaatgaccgcactggaagagaatatatcaaagctgaccaaagaaaaaaaaagcctgcaggaggcccaccagcagaccctggatgatctgcaggtcgaagaagataaggtgaacgggctgatcaaaataaatgcaaagctggaacagcaaactgatgacttagaggggagcctggagcaagaaaaaaagctgagagctgacttagaaagagcaaaaagaaagctggagggggacctgaaaatgtcacaggagtccatcatggatctggaaaatgataagcagcaaatagaggaaaagctcaagaaaaaggaattcgagctgtcccaactccaggcgaagattgacgatgagcaggtccactccctgcaattccaaaaaaagattaaggagctgcaggcacggatcgaagagctcgaggaagagatcgaggccgaacacacgctgcgggccaagattgaaaaacaaagaagtgacctggctagggaacttgaggagatcagtgagcgcttagaggaagctagcggcgcaacatcggctcaaatagaaatgaataaaaagagagaggccgaattccagaagatgaggagagacctagaagaagctaccctgcagcacgaggcgacagcggccaccctgcgcaaaaagcaagcagattctgtggcagaacttggcgagcagatagataatcttcaacgcgtgaaacagaagctggagaaagaaaagagcgaactgaaaatggagatcgacgacatggcaagcaatatcgaggcccttagtaagagtaagtccaatatagagagaacatgcagaaccgtggaagaccagttctctgaaatcaaagccaaagacgagcagcagacccaactgatacacgatttgaatatgcagaaggcgcgtctccagacccagaacggagaactatcacatagggtcgaagagaaagaatccctgatcagtcagctcactaaatcaaaacaagctctgactcagcaattagaagaactgaaacgccagatggaggaagagacaaaggcaaagaacgcaatggctcacgctctgcagtccagccggcatgattgtgacctgctgagggagcagtatgaagaagaacaggaggctaaagcagagctgcagagagccttgtccaaagctaactcagaagtcgcccagtggaggacgaagtatgaaacggatgcaattcagaggaccgaggagctggaggaggcaaagaagaagctggcacaacgtctgcaggaagccgaggagaacaccgaaaccgctaacagtaagtgcgcatcccttgagaagacgaagcagcgccttcagggggaagtggaggacctgatgagagacttggagaggtcacatacagcctgtgcaaccctggacaagaaacagcggaactttgacaaggtgcttgcagaatggaagcagaagcttgatgaatcgcaggccgagctggaggccgcccaaaaagagagtagaagtctctccactgagcttttcaaaatgaggaatgcatatgaggaggtcgttgatcagctggagacgttgcggagagaaaataagaatttacaggaagaaatttctgatctcactgagcagattgccgagaccggaaagaacttgcaggaggcggaaaaaacaaagaaactggtggagcaggagaaatccgatttgcaggttgcgctggaagaggtggaaggttctctcgagcacgaagaatcgaagattctccgggtgcaactggaattaagtcaggtgaagtcagaattagatcggaaggtcattgagaaggatgaagagatcgagcagttaaagcggaattctcaaagggcagctgaggccctgcaaagtgtcttggatgccgaaattagaagccggaacgacgctctcagattaaagaaaaagatggagggtgaccttaatgaaatggaaatacaactggggcacagcaatcggcaaatggcggagacacagaaacaccttcgtaccgtccaaggacagctgaaggacagccagctgcacctcgatgatgctctgcggtctaatgaagatctaaaagagcagcttgccatcgtggagaggcgtaacggattgctgctcgaggagctggaagaaatgaaggttgccctcgagcagaccgaacgcactcgcaggctgtctgaacaggagctgctagacgccagtgatagggtccagctcctccatagccagaatacttcacttattaataccaagaaaaagctggaagctgatattgctcagtgtcaggctgaggttgagaacagtattcaagagtcacgaaatgccgaggagaaagccaagaaagcaatcacagacgcagccatgatggcagaggagctcaagaaagaacaagatacaagcgcccatctcgagcggatgaagaagaatcttgagcagactgtgaaggacctccagcaccggttggatgaggccgagcagctagcgctcaaaggggggaaaaaacagatacagaagctagagaatcgcgtgagagagctcgagaacgagcttgatgtggagcagaaacgtggcgctgaggccctgaagggcgctcacaaatacgagcgtaaggttaaggagatgacataccaagcagaggaggatcacaagaacatactcagacttcaggacctagtggataagctacaggccaaggtaaagagctacaagaggcaggctgaagaagccgaggagcaagctaacacacaactctcccgctgtaggcgggttcagcatgagctggaagaggccgctgagcgggccgacatcgccgagagccaggtgaataagctacgtgccaaatccagggatgtgggaagtcagaaaatggaggagtag

SEQ ID NO: 196296 - DNA, 2001 bp, Artificial Sequence
  Description of Artificial Sequence: Synthetic coding sequence
atgctgagccacatgctgtacaagaaggagaacgccatcgacatcttaggatttagtagcgaagagaaagtcggcatttacaaactgacgggcgctgtcatgcattacgggaacatgaaatttaagcagaaacagcgggaagaacaagcagagccagacggcaccgaggtggccgataaagccggatatcttatggggttaaacagcgcagaaatgctcaaaggactatgctgcccgagggtcaaggtggggaacgagtacgtaaccaaaggtcagaacgtgcagcaggtcactaacagtgttggcgctctggctaaggcagtctatgaaaagatgttcctatggatggtgacacgtattaatcagcagctggacacaaagcagcctcggcaatacttcatcggcgtgctggacatcgcaggcttcgaaatttttgactttaactcgctggaacagttgtgtatcaattttaccaacgagaagctacagcagttttttaatcatcacatgtttgtcttggagcaggaagagtacaagaaagaaggtatcgaatgggaatttatcgacttcggaatggatctggcagcctgcattgaactgattgagaaacccatgggtattttcagcattctcgaagaggagtgcatgtttcccaaggctaccgacactagtttcaagaataagctgtatgatcagcacctaggtaaatccaataacttccaaaagcccaaaccggccaagggcaaagcagaagcccacttctcacttgtgcattatgcgggcacagttgattataacatcgcaggatggctcgacaagaacaaagatcccctgaacgagaccgtagtggggctctaccaaaaatccagcttgaaactgctttcctttctattcagcaactacgccggcgcagaaactggcgactcgggggggtctaaaaagggcggaaaaaagaaaggcagcagttttcaaacagtaagcgctgtcttcagagagaacttgaataaactcatgaccaatctccgaagcacacacccacactttgtgcggtgtctaattcccaatgaaaccaaaacaccgggcgttatggatcattatcttgtgatgcatcaactgagatgcaatggagtgttggaaggcatccggatttgcaggaagggcttcccatcacgcatattatacgctgacttcaagcagcgataccggatactaaacgccagcgctattccggaaggacagttcattgattcaaagaatgcatccgaaaagttgctgaacagcatcgatgtggacagggaacagttccggttcggaaacaccaaggtgttctttaaagcggggttgctagggctcttggaggaaatgcgcgacgagaagctggttacactgatgactagcacacaggccgtgtgtaggggatacctgatgagggtggaattcaaaaagatgatggagagacgggattctatcttttgcatccaatacaatatcagatctttcatgaatgttaagcactggccgtggatgaatctgtttttcaaaatcaaacccctattaaaatccgcagaggcagaaaaggagatggcaacgatgaaagaggacttcgaacgtacgaaagaagagttagccaggtcggaagccagacgtaaggagcttaccgaaagactcgaagaggaagaagaaatgaactctgaactggtggccaagaaacgaaatctcgaggacaagtgttcaagtctcaagcgcgatatcgatgatcttgagctcactctgaccaaggtggaaaaagagaagcacgccaccgagaataaagtgaaaaacttgagtgaagagatgacagccctggaggaaaatatttcgaaattaactaaggagaaaaagagtcttcaggaagcacatcagcagactctcgatgacctgcaggtagaggaggataaagtgaacgggctgataaaaattaacgctaaactggagcaacagacggacgacgagggcgtttag

SEQ ID NO: 196297 - DNA, 6111 bp, Artificial Sequence
  Description of Artificial Sequence: Synthetic coding sequence
atggccgccgtgaccatgagcgtgcccggccggaaggcccccccccgcccaggaccggttcctgaggcggcacagcccttcctcttcactccgagaggcccctcagctggcggtggaccgggctcaggcacaagtccgcaggtcgagtggaccgcacgaaggttagtatgggtgccaagcgagctgcatggctttgaagccgccgccttaagggatgagggggaggaggaggctgaggtggagctggcagagagtgggagaagactaaggttacctcgggatcaaattcagaggatgaacccccctaaattctctaaggccgaggacatggctgagttgacctgtctcaacgaagcgagcgtgttacacaacttgcgagagcgatactatagtgggctgatttacacttacagtggactattctgcgtcgtcatcaatccctacaagcaactgccaatttatactgaagccatagtggagatgtaccgtggaaagaagaggcacgaagtgccgcctcacgtgtacgcagtgactgagggggcgtatcgcagtatgctgcaggaccgtgaagaccagtctattctgtgcaccggggagtcaggggcaggaaaaacagaaaataccaagaaggtcattcaatacctggcccacgttgcgagcagcccaaaaggacgaaaagaacctggtgtgcctgcgtctgtttctactgttagctacggtgaactggaaaggcagcttctccaggccaacccaatcctggaggccttcgggaatgcgaaaaccgtaaaaaatgacaattcatctagatttggcaaatttattcggatcaatttcgatgtggccgggtacatcgtgggagccaacatcgaaacgtaccttttggaaaagtccagagctattcgacaggccaaggacgaatgctcatttcacatcttctaccagcttctgggcggagccggagagcagttaaaggcagacttattactcgagccctgcagccattaccggtttctcacaaacggcccaagttccagtcccggtcaggagagggagctttttcaggaaaccttggagtccctgcgcgtcctcggattctcccacgaggaaatcatatctatgctgcggatggtctctgcggtgctacagtttgggaatatcgctcttaaacgggagagaaacaccgaccaggcgaccatgcccgataacaccgcagcccagaagttgtgccgattgctgggcctgggtgtgaccgacttctcaagggccctcctgactccccgcataaaagtgggccgggactacgttcagaaagcccagactaaagaacaggccgatttcgcactggaagcgctagcaaaggcgacctacgaaagactgttccgctggttagtcctgagactcaacagggccctggatagatcgccccgccagggcgccagtttccttggcatcttggacatcgcaggtttcgagatcttccagctgaactcattcgagcagctctgcataaactatacgaatgaaaaactgcagcagctattcaatcacacaatgttcgtgctagagcaagaggagtatcagagggaagggattccgtggacattcctggattttggcttagatctgcagccatgtatagatctgatcgagagaccggctaacccccccggcctgctagctttgttggatgaggagtgctggttccctaaggccactgacaagagttttgtagagaaggtggcccaggaacaggggggccatcctaagttccaacgaccccggcatctgagagaccaggctgactttagcgtcttgcattacgccggaaaagttgactacaaggctaacgagtggctgatgaaaaacatggaccctctgaatgataatgttgctgctctgctgcaccagtcaaccgataggctaacagcagaaatctggaaggatgaacacggcgggttccaacagtttagttttttggggtccttcccgccatctccaccgggtagcgctgagcggtgctccagcgccatctccccacctggagtcgaagggatcgtgggcctggaacaggtgtcatctttgggcgacggaccacccggtggtaggcctagacgcgggatgttccggacagtgggccagctgtacaaagaaagcctgagccggctgatggcaacactgagcaacaccaatccctccttcgtccgttgcatagtccccaaccatgagaagagggctggaaagcttgagcccagactggttctagaccaacttagatgtaatggagttcttgaaggcattagaatctgcagacaggggttcccaaaccgaattctgtttcaggagttcaggcaaaggtacgagattctcacccccaatgcaatccctaagggatttatggacgggaagcaggcctgcgagaagatgattcaggcactggagctcgaccccaacctctatagggtgggacagagcaagatcttcttccgcgccggagtcctggctcagctggaggaggaacgggatctcaaagtcactgatattattgtgtcgtttcaggccgccgccaggggttacctggcccgtcgtgcctttcagaaacgccagcagcagcagtcggctctaagggtgatgcagcggaattgcgccgcttacctgaaactgagacattggcaatggtggcgcctgttcactaaggtaaaaccgctgttgcaggtcaccagacaggatgaagtgttacaggccagagcgcaggagctccagaaagtccaagaactgcaacagcaatcagctagagaggtcggcgaactgcagggcagagttgcacaactggaggaagaaagggcccgcctggcagagcagttgcgcgctgaggctgagctatgtgcggaggctgaagaaacccgaggacgccttgcagcgcgaaaacaagaactggagcttgttgtatctgagctcgaagcgcgggtgggagaggaagaagagtgcagtcgccagatgcaaaccgagaaaaaacgcctccagcagcacatccaagagctggaggcgcaccttgaggccgaggagggggctaggcagaaactgcagctcgagaaagtcacaaccgaggctaagatgaagaagtttgaagaagacttactgctccttgaggaccaaaattctaagctttccaaggaacggaaattgttagaagaccgcctggcagaattcagtagccaggccgcagaagaagaggaaaaggtaaagtctctcaataagctccgcctgaaatatgaggccacaatcgctgacatggaagaccggttaagaaaggaagagaagggaagacaggaactcgagaagctcaagagacgcctagacggtgaaagcagcgagctgcaagagcaaatggtggaacagcagcaaagggcggaagagttaagagcacagttaggtcgcaaagaagaggaactccaagctgccttggcaagagctgaagacgaaggcggcgcaagagctcaactgcttaagtcattacgggaggcacaggccgccctggcggaggcgcaggaggacttagaaagcgaaagagtggcccggactaaagcagaaaagcaaagacgggaccttggggaggaactcgaagctctgagaggggagcttgaggatacactcgactccactaacgcccagcaagaattgcgatctaaacgcgaacaggaggtgaccgaacttaagaaaacactagaggaggagacccggatccacgaggccgcggtgcaggagctcagacagcgccacggacaggccctgggtgagttggcagaacaactagaacaagcaagaagagggaagggtgcttgggaaaagacaaggcttgcactcgaagcagaggtgtctgaacttcgagccgaactttccagtctccagactgctcgacaggagggcgagcagcggcgccgccgcttggaactgcaattacaggaagtacagggacgagctggagatggcgagagagcccgagcggaggcggctgaaaaactccagagagcgcaagccgagttagagaatgtgagcggggccctcaatgaagcagaatcaaaaactatacggcttagcaaggaactgagctcaactgaagcccagctccacgacgcccaggaactgctccaggaagagaccagggccaagctggcccttgggagtcgggtgcgcgccatggaagccgaggcggccggcttgagagaacagttagaagaagaagccgcagctagagagcgcgctggcagagagctccaaaccgctcaggctcaacttagcgagtggcgacggagacaggaggaggaggcgggagccctcgaagcaggcgaggaagcaaggcgacgcgcagcccgggaagctgaggccctaacccagaggttagcggaaaagaccgagaccgtcgatagactcgagagaggtaggagacgactgcagcaggagctagacgatgccactatggacctagagcagcagcgacagctggtgtccacgctggagaaaaaacagagaaagtttgaccagttgctcgcagaagaaaaagccgcagtattgcgtgcggtagaggagcgcgaaagggccgaagccgagggacgcgagcgggaagcacgagccctctctctgacgagagctctggaggaagaacaagaggcacgcgaggagcttgagcgccaaaaccgagccctgagggccgaattggaggcgctcctcagttccaaagacgacgtcgggaagagtgtccacgaattagagagggcttgtcgtgtggcggaacaggcggcaaatgacctgagggcacaggtgactgagctggaggacgagctcaccgccgctgaggatgcaaagctgaggcttgaagttacagttcaggccctcaagacccagcacgagcgcgatctccaggggagggatgaggccggcgaagaacgccgacggcagttagcaaagcagctgcgggatgccgaagttgagagagatgaagaacgcaagcagcgaacgctcgcagttgctgcacgcaaaaagttagaaggcgagctagaggaactgaaggcgcagatggcgtccgcggggcaagggaaagaggaggcagtgaagcagctccggaaaatgcaggcccaaatgaaagaactgtggagggaggtcgaagagactaggacctctcgggaagagatcttctctcaaaacagggaaagcgagaaacgccttaaaggcctagaggccgaggtcctccgcctccaggaagagctggcggcctccgatagggcgcgtcgacaggctcagcaggacagggatgaaatggcagatgaagtggctaatgggaatctatctaaggcagcaatccttgaggaaaagaggcaattagaaggcaggttgggtcagctggaggaggagctggaggaagagcagtcgaactcagagttactaaacgaccggtataggaagctgttgctgcaggtagagagcctaacaactgagttatccgcagaaagatcttttagtgctaaggcagaatccggcaggcagcagcttgaaaggcagattcaggaattgcgcggcaggttgggggaggaagatgctggagcacgcgctcgacataagatgacaattgccgcactagagtccaagttagctcaggccgaggagcagctggagcaagagactagagagcggattttgagcggaaaactggtccgccgtgctgagaagcgattgaaagaagttgtgcttcaagtagaggaagaaaggagagtcgcagatcagttaagagaccagttagagaaagggaatctgcgggtcaagcagctgaagcgccaattggaagaggcagaagaggaggcttccagagctcaggctggacgacgacgactgcagcgggagctggaggacgtcaccgagtccgccgagagcatgaacagagaagtgactactctacgcaaccggcttaggcggggtccccttacattcactacgcgaacagtcagacaggtattcaggcttgaagagggcgtggcctctgatgaggaagctgaagaagcccagcccggttccggaccctcgcctgagccggaagggagtccccctgcccacccacagtag

SEQ ID NO: 196298 - DNA, 4437 bp, Artificial Sequence
  Description of Artificial Sequence: Synthetic coding sequence
atggccgccgtgaccatgagcgtgcccggccggaaggcccccccccggccgggccccgttccagaggctgctcagcctttcctgtttactccaaggggtccgtcggccgggggcggaccagggtccggcacctctcctcaggtggagtggaccgccaggcgcctggtctgggtgccttctgaactgcacggtttcgaagcagcggctctacgagacgaaggtgaggaggaggcagaggtcgagcttgcagagtctggacgccgtctgcggctcccccgtgatcaaatccagcggatgaaccccccaaagttttctaaagccgaagatatggctgagcttacctgcttaaatgaagcctccgtgcttcacaacctgcgtgagcgctactatagcgggcttatttacacgtattctggcttgttctgcgtcgtgattaacccttataagcaacttcccatttatacggaagccatcgttgagatgtaccgtgggaaaaagcgccatgaggtgccccctcatgtgtacgcagtcacagaaggtgcctaccggtctatgttacaggacagagaggatcagtccattctctgtactggcgagtctggagcaggcaagaccgagaatacaaagaaggtgatccagtacctggcccacgtcgcctcatctccgaaagggagaaaagagcctggagtccccggtgaactggagaggcaactccttcaagccaatccaatccttgaggcatttgggaacgcaaagaccgtaaaaaatgacaacagctccagattcgggaaatttattaggatcaatttcgacgtagccgggtacattgtaggcgccaatattgaaacatatctgttggaaaaaagtcgcgccatacggcaagctaaggatgaatgctcgttccatatcttctatcaactgttgggaggggccggggaacaactaaaagctgatctcctactcgaaccctgtagccactaccgctttttgacaaacggtccgtcttcgagtccgggacaggaacgcgagttattccaggaaactctcgaatcgcttcgagttctggggtttagtcacgaggagatcatttcaatgcttagaatggtgtcagctgttctgcagtttggcaacatcgccctcaagagggaacgcaacactgaccaggcgaccatgccagacaatacagctgctcagaaattatgcagacttctgggcttgggggtcacagatttcagccgggccctgcttacacccagaatcaaagtgggaagagactatgtgcagaaggcccagactaaagagcaggcggactttgccctggaggcgttagctaaggccacctacgaaaggctgttccgatggttggttttgcgcctgaacagagcactggaccgatcccctcgtcaaggggccagtttcctaggaatactggatattgctgggtttgagatttttcaactcaactctttcgaacaactctgtattaactatacaaatgaaaaactgcagcagttgtttaatcatactatgtttgtactggagcaggaagagtatcaacgagaaggtattccatggacattccttgacttcggactggacctgcaaccatgcatagacctgatcgagcgacccgccaatcctcctgggctactagcccttctggatgaggaatgttggtttccgaaggcaaccgataaatcattcgtcgagaaggtggcccaggagcagggcggtcacccaaagttccagcggccaagacacttacgggaccaggccgatttttcggtattacactatgctgggaaggtggattacaaggctaacgagtggctaatgaaaaatatggaccctttgaacgacaatgtggccgcactcttacatcagagcaccgaccgcctgacagcagaaatttggaaggacgttgagggaatcgtgggactggagcaggttagctctttgggcgatggacctcctggaggcaggcccaggcggggaatgtttcggactgttggacagctgtacaaagaaagtctgagtaggctgatggcaacattgagtaataccaatccaagctttgtacggtgcattgttcctaaccatgagaagcgggccggtaagctggaacctcgactcgtgcttgatcaactccgctgcaatggggtgttagaaggcattagaatctgcagacagggctttccaaatcggatcctgttccaggagttccgacagaggtatgagattctcacgcccaacgctattcctaaaggctttatggatggcaagcaggcatgcgagaagatgattcaggccctcgaattagatcctaacctgtatcgcgtgggacagtcaaagatcttcttcagggccggggtgcttgcgcagctcgaagaggagagggacttgaaagttactgacattatagtgtccttccaggccgccgctcgagggtatctcgctagacgcgcctttcagaagaggcaacagcagcaaagtgccctgagagtgatgcagaggaactgcgcggcctatctgaaactgcgtcactggcagtggtggcggctattcactaaagttaaacctttactgcaggttacgagacaggatgaggtccttcaggctcgggctcaggaactccaaaaagtacaagaactccagcagcagtccgctagagaagtaggagaactgcaaggcagagtcgcccagctggaagaggagagagctcgcctcgctgagcaactgcgggctgaggcagagctctgcgccgaggctgaggagacacggggccggttagcagcgcgcaagcaggagctcgaattggttgtgagcgaactggaggcacgggtgggggaggaagaggagtgtagtcgccagatgcagactgaaaaaaagaggttacagcagcacattcaggagctcgaggctcatctcgaggctgaggagggagctcgccaaaaactccaactcgagaaagtaacgactgaggcaaagatgaaaaagtttgaagaagacctgctgttgctcgaggatcagaattccaaactcagcaagtccggctcttgttggaaaatcgtatggcccagtagccaccccaggcagctgcgtaggaggaggcgttctcgggcaagtatttcatacgggtctaacatgcggccccaatctcagacctggagagacaggctgagaaaagaagagaagggccgccaagagctggagaaactcaaaagacgtctcgacggggagtcatccgagctccaggaacagatggttgagcagcagcagagagccgaagagcttcgcgcacagcttggaaggaaggaagaagaactccaggctgcactggcccgggctgaggacgaaggcggtgctagggcccagttactaaaatcgctccgagaggcccaggccgccttggccgaggcacaggaggacctcgaaagcgagagggttgccaggacaaaggctgagaagcagcgaagggatcttggagaagagctggaggctcttcggggagaactggaggataccctggactccactaatgcccagcaggaattgagaagcaagcgggagcaggaagtaacggaactgaagaaaactcttgaagaggaaacacggatccatgaagctgcagtgcaagaacttcgacagcgccacgggcaggcacttggtgagttggcagagcagctcgagcaggcaagaaggggcaagggagcatgggagaagacccggttggccctggaagcggaggtatcggaactccgagcagagctcagtagcctgcagaccgcgcggcaagagggtgaacagagaaggaggaggctcgagctacagctccaagaggtccagggaagggcaggcgatggtgagagagcccgggcagaagctgctgagaaactccagcgggctcaagccgagctcgagaacgtgagcggtgccctgaatgaggcagagtcaaagacaatccgcctgtcaaaggagctgagcagcaccgaggcgcaactgcacgacgcccaggaacttctgcaggaggagactcgggccaagctggcactagggtcccgtgtgcgcgcaatggaggctgaggccgccggactaagggagcagctggaagaagaggctgccgcccgcgagcgggccggtcgcgaactgcaaacagcccaagcacagctttccgagtggcgccgacgacaggaggaggaagcaggcgctctggaggctggtgaggaggcccgcaggcgcgctgctcgcgaggctgaggcacttacacagagactggctgagaagacagagaccgtcgatagactggaacgaggacgacgccgcctgcagcaggaactcgatgatgccaccctgtcacctgatgccctcacagatggggcgcagccaccctccagcctggatcccactggaccatgcccacggaatcccgcgttatag

SEQ ID NO: 196299 - DNA, 5340 bp, Artificial Sequence
  Description of Artificial Sequence: Synthetic coding sequence
atggccgccgtgaccatgagcgtgcccggccggaaggccccccccaggcccggaccagtcccggaagctgcccagccattcctgttcaccccaagaggcccatctgcgggcgggggccccggctccggcacatctccgcaggtggagtggacggcccgcaggttggtatgggtgccatctgagcttcatggattcgaggctgccgctctcagagatgagggcgaagaggaagctgaggttgagctggccgagagcggaaggcgcctgaggctgcctcgcgaccagatacagagaatgaacccccctaagttctccaaagcagaagatatggcagaactcacatgtttgaacgaagcatccgtccttcataatctgagggaacggtactacagcgggctcatctacacttatagtggtctgttttgcgtggtcatcaacccttacaagcagctacccatctacacggaagccatcgtggaaatgtatagaggcaagaaaagacatgaggtgcctccccatgtgtacgcagtgaccgagggagcttacagatctatgctgcaggatagggaagatcagtcaatattatgcacgggcgagagtggcgcaggcaagactgagaacacgaaaaaggtgatccagtatctagctcatgttgcttcttcgccaaaaggccgaaaggaacctggggtgcctggggagctcgaaaggcagcttctccaggcgaaccccattttagaggcattcggcaatgccaaaaccgtaaagaacgacaactccagcagatttggcaagtttatccgtatcaacttcgacgtcgcaggatacattgttggggccaatatcgaaacatacctgctggagaaaagccgtgctataaggcaggcaaaggacgagtgctccttccacatcttctatcaactgctggggggcgccggagaacagctgaaggccgacctgctcttggagccctgcagccactacagatttctcacaaatggcccttcatccagtccgggacaagaacgagagctatttcaggaaaccctggaatcacttagagttctcggcttctcacacgaggaaattatctctatgctaaggatggtgtccgcagtcctccagttcggaaatattgccctcaagagggagcggaacacggatcaggccacaatgccggacaacacagctgcccagaagttgtgccggctgctgggattgggtgtgaccgatttctcccgggcattgctcacgccccgtattaaggtgggcagagactacgtgcagaaagctcagacgaaggaacaggcggattttgccctggaggctctggcaaaggccacctatgaaagactgttccgatggttagttctgaggcttaaccgtgctctggacaggtccccacggcagggggcctccttcctgggaatattagacatcgccggatttgaaatcttccagttgaacagcttcgaacagttatgtattaactacaccaacgagaagctccaacagcttttcaatcataccatgtttgtacttgaacaggaggaataccagagagagggcattccctggaccttcttagacttcggtctggacctgcaaccttgtatcgacctcatagaacgccctgccaatccacctggcctccttgcgcttctcgacgaagagtgctggtttcccaaggctacagataagtctttcgttgaaaaggtggctcaggagcaggggggccaccctaagtttcaaaggccacgccacctgcgtgatcaagccgatttctctgtgctccactatgccggaaaggtagactacaaagccaacgagtggttgatgaagaatatggatcctctcaacgataatgtcgctgcactcttacatcaatcgactgaccgactgacggctgaaatatggaaggacgtggaggggatcgtaggactagagcaggtctcttcactgggcgacggaccaccagggggtcgtccgaggcgaggaatgtttcgaacagtggggcagctttataaagagtcattatcaaggctcatggcgactctgagtaacaccaatccctcttttgtccgctgtatcgtgcccaatcatgaaaaacgcgccgggaaactggagcccagattggtactcgaccagctcagatgtaatggcgttcttgaaggaatccgcatctgcagacagggtttcccaaaccgcatactctttcaagagttcaggcagcgttatgagatccttacccccaatgcgattccaaagggcttcatggacggtaaacaagcctgtgagaagatgatccaagctttggagctcgatccaaacctgtaccgtgttgggcagagtaaaatttttttccgcgctggggtactggcacagttggaagaggagagggaccttaaggttaccgatataattgtgagctttcaggcagccgctagagggtaccttgcccgccgcgctttccagaagaggcagcagcagcagtctgccctccgtgtgatgcagagaaattgtgccgcatatctgaagcttaggcactggcagtggtggagattattcacgaaggtgaagcctctgctgcaggtgactaggcaggatgaagtcctgcaggctcgtgctcaagaactccagaaggtgcaggaattgcagcagcagtccgcccgtgaggtcggcgagttgcaggggcgggtggctcagctggaagaggagagggcgcgactcgctgaacagcttagggcagaagccgaattgtgcgctgaagccgaagagaccagaggcaggttggctgctcggaagcaggaacttgaactggtcgtgtcagaattagaggcaagggtaggagaggaggaggagtgctctcgccagatgcagaccgagaagaagaggctacaacagcatattcaggagcttgaagcccacctggaagcggaggagggtgctcgccagaaactgcagctcgaaaaagtgaccacggaggcgaaaatgaagaagttcgaggaagatctgttgctgcttgaggaccagaactcaaaactgtccaaaagtggaagctgttggaagattgtgtggcctagctcccaccctcgacagctgagacggcgcagaagatcacgcgcttccatcagctacggctccaacatgaggccacagagccagacatggcgtgatagactcaggaaagaggaaaaaggccgacaggagttggaaaaactcaaaagacggctggatggagaatcctcagagctccaggagcagatggtggaacagcagcaaagagcagaagaacttagggcccagctggggaggaaggaggaggaactacaggccgctctggctagagctgaggacgagggtggcgctcgggctcagctgcttaagtcacttcgcgaagcacaggcagccttggccgaagcccaggaagacctcgagtcagaacgtgtggcccgcactaaggcagaaaagcaacggcgcgacctaggcgaggaactcgaggccctgcggggggagctagaggatacactggacagtaccaacgcgcagcaagaattacgctcaaaaagggagcaggaggtgacagagttgaaaaaaactctggaggaagagaccaggatccacgaggcagccgtccaggagctgcggcagcgacacgggcaggctttgggagagctggcagagcaacttgaacaggcccgtcgtggcaaaggtgcttgggagaaaaccaggcttgccctagaggcagaagtgtccgagttgcgagctgaattgtcttcactacagacagctaggcaggaaggagagcagaggagaagacgacttgaattacaactgcaggaggtgcagggcagggccggtgatggagaacgagcccgcgcagaggccgctgaaaaacttcagagggctcaggccgaactggaaaacgtgagcggcgcccttaacgaagccctgttatccagtaaggatgatgtgggcaagagtgtccacgagctggagcgagcgtgtagggtggctgaacaggctgctaatgatcttcgggcgcaggtgacggaattggaggatgaactgactgccgccgaagacgccaagttgcggctggaggtgaccgtacaggccctgaaaacccaacatgaaagggaccttcagggccgcgacgaggccggtgaagaaagacgccggcagctggcgaagcagctacgtgacgccgaggtggaaagggacgaagagaggaagcagcgcaccttagctgtcgccgcccgcaagaagttagagggagaattggaggaactgaaagcccagatggctagcgccgggcaggggaaagaggaagcagtgaagcaactccgcaagatgcaagcacagatgaaggaactctggcgcgaagtagaggagactcgaaccagtagagaggaaatcttttcacaaaatcgagagtctgagaagcgcttgaaaggcttggaggcagaagttctcagactgcaagaggagcttgccgcttcagacagagccagacggcaagcccagcaggatcgcgatgagatggctgacgaggtagccaacgggaacctctctaaggccgccattctggaagagaaacggcagctggaggggcgactgggacagctagaggaagaactggaggaggagcagtccaatagtgagctgttgaacgatcggtatagaaagcttctcttacaggtagaatccctcactacggaactgtcagcagagcgttctttctctgccaaagctgagagtggacgacagcagctcgagcggcagattcaggaactgcggggtagacttggagaagaggatgccggcgcacgcgcccgccataagatgaccattgccgccctcgaaagcaagctggcacaggcggaggagcaacttgaacaagagactagggaaaggatcttatcgggtaagctcgtccggcgagcagagaagcgactgaaggaagttgtcctgcaagttgaggaagagaggagggtggcggatcaactgagagatcagctggaaaaaggaaatttacgagttaaacaattgaagcggcagctcgaggaagccgaagaggaggcatcccgggcacaagccgggcgtcgccggctccagcgggaactcgaggatgtaactgaaagtgctgagtcaatgaatcgcgaggttactactctcaggaaccgccttcggcggggtccactcacgttcacaactaggaccgtgaggcaagtctttagactggaggagggcgtcgcaagcgatgaagaagccgaagaagcccagcccggatctggcccctccccagaacctgaagggtccccccccgcccatccccagtag

SEQ ID NO: 196300 - DNA, 6087 bp, Artificial Sequence
  Description of Artificial Sequence: Synthetic coding sequence
atggccgccgtgaccatgagcgtgcccggccggaaggccccccccaggcccggccccgtgcccgaggcagctcagccattcttattcactccccgcggccccagcgccgggggaggaccaggaagcggcacatccccccaagtcgagtggaccgcgcggcggttagtctgggttccgagtgagctccacggtttcgaagccgctgctctgcgggacgagggcgaagaggaggctgaggtggaactggccgagtccggccgcaggctgcggctgccacgagaccagattcagcgcatgaacccgccaaagtttagcaaagccgaagacatggccgaactaacatgccttaacgaggcctcagttctgcataacttgagagaaaggtactactccggccttatctacacttattcaggcctgttttgtgtggtgatcaacccatacaaacagctgcctatctatacagaagctattgtcgaaatgtacaggggtaagaagaggcacgaagtgccaccgcatgtgtacgccgtaaccgagggggcatacaggtcgatgctgcaggacagggaagatcagtctattctctgtactggggagtccggtgcagggaagactgaaaacacaaagaaagtgattcagtatttagctcatgtggctagcagtccaaaaggcaggaaggagcctggagtgcctggggagttagaaaggcagctgcttcaggctaacccaatcctggaagctttcggcaacgctaagaccgttaagaatgataacagctcccggttcggcaagttcatacgcataaattttgacgttgctggttatatagtcggcgcaaacattgaaacgtacctgctcgaaaagagtcgagcaatacgccaggctaaagacgagtgctcattccatatcttctatcaacttctgggaggagctggcgagcaattgaaggctgatctgctgctggagccctgctcccactacaggtttctgactaacggaccctcctcaagccccgggcaggaacgcgagctttttcaggaaacactggagtcactgcgcgtgctgggcttctctcatgaagagattatctctatgctgaggatggtttcagccgtgctgcagtttggaaacatcgccctgaaaagggagcgtaacactgatcaagcaacaatgccagacaacactgccgcacaaaagctgtgtcgcttactcggcctgggggtgactgactttagccgcgcacttctgacacctagaatcaaagtgggcagggactacgtccaaaaagcccagacgaaagagcaggctgactttgccttggaagcccttgccaaggctacttacgagaggttattccgctggttagtgctcaggctgaacagggcccttgaccgttcaccccggcagggcgctagctttctggggatcctggacatcgcaggttttgagatatttcagttaaatagtttcgaacagctgtgtatcaattatacaaacgagaaattgcagcaactatttaatcataccatgttcgtcttggagcaagaagaatatcagcgtgaaggaataccatggaccttcttggattttggcttggacctgcagccctgtattgatctgatcgagagacctgctaatcctccaggcctgttagcactgctcgacgaagagtgctggtttccaaaggctaccgacaaatcctttgttgaaaaagtcgcccaggaacaaggagggcaccccaaatttcagcggcccagacacctacgagatcaggctgatttttctgtgttgcactatgccgggaaggttgattacaaagcgaacgagtggctgatgaagaatatggatccgctgaatgataacgtcgcagcgctgttacaccagtccacagatcgcttgaccgcagagatatggaaggatgaacacggtggcttccagcaatttagcttcctcggaagctttcccccttccccacccgggagcgctgaacggtgtagcagtgccatctcccccccaggggtggaaggtatcgtgggcctcgaacaggtcagctccttaggcgacggtcctccaggtggccgccccagaaggggcatgtttcggactgttggccaactatacaaggagagcttgtccagattgatggccaccctcagcaacacgaatcctagctttgtcagatgcattgttccgaaccacgagaagcgggcggggaaactcgagccacgcctggtcttggatcagctcaggtgtaatggtgtcctcgagggcattaggatctgtaggcagggcttccctaatcgcatcctatttcaggagtttaggcaaagatacgaaattctgactcctaacgcaataccgaaaggcttcatggacggaaagcaggcttgtgaaaagatgattcaggcactggaattagaccccaacctctaccgggtgggccagagcaaaatcttcttccgagctggcgtgctcgcgcagctggaagaggagagagatctaaaagtgaccgacattatcgtgagctttcaggccgccgccagggggtatctcgcccgacgcgctttccagaaaaggcaacaacaacagtctgccttgagggtcatgcagaggaactgcgctgcatatctcaagttaagacactggcagtggtggcggctttttaccaaggtcaagcccctgctgcaggtcactcgccaagatgaagtgctccaggcccgtgcacaagagcttcagaaggttcaagagttgcagcagcagagtgcgagggaagtcggagaattacaggggagagtagcacagttggaagaagagagggcgagactagcggaacagctccgtgcagaagcggagctttgcgcagaggctgaggagaccaggggacggttggcagcacgcaagcaggagctggagctggtcgtgagtgaactcgaggccagagtgggggaagaggaggagtgctctaggcagatgcagaccgaaaagaagcgactacagcagcacatccaggagctcgaagcccacctggaggctgaggagggtgctcgacagaagctgcagctggaaaaagtgacaacagaggctaaaatgaagaagtttgaagaggatctgctcctgctcgaggaccaaaattcaaagttatccaaagagaggaaattgctggaggatcgcctcgccgagttttccagtcaggccgcagaggaggaggaaaaggtaaagtcattgaacaagttgaggctcaagtacgaagctacaatagctgatatggaggatagactgcggaaggaggagaagggcaggcaggaactagagaagcttaaaagacggttggacggcgaatcaagcgaactgcaagagcagatggtcgagcaacaacaacgtgccgaagagttgcgagcccagctaggccgcaaggaagaagaactgcaggccgccctggcgagagcagaggacgaaggtggagccagggcacagcttctaaagtccttgcgggaagctcaggcagccctggcggaggcccaagaggaccttgaatcagagcgtgtggctaggaccaaagctgagaaacagcgacgagacctgggagaggagttggaagctctgcgaggcgagttggaagataccctggacagcacaaacgctcagcaggagctgcggagcaagagagaacaggaagttactgaattaaagaaaacattggaagaagagacacgtattcacgaagcagccgtgcaggaactccggcagcgacacggacaagctttgggtgagctcgccgaacaattagagcaggctcgaagaggcaagggagcttgggagaagacacggctagctctggaggctgaggtttcagagctcagagccgaactatcgtctctccagaccgcaagacaggaaggggaacagcgccgcaggcggctggaactgcagctgcaagaggtccagggaagagccggggacggcgaacgcgcacgcgctgaagctgccgaaaagctgcagcgcgcccaggctgaattggaaaatgtttcaggggccctcaacgaagcggaatccaagacaattagactgagtaaggagctttcttccacagaggcccagcttcacgatgcacaggaacttttgcaagaggaaactcgggctaagctggcattaggaagccgcgtgagagcaatggaggcagaagctgcaggactccgggagcagctagaggaggaggccgcggcgcgggagcgcgccggacgggaactgcagacggcccaggctcagctatcagagtggaggaggcgacaggaggaagaagccggagctctcgaggctggggaagaagccaggaggagggccgccagggaggctgaagcgttgacccaaaggttggccgagaagactgaaaccgtggatagattggagagagggagacggaggcttcagcaggagctcgacgacgccactatggaccttgaacaacagcgccagctggtctcgacattggaaaagaagcagcgaaagtttgaccagcttttggccgaagagaaggccgcggtcctgagggccgtggaagagcgggagagagctgaggccgagggacgagaacgtgaggcccgcgccttgagtcttaccagagccttagaggaagagcaggaggctagggaggaactggagcgccagaatcgcgccttgagagccgaattagaagctctgctgtccagtaaagatgatgtgggcaaaagtgtccatgagctggaaagagcgtgtcgggttgcagaacaggctgcaaacgatcttagagctcaggtcaccgagctggaagatgagttgaccgcggctgaagatgctaagctgagacttgaggtaacggttcaggcattaaagacacagcacgaacgcgacctccagggacgcgacgaagccggcgaggagaggcgccggcaactcgccaagcaactgcgggatgctgaggtcgaacgcgatgaagagcggaaacaaagaactttggctgtagccgcccgaaagaagttggagggagaacttgaagaacttaaggcacagatggcttctgcaggtcagggaaaggaagaagctgtcaagcagcttcgcaagatgcaggcccagatgaaggaactttggagggaggtagaagaaacccgaacctctagggaggaaatattcagtcagaacagggagagtgagaagaggctgaaagggctcgaagccgaggtccttcgtctgcaggaggaactagcagcctctgatagagcgcgacgccaagcccagcaggatagggacgagatggccgacgaggttgcgaacggaaacctgtcaaaagccgcgatacttgaggaaaaacggcagctagagggacgtctgggtcagctggaggaagaactggaagaggaacagtcaaatagcgagctgctgaacgacaggtaccggaaactgttgctgcaagttgaatcgctgaccaccgagctgagcgcggaaaggtcattctccgccaaggctgagtccggtaggcagcaactggagcgacaaatacaggagttaagaggacggctgggagaagaggacgccggggctagggccagacacaagatgacaatcgccgccctggaaagtaaattggcacaggctgaagagcaattagaacaagagaccagagagagaatcctctctggcaagctggtgagacgcgccgagaaaagactaaaggaggtagtgctgcaggttgaggaggaacgccgagtagcagatcagctgagagaccagcttgaaaaaggcaacctccgggtgaagcagctgaaacggcagctggaggaagcagaggaggaagcatctagagcccaggctgggcgtagaaggctgcagagagaactcgaagacgtgactgaatctgcagaatccatgaacagagaggtcaccaccttgagaaaccggctgagacggggcccactgacatttactaccaggactgtaagacaggtttttagactagaggagggcgtcgcttcggacgaggaagcagaagaagcccaacctggcagtgggccttctcctgaacctgagggatctcctcccgcccatccacagtag

SEQ ID NO: 196301 - DNA, 6012 bp, Artificial Sequence
  Description of Artificial Sequence: Synthetic coding sequence
atggccgccgtgaccatgagcgtgcccggccggaaggcccccccccggccaggccctgtccccgaagctgctcagccttttctgtttacgccccgcggaccttccgctgggggtggccctggttccggcacaagtcctcaggtggaatggactgcccgccgattggtctgggtgccctccgagctgcacgggtttgaggccgcggcactcagggatgagggcgaagaagaagccgaagtcgagctggcggaaagcggacgaagattgagattacccagggatcagatccagcggatgaatccgcccaaattttcaaaggccgaagacatggccgaactaacctgcttaaatgaagccagtgtgctacacaacctgcgtgaaagatattactcaggtctgatatatacttactccggtctgttctgcgtcgtgataaacccatataagcaactgcctatttataccgaggctattgtcgagatgtacaggggtaaaaaacgacatgaggtcccccctcatgtctacgcagtgactgagggtgcataccgcagtatgctccaggacagggaagaccaaagcatcctgtgcaccggtgagtccggcgcaggcaagactgagaacaccaaaaaggtgatccagtatctcgcccatgttgcatcctctccaaaggggaggaaggagccgggcgtgccagcttccgtctccaccgtttcttacggtgaacttgaacgtcagctgttgcaggctaaccctatactcgaggcgttcgggaatgcaaagacagtcaaaaacgacaattctagtcggttcggtaagtttattaggatcaacttcgatgtcgcggggtacatcgtcggggccaatatagaaacttacctgttagaaaagtctcgggcaatcaggcaggcaaaagacgaatgcagttttcacattttctaccagttgctgggtggggcaggagagcaactcaaagcagatctgctcttagaaccatgttctcactacaggtttctgactaacggcccaagcagtagccccggacaggagcgggaactctttcaggaaactctagagtcgcttagggtcctcgggttttcgcatgaggaaatcatctccatgttgcggatggttagtgccgtgctacaatttggcaatattgcccttaaaagagagcgaaacactgaccaggccaccatgcctgacaatacagccgctcagaagttgtgccgattacttggtttgggcgtgactgatttctctcgagcacttctgacccctcggataaaggtgggcagggactacgtgcagaaagcgcaaaccaaggaacaagcagactttgccctcgaggccttagcaaaggctacatatgaacggctttttcgctggttggtactgagactgaatagggctctggacaggtctcctcgccagggggccagtttcctggggattctggacattgcaggttttgagatcttccagcttaactccttcgagcagctgtgcattaactatacaaacgaaaagctccagcaactttttaaccatacaatgtttgttcttgaacaagaggaatatcagagagaaggcatcccttggactttcctcgacttcgggctggatctgcagccctgcattgatttgatagaacgtcctgcaaatcctcctggcctgttagcattgttagatgaagagtgctggttcccgaaagcaacagacaagtcttttgtcgaaaaggttgctcaggaacagggcggccaccccaaattccagagaccccgccacctgagggaccaggccgacttttctgtgcttcactacgctggtaaggttgactacaaagccaacgagtggctaatgaagaatatggatccactgaatgataatgtggccgccttgcttcatcagtcaaccgatcggcttaccgcggaaatttggaaggacgtggagggaattgttgggctggagcaggtctcaagcttgggcgacggaccgcccggtggcaggcccagaaggggaatgttcagaacggtggggcagctctataaggagtccctgtcaaggctgatggcaacactgtcaaataccaacccatcgtttgtccggtgcattgttcccaaccacgagaagagagctggcaaactggaacctcgcttagtgctggaccagcttcgctgtaacggtgtgcttgaaggcatacgcatttgccggcagggcttccctaatcggatcctgtttcaggagttcagacagaggtacgagatcctaaccccgaacgctataccaaagggctttatggatggcaagcaggcctgcgaaaaaatgattcaggcattggagctggacccaaacctgtaccgtgtggggcagagtaaaatattcttccgggccggggtcctagctcagttagaagaagaaagggatctgaaagtaactgacatcatcgtcagtttccaggccgccgctagaggttatcttgctcgaagggccttccagaaacgccagcagcagcagagtgccctgcgagtgatgcagcgcaactgtgccgcctacctcaaactgcgccactggcagtggtggcgtctgttcaccaaagtgaagcctctgttacaggtgacacgtcaggacgaagtgctccaggctagggcacaggagcttcaaaaagttcaagaactgcaacagcagtccgcaagagaggtaggtgagctgcaaggacgggtggctcagctggaggaagagcgggcacgactggcggaacagctgcgggccgaagccgaattgtgtgccgaggccgaagaaacacgtggacggctcgcagcgcggaagcaggaacttgaactggtggtgtccgagttggaagcgcgcgtgggcgaagaagaggaatgcagtcgacagatgcagactgagaagaaacgcctccaacagcatattcaggaactcgaggcccacctggaggcagaagaaggagctaggcagaagctgcagctcgagaaagtgactaccgaagcaaaaatgaagaagtttgaggaggatctgcttttgcttgaagatcagaactcgaagctttctaaagagcgcaagctcttagaggacaggttggccgaattctcaagccaagcagccgaggaagaggagaaggtcaagtcccttaacaaactgcgcctcaaatacgaggctactattgctgacatggaggaccgcctaagaaaagaagagaaaggcaggcaggagcttgagaaactgaagaggagattggacggcgagtcaagcgaactgcaagaacaaatggtagagcagcagcagagggccgaagaactgcgggcgcagttaggacgcaaagaggaagaactccaggctgcgcttgcccgggcagaggatgagggcggcgcccgggctcagttgctaaagagtctgcgcgaggcgcaggccgcccttgccgaggctcaagaagacttggaatcagaacgtgtcgcccgaactaaagcggaaaaacagaggagggatctgggcgaggagctggaagcactccgtggagagctggaagatacccttgactccactaatgcacagcaagagctgcgcagcaagcgagagcaggaagtgaccgagctgaaaaagaccctggaagaagaaactcggatccacgaagccgcagtgcaggagttgaggcagcgacatgggcaggcccttggcgagctggcagagcagctagagcaggctcgcaggggcaagggcgcctgggaaaagacccgattggccctggaagccgaggtgagcgaattgcgcgccgaactgtcttcacttcaaaccgcgcggcaggagggagaacagcgacgccgacgcctggaactgcagttgcaagaagtccaaggcagggcaggagatggcgagcgagcgcgagcggaagccgctgaaaagctgcagagagctcaggccgagctggagaacgtgtcaggcgcactcaatgaagctgagagtaagacaattagactttctaaggagctgtcaagtactgaggctcagttgcacgatgcccaggagcttctgcaggaagaaaccagggcaaaactcgctcttggttcccgcgtcagggcaatggaggcggaagccgctggattgcgcgagcagttggaagaagaagcagccgcccgagagcgagccggacgggagctccagacagcccaagcacagctaagcgaatggcgccgccggcaagaggaggaggccggtgctcttgaagcaggcgaggaagctagacggcgagccgcccgagaagccgaggcattaacccagcggttagccgagaagaccgagaccgtggatcgactcgagagagggcggcgccgcctgcagcaagaactggacgacgcgaccatggatttggagcagcaaagacagttggtcagtacccttgagaaaaagcagagaaagtttgaccagctgcttgcagaggaaaaggctgctgtcctgagagccgtggaggagcgtgagcgggcggaggcagaaggtcgggaaagggaagcgagggcgctgtcgcttactcgtgcccttgaggaagaacaggaggcccgtgaggaactggaaaggcagaaccgggctctgcgtgcagaactggaggcccttctttctagtaaagatgatgtgggcaaatccgtgcatgagcttgagagggcctgcagagtggccgagcaggctgccaatgacctgcgagcccaagtgaccgaactcgaggacgaattaacagctgccgaggatgccaaactgcgactggaggtcaccgtgcaggccttaaaaacacagcatgagagagacctgcagggtagagatgaagccggcgaagagaggcgacgacagctggccaagcagctgagggatgcagaggtggagcgagatgaggagcgcaagcagcgcactctcgccgtggcagctcggaagaagcttgagggcgaactggaggagctaaaagcgcaaatggcctcagccggccagggaaaagaagaggcagtgaaacagctgagaaaaatgcaagcgcagatgaaggagttgtggagagaagtggaagagactaggacatcgagagaggagattttcagtcagaatagagaatcagaaaagagattgaaaggtcttgaggcagaagtgctgcggctgcaggaagagctagctgcaagcgaccgggcccgcagacaggcacagcaggatcgggacgaaatggctgatgaagtggcgaacggcaatctgagcaaggctgccattttagaggaaaagcggcagctggagggcaggctcggccagctagaggaagagctggaagaggagcagagcaattccgagcttctcaatgacagataccggaagcttcttttacaggtggaatcactgaccaccgagctttcagccgaaaggagtttctctgctaaggctgaatctgggcgccagcagctggagaggcagattcaagagctgcgcggacgactcggcgaggaggacgccggggctcgagccaggcataagatgacaatagcggctctcgagagtaaattagctcaagcagaagagcagctggaacaagagacgcgtgaacggatcctttcagggaagctcgtgaggcgggcagaaaagcggctgaaggaggtggtcctgcaggttgaagaagaaagacgggtcgccgaccagcttagagaccagctggagaaaggcaacctgagggtgaagcagttaaaacgccaactcgaggaagccgaggaggaagcctctcgcgcacaggccgggcgccgacgactgcagcgagagttggaagatgtgaccgagtcagccgagagcatgaatcgcgaagttaccactcttcggaatagacttcgccggggtcccttgacttttaccacaaggactgtccgacaggttttccgcctggaggaaggagtggcaagcgatgaggaggccgaggaggcgcagcccggctcaggaccatcacctgagccggagggcagcccgcccgcccaccctcaatag

SEQ ID NO: 196302 - DNA, 6111 bp, Artificial Sequence
  Description of Artificial Sequence: Synthetic coding sequence
atggccgccgtgaccatgagcgtgcccggccggaaggcccccccccgacccgggccagtaccggaagctgctcagccctttctgttcacgccccgcggtccctctgccggcggaggtcctggtagtgggacctcacctcaggtcgagtggacagccagaaggttggtatgggttccaagcgagttacacggctttgaggccgcagccttgagggatgagggagaggaagaggctgaggtggagcttgccgaaagtggccgaagactccgcttaccccgggatcagatccagagaatgaatccccctaaattttccaaggccgaggacatggcggaactgacctgtctgaacgaagctagcgttctccacaatttaagggaaagatactacagtggactgatctacacatattctggcctgttctgtgttgtgatcaacccctataagcagctgcccatctacacagaggccattgtggaaatgtacaggggcaagaaaaggcatgaagtgcctccacatgtttacgccgtcactgaaggcgcatatcggtcaatgctgcaggacagagaagaccagtctattttgtgcacaggggagtccggagccggtaaaactgagaacaccaagaaagtgattcagtatcttgcacacgtggcttccagcccgaaggggcgcaaagaacccggtgtgccggtaagtaacccagccctgggttggggcgagctggaaaggcagctcctgcaggccaaccccatcctggaggcctttggcaacgcaaaaacagtgaaaaacgataatagttccagattcgggaagttcatcaggattaacttcgatgtggcaggctatatcgtgggcgccaacatcgaaacctacctgctagagaagtcccgggcaattagacaggccaaagacgaatgttcattccacattttttaccaacttttgggcggggctggcgaacagctgaaagcagatttgctgttggaaccatgctcccattatagattcctaactaatggcccgagctccagccccggccaggagcgcgagctgttccaggagacactggaatccctgcgggtgttgggattttcacatgaagaaattatctcaatgttacgcatggtttccgcagtcttacagtttggcaacattgcccttaagcgcgagcgcaacactgaccaggccacaatgccggataacactgcggcacaaaaactgtgccggctcttgggcttgggcgtgactgacttctcacgtgctctattgactcctaggatcaaggtaggaagggactatgttcagaaagcccaaaccaaagagcaggcggactttgccctcgaggccctggccaaggctacctacgagaggttgttcagatggttggtgcttcggcttaatcgtgcgctggataggagtcctcggcaaggcgccagcttcctcggaatcctggacatagctgggttcgagatttttcagcttaactcattcgagcaactgtgcattaactataccaacgaaaaacttcagcagctgttcaaccacaccatgtttgttctcgagcaggaggagtatcagagggagggaattccatggacatttctggactttggtcttgatcttcagccttgtattgacctcatcgaacgaccagctaatcctccgggcttactcgctctgctcgatgaggaatgctggtttcctaaggccaccgacaagtctttcgtggaaaaggtcgcacaggaacagggcgggcaccctaaattccagcgcccaagacatttgcgcgatcaagccgacttctccgtcctacattacgccggtaaggttgattataaggctaacgagtggttgatgaaaaatatggatcctctcaatgacaatgttgccgcattactacaccagtctacggacagactgacagccgagatctggaaagatgaacacggggggtttcagcagttcagcttcctaggaagctttcctcctagtcccccaggctccgcagaacggtgttctagcgctatcagcccacctggagtggaagggatcgtgggactggaacaggtgtcctccctgggcgatggaccacctggagggcggcctcgccggggcatgtttcggacagtgggccagctgtacaaggaatctctgtctcgcctgatggctaccttatctaacactaatcccagctttgtcaggtgcattgtgccaaaccatgaaaaaagggccggtaaactcgagcctcgactggtgttggatcagttgcggtgcaatggggttctggaaggaatccgcatttgccgccagggtttcccaaatagaatcttgttccaggaattccgacagcgatatgaaattctgacacccaatgccattccaaaagggttcatggacggtaagcaagcctgcgaaaaaatgatccaggccctggaacttgatcccaacctatatagagttggtcagagtaagatcttttttcgcgctggagtactggcccagctcgaagaggagcgggatctgaaagtcaccgatattattgtttctttccaggctgctgcgagaggttacctggccagaagagcattccagaagcgccagcagcaacagagtgctctcagagtcatgcagcgaaactgtgctgcgtacctgaaactccgccactggcagtggtggcggttatttacaaaggtcaagcctctgcttcaggtgacacggcaagatgaggtcctacaagcacgcgctcaggaattgcagaaggtccaagaactccagcagcaatctgcgcgggaagtgggggagctccagggcagggttgcacagctggaagaagaacgggcccggctggctgagcagctgagggccgaagccgaactctgcgccgaagcagaggagactcgcggaaggttggccgcccggaagcaggaattggaactcgtggtgtccgagctggaggctagagtgggcgaggaggaagagtgtagccggcagatgcagacagagaaaaagcgcttacagcagcacattcaggaactggaggctcacctggaggccgaagaaggcgctcgccagaagttgcaactggaaaaggttacgactgaagccaaaatgaaaaaatttgaggaggatctgctgctcctcgaagatcagaatagcaagctatcaaaggagagaaagctgctggaagacagactggctgaattttcaagccaggccgctgaagaggaggagaaggttaaaagtctgaataaactgagactcaaatatgaagcaaccattgccgacatggaggatcggctccgcaaggaggaaaaaggacgccaggaactggagaaactgaaaaggcgtttggatggggagtcttcagagctgcaggagcagatggtcgaacagcagcagagggctgaggagttgcgagcgcagctcggacgcaaagaggaggaattacaggctgcgctcgcccgggcggaggatgagggtggcgctagagcccagttgcttaaatcccttcgggaagcccaggctgccttggccgaagcacaagaagacctggagtccgagcgggtggcccggacaaaggccgagaagcagcggagagacctgggcgaggaactcgaggcccttcggggtgaactcgaagatactctagacagcacaaatgcccagcaagaactgcgctccaagagagagcaagaggtaaccgagctgaaaaaaaccctagaagaagagacccgcatccacgaagctgccgttcaagaattgcggcagcgacacggacaggccctgggagagctcgcagagcaactagagcaagcccgaaggggaaaaggggcctgggagaagactcggctggcccttgaagccgaggttagcgagctgagggcagaactatctagcctacagactgcgaggcaggagggcgagcaaaggcgccggagactggagctgcagctgcaggaagtgcaaggacgggctggggatggtgagagagcaagagcagaggctgccgagaagctgcaaagggcccaagccgaactagagaatgtttctggagccctgaacgaagcggaatctaagaccattcggctgtccaaggagctgtcgtccactgaggcccagctacacgacgctcaggaactgttacaggaggagacccgcgcaaagttagcactggggtcaagggtgagagccatggaagctgaagcagccggactgcgggagcagctagaggaggaggccgcagccagggaacgcgcaggtagagaactgcagactgctcaggcccagctgagcgagtggcgacgtcgacaagaggaggaggccggagccctcgaggccggagaggaggccaggagacgcgctgccagggaggctgaggcattgacacagcggctggcggagaagacagagacggttgaccgcttggaacgcggtcgacgaaggttgcagcaggagttagacgatgccacaatggatttggaacagcagaggcagttggtgagtacgctggaaaagaagcaaagaaagttcgatcagctgctggccgaggaaaaggcagccgtgctaagagccgttgaagaacgcgaaagggctgaagccgagggaagagaacgggaagcgcgggcactcagcttgaccagagcgttagaggaggaacaggaggctagggaggagttggaacgacagaacagggccttaagagcagagcttgaagccctcctatcttctaaagatgatgttggtaaatcggttcatgaattggagcgggcttgcagggtcgcagaacaagccgctaatgatctgcgcgcacaggtcacagaactggaggatgagttgaccgccgccgaagatgcgaagctccggcttgaggttactgttcaagctcttaagactcagcacgaacgagatcttcaggggcgggacgaggccggggaggagcggcgacgtcagctcgcaaagcaactgagagatgctgaagtggaaagagatgaagagaggaaacagagaactctagcagtcgccgccaggaaaaagcttgagggagaactggaagaactgaaggctcaaatggcctccgccggccagggtaaggaagaggccgtgaagcagctgaggaagatgcaggctcagatgaaagaactgtggagagaagttgaggagactcgcacttcacgcgaggaaatattcagccagaaccgagagtcggagaaaagacttaaaggcctggaggccgaggtgctgaggctccaggaggaattagctgcgtccgatcgcgctagaaggcaggctcagcaggatcgagatgagatggcagatgaagtggctaatggcaacctgagtaaggcagctatcctagaagagaagcgacagttggaaggtcgtctcggccaactggaggaggagcttgaggaggagcaatctaatagtgaattgttgaacgatcgataccggaagctcttgctacaggtggaaagcctgacaaccgagctttccgcggagcgctcattctctgccaaagccgagagcggacgccagcagcttgaaagacagatacaggagctgcgcgggcgccttggcgaagaagatgctggagccagggcccgacataagatgacgatcgcagctctggagtcaaagctggcacaggcggaggagcagctcgaacaggagacaagggaaagaatccttagtgggaagctggtccggcgtgcagaaaaaagactgaaggaagtggtgcttcaggtagaagaagagcggcgagtggcagaccagctgcgtgaccagctggaaaagggtaatctaagggtgaaacaactgaagcgacagttggaggaggctgaagaggaggcgtcgagagcacaggcaggccgtcgacggctgcagcgggagcttgaggacgtgaccgaaagcgccgagtcaatgaaccgggaggtgactacactccggaatcgtttgcgcagggggcctctgacgtttaccacacgaacagtacgccaggtcttccggctcgaggagggcgtggcctctgacgaagaggcagaggaggctcagccaggctcaggaccctccccagagccagaggggtctccacccgcgcatccacagtag

SEQ ID NO: 196303 - DNA, 5841 bp, Artificial Sequence
  Description of Artificial Sequence: Synthetic coding sequence
atggtggagagctgcctgctgaccttccgggccttcttctggtggattgcactcattaagatggacctgtccgatctcggggaggcggccgccttcttgcgacgatcagaagcagagttactgctcctgcaagctaccgctctggacgggaagaagaagtgctggatcccagacggagagaatgcgtacattgaggccgaggtgaaaggcagcgaagacgatggcactgtgattgtcgaaacagcggacggagaatcgctttcaattaaggaagataaaattcagcagatgaacccaccagagttcgagatgatcgaagacatggcaatgctcacccacctcaacgaggccagcgtactgcacactctaaagaggcggtacggccagtggatgatctacacatatagtggacttttctgcgttaccatcaatccttataaatggctgcctgtgtaccagaaagaggtcatggccgcctataagggtaagagaaggagcgaagctccaccacacatcttcgccgtggccaacaatgcttttcaagacatgctccacaaccgtgagaatcagtcaattctcttcacaggagaatccggtgcaggcaagactgttaactcaaagcacattatacaatattttgcaaccatcgcagcgatgatcgagtccaggaaaaaacagggagccctcgaggatcaaattatgcaagcaaataccattctggaagcatttggcaatgccaaaacactgcgcaatgacaactcatcgagatttggcaagtttatcagaatgcacttcggagccagaggcatgctttctagcgtggacatcgacatctacctcttggaaaaaagtcgggtgatattccagcaagccggtgaaaggaattaccatatcttttaccagatccttagcggccaaaaggaactccacgatctcttactcgtttccgctaatcctagcgacttccacttctgttcttgtggcgcagtaactgtcgagagcctcgacgacgcagaagagctgctggcaacagagcaggctatggatattctggggttcctaccagatgaaaaatacggctgttataagttaactggtgccataatgcacttcggaaatatgaagtttaaacaaaaaccccgggaggaacaacttgaggccgacggcaccgaaaatgccgacaaagcagcatttttgatgggcatcaattccagcgaactggtgaagtgtttaatccaccctcgcattaaagtgggtaatgaatatgtcactaggggacagacaatagaacaggtcacatgcgcagtgggcgccctgtccaagtctatgtacgagcgcatgtttaagtggctggtggcacggattaaccgtgccctggacgctaagttaagtcgtcaattcttcatcggaatcttggacattactggattcgagatcctggagtacaattcactggagcagctgtgcatcaactttaccaatgagaagctgcagcaattctttaactggcatatgtttgtgctggagcaggaagagtacaaaaaagaatccatcgagtgggtgtcaatcggatttggactcgacctccaggcatgcatagacctgattgagaaacctatgggtatcctgagcatactcgaggaggaatgcatgttccccaaggccacagacctcacatttaaaactaaactgtttgataaccattttggtaagtccgtgcatctgcagaagccgaaaccggataagaaaaaattcgaggctcacttcgaactcgtgcactatgcaggagtagtgccatacaatattagcggatggctcgagaagaataaggacttgttaaacgagactgtggtggccgtctttcaaaaaagcagtaatcgcctgttggcaagtctgttcgagaactacatgagcactgattcggccatcccattcggcgaaaaaaagaggaagaaaggcgcctcttttcagactgtcgccagtcttcataaggaaaacctcaataaactgatgaccaatctcaaatctaccgcccctcattttgtgcggtgcatcaacccaaacgtgaataagatccctgggattcttgatccgtacctggttcttcagcagctcagatgtaacggagttctggaaggaacacgtatatgcagagaaggattcccgaatcgactccaatacgcagatttcaagcagcgctactgtatcctaaatccccggacattccccaagtctaaattcgttagctccagaaaggccgcagaagaactccttgggagcctggaaatagaccacactcagtatcggttcggaatcactaaggtatttttcaaagcaggcttcttaggtcagctcgaggcgattagggatgagcggctgtccaaggtattcacgcttttccaggctcgagctcagggtaagctaatgcgtatcaaattccaaaaaatactcgaagagcgggatgccttgatcctgatccagtggaacatccgagcatttatggcagtgaaaaactggccctggatgcggcttttctttaagatcaagcccctagtcaagtctagtgaggttggtgaagaggtcgctggtctcaaagaggagtgtgcgcagctccagaaagcgctcgagaaaagcgagttccagcgcgaggaattgaaggcgaagcaggtttccctgactcaggaaaagaacgacctgatccttcagctgcaggcagaacaggagaccttagcaaatgtggaggagcagtgtgagtggttgatcaaaagcaaaattcagttggaagctagggtaaaggaactcagcgaacgtgtcgaagaggaggaggagatcaacagcgagctgaccgctagaggcaggaagctggaagacgaatgcttcgagctgaagaaagagatagatgatcttgagacgatgctcgtcaagtccgaaaaagagaagcgcacaaccgagcataaagtgaaaaacctcaccgaggaagtagaattcctgaatgaggatatctccaagctcaatcgggccgctaaagttgtgcaggaggctcatcagcaaactttagacgatctgcacatggaagaggaaaagctgtcctccttatctaaggcgaacctgaaactcgaacagcaagtcgacgaactcgaaggggccctagaacaggagagaaaggcccgaatgaattgtgagagggaactccataagctggaggggaatctgaagctcaacagggaatctatggagaatttggaaagctcccagcggcacttggccgaagaactgaggaaaaaagagctggaactgtcccagatgaactccaaagttgaaaacgagaagggcctggttgcacagctgcagaaaacagtcaaggagctgcagacccagattaaggatctgaaggaaaagctggaggccgaacgcactacaagggccaagatggaaagggagcgagctgatctgacacaggacctggccgatctcaacgaacgcctcgaggaggtgggaggcagttccctggctcaactagagatcacgaagaagcaggagacaaagtttcagaagctgcacagggatatggaggaagctaccctccatttcgaaacaaccagcgcctctttaaagaaacgccacgccgacagcctagcagaactcgagggccaggtggaaaaccttcaacaggtgaagcagaagctggagaaagacaagtctgatttgcagctggaggtggatgatctactcactcgggtggaacaaatgacacgggccaaggcaaacgctgagaaactttgtacattatatgaagagcgcctccatgaagccactgccaagctcgacaaggtcacccaactcgcaaacgacctggcggcacagaaaacgaaattatggtcagaatccggggagtttctcaggaggctggaggaaaaggaggctctcattaaccaattgtcgagggaaaagtctaattttacaagacagattgaggatcttcgaggtcagctggaaaaagagactaagtctcagtccgctcttgcgcatgctcttcaaaaggcacaaagagactgtgatctcttgagggagcagtacgaggaggagcaggaggtcaaagcagagctgcataggactctgtctaaggtcaacgcggaaatggtgcaatggaggatgaaatacgagaacaatgttattcagcggacagaagatctcgaagatgcgaagaaagagctggctatcaggctccaagaagccgctgaggccatgggggtggcaaacgctcgaaacgccagtctggaacgtgctcgccatcagctccagctcgaacttggcgacgccctttccgacctggggaaagttcggagcgccgccgctcgactggaccagaagcaactgcaatctggtaaagctctcgctgactggaagcaaaaacacgaggagagtcaggccttactggacgcctcacagaaggaagtgcaggctctgtctacggagctactgaaattgaagaacacttatgaagaatctatcgttggacaggagactctgcgtagggagaacaagaacctgcaagaagagatcagtaacctgaccaatcaagtcagagaaggcacgaaaaacctcaccgagatggaaaaggttaaaaaactgatcgaggaggaaaagaccgaagtgcaggtaactctggaggagaccgaaggtgcactcgagcgtaatgaatcgaagattttgcacttccagctggagctgctagaggctaaagccgaattggagaggaagttaagcgaaaaggatgaggaaattgagaattttaggagaaaacagcagtgtacaatagacagcttacagtccagcttagattccgaagctaagagcagaatagaagtcactagacttaagaagaaaatggaagaggacttgaacgaaatggagctgcagctcagctgtgctaaccggcaggtgtctgaagcaacgaaatccttaggtcagttgcaaatacagatcaaagatctgcagatgcagctggatgacagcactcagcttaattctgacctgaaggaacaggttgctgtggcagaaaggcgtaactcactcctacaaagcgaactggaagatctaagaagccttcaggagcagacagagcggggccggcgattgtcggaagaggagttgttggaggccaccgagagaatcaacttgttctatacccaaaacaccagcctcctgtcccagaaaaaaaagctcgaggccgacgtggccaggatgcagaaagaagccgaagaagtggtgcaagagtgccagaatgctgaagagaaggcaaagaaagcagccatcgaagcagctaatctgagcgaggagctcaagaagaaacaggacacaattgcccatctggaaagaactcgcgaaaatatggagcagacaattactgacctccaaaagagattggcagaagccgagcagatggctctcatggggtccaggaaacaaatacagaaacttgagagccgggttagggagttggagggagagctggagggagaaattcggaggtccgcggaggctcagagaggagcccgcaggttagagcggtgcataaaagagctcacatatcaggccgaagaagataaaaaaaatctctccagaatgcaaacccagatggacaaattacagctgaaggtccagaactacaagcagcaggtcgaggtggctgagactcaggctaatcagtacttgtcgaaatacaagaaacaacaacacgagctgaatgaagttaaggaaagagctgaggtggcggagtcccaggttaacaagctgaagataaaggcgagggagtttggcaagaaagtccaggaagagtag

SEQ ID NO: 196304 - DNA, 5826 bp, Artificial Sequence
  Description of Artificial Sequence: Synthetic coding sequence
atgagcagcgacagcgagctggccgtgttcggcgaggccgccccctttctgaggaagtccgaacgggaacgcattgaggcgcagaataggccatttgacgccaaaacctctgtgttcgtggccgagccgaaagaatccttcgtgaaaggtacaatccagtcccgggaaggcggcaaggttaccgttaagacagaaggcggggccaccttaactgttaaggacgaccaggtgttccctatgaacccccctaaatacgacaaaattgaggacatggccatgatgactcatttgcatgaaccagctgttctttataacctgaaagagcgatacgctgcctggatgatttacacatattcagggttattttgcgtgacggtgaatccatataaatggctgccggtctacaagcccgaagttgttaccgcctaccgcggtaagaaaaggcaggaagcaccaccacacatcttctccataagcgacaacgcttaccagtttatgctaacagatcgcgagaaccagagtatcctgatcactggcgagagcggagctggcaagaccgtgaacacaaaacgcgtgatccagtattttgccactatcgctgtaaccggcgagaagaaaaaagaagaaattactagtggtaagattcagggtacgttggaggatcaaataatctcggcaaaccccctgctggaagcgttcggaaatgccaagaccgttcggaacgacaatagcagcaggtttgggaagttcattcgaatccattttggtacaacaggaaagctcgcttccgcagatattgagacgtacctgttggaaaagagtcgggtggtgtttcaactgaaagccgagcgtagttaccatattttttaccaaatcacatccaataagaaacccgagctgatcgagatgctgctgataacaaccaacccctatgactatccctttgtctctcagggagagatctcagtggccagcattgacgaccaggaggaacttatggctaccgacagtgcgattgacatattgggttttaccaatgaggagaaagtctcgatctataaacttaccggagctgtgatgcattacggcaatctcaagttcaagcaaaagcagcgggaagagcaggctgaacctgacggaacagaagtcgcggataaagccgcgtatctacagagtctaaattcagctgacctcctgaaggcactctgttaccccagagtaaaggtgggcaatgagtatgtgacaaagggacagactgtggagcaagtgagcaacgctgttggtgcactcgctaaggccgtctacgaaaagatgttcctttggatggtagctcgcattaaccagcaactcgataccaaacagcctaggcagtatttcatcggggtgctggatattgccggctttgagatcttcgattttaattcgctggaacagctctgcattaactttaccaatgagaaactgcaacagtttttcaaccaccacatgttcgtgctggagcaggaagagtacaaaaaagagggtatcgagtggacattcatagactttggcatggacctcgcagcctgcatcgagcttattgaaaagcccatgggaatattttcaatactggaagaagagtgcatgtttccaaaggcaacagatacaagctttaaaaacaaactttacgatcaacatctgggaaaatccgctaactttcaaaaaccaaaggtggtgaagggaaaagctgaggcccacttcgcactgatacactacgcaggcgtggtggactacaatattactggctggctcgagaagaacaaagatcccctgaatgaaactgttgtgggactgtatcaaaagagcgctatgaaaacgcttgctcagctcttctcgggcgcgcagaccgcggagggggagggcgctgggggcggtgccaaaaaaggggggaagaagaaagggtctagcttccaaaccgtgtccgccctcttccgcgaaaatctgaacaagctgatgacaaatctgcgatccacacacccccactttgtccgatgcattatccctaacgagacaaaaacccccggcgcaatggagcacgagttagtcctgcaccagctcagatgcaatggtgtcctcgaaggaataaggatctgccggaagggtttcccctctcgcatcctatatgctgatttcaagcagcgatataaagtcctgaacgcttccgctatccctgagggccagtttatagacagcaaaaaggcatccgagaaactcttggcgtcaatcgacatcgatcatacccagtacaaatttggccataccaaagttttcttcaaagccggcttgcttgggctgctggaggagatgagagacgataaattggctcagctgattactagaacacaagctagatgtcgcggattcctcgcaagggttgagtatcagcgcatggtggagcggcgagaggccatcttttgtatccagtacaacatcagatcattcatgaacgttaagcactggccatggatgaaactgttttttaaaattaagccactgcttaagtccgccgaaactgagaaggagatggcaacaatgaaggaagaattccaaaagatcaaagatgagctcgccaaaagtgaagcaaagaggaaagaactcgaggaaaaaatggttaccctgctgaaggaaaagaatgacttgcaacttcaggtacaggccgaagcagagggcctcgccgacgccgaggagcggtgtgaccagctcattaagacaaagatccagttggaggccaaaatcaaagaagtgaccgaacgggcagaagatgaggaagagatcaacgcagagctcaccgccaagaaacgaaagcttgaggatgagtgctccgagcttaagaaggatattgacgacctggaattaactctggctaaggtggagaaggaaaagcatgccaccgagaataaggttaagaatctgaccgaggaaatggctggcctggacgagaccatcgcgaaactaactaaagagaaaaaagccctgcaagaggcacatcaacagacactcgacgacctgcaagcggaggaggacaaagtaaacaccctcaccaaggcgaaaattaagctggaacagcaggtggacgatcttgagggctctcttgaacaggagaaaaagctcaggatggatcttgaacgggctaagcgcaaactggagggggatctgaagctggctcaagaatcaatcatggacattgagaacgaaaaacagcaactggacgagaagctgaagaagaaagaatttgaaatctctaaccttcagagcaaaatcgaggatgaacaggccttaggcatccagttacagaaaaaaatcaaggagctgcaggctcggatcgaggaactagaggaggaaatagaggccgagagggcatcccgagccaaggcagagaaacaaagatccgatttgtcacgggagctggaggagatttctgaacggctggaagaggcgggcggtgccacatctgctcagatagagatgaataaaaaacgggaagcagaatttcagaagatgcggcgggacctggaggaggccactttacagcacgaggcaacggctgcgaccctcagaaagaagcacgccgattcggtggccgagctgggtgagcagattgataacctacaaagggttaagcagaagctcgagaaggaaaagagcgagatgaagatggagatcgatgacctggcctccaatgttgagactgttagcaaggcgaaaggcaatctggagaaaatgtgtagaaccctggaggaccagctcagcgaactgaagtcaaaagaggaggagcagcaaaggttaatcaatgatcttaccgcccagagggggagactccagaccgagtccggcgagttctctcgccaactcgacgagaaggaggcactcgtatcccagctctctcgaggtaaacaggccttcacccagcagattgaggagctaaaaaggcagttagaagaagagattaaagccaagaacgcgctggctcatgccctccaatcctcaagacacgattgtgatctcctgagagaacagtatgaagaagaacaggaatccaaggccgagctccagagggccctctcaaaggccaacacggaagtagcccagtggcgcaccaagtacgagactgacgcaatccagaggacagaagaattggaggaagcgaagaaaaagttggctcagagacttcaggctgccgaagagcatgtcgaggccgtgaacgcgaagtgtgcgtctctggagaagaccaagcagcggctccagaacgaagttgaggatctaatgctggatgtggagcgcacaaatgccgcttgtgccgcactcgataagaagcaacgaaacttcgataagatcctggcagaatggaagcagaagtgcgaggaaacccatgctgaacttgaggcttcacaaaaagaagccagaagtttaggcactgaactcttcaaaatcaagaacgcttacgaagaatctctggaccaactggagacactgaagagggagaacaaaaatctacagcaagaaataagtgacctcactgaacagatcgcggaagggggtaagagaatccacgagcttgaaaagattaagaagcaggtggaacaggagaaatgcgaattgcaggccgcattagaagaagctgaagcctcattggagcatgaagagggaaagatcttaagaatccaacttgaacttaatcaagtgaaatccgaagtggaccgaaagattgcggaaaaagatgaagagatcgatcagttgaaaaggaaccatatccggatcgtggaaagcatgcagtctacactggatgccgaaattcgaagccgaaatgatgccattcggttaaagaagaaaatggaaggggatctgaatgagatggagatccagttgaaccatgcaaatcgcatggctgctgaagctcttaggaattaccggaatacgcagggaatcctgaaagacacgcagatacacttggatgacgccctaagatcccaagaagacttgaaggaacaactggcaatggttgagcggcgcgccaacctgctccaggcggagattgaggaacttcgagccaccctagaacagaccgaacggagcagaaaaatcgcagagcaagagctcttagatgcgagcgagagggtgcagttgctccacacccaaaatacaagtctgattaatactaagaaaaagctggagacggatattagtcagatgcagggagagatggaggatattctccaggaagctagaaacgcagaggagaaagccaaaaaagcgatcaccgatgccgcaatgatggcagaggagctcaagaaagagcaggatacttctgcacacctggaacggatgaagaagaacatggagcaaaccgtgaaggacctgcagttgcgcttggacgaggctgaacagctggcactgaaggggggaaagaaacagatccagaagctcgaagcgagagtccgtgagctagagggggaggttgaaagcgagcagaagagaaatgctgaggcggtcaagggactcagaaaacatgaaaggcgagtgaaggagctgacctaccagacagaggaagatcggaagaacatccttagactgcaggacctggtcgataaactgcaggcaaaagtcaagagctataaaaggcaggcagaagaggcagaggaacagagcaacaccaatcttgccaagttcagaaagctacagcatgagttggaggaggcagaagaacgcgcagatattgctgaatcccaggttaataagctgagggtgaagagcagagaggttcacacaaaagtgatctccgaggagtag

SEQ ID NO: 196305 - DNA, 5826 bp, Artificial Sequence
  Description of Artificial Sequence: Synthetic coding sequence
atgagcagcgacagcgagctggccgtgttcggcgaggccgccccctttctacggaaatcagagcgggagaggatcgaggctcagaacaggcccttcgacgcaaagacatccgtgtttgttgccgagccaaaggagtccttcgtcaagggcaccatacagagtagagagggtggaaaggtgaccgtaaaaacagagggcggagcgaccctgacagtgaaagacgaccaagtgttccccatgaatcctcccaagtatgataagattgaggacatggccatgatgacccatctgcacgaaccagctgtcctgtacaacctaaaggagcggtacgccgcctggatgatatacacctacagtggactgttctgtgtgacggtgaatccctataaatggttaccagtttacaagcctgaggtggttaccgcctatcgcggcaagaaacggcaggaggctcctccgcacatcttctctataagcgacaatgcttatcagttcatgctgactgatcgagaaaaccagagcattttgatcacaggggaaagtggggctggaaaaacagtgaacacaaaacgcgttatccaatattttgctaccatcgcagttacaggtgagaagaagaaagaggaaataacatcggggaagatccaaggtactttggaggatcagattattagcgcaaacccccttctggaagcctttggtaacgcgaaaacagtgcgaaacgataattctagcagatttggcaagtttatcaggattcactttgggacaaccggaaagctggcgtcggccgacattgagacctatctgctcgagaagtcccgagtcgtattccaactgaaagcagagcgcagttatcacattttctatcagattaccagtaataagaagcccgaactgattgaaatgctgttgatcacaactaacccatatgactaccccttcgtttctcagggcgaaatctctgtagcttccattgacgaccaagaagaattgatggccacagatagtgcaattgatatcctggggtttaccaatgaggagaaggtctcaatttataaactcaccggtgcggttatgcactatggaaacctgaaatttaagcagaaacagagagaggaacaggccgagcctgacggaaccgaggtggcagataaggccgcttacctccagtctttgaactccgctgatctcttgaaggctttatgttaccctcgtgtcaaggtggggaatgagtatgttaccaaggggcagactgttgagcaggtgagtaacgccgtcggtgcgcttgctaaagccgtgtatgaaaagatgttcctctggatggtggctaggataaatcagcagcttgataccaaacaaccgcggcagtactttataggtgtcctggatatcgctgggttcgaaatattcgattttaacagcctggagcaattatgtatcaacttcaccaacgagaaattgcagcagtttttcaatcaccacatgtttgtgctagagcaggaagagtacaagaaggagggcatcgagtggacgtttattgatttcggcatggatctggctgcatgtatcgagctaatagagaagcccatggggatcttttcaattctcgaggaggaatgcatgtttcccaaggcgacagatacttcatttaagaacaaactatatgatcagcacctcggaaaaagcgctaactttcagaaaccaaaagtggttaagggaaaggccgaggcacattttgccctcattcactacgctggcgtcgtcgattacaatatcaccggatggctggaaaagaacaaggaccctcttaacgagaccgtggtaggactctaccagaaatctgccatgaaaactctcgctcagctctttagcggtgctcagacagcagagggggagggtgccggaggcggagcaaagaagggcggcaagaaaaagggtagcagtttccagactgtcagtgctcttttccgcgagaatctgaacaaactcatgaccaatttgcggtccacgcacccacatttcgtccggtgcatcatcccaaacgagacaaaaactccaggcgccatggagcatgagctagtgcttcatcagctgcgctgcaacggtgttctggaggggattcgcatttgtcgcaaggggtttccatcaagaatcttgtatgcagacttcaagcaaagatataaagtgctcaacgcctccgcgattcccgagggtcaatttatcgacagcaaaaaggcctccgaaaagctcctggcatcgatcgacatcgatcacactcaatataagtttggccacacaaaagtcttctttaaagctggtctcctcgggctactcgaggaaatgcgggatgataagctggcccaactgatcacacgcacccaagcgcggtgtagaggcttccttgcccgcgttgaatatcagcggatggtggaacgaagagaagccattttttgtatacagtacaacatcaggtctttcatgaacgtgaagcactggccctggatgaagctcttctttaagattaaaccccttctgaaaagtgccgagacagagaaggaaatggctactatgaaggaggagtttcagaaaataaaagacgagttggctaagtccgaggcaaagcgaaaggaactggaggagaaaatggtgaccctcctcaaggaaaaaaatgatctgcagttgcaggtccaggccgaggcggaagggcttgcagacgcggaagagaggtgcgatcaactcataaaaactaaaatacaactggaggccaaaatcaaggaggtgacagaaagggctgaagatgaggaggagatcaacgccgagctgactgcaaaaaaacgaaagttagaagatgagtgcagtgagctgaagaaagacattgatgatctggagcttactcttgcgaaagtagaaaaagaaaagcatgccactgaaaacaaagtgaagaatctgactgaggagatggccggtctcgatgagaccatagcgaagctcacaaaagagaagaaagccctccaagaggctcaccagcagacattagatgaccttcaagctgaggaggacaaagtaaatacgctcaccaaagcgaagataaagcttgaacaacaagtcgatgatctagagggatccctggagcaggagaaaaaattaaggatggatcttgaaagagctaaaaggaagttggagggggacttaaaactggcccaagagagcatcatggacatcgagaatgagaaacaacagctagatgagaagctgaaaaagaaagaattcgagatcagcaaccttcaatcaaagatcgaggatgaacaggcgctggggattcagctgcagaaaaagataaaggagttacaggcacgaatagaagagcttgaggaagagatagaagccgagcgcgcatctcgggctaaggccgaaaagcagcgctccgacctgagtagagagttagaagaaatctcagaaaggcttgaggaagcaggtggggcaactagcgctcagatcgaaatgaacaaaaaacgggaagccgagttccagaaaatgcgccgcgatctagaggaggctaccttacagcatgaagctacggcggccactctcagaaaaaagcacgccgactccgtcgctgaacttggtgaacaaatagacaacttgcaaagagttaagcagaagttggagaaggagaaatcagagatgaagatggagatcgacgacctcgcctccaatgtcgaaaccgtttcaaaagccaaaggcaacctggagaagatgtgccggaccctcgaggatcaactttcagaattgaagtccaaagaagaggaacaacagagattaattaatgaccttactgcccaaaggggcagactgcagaccgagagcggcgagttcagccggcagctggatgaaaaagaggcactggtcagtcagctttcgagaggaaaacaggcgtttactcagcagattgaagagctgaagagacagctggaggaggagattaaggccaagaatgccctggcccatgcacttcaatcttctaggcatgattgcgatctgctgagagagcagtacgaagaggagcaagagagcaaagccgagttgcagcgggctctgtcaaaggccaatacagaagtcgcccagtggagaactaaatacgagaccgatgcaatccagcgcacagaggagctcgaggaagctaaaaaaaagttagcacagaggctccaagcggctgaagagcacgtggaagccgtcaacgccaagtgtgcttctctcgaaaagaccaagcagcgcttgcagaacgaggtggaagatctgatgttagatgtagaacgtactaatgccgcatgcgcagctctggacaagaagcagaggaactttgacaagatcttagcggaatggaagcagaagtgcgaggagactcacgctgagttggaggcttcccagaaagaagcaagatcgctgggcactgagctgttcaagattaaaaacgcatacgaagagtctcttgatcaactggaaaccctgaaaagagagaacaaaaatctgcagcaggagatcagcgacctgaccgaacagatagcagaggggggaaagcgcatccatgaacttgaaaaaatcaaaaagcaggttgaacaggagaagtgtgaactgcaggcagcactagaggaggccgaggcgtctctggagcacgaggagggcaagattttaaggattcagctggagcttaaccaagtgaagtccgaagtggatcgcaagatagctgagaaagacgaggaaatcgatcagctcaagcgcaatcacattaggatcgttgaatccatgcagtctacactcgacgccgagatccgatccagaaacgatgcgatacgcctgaagaaaaaaatggagggcgatttgaacgagatggagatccagctcaatcacgctaataggatggctgctgaagcactgcgaaactaccgaaatacccaaggcattctgaaggacacccagattcatcttgatgatgctctgcgcagccaagaggatcttaaagaacagctggctatggtagagcgccgcgccaatctgctgcaggccgagattgaagaactccgggccaccttagagcagactgagcgcagtaggaaaatcgccgagcaggagctcctggatgcttctgagcgcgtccagttactgcacacccaaaacacctctttaatcaacacgaaaaagaagctggaaaccgatatatcccaaatgcagggagagatggaggacattctccaagaagccaggaatgccgaggagaaggcaaaaaaagctatcacagacgcggccatgatggccgaggagttaaaaaaggaacaggacacgtccgcccacctcgaacgcatgaaaaaaaacatggagcagacagtgaaggatctgcagctccggctggacgaggcagagcaattggctctaaagggggggaagaaacagatccaaaagttggaggcacgggtccgtgaactcgaaggcgaggtagaatccgaacagaaacgcaacgctgaggccgttaagggccttcggaagcacgagagaagagtcaaggaactcacctatcaaacagaagaagacagaaagaacattttgagattacaagacttggtggacaaactgcaagccaaagtaaagagttacaagaggcaagccgaggaggccgaggagcaatccaacacaaacctggctaagtttcgcaagctacagcacgaactcgaagaggccgaggagagggctgatattgctgagtcgcaggttaacaaactgcgggtcaagtcacgagaggtccacaccaaggttatcagtgaggaatag

SEQ ID NO: 196306 - DNA, 549 bp, Artificial Sequence
  Description of Artificial Sequence: Synthetic coding sequence
atgagcagcgacagcgagctggccgtgttcggcgaggccgcccccttcctccgaaagtcagagcgggagcgaattgaggcccaaaacagaccatttgacgcaaagacatcggttttcgtcgctgaacccaaagaaagttttgtgaaaggaaccatacaatctcgtgagggcggaaaggttacagttaaaactgaggggggcgcaacccttaccgtgaaagatgatcaggtgttcccaatgaaccctccaaagtatgacaagatcgaagatatggcaatgatgacccacctgcacgaaccagcggtgctctacaatctcaaagagcgatatgctgcttggatgatttacacttactctggacttttttgtgtcaccgtaaatccttacaagtggcttcccgtttacaagcctgaggtggtcaccgcttatagggggaagaaacgacaggaagccccacctcacattttcagtatcagtgacaatgcctatcaattcatgttgaccgatagagagaaccaaagtattttgatcaccggggagtctggctag

SEQ ID NO: 196307 - DNA, 405 bp, Artificial Sequence
  Description of Artificial Sequence: Synthetic coding sequence
atgagcagcgacagcgagctggccgtgttcggcgaggccgccccctttttgcgcaaatctgagcgggaaaggattgaagcccagaatcgacctttcgatgcgaagacatcagtgtttgtcgccgaacccaaagaaagcttcgttaagggcaccattcaaagcagggaaggaggaaaggtcacagttaagaccgaaggcggggccacacttactgtgaaggacgaccaagttttccccatgaaccctccaaaatacgataaaatagaagatatggccatgatgacgcatcttcacgaacccgcagtgttatacaatctgaaagaaagatacgccgcatggatgatctatacctatagcggcctgttttgcgtgaccgtgaacccatataagtggctgccagtctag

SEQ ID NO: 196308 - DNA, 2127 bp, Artificial Sequence
  Description of Artificial Sequence: Synthetic coding sequence
atgagcagcgacagcgagctggccgtgttcggcgaggccgccccctttttgcgcaaaagcgaaagggaacgtatcgaagcgcaaaaccgccccttcgatgcaaagacttccgtgttcgtggccgagcccaaggaatcattcgtgaaggggacaatccagagccgcgagggagggaaagtgactgtgaagaccgagggcggcgccacccttacagtgaaggacgatcaggtcttcccaatgaaccctcccaagtatgataagattgaggacatggctatgatgacccacctgcatgaacccgctgtgctgtacaatcttaaggaacgatacgccgcctggatgatttatacatactcggggctattttgcgtgactgtgaacccctataaatggctgccagtttataagcctgaggttgtgaccgcgtataggggcaaaaaaagacaagaggcccccccccacatctttagcatctctgataacgcctaccagttcatgctcaccgacagagagaatcaaagcattctgattacaggggagtcaggggccggcaaaactgtaaacaccaagcgggttatccagtacttcgccacaatagcggttacaggggagaagaaaaaggaggaaattacaagtggcaaaatccaagggacccttgaagatcagataataagcgccaacccacttttagaggcctttggtaacgccaagacggtccgaaatgataactcctctcggtttggcaagtttataaggatacactttggtaccactgggaagttggcaagcgcagacatcgaaacctacctgttggagaagtcccgagtggtgttccagctcaaggccgaacgatcttaccacattttctaccaaatcacatccaataaaaagcccgagctgatcgaaatgctgctgataacaacaaatccgtacgattatccttttgtatcccagggagagatttctgtggcgtcaatcgacgatcaggaggagctcatggcgacagattcggccattgatatcctgggattcaccaacgaggaaaaagtatctatatacaagctgacgggagccgtcatgcattatggcaatctgaaattcaaacagaagcagagggaagaacaggcagaaccagacggaactgaggtagcagacaaagccgcctacttacaaagcctcaacagcgcagatctactgaaagcactctgctacccccgggttaaggtggggaatgaatatgtgactaaaggccagaccgtcgagcaggtgtctaacgctgtgggagccctggctaaggcagtgtacgagaaaatgttcctttggatggtggcgcgcataaatcagcagctagacactaagcagccacgtcagtactttattggcgttttggatatcgcaggtttcgaaatttttgattttaattcactcgagcagctatgtattaactttacaaacgaaaaattacaacagttctttaaccaccacatgttcgttctggaacaggaagaatacaaaaaggagggcattgaatggactttcatcgattttggaatggacctggcagcctgtatcgaattgatcgagaagccaatggggattttttctattctggaggaagagtgcatgttcccaaaggccaccgatacatcctttaagaataagctatatgaccagcatctaggtaagtctgccaacttccagaagcccaaggttgtgaagggaaaagccgaggcacattttgccctgatccattatgccggggtggtggattataatataaccggttggttagagaagaacaaggatcctttaaacgagactgttgtgggtctgtaccaaaagtcggcaatgaagacccttgcacaacttttcagtggtgcacagacggctgagggcgagggggccgggggaggagcaaagaaaggcggcaaaaaaaaaggctcttcctttcagactgtgtctgcacttttccgagaggagcagtccaacacaaacttggccaagtttagaaaactccaacatgagctagaagaggccgaagaacgtgctgacattgcagaatctcaggtgaacaaattgcgtgtgaaaagccgtgaggtccacacaaaagttatctctgaagaatag

SEQ ID NO: 196309 - DNA, 5820 bp, Artificial Sequence
  Description of Artificial Sequence: Synthetic coding sequence
atgagcagcgacagcgagatggccatcttcggcgaggccgccccctttcttcggaaaagtgagagggaacggatagaagctcaaaataaaccatttgacgctaaaactagcgtgttcgtggttgacccgaaggagtccttcgttaaggccacagtgcagtcccgggagggtggaaaggttacagccaaaacagaggccggagccacggtcaccgtgaaagacgatcaggtctttccgatgaacccacctaaatatgacaaaattgaggatatggccatgatgactcacttacacgaaccagccgttctgtataacttgaaagagcgctacgcagcctggatgatttacacttactccggactgttttgcgtgactgttaatccatacaaatggctgccagtgtacaacgccgaggtcgtcacagcgtacaggggaaagaagagacaggaagcaccaccgcacatattcagcatttccgacaacgcgtatcaatttatgctcacagatcgggagaaccagtccattttaataaccggggaaagcggcgccgggaagaccgtgaacactaaacgagtaattcagtatttcgctaccatcgccgtcacgggcgagaagaagaaggaggaggtgacctccggcaagatgcagggcaccctagaggaccagattatatccgcgaatcctctgttggaagcatttgggaacgcaaaaactgttcggaacgataatagcagccgattcgggaagttcatccgcattcactttggtaccaccggaaagctggccagtgctgacattgaaacctatctactcgaaaaaagtagggtgacattccagctcaaagccgagagatcataccacatcttctaccaaattatgtccaacaagaagccggacctgattgagatgctgctgatcaccacaaacccctacgactacgcttttgtgtcgcagggtgaaattaccgtacccagcatcgacgatcaggaggagctgatggccacagatagcgccatcgagatcctcggattcactagcgacgagcgggtaagcatctataaactgacaggagccgtcatgcactacgggaacatgaaattcaaacaaaagcaaagggaagaacaggccgaacctgacggcaccgaggtggccgacaaggcagcgtatcttcagaatctgaacagtgccgatctccttaaggccctgtgttatccccgggtgaaggtaggtaacgagtacgtcactaaagggcagacagtacagcaggtctataacgctgtcggagctctggccaaagcggtctacgataagatgttcttgtggatggtgactcggattaatcagcagctggacaccaagcagcccagacagtattttattggtgtgcttgatatcgctggttttgaaatctttgatttcaattcactggagcaactttgcattaactttaccaatgaaaagttgcagcagttctttaatcaccatatgttcgtgttggaacaggaagaatataaaaaggagggcattgaatggacttttattgattttgggatggatttggccgcatgcatcgaactgatcgaaaagcctatgggcatattttccatcctggaggaagaatgcatgttccctaaggcaactgacacctctttcaaaaacaaactgtatgagcaacacctgggcaagagtaataatttccagaagcccaagccagcaaaaggcaaaccagaagcccatttttcacttattcactacgctggaacggtcgactataacattgcaggttggctcgacaaaaacaaggacccccttaacgagactgtagtcggcctctaccagaagtctgctatgaagactctggcattattgttcgtgggagccaccggcgcggaagcagaggctggtggcgggaagaagggtggaaagaagaaaggaagcagttttcagactgtgtccgcactcttccgggaaaacctaaataaactgatgaccaatttacggtctacacatccacacttcgtgaggtgcatcatcccaaatgaaaccaagacccccggagctatggagcatgaactagttcttcatcagcttcgctgcaacggtgtactggaagggataaggatttgtcggaaaggattccccagtagaattctgtacgctgatttcaagcaacgttacaaagtgctcaacgcatccgcgattccagaaggccagttcatcgatagtaagaaggctagcgagaagctcctggggtcaatcgacatcgaccacacacaatacaaatttgggcacacaaaggttttttttaaggccggcctcctggggctgcttgaggagatgcgggatgagaagctcgcccaattgatcacgaggacccaggcgatgtgcagaggtttcttggcccgggtcgagtaccagaagatggtggagcgacgcgagtcgatcttttgcatccagtataacgtgcgggctttcatgaacgtgaagcactggccatggatgaaattatactttaaaatcaagccactccttaagagcgctgagacagagaaagaaatggctaatatgaaggaggagttcgagaaaactaaagaggaactggccaaaactgaggctaagagaaaggaattggaggagaaaatggttaccctgatgcaggagaagaatgatcttcagctccaggttcaggcagaagcagattccctggcagatgcagaagaacgctgcgatcagctgattaagacaaaaatccaactcgaagctaaaattaaagaagtgaccgaaagggctgaggacgaagaggagatcaacgcggaacttacggctaagaagcggaagcttgaagacgaatgttcagagttgaaaaaggacatcgacgatctggagttgaccttggctaaagtcgaaaaggaaaagcacgctacagagaacaaggtgaagaatctcacagaggaaatggcgggcctcgacgaaaccatcgccaagctcactaaggagaagaaagcgctccaggaggcacaccagcaaacacttgatgacctgcaagccgaagaagacaaagttaatacgctgaccaaagcgaagattaagctagaacagcaagtggatgatttggaagggagcctggaacaggaaaaaaagatccgaatggatcttgagcgggcaaagagaaaactggagggggacctcaaactggcccaagagtccaccatggacatagaaaacgacaagcaacagctcgacgagaaactaaagaagaaagaatttgaaatgagcggtcttcagtccaagattgaagatgaacaggccctcggcatgcaactgcagaagaagataaaagaactgcaggcccggattgaagagttggaggaggaaatagaggctgagcgggccagccgtgccaaagctgaaaaacagagatctgaccttagccgagagttagaggagattagcgagcgcctcgaagaagctggcggggctacgtccgcccagatagagatgaataagaagagagaagcggagttccagaaaatgaggagggatcttgaagaggccaccttgcagcatgaggccacagcagccactctgcgaaagaagcacgctgatagcgtcgctgagttgggtgaacagatcgacaatttacagcgtgtgaaacaaaaactcgaaaaggagaaatccgagatgaagatggaaattgatgacctggcctcaaacatggagaccgtctcaaaggccaagggcaacctggaaaaaatgtgcagagccttggaggaccagctcagcgaaatcaagaccaaggaggaagagcagcaacggcttatcaacgaccttactgctcaaagggctcggctgcagactgagagtggtgagtattctcgacagctagatgaaaaagacaccttagtatctcagctcagcagagggaaacaggcgtttacgcagcagatcgaggaattgaagcgtcaactagaggaagagatcaaggcgaaaagcgccctcgcacacgccctgcagtcttcgaggcacgactgtgacttgctgcgcgagcaatatgaggaggagcaggaggcgaaagccgagcttcagagagctatgtcaaaagcgaattcggaggtggcacagtggagaaccaaatacgagacggacgccattcagcgcaccgaggagctagaggaggccaagaaaaaactggcccagcgcttgcaggacgcagaagagcatgttgaagccgtaaacgccaagtgcgcctcactggagaagaccaaacaacgacttcaaaacgaggtggaggatcttatgattgacgttgaaagaaccaatgccgcttgtgctgctcttgacaagaagcagaggaactttgacaagattttagctgaatggaagcagaaatgtgaagagacacatgccgagctggaagcctcccagaaggagtcccgtagcttgtctaccgaactattcaagataaaaaacgcatacgaagagtccctggatcaactggaaacccttaagagggagaataaaaacttgcaacaagaaatatccgacctgacggaacagatagcagagggcggcaagaggatacatgaactggaaaaaattaagaagcaggttgaacaggaaaaaagtgagttgcaagcagccctggaagaggctgaggctagtctagaacatgaggaggggaaaattctgagaatccagctggaattgaaccaagtaaaaagcgaggtagaccgaaaaatcgctgagaaggacgaggagattgatcagatgaaacgtaatcatatcaggattgtcgagtccatgcagtccacactggacgctgagatcaggagccggaatgatgccataagactcaaaaagaagatggaaggtgatcttaacgaaatggagatacaactgaaccacgccaatcggatggccgccgaagccctccgaaattacagaaacacacaggcgatcctgaaggatacacaattgcatctggatgacgcccttcggtcccaggaggatttgaaggagcaactggccatggtcgagagacgagccaatctgttgcaggcagagatagaggaactccgtgcaacattggagcagacagagagaagtcgtaagattgccgagcaggagctgctcgatgcctcagaacgcgtgcagttattacacacacagaacacgagccttattaacactaagaagaagcttgaaaccgatattagccagatacaaggcgaaatggaggacatcattcaggaggcaaggaacgctgaggagaaggctaaaaaagcgattactgacgctgctatgatggctgaggaactgaaaaaggagcaggatacttccgcccatctagagaggatgaagaaaaaccttgagcaaaccgttaaggacctgcagcacaggctggatgaggcagaacagcttgcactcaagggcggtaagaaacaaatacagaagctggaggcccgagtgcgggagttggaaggagaagtcgaatcagagcaaaagcgcaacgtggaggccgtgaagggcttgagaaaacatgagcggaaggttaaagagctgacctaccaaacagaggaagaccgaaagaatatcctgcggctccaggacctggtggacaaactgcaggcaaaagttaagtcgtataaacgccaggcagaagaggcggaggaacagagcaacgtgaacttatcgaaattcaggagaatacagcacgagctggaagaggccgaggagcgcgcggatattgcagagtctcaggtgaataaattaagagtgaaatcccgggaggtgcacactaaaattatttccgaagagtag

SEQ ID NO: 196310 - DNA, 5820 bp, Artificial Sequence
  Description of Artificial Sequence: Synthetic coding sequence
atgagcagcgacagcgagatggccatcttcggcgaggccgccccctttctgaggaagtccgaaaaggagcgaattgaggctcagaacaagccctttgatgcgaaaactagtgtgttcgtggttgaccccaaggaatcatacgtcaaggcgatcgtgcagtcgcgggagggtggtaaggtgacggccaaaactgaagctggagccacagtcaccgtgaaagaggatcaagtcttcagtatgaacccccccaagtacgacaaaattgaggacatggccatgatgacccacttacacgaacccgccgtcttatacaatctgaaggagagatatgctgcgtggatgatctacacctacagtggactattctgtgtcacagtgaatccttataaatggctgccagtgtacaatcctgaagtggtcactgcgtatcgtggcaagaagcgacaggaagcccctccccatatcttttcaataagcgataacgcatatcaattcatgctgacggatcgggaaaatcaatcaattctcattacaggtgagtctggagcaggcaaaacagtgaacacaaaacgcgtgatacagtatttcgctactattgccgtcactggcgagaagaagaaggaagaacccgcgagtggaaagatgcagggtacgctggaagatcagataatctccgcaaatcctcttctcgaagcgttcggaaacgccaagacggttagaaatgacaactcaagtaggtttgggaagttcattcgaatccactttggtgcaacaggcaagcttgcatccgccgatattgaaacttatttgctggagaagtctagggtcaccttccagcttaaggcagagcgctcctaccacatattttaccagattctttcgaacaagaagccagagctgatcgaaatgctccttattacaactaacccatacgacttcgcgtttgtaagccagggcgagattacggttcccagtattgatgatcaggaggagctgatggctaccgactcagcggtggacatactaggttttacagctgacgaaaaggttgcaatctacaagttgactggcgccgtgatgcactatggcaatatgaagtttaagcagaagcagagagaggagcaggccgaaccagatggtactgaggtggctgataaggccgcctatcttacctccttgaattcagccgatctattgaaaagtctctgctatccccgagtcaaagttggtaatgaatttgtcaccaaaggacaaaccgttcagcaggtatataatgctgtcggcgccctggctaaggccatttatgagaagatgttcctgtggatggtgacccgaatcaatcagcaactggatacaaaacaaccccggcagtattttatcggggttctggacatcgctgggtttgagattttcgacttcaattcattagagcagctttgcatcaacttcaccaatgagaaactccaacagttctttaaccaccacatgtttgttctggaacaggaagagtataagaaagagggcatagaatgggagttcatcgacttcggtatggacctcgccgcctgcatcgaacttatcgagaaacctatggggatttttagcatcctggaagaggagtgtatgtttccaaaagcaactgacacgagctttaaaaataaactgtacgagcagcacctggggaaaagtaataattttcaaaaaccaaagccagccaaagggaagcccgaggcacactttagcctggtccactacgcgggtaccgtggattacaacatagcgggctggttagataagaacaaagatcctctaaacgagactgtagtcgggctgtaccagaaatccgctatgaaaacactggcgtttctgttttcgggtgcacagaccgcagaggcagaaggaggtggggggaaaaaaggggggaaaaaaaagggttctagctttcagaccgtgagcgcactctttcgagagaacctgaataaactgatgactaatttacgctctacacatccccactttgttaggtgtattattcctaatgaaacaaagacccctggtgctatggaacatgagctggtgcttcaccaattgagatgcaatggagtgcttgagggcatcaggatttgtcgcaaagggttcccatcgcggatcctgtacgcagatttcaaacagcgatataaagtgctcaacgcgtccgctatccccgaagggcagtttattgactctaagaaagctagcgaaaaactgctgggatccatcgaaatcgaccacacccagtataagttcggacatacaaaggtgttttttaaagccggtctactcgggaccctggaggagatgagggatgagaagttggcacagctgatcaccagaacccaagctatttgtcgcggttttctcatgagagtggagttccgcaaaatgatggagcgccgggaatctatcttctgcatacagtacaacattagagcctttatgaatgtcaagcattggccctggatgaaactgtactttaaaatcaagcctctcctaaagagcgccgaaaccgaaaaagagatggctaacatgaaagaggaattcgagaaaaccaaagaagagctggcaaaaacagaggccaagcgaaaagaactggaggagaagatggttacattaatgcaggaaaagaacgacttgcagctgcaggttcaagccgaggctgacgccttggcagacgcagaagagagatgcgaccaacttatcaagaccaaaatacaacttgaggctaagatcaaagaagtgaccgaacgggcagaagatgaagaagagatcaatgctgaactgactgcaaagaaacgcaaactggaagacgaatgctctgagctgaagaaggatattgatgacctggagctaacacttgccaaagtggagaaagagaagcacgctactgagaacaaggtgaagaatttgacagaagagatggcgggcctagacgaaactattgcgaagctgacaaaggaaaagaaagctctccaggaggcccaccagcaaacccttgatgacttgcaaatggaggaagacaaggtaaataccctgactaaagctaagacaaagcttgagcagcaggtggatgatctggagggcagtctcgaacaagagaagaagctctgtatggatctcgaaagggctaaaagaaaattggagggcgacttaaagttggcccaggagtccaccatggacactgagaatgacaagcaacagctgaatgaaaaactgaagaaaaaggagtttgagatgagcaatcttcagggaaaaattgaggacgaacaagccttggccatccaactccagaagaaaatcaaggaactccaggctcgcattgaagagctcgaggaagagatagaggcagagagagccagtagggctaaggcagagaaacagcggtctgacctgtctcgagagcttgaggaaatctcagagaggctcgaggaggcagggggagcgacctcggctcaaatcgagatgaacaaaaagcgggaggccgaattccaaaagatgagaagagacctcgaggagagcactctccaacacgaggcaactgcagccgccctgagaaaaaagcatgccgactccgtggcagagctgggggaacagatagattccctgcaacgcgtcaaacagaaactcgaaaaagagaagtcagaactcaagatggagattaatgacctggctagtaatatggagacggtcagcaaagccaaggccaactttgagaaaatgtgccgtactttagaagaccagctcagcgagatcaaaaccaaggaagaagaacagcaacgcctcattaacgagctgagtgcacagaaggcgagactgcataccgagtccggggagttttccagacagctggatgaaaaggacgcaatggtctcccaactcagccgtggcaaacaggccttcacccaacaaattgaagagctgaaaagacaacttgaggaagaaacaaaggctaagtccacactggctcacgctcttcagtctgcaagacacgactgcgacctgctccgagaacagtatgaggaagaacaggaggcgaaggccgagctccagagaggcatgtccaaggctaatagtgaggttgctcagtggcgaacaaagtatgaaaccgacgcaatacagcggaccgaggagctggaggaggcaaaaaagaagcttgcacagcgtctgcaagacgcagaagagcacgtggaggccgttaatagtaagtgtgcaagtctcgagaaaactaaacaacgactgcagaatgaagtggaagacctgatgatcgacgtggagcgcagcaacgcagcctgcatcgcattggacaaaaagcagaggaacttcgataaagttttggcggaatggaaacagaaatacgaggaaacccaggccgaactggaggcctcccagaaagagagtcggagtctatcaacagagctgtttaaagtgaagaatgcatatgaagagtccttagaccacctggaaaccttaaaaagggagaataagaaccttcagcaggagatcagtgatcttacagagcagatcgcagaaggtgggaagcatattcacgagctggagaaggtaaaaaagcagctagaccatgaaaaaagcgagctgcagacgtcgctcgaggaggcagaagcatccctcgaacacgaggagggcaagatcctgagaatacagttagaattgaatcaggtgaaatccgagatcgacagaaagattgccgagaaggatgaagagctggatcagctcaaacggaaccacttacgggtcgtggagtctatgcagtcaaccctagatgcagagatccgcagcaggaacgatgctttgagaatcaaaaagaagatggagggcgacttgaacgaaatggaaatacagttaaatcacgccaaccggcaggccgcggaagctttgagaaatctccgcaacactcaggggatcctaaaggacacccagttgcaccttgatgatgctatcagggggcaagacgacttaaaagaacagctggcaatggtcgaacgaagggcaaatttaatgcaggcagaggtcgaagagttgagagccagcctcgagcgcactgaacggggaaggaaaatggcagagcaagaacttctcgatgcttcagagcgcgttcagttactgcatactcagaacacttcactcatcaacaccaagaagaaattggagaccgacattagtcaaatccagggggaaatggaagacatcgtgcaggaggcacgaaacgccgaggaaaaggcaaaaaaagcaattactgacgccgccatgatggcggaggagctgaaaaaggaacaggacaccagtgcccatcttgagcgcatgaaaaaaaacatggagcagaccgtcaaggacctgcagctcagactggacgaagccgagcagctagctctgaaggggggaaaaaagcaaattcagaagctggaggccagagtgagggagctagagagtgaggttgagtctgaacagaaacacaatgtcgaggcagtgaagggtctacgaaagcacgagaggcgcgtgaaagagctgacctatcagaccgaggaagatagaaagaatatcctgaggctgcaggatctcgtggacaagctccagacaaaagttaaagcctataagagacaggcagaggaggcggaggaacaaagtaatgtaaacctggccaaattccggaagcttcaacatgagttagaggaggcgaaggaacgcgcagatattgcagagtctcaggtcaataaacttcgcgtgaaatcacgcgaggttcataccaaggtcatcagtgaagagtag

SEQ ID NO: 196311 - DNA, 5820 bp, Artificial Sequence
  Description of Artificial Sequence: Synthetic coding sequence
atgaccgacgcccagatggccgacttcggcgccgccgcccagtacctgagaaaatctgaaaaggagaggttggaggctcagacaaggccctttgatattaggaccgagtgttttgttccagatgataaggaggagttcgtgaaggccaagatccttagtcgcgagggcggaaaggtgatcgccgaaactgagaatgggaagaccgtgaccgtgaaggaagaccaagttctgcaacagaacccacccaagttcgataagattgaggacatggccatgctcaccttcctacacgagccagcggtactgttcaatctgaaggagcggtatgctgcatggatgatctatacttattccggactattctgcgtgacagtcaacccttacaagtggctgcctgtctacaacgcggaagtggtggcagcttacaggggcaagaagcgctctgaggcacctccgcatatcttcagcatttcagacaatgcatatcagtatatgttgacagatagggaaaaccagtccatcctcatcactggtgagagtggagcaggcaagactgttaacacaaaaagagtgattcaatacttcgcctctatagcagccatcggagaccggggaaaaaaggataacgctaacgcaaacaaaggaactctagaggaccagatcattcaggcaaatcctgcgctcgaagctttcggcaacgctaagacagtgcgcaacgataattcttcaaggtttggcaagttcatacgaattcacttcggtgctacgggaaaactcgcctcggcagatattgaaacttacctattggaaaagtctcgagtgatctttcagctcaaggccgagcgcaactatcatatcttctatcagatcctttctaataaaaagcctgaactgttagacatgctcctggtgaccaacaacccttatgattacgcctttgtgagtcagggggaagtgagcgttgctagcattgacgacagcgaggaactaatggcaaccgactctgccttcgacgttttgggctttacgagtgaagagaaagccggcgtctataagttaaccggcgcaatcatgcattatggtaacatgaagtttaaacagaagcagcgtgaggaacaggctgaacctgatggcaccgaggatgccgataaatctgcctatttgatgggattaaactctgctgatcttctgaaagggctgtgccatccgcgagtcaaggtagggaatgagtatgtgacaaagggccagtcggtgcagcaggtctactactccattggcgccctcgctaaggccgtgtatgaaaagatgttcaattggatggtcactcggattaacgccaccctcgagaccaagcagccccgccagtacttcatcggggtcctcgacattgcgggattcgagattttcgacttcaatagctttgagcagctgtgtattaattttactaacgagaagctgcaacaattcttcaaccatcatatgtttgtgctggagcaggaggagtacaaaaaagagggaatcgaatggaccttcatcgactttgggatggacttacaggcttgtatagatctcattgaaaaacctatgggtattatgagcatcctggaagaagaatgcatgtttcctaaagccacggatatgactttcaaggcgaagttgtatgataatcacttaggtaaaagcaataatttccagaagccacgaaacatcaagggaaaacaggaggctcacttttccctgattcattacgccggtactgtggattataatatcttaggatggcttgagaaaaacaaagacccactgaatgaaactgtggtcgccctctaccagaagagtagcctgaaactcatggctacactcttttcttcctatgccacagccgacacaggggacagcggcaagtccaaaggggggaagaagaaaggcagttccttccagacagttagcgcactccacagagagaacctgaacaagctgatgaccaacctgaggactactcaccctcacttcgttaggtgcatcattcctaatgagcgcaaagcacccggagtgatggataatccactggttatgcaccaactccggtgcaacggcgtgctagaagggattcggatctgtaggaaagggttccctaacaggattctttatggcgatttccgtcaacgatacagaatattgaacccagtcgccatacctgaaggtcagttcatcgatagtcgcaaggggacggaaaaattgctgtcatccctggacattgaccataatcagtataaatttggccacaccaaggtcttctttaaagccggcctgctggggctgctagaagagatgcgggatgagcggctctcaagaattatcaccaggatgcaagcccaggcccgcggccagctcatgagaattgagttcaaaaagattgtcgagaggcgggatgccctattagtcatccaatggaatataagggcttttatgggcgtgaaaaattggccctggatgaagctttactttaaaataaagcccctgttaaaatccgctgaaactgaaaaggagatggctacaatgaaggaggagtttggccggataaaggagacgctggagaaaagcgaagcacgccgtaaggagctggaggagaagatggttagcctgctgcaggaaaagaacgatctgcaactacaggtccaggctgaacaggataatttaaatgatgctgaagagcggtgcgaccaattgatcaaaaataaaatacaactcgaggccaaagtcaaggagatgaatgaaagactggaagatgaagaagaaatgaacgcggagctcaccgcaaagaaaagaaagctggaggatgaatgttctgaactaaagaaagatattgatgacctcgagctgacactggcgaaagtggagaaggaaaagcacgccaccgagaacaaagtgaaaaacttgactgaagaaatggccggactggatgagatcattgcgaagctcactaaggagaaaaaagctctgcaggaggcccaccagcaggcactggatgacctgcaggtcgaagaggacaaggtgaattcactttcgaaaagtaaggttaaattggagcaacaagtggacgatcttgaaggatcgctggagcaagagaagaaggtcaggatggacttggaaagggccaaacgcaagttggaaggggacctcaagctaacccaggaaagcattatggacttggaaaacgacaagctgcagcttgaggaaaagcttaagaaaaaggagttcgacattaaccagcagaactctaagatagaagatgaacaggtgcttgccctgcaactgcaaaaaaaactgaaagaaaaccaagcccggatcgaagagttggaagaggagctggaagccgagagaacggctagggccaaagtggaaaagcttcggagcgacttaagccgcgaactggaggagatctcagagaggctggaggaagccggaggggccacctcggtgcagatcgagatgaacaaaaagagagaagcagagtttcagaagatgcggcgcgacctagaggaggccacacttcaacatgaagcaacagcagctgctctgaggaagaaacacgccgatagtgtggcggagctgggagagcagattgacaacctccagagagtcaagcagaagttggagaaggaaaagagcgagttcaagctcgagctggacgatgtgacctcaaatatggaacagatcattaaggcaaaagcaaatcttgagaaggtcagcagaactctagaagaccaagcaaacgagtacagagtcaaactggaagaggcgcaacggtctctcaacgattttactacgcagcgggccaaacttcagaccgagaacggtgagctggcaagacagctggaagaaaaggaagcactgatttcacagctaacaaggggaaagctgtcttacactcagcagatggaagacctaaagcgccagctcgaggaagagggaaaagccaagaacgcacttgcgcacgcattacagagtgctcgccatgattgtgacctcctgagagaacagtacgaggaagagacggaagctaaagcagaattgcagcgtgtgctgtcaaaggccaacagtgaagtcgcgcagtggcggactaaatacgagacagatgcgatccagcgtacggaggaactggaggaggcaaagaaaaaactggcccaacgtctccaggatgctgaagaggccgtcgaagcggttaatgcaaaatgctcaagtctcgagaagaccaagcatcgacttcagaatgaaatcgaggatctgatggtggacgtggaacggagtaacgccgcagccgccgctctggataagaaacagagaaactttgacaagatcctggcggaatggaaacagaaatatgaagaatctcagtcggagttggagagcagccagaaagaggccaggtcactctcgactgagctatttaagcttaagaatgcatatgaagagtcactcgagcacctggagacttttaaacgcgaaaacaaaaacctgcaggaggagatctccgatctcaccgagcagcttggtgagggtgggaagaacgtgcacgagctggaaaaagtcagaaagcagttagaagtcgaaaagctcgagctgcagtcggccttggaagaagcagaggcgtccttagaacacgaagagggcaagatcctgagagctcagcttgaatttaaccagataaaggcagagattgaacgcaagctcgccgaaaaggatgaagagatggagcaggccaaacggaaccatcaaagagtcgtggactctctccagacaagtctggacgctgaaacgcggtcgcgaaatgaagtgctcagggtgaaaaagaagatggaaggtgatctcaacgagatggagatccagctctcacacgctaaccgaatggcggccgaggcacagaagcaggtgaaatccctccagtccctccttaaagacacccagatccagctcgacgatgcagtccgcgcgaacgacgatctgaaagaaaatatcgctatagtcgagcgtagaaataacctcctgcaagccgaactggaggagttaagagccgtggtcgagcagactgaaaggtcacggaagctcgctgaacaggagctcattgaaactagtgagcgagtccagctcctgcacagccagaacacatccctgattaaccagaaaaagaaaatggagagcgatcttactcagctccagagcgaggtggaggaggctgttcaagagtgcaggaatgccgaagaaaaggccaagaaggctataacagacgcagccatgatggcggaggaactgaaaaaggagcaggatacctccgctcatcttgagcggatgaaaaaaaacatggagcagacaattaaagacctccaacacaggctggacgaggccgaacaaatcgccctgaagggtggcaagaaacagctgcagaaactggaggctcgagtccgcgaactcgaaggtgagctcgaagccgagcaaaaacggaatgccgagtcggtgaaaggaatgcggaagagcgaacgacggattaaggagttgacctaccagacggaggaagataagaaaaacttactacggcttcaggacctggttgacaaattgcagctcaaagtaaaggcctacaaacggcaggcagaagaggccgaggaacaagctaacactaatctgtccaagtttaggaaggtgcaacacgaactcgatgaagctgaggaacgtgcagatattgccgaatcacaggtcaataagctccgcgcaaagagccgggacatcggcgctaaacagaagatgcatgatgaagagtag

SEQ ID NO: 196312 - DNA, 5820 bp, Artificial Sequence
  Description of Artificial Sequence: Synthetic coding sequence
atgaccgacgcccagatggccgacttcggcgccgccgcccagtacttgcgtaagtccgagaaagaacggttggaggcccaaacccggccctttgatatccgaactgagtgctttgtccctgatgacaaggaggagtttgtgaaagccaagatactatcacgcgaaggcggcaaagtcattgcagagactgaaaacgggaaaacagtaaccgtgaaggaagaccaggtgctccagcagaatcccccaaagttcgacaaaatagaagacatggccatgctgaccttcctgcatgagcctgcagtgcttttcaacctgaaggagcggtacgccgcatggatgatctacacctatagcgggctgttctgtgtgacggtcaacccttataaatggcttcccgtctacaacgccgaagtcgtcgccgcatatcgcgggaaaaagaggagcgaggccccgcctcatattttctcaatatccgataacgcgtatcagtatatgctcactgaccgagagaaccagagtatcctcatcaccggagagagcggcgcgggcaaaaccgtgaatactaaaagagtgattcaatattttgctagtatagccgccatcggcgatagaggaaaaaaagataacgccaacgcgaataaaggtaccctggaggatcagatcatccaagcaaatcccgcacttgaggcatttgggaatgcaaagacagttcgtaacgacaacagttcccggtttggaaagtttatcagaatacattttggcgccaccggcaaactggcttccgcggatatcgagacatatctactcgagaagtcacgggtgattttccagctgaaggctgagagaaactatcatatcttttaccagatcctgagcaataagaagcctgagttgctggacatgctgttagtgaccaacaatccctatgactatgcgtttgtttctcagggcgaagtgagtgtggccagcattgatgacagcgaggagctgatggccacggactctgcgtttgacgtgctgggctttaccagcgaggaaaaggcaggggtgtacaagctgacgggggcgatcatgcactatggaaatatgaagttcaaacagaaacagcgcgaggaacaggctgaacccgacgggacagaagacgctgataagagcgcctatttaatgggcctaaattccgccgatttattaaagggtctgtgtcacccaagagttaaagtcggcaatgaatatgtgactaagggccagtccgtgcaacaggtgtactactctatcggcgccctggcaaaagcagtgtacgagaaaatgtttaattggatggtcactaggatcaatgccaccctcgaaactaaacagccaaggcaatattttattggcgtgctcgacatcgcagggtttgagatcttcgactttaattcctttgagcaattatgcatcaacttcactaatgaaaagttgcagcagtttttcaaccaccacatgtttgtcctggagcaggaggaatacaagaaggaggggatcgagtggacatttattgactttggtatggaccttcaggcttgcatagatttaatagagaagcctatgggtatcatgtccatcttggaagaagagtgcatgtttcctaaggctaccgatatgacatttaaggccaagctctatgataaccacctgggtaagtccaataatttccagaagccccgcaatatcaagggtaaacaggaagctcatttctccttgattcattacgctgggacagtggattacaatatcctcggctggctcgaaaaaaacaaagaccctcttaacgagacagtggttgcactgtaccagaaatctagccttaaactcatggccacgctttttagcagctacgcaaccgcagataccggagactcaggcaaatcaaaagggggaaagaaaaaggggtcgtcttttcagacagtgtctgctctccatcgagagaaccttaataaactgatgacaaacctgagaaccacccatccccacttcgtgcgatgcattatccctaacgagcggaaggcgccaggggtgatggataacccgttggtgatgcatcaactgaggtgcaatggcgtgcttgaaggcataaggatatgccggaaagggttccctaacagaattctatacggggatttccgtcagcggtacagaatccttaacccagtcgcaattcctgagggccagttcattgatagcaggaagggaactgaaaaactgctgagtagcctagacatcgaccacaatcaatacaaatttggccataccaaggtgttcttcaaggcgggcttgttggggcttcttgaagaaatgcgggacgaacgcctcagccgcattattacccgaatgcaggcgcaggcgcggggccagcttatgcggattgaattcaagaagatcgttgagaggcgggatgccctcctggtcatccagtggaatattagggctttcatgggcgtcaagaactggccatggatgaaactctactttaagattaaaccccttcttaagagcgccgaaactgaaaaggaaatggcaacaatgaaggaagagtttggacgaataaaagagactcttgagaaaagcgaggcccgccgcaaagaacttgaggagaaaatggttagcctgctgcaggagaagaatgacctgcagctccaagttcaagctgaacaagacaacctcaacgacgcagaggaacggtgcgaccaactcatcaagaacaaaatccagcttgaggccaaggtaaaagagatgaacgagcggctggaagacgaggaggagatgaacgcggagcttaccgccaagaaacggaaattggaagacgaatgctcagaactgaagaaggatattgatgacctcgaactcactctggccaaagtggaaaaggaaaagcacgccacagaaaataaggtgaagaacctgacagaggaaatggctggcctggacgaaattattgccaagctgaccaaagagaaaaaggcactgcaagaagcacaccagcaggccctggatgatctccaggtcgaggaagataaggtcaatagcctttctaaatctaaggtgaagctcgagcagcaggttgacgatctcgagggctccctggagcaggagaaaaaagtgcggatggacctcgagcgcgcaaaacgtaagctggagggcgacctaaaacttacccaggagtccatcatggacttggaaaacgataagctgcagcttgaagagaagctgaagaaaaaggagtttgacattaaccagcaaaacagcaagattgaagacgaacaggtgctagccctgcagcttcaaaaaaagctcaaagagaaccaggcaagaatagaagaactggaggaggaattggaggcagaaagaaccgcgcgagcgaaggtggagaaactgagaagcgatttatcaagggagctggaggaaatctcagagcgactggaggaagctgggggagccacaagtgtgcagattgagatgaacaaaaaaagagaggcagagttccagaaaatgcggcgggacctggaggaggccaccctccagcatgaagccacagcagccgctctccgtaagaagcacgcagattcagtagccgagcttggcgaacagattgacaaccttcagagagtgaaacaaaagctggagaaggaaaagagcgagtttaaactggagctggatgatgtcaccagtaacatggagcaaatcattaaggcgaaggcaaacctggaaaaggtgagtcgcactctggaagaccaggctaacgagtaccgggttaagctcgaggaagctcagaggtctctgaatgacttcacaacacagagagcaaaattgcaaaccgaaaatggtgaactggcgcgacagctggaagaaaaagaagcactcatctcccagcttaccaggggtaaattaagctacactcaacagatggaagacttgaagcgccagttagaggaggagggaaaagccaagaatgccctggcacatgcgctacagtccgcacgccacgactgtgacctgctccgggagcaatatgaggaggagaccgaagccaaagccgagctgcaacgggtcctgtcaaaagcaaactctgaagtcgcccagtggagaacgaaatacgaaacagatgcaatccagaggactgaagagctggaagaggccaagaagaaactcgcccagaggcttcaggatgccgaggaagccgtggaggcagttaacgccaagtgtagctcactcgagaaaactaagcacagactgcagaacgaaattgaagacctcatggttgatgttgagagatccaacgccgcagctgccgcactggataagaagcagcgcaacttcgataagatcctagctgaatggaaacaaaaatacgaggagtcccagtcagaactcgagagcagtcagaaggaggctaggtcactaagtactgaactctttaaactcaaaaatgcatacgaagaaagtctcgaacacttagagacttttaaaagagaaaacaaaaacctgcaagaagagatctcagatctcactgagcagctgggcgaaggtggaaaaaacgtccatgaattagagaaggtgaggaaacagttggaggttgagaagctggagcttcagtctgctctggaagaagccgaagccagcctggaacacgaagagggcaaaattctacgcgcacaactcgaatttaaccagattaaggcagaaattgagcgcaagcttgccgaaaaagacgaggagatggagcaggcaaaacgcaatcaccagcgggttgtcgattcactgcagacctccctagacgccgaaacgaggagcaggaacgaagtcttgcgagttaaaaaaaagatggaaggagatttgaacgagatggaaattcagctctctcatgccaacaggatggctgccgaggctcagaagcaggtaaaaagcctgcagtccctcctgaaagatacgcagattcaactggatgacgcagtgcgagccaacgacgatcttaaggaaaacattgctatcgtggagcggcgaaataacctcctccaggcagaactggaagaactgagggctgtggtggaacagactgagagatcccgcaaattggctgagcaggagttaattgagacatctgaacgcgttcaactgctccactcccagaatactagcctcataaaccagaaaaaaaagatggaaagcgatcttacacagcttcagtcagaagttgaagaggcggtacaggaatgtcgcaatgctgaagagaaggctaaaaaagcgatcacagatgctgccatgatggcggaagaactgaagaaagaacaggatacgagcgcccatctcgagcgaatgaagaagaacatggagcagaccatcaaggatctccagcaccggctggatgaggccgaacagatcgctcttaagggcggcaaaaagcagctgcaaaaactggaagccagggtccgtgaactggagggagaactggaggccgagcaaaagcgaaacgccgaaagcgttaagggaatgagaaagtctgaaaggcgcattaaggaacttacatatcagaccgaggaggacaagaagaatctgctgcggttacaagacctggtggacaagctgcagctgaaggttaaagcctataagagacaagccgaggaagctgaggaacaggctaataccaatctcagcaagttcaggaaagtccagcacgaactggacgaagcagaagagcgtgctgacattgccgagagtcaggtaaacaagctccgcgcaaaatcacgcgacatcggcgccaagcagaagatgcacgatgaggagtag

SEQ ID NO: 196313 - DNA, 5808 bp, Artificial Sequence
  Description of Artificial Sequence: Synthetic coding sequence
atgggcgacagcgagatggccgtgttcggcgccgccgccccctacctaaggaaaagtgagaaggagcgtctggaagcacagacccgccctttcgatctgaagaaggatgtgttcgttccagacgacaagcaggaatttgtgaaagcaaagatagtgtccagggaaggtgggaaggtgactgccgaaaccgagtacggcaagactgtaaccgtgaaagaggatcaagtgatgcaacagaacccacctaagtttgacaagatagaagacatggctatgctgacctttctccatgagcctgccgttctctataacctaaaagacaggtacgggagttggatgatctatacatattccggtctcttctgcgtgacggtgaacccatacaagtggctgcctgtctacacacctgaggtagttgccgcttatcggggcaaaaaacgaagtgaggccccccctcacatcttctcgatttccgataacgcatatcaatacatgctcaccgaccgcgagaaccagtcgatcctgatcactggggaatcgggagctggcaagacagtcaatactaaacgggttattcaatacttcgcagtgatcgccgcgatcggcgatcggagcaagaaggatcaaagccccggaaaaggcactctggaagatcagatcatccaagccaatcctgccctcgaagcgtttggcaacgccaaaaccgtacggaatgacaatagtagccgcttcggcaaattcattcggatccatttcggagcaacaggtaagctagcatctgcggatatagagacttatctgctggagaagtctagagttatctttcagctgaaagccgaaagggattaccatatcttctatcagattctgtccaacaagaagcccgagctgctggacatgttattaatcacaaacaacccctatgactatgcctttattagtcagggtgagacaacagtggccagtatcgacgacgctgaggagctcatggccacagataacgcgtttgacgtgctgggcttcacctccgaggagaagaacagcatgtacaaactcactggggctataatgcatttcggaaacatgaagttcaaactcaaacagcgtgaggagcaggcagaacccgacggcacagaggaagcggataagagcgcttatttgatgggcctcaatagtgctgatctgctgaagggattgtgtcaccctcgagtgaaggttggcaacgagtatgttaccaaaggacagaacgtgcagcaggtgatctatgccacaggggctctagccaaggccgtgtacgagaggatgttcaactggatggtcactcgaatcaacgcaacactggagacaaaacagcctagacagtacttcatcggtgtgctggacatagccggattcgagatcttcgatttcaacagcttcgagcagctgtgtatcaattttacaaacgagaaactccagcaattcttcaatcaccacatgtttgtccttgagcaggaggagtacaaaaaagagggaatcgaatggaccttcattgacttcgggatggacctccaggcatgtatcgacctcattgaaaagcctatgggaatcatgagcattttggaagaggaatgtatgttccccaaggctactgacatgactttcaaggccaaactttttgacaaccatctgggtaaaagcgctaacttccagaagccacggaatattaagggcaagcctgaggcccacttcagccttatccattacgcaggcattgtggattataatataatcgggtggctgcagaagaataaggatcccctaaacgagaccgtggttggcctgtaccagaaaagttcgctcaagctcttaagcacccttttcgcaaattacgccggtgcggacgctccaatagaaaagggcaaaggcaaagccaagaagggaagtagcttccagaccgtgtctgcactgcacagagagaatctgaacaagctgatgaccaacctcaggagcacgcatccacactttgtacgctgcattattccaaatgagaccaaatcccccggcgttatggacaatcccctggtgatgcaccagctccgatgcaatggagtgctggaggggattagaatatgcaggaaaggcttccccaaccggattttatacggtgatttcagacagcgatatcgcattcttaaccctgcagcaatcccagagggacagtttattgactcacgaaagggtgcagagaagctgctcagctcattggacatagaccacaaccaatataagttcggccataccaaggtgttttttaaggctggactgctgggcctgctcgaagagatgcgggatgagagactgagtagaatcattactcgcatccaggcacagtcccggggtgtcctcgctaggatggagtacaagaagctcctggagcggcgtgatagtctgttagttattcaatggaatattagggcctttatgggagtgaaaaattggccatggatgaagctgtactttaagattaagcccctcctcaagtccgccgagcgagaaaaagaaatggcatccatgaaggaagaatttacaagattgaaggaagctctcgagaaatccgaagcaaggcggaaggagctcgaagagaaaatggttagcctgctgcaagaaaaaaatgatttacagctccaggttcaggctgaacaggataacctggctgacgctgaggagaggtgcgaccagctcataaagaacaaaatccagctggaagctaaagtcaaagagatgaatgaaagactggaggacgaggaagagatgaatgcagaattaacagccaagaagagaaagctcgaggatgagtgcagtgagttgaaaagggatattgatgaccttgaacttacactcgccaaggtggagaaggaaaaacacgcgaccgaaaacaaagttaagaacctaacagaagaaatggccggcctggatgaaatcatcgctaagctgacaaaggagaaaaaagctctccaagaagctcaccagcaggccctcgacgacctgcaggctgaagaggacaaagttaacacccttaccaaggctaaagtcaagctggagcagcaggtcgacgacctggaggggagcttggagcaggagaagaaagtgcggatggatcttgagcgagccaagcggaagttagaaggagatctcaagctaacccaggagtccattatggacctcgaaaatgacaaacagcagctcgatgagcgactgaagaaaaaagactttgagctcaacgctctcaacgctcgtattgaggatgagcaggctctgggctcacagcttcagaagaagctgaaagaattgcaggcaagaatcgaagagctggaggaggaactggaggccgaacgcacagcccgcgcaaaggtagaaaagcttcggtcggaccttagcagggagctagaagaaatatctgagaggctagaggaggctggtggcgctacaagtgtgcagattgaaatgaataagaagcgggaggcagagtttcaaaagatgcgccgggatctcgaggaggcaaccctccaacatgaggcaacagccgccgcacttagaaagaaacatgctgactctgttgctgagctgggagaacaaattgacaacctgcagcgtgtgaagcagaagttggagaaggagaagagcgaatttaagttggagctggacgacgttacatcaaatatggaacagataattaaagccaaggcaaacttggagaagatgtgccgcaccctggaagatcaaatgaatgagcaccgtagcaaggccgaggagactcagaggtccgtgaatgatctaacctcccagcgcgctaagttgcagaccgaaaacggagagctgtccaggcagctggatgagaaggaagcattgatttcacagctgacgagaggaaagctgacgtacacgcagcaactagaagatctcaaacgtcagctggaggaagaagtgaaggctaagaacgctctggcacacgcactgcagtccgcacgtcacgattgtgacctcctgagagagcagtacgaggaagaaacagaggccaaggctgagttacaacgcgtcctctcaaaggcaaatagcgaggtcgctcagtggagaacgaaatacgaaaccgatgccatccaacgcaccgaggagctggaagaggccaaaaagaaattggctcaacgccttcaagaagctgaggaggccgtcgaagcagtgaatgccaaatgttccagcctggagaagactaaacatcggctccagaatgagatcgaggatttgatggtggatgtggagcgatctaacgcagcagcagcggctcttgacaaaaaacaacgcaactttgacaaaatattggcagagtggaagcagaagtacgaagaatcgcagtctgaactcgagagctcacagaaggaagcacggagcctctctaccgagctttttaagctgaagaacgcctatgaagagtctttggaacatctagaaacatttaagcgggagaacaagaacctgcaggaggagatttctgacttgaccgagcagttgggtagcagcggtaagacaatccacgagttagagaaggtgagaaagcagttggaggcagagaaaatggagctgcagagcgcgcttgaggaggcagaagcttcattggaacacgaggaaggtaaaattttacgtgcgcagcttgagttcaaccagattaaggccgaaatcgaacgcaagctcgccgaaaaagacgaagaaatggagcaagccaaaagaaatcatttacgcgtggtggacagcctgcagacttctctggacgcagagactcgtagccgaaatgaggccttaagggttaagaagaaaatggaaggggacctgaatgaaatggaaatccagttgagccacgcgaatcgtatggcagcagaggcgcagaagcaagtgaagtcgttgcagtctctgctgaaggatacacaaatccagctcgatgatgccgtccgcgctaacgatgatctaaaagaaaacatcgcgatcgtcgagcgcaggaataacttgctccaagccgaattggaagagctcagggcagtggtggaacagacagagcgcagccggaagttagccgaacaggagcttatcgaaacctcagagcgcgtgcaacttcttcacagtcaaaacactagcctcattaatcagaagaaaaagatggatgcggatctgtcgcagctgcaaacagaggtagaggaggccgtgcaggaatgccggaacgctgaagagaaagcaaagaaagccatcaccgacgccgctatgatggcagaagagctgaaaaaagaacaggacacctctgcacacctagaacggatgaagaagaatatggagcaaacaattaaggacctccaacatcgactggacgaggccgaacagattgccctgaaaggagggaaaaaacagctccagaagttggaggcccgggttagggaattagagaatgaactcgaagctgaacagaaacggaatgcagagtcagtgaagggaatgcgcaagtcagaacgacgcatcaaggagctcacataccagaccgaggaagaccggaaaaatctgctccgattgcaggatctggtggacaagctgcaacttaaagttaaagcttataagcgacaagctgaagaggcggaggaacaagcaaataccaatctctcaaaattccggaaggttcaacatgaactcgacgaggccgaagagagggctgacatcgcggaaagccaagttaacaagctccgggccaaatctagagatataggaacaaaggggcttaatgaggaatag

SEQ ID NO: 196314 - DNA, 5823 bp, Artificial Sequence
  Description of Artificial Sequence: Synthetic coding sequence
atgggcgacagcgagatggccgtgttcggcgccgccgccccctaccttagaaagtccgagaaagagcggctggaagcccagaccagacccttcgacctcaagaaggatgtttttgtgcccgacgataagcaagagtttgtgaaagcgaaaattgtctcccgcgaggggggaaaggtgacggccgagactgagtatggcaaaacagttaccgtgaaggaggaccaggtgatgcaacagaaccccccgaaatttgacaagatcgaagatatggctatgctcacttttctgcacgaacccgccgttctctataacttaaaagatcgatatggatcgtggatgatctatacttactctggcttgttttgtgtgaccgtaaatccatataagtggctacccgtgtacaccccagaagtggttgcagcttatagaggtaagaagaggtctgaagcaccccctcacatcttctcaattagcgacaacgcataccaatatatgctaaccgatagggaaaatcagtcgatcctgatcaccggcgaaagcggcgccgggaaaaccgtgaataccaaaagggtgattcagtactttgcggtgatcgccgcgattggcgaccggtctaagaaagatcagtctccaggcaagggcacacttgaggaccaaatcatccaggctaatcccgcactggaagcatttggtaatgcgaaaactgtgagaaatgataacagctcacgcttcggaaaattcataagaatccactttggagccaccggaaagttggccagcgctgacattgaaacctatcttctggagaagtccagagtgatttttcagttgaaggctgagcgcgattatcacatattctaccaaattcttagcaacaaaaagcccgagctgctggacatgctgctgattaccaataatccatacgactacgcctttatctctcagggcgaaacaaccgtggctagcattgacgacgctgaagaacttatggccaccgacaatgcattcgatgtactgggattcacctccgaagagaagaattcgatgtacaagttgacaggcgctattatgcatttcggaaatatgaagttcaaactcaaacagagggaagaacaagcagaaccggatggcactgaggaggccgacaagtcagcataccttatggggctgaatagcgcagacctgctgaaggggttgtgtcaccccagggtgaaagttggaaacgagtatgttactaaagggcagaacgtgcagcaggttatctacgccacaggggcgctcgccaaagctgtgtacgaacggatgttcaattggatggtgacacgtatcaatgcaactttagaaacaaagcagccccgccagtattttatcggggttctagacatcgccggcttcgaaattttcgacttcaactcatttgagcagttatgtattaacttcacaaacgagaagctgcagcagttcttcaaccaccatatgttcgtgttagaacaggaagaatacaagaaggaaggaatcgaatggaccttcatcgacttcggaatggatctgcaggcgtgtattgatcttatcgagaaacccatggggatcatgagcatcctcgaggaggagtgtatgtttcctaaggccactgacatgactttcaaggctaaattattcgataaccacctaggaaagtctgccaattttcagaaaccccggaacatcaagggaaagccagaagctcatttttccttgatccactatgccgggattgtggattacaacattattggatggttacagaaaaataaggatcccctcaatgagaccgtggtgggtctgtatcagaagagcagcctcaagctgctcagtacactgttcgcaaattacgcaggggcagacgcaccaattgaaaaggggaaaggcaaggccaagaagggcagctcgttccagacggtgtcagcgctccatcgcgagaacctgaacaagctgatgacaaatctgcggtccacccacccccattttgttaggtgtattataccaaatgagactaagtcccctggggtgatggataacccactggtcatgcatcagttgcgttgtaacggcgttttggaggggatccggatctgcagaaagggcttcccgaaccggatcctgtacggcgacttcagacagcggtaccgcatcctaaatcctgcagctattccagaggggcaatttatcgactccaggaaaggagctgagaaactgctgtcatcgctggatatagaccacaaccaatacaaattcgggcataccaaagtttttttcaaagcaggcctgctgggattgttagaggaaatgcgggacgagcgactcagcagaataataacacggatccaagcacaatcgcgaggagtcctggccaggatggagtacaagaaactgctcgagcgcagagatagtttgttggtcattcagtggaacatccgcgctttcatgggcgtgaaaaactggccctggatgaagttgtatttcaagatcaagccgctgcttaaatctgccgagagggagaaagagatggcgagtatgaaagaggaattcacaaggcttaaggaagccctcgagaaatcggaggctcgacgcaaagaactcgaggaaaaaatggtgtccttactccaggagaaaaatgacctccaattgcaagtgcaggcagagcaggacaatctcgcagatgctgaggaacgctgtgaccagctaatcaagaacaagatacagctggaggctaaagttaaggagatgaatgaaagattagaagacgaagaggagatgaatgccgagctgaccgcgaagaagcgcaaactcgaagacgaatgctctgagctgaaaagggatatcgacgacttggagttaactctggccaaagtagagaaagagaaacatgcgaccgagaacaaggttaagaatctgactgaagagatggctgggctggatgagatcatcgccaaactgaccaaagagaagaaggctctgcaggaggctcatcagcaggccctggatgatctgcaagctgaagaagacaaggtgaacacactcaccaaggcaaaagtgaagctggagcagcaggtggatgacctggaaggatctctggaacaggagaaaaaggtacgcatggacttagagcgggccaagcgcaaacttgagggggatctgaagctgacacaggagtccataatggacctggagaatgataagcagcagctggacgaacggctgaaaaagaaagactttgaactgaacgccctgaatgctagaatcgaagacgagcaggctctgggttcccagctgcaaaagaagttgaaagaactgcaagcgcgcatcgaagaactggaggaagagttagaggcggagagaaccgcccgtgccaaagtggagaagttgcggtctgacttgtcacgtgagttggaggagatctcagagcggctggaagaggcagggggggccactagcgtgcagatcgagatgaataaaaagagagaggccgaatttcagaaaatgcggcgtgacctggaggaagctacattgcagcacgaggccaccgccgccgcacttcgcaaaaagcatgccgacagcgtggcagagctgggcgaacagatagataaccttcagagagtgaaacagaagctcgagaaagagaaaagtgagttcaaactggaactagatgacgcactgttgggactaccttcgagtaacttcctgcttccacccccactcagcgctaatctggaaaagatgtgtcgtaccctggaggatcagatgaacgagcaccggtcaaaggctgaggaaactcagaggtccgtaaatgatttaacgagtcagagagcaaagttgcagacagaaaacggcgaactgagccgccagcttgacgaaaaagaagcgcttatttcacagcttacgcggggcaaactcacgtatacccagcaactggaggatttgaagaggcagctggaagaggaggtcaaagccaagaatgcgttggctcacgcgctccagtctgcacgccacgattgtgacctgctacgtgagcagtacgaagaagagacggaagcaaaggctgaattacagcgcgtcctgagcaaggccaactccgaagtcgcacagtggaggacgaaatacgaaaccgatgctattcagagaactgaggagcttgaggaagccaagaaaaaactcgcccagagattgcaagaagccgaggaggccgtggaagctgttaatgctaaatgctcttccttggagaagacaaaacacaggctgcagaatgaaatagaggacctcatggttgacgtcgaacgatccaacgctgccgccgctgcactggacaagaaacagagaaactttgacaagatactggccgaatggaaacagaaatacgaggaatctcaatccgaactggaaagcagccaaaaggaggcacggtcccttagcactgaactctttaagctgaagaacgcctatgaagaaagcctcgagcacctcgaaacattcaagagggagaataagaacctccaggaggagatctcggatctcacagagcaactgggctcttcagggaagactatccacgagctcgaaaaagtcagaaaacagctcgaggcggagaagatggagcttcaatccgccctggaggaggctgaggcctcgctggagcatgaggaaggaaaaatattacgggcgcagctggaatttaaccagataaaggcagagatagaaagaaagcttgctgaaaaggacgaagagatggaacaggctaaacgtaatcatctgcgggtagttgactccctgcaaaccagccttgacgcagagacccggagtagaaacgaagctctacgtgtcaaaaagaagatggagggcgatctgaacgaaatggagatccaactgtcccacgccaataggatggctgctgaagcacagaaacaggtgaagagtctccagagcctgctgaaggatacccaaatacaactcgacgacgctgtgcgcgcaaacgacgacttgaaggaaaatatcgccatcgtggaacggagaaataatctgctgcaggcggaactcgaggaactgcgagcagtagtggaacaaacggaaagatccaggaaactggccgaacaggaattgattgagacctccgaaagggtgcagcttctgcattcacaaaacacttcgctcattaaccagaagaaaaagatggatgccgatctctcgcagttacagactgaggtggaggaggctgtgcaggaatgccggaacgctgaggagaaagcgaagaaggcaattaccgacgccgcaatgatggccgaggaactaaagaaggagcaagacacctccgctcacctcgagcggatgaagaaaaacatggaacaaactatcaaggatctgcagcatcgcctggacgaggccgagcagatagcattaaaagggggtaaaaaacagctgcaaaagttggaggctagggttcgtgaactggaaaatgaactcgaggccgagcagaagcgaaatgcggagtcggtgaaagggatgaggaagtctgaacggagaattaaagaactgacttatcagacagaagaagacaggaagaacctgctgcggctacaagacctggtggataaactacaacttaaagtgaaggcctataagagacaggcagaagaggccgaagagcaggccaacacgaatctgagtaagttcagaaaggtgcagcatgagctcgacgaggcagaggagcgagcagatatagccgagagtcaggtaaataagttgcgtgctaagagtcgtgacatcggcacaaagggccttaatgaggaatag

SEQ ID NO: 196315 - DNA, 5814 bp, Artificial Sequence
  Description of Artificial Sequence: Synthetic coding sequence
atgagcgccagcagcgacgccgagatggccgtgttcggcgaggccgctccatatctcaggaagagtgagaaggagcggattgaggcccagaacaaaccattcgacgccaagacttctgtgttcgttgccgagcctaaggaatcatatgtgaagtccactatacaatcaaaagaggggggaaaagtaaccgtgaaaacggaggggggtgccaccctgaccgttagggaagatcaggtttttccaatgaacccccccaaatatgacaaaatcgaggacatggctatgatgacccatctgcatgaacccggcgtgctttacaacttgaaggagaggtacgccgcatggatgatttatacgtatagtggcctgttttgtgtgactgtgaacccatacaagtggctccctgtctacaaaccagaggtggtcgccgcttataggggtaaaaaacgacaggaggctccccctcatatcttcagcatctctgacaatgcttatcagttcatgctaacagatagggagaatcagagcattctcatcacaggtgagtccggagccgggaagacagtgaatacaaaaagggtcatccagtacttcgcgaccatcgccgttaccggggaaaagaaaaaggatgaaagcggcaagatgcaagggactctcgaggaccagattatctccgccaacccgttgctggaggcgttcggcaatgccaagacggttcgaaacgacaattcgtcacgctttggaaagtttatccggattcactttggtactacaggcaaactggcatcagccgacattgaaacctatctcttggagaagagtcgggtaacctttcagctgaaggccgaaagatcctaccacattttctatcaaatcactagcaataagaagccagatttgatcgagatgctcttgattactactaacccgtatgactacgccttcgtgagccagggcgagattactgttccaagtatcgatgaccaagaggaactgatggccacggactctgccattgatatcctgggattcacgcccgaggaaaaggtttccatttataaactgacaggcgccgtaatgcattacggtaacatgaagtttaaacagaagcagcgggaagaacaggctgaaccagatggtaccgaagtggccgataaggccgcttacctccagagtcttaatagcgctgacctactcaaagccctttgttatcccagagtcaaggttggaaacgagtatgtaaccaagggtcaaactgtccagcaggtgtacaacgcagtgggagccctggcgaaagccgtttacgaaaaaatgtttctttggatggtcacccgcatcaaccaacagctggacaccaaacaacctcgtcaatactttatcggagtcctcgatatagcaggatttgaaatctttgacttcaattcactggagcagctatgcatcaacttcactaacgaaaaactgcagcaatttttcaatcatcatatgtttgtgctggagcaggaggagtacaagaaggaaggaatcgagtggaccttcattgacttcggtatggatttagccgcctgtatcgaactaatcgaaaagccactcggaattttttccattcttgaggaggaatgcatgttccctaaagctaccgacacctccttcaaaaataaattgtacgatcagcacctgggaaaatcggccaacttccaaaagccgaaagttgtcaagggcaaggccgaggctcacttttcactgattcattacgccggtaccgttgactacaatatcacgggctggctggacaagaataaggacccccttaacgacacagtggtcggactataccagaagagtgctatgaagacactggcatcactgttctcgacgtatgcgtccgctgaagccgactcctccgccaaaaagggggccaagaaaaaaggctccagctttcagacagtgtctgcactgtttagagagaacctcaataagctaatgacaaacctgcgtagcacacatccacactttgttaggtgcattattcccaacgaaacaaagacccccggggccatggaacacgagctagtcttgcatcagttacgatgtaacggcgtgctcgaggggataaggatatgtcggaagggcttcccctccagaatattgtatggcgactttaagcagcgttataaagtcctgaatgctagtgctatccctgagggtcagttcatcgatagcaagaaggcctctgaaaaattacttgcttccatcgacatcgaccatacacagtataagtttggccacactaaagtgttcttcaaagcagggttgctgggactgctcgaggaaatgagggacgagaagctggcacagattatcacccgcacacaagcggtttgccgggggttccttatgagagtcgagtatcagaaaatgctgcaacggcgagaagccttgttctgtatacagtataatgtaagggccttcatgaacgtcaaacactggccatggatgaaattgttcttcaaaatcaaacccctgctcaagtcggccgagactgagaaagagatggcaacaatgaaagaagagtttcaaaagacaaaggatgagctggcgaaaagcgaagccaagaggaaggaattagaagaaaagatggtgactcttctaaaagaaaaaaatgatctgcaactgcaggtccagtctgaggctgattctctggcagacgctgaggagcgctgcgagcagctgattaaaaacaagatacaattagaggctaagattaaagaagtgaccgagagagcagaggaagaggaggaaattaacgccgagctaacagcaaagaagagaaagctggaagatgaatgcagtgagctgaagaaggacatcgatgatcttgaacttacattggccaaagtggaaaaagaaaagcatgcaaccgagaataaggtgaagaacttgacagaggaaatggccggcctcgacgaaacaatcgcgaaattgtcgaaggaaaagaaggccttacaagaaactcatcagcagaccctggatgacctacaggcggaggaggacaaagtaaacatcttaacaaaggccaagacgaaactggaacagcaggtggacgacctagagggatcattagagcaggagaaaaagcttcggatggacctggaacgggccaaacggaagctggaaggggatcttaagttggctcaggaaagcacaatggatatggagaacgataagcagcagctagatgaaaaactggagaagaaagagtttgagatttcaaacctaatttccaaaatcgaagatgaacaagctgtagaaattcaactgcagaagaagattaaagagctccaagccaggatcgaggaattaggagaagagatcgaggcagagagggcttcacgagcaaaagcagaaaagcagaggtctgatctttcacgtgaactggaagaaatatccgaaagactggaagaagctggaggcgccacctctgcacaggtggagctgaataagaagagagaagccgagttccagaagctgcggagagacttggaggaagccactctccaacatgaagccatggtggcagctctgcgaaagaaacatgccgattccatggccgaactgggtgagcagatcgataaccttcagagggttaagcaaaaactggagaaggagaaatcggagcttaagatggaaaccgatgacctgagctctaatgcagaggctattagtaaagccaaaggaaacttggaaaagatgtgcaggtccctcgaagaccaagtctccgaattgaaaacaaaggaagaagagcagcaacggcttatcaacgacctgacggcgcagagagcacgcctgcagacagaggccggcgagtactctagacagttggatgaaaaagacgccttggtgagccaattgagtagatccaagcaggcatccacacagcagatcgaagaactgaaacaccagctggaagaagaaacaaaggccaagaatgccctggctcacgcacttcagagttcccgacacgattgtgacctactccgagaacagtatgaagaggagcaggagggcaaggccgaactgcagcgggccttgagtaaggcaaacagcgaggtcgcacagtggcggacaaaatatgagaccgacgctatccagcgtacagaagagctggaagaggctaagaagaaactggctcagagactgcaggaggctgaggagcacgttgaggccgtcaatgccaagtgtgcatccctggagaaaacaaaacagcgcctgcaaaatgaagtggaagatctgatgctggatgtcgagaggtctaatgctgcttgcgccgccctcgacaagaagcaaaggaatttcgataaggtcctttccgagtggaaacagaagtacgaggagacacaggccgagctggaggcgtcgcagaaggaatcaagaagcctgagcaccgagctctttaaggttaaaaacgtttatgaagagagtctcgatcaactggagactcttcggagggaaaataagaacttgcagcaagagattagcgacttaactgaacaaatagccgaaggaggaaaacagatccacgagctggaaaagataaaaaaacaggtcgagcaagaaaagtgtgagatccaggccgccttggaagaggccgaagcctctttagaacacgaagagggcaagatcctaagaatccagctcgaactgaatcaggtgaaaagtgaagtggatcggaaaatagctgagaaagacgaggaaatagaccaactgaaacgcaatcacacccgcgttgtagaaaccatgcagtccacccttgacgccgagattcgctcccggaacgatgctctcagggttaaaaaaaaaatggaaggagatctgaatgaaatggagatccagctgaatcacgcgaaccgactggccgccgaatcattgagaaactatcgcaacacccaagggattttgaaagagacacagctccaccttgacgatgctctgaggggccaggaagatctgaaagaacagttggcaatagtagagcgaagagctaatctgctccaagcagagatcgaagaactctgggccacccttgagcagaccgagaggagcagaaagatcgcagagcaggaactgctggacgcttccgagagagttcaattgctccatacacagaacacaagccttattaatacaaagaagaaactggaaaatgacgtttcccagctgcaaagcgaagtcgaagaggtcattcaggagtccaggaacgccgaggagaaggcgaaaaaagctatcaccgacgctgccatgatggcagaagagctgaagaaggagcaagatacgtctgcacatctggagaggatgaaaaagaacctcgaacagaccgtgaaagatttgcagcatcggctggatgaggccgaacagctcgccttgaagggtgggaaaaaacagatccagaagctggaggccagagtccgcgagttagagggtgaagtcgagaatgagcagaaacgcaatgctgaagcagtcaaagggttgcgcaaacatgagaggagagtgaaagagttgacttaccagactgaagaagataggaaaaatgtgttgagactgcaggacctcgtcgacaaactgcaggctaaagttaagtcctataagcggcaggctgaggaggctgaggaacagtccaacgccaacctcagcaaatttagaaaactccagcacgagcttgaagaagccgaggagcgggcagacatcgccgagtcacaagtgaataaactccgggtgaagtctagagaggtccacacaaagatatctgcagaatag

SEQ ID NO: 196316 - DNA, 5814 bp, Artificial Sequence
  Description of Artificial Sequence: Synthetic coding sequence
atgagcgccagcagcgacgccgagatggccgtgttcggcgaggccgccccatatctgaggaaatctgagaaggaacggattgaggctcagaacaagccatttgacgcgaaaacctcagtgttcgtcgcagagccaaaggagtcttatgtgaagtccacaatccagagtaaagagggaggcaaagtgaccgtgaagaccgaaggcggtgctacactcacagttcgagaggatcaggttttccccatgaatccaccgaagtacgataagatcgaggatatggcaatgatgacacacctgcatgagccgggagtactgtataaccttaaagaaagatacgcagcctggatgatctacacatactcgggccttttctgcgtaaccgtcaacccttataagtggttacctgtgtataagccagaggttgtcgctgcgtacaggggcaagaagcgacaggaggcacccccccatatcttttccatttccgataatgcataccaatttatgctgactgatcgcgaaaatcaaagtatcttgatcactggcgagtccggggccgggaagacagttaacaccaagcgcgtaatacaatacttcgccaccatcgccgtgaccggcgagaagaaaaaggacgagtctggcaaaatgcagggtaccctcgaggatcagatcatttctgctaatcccctgttggaggccttcggaaatgccaaaacagttaggaacgataatagtagccggttcggaaaattcatccgaatccactttggaaccactggcaaacttgcaagcgccgatatcgaaacatatcttctggaaaagtcccgtgttacgttccagctcaaggctgagagaagctaccacattttttaccagatcacttcaaataaaaagcccgatctgatcgagatgctacttattactacaaatccatatgattatgcctttgttagccagggggaaatcaccgtgccgtctatcgatgaccaggaagaactgatggccaccgacagcgcaatcgacattctgggctttacgccagaggagaaggtgtccatatacaagctaacgggggcagtcatgcactatggcaacatgaaattcaaacaaaagcagcgcgaagagcaggccgaaccggacggcactgaggtcgctgacaaagcggcatacctacagagccttaacagcgcagatctcctgaaagctctgtgctaccctcgagtgaaagtgggcaacgaatatgtgacaaaagggcaaaccgtccagcaggtgtacaacgctgtcggagccctggcaaaagccgtgtatgaaaagatgttcctgtggatggtgactcgcattaaccagcaattagatacaaagcagcccagacagtactttattggtgtgctggacattgctggtttcgaaattttcgacttcaattctttggaacaactctgcattaatttcacaaacgagaagctccagcagttcttcaaccaccacatgttcgttctggagcaagaagaatataagaaggaaggcattgagtggactttcatcgattttgggatggacctcgctgcctgtattgagctcatcgagaaaccactcggtatcttctctatccttgaggaagaatgcatgttccccaaggccaccgacacaagtttcaagaacaagctctatgaccagcatttgggtaaatccgctaacttccagaagcctaaagtcgtgaaagggaaagctgaggcccacttctcactcatccactacgctgggactgtcgattacaatattactggatggctggacaaaaataaggaccctctaaatgatacagttgtgggcttataccagaagtcagctatgaagacactggcctcacttttttccacctatgcttctgccgaggctgactcctcagcgaaaaaaggtgctaaaaaaaaaggttcaagcttccagaccgtgtctgccctcttcagagaaaatctaaacaagcttatgacaaaccttcggtctacacatccccacttcgtcagatgcattattccaaacgaaacaaagacaccgggagctatggaacacgaactcgtcctgcaccagcttaggtgcaatggcgtgctggaaggcatccgaatttgccgaaagggcttcccttctaggatcctctatggagatttcaaacaacggtataaagtgctgaatgcctctgcaattcccgagggacagttcatcgactcaaagaaggctagtgaaaagctactggccagcattgacatcgaccacacccaatacaaattcggccatactaaagtcttcttcaaagctggcctgctgggactcctggaggagatgcgcgacgaaaagctggcccagatcatcacccggacacaggctgtatgcagggggttccttatgagggtggagtaccagaagatgctgcagcggagagaagccctgttctgcatccagtacaacgtcagggctttcatgaacgtaaagcactggccttggatgaagttattcttcaagatcaagcccctgctcaagtctgcagaaaccgaaaaggaaatggctactatgaaggaggaatttcagaaaactaaagatgagctggccaagagcgaggccaagaggaaggagttggaagaaaagatggtgactctgctgaaggagaaaaatgacctgcagctccaggttcaaagcgaagccgattctctggcagacgccgaggaacgatgcgagcagctgatcaagaacaagatccagctcgaggctaaaattaaggaggtgactgaacgcgctgaagaggaagaggagataaacgccgagctgactgcgaagaagaggaaactggaagacgagtgcagcgagctgaaaaaagatattgacgatctggagcttacgttagccaaggtcgaaaaagaaaagcatgcaaccgaaaacaaagtgaagaatctgaccgaggagatggctggactagatgagaccattgccaagttaagtaaagagaaaaaagccttacaagaaacgcatcagcaaaccctcgacgacctccaagccgaggaagacaaggtgaacatcttgacaaaggccaagacaaaactcgagcagcaggtcgacgacctcgagggcagcctggaacaggaaaaaaagttacgtatggacctggagagggcaaaacgcaaactggaaggcgacctaaaactggcacaggaatctactatggatatggaaaatgataagcagcagctcgatgagaaactggagaaaaaagaatttgagattagcaatctgatcagtaagatcgaggatgaacaagctgtggagatacagttgcaaaaaaaaatcaaggagttgcaggcccggatcgaagaattaggtgaggagatcgaggctgaaagggctagtagagccaaagccgagaaacaaagaagtgacctttccagagagctcgaggaaatttcagaacggcttgaggaagccggaggagcgaccagcgcccaggtcgaactcaataaaaaaagagaagccgaattccagaagctcaggcgcgatctagaagaggctacattgcagcatgaggccatggtggctgcgttgaggaagaaacatgcagactcgatggccgagctgggagagcagatagataaccttcagcgagtgaagcagaaactcgaaaaagagaagtctgagttgaaaatggagacagacgatctgagctctaatgctgaagcgatctcgaaggcgaaggggaatctggaaaagatgtgccggtcactggaggatcaggtctccgagcttaaaacaaaggaggaagagcaacagcgcctgattaatgacttaaccgcccagagggcccgcctgcaaaccgaggccggtgaatactcccggcagttggacgaaaaagacgccctcgtgagccaactctcacggagcaagcaggccagcacccaacagattgaagagctaaagcatcaattagaagaagagaccaaagcaaaaaacgccctggctcatgctttacagtctagccggcacgactgcgacctcctcagggagcagtatgaggaggaacaggaaggcaaggccgaactccagcgggctctgagtaaggctaattctgaggtggctcagtggcgcactaaatatgagaccgacgctatccagagaaccgaggaattggaagaggccaaaaagaagctcgcgcaacgtttacaggaggctgaggagcacgtagaggcagtgaatgctaagtgcgcttcccttgagaaaacgaagcagcgcctgcagaacgaggtggaggatcttatgctcgacgttgaacgaagtaacgcggcatgtgcagcccttgacaagaaacagaggaacttcgacaaggtactttccgaatggaaacagaaatacgaggagacacaggccgagctggaagcatctcagaaagaaagcagatctctgtccactgagctgttcaaagtgaagaacgtctacgaggaatccctggatcagctggagaccctcaggcgcgaaaataaaaacctccagcaggaaatctctgacctcacggagcagatcgcagaaggaggcaagcaaattcatgaattggagaagattaaaaagcaggtcgaacaggagaagtgtgagatccaggccgccctcgaggaagctgaggcaagcctagagcacgaggaggggaaaattctccgcattcagcttgaactgaaccaggtgaaaagcgaagtggaccggaaaattgcggagaaagacgaggagatcgatcaactgaagcggaaccatactagggtcgttgagacaatgcaatcaaccctcgacgccgagattcgctccaggaatgatgccctgagagtcaagaagaagatggagggcgacctgaatgaaatggagatccagctgaaccatgcaaacaggctcgctgcagaatctttaagaaactatcgtaatacgcagggcatcctgaaagaaacccagctgcacttggatgatgctctccggggccaggaggacctgaaggagcagctcgcaatcgtggagaggcgcgccaatctgcttcaggctgagatagaggagctgtgggcaactctcgagcagacggagcggtcgaggaagatagctgagcaagagctcctcgatgcttccgagagggtccaactactgcacactcagaacacttcactgatcaataccaagaaaaagctggagaacgacgtcagccagttgcaaagtgaagtggaagaagttattcaagagagccggaatgccgaagaaaaagctaagaaggcgatcacagatgcggcaatgatggccgaggaactgaaaaaagaacaggataccagtgcccatctcgaacgcatgaagaagaatcttgaacagacggtgaaagatttacagcaccgtctggatgaggctgagcagctcgctctgaaaggagggaaaaaacaaattcagaaactcgaggcacgcgttagggagctggagggagaagtcgagaatgaacagaaacgcaatgcagaggctgtcaaaggcttgagaaaacatgaacgccgggtgaaagaattgacatatcagacagaggaagataggaaaaatgtcctgagattgcaggatctggtagacaagctacaggcaaaagtaaaatcctataagcgccaggctgaggaggccgaagaacagtcaaacgccaatctaagcaaattccggaagctgcagcatgaacttgaggaggctgaggagcgtgccgacatagccgagtcccaggtgaataaactgagggtaaaaagccgcgaagtgcatacaaaaatatcagctgagtag

SEQ ID NO: 196317 - DNA, 453 bp, Artificial Sequence
  Description of Artificial Sequence: Synthetic coding sequence
atgagcttcagcgccgaccagatcgccgagttcaaggaggccttcttgctcttcgataggactggggatagtaaaataaccctctctcaggttggggatgtcctgagagcattgggtaccaaccccacaaacgccgaagtgaggaaggtgctgggtaacccttctaatgaagagctgaatgctaagaagatcgaattcgagcagtttcttccaatgatgcaggcaatttctaataacaaagatcaagcaacctatgaagattttgtcgagggccttcgggtgttcgataaggaaggcaatggaacagtgatgggggctgagctaagacatgtcttggccaccctgggcgagaagatgaaagaggaagaagtggaggccctgatggctggtcaggaggacagcaacggatgtattaattacgaggcatttgtgaagcacatcatgtccatttag

SEQ ID NO: 196318 - DNA, 585 bp, Artificial Sequence
  Description of Artificial Sequence: Synthetic coding sequence
atggcccccaagaaggacgtgaagaagcccgtggccgccgccgccgcagctcccgccccagcaccggccccagctccagcccccgccccagccaagcccaaggaagaaaaaatcgatctgtctgccattaaaattgaattctcaaaagagcagcaggacgagttcaaagaggctttcctgctgttcgaccgaacaggtgattcaaagatcactctctctcaagtgggtgatgtgctgagggcgttaggcaccaatcccacgaatgcggaggttcgcaaagtgctgggtaatccttcgaacgaagagctaaatgccaagaagattgagttcgaacaatttctgcccatgatgcaggctatttccaataacaaagaccaggccacctacgaggatttcgttgagggccttcgtgtgttcgataaggaaggcaacgggacagtgatgggtgcagagcttaggcacgtgttagctacgttaggcgagaagatgaaggaggaagaggtggaggccttaatggccggacaagaggattccaatggctgcatcaactatgaagcattcgtgaagcatattatgtccatttag

SEQ ID NO: 196319 - DNA, 519 bp, Artificial Sequence
  Description of Artificial Sequence: Synthetic coding sequence
atgagcagcaagaaggccaagaccaagaccaccaagaagcggccccagagggccacctcaaatgtgttcgccatgttcgatcagagtcagatccaggaattcaaagaagctttcaatatgatcgaccagaatcgagatggtttcatcgataaggaagacctacacgatatgctggcgtctctcggaaaaaaccccactgacgcctatctggacgcaatgatgaatgaggctcccggtcccatcaattttaccatgttcctgaccatgtttggggagaagctgaacggaacagaccctgaagatgtgatcagaaatgcgtttgcatgttttgatgaagaggcaactggaaccatacaggaggactaccttcgggaacttctgactaccatgggggacaggtttactgacgaggaggttgacgagttatatcgggaggcaccaatcgacaaaaaggggaactttaactatatcgagtttacaaggatcctgaagcacggcgctaaggataaggacgattag

SEQ ID NO: 196320 - DNA, 519 bp, Artificial Sequence
  Description of Artificial Sequence: Synthetic coding sequence
atgagcagcaagaaggccaagaccaagaccaccaagaagcggccccagagagcgacctccaatgtttttgcaatgtttgaccagtcacagatacaagagttcaaagaggcatttaacatgatcgatcagaatagggacggatttatagacaaggaggatttacacgacatgctggctagtctggggaagaaccctacagacgcatacctggacgccatgatgaacgaagcccccggacccattaattttactatgttcctgacaatgttcggtgagaaactgaatggtaccgacccagaggacgtgattcgaaatgcgtttgcctgctttgatgaagaagccaccgggaccattcaggaagattacctgagggagctgctaacgactatgggcgacagatttaccgatgaggaagtagatgagttataccgagaggctcccatagataagaaggggaattttaattacatcgaattcacacggatcctaaagcatggagcaaaggataaagacgattag

SEQ ID NO: 196321 - DNA, 519 bp, Artificial Sequence
  Description of Artificial Sequence: Synthetic coding sequence
atgagcagcaagaaggccaagaccaagaccaccaagaagcggccccagcgggcaacgtccaacgtgtttgcaatgttcgatcagtctcaaattcaggagttcaaagaggcctttaacatgatcgatcagaatcgggatggcttcattgacaaggaggaccttcacgatatgctggcctccctcggaaaaaatcccaccgacgcttacctggacgctatgatgaatgaagcgccgggaccaatcaacttcaccatgttccttacaatgtttggcgagaagttgaatggcaccgaccccgaggacgttatcaggaatgccttcgcctgttttgacgaggaagcaaccggaaccatccaagaggactacctgagggagttgctgaccactatgggggatcgcttcactgatgaagaagtagacgaactgtaccgggaagcacccatcgacaagaaggggaacttcaactacatcgaatttaccaggattctcaaacacggagctaaagacaaagacgactag

SEQ ID NO: 196322 - DNA, 519 bp, Artificial Sequence
  Description of Artificial Sequence: Synthetic coding sequence
atgagcagcaagaaggccaagaccaagaccaccaagaagcggccccaacgagctacgtcaaatgtgttcgcaatgttcgaccaatctcagattcaagaattcaaagaggcatttaacatgattgaccaaaaccgagatggctttatagacaaagaggatcttcacgacatgctcgcctcactgggtaagaacccgaccgacgcttacttggacgcaatgatgaatgaggcacctggtcctattaactttaccatgtttctcaccatgttcggagaaaagctgaacggcacagaccccgaggatgtgatccgcaacgccttcgcctgttttgatgaagaggcgaccggaaccattcaggaagactatctgcgggaactgctaaccacaatgggagatcgctttacagatgaggaggttgacgagctgtacagagaggcccctatcgacaagaaagggaactttaattacattgagtttacacgcatcttgaaacacggtgcgaaggataaagatgattag

SEQ ID NO: 196323 - DNA, 627 bp, Artificial Sequence
  Description of Artificial Sequence: Synthetic coding sequence
atggccctgggccagaagctgttcatcaccatgagccggggcgccgggagacttcagggcacattatgggctttggtgtttttaggaattctggtagggatggtggtgccgtccccggcagggaccagggccaataacacactgctagacagccgcggctgggggacattgctgtcaaggagtcgggcgggtctggcgggtgagattgccggcgtgaattgggaaagtggttatctggtcggcatcaaacggcagcgcaggctgtactgcaatgtcggaatcggattccacctccaggtgcttcccgatggccggattagtgggactcacgaggaaaacccctatagtctgcttgaaatctccacagtggagcgaggcgtggtcagtttgtttggcgtccgctcagctctgtttgtcgccatgaattctaagggacggctttatgccacaccttccttccaagaagaatgtaaatttcgtgagaccctactccccaataactataatgcttatgagtcggacctctaccagggcacttacatagcgctgtccaaatacgggagagttaagcggggctccaaggtgtcacccatcatgaccgtgacacactttctgcctcggatctag

SEQ ID NO: 196324 - DNA, 588 bp, Artificial Sequence
  Description of Artificial Sequence: Synthetic coding sequence
atggcccccaagaagcccgagcccaagaaggacgacgccaaggccgctcccaaggctgcccccgctcccgctcctccacctgaaccagagcgcccaaaggaagtagagttcgacgcctccaagattaagatagagttcacacccgagcagatcgaagagttcaaggaggcctttatgctgtttgacaggactcccaagtgcgaaatgaagattacttatggacagtgtggtgatgtgcttcgcgcacttgggcagaaccctacgcaggctgaggtgttgcgggttctgggcaagccccgtcaagaggagctcaatacaaaaatgatggatttcgaaacatttcttcctatgctgcaacacatctctaaaaacaaggacactgggacttacgaggacttcgtggagggcctgcgcgtcttcgacaaagagggaaacggcacagtaatgggagccgagctgcgtcacgtactggccaccctgggtgagcggctcacagaggacgaagtcgagaaactcatggccggccaggaggattctaatggttgtattaactacgaagcgttcgtgaagcacataatgtcatcatag

SEQ ID NO: 196325 - DNA, 588 bp, Artificial Sequence
  Description of Artificial Sequence: Synthetic coding sequence
atggcccccaagaagcccgagcccaagaaggacgacgccaaggccgccccgaaagctgcccctgcaccagcgccaccccctgagcctgaaagaccaaaagaggtggaattcgatgcttcaaaaattaaaattgaatttacaccggaacagattgaggaattcaaggaggccttcatgctctttgaccgcactcccaaatgtgaaatgaagattacttacgggcagtgcggcgacgtcctgcgcgcactcgggcagaatcctacccaggccgaggtgctaagagtgttggggaaaccacggcaagaagagttgaacaccaaaatgatggatttcgagacatttctccctatgttacagcatatctccaaaaacaaggatacagggacgtatgaagattttgtggagggcctgcgcgtcttcgacaaggaggggaatggcacagtcatgggggcagagctgcggcacgttctagcaacgctgggcgagcggctgacagaagatgaggtggaaaagctgatggccggccaagaagacagcaacggatgcatcaactatgaggcttttgtgaaacatatcatgtcctcctag

SEQ ID NO: 196326 - DNA, 141 bp, Artificial Sequence
  Description of Artificial Sequence: Synthetic coding sequence
atggcccccaagaagcccgagcccaagaaggacgacgccaaggccgcacccaaggcagcaccggctccagctccaccgcccgagcccgaacgaccaaaggaggttgaattcgacgcgtcaaaaattaagattgagttctag

SEQ ID NO: 196327 - DNA, 594 bp, Artificial Sequence
  Description of Artificial Sequence: Synthetic coding sequence
atggcccccaagaagcccgagcccaagaaggaggccgccaagcccgctccagccccagcaccggccccagctcccgccccagcgccggctcccgaagctcccaaggaaccagcattcgaccccaaaagtgtgaagatcgattttactgctgatcagatagaagaattcaaagaagccttttccctgtttgatcgtactcctactggcgagatgaaaatcacttacggtcagtgcggcgacgttttgagagcgctcgggcaaaacccaacaaatgccgaggtgctccgtgtgctgggtaagcccaagcctgaggaaatgaacgtcaaaatgctggatttcgagacttttctgcctatcctgcagcatatatcacggaacaaggaacaaggaacatacgaggattttgttgagggcctacgggttttcgataaagaatccaacgggacggtcatgggcgccgaacttcgccatgtcctggctactctgggagaaaagatgaccgaggctgaggtggagcagttgctggccgggcaggaggacgcaaatgggtgtatcaactatgaagccttcgtcaagcacatcatgtcgggctag

SEQ ID NO: 196328 - DNA, 594 bp, Artificial Sequence
  Description of Artificial Sequence: Synthetic coding sequence
atggcccccaagaagcccgagcccaagaaggaggccgccaagcccgcgccggccccagcgccagcacccgcacctgccccggccccagcaccagaagcccctaaggagcctgcatttgacccgaagagcgtgaagatcgacttcactgcggaccagattgaggagtttaaggaagctttttcacttttcgaccggacgcctaccggagagatgaagatcacctatggtcagtgcggtgacgtgctacgagccctggggcagaatccaactaacgccgaggtgctgagagtgttgggcaagcccaagcctgaagaaatgaacgtgaagatgctggactttgagacgtttctccctatcctccaacatatctctcgcaacaaggaacaaggcacatatgaggatttcgtcgagggtctgcgcgtgttcgacaaagagagtaatgggaccgttatgggggcagaactgcggcatgtgctggccactctgggagagaagatgacagaagccgaagtggagcagctcctcgccggccaggaagatgccaacggatgtattaactacgaggccttcgttaaacacatcatgtccggctag

SEQ ID NO: 196329 - DNA, 264 bp, Artificial Sequence
  Description of Artificial Sequence: Synthetic coding sequence
cccgaggcccccaaggagcccgccttcgaccccaagagcgtgaaggtcattgggtgcccttgtccccgttcacaatcgcacggggcagtcatcgactttacagccgaccagattgaagaattcaaggaagccttcatgggtgccgaactaagacacgtcctcgctactttagtgattaagagcgccccgccccccaaaccgacggcaggagagaaaatgacagaggccgaggtcgagcagctcctcgcagggcaagaggactag

SEQ ID NO: 196330 - DNA, 522 bp, Artificial Sequence
  Description of Artificial Sequence: Synthetic coding sequence
atggccagccggaagaccaagaagaaggagggcggcgccctgcgggcccagcgggcctcttccaatgttttttccaattttgaacaaacccagattcaggagttcaaggaagcatttactctgatggaccaaaatagagatgggtttattgacaaggaggatctgaaagatacatacgccagcctgggtaaaacaaacgttaaggacgacgaactggacgctatgttaaaagaagcctcaggtcctatcaactttaccatgtttctgaacctgttcggagagaaactctccgggactgacgctgaagagaccatcctgaacgcctttaaaatgcttgatcccgacgggaagggcaagattaacaaagaatacatcaagaggctattaatgagtcaggcagataagatgaccgccgaggaggttgaccagatgtttcaattcgcatctatcgatgtagccgggaacctggattacaaggcactatcctacgtgattacgcacggcgaggagaaggaagaatag

SEQ ID NO: 196331 - DNA, 399 bp, Artificial Sequence
  Description of Artificial Sequence: Synthetic coding sequence
atggaccagaaccgggacggcttcatcgacaaggaggacctgaaggacacctacgcttctcttggcaagactaatgtgaaggatgacgagcttgacgccatgctgaaggaagcatccggacccattaacttcactatgtttctcaatctttttggtgagaagctgagcggcactgacgcagaggagaccatcctgaatgcctttaagatgctcgaccccgatggaaaaggcaaaatcaataaggagtatataaaacggctgctgatgtcacaggcagacaagatgactgccgaggaagtggaccaaatgtttcagtttgcttccatcgatgtcgccggcaatcttgactacaaggcattgtcctatgtcatcacacacggtgaagaaaaggaagagtag

SEQ ID NO: 196332 - DNA, 399 bp, Artificial Sequence
  Description of Artificial Sequence: Synthetic coding sequence
atggaccagaaccgggacggcttcatcgacaaggaggacctgaaggacacctatgcctcattgggcaaaaccaatgtcaaggacgacgaacttgacgctatgcttaaggaggcgagcggaccgattaattttacgatgttcctcaacttattcggtgaaaagctctctggtactgatgctgaagagaccatactgaatgccttcaaaatgttagacccagatggcaaaggtaaaatcaataaggagtatattaagagactgctcatgagtcaggccgataagatgacagccgaagaagtggaccagatgttccagttcgcaagcattgacgtcgccggtaacctggactacaaagccctttcatacgtgatcacccatggcgaagaaaaggaagagtag

SEQ ID NO: 196333 - DNA, 399 bp, Artificial Sequence
  Description of Artificial Sequence: Synthetic coding sequence
atggaccagaaccgggacggcttcatcgacaaggaggacctgaaggatacgtacgcaagcttgggcaagacaaacgttaaggatgacgagctggacgccatgttgaaggaggcctccgggcctatcaacttcaccatgtttttgaatctgtttggcgaaaagttaagcggcacagacgccgaggagactattttgaatgcttttaagatgctcgatcctgacggcaaggggaagatcaataaagaatacatcaaaagactgctgatgagccaagcagataaaatgaccgccgaagaagttgatcagatgttccagtttgcgtcaatagacgtcgctggaaacctggactacaaagccttatcatatgttatcacccacggcgaagaaaaagaagagtag

SEQ ID NO: 196334 - DNA, 456 bp, Artificial Sequence
  Description of Artificial Sequence: Synthetic coding sequence
atgtgcgacttcaccgaggaccagaccgccgagttcaaggaggcctttcagctgttcgataggacgggcgatggaaagatcttgtattctcagtgtggcgatgtcatgcgcgccctgggacaaaatccaaccaatgccgaagtgctaaaagtgctgggaaaccctaaaagcgatgaaatgaatgttaaggtcctggacttcgaacatttcctgccaatgcttcagacagtggccaaaaataaggatcagggtacatacgaagactacgttgagggtctcagggtctttgacaaagaagggaacgggacagtaatgggtgcggaaatccgtcatgtgctcgtcacactgggcgagaaaatgaccgaagaagaagtggagatgttggtggccggccatgaggatagcaatggttgtattaattacgaagaactggtcagaatggtactcaacggatag

SEQ ID NO: 196335 - DNA, 456 bp, Artificial Sequence
  Description of Artificial Sequence: Synthetic coding sequence
atgtgcgacttcaccgaggaccagaccgccgagttcaaggaggccttccagctgtttgacagaaccggggacggcaaaattttatatagccagtgtggtgatgtgatgcgagccctggggcagaaccctaccaacgctgaggttctgaaggtgctaggtaatccgaagtcagatgagatgaatgtcaaagttttagattttgagcactttctgccaatgcttcagactgtcgccaaaaacaaagaccaaggcacctatgaagattatgtggaagggctccgtgtcttcgacaaagaaggtaacggaacggtgatgggcgcggaaattcgccatgtattggtaacgcttggggagaagatgactgaggaggaggtggaaatgctggtggccggacatgaggactctaatgggtgcatcaattatgaggccttcgtacggcatatcttgtccggctag

SEQ ID NO: 196336 - DNA, 456 bp, Artificial Sequence
  Description of Artificial Sequence: Synthetic coding sequence
atgtgcgacttcaccgaggaccagaccgccgagttcaaggaggccttccagctgtttgaccgaacaggagatggcaaaattctgtactcacagtgtggagacgtgatgcgtgctctcggccagaaccccaccaatgcagaagttctgaaagttcttggaaacccgaaaagcgatgaaatgaacgtcaaggtgttagacttcgagcactttctgcccatgcttcagacggtggctaaaaacaaggaccagggcacatacgaggactacgtagagggcctgagagtgttcgacaaggagggaaacgggacagttatgggagctgagatacgccacgtcttggtgactctgggtgagaaaatgactgaggaggaagttgaaatgctggtggctggacatgaggactctaatgggtgcatcaactacgaagccttcgtgcggcatattctgtcaggatag

SEQ ID NO: 196337 - DNA, 1491 bp, Artificial Sequence
  Description of Artificial Sequence: Synthetic coding sequence
atgagcagcatggaggagatccaggtggagctgcagtgcgccgacttatggaagagatttcacgacatcggcaccgagatgataatcacaaaggccggccgtcggatgttccctgctatgcgagtcaaaatcaccggcctcgatccacatcagcagtattacatcgccatggacatagtgcccgtggacaataagaggtaccggtatgtttatcattccagtaagtggatggtcgctggcaacgccgatagtcccgttccgcctagagtgtacatccatccagactccctcgctagcggggacacttggatgcgtcaagtcgtgtcttttgacaagctgaaactgacaaacaacgagcttgacgatcagggccatatcatcctgcacagtatgcataaatatcaacctagagttcacgttatcaggaaggatttctcatctgatctctctccaaccaaacctgtaccagtaggtgacggagtgaagacgttcaatttccccgaaactgtgtttaccacggtaacggcctatcaaaatcaacagatcacacggcttaagattgatcgcaaccctttcgccaagggtttccgcgattccgggcgcaataggacaggcctcgaagcgatcatggaaacatacgccttctggagaccgccggtgaggacgctcaccttcgaagactttacaactatgcagaagcagcagggaggtagcacaggaacgtcgcctacgacctcgagcacgggcacacctagtccatcagctagtagtcatctgttatcaccttcttgcagccctcccacatttcacctcgcgcctaataccttcaatgtgggatgccgtgaaagccagttgtgcaacctaaacctaagtgactatcccccttgcgcccggtccaatatggccgccctccagtcatatccagggctctccgattccgggtacaaccgcctccagtccgggactacctccgctacacaaccctcagagacattcatgccgcagcggaccccctccttgatcagtggaattccgaccccacctagccttcccggtaactctaagatggaagcctacgggggacagctgggttcttttcccacttctcagtttcagtatgtgatgcaggcaggaaacgcagcctcaagcagttcatctccacacatgtttggggggtcccatatgcaacagtcctcatataatgccttcagccttcataacccttataacttgtacggctacaattttcccacaagcccgaggctggcagctagtcccgagaagctttcagcttctcagtctacactcttatgctcttcccctagcaatggtgcctttggggagagacagtatctgccgtccggaatggaacactctatgcacatgatctctcctagcccaaacaatcagcaggccacaaatacctgtgacgggagacagtatggggctgtgcccggctctagtagccagatgtcagtccatatggtttag

SEQ ID NO: 196338 - DNA, 627 bp, Artificial Sequence
  Description of Artificial Sequence: Synthetic coding sequence
atgccccccaagaaggacgtgcccgtgaagaagcccgccggcccctccattagcaaaccagccgccaagccagcagcagcgggagccccgccagccaaaacgaaagcagaaccagctgttccacaggcgccacagaaaacccaggagcctcccgtggaccttagcaaggtggtaatcgagtttaacaaggatcagctggaggaatttaaagaagcattcgagctgtttgacagagttggcgacggcaagatcctgtactcgcagtgtggtgacgtgatgcgggcactcggtcaaaatccaacaaacgcagaagtgctgaaagtgcttgggaatcccaaatccgacgaattgaagagtaggagagtcgactttgagacttttttaccgatgctgcaagcagtggccaaaaatcgtggacaggggacctatgaggattacctggagggtttcagagttttcgataaagaaggaaacgggaaagtaatgggggctgaactgcgccatgtcctgactacccttggtgaaaagatgacggaagaggaggtcgaaacagtgctggctggacacgaggactctaatgggtgtatcaactacgaggccttcctcaagcatattctgagtgtttag

SEQ ID NO: 196339 - DNA, 90 bp, Artificial Sequence
  Description of Artificial Sequence: Synthetic coding sequence
atgccccccaagaaggacgtgcccgtgaagaagcccgccggcccctccatcagcaagcctgctgcgaaacccgcagccgctggtgcttag

SEQ ID NO: 196340 - DNA, 627 bp, Artificial Sequence
  Description of Artificial Sequence: Synthetic coding sequence
atgccccccaagaaggacgtgcccgtgaagaagcccgccggccccagcataagcaagcctgctgccaagcccgcagccgcaggcgcaccaccagcaaagacgaaagccgagcctgctgttccgcaggcccctcaaaagactcaggaacccccggtcgatttgtcaaaagtggtcattgagtttaataaggatcagctggaggagtttaaagaagctttcgaactgtttgaccgtgtgggtgacggcaagatcttatactctcaatgcggtgatgtaatgcgcgcattaggccaaaatcctacaaatgccgaggtgctgaaggtccttggcaatccgaagtccgacgagctgaaaagcaggcgcgtcgatttcgagactttcctcccaatgttgcaggcggtggccaagaatcggggacagggaacgtatgaagattacttagagggattccgagtttttgataaggagggcaacggaaaggtgatgggggccgagctacggcatgtcttgacgactctgggggagaaaatgactgaggaggaagtggaaaccgttctggctggacatgaggacagcaacgggtgcatcaattatgaagcctttctgaagcacattctgagcgtgtag

SEQ ID NO: 196341 - DNA, 3477 bp, Artificial Sequence
  Description of Artificial Sequence: Synthetic coding sequence
atggccgccgtgcggggcgcccccctgctgagctgcctgctggccctgctggctctttgcccgggtggccgtcctcagaccgtcctgactgacgatgaaatagaggaattcctcgaggggtttctgtcagagctggagcctgaaccacgggaggatgatgtcgaggcccctcctccccctgaacctacgccacgtgtgagaaaggcccaggccggtggaaaacccggcaagcggcccggcacagcagctgaggttcccccagaaaaaaccaaggataagggcaagaagggtaagaaggacaaaggacctaaggttcccaaggagtcattggaagggtcaccccggcctcccaagaaaggaaaagagaagccccctaaggccactaaaaagcccaaggaaaagcccccaaaagcaaccaagaagcccaaagaaaagcctcctaaggccaccaaaaagcccaaggagaaacctccaaaggcgactaaaaaacctccaagcgggaaacggccccctatcttggcccctagcgagaccttagaatggccattaccgccgcctcccagccccggcccagaggaactgccacaagagggaggcgcccccttgtcaaacaattggcagaatccaggagaggagacccacgttgaggcgcgggaacatcagcccgagcctgaggaggagaccgaacagcccaccctggattataacgaccaaatcgaacgtgaagactacgaggactttgagtacatccgtcgccagaagcaacctcgtccgcctccatcccgaagacgccgacccgaaagagtttggcctgagcctcctgaggagaaggccccggcccctgcacctgaggagcgcattgagccccccgtgaagccgctcttgccccccttgcctccagattatggagatggctacgtgataccgaactacgatgacatggattactactttggaccccctcctccccagaagcctgacgccgaacgtcagactgatgaagagaaagaagaactcaaaaagccaaaaaaagaggacagctcccccaaggaggaaaccgacaaatgggccgtcgagaaaggaaaggaccataaggagccacgaaagggcgaggagctggaggaggaatggacccccaccgagaaggtgaaatgtccacctatcggaatggaatcccaccgaatagaagacaaccagattcgggcctcctctatgttacgtcacggcctaggcgcacaaagggggcgtcttaacatgcagacaggggctactgaagacgattattacgatggagcctggtgtgcggaagacgacgcacgcacacaatggatcgaagtcgataccaggaggaccaccaggttcactggcgtgattacgcaggggcgagactcaagtattcacgacgactttgtaacaaccttttttgtgggcttcagcaatgactcccagacatgggtcatgtataccaacggttatgaggagatgacattccatggcaatgtagataaggacactcctgtcctgagcgaacttcctgagcccgtggtcgccaggttcattcggatttatcctctgacgtggaatgggtcactgtgcatgcggttagaggtactcggatgtagcgtcgcacccgtttacagttattacgctcagaatgaggtggtggcaactgacgatcttgactttaggcatcacagctacaaggacatgcgacagttgatgaaggtggtgaacgaagaatgccccacaatcacacgcacgtacagcctcggaaagagcagccgaggtctcaagatctacgccatggagataagtgataacccaggggaacacgagctgggcgaacccgagtttcgatacaccgccgggattcacggtaacgaagtgcttggaagagaacttctcctactactgatgcagtatctgtgtcgagagtaccgagacggtaatcctcgagtgaggtctctggtgcaggacacgcgcatacatttagtgccttctctcaatcccgatggttatgaagtggctgcccaaatggggtctgagttcgggaattgggccctcgggctatggacagaagaagggttcgatatttttgaggattttccagatttgaattctgtcttgtggggcgccgaagaaagaaaatgggtgccatatcgcgtcccaaataataacctgccaatacctgaaagatatttaagcccagatgccacggtgtctacagaagtgagggcaattatcgcctggatggaaaaaaatcctttcgtactgggcgccaacttgaacggcggggagaggcttgttagttatccctatgacatggcacggacaccgacccaagagcaactcctagcggccgccatggccgccgctcgcggcgaagatgaagacgaagtgagcgaagcccaggagacacctgatcatgctatttttcgttggctggctatttcattcgcctctgcacatttgactctgacagagccatatagagggggctgccaggctcaagactatactggaggcatgggaatcgtgaatggcgccaagtggaacccccgcaccggcaccatcaatgatttcagctatctgcacactaactgcctggagctgtccttctacctcggatgcgataagtttccccacgagagtgaactgccacgagagtgggagaacaacaaggaggcacttctgaccttcatggagcaggtgcacagaggaatcaaaggggtggtgaccgatgagcagggaatccccatcgccaacgccacaatcagcgtgagcggaatcaatcacggcgtaaaaacagcgtctgggggagactattggcgaattctcaaccccggtgagtaccgagttaccgcacacgccgaagggtatacgccaagcgccaagacttgtaacgttgattacgatattggagcaacccaatgcaacttcatactcgctagatctaattggaaacggattagggagatcatggcaatgaacggaaacagaccaattccgcacatcgacccgtctcggcctatgactcctcagcagcggcgcctacagcagaggcggctgcagcatcgtcttaggctccgagcacaaatgcgactgcgacggctcaatgcaacgaccaccctgggaccccacaccgttccccctacactgcctccggctcccgccactactttgtctacaacaatagagccttggggactcatcccccccaccaccgctggttgggaggaatccgagactgagacatacaccgaagtggtgacagagttcggaaccgaggtggagcctgagtttgggaccaaggtggagcccgaatttgagactcagctcgaacccgaattcgagacgcaactggaacctgagtttgaagaagaagaggaagaagagaaggaagaggaaatcgccacaggccaggctttccctttcactacggtggagacatatacggtcaatttcggtgacttttag

SEQ ID NO: 196342 - DNA, 447 bp, Artificial Sequence
  Description of Artificial Sequence: Synthetic coding sequence
atgttcgagcaggcccagatccaggagttcaaggaggccttcagctgtattgatcagaatagggatgggatcatctgtaaggctgacctgcgggagacatacagccagcttggaaaggtcagtgtaccggaggaagaactggacgccatgctgcaagagggcaaagggccaatcaatttcacagtgttcctcacactgtttggagaaaaactgaatggcacagaccctgaggaggcaatactaagcgcattccggatgttcgatccctccggcaaaggagttgtaaacaaagatgaattcaaacagttactcttgacccaggccgataagtttagtcctgctgaagttgagcaaatgttcgcgctaaccccaatggacttagctggaaacatcgattataaaagcctgtgttatatcattactcatggcgacgaaaaggaggaatag

SEQ ID NO: 196343 - DNA, 1128 bp, Artificial Sequence
  Description of Artificial Sequence: Synthetic coding sequence
atgcagaagctgcagctgtgcgtgtacatctacctgttcatgctgatagtagcaggtcctgtcgaccttaacgaaaactcagaacagaaggagaacgtggagaaggaagggctgtgtaatgcctgtacctggcggcagaataccaagtctagccggattgaggcaatcaaaatacaaatcctgtccaaactgagactcgagacggctccaaatatttctaaggacgtgattcggcagctgctgcccaaagctccaccactgcgggagctgatcgaccaatacgacgtacagagggatgatagctccgacggtagcttagaagacgacgattaccacgcaacaactgagaccatcatcaccatgccaacagagtcagactttctcatgcaggtggacggcaagccaaagtgctgtttctttaaattctccagcaaaatccagtacaataaggttgttaaggctcagctttggatctacctccggcctgtcgagacacccaccaccgtcttcgtccaaatactgcgtcttatcaagccaatgaaggatgggaccagatacactggaatacgcagccttaagctggatatgaaccccggaacgggcatctggcaatccatcgatgtgaagaccgtgctacaaaattggctgaaacagcccgaaagtaatctgggaattgagattaaggcgcttgacgagaatggccacgatctggccgtaacgttcccaggtcccggcgaagatggattgaaccctttcctggaagtgaaagttactgacactcccaaacgttctagacgggactttggtctggattgtgatgagcacagcactgagtcccggtgctgcagataccccttgactgtggatttcgaggcgtttggctgggactggataatcgctcccaaaagatataaagcaaactactgttctggtgagtgtgagtttgtgttcctgcagaaatatcctcatactcatctcgtgcaccaagcgaatccacgcggttcagccgggccctgttgcacacctacgaagatgagccccattaacatgctctactttaacggcaaggagcagataatatacggaaagatccctgctatggtggtcgatcgatgtgggtgttcctag

SEQ ID NO: 196344 - DNA, 1497 bp, Artificial Sequence
  Description of Artificial Sequence: Synthetic coding sequence
atgttcaactacgagcggcccaagcacttcatccagagccagaacccctgtggatcccgcctgcagcctcccggccccgaaactagttccttcagctcacagaccaaacaatcatccataatcattcagccccgccaatgcacagaacaaagattttccgcgagctctaccctgtccagtcacattaccatgagctcttccgcattccccgcttccccgaaacagcatgctggatcaaaccctggccaaagggtgacaactacctacaatcagtcccctgctagtttcctgagtagcatcctgccctctcagcctgattacaactcatccaagattccaagtgctatggacagtaattaccaacaaagtagcgcgggtcagccaatcaacgccaaaccaagccaaactgccaatgctaaaccgatcccccggactcctgatcatgaaattcaggggagtaaagaagccctgatacaggacctggaacgtaagctgaaatgcaaggacaccctccttcataacggtaatcaaagactcacatacgaagaaaagatggcacggagactgctgggccctcagaacgctgccgcagttttccaggcgcaggacgacagcggcgcacaggactcgcagcagcataacagtgaacatgcccggctgcaggtgccaacctcccaagttcgtagcaggtccaccagcaggggggacgttaatgatcaggatgctatccaagagaaattttatcctccaaggtttatccaagtgccagagaacatgtctatcgatgagggacggttctgtcgtatggattttaaagtcagcggactgcctgcaccagacgtgtcgtggtacttgaatgggcggacagtgcagtctgatgacctgcacaaaatgatagtgtcggaaaagggccttcattcactgatctttgaagtcgtccgcgccagcgatgcgggggcctacgcctgcgtagctaagaaccgcgcaggcgaagcgaccttcactgttcaacttgatgtgttggcaaaagagcacaagagggcaccaatgtttatttataagcctcagagcaaaaaggttcttgaaggtgacagcgtgaaactggagtgtcaaataagcgcgatcccccctcctaaactgttctggaaaaggaataatgaaatggtgcagtttaatactgatcggatctccctttaccaggataataccggacgggtaactctgctaatcaaagacgtaaataaaaaggacgccgggtggtatacagttagcgccgtgaatgaggccggtgttacaacgtgcaatacccggttagatgtgactgcacgcccgaaccaaactctgccagccccaaagcaacttagggtgcgtccaacattctctaagtatttggcgttaaatggcaagggcctgaatgtgaagcaggctttcaaccccgagggcgagtttcaaaggctggcggcacagagtggcctgtacgagtcagaagagttatag

SEQ ID NO: 196345 - DNA, 945 bp, Artificial Sequence
  Description of Artificial Sequence: Synthetic coding sequence
atggcccggcggctgctgggcccccagaacgccgccgccgtgttccaagcccaggacgacagcggggctcaggactcacagcagcacaattccgagcacgcccggctgcaagtgcctacatcacaggtaagaagccgctccacctcaagaggcgacgtcaatgaccaggacgcaatccaggagaagttctacccacctcgcttcatccaggtgcccgaaaacatgtcaattgatgagggccgattttgcaggatggactttaaagtatcgggcttaccagcccccgacgtgagttggtatttgaacggcagaacggtccaaagcgatgaccttcacaaaatgattgtctctgagaagggtctgcactctctaatttttgaagtggtgcgtgccagtgatgccggggcttatgcttgtgtggccaagaacagagctggagaagctaccttcacggtacagctggatgtgttggctaaagaacacaagcgggctccaatgttcatatacaaacctcagtcaaagaaagttcttgagggcgacagcgttaaactcgagtgtcagatttccgcaatccccccgcccaagctgttctggaagagaaacaacgaaatggtgcaattcaacaccgataggatttctctgtaccaggataataccggcagagttacattgctgatcaaggacgtcaataagaaagacgcaggatggtacaccgtgagtgccgtgaacgaggcaggcgtcacaacatgtaatacacggctcgacgtcacggccaggcccaatcaaaccttgccagcccccaagcaattgcgagttcgcccaaccttctctaagtaccttgccctcaacggtaagggcctgaacgttaagcaggctttcaacccagagggggagttccagaggctggccgcacagtcaggactgtacgagtcggaggaactctag

SEQ ID NO: 196346 - DNA, 357 bp, Artificial Sequence
  Description of Artificial Sequence: Synthetic coding sequence
atgtgcgacaaggagttcatgtgggccctgaagaacggcgacctggacgaggtcaaggattatgtggctaagggagaagacgttaatcgcaccctggagggaggccggaagcctcttcactacgctgccgactgcggtcaactcgagattcttgagttccttctgctgaaaggcgccgacatcaacgcccccgataaacaccacataacgcccctgctcagcgccgtgtatgaaggtcatgtgtcctgtgtaaaactcctgttaagtaagggagccgacaaaactgtgaagggcccagatgggctgactgcgttcgaggcaactgacaaccaggcaattaaagcccttctccaatag

SEQ ID NO: 196347 - DNA, 1812 bp, Artificial Sequence
  Description of Artificial Sequence: Synthetic coding sequence
atggccagcgccagcaccagcaagtacaacagccacagcctggagaatgagtcaatcaagagaacaagcagggacggggtaaaccgggacctgactgaagccgttccgcggctgcctggagagactctcatcactgataaggaggtgatatatatctgccctttcaatggtcccatcaaaggccgggtatacatcaccaactatcggctgtacctgcggagtttagaaactgacagctctctaatactggacgtgcccttgggcgtcatctcacggattgaaaagatgggcggtgcgacgtcccgaggtgagaattcatatggattggacatcacttgcaaagacatgcggaacctccgcttcgcacttaaacaagagggccactcccgccgagatatgtttgagatcctcacccgctatgcattcccactggcccacagcctccccttattcgcctttcttaatgaggagaaatttaacgtcgacggatggacagtgtataacccagtcgaagagtataggaggcaggggctgcccaaccaccattggcgaatcaccttcataaacaagtgttacgaactgtgcgacacctaccccgccctcctggtggttccgtacagggcctcagacgacgatctgcgccgtgtggcaactttcagaagccgcaatcgcatcccagtactgagttggatacacccagagaacaagacggtgatcgtccgctgcagccagccgttggtcgggatgtcaggtaaacgcaataaggacgatgaaaaatacctcgatgtcataagggaaactaacaagcaaatatccaagttaacaatctatgacgccagacccagtgtgaatgccgtggccaataaggcaacaggcggtggctacgaatccgatgacgcctaccataacgcagagctgttcttcttggacattcataacattcacgtcatgcgcgagagcttgaagaaagtgaaggatatagtgtacccgaatgtggaggaaagtcactggctgagcagcctcgagtcaacacactggctggaacacattaagctggttctgactggcgcaattcaagtggccgacaaagtgtcgtctgggaaaagctcagtgcttgtgcattgttccgacggctgggatcgtaccgcgcagctgacttccctggccatgctcatgctggactccttctatcggagcatagagggtttcgagatcctagtacagaaggaatggattagttttgggcacaaatttgcctcacgaattggccacggagacaaaaaccacacggatgcagatcgatcaccgatcttccttcagtttatcgattgcgtgtggcagatgagtaaacaatttcctaccgcatttgaattcaacgagcagttcctcatcatcattcttgaccacctctatagctgtcggtttgggacctttcttttcaattgcgaaagcgccagagaacggcaaaaagtgacggaacgaactgtgtctctgtggtcactaattaatagcaacaaagagaagtttaaaaaccctttttatacgaaggagatcaatagagtattatatccagtggccagcatgcgacacctggaattgtgggttaattactatatcaggtggaatccgcgaatcaaacaacagcaacctaaccctgtagaacaacggtatatggagctcttggccctccgtgacgagtacatcaagcggcttgaggagctacagctggcaaactctgctaagctttccgaccctccaacttctccaagctccccgagccaaatgatgccacacgtgcaaacgcatttttag

SEQ ID NO: 196348 - DNA, 1701 bp, Artificial Sequence
  Description of Artificial Sequence: Synthetic coding sequence
atggccagcgccagcaccagcaagtacaacagccacagcctggagaacgaaagcattaaacgcacttcgagagacggggttaatcgtgatttgaccgaggctgtcccacgattacccggtgaaacccttatcaccgacaaagaggtcatttacatctgccccttcaatggacctataaaggggagggtctatattacaaattatagactctatctgcgaagtctggaaacagatatgaggaatttgcgtttcgcgttgaagcaagagggacattccaggcgggacatgtttgagattctcactcgctatgcctttccattggcccatagtttgccgctgttcgccttcctgaacgaagaaaagtttaatgtcgacgggtggaccgtctacaacccagtcgaggaatataggcggcagggactgcccaatcatcactggcgcattaccttcatcaataaatgctacgagctctgcgatacatatccggcactgcttgtggtgccttatagggctagcgacgacgatctgagacgcgtggctacttttaggtcacgtaataggatccccgtgttgtcttggatacatcccgagaacaagaccgtcatagtacgatgtagtcagcctttggtggggatgtccggaaaacggaacaaggatgatgaaaagtatctggacgtgatcagggaaaccaataaacagatcagtaaactgaccatttacgatgcccgcccaagcgtcaacgctgtggcaaacaaggctactgggggcgggtatgagtctgatgacgcataccataatgctgagctcttctttctggacattcataacattcacgtcatgagagagagcttgaaaaaggtgaaagacatagtatatccaaatgttgaggagtcccattggctgagttcgctggaatccacccactggttggagcatataaaactggtgctgactggtgcaatccaggtggccgacaaagtgagcagtggcaagtcttcagtgctggtgcactgttctgacggatgggataggaccgctcagctgactagcttggctatgctgatgctggacagtttttaccgcagcattgaaggatttgaaatcttagtgcagaaggaatggatcagcttcggccataaatttgcatctaggataggccacggcgataagaatcacacagatgctgacaggtcccccatattcctacagtttatcgactgtgtgtggcaaatgtccaagcagtttccaacagctttcgagtttaacgaacaattcctgatcattatcctggatcacctgtacagctgtcgctttggaacattcctgttcaactgcgaaagtgctcgcgagcgacagaaggtaacagagagaaccgtttcgctgtggtcactgattaacagtaataaggaaaagttcaagaacccgttctataccaaagagattaatagggtgttataccccgtcgcatcaatgagacacttggagctctgggtaaactattacattagatggaacccccgtatcaagcagcagcagccaaatccagtggaacaaaggtatatggagctgctcgcactgcgggatgagtacatcaaacgcctggaagagctgcagttggctaactccgccaaactgtcagatcctcccacttccccctctagcccctcgcaaatgatgccacatgtgcagacacacttctag

SEQ ID NO: 196349 - DNA, 1251 bp, Artificial Sequence
  Description of Artificial Sequence: Synthetic coding sequence
atgggcggcgccaccagccggggcgagaacagctacggcctggacattacctgcaaagacatgcgcaatctccggttcgctctgaaacaggaaggacatagccgtcgggatatgtttgagatactgactcgatatgcgtttccactcgcccactctctgcctttatttgcatttctgaacgaggaaaaattcaacgtggatggttggacagtgtataaccccgtggaggagtaccgtaggcaagggttacccaaccatcactggaggatcaccttcataaacaagtgctatgaattgtgtgacacataccctgcccttttagtcgtcccctatcgcgcttccgatgatgacctgcgcagagtggctacatttcgctctaggaacaggatcccggtactatcctggatccaccccgagaacaagacagtgatcgttagatgcagccagccactggtgggaatgagcggaaaacgaaataaagacgatgagaaatacctggatgtcatcagggagactaacaagcaaatctccaagctaacaatttatgacgcacggcctagtgtaaacgcagtcgccaacaaggccaccggaggcggctatgagagtgacgacgcttaccacaatgctgaacttttcttcctagatatccacaacattcacgtgatgcgcgagtcgctaaagaaagtgaaagatatcgtgtacccgaacgtcgaagaaagccactggctgagcagcttagagagtacacactggctagagcacattaagctagtgctaacgggcgctatacaagtggccgataaggttagtagcggcaaaagctcggtcctggtgcattgtagcgacggatgggatagaaccgctcaattaacttcacttgcaatgttgatgctggattccttttatcgcagcatcgagggcttcgaaattctcgtgcagaaagagtggattagtttcggccacaagtttgcaagccggattggccatggagacaagaaccacacagacgcagatcgatcgccgatcttccttcagttcatagattgtgtctggcagatgagcaagcagttcccgacggccttcgaattcaacgaacaattcctgattataattctcgaccacttatatagctgtcggttcggaaccttcttgttcaattgtgaaagcgcgagagaacgtcaagcgctgcactttctgtccctgtcactgtgtcggcgccttcagaagggcttgttcctttatggacactag

SEQ ID NO: 196350 - DNA, 1467 bp, Artificial Sequence
  Description of Artificial Sequence: Synthetic coding sequence
atgcggaacctgcggttcgccctgaagcaggagggccacagccggcgtgacatgttcgaaatccttactaggtacgcttttcccctcgcccattctctacccctgttcgcctttctgaacgaagagaagttcaacgttgacggctggacagtctacaaccccgtggaggaataccgccggcagggactgcctaaccaccattggagaatcaccttcatcaacaagtgctatgaactctgtgatacataccccgccttactggtggttccctacagggcaagcgacgacgatttaagacgggttgcaaccttcaggtcgcggaacaggatccccgtcctttcatggatacatcccgagaataagaccgtgatcgtgcggtgctcacagccactcgtaggcatgtctgggaaacgcaacaaggatgacgagaagtatcttgatgtaatccgggaaacaaataaacagatttcaaagctgaccatctatgatgcgcggcccagcgttaacgctgtcgccaacaaggccacagggggcggatacgaaagtgacgacgcataccataatgccgaactgttcttcttagacatccacaatatacacgtgatgcgcgagagcctgaagaaggtgaaggacatcgtgtaccccaacgtcgaagaatcccattggttgtccagccttgaaagtacccattggttagaacacattaagctggtccttactggcgccatccaggttgctgacaaggtgtccagtggaaagagctcggttttggtccactgttcagacgggtgggacagaactgctcaactcaccagcctcgccatgcttatgctggactcattctaccgctctattgaaggtttcgagatcctggtgcagaaagaatggatatccttcgggcacaaattcgcttctcggatcggacatggcgacaaaaatcataccgacgcagaccggtcccccatctttctgcagttcatcgattgcgtgtggcagatgtcaaaacaatttccgactgccttcgagttcaacgaacagttcttaattatcatactcgatcacctctactcatgtagatttggaacatttctattcaactgtgaatcagcccgcgagagacagaaggtgacagagcgcactgtgtcgctgtggtcgctgattaattcaaacaaggagaaatttaagaaccctttctataccaaagaaattaatcgtgtgttgtaccctgtcgccagcatgcgacatctggaactgtgggtcaattactatatcaggtggaaccctcgcatcaaacagcagcaaccaaacccagtggagcagcgatacatggaactactcgccctacgagatgagtacatcaaacgcctggaggagctacaactggctaattccgccaagctttccgacccccctacaagccccagttctcctagccaaatgatgccccacgtccagacacacttctag

SEQ ID NO: 196351 - DNA, 1998 bp, Artificial Sequence
  Description of Artificial Sequence: Synthetic coding sequence
atggaccggcccgccgccgccgccgccgccggctgcgagggcggcggcggcccaaatccaggaccagccgggggaagacggccgcctagagccgcaggaggcgcaaccgctggatcacgtcagcctagtgttgaaacactggacagccccaccggcagccacgtggaatggtgtaagcagctcatcgccgcaaccatcagcagtcaaatttccggatctgtgaccagcgaaaatgtttcccgagactacaaagcacttcgggacgggaacaagttagcccagatggaggaagcccccctgtttcccggtgagtcaatcaaagctatcgtcaaagacgtgatgtatatctgcccgtttatgggagccgtgtcgggcacactgaccgttactgacttcaaactgtactttaagaacgtcgagagagaccctcacttcattctcgatgtccctcttggcgtgatctccagggttgaaaagatcggagcccagtctcacggcgataattcctgtggaatcgaaatcgtgtgcaaggacatgcgtaacttaagactggcgtacaaacaggaagaacaatccaagttaggcatcttcgagaatctgaataaacacgcctttccattgagcaacgggcaggcactgtttgcgttctcttacaaggaaaaatttcctattaacggatggaaagtttatgaccctgtatctgaatacaaacgccaagggcttcctaatgaaagctggaaaattagcaagattaactcaaattacgaattttgtgacacctatcccgcaataatcgtggtgcccactagcgtcaaagatgatgacctttctaaagtggccgccttccgcgcgaaaggaagagttccagtactgtcctggatccaccctgagtcgcaagctacaataacgaggtgttctcagcccttagtgggaccaaatgacaagcgctgcaaggaggatgagaaatatttacagacaatcatggatgccaatgctcagtcacataaactaatcatctttgatgcacgacaaaactctgtggctgacaccaataaaaccaagggagggggatacgagagtgagtcagcctatcctaatgctgaattagtttttctagagatccacaacatccacgtgatgagagagagcttaaggaagctgaaggaaatcgtctaccccagcatagacgaggctcggtggctgagcaatgtcgacggcactcactggctggaatatattaggatgctgctggccggagcggtccggatcgccgacaaaatcgaaagcggcaagacaagcgttgtggtgcactgctccgacggctgggatcgcaccgctcagctcacatcactggccatgctgatgttggattcctattaccggactatcaagggtttcgagaccctagtcgagaaggaatggatttcctttggacaccggttcgccctccgagtgggtcatgggaacgataatcacgctgacgctgataggtcaccaattttcctgcagttcgttgactgcgtttggcagatgacccgccagtttccctcggcttttgagttcaatgaactgttccttatcacaatcctggatcacctctattcatgcctgttcggcactttcctttgcaattgcgagcagcaaagattcaaagaggatgtttacacgaagaccatctctttatggtcctatattaacagtcaactggatgagttttccaatcctttttttgttaattacgaaaaccacgttctgtaccccgtggcgtccttgagtcacctggagctgtgggtgaattattacgtgagatggaatcctcgaatgcggccacagatgccaatacaccagaaccttaaggaactgttggccgttcgcgctgaactgcagaagagagtggagggcttgcagagggaggtggctactcgggccgtgtccagttcatctgagcgggggagcagcccaagccatagcgccacgtccgtgcatacgagtgtatag

SEQ ID NO: 196352 - DNA, 264 bp, Artificial Sequence
  Description of Artificial Sequence: Synthetic coding sequence
atggaggaggcccccctgttccccggcgagagcatcaaggccatcgtcaaagacgttatgtatatatgtccgttcatgggcgccgtgtctggcaccctgaccgtgaccgattttaaactctacttcaaaaacgtcgagcgggatccacattttattttagacgtgcctctgggcgtcatctcccgggtcgaaaagatcggggctcaaagtcacggagacaattcctgcgggatagagattgtgtgtaaggacatgcggaactag

SEQ ID NO: 196353 - DNA, 264 bp, Artificial Sequence
  Description of Artificial Sequence: Synthetic coding sequence
atggaggaggcccccctgttccccggcgagagcatcaaggccatcgtgaaggatgttatgtatatctgcccttttatgggggcggtctctgggacccttaccgtcaccgatttcaaactgtattttaaaaacgtggagcgcgatccacacttcatactggatgtgccgttaggcgttatttcccgcgtcgagaaaatcggggcccaatcccatggcgacaattcgtgcggcatcgagattgtatgtaaagacatgcggaactag

SEQ ID NO: 196354 - DNA, 273 bp, Artificial Sequence
  Description of Artificial Sequence: Synthetic coding sequence
atggaggaggcccccctgttccccggcgagagcatcaaggccatcgtcaaagacgtcatgtatatatgcccgttcatgggcgctgtgagtggaacactcactgtcaccgatttcaaactgtatttcaaaaatgttgaaagggatcctcacttcatactggacgtgcctttgggtgtgatctcccgcgtagagaagatcggtgctcagtcacacggagataatagctgcggcattgagatcgtctgcaaggatatgcgcaatctgaggttgtag

SEQ ID NO: 196355 - DNA, 2022 bp, Artificial Sequence
  Description of Artificial Sequence: Synthetic coding sequence
atggaccggcccgccgccgccgccgccgccggctgcgagggcggcggcggtcctaacccaggccctgcaggggggaggagacctccacgggccgcgggcggcgctacagctgggagtagacagccaagcgtggagaccctggacagtccaaccgggagccacgtagagtggtgcaagcagctgatagccgcaacaataagtagccagatctcggggagcgtcacaagtgaaaatgtttcccgggattacaaagtgtttcgacgaccagatcttagagccctgagggacggcaataagcttgcacaaatggaagaggctcccctgttccccggcgagtctatcaaagcaatcgttaaggacgtgatgtacatctgtcctttcatgggagccgtgtctggcaccctgaccgttacagattttaaattatactttaaaaacgtggaaagggatccacactttatcctcgacgtacccttgggcgtgatcagccgggtggagaaaatcggagcccaaagccacggtgataatagttgcggaattgaaatcgtctgcaaggacatgcgtaacctcagacttgcctataagcaagaagaacaaagcaaattagggatctttgaaaatcttaacaaacatgcgtttccactgtccaacggacaggccttattcgcgtttagctacaaggaaaaattccccatcaatggatggaaggtttatgacccagtgagtgaatataaacgacagggcctccccaatgaaagctggaaaatttcaaaaattaactcaaactatgagttctgtgatacatatcccgccattatcgtagtcccgaccagcgtgaaggacgatgacctcagcaaagttgccgcttttcgggccaaggggagagtgcctgtcctgtcctggattcatcccgagtcccaggccacaattaccagatgcagccagccattggtcgggcccaacgataaaaggtgcaaagaggacgagaagtacctgcaaacgatcatggacgcgaacgcacaaagccacaaattgattattttcgatgcaaggcagaactcagtggccgataccaataaaaccaaaggcggcgggtacgagtcggagagcgcatacccaaacgcagagctggtctttcttgaaatccataacatccacgtgatgcgggaaagcctccgcaagctcaaggaaatcgtttaccctagcatcgacgaagctaggtggctgagcaacgtggatggcactcactggctagagtatatccggatgctactcgccggggcggtccgcattgcagacaaaatagagagcggcaagacaagtgtggtggtccactgttccgatgggtgggataggactgcccagttgacctccctggctatgcttatgcttgatagctattaccggaccattaaaggcttcgagacactcgtggagaaggagtggatttcctttggccacaggttcgccctacgcgttggacacggcaatgataatcacgcggacgccgacagaagtccaatcttcttgcagttcgtcgactgtgtgtggcaaatgaccagacagttcccttcggccttcgagttcaatgaattgttccttattaccatcctagaccacctttactcctgcctgtttggcaccttcttgtgcaattgtgaacagcaacggttcaaggaagacgtgtacactaagaccatcagtctgtggtcttacataaatagtcagttggatgagttttctaatccattcttcgtgaattatgaaaatcatgtgctgtacccggtggcttctttgagtcatcttgaactgtgggtaaactattatgttagatggaatccccgcatgcgaccacagatgcccattcaccaaaatctaaaagagctcctggctgtgcgggccgagctgcagaaaagggtggaaggtctccaaagagaagtggccactagagctgtgtcgagcagtagcgaacgggggtccagtccttcacattctgctaccagtgtgcacacatccgtgtag

SEQ ID NO: 196356 - DNA, 1707 bp, Artificial Sequence
  Description of Artificial Sequence: Synthetic coding sequence
atggaccggcccgccgccgccgccgccgccggctgcgagggcggcggcggccccaatcctgggccagcgggaggtaggagacctcccagagcagctggcggcgcgacagccggcagccggcagccgtccgtcgagacccttgattcccccacaggaagtcatgttgaatggtgtaaacagctgatcgctgccaccatcagcagtcagatctctgggtctgtcacctctgaaaatgtttcaagagattacaaagctttgcgagacggcaataaacttgctcagatggaagaggcccctctgtttccgggcgagtccatcaaggcgattgtgaaggatgtaatgtacatttgtccgttcatgggcgcagtctccggaacactgacggttactgacttcaagttatatttcaagaacgtagagagagaccctcacttcatcctcgatgttcccctgggggtgattagccgcgtggaaaagattggcgcccaatcccatggcgataactcatgtgggatcgaaatcgtgtgcaaggacatgcgcaacctgcggctggcgtacaagcaggaagagcaatcaaaactcggcatcttcgagaacctcaataaacacgccttccctttgtctaatgggcaggccctgttcgctttctcttacaaggagaagttcccaattaatggctggaaggtgtatgaccccgtctccgagtacaaaagacaggggctaccaaatgagagttggaagatctctaaaatcaactccaattacgaattttgcgacacctaccctgcaattattgtagtgcccactagtgtgaaagatgatgacctatccaaagtggcggcctttagggctaagggccgggtgccagtcctcagctggatccacccggaatcccaggcaaccataactagatgcagccagcccctggtgggacccaacgacaagaggtgcaaagaagacgagaaatacctgcagaccatcatggatgccaatgcccagtcacataagctgataatcttcgatgcgcggcagaatagtgtggcagatacaaacaagacaaagggagggggctacgaaagcgagtcagcttatcccaatgcagaactggtcttcctggagatccacaatatacacgtcatgagagaaagcctccggaagctaaaagaaatagtgtatccttcaatcgacgaggcacggtggctgtcgaatgtcgatgggacacactggctggaatacatcaggatgctgctggccggggcagtcagaatcgccgacaaaattgagtcaggcaagactagcgtcgtggtgcactgctccgatgggtgggatcgcactgcccagctgacttcactggccatgctgatgctcgattcctattatcgcacgattaagggctttgaaacgctggtagaaaaagagtggatttcatttggccacagattcgctttgagagtaggacacggaaatgataatcatgccgatgcagacaggagcccaattttcttgcagtttgtcgattgtgtgtggcaaatgacccggcagttcccaagcgccttcgagtttaatgagctgttcctcattaccattctggaccacctctattcctgtctattcggcaccttcctgtgtaactgtgaacagcagagattcaaagaggcctggggagctggcacacagcgagcacggggttccctgagatcaaggtag

SEQ ID NO: 196357 - DNA, 444 bp, Artificial Sequence
  Description of Artificial Sequence: Synthetic coding sequence
atggaggaggcccccctgttccccggcgagagcatcaaggccatcgtgaaagacgtaatgtacatttgtccctttatgggcgccgtaagcggcacactcacagtcacggacttcaaattatactttaagaacgtggagcgcgacccacacttcattctggatgtgcctctgggagtgatcagcagggtggagaaaattggcgcccagtctcatggtgataattcttgtggcattgaaatcgtgtgcaaggacatgagaaatctgcgactcgcttataaacaggaggagcaatctaagttagggatcttcgagaatctgaataagcacgcctttccgctcagtaatggacaggctctgtttgccttcagttataaagaaaagttcccgatcaatgggtggaaagtctatgatcccgtgagcgagtataagcgacaggggctttag

SEQ ID NO: 196358 - DNA, 1182 bp, Artificial Sequence
  Description of Artificial Sequence: Synthetic coding sequence
atgtacatctgccccttcatgggcgccgtgagcggcaccctgaccgtgactgattttaaactgtattttaagaacgtggaacgagaccctcattttatcctagatgtccccctcggggtgattagccgtgtagagaaaatcggagcccaatcacacggagataattcttgtgggatcgaaatagtatgtaaagatatgcgcaacctgcgattagcctacaaacaggaggagcagagcaagcttggaatctttgaaaacctgaataagcatgcttttcccttatcgaacgggcaggcgctgttcgcattctcctacaaagagaaatttccaataaatgggtggaaggtctatgacccggtgtcagagtacaaaagacagggacttccaaacgagtcgtggaaaattagcaagatcaatagtaattacgaattctgtgacacttacccagcgatcatcgttgtgccaaccagtgttaaggacgacgatctgagtaaagtcgctgcttttcgtgcaaaggggcgagttcccgtgttatcctggattcaccccgaatcccaggcaactatcaccaggtgcagccagccgctagtaggtccgaatgataagagatgtaaagaggatgagaaatatctgcagactatcatggacgctaatgcccagagccataagttaatcatcttcgacgccagacaaaactccgttgccgacaccaacaaaatgctgctggctggagcagttaggatagcggacaaaatcgaaagcgggaagacctcagtggttgtccactgcagtgacgggtgggaccggactgcccagctgaccagcctcgcaatgttgatgctagactcctattaccgaactataaagggtttcgagacattagtggaaaaggagtggatctcatttggccacaggtttgcccttcgtgtgggacacgggaatgataaccatgccgatgctgaccgcagccccattttcctgcaattcgttgactgtgtgtggcagatgactagacagtttccttctgctttcgaatttaacgaactgttcctgatcacaatattggaccacctatactcatgcttgtttggtacattcctatgtaactgtgagcagcagcggtttaaagaggcctggggagcaggcactcaaagggcccggggaagtcttagatctaggtag

SEQ ID NO: 196359 - DNA, 1716 bp, Artificial Sequence
  Description of Artificial Sequence: Synthetic coding sequence
atggaggaggcccccctgttccccggcgagagcatcaaggccatcgtcaaagatgtgatgtatatctgtccattcatgggtgccgtgtccggtacactgaccgtcaccgattttaagctgtacttcaagaatgtggagcgagatccgcattttatcctagatgtgcctctgggggtgatctcccgtgttgagaagatcggagcgcagtcacacggagataactcatgtgggatcgagatagtttgcaaggatatgagaaacctcagattagcatataagcaagaagagcagtctaagctggggatcttcgaaaacctgaacaagcacgcctttcccttatctaacggacaggcgctcttcgcgttttcgtataaagagaaattccctataaatggttggaaagtgtatgaccccgtgtccgaatacaaaagacagggcctgcccaacgagtcctggaagataagcaagatcaattcaaattacgagttctgtgatacttatcccgccatcatcgtagtccccacgagcgtaaaggatgatgatcttagcaaagtggctgctttcagggcgaagggcagagtcccagtgctgtcctggattcacccagaaagccaggccacaatcacccggtgttcccaaccattggtgggccccaatgacaaaagatgcaaggaagacgaaaagtacctgcagactataatggacgcaaacgcccagtctcacaaactcattatcttcgacgcacgccaaaacagcgtggccgatactaacaaaacaaagggagggggatatgaatctgagtcagcctatccaaacgcggaactggtgtttcttgagatccacaatattcatgttatgcgcgaatcactgaggaagttaaaggagatcgtttatccctcgattgatgaagcaaggtggttatccaatgtcgatggcacacactggctcgagtacatcaggatgcttcttgctggggccgtgcggatagccgacaaaatcgagtctggtaagacgtctgtcgtggtgcattgttctgatggttgggataggactgcacagctgaccagtctggcgatgcttatgctggactcctattaccggaccatcaaaggttttgaaactttggtggaaaaagagtggatttcctttggccaccgattcgctcttagagtgggccacggcaatgataatcatgccgacgctgaccgctctcccatattcctccagttcgttgactgcgtatggcagatgaccaggcaatttccctcagcttttgagttcaacgaactattcctgatcactattttggaccacttgtactcgtgcctgtttggtactttcctctgtaattgtgaacagcaacggtttaaggaagatgtgtacacaaagactatctccctgtggtcctacatcaattcacagttggatgagttttcgaatcccttcttcgtgaattatgaaaatcacgttctttatccggtggcttcattgagccacctcgagctgtgggtcaattattatgtccgctggaacccaagaatgaggccccagatgcccattcaccagaatcttaaggagctcctcgccgtcagagccgaactccagaagcgggtggaaggcttgcagcgggaagtggcgaccagggcagtttcttcctcaagtgaaagggggtcttcgcctagccacagcgctacctctgtgcacacctcggtttag

SEQ ID NO: 196360 - DNA, 1092 bp, Artificial Sequence
  Description of Artificial Sequence: Synthetic coding sequence
atggaccggcccgccgccgccgccgccgccggctgcgagggcggcggcggaccaaacccagggcctgccgggggaagaaggccaccgagggccgctgggggggccacagcggggagccgtcaaccttcggttgagaccctggatagtccaactggcagccacgtagaatggtgcaaacagttgattgctgccacaatctccagccaaatctccggctctgtaacgagtgaaaatgtttcacgggactacaaagctttgcgagatggtaacaaactggcgcagatggaggaggcgccactctttccaggagaatctattaaggccatcgtaaaggatgtgatgtacatctgcccttttatgggtgcagtttctggcacactgaccgttacagatttcaagttatactttaagaatgtggagagggatccacattttatactggacgtgccacttggcgttatcagcagggtcgaaaagattggagcccagagccatggcgataattcgtgtggaatcgaaatcgtctgtaaggatatgcggaacctgaggctcgcctacaagcaagaggagcagtctaagttgggaatttttgagaatctcaataagcatgcttttccactgtccaacgggcaggctttgttcgcgttcagctacaaggagaaattcccaatcaacggatggaaggtgtacgaccctgtgagcgaatataaacgccaagggctgcctaacgagtcgtggaagatttctaagatcaactctaactacgagttctgcgacacctatcccgccattattgttgtgcccacgagtgtgaaggacgacgatctttccaaagtggcagcatttagagctaaaggaagggtgcctgtgctcagctggatccacccagagtctcaggctactattactcgctgctcgcagcccttggtggggccgaacgataaacggtgcaaagaagatgaaaagtatctgcagacaatcatggatgcaaacgctcagtcacacaaattaatcattttcgacgccaggcagaactcagtggctgatacgaataagctctggtaccaggacaccgctagcttgatggagtag

SEQ ID NO: 196361 - DNA, 1998 bp, Artificial Sequence
  Description of Artificial Sequence: Synthetic coding sequence
atggaccggcccgccgccgccgccgccgccggctgcgagggcggcggcggtcccaaccccggtcctgcagggggacgccgcccaccgagagcggctgggggcgctaccgccgggagtaggcagccatcagtggaaacattggactcacccaccggtagccacgtcgagtggtgcaagcaactgattgcagccacaattagcagccagatcagcggctctgttacctctgagaacgtgtcccgagactacaaagccttgagagacggcaacaagctcgcacagatggaggaggcccccctctttccaggcgagtctattaaagcaatcgtcaaagatgtaatgtatatttgcccattcatgggcgctgtgtccgggactctaacagtcactgatttcaaattgtacttcaaaaatgtcgaaagagatccccatttcatcctggatgtgcctttgggagttatctccagagtggagaagatcggtgcccagtcacacggtgataacagctgcggaatagagattgtgtgcaaggacatgaggaatctacggctggcctataagcaggaggagcaaagtaagctgggcatctttgagaacttgaacaagcacgctttcccgctcagtaatggtcaggcgctgtttgcattttcctacaaggagaagttccctataaatggatggaaggtttatgatccagtatccgaatataagcgacagggtctgccaaatgagagctggaagattagcaagatcaatagtaattacgaattttgcgacacttaccccgccattattgtagtcccaacgtctgtcaaggacgacgacctgtctaaagtagcagccttcagggccaagggcagggtccccgtgctctcatggattcatcccgaaagtcaggccaccatcactcgctgttcgcagcctctcgtggggccaaatgacaagcgttgtaaagaagacgagaagtaccttcagacgattatggacgccaatgcccaaagtcataaacttatcatctttgacgcccgccaaaactccgtggccgacactaacaagaccaaaggggggggatacgaaagcgagtctgcataccctaacgcagaactagtcttcctcgagattcataatatccacgtaatgcgagagtccctgagaaagctcaaggagatagtttacccttccattgacgaggccaggtggttgtccaacgtggatggcacccattggctggaatacatccgaatgctgttggcaggagctgtgaggattgccgacaagattgagtcgggcaaaactagtgtcgtggtccattgttcagatggttgggatcgcactgctcagctaactagcctggccatgttaatgctggatagttactacaggaccataaaagggttcgaaacactggttgagaaagaatggattagctttggacaccgttttgccctcagggtgggacacggaaatgataaccacgccgacgctgacaggtcccccatctttctccaattcgtggattgcgtctggcagatgacaaggcaattcccatctgcctttgaattcaacgagctgttcctcatcaccatcttagaccacctgtacagttgcttatttggcacgttcttatgcaactgtgaacagcaacggttcaaggaggatgtatacactaagacgatcagcctgtggagctacatcaactcccagctcgacgaattctccaaccctttttttgttaactacgaaaatcacgttttgtatcctgtggccagcttatctcacttggagctctgggtgaactactatgtgcggtggaaccctaggatgagaccacagatgcctatccatcagaatcttaaggagctgttggctgtgcgcgccgaacttcagaaacgcgtggaggggctccagcgagaggtagcaacaagagctgtgtcctcatcctcagaaagagggagctcaccatcccattccgcaacctcagttcatacgtcggtgtag

SEQ ID NO: 196362 - DNA, 1914 bp, Artificial Sequence
  Description of Artificial Sequence: Synthetic coding sequence
atgctgggcaagggcgtggtgggcggcggcggcggcaccaaggcccctaagccaagtttcgttagttacgtgcgccccgaggaaattcacactaatgagaaggaagtgacagagaaagaggtgactctccatttgttaccaggcgaacaactgctgtgcgaagcttctaccgtgctaaagtatgtgcaagaggattcttgccagcatggtgtttacgggcggctcgtatgtacagactttaaaattgcgttcctgggagatgacgagtctgctcttgacaatgatgaaacgcagttcaagaacaaagttatcggtgagaatgatatcacacttcattgcgtcgaccagatctacggagtgttcgatgagaaaaaaaagaccctttttggccaactgaaaaaataccctgagaaactcattatccactgcaaggacttgcgagtattccagttttgccttcggtatacaaaagaggaggaggtgaagcgtatcgtgtcaggaattattcaccatacacaggctccaaagttgttgaagcgactgtttctgttctcttacgcaacagctgcacagaataacacagttacagatcctaagaaccacaccgtaatgttcgacacgctgaaggactggtgctgggagctggaaagaacaaaagggaatatgaagtacaaagcagtttcagtcaacgagggttacaaagtttgcgaaagactgcccgcatacttcgtagtacctactcctctgcccgaagaaaacgttcaacgcttccagggtcatgggatccccatctggtgctggtcttgccataacggtagcgccctcctaaaaatgtcagctctgcctaaagaacaggacgacgggattctccagatccagaagtcatttttggacggaatctacaagaccattcataggccgccttacgagattgtgaagactgaagatttgagctccaatttcctctcccttcaggagatccagaccgcttacagtaaattcaaacagctgttcctaattgataacagcacagagttttgggataccgatatcaagtggttttcactgctggaatcatcttcatggctggacatcattaggcgctgtctgaagaaagccatcgaaattaccgaatgcatggaggcccagaacatgaatgtgctgctgctggaggaaaacgcttcagatctgtgctgcctgatttcaagtctggtccagctcatgatggacccccattgcagaacacggatcggtttccagtcactgatccagaaggagtgggtcatgggaggccactgttttttggaccgctgcaaccatcttcgccaaaacgacaaggaagaacaccagcgccagctgagcttgccattaacacagtccaaaagcagcccaaagcgcggcttctttcgggaggagaccgaccatctgatcaagaacctattgggaaagaggatttccaagctgatcaactccagcgacgagcttcaagacaactttcgggaattttacgattcgtggcactctaaaagcactgactatcacggactcctgctaccgcatatcgaaggacccgaaatcaaggtctgggcccagcgctatctgcggtggattcccgaggcacagatattgggaggaggtcaggtggctacacttagcaagttactagagatgatggaagaggttcagagccttcaagagaaaatcgacgagcggcatcacagtcagcaggcaccccaggccgaggcaccctgtctgctcagaaatagtgcacggttatctagtctcttccccttcgcgttactccagcgacatagtagcaagccggtgttgcccacctccggctggaaggcgctgggtgacgaggacgacctggcgaagagagaggatgagttcgtggacctcggagacgtttag

SEQ ID NO: 196363 - DNA, 2082 bp, Artificial Sequence
  Description of Artificial Sequence: Synthetic coding sequence
atgctgggcaagggcgtggtgggcggcggcggcggcaccaaggcccccaaaccatcatttgtatcctatgtgcggcccgaggaaatacacacaaacgaaaaggaagtgaccgaaaaagaagttacactgcaccttctgcctggggaacaactgctgtgcgaggcttccactgtgctgaaatatgtgcaggaagactcgtgtcagcacggagtatacggccgcttggtgtgcacagatttcaaaatcgctttcctcggtgacgatgaatctgccctagataacgatgagacccaattcaagaataaagtgatcggtgagaacgacataactctgcactgtgtcgaccaaatttatggtgtgtttgacgagaaaaagaagactttgtttggccagcttaaaaagtaccccgagaagctaattattcattgtaaggacctaagagtatttcagttttgtctccgatatacaaaggaggaggaagtcaagcgcatcgtgagtggaattatacatcacacacaagcccctaaactcctgaagagattgtttctattttcctatgccacagcagcacaaaacaacaccgtgacagatcctaaaaaccatacagtgatgtttgacacgctcaaggactggtgttgggagctcgagcgcaccaaggggaatatgaaatacaaagccgtgtcagtgaatgagggctataaggtatgtgagcgtctgccggcttactttgtggtgccaacaccattgcctgaggagaatgtccagagattccagggccacggaatcccaatttggtgctggtcttgccacaatggaagcgctctgctcaaaatgtccgccctgccgaaggaacaggacgacggcatattgcaaatacaaaagtcttttctcgacgggatttataaaaccatccaccgaccaccgtacgaaattgtgaagactgaagacctgtctagtaattttctgagcctccaggaaatccagactgcttactctaagttcaaacaactcttcctcatcgacaactcaaccgagttctgggatactgatatcaagtggttttcattactggaaagttctagctggcttgacatcatccggcggtgtctgaagaaagcaatcgaaatcacagagtgcatggaagcacaaaatatgaacgtgcttctgcttgaggagaacgcctcagacctgtgttgccttattagcagtctcgtgcagctcatgatggatccccattgtcgcacccggataggattccaatctctgattcagaaggaatgggttatgggaggccattgcttcctggatcgctgcaatcacctgcgccagaatgacaaagaagaggtccctgtctttctcctctttttagactgcgtctggcagcttgtccatcagcaccctcctgcctttgaatttacagaaacctatttgactgttctatctgacagcctctacatcccaatctttagcacctttttcttcaactcacctcaccagaaggataccaacatgcaccagaggcagttaagcttaccgttgacgcaatcaaagtcgagccccaaacgcggctttttccgcgaggagaccgatcatttaataaagaatctcctgggtaagcgtatcagcaagctgatcaactcatcggatgagctacaggacaacttccgagaattctatgatagctggcattccaaaagcacagactaccatgggctgttactaccacacatcgaggggccagagatcaaggtttgggcccagagataccttagatggatccccgaggcccaaattctcggtggcggtcaagtggcgaccctttctaagttgttggagatgatggaggaagtacaatcactgcaggagaagattgacgaacgacaccactcccagcaggctccccaggcagaagccccttgcctgcttaggaattctgctcggctgtccagtctctttcccttcgctctcctccagcggcatagctcaaagccagtgcttcccactagtgggtggaaggcactgggagacgaggatgatctggctaagagagaagatgagttcgtcgatctgggcgacgtgtag

SEQ ID NO: 196364 - DNA, 2244 bp, Artificial Sequence
  Description of Artificial Sequence: Synthetic coding sequence
atgctgggcaagggcgtggtgggcggcggcggcggcaccaaggccccaaaacccagctttgtgtcttacgtcagacctgaggagatccatacaaacgaaaaggaggtgactgagaaagaggtcacactgcacctgctgcccggcgagcaattgctgtgtgaggcttctacggtgctcaagtacgtgcaggaggattcatgccaacatggcgtttatggccggctggtttgcacagacttcaaaatcgcatttctgggcgacgatgagtccgctctggataatgacgaaacacaattcaaaaacaaagtgatcggcgagaacgacattactttgcactgtgtggaccagatatacggagtctttgatgagaagaaaaagacactctttggccagctcaaaaaataccccgagaaattaatcattcattgcaaggacctccgagtgttccagttttgcttgcggtataccaaagaggaggaagtgaaacggatcgtgagtgggataattcaccatacccaggcccccaaactcctcaaaaggttatttcttttttcttatgccactgctgcccaaaacaacaccgtcacagatcctaagaatcacaccgtgatgttcgacacactgaaggactggtgttgggagctggaacggacaaagggaaacatgaagtataaggccgtcagcgtcaacgaaggctacaaagtatgtgagaggctaccggcttacttcgtggttcctaccccactcccagaagaaaacgtgcagcgcttccagggtcacggcatccctatctggtgctggtcctgccataacggatccgcactgctaaagatgtctgctctgcctaaggagcaggatgacggcatcctgcaaattcagaagagcttcttggatggcatctacaagactatccatcgccctccctacgagattgtgaaaacagaagacttgtctagtaattttttgagtctccaagaaatccagacggcatatagtaagtttaagcagctattccttattgacaactctacagagttctgggatacagacataaagtggttttcgctgctggagtcctcttcttggcttgacatcatccggaggtgtttgaagaaggccattgaaatcacagagtgcatggaggcacaaaatatgaatgtcctcctgctggaagagaatgcctctgatctgtgctgtctcatctcctctctcgtccaacttatgatggacccccactgtcgcacacgcatcggattccagtctttgattcagaaagaatgggtcatgggaggccattgtttcctcgatcgctgtaatcacctccgccagaacgacaaggaagaggtaccagtctttctgcttttcctagactgcgtctggcagttagtacatcagcacccccctgcctttgagttcaccgagacctacttgaccgtgctttctgattccctatacatccccatcttttctacatttttcttcaattcccctcaccaaaaagacaccaacatgggccgggaaggccaggacacccaatccaagcccttaaatctattaacagtttgggactggtctgtccagtttgagcccaaggcacagaccttactgaagaacccactgtacgtggaaaagccaaaactcgataagggacagcgaaaaggcatgcgatttaagcaccagaggcagttatccctgccactcacccagtcgaagtccagccctaagcgcggcttctttagagaagaaaccgaccacctgatcaagaacctgctcggaaagcggattagcaagctcattaatagcagcgatgagttgcaagacaatttcagagaattctatgattcatggcacagcaaatcaacagattaccatggtcttttgctacctcacattgagggcccggagataaaggtgtgggcacagagatatcttcggtggattcccgaggctcagatcctgggtggaggacaagtcgctactttaagcaagctgctggaaatgatggaagaggtgcaatcactccaggagaagatcgatgaacgacatcactctcagcaggcccctcaggccgaggctccatgtctgttgcgcaacagcgcgcgcctcagctccttattcccttttgctctgctgcagcggcactccagcaaacctgtgctgcctacatcggggtggaaagctcttggcgatgaggatgacctcgccaagagagaagatgagtttgtcgacttaggagatgtatag

SEQ ID NO: 196365 - DNA, 1953 bp, Artificial Sequence
  Description of Artificial Sequence: Synthetic coding sequence
atggccggcgcccgggccgccgccgccgccgccagcgccggcagctcggcctcgtctggcaatcaaccgccccaggaactgggtctcggcgagctgctagaggaattttctcggacccagtaccgtgccaaggatggtagcggaaccggaggaagcaaagtggagaggatagagaaaagatgcctggagctgtttgggagggactactgcttttcagtaatccccaacaccaatggagatatctgcggccactacccccgccacatagttttcttggagtatgaaagtagcgagaaggagaaggacacctttgagagcaccgtgcaggttagtaaacttcaagatttgatacacaggagcaaaatggcaaggtgcagaggtcgatttgtctgtcctgtcattctcttcaagggtaagcatatttgtcgcagcgcgacgctcgccggatggggcgaactgtatggcagatctggatataactactttttctccggcggcgctgatgacgcgtgggccgatgttgaggacgtgacggaagaggactgtgcactccgctcaggtgacacacacttgttcgataaagttcgaggatacgacatcaaattacttcgctaccttagcgtgaaatacatctgtgatctaatggtggagaacaagaaagttaagtttgggatgaacgtgacatcatccgaaaaagtggacaaagctcagaggtacgccgactttacactgttgtccattccctatccaggctgcgagttcttcaaagagtacaaagatcgcgactatatggccgagggccttatcttcaactggaagcaggactacgtggacgcgccgctcagcatccccgattttttaactcatagcctgaacatcgattggtcacagtaccagtgttgggatttagtacagcagacacagaactacctcaagttgctgctttccttggtaaacagcgacgacgatagcggcctgctggtacactgcataagcgggtgggaccgtacacctctcttcatttccttactgagactctccttgtgggccgatggactgattcacacgtctttgaaaccaacagagatcctgtaccttactgtggcctacgattggtttctgttcggccatatgctcgtggacaggttgtcaaaaggtgaggaaatctttttcttctgtttcaatttccttaagcacattacatctgaagagtttagcgcacttaagacacagcggcggaaaagccttcctgctcgcgatggtggattcactctggaggatatctgcatgctcagaaggaaggatcgaggctctacaacatccctgggcagtgatttctccttggtgatggagagctcacccggggcaaccgggtctttcacctacgaggccgtggagctagtccccgctggtgctcctacgcaagctgcgtggcgaaagagccacagctcttctcctcaatccgtactgtggaacaggcctcagcccagcgaggataggctccccagccagcagggcttagcggaggcaagaagcagttcctcctctagctcaaaccactccgacaatttttttcgtatgggctcctctcctctagaggtgccaaagcctagaagcgtagatcatcctcttcccgggagctccctctccaccgactatggttcctggcaaatggtcacaggatgtgggagcatccaggagagagcggttctgcataccgactccagcctgccatttagctttccggacgaattaccgaactcttgtcttctggccgcgctgagcgaccgggaaacgagactccaggaggtccgcagcgcttttctggccgcttattcttcaaccgtcggcctccgggccgttgcacctagcccatccggagccatcggggggctccttgaacagtttgcacgaggagtcgggttgaggtccatttctagcaacgccctgtag

SEQ ID NO: 196366 - DNA, 1617 bp, Artificial Sequence
  Description of Artificial Sequence: Synthetic coding sequence
atggccggcgcccgggccgccgccgccgccgccagcgccggcagcagcgcatcctccggcaaccaacccccccaggaacttggccttggcgagctactggaagaattctctcggactcaatatagagcgaaagatggatctggaactgggggcagcaaagtggaacggattgagaagcgatgtctggaattgtttggccgagattactgtttttcagtgatccccaacaccaatggggacatctgtgggcactatcctaggcatatagttttcctggagtacgagtctagcgagaaagaaaaggatactttcgagtcgacagttcaagtgagtaagctccaagatctgattcaccgttccaaaatggcacgttgccgcggccgtttcgtctgccccgtgattctcttcaagggcaagcacatttgccgttctgcaacattggcagggtggggggagctctacggaagaagcggttacaactatttcttctcagggggcgctgatgacgcctgggcagatgtggaggatgtgaccgaggaagattgcgcccttcggagtggcgacactcatctgttcgacaaggttaggggatatgacatcaagctgttgaggtacctgtcagtaaagtacatttgcgacttgatggtcgagaacaagaaggtgaagtttgggatgaatgttactagctcagaaaaggtcgacaaagctcagaggtatgccgactttacattacttagtattccttatcccgggtgcgagttctttaaggagtataaggatagggactatatggccgaaggtttgatcttcaactggaaacaggattatgtagatgctccactgtcaatcccagattttttgacacattccctgaatatcgattggagccagtaccagtgctgggatctggtgcagcaaactcagaactatctgaaattgttactgagcctcgtaaactccgacgacgactcgggactcctcgtgcattgtatatctggatgggaccgcacccctctgtttatctcactgctgagactttcattgtgggcagatgggctgattcatactagtctgaagccaactgaaatcctgtacttgacagtcgcatatgattggttcctcttcggacacatgctcgttgacagactatcaaagggagaggagatcttctttttttgctttaatttcctcaaacatatcacgagtgaggagttttctgccctgaaaacccagcgtcggaagagtctgccagcaagggatggcgggtttactctggaggatatttgcatgctgaggaggaaggacaggggcagcaccacatctctcgggagtgattttagtctcgtaatggagtcctccccaggcgccactggttccttcacatacgaggcagtagaattagttccagcgggcgctccaacccaggcagcatggctggcagctctctccgacagggagaccagactgcaagaggtgaggtctgcttttctggccgcctacagttccactgtgggcctccgagccgtcgctccatccccaagcggcgcaatcggtggactgctggagcaatttgccaggggggtgggcttgcgttccatttcttccaacgcgttatag

SEQ ID NO: 196367 - DNA, 1797 bp, Artificial Sequence
  Description of Artificial Sequence: Synthetic coding sequence
atggccggcgcccgggccgccgccgccgccgccagcgccggcagctccgcgtcctcaggaaatcagcccccacaggaattagggctcggagagcttctagaagaattctctagaactcaatatcgcgccaaggacggcagcgggaccggcgggagcaaggttgagcgaatcgagaagagatgcttagagcttttcggccgggactactgttttagcgtgattccaaatactaatggtgacatttgcggccattacccgcggcacatcgtattccttgagtacgaatcttcggaaaaagagaaggatacctttgagtcaactgtacaagtaagcaagcttcaggatctgatccacagatccaaaatggctcgctgccggggtaggtttgtttgcccggttattctgtttaaggggaagcacatttgccgctccgcaacgcttgctggctggggcgagctgtacggacgctccggttataactactttttttctggaggagccgatgatgcatgggctgacgttgaggacgtcacggaagaagattgtgctctgaggagcggtgatacccatctttttgacaaagtccgcggctacgatattaagttacttcgatatttatccgtgaaatatatatgcgatctgatggtggaaaacaaaaaagtcaagttcggtatgaacgtgacctcaagcgaaaaggtggataaagcccaacgttacgccgatttcactctgctttctattccataccccggctgtgaattcttcaaggagtacaaggatagagactacatggccgaggggctcatattcaactggaaacaggattacgtagatgcacccctttcgatcccagacttcctgactcacagtctgaatatcgactggagtcagtaccagtgctgggacttagttcagcagacccagaattatttaaagctactcctctccctagtgaacagcgacgatgacagcggcttgttagtgcactgcatttcgggatgggaccgtacccccctgttcatttctttactgcgccttagcctatgggccgatggcttaatccacacctccctgaagcccaccgagatcctgtatctcacggtcgcttacgattggttcctgtttggccacatgctggtagataggctttccaagggtgaggaaatcttttttttctgttttaacttcttaaaacatatcacctccgaagagtttagcgctctcaaaactcagcgccgtaagagcctgccagccagagatggaggattcacactggaagatatttgtatgctgaggcggaaggaccgcggttccacgacatctctgggcagtgatttctctctagtgatggaatcttcaccaggggccaccggatccttcacctacgaagcagtcgagcttgtgccggcaggagccccaacccaggctgcatggaggaaatctcacagctcgtcacctcagtccgtcctgtggaatcgcccccagccttcggaggacagactcccttcccagcaaggccttgccgaggcccggtccagcagcagttcgagctccaatcactctgataacttttttagaatgggtagctccccactggaagtgcccaaacccaggctggccgcgctcagcgaccgcgagacgagactgcaagaggtccgttctgctttcttggcagcttactcttccaccgtaggcctgagggccgttgcaccctctccaagtggcgccatcggaggattactggagcaattcgctcgcggggttggattaagatccatctccagtaacgccctgtag

SEQ ID NO: 196368 - DNA, 1563 bp, Artificial Sequence
  Description of Artificial Sequence: Synthetic coding sequence
atggccggcgcccgggccgccgccgccgccgccagcgccggcagcagcgcctcttcaggcaaccagccaccccaggagttaggcctgggagaactgttagaggagttcagtcgaacacagtatagggcaaaggacggctcaggcaccggcggatccaaagtggagaggattgagaaacgatgcctggagctgtttggcagggactattgtttttccgtcattcctaacacaaatggcgacatttgtggccactatcctcgccacattgtattcctagaatacgagtccagcgagaaagagaaagacacatttgaatcgaccgtgcaggttagtaagttgcaggacctgattcataggtccaaaatggctcggtgtcgagggcgcttcgtatgccccgtaatcctgttcaaaggaaagcacatttgcaggtccgccacactagcaggatggggagaactatacggccggagcggctataattacttcttctccggtggggccgacgatgcctgggccgatgtagaggacgtgactgaagaggactgcgctttgcgcagcggtgacacccacttattcgataaagtgcgaggttatgacatcaaacttttgaggtatctgagtgtgaagtatatatgtgacctgatggtggaaaataaaaaggttaagtttggaatgaacgtaacgtcaagtgaaaaggtggataaggcccagaggtatgccgacttcaccctgctttctattccatatcctggttgtgaatttttcaaggagtacaaggatcgggattatatggcagagggcttaattttcaactggaagcaggactatgttgacgcacccctgtcaattcccgatttcctcacccattccttgaacatcgactggagtcagtatcaatgctgggatctggtgcagcagacacagaactacctcaaacttctgcttagcctggtgaacagcgatgatgattctggtttgttagttcactgtatctcgggatgggaccgcacacctctgtttataagtctgctgcggttgtcactctgggccgacggcctaatccatacctcacttaaaccgacagaaatcctgtatcttaccgtggcctatgactggttcctgttcgggcacatgctggtcgataggctttcgaaaggagaagagattttcttcttttgtttcaactttttaaagcatatcacatcggaagaatttagcgccctgaagacccagaggaggaagagcctgcctgcacgtgacggtggattcaccctggaagatatttgcatgctcagaaggaaagaccggggctctactaccagtctggggtcagacttctccctggtcatggaatctagccccggagctaccggctccttcacctatgaaagaggagcaggccctagccggagcgctaactccggtagcctcgaggaggagccgctcatcctgtcaactgaatgtcctttggagccagccactacgctgcgcgggcctctggcattccctgcaggggcgggcgggtctcaggtgttccaactgctctttcttaagcccttttag

SEQ ID NO: 196369 - DNA, 1932 bp, Artificial Sequence
  Description of Artificial Sequence: Synthetic coding sequence
atggagaagagcagcagctgcgagagcctgggcagccagcccgccgccgcacgcccgccgtcagtcgacagcctctcatccgcctccacctcccattccgaaaattccgttcatactaagagcgcatccgtcgtgagcagtgactctatttcaacgagtgccgacaactttagccctgatctgcgcgtgctgcgcgagtcaaacaaattagctgaaatggaagagccccctttgttgccaggtgaaaacatcaaggacatggcaaaagacgtgacctacatttgtccgtttaccggcgccgtccggggcactttaacagtgaccaactaccgtctgtactttaaatccatggagcgtgaccccccattcgtgctagacgcctctttgggcgtaataaaccgcgtagagaaaatcggcggcgcctctagtagaggcgagaattcgtacggtcttgagactgtgtgtaaggatatccgcaacctcagattcgcacacaaaccagaaggtcgtacccggcgatccatattcgagaaccttatgaaatacgcctttcctgtaagcaataatcttcccttattcgcattcgaatacaaagaggtgttccccgagaacggctggaagttgtacgaccctcttctggagtatagaaggcagggcattcccaacgaatcttggcgcattactaaaataaacgagagatatgagttatgcgatacctatccagccctcctagttgtccctgctaacataccagacgaagaactgaaacgggtagccagcttcagatcgaggggtagaattccagttctgagctggatccaccccgaaagccaggccaccatcacgcgctgctcccagccgatggtcggtgtatccggtaagagaagcaaagaagatgaaaaatacctgcaggctatcatggactcaaatgctcagtctcacaaaattttcatctttgacgcacgaccttctgtgaacgcggtcgcaaataaagcaaagggtgggggctatgagtcggaggatgcctatcaaaatgccgagctggttttcctggacatccacaatattcatgtgatgagagagtccttgagaaagcttaaagaaattgtgtatcccaacattgaagaaacccactggctgtcgaatctcgagagtacccattggctggaacacatcaaactgatcctggccggagcccttcgcatcgctgacaaagtggagtccggtaagaccagcgtcgtggtgcactgctcagatgggtgggaccgcactgcccagttaacctctcttgctatgttaatgcttgacggatactataggacaatcaggggattcgaggtgctcgtagaaaaggaatggctgagttttgggcataggtttcaactgcgagttggtcatggagataaaaaccacgctgacgcagaccgcagccccgtgttcctccaattcattgactgtgtgtggcaaatgacgcgccagtttcctactgcctttgaatttaacgagtattttctgatcaccatcctggaccatttgtattcatgtctatttggaactttcctgtgcaattctgaacagcaacgggggaaagagaacctaccaaaaagaactgtctccctgtggtcttacattaattcccagctggaagacttcacgaacccgctctatggctcctatagcaatcacgtcctgtaccccgtggcttctatgaggcacctggaactctgggttgggtattatataagatggaatcctaggatgaagccccaagagccgattcacaatagatacaaggaactactggcaaagcgggccgagctccagaagaaagtggaggaactgcagagagagattagcaacagaagcacgtcctcttcagagcgcgccagttcacctgcccagtgcgttactcctgttcaaacggtggtgtag

SEQ ID NO: 196370 - DNA, 1716 bp, Artificial Sequence
  Description of Artificial Sequence: Synthetic coding sequence
atggaggagccccccctgctgcccggcgagaacatcaaggacatggccaaggacgtaacctacatttgcccctttactggggccgtgcgcggcacactgaccgttacaaattatcgcctctacttcaagagcatggagagggacccccccttcgttctagacgcctctctgggagtgatcaacagggttgagaaaatcggcggggcatcctcacgaggtgagaacagctacgggttagaaaccgtatgcaaagacatccgaaatctgcggttcgcccataagccagagggccgaacgaggaggtcaattttcgaaaacctcatgaagtatgcctttccagtcagcaacaatctgccactgtttgcgttcgaatacaaggaagtgttccccgagaacggatggaaactgtatgacccactgctcgaatacaggcgacaaggcatccccaacgagagctggcgtattacaaagattaatgaacggtacgagctctgcgatacctaccctgccctgttagtcgttccggccaatattccagacgaggagttgaagcgtgtggcctcctttaggagccggggtagaataccagtactgtcctggatccaccctgaatcccaggccacaattacccgttgttctcagccaatggttggagtgagcggcaaacggtccaaggaggatgaaaagtatctccaagccattatggattcaaatgcccagtctcataaaatatttatttttgacgcaaggccctccgtaaacgctgtcgcaaacaaggccaagggaggcgggtacgaatctgaggacgcctatcagaatgccgaactggtgtttcttgacatccacaacattcatgtcatgcgcgagtctttacggaagctgaaagaaatagtctaccccaacattgaggagacgcactggctgtccaatcttgagagcacacattggctggagcatatcaagctcatcctggccggggctcttcgcattgctgacaaggtggagtcaggtaagaccagtgtggtcgtccattgctcagacggatgggatcgtactgctcagctcaccagccttgctatgctgatgctggacggctactaccgcaccatccgcggctttgaggttttagtcgaaaaggaatggctcagcttcgggcaccggtttcagctgcgcgttggccatggcgacaagaaccatgcagatgctgataggtctcccgtgtttcttcagttcatcgattgcgtctggcagatgacacgccaatttcctactgccttcgagtttaacgagtatttcctcatcacaattctggatcacctgtactcctgtctttttggaaccttcttgtgcaactcggagcagcagcgagggaaggaaaacttgccaaagcggacagtctcactgtggtcctatattaactctcagctggaggactttactaacccactgtatgggtcatatagcaatcatgttctgtaccccgtagccagtatgcgccatctggaactctgggtgggctattacattcgatggaatccacgtatgaaaccccaagagcccatacacaatcggtacaaagaactgctggccaagcgcgcagagctgcagaagaaggtcgaggagctccagcgtgaaatcagcaatagatctactagcagtagtgaacgcgcatcttcaccagcccagtgtgtgacccccgtccagaccgttgtatag

SEQ ID NO: 196371 - DNA, 1716 bp, Artificial Sequence
  Description of Artificial Sequence: Synthetic coding sequence
atggaggagccccccctgctgcccggcgagaacatcaaggacatggcgaaggacgtcacgtatatatgtccattcactggagccgtacgaggcaccttgactgtgacaaattatcgcctttacttcaagagtatggagcgcgaccccccgtttgtgctcgatgctagcctgggcgtcattaaccgagtggagaagataggtggcgcttcgtctcggggagagaattcgtatggcctggaaacagtttgtaaagacatacggaatctcaggttcgcgcataagcctgaggggcggacccgacgctccatttttgaaaacctgatgaaatacgccttccccgtgtccaataatctcccgctgttcgcctttgagtacaaagaggttttccctgagaatgggtggaaactgtacgacccactcctggagtatcgaaggcaaggcatcccaaatgagtcctggcgcattactaaaatcaacgaacggtacgagctatgcgatacttatccagccctcctggtggtgcccgcaaacattccggacgaggaactgaagcgagttgcatccttcagaagtcgcggaagaattcccgtgctctcatggatccaccccgagtcccaggcaaccatcacccgatgcagtcagcctatggtgggagtgagcggcaagcggtctaaggaggatgaaaaatatctccaagcaatcatggattctaacgcccagtcacacaaaatttttatatttgatgcacgaccctctgtgaatgccgtggcaaacaaggctaagggtggcgggtacgagtccgaggacgcataccagaacgcagaactggtgtttctagacatccacaacatccatgtcatgcgggagagcttgagaaagctcaaggaaattgtttacccaaatatagaggagacccactggctgtcaaatctagagtccacacactggctggaacacatcaaactgattttagcaggtgcactgagaatcgcagacaaggtggaatctggcaaaacctccgtggtggtgcactgcagtgacggctgggaccgtaccgcacagctcacttccctcgccatgctgatgctggacgggtattaccggaccatacgtgggttcgaagttctcgttgagaaggagtggctgtctttcggtcacaggttccagttgagggtgggccatggcgacaaaaaccacgccgacgccgacagaagccctgtgttcttgcagtttattgactgtgtttggcaaatgacaaggcagtttcccacagctttcgaatttaatgagtactttctgatcaccatacttgatcacctctacagctgcttgttcggcacatttctatgcaattccgagcaacagagggggaaggaaaaccttccaaagcgcacagtctcgttgtggtcctacatcaactcacagctcgaggatttcactaaccctttatatggcagctattccaaccacgtactatatccagtcgcctcaatgcgacacttagagttgtgggtcggttactatattagatggaatccgcgtatgaagcctcaggagccgatccacaacaggtacaaggaactcctggcaaaacgagcggaacttcaaaagaaggtagaggaactgcagagggagatcagcaacagaagtacaagctcaagtgagcgcgcatcaagcccagcccaatgtgtgactcctgtgcagacagtagtctag

SEQ ID NO: 196372 - DNA, 1716 bp, Artificial Sequence
  Description of Artificial Sequence: Synthetic coding sequence
atggaggagccccccctgctgcccggcgagaacatcaaggacatggctaaggatgtcacatacatatgccccttcacaggggctgtgaggggcactcttactgtcaccaattatcggctctactttaaatcaatggagagagacccgccttttgtactggatgctagcctgggagtaatcaaccgagttgaaaaaatcggaggcgcgagctcccgcggggaaaacagctatggcctggagaccgtgtgtaaggatatccggaatctccgctttgcgcacaagcctgagggacggacccggcggtcaattttcgagaacctgatgaaatacgcatttccggtctccaataacttgcctctctttgccttcgagtataaagaggtttttcccgagaacggatggaaattatatgatcctctgctggagtaccgccgtcaggggatacccaacgagagctggaggataacgaagatcaatgaacggtacgagttatgtgatacctatcccgcactgctggtggtaccagctaacatcccagatgaagagctgaaacgagttgcgagcttccgcagccgcggcagaatccctgtactctcctggatccatcctgaatcccaggctacgatcacccgctgctcccagccaatggtgggtgttagcggaaagcgcagcaaagaggacgaaaaatatttacaggctattatggattccaacgcccagtcccacaagatttttatctttgatgccaggccaagcgttaatgctgtggccaataaagcaaaaggaggtgggtatgagtccgaggacgcctaccagaatgcagagttggtgttcctggatatacacaatatccatgtgatgagagaaagtcttcggaagctcaaggagatcgtctaccccaacatagaagagacccattggttatccaacctggaatccactcactggctcgagcacattaaacttattcttgctggagcactgcgcatcgctgacaaggttgaatcagggaagacctccgttgtcgtgcactgtagcgatggctgggacaggacagctcagctcacttcactcgcaatgctgatgctggacggctactataggaccatcaggggattcgaagtgctggttgagaaagaatggctctcttttggacacaggttccagctccgagtgggacacggagataagaaccatgccgacgctgaccgctcccctgttttcttgcagtttatcgattgcgtgtggcagatgactcgacaattccctacagcctttgagtttaacgaatattttcttattacgatcctggatcatctgtacagttgcctgttcggcactttcttatgtaactctgagcagcagcgcggcaaagagaatcttcccaaacgcacagtgtccctttggagttacatcaactcccagctggaggattttacaaaccccctatatggttcttactctaaccatgttctctacccagtcgcttccatgcgtcatttagagctttgggttggctactatatccggtggaatcctagaatgaaaccccaggagccgatccataataggtataaagagctgctggcaaaaagggcggagctacagaagaaggtggaggaattgcagagagagatcagtaatcgctcgaccagctcttccgagagagcctcttcccctgcccaatgtgttaccccagtccagaccgtggtctag

SEQ ID NO: 196373 - DNA, 981 bp, Artificial Sequence
  Description of Artificial Sequence: Synthetic coding sequence
atgctggccgtggccctgaccatcctgagcgccagcaccagccacagcgaaaatagcgtgcacaccaagtctgctagtgttgtgtcatccgattcaatttcgacatctgctgataacttctccccagacttgagagtgctgagagaaagcaacaagctggctgagatggaggagcccccattgttaccaggtgagaacatcaaagatatggctaaggacgtcacatacatttgcccattcacaggagctgtcagaggaacactgacggtcactaactacaggctctactttaaaagcatggaaagggatccacctttcgttctggacgcaagtctgggcgtgattaatcgcgtggaaaaaatcggcggtgcttcgtccagaggtgaaaactcatacggtctggagaccgtctgtaaagacatacgaaatctgagattcgcccacaaacccgaggggcgtactcgaagaagtatctttgaaaacttgatgaagtacgcctttcctgtatctaataaccttccattgtttgcctttgagtacaaggaagtgttccctgaaaacggttggaaactgtatgaccccctgttggaataccgccgccagggcatcccaaacgagagctggcgaatcacaaaaatcaacgaacgctacgagctctgcgatacgtatccggcacttttggtcgtgcccgccaacattcccgacgaagagctcaaacgtgttgctagttttcgcagcaggggccgcatcccggtgttgtcttggatacacccagaatcacaggccaccattactcgatgctcacaacccatggttggtgtcagcggtaaaagaagcaaagaagatgaaaagtacctacaggccataatggattctaatgcacaatcccataagattttcatcttcgacgccaggccttcagtcaacgccgtcgccaataaggcgaagggcgggggatatgagtcagaggacgcttactag

SEQ ID NO: 196374 - DNA, 3513 bp, Artificial Sequence
  Description of Artificial Sequence: Synthetic coding sequence
atggacgaggagacccggcacagcctggagtgcatccaggccaaccaaatcttcccgaggaagcaactgatccgggaggatgagaacttacaagtgcctttcctggaacttcatggggaatctactgagtttgtgggacgcgcagaagacgcaattattgctctcagtaactaccgcttacacataaaatttaaagagtcacttgtgaatgtcccactccagctgatcgaaagcgtcgaatgcagggatattttccagcttcatctgacatgtaaggattgtaaggtgatccgttgtcaatttagtacctttgagcagtgtcaggaatggctcaaacgactgaataacgccatcaggcctccagcaaagatagaggatctcttctctttcgcttaccacgcctggtgtatggaagtctatgcgtctgagaaagaacagcatggcgatttatgtcgacctggagagcatgtcacttcgagattcaaaaatgaagttgaaaggatgggattcgacatgaataacgcctggcggatttccaacatcaacgaaaagtataagctgtgcggctcctatccacaagaattaatcgttccagcttggatcactgacaaggaactggagtcagtttccagctttcggtcttggaaacgaatcccagccgtaatttataggcatcaatccaatggggctgtaattgcgaggtgtggtcagccagaagtcagctggtgggggtggcggaacgcggacgacgagcatttggtccagagtgtcgctaaggcatgtgcctccgactctcgcagcagtggatctaaattaagtacaagaaatacctcgagggatttcccaaacggaggggacctgtcagacgtagagttcgactccagtctctccaatgcatcaggtgctgagtcactcgccattcaaccgcagaagcttttgatcttggatgcgaggtcatatgcagcggctgtggccaaccgcgccaaaggcgggggctgcgagtgtcctgaatattatccaaactgcgaggtagtgttcatgggtatggcaaatattcattccattaggcgcagctttcagagtctgcgcctgctgtgtacgcagatgcctgaccccggcaactggctgtccgccctggagagtaccaagtggctgcaccatctgagcgtcctgttgaagagcgccctgttggtggtccacgccgtggatcaagatcagcggccagttttggtgcactgcagtgacggctgggaccggactccccagattgttgccttggcaaagctgcttctcgacccctactaccgtaccattgagggatttcaggtcttggtggagatggaatggctcgatttcggacataaatttgccgaccggtgcggacatggcgagaattcagacgaccttaacgagcgctgccccgtttttctgcaatggttagactgtgtgcaccaactccagagacaatttccttgcagctttgagtttaacgaagcgtttctcgtaaaactcgttcagcacacttattcgtgtctattcggtacattcctgtgtaacaatgccaaagagagaggagagaaacacacacaagagaggacctgcagtgtgtggtctctgctacgggcggggaacaaggccttcaaaaacctgctgtactcaagccagagcgaagcggttctctacccagtgtgtcatgtgcgcaaccttatgctgtggagtgcggtgtacctgccatgcccaagcccaaccacaccagtggatgactcgtgtgcgccttatccagcacctggtacatctccggatgatcccccactgagccggctcccaaagacccgatcttacgacaacttgacaacggcctgcgacaacaccgtgcccttagcatctcgccgatgctcagacccatccctcaatgaaaagtggcaagaacatcggaggtctttggagctcagtagtttagccggccccggtgaggatccgctttcggccgacagccttggaaaaccgacgcgcgttcctgggggcgccgaactgagcgttgctgctggagtggctgaagggcaaatggagaacatactccaggaggcaaccaaggaggagtctggagtggaggagccggcccatagagctgggatcgagatacaggaagggaaggaggatcctcttctggaaaaggagtcgagacggaaaacccccgaagcgagcgcaatcgggttacatcaggaccccgaactcggagacgcagcgctgagaagtcacttggacatgtcctggccactgttctcccagggcatctccgaacagcagagcggcttatcggtgttactgagctcactgcaggtccccccccggggagaggattctctggaagtccccgttgagcagtttcgcattgaagagatcgcggagggcagagaggaggcggtgctcccaatccctgtggatgcaaaggtcgggtatggaacatctcaaagctgttccctgctcccctcacaggtacctttcgagactaggggacctaacgtcgatagcagcacggacatgctggtcgaggataaggtcaaatcggtgtctgggcctcagggccatcacagatcctgcctggtgaactccgggaaagatcgcctgccgcagaccatggaacccagcccttcagagactagtttagtggagcggccacaggtcggatcagttgttcatagaacttctttaggatcaacactaagtctgacaagatctccctgcgcgctgcctttagctgagtgcaaggagggactcgtctgcaatggggctcctgagaccgagaatcgggcctctgaacaacctcctggtctgagtaccctgcagatgtatccaactcccaacggacactgcgcgaacggcgaggcagggagatcgaaagatagtctatctcgtcagctttccgctatgagttgctcatcggcccacttgcatagccggaatctacaccataaatggttgcatagccactccggacgcccctctgccacatctagccctgaccagcctagcaggtcccacctggacgatgacggcatgtcggtatacactgacacaattcagcagcgcttgaggcagattgagtccggccatcaacaagaagtcgagaccctcaagaagcaagtgcaggaactgaagagcaggctagaaagccagtacctgacatcctccctgcattttaacggagattttggggacgaagttatgacacgatggctgcccgatcaccttgctgctcattgctatgcatgtgacagcgccttttggttagcatcgcgcaaacaccattgcagagataccgatagagtcgatcagacctggaattgtggaaatgtgttttgcagtagctgctgcaatcaaaaggttcctgtgccctcacagcagctgtttgaaccaagtcgggtgtgtaaaagctgttactcctccctgcatcccacgtcctcctctatcgacctcgaactggacaaacccattgccgcgacctctaactag

SEQ ID NO: 196375 - DNA, 3486 bp, Artificial Sequence
  Description of Artificial Sequence: Synthetic coding sequence
atggacgaggagacccggcacagcctggagtgcatccaggccaaccagatcttcccaaggaagcagttgattcgggaagacgagaatcttcaggttccttttctggagctccacggtgagagcaccgagttcgttggccgagctgaggacgctatcattgcgctgagtaactaccgtcttcacatcaagtttaaggagtccctggtcaatgtgcctcttcagctcatcgagtcggtggaatgcagagatatcttccagcttcatctcacgtgtaaagactgtaaggtaatacggtgccaattttcaacctttgagcagtgtcaggagtggttgaaacgcctcaacaatgctatccgacctcccgcgaagattgaggaccttttctcttttgcctatcatgcttggtgtatggaagtctatgccagcgaaaaggaacagcacggagacttatgtcggcccggagagcacgtcacttctcggttcaagaatgaagttgagcgcatgggcttcgatatgaataatgcatggcgcatctccaatattaacgagaaatataagctgtgtgggtcttatcctcaggagctgatcgttcccgcatggatcacagataaagaattggagagcgtcagttccttccgctcctggaaacgtattcccgccgtcatctacaggcatcagagcaacggcgctgtgatagccaggtgtgggcagcccgaagtatcatggtggggttggaggaacgcagatgatgagcacctggttcagtctgtcgccaaagcatgcgcaagcgactcccgcagttccgggagcaagctcagcacccgcaacacctccagggatttcccgaatggaggggatctaagtgatgtggaatttgatagctccttgagcaatgctagcggcgccgagagtctggcaattcagcctcagaagctgctcattctagacgcacggagttatgccgctgctgtggccaatcgggccaaaggcggaggttgtgaatgccctgagtactaccccaattgcgaggttgtatttatgggaatggccaacatccattcgatccgccggagcttccagtcattgcgactactttgtacgcagatgcctgaccctggcaattggttatctgctctggagtctactaagtggcttcatcatctgtccgtgttgctgaaatccgcactattggtggtgcatgcggtggaccaagatcagcggcccgtgctggttcactgtagcgacggatgggatcgaacccctcagatcgtcgcgctggcgaagctgctgttagatccgtattaccgtacaatcgaaggctttcaggtcttggtcgaaatggagtggttggatttcggtcataagtttgccgacagatgtggacacggtgaaaattctgacgacctaaacgagcgatgtcccgtgttcctgcaatggctggattgtgtacaccagctgcagagacagttcccttgctcgttcgaattcaacgaagcatttcttgtgaagctggtgcagcacacttactcctgcctttttggtacctttctgtgcaacaacgcaaaggagcgtggcgagaaacacacccaggaacggacgtgcagcgtctggagcctgcttagagcgggaaacaaggcctttaagaatctgctgtattcatctcagagtgaggctgttctctatcctgtttgccatgtaaggaacctgatgctttggagtgccgtatatctcccttgcccctctcccaccacgcccgtagacgacagctgtgccccgtatcccgctccaggaacctcccccgatgatccaccactgtcccggctccctaagactcgctcttatgacaacctgaccacggcttgcgataatacagttccccttgcgtcacgccgttgtagcgacccaagtctgaatgagaaatggcaggaacacaggagatcactagagttgtccagcttggcgggacctggcgaggatcctctgtcagctgacagcctcggcaagccaacccgggttccaggcggggccgagctaagcgttgccgctggagtagctgaaggtcagatggagaacatccttcaggaggccaccaaggaggagtccggcgtcgaagagcccgcccatagagcagggatcgagatccaggagggaaaagaggatcccctgctggaaaaggagtccaggaggaagacccccgaagcttctgcaattggcttgcatcaggacccagaactgggtgatgcagcgctccgtagccatttagatatgtcctggcctctgtttagccagggcatcagcgaacagcaatcagggctgtcggtgctgctgtcttctctgcaggtccctccacgcggcgaggattctctggaggtacccgtggaacaattccgcattgaagaaatcgcagaggggcgggaggaagccgttctccctataccagtagacgctaaagtgggatatggtacatcccagagctgttctcttcttccgtcacaggtgccgttcgagacccgcggtcccaacgtggactccagcacggatatgctagtcgaagacaaggttaagtccgtgtcgggccctcagggacatcaccgatcctgcttggtaaactctggaaaggaccggcttccacagactatggagccaagcccctcagagacatccttggtagaaaggcctcaggtcggatcagtggtgcataggaccagcctgggcagcactctgtcactcacgcgtagcccgtgtgcactcccactggctgagtgtaaagagggtctagtgtgcaacggcgcccctgagaccgagaaccgggcttccgaacaacctccaggacttagcactctgcagatgtatcccaccccaaacgggcattgtgctaatggcgaggccggcagatctaaggactcactgtctcggcagctctccgccatgtcttgtagctctgctcatttgcactcacgaaatctgcatcacaaatggcttcacagtcatagcggcaggcccagtgctacgagttccccagaccagcctagcaggtctcacttggacgacgatgggatgtccgtgtacaccgataccatccagcagcgactgcggcaaatagaaagtggccatcaacaagaggtggagactttgaagaaacaggtgcaggaactcaaatcccggctggagagccagtacctcacatcctcattgcacttcaatggagatttcggcgacgaagtgatgacaagatggcttcctgaccatttagctgcacactgctatgcgtgcgacagcgcattttggctagcctcacgaaagcatcactgtcgaaattgtggaaatgtcttttgcagttcatgttgtaatcagaaggtccccgtcccctctcagcagctcttcgaacccagtagggtgtgtaagagctgctattcttcactacacccgacttctagtagcattgatttggagctagataagcctatcgctgctacctccaattag

SEQ ID NO: 196376 - DNA, 3597 bp, Artificial Sequence
  Description of Artificial Sequence: Synthetic coding sequence
atggacgaggagacccggcacagcctggagtgcatccaggccaaccagatcttcccgcggaagcagctgatcagggaagatgagaacctgcaggtcccttttctggagctgcacggtgaatctacagagttcgtgggtagggccgaggacgcaattattgctttgagcaactacagactgcatattaagttcaaagagtcactggtcaatgtgccactacagctgatcgaaagcgttgagtgccgggacatctttcagctgcacctgacttgcaaggattgcaaggtgattagatgtcagttcagcactttcgagcagtgccaggaatggctgaagcggttaaataatgccatacgaccacctgcaaaaatcgaagacttgttttcttttgcctatcacgcttggtgcatggaggtctacgctagtgaaaaagaacagcacggggatctgtgtcgccccggcgaacacgtgactagccgcttcaaaaatgaggtagaacgaatgggctttgatatgaacaatgcctggcggatatccaacattaatgaaaagtacaagttgtgcggctcctatccacaggaactcatcgtgcctgcctggatcacggacaaagagcttgaaagtgtgtcttctttccgcagctggaaacggattccggccgttatttataggcaccaaagcaatggagccgttattgcacgctgtggccagccggaggtatcctggtggggatggcgcaatgctgacgacgagcaccttgttcaatccgtggccaaggcgtgtgcatccgactctcgatcctctgggagtaaactatctacaaggaacacaagtagagatttccctaacggaggggacttgtccgatgtcgaatttgactcaagcctatccaacgcaagtggtgctgagtcgttggccatacagcctcagaaattgctcattcttgatgcccgatcctacgctgcagcagtggcaaatagagccaaaggtggagggtgtgagtgtccggaatactaccccaattgtgaggtagtgttcatgggtatggctaatattcatagcattagacggagcttccaatctctgaggctgttatgcacacagatgccagatcctggcaattggttgagcgccctggaatccacaaaatggctgcatcatttgagtgtgcttctgaaaagtgctctgttggtggtacatgccgtcgaccaggaccaaagaccagtcttggtgcattgctccgatggatgggatcggacaccacagattgttgctctggccaagttgctccttgatccctattataggaccattgagggctttcaggtgctcgtcgagatggagtggctggattttgggcataaattcgctgaccgatgcggtcatggggagaactcagatgacctcaacgaacggtgccctgtgtttcttcaatggctagactgtgtccaccagctccaacgccagttcccctgcagttttgagttcaacgaagcttttctggtcaaactcgtacagcatacgtatagttgcctgttcggcaccttcctgtgcaataacgccaaggaaaggggtgaaaagcacacccaagagcggacgtgcagcgtgtggtctctgctccgagcaggtaataaggctttcaaaaacctgctgtactctagccagagtgaggccgtcctctacccagtgtgtcacgtgcgaaacctcatgctctggtcagccgtgtacctgccatgcccgtctccaacaacaccggtagatgactcttgtgcaccgtatcctgctcccggtacgtctcccgacgacccacctttgagccgtctgcctaagacacgttcctacgataatctgacaacagcgtgcgataatactgtgccactggcttccaggagatgcagcgaccctagcctcaatgaaaagtggcaggaacaccggcgatcccttgagctgtctagcctcgcggggcccggtgaagaccctctgtccgcagatagcctggggaaaccgactagagtccccggcggcgccgagctttccgtagctgccggcgtggccgaaggccagatggagaacatactacaggaagcgaccaaagaggagtccggtgtcgaggagcctgctcatcgtgccggcattgagattcaggagggaaaggaggatcccctcctcgagaaagagagtagaagaaaaacccctgaagcttcagctatcggactgcaccaggatcccgaactgggtgatgctgcgttaaggagtcatcttgatatgtcctggccgcttttttcacaaggcatttcagaacagcagtcaggcctgagcgttttgcttagctctctgcaggttccaccaagaggagaagattcactggaggtgccagtagagcagtttcgaatcgaagagattgcagaggggcgagaagaagccgtactgccaatacccgtcgatgcgaaagtcgggtatggtacatcccaaagttgctcactccttccatcacaggtgccgttcgagacacgcggacctaacgttgactcgtctaccgacatgctggtggaagacaaggtgaagagcgtgtcaggtccgcaaggacaccaccggtcctgcctcgtcaactctggtaaagacaggctcccccaaacaatggagcctagcccaagtgagactagtctggtggagagaccccaggtggggagtgtggtccacaggacctcgctcggaagcaccctcagtctgacccggtccccatgtgcgctgcccctcgcagagtgtaaagagggcctggtctgtaatggggcccccgagactgaaaatcgcgcttccgagcagccccctggactgtccacattgcagatgtacccaaccccaaacggtcactgtgcaaacggagaggccggaagatcaaaggactccctgagccggcagctcagtgccatgtcctgctcatccgcccacctacactcccgcaacctccatcataaatggctacactcgcatagtggtagacccagcgccacaagctcacctgatcagccaagtcgcagccacttagatgacgacgggatgtcagtttatactgacaccatccaacagcggctgcgacagatcgaaagcggacaccagcaagaagtcgagactttgaaaaaacaggtgcaagagctaaaatctcggctggagtcccaatacttgacaagtagtctgcatttcaatggcgactttggcgacgaggtaacaagtattcccgattccgaatcaaatctggaccaaaactgcctgtctagatgcagtaccgaaattttcagtgaggcatcctgggagcaagtggataagcaggacacggagatgacccgctggctgccagaccatctggcagctcattgttacgcctgtgacagcgccttttggctggctagtagaaagcaccactgtaggaactgtggcaatgtgttttgcagttcctgttgcaatcagaaggttccagtaccaagccagcagttattcgagccaagccgcgtttgtaaatcttgttactccagtctgcatcctacgtcctcttcaattgacttggaactagacaaaccgattgctgctacgtcgaattag

SEQ ID NO: 196377 - DNA, 3513 bp, Artificial Sequence
  Description of Artificial Sequence: Synthetic coding sequence
atggacgaggagacccggcacagcctggagtgcatccaggccaaccaaatcttccctaggaagcaattaattcgagaagatgagaacctgcaagtgccctttctcgagctccatggggaatctacagaatttgtcggccgcgccgaggatgctatcatcgctttgtcaaactaccgcctgcacataaaattcaaggagtccctcgtgaacgtgcccctgcagcttatcgaaagtgtggagtgccgagatatctttcaactgcaccttacatgcaaggattgtaaggtgatacggtgccaattctctacatttgagcaatgccaggagtggctcaagaggctcaataatgcgatccggcctcccgcaaagatcgaagacctcttcagctttgcctatcatgcgtggtgcatggaggtgtacgcatcagaaaaggaacagcatggtgacctgtgtcggccgggcgaacacgtgaccagtagatttaaaaatgaagtcgaacggatgggtttcgacatgaataatgcttggagaatttcaaacatcaatgaaaagtataagctgtgtggatcttaccctcaggagttaattgttcctgcctggattacggataaagaactggagtccgttagcagcttcagatcttggaaacgcatccccgccgtgatttatagacaccagagcaatggcgccgtcatcgctagatgtggccagcctgaggtgtcatggtggggctggagaaatgccgacgatgaacacctggtccagtctgttgccaaggcctgcgcctcggacagcagatccagcggaagcaagttgtctacccggaatacctcgagggacttcccgaacgggggggatctttcggatgtggagtttgattcttcactgtctaacgcaagcggagctgagtccctggccattcagccacagaagcttctgattctggacgccagatcttacgctgccgcagtggcaaaccgcgcgaaaggagggggatgcgagtgtcccgaatattatccgaattgcgaagtggtatttatgggaatggcaaacatccactctattcggcgctctttccaaagtctccgcttgctgtgtacccaaatgccagatccaggcaattggctgtccgcactggaaagcacaaaatggctgcaccacttaagcgtgcttctgaaatcagccctcctagttgtgcatgccgtggaccaggaccagcgccctgtgctggtgcattgttcagatggctgggatcgaaccccccaaattgtcgccctagctaaactgcttctagacccctactataggacgattgagggcttccaggtccttgtggagatggaatggctcgactttggacacaaattcgccgataggtgcggacacggggaaaattccgatgacctgaacgaacggtgcccagtgttcctccaatggctcgattgtgttcaccaactgcagcgccagtttccttgctcctttgagttcaatgaggcctttttggttaagctcgtgcagcatacgtacagttgcttgttcggaacattcctgtgcaataatgccaaggagcgcggagaaaagcacacacaagagcgcacctgtagcgtctggagtctgctgagagccggtaacaaagcctttaagaacctgttatactctagccagtcggaagcagtactgtatccagtgtgtcacgtgaggaaccttatgctgtggagcgccgtatacctgccctgtccatcacccacaactccggttgatgattcatgcgcaccctatcccgctccagggacaagtcccgacgaccctcctctctctcggctaccaaaaactcgctcatatgataacctcacaaccgcttgcgacaatacagtacctctggcctctcgaaggtgcagcgacccaagtctgaatgagaaatggcaagaacacaggcgctctctcgaactcagttccctggccggaccaggtgaagatccacttagcgctgactcgctgggcaagccgactcgggtccctggcggcgcggagctgtctgtcgccgccggagttgctgaagggcaaatggaaaacattttgcaagaggccacaaaagaggagtccggcgtggaggaaccagcccatcgcgccgggatcgaaatacaggaggggaaggaggatccactcctggagaaggaatcccgtcgaaagactcccgaagcctctgccatcggcttacaccaagatcctgagctgggcgacgcagctctgaggtctcatttagacatgagttggccactcttctctcagggaatatcggagcagcagagcggactcagcgtgctgctctctagccttcaggtgcctccaaggggagaggattctctggaagtccccgtagaacagttccgcattgaagagatcgctgagggccgcgaggaggctgtattacccattccagtcgacgcaaaggtcggctacggaacttcccaatcctgctccctgttgccttcacaggtaccattcgagacacgcggaccaaatgtggactcaagcaccgatatgctcgtcgaagataaagttaagagcgtatctggcccacaagggcaccatcgctcttgtctggtcaatagtggcaaggaccgcttgcctcaaactatggagccatcaccgtccgagacgtccctcgtggagcgccctcaggtcggaagcgttgtccaccggacaagcctcggctccaccctaagcttgacgcgaagcccttgcgctctgcctctggccgagtgcaaggaaggcctcgtgtgcaacggagcgcctgagacagagaacagggcttccgaacaaccacccggcctgtctacgctgcaaatgtatcctactcccaatggacactgcgccaatggagaagccggcaggagcaaagattccctatccaggcagttaagcgctatgagctgtagcagtgcacatctgcactccaggaacctacaccataagtggctgcattcccacagcggcaggccctcagcaacatctagcccagatcagccatcccgaagccacctggatgatgacgggatgtccgtttatactgatacgatccagcagcgattaaggcagattgagtctggacaccagcaggaagtggagactctgaaaaagcaggtgcaggaacttaagtcgaggctggagtctcagtacctgacttcctcgctgcacttcaatggcgattttggagacgaagtgatgacccgctggttgccggatcacctcgcggcccactgttacgcctgcgacagcgccttctggctcgcctctagaaaacatcactgtcgcgacactgaccgtgtggaccagacttggaactgcggcaatgtattttgtagctcttgctgtaaccaaaaagttccagtgccatctcagcagctctttgaaccctcccgcgtatgtaagtcatgctactcatctttgcacccaacctcatcgtccatcgaccttgagctcgacaagcctatagctgccactagcaattag

SEQ ID NO: 196378 - DNA, 420 bp, Artificial Sequence
  Description of Artificial Sequence: Synthetic coding sequence
atggacgaggagacccggcacagcctggagtgcatccaggccaaccagatttttccacgcaagcagctgatccgggaggatgagaacctgcaggtcccctttttagaattgcatggcgagtctactgagttcgtcggacgagccgaagatgccattatagcactgagcaactacagattgcatatcaaatttaaggaatctctcgtgaacgttcccctccaactgattgagtccgtggagtgccgagacatctttcaactgcacctcacctgcaaggattgtaaggtgattagatgccagttctcaacattcgagcagtgccaggagtggctgaaaagactgaataacgccatacgccctccggctaaaattgaagacttgttcagctttgcttaccacgcttggtgcatggaggtttag

SEQ ID NO: 196379 - DNA, 3588 bp, Artificial Sequence
  Description of Artificial Sequence: Synthetic coding sequence
atgggcgaggagggcccccccagcctggagtacatccaggccaaggaccttttcccacctaaagagctggtcaaggaggaggagaacctgcaggttcccttcactgtccttcagggggaaggggttgagttcctcgggcgtgccgctgacgcactgattgccatcagcaattatagattgcatatcaaattcaaggattcggttataaacgtcccgttgaggatgatcgattccgtggagtcgcgggatatgtttcagctgcatatctcttgcaaagacagcaaggtggtccggtgtcatttcagtacctttaaacagtgccaagaatggttgagtcgtcttagtcgagcgacagccagacccgcaaagcctgaggacctgtttgcttttgcctaccatgcatggtgtcttggccttacagaggaggaccaacacactcacctgtgccagccaggtgagcacatccggtgccggcaagaggccgaactggcgcgcatgggatttgatctccagaatgtgtggcgagtctcccacattaacagcaactacaaactgtgcccgtcttatccacagaaattactggtcccagtctggattactgataaggaactggaaaatgtggcaagctttaggagttggaagcgtatcccggttgtggtgtacagacacctacgtaatggcgctgccattgcacgatgttcccaaccagagatcagctggtggggctggaggaatgccgatgatgagtatctggtgacctctatcgccaaagcctgcgctctggaccccggcacccgtgcaaccggcggttccctctccaccggcaataatgatacctccgaggcctgcgatgcggattttgatagctcactgaccgcctgctccggtgtggaaagcactgctgcaccccagaagcttctgatcctggatgcaaggagttacaccgcggctgtcgctaaccgagctaaagggggagggtgcgagtgcgaggaatattatcctaattgtgaagtcgtttttatgggaatggctaacatccacgcgattcgcaatagctttcagtacttacgggccgtgtgctcgcagatgcctgacccatcaaactggcttagtgccctagaatccaccaaatggctgcagcacttatcagtaatgctgaaagctgccgttcttgtcgcaaacacagtggatagggaagggaggcccgtgctggtgcattgtagcgacggctgggacagaaccccccagattgtggctttggccaagatcctgctggacccttattatagaactctggaaggctttcaggtgttggtagagtccgactggctggatttcggccataagtttggagacagatgcggtcaccaggaaaatgttgaggatcagaatgagcagtgtcccgtatttctgcagtggctggattccgtccaccagctactaaaacaattcccatgcctattcgagtttaatgaagcttttctggtaaagctcgtgcagcatacttatagctgtctctacggcacctttctggctaataacccatgcgagcgcgagaaaagaaacatttataagcgcacctgttctgtgtgggccctgctccgagccggaaataagaattttcataatttcctatatacaccttcatctgacatggttctgcatcctgtttgtcatgttcgggccttacacctgtggactgcagtgtacctgcccgcttctagtccctgcacacttggggaagagaatatggatctgtacctttcacctgtcgctcaaagtcaggagttcagcggtcgcagtctggacaggctacctaagacccgctccatggacgacctgctgtctgcctgcgatacatccagcccattgacaaggacatcatcagaccccaatcttaacaaccactgccaggaggttagggtgggccttgaaccatggcattctaaccccgagggaagcgagacctcgttcgtggactctggcgttggcgggccccaacagacggtgggagaagttggtctcccacctcccctcccatcatcacaaaaggactacctgtcgaacaaacccttcaagagccacaaaagttgtagcccaagctataaactgctgaatacggccgtccctcgggagatgaaatcgaatactagcgacccggaaatcaaagtgcttgaggagactaaggggcctgccccagacccaagtgcacaagacgagttgggacggactcttgacggtatcggcgagcctcctgaacactgtccagagacggaagccgtgagtgccctgtcgaaagtcatcagcaacaaatgcgatggtgtttgtaactttccagaaagctcccagaattctccaacaggaacacctcagcaggcccaaccggacagtatgctgggagtgcctagcaaatgtgtcttagaccactcattgtcaaccgtgtgcaacccgccaagcgcagcctgccagacgccgctggatcccagtaccgactttctcaatcaggacccctccggtagtgtggcaagtatctcacaccaagagcagctgagctccgttccagaccttacacacggagaagaagacataggaaagcgcggcaataatcgaaatggccagctcctggaaaatccgaggtttggcaagatgcccttggagctcgtaaggaagcctatctctcagtcacagatcagtgagttttcctttctcggcagcaattgggacagcttccaggggatggtcacatctttccctagtggtgaggccaccccaaggagactcctgtcgtacggatgttgcagtaagcgacctaatagtaaacagatgagggccactggaccatgctttggggggcagtgggcccaacgggaaggcgtcaagtccccagtgtgctcttctcattccaatgggcactgcaccggtccaggcggcaagaatcagatgtggctgagctctcaccctaagcaggtatcttctaccaagccggtccctctgaactgtccctctcccgttcctcctctttatctggatgacgacgggcttcccttcccaacagatgtgatccagcacagactcagacagattgaggccggctacaaacaggaggtggaacagctgcgtagacaggtccgcgagctccaaatgaggcttgacataaggcattgttgtgctccaccagctgagccacccatggactacgaggacgactttacatgtctgaaagagtctgacggatcagacaccgaggattttggctctgatcactccgaagattgtctctccgaggcatcatgggagcccgtagataagaaggaaactgaagtcacccgctgggttcctgaccacatggcctcccactgttataactgtgattgcgaattttggctggctaaaagacggcaccattgcagaaattgcggcaacgtgttttgcgctggttgctgtcatctgaaactgcctataccggatcagcagctctacgaccccgtgctcgtctgtaactcttgctacgagcatatccaggtaagccgagccagagagctgatgtcccaacagctgaagaaacctatcgcaactgccagctcctag

SEQ ID NO: 196380 - DNA, 570 bp, Artificial Sequence
  Description of Artificial Sequence: Synthetic coding sequence
atgcccgtgtggaagctgccctggaagctgagcgagggcaagcggagggcacaggtggagggggaggatctttttccggtagcgatctctttcggccggcccaaggaggtcctgccactttacagtagtgaatcccacaggttcacagttcttgaaccaaataccgtcagtttcaacttcaaattctggcgcaatatgtatcaccagtttgacagaaccctccatccgcggcagtctgtgttcaatatcattatgaatatgaacgaacagaacaaacaactggagaaggatatcaaggacctggagagtaaaataaagcagcggaaaaacaaacagaccgacggcatcctcactaaggaacttctgcacagcgtgcatccagagagcccaaatctgaaaacctctttatgcttcaaagagcagacactgttaccagtgaatgacgcccttaggactattgaagggtcttctcccgccgataacaggtactccgaatatgcagaggaattctcgaagtcagaacctgccgtagtctctttggagtacggcgtggcaagaatgacctgttag

SEQ ID NO: 196381 - DNA, 1866 bp, Artificial Sequence
  Description of Artificial Sequence: Synthetic coding sequence
atggagcacatccggaccaccaaggtggagcaggtgaagctgctggatcgttttagtaccagtaataagtcacttaccggaacgctgtatctgactgccacccatctactctttatagacagtcaccagaaggaaacctggatcctccatcaccacatcgcctctgttgaaaaactcgcactcaccacctccggatgtcccctcgtgatccagtgtaagaatttcaggaccgtccatttcatcgttccgcgggagagggattgtcatgatatctacaacagcttgctccagctgtcaaaacaggccaagtacgaagacttatacgctttcagttataatcccaagcagaatgacagtgaacggctgcaaggatggcagctcatcgacctcgcggaggagtacaaaaggatgggcgtccccaattcgcattggcagttgagtgatgctaaccgcgactacaaaatatgtgaaacgtacccccgtgagctatacgtgccccggattgcgagcaaacccatcatcgttggcagttccaagttcagaagcaaaggaagatttccagtcctgtcctattaccatcaggataaggaggcagccatctgtaggtgtagccagccactgtctggctttagtgctcgctgcctcgaggacgaacatctgctgcaggcaatcagtaaagcgaatccggtgaatcgctatatgtatgtcatggacacaagaccgaagctaaacgccatggccaaccgggctgcaggcaaggggtacgagaacgaagacaactactctaacatccgcttccagtttgtagggattgagaatatacacgtcatgcgcagctcactgcagaagttgctcgaagttaacggtacaaagggcctaagtgtgaatgacttttatagtggattggaatcctccggttggttacgccatattaaggctgtgatggacgcagccatctttttggctaaagcgatcaccgtggaaaatgcgtctgtgttggtgcactgttccgacgggtgggatcggacttcccaggtgtgttcactcggcagtctactattagacagctactaccgtactattaagggattcatggtcttaattgaaaaagactggatctcttttgggcataagttctccgagaggtgcggacagctggacggagaccctaaggaagtatctccagtattcacccagtttctcgagtgtgtttggcacctcactgagcagttcccgcaggcatttgagttctcagaggccttcttgcttcagatccatgagcatatacatagctgccagtttggcaacttcctgggaaactgtcagaaggaaagagaggagctgaaactgaaagagaaaacctattccctctggcccttcttgctggaagaccagaagaaatacctgaatcccctgtactcaagcgagtcacaccgctttacagtgctggaacctaacactgttagcttcaatttcaagttttggagaaacatgtatcatcaatttgatcgaacattgcacccacggcaaagtgtcttcaatattattatgaacatgaatgaacagaataagcagctagagaaagatatcaaagacctggagtccaagattaagcaaagaaagaataagcagacagatgggatcctgacgaaggagttgcttcatagtgttcacccagagtctccgaatctaaagacttctctctgctttaaggaacagacactgttacctgtgaacgacgctctcaggactatcgaaggctccagtcctgccgacaatagatattcggagtacgctgaggaattctcgaaaagcgagccagctgttgtcagtttagaatatggcgtggcgcggatgacctgttag

SEQ ID NO: 196382 - DNA, 1647 bp, Artificial Sequence
  Description of Artificial Sequence: Synthetic coding sequence
atggagcacatccggaccaccaaggtggagcaggtgaagctgctggaccgcttttccacttccaataaatccctcacaggcacactttatctgactgccacccatctgctctttatcgattcccatcaaaaggagacgtggatcctgcaccatcacatcgcctcagtggagaagctggcgcttactacgagcggatgtcctttggtgatacagtgcaagaacttcaggacagtgcacttcatcgtccctcgagaacgggattgtcacgacatttataactctctgctccagctctcgaaacaggccaaatatgaggatctgtatgccttttcatacaatcctaagcagaatgattcagagaggctccaagggtggcagctcatcgacctcgcagaggaatacaaacgtatgggagtcccaaactctcactggcaactgagcgatgcaaatagggattacaaaatatgcgagacataccctcgggaactttacgtcccaagaatcgcatctaagccaattattgttggatcaagcaagttccgctcaaagggtagattcccggtcttatcttactaccaccaggacaaagaggccgccatctgccggtgcagccagcctctgtctgggttcagcgcccgctgtctagaggacgagcatctcttgcaggccatctcaaaagccaatcccgtgaatcggtatatgtatgtcatggataccagacccaaactgaatgcaatggctaacagggccgccggcaaggggtatgagaatgaggataactatagcaacatcaggttccagttcgtaggcatcgaaaacattcatgtgatgcgtagttcattgcaaaagctcctggaagtgaatgggaccaaggggctcagtgtgaatgatttctactctggactggagtcttctggctggctgcggcatattaaggccgtcatggatgccgcaatatttttggctaaagccatcactgtcgagaacgccagcgttcttgtgcattgttcagacggttgggacagaacctcgcaggtgtgctctttggggagtctcctgctggattcctactaccgaactatcaaagggtttatggtacttatcgaaaaagattggatcagtttcggacacaaattttccgagcgctgcggccaactcgatggcgacccaaaggaggtgtctccagttttcacccaattcctggagtgcgtatggcacctcaccgaacagtttccacaggcatttgaattctctgaggccttcctcttgcaaatacacgagcatatccactcctgccagttcggaaattttttaggcaactgtcaaaaggagagggaagaattgaaattaaaggagaaaacttacagcctctggcctttcctgctcgaagatcagaaaaaatacctgaatcctctttatagcagtgagagccataggtttaccgtactggaacccaacaccgtcagcttcaacttcaagttctggagaaatatgtatcatcaattcgaccgaaccctgcatccccggcaaagcgttttcaacatcattatgaacatgaatgagcagaataaacagctggaaaaagatatcaaagaccttgaatcattaacatcttatagctctttcaagatcatcgtcgggcagtag

SEQ ID NO: 196383 - DNA, 1647 bp, Artificial Sequence
  Description of Artificial Sequence: Synthetic coding sequence
atggagcacatccggaccaccaaggtggagcaggtgaagctgctggacagattcagcacgagcaacaagtccctcacggggacactgtacctgaccgccacccacttactctttatcgattctcaccagaaagagacctggatcctgcatcaccacatagcctccgttgagaaactcgccctcactacgtcagggtgccctctcgtgatccagtgcaaaaactttaggaccgtacactttattgtgccccgcgagagggattgccacgacatatacaattctttgctccagctcagtaagcaggcaaagtacgaagacctgtatgccttttcctataatcctaagcagaacgatagcgagaggctgcagggatggcagctgattgatcttgcggaagaatataagagaatgggcgttcccaacagccactggcaattgtctgacgccaacagagactacaaaatttgtgaaacctatccccgtgagctttatgtaccacggatcgcgtcaaagccaataattgtgggctcttccaagtttaggagtaagggccggttcccagttctgtcatattaccatcaagacaaagaggcggcaatctgtaggtgcagccaaccactgtctgggttcagtgccaggtgtctggaagatgaacacttactgcaggcaatctcaaaagcgaatccagtgaacaggtatatgtatgtgatggacactcgccctaaactgaatgccatggctaaccgcgctgccggcaaagggtatgaaaatgaggataactactctaatattcgctttcagttcgtcggaatcgagaacatccacgttatgcggtctagcttgcagaaactgttggaggtgaacggtaccaaaggcctgtcagtcaacgacttttatagcggtctcgagtctagcggttggctcaggcacatcaaagccgtcatggatgcggctatttttctagcaaaggccataactgtcgagaatgccagtgtgctcgtgcactgcagtgacggatgggacagaactagccaagtgtgctctctggggagcctgctcttagacagctattaccgcacaatcaagggcttcatggtgctgatcgagaaggactggatctcctttggccataagtttagtgagcgctgtggccagttggacggcgacccaaaggaagtgtctcccgtgttcactcagtttctggaatgtgtttggcatttgaccgagcagttccctcaagcctttgaattcagcgaagcgttcctcctgcaaattcacgaacacatacacagttgccagttcggcaacttcttaggcaactgtcagaaggaaagagaagaactaaagctgaaagagaaaacttatagtctctggcctttcctcctggaggatcagaaaaaatacctgaaccccctgtattcctcagaatctcaccggtttactgtccttgagcctaacaccgtttcattcaatttcaaattctggcgaaacatgtaccatcagtttgaccgaacactccacccccgccagagtgtgtttaacattattatgaacatgaacgaacagaataaacagctagaaaaggacattaaggacctcgaatcgtttacctccttcgccgcagccagagtgatacagggacagtag

SEQ ID NO: 196384 - DNA, 1983 bp, Artificial Sequence
  Description of Artificial Sequence: Synthetic coding sequence
atggagcacatccggacccccaaggtggagaacgtgcggctggtggaccgcgtgagcccaaaaaaagctgctctgggtacactgtatttaaccgccactcacgtcatctttgtcgaaaattcccctgacccgagaaaggaaacgtggattttgcatagtcagatctccactattgagaaacaagccactacagcgaccgggtgcccccttctgatacggtgcaagaacttccaaattattcaactgatcatcccacaggaaagggactgccacgatgtttatatctccctcattcgactcgctagacccgttaaatatgaggagctgtactgcttttcgttcaacccaatgctggacaaggaagagcgagaacaaggctgggtactcattgacctgtcagaagaatatacacggatgggtctccctaatcattactggcagttatctgatgtgaaccgagactatagggtgtgtgactcctacccaaccgagctgtatgtccctaagagcgccacagctcacattattgtcgggagcagcaaattcaggtcacgcagacgattccctgtgttatcatactactacaaggataaccatgccagcatctgcagaagttcacagcccctttcagggttcagcgctaggtgcctggaggacgaacaaatgcttcaggctatacgcaaagcaaatccaggcagtgacttcgtgtatgtggtagatacacggccaaagcttaacgcaatggccaatagagccgccggtaaaggctacgaaaatgaggacaattactccaacataaaatttcaattcatcgggatcgaaaacattcacgttatgagaaattctctgcaaaagatgttggaggtgtgtgagctaaagagccccagcatgtcagatttcctatggggcctcgaaaactcaggctggctccgccacattaaagctatcatggatgccggcatcttcatcgccaaagcagtgtcagaggaaggggcttctgtcctggtgcattgtagtgacggttgggaccggacggctcaggtttgctcagtcgcatctttgctattggacccccactaccgcaccctaaaggggtttatggttctgattgagaaggactggatatccttcggtcacaagtttaaccatagatacgggaacctcgacggagaccccaaggagatttctccagttattgaccagtttattgagtgtgtttggcaactcatggagcagtttccctgcgccttcgaattcaatgagagatttctcattcatatccagcaccatatctactcttgtcagttcggaaacttcttatgcaactcccaaaaggaaagaagagagctgaagattcaggaaagaacgtatagcctgtgggctcatttatggaaaaacagggccgactatctgaatcctctttttcgagccgatcatagtcaaacccaaggtactctccatctgccgacaacaccttgcaatttcatgtacaagttctggagcggcatgtacaacaggtttgaaaaagggatgcagcccaggcagtctgtgaccgattacttgatggcagtcaaggaagagacgcagcaacttgaggaggaactcgaagctcttgaagagaggctggagaaaattcagaaggtccagctcaattgtaccaaggtcaagtctaagcagtctgagcccagcaagcactctggattttctacaagtgacaatagtatcgccaatacaccccaggattattctggcaatatgaagagttttccttctagatctccttcccagggcgatgaagatagtgccctgattttgactcaggataacctgaagtccagcgaccccgatctcagcgccaatagtgaccaggagagtggagtcgaagacctgtcatgcagatcacctagtggtggcgagcacgccccttccgaagatagcgggaaggaccgggactcagatgaagcggtgtttttgactgcctag

SEQ ID NO: 196385 - DNA, 756 bp, Artificial Sequence
  Description of Artificial Sequence: Synthetic coding sequence
atggagcagttcccctgcgccttcgagttcaacgagcggttcctgatccatatccaacatcatatatattcttgtcagttcgggaatttcctgtgcaactcacagaaggaacgaagagaactcaaaattcaggagcgcacctattcattgtgggcgcatttatggaagaatagggcagactacctgaacccactctttagagccgaccattctcagacccaaggtacgttacacctgccgacaacaccgtgtaatttcatgtataaattttggagcggaatgtataaccgattcgagaagggtatgcagccacgacagagcgtgacagattacttgatggctgtgaaggaagagacccagcagctagaggaggagctggaagctctggaagagaggctggagaagattcagaaagtgcaactgaattgcaccaaggtcaagtctaagcagtctgagcccagtaaacactccgggtttagtacatcagacaacagtattgctaatactccccaggattattctggcaacatgaagagttttccatcccgttctcccagtcagggtgacgaggactctgctctgattctgactcaggacaacctgaaatccagcgaccctgatcttagcgccaactccgatcaggagtccggggtggaggatctgagctgtagaagcccatcaggtggtgaacacgccccgagtgaggatagcgggaaggacagagacagcgacgaagccgtctttttgaccgcctag

SEQ ID NO: 196386 - DNA, 1668 bp, Artificial Sequence
  Description of Artificial Sequence: Synthetic coding sequence
atggagcacatccggacccccaaggtggagaacgtgcggctggtggacagagtgagtccgaaaaaagcagctctgggcaccctatatttaaccgccactcatgtcatattcgtggagaatagtcccgaccctcggaaagagacctggatcctgcactctcagattagcaccattgagaagcaagcaaccactgctactgggtgccccctccttatcagatgcaagaactttcaaatcattcagctgattatcccccaggagcgcgactgccatgacgtgtatatctccctgataaggctggctcgaccagtgaaatacgaagagctgtattgtttttcttttaatccaatgctggacaaggaggagcgcgagcagggatgggtattaatcgacttatctgaggagtacactagaatggggctcccgaaccactactggcaactgtctgatgtaaaccgggattatcgtgtttgcgattcctatcctaccgaactgtacgtcccgaaatccgccactgcccatataattgtggggtcttctaaattccgcagtagacgccgctttccagtcctaagctattattacaaagacaaccatgcatcaatatgtcgttcctctcagcctctgagcggcttcagtgcccggtgccttgaagatgaacagatgctgcaagctatccgcaaggccaatccaggatccgacttcgtgtacgtcgtcgacacccggccaaaactcaatgccatggccaacagggcagcaggaaaaggttatgaaaacgaggataactattccaatattaagttccagtttattggtattgaaaacattcacgtcatgaggaatagtcttcagaagatgctagaagtgtgtgaactgaagagtcctagcatgtcagatttcctttggggcctggaaaatagtggctggcttcgacatatcaaagccatcatggacgcggggattttcattgcaaaagcagtctcagaggaaggcgccagcgttctagtgcactgctcagacggctgggacagaaccgcccaggtctgttccgtggccagtctgctacttgatccacattacagaaccttaaaaggcttcatggtccttatcgagaaagactggatctcttttgggcacaaatttaaccataggtacggcaatctcgacggcgatcctaaggagatttcccctgtcattgatcaattcattgagtgcgtttggcagctgatggagcaatttccctgtgctttcgaattcaacgagagattcctcatacacatacaacatcatatatatagttgccagtttggcaacttcctgtgtaacagccagaaggaacggcgggaactgaagatccaggagagaacttactccctttgggctcacttgtggaaaaaccgggcagattatctgaaccctctctttagagcggatcattctcaaacgcagggcaccctgcaccttcccaccactccttgtaactttatgtacaagttctggtccggcatgtacaacaggtttgagaaaggaatgcagcctagacagtctgttactgattatcttatggccgttaaggaagaaacccagcaattggaagaagaactggaggctttggaagaggtccgacacacctgcttcgtgaacctcttctccgtgctcatctcgtag

SEQ ID NO: 196387 - DNA, 1773 bp, Artificial Sequence
  Description of Artificial Sequence: Synthetic coding sequence
ctggacctgctggtgcccaaggtggagaacgtgaagctggtggacagatacgtgagtaagaagccggccaacggaatcctatatttgaccgccacccaccttatatatgtggaagctagcggcgctgcccgcaaggagacttggattgccctgcatcacatagctactgtggagaagctgcccatcacttctctcggctgcccactaactcttagatgtaagaattttagggtggctcatttcgttctggactcggacttggtgtgtcatgaagtgtatatctccctcctcaagctgagccagcccgccctccccgaggatttgtatgccttttcttacaaccctaaatcttctaaggaaatgcgtgagtctggctggaaactgattgaccccatcagcgactttgggcgcatggggataccaaatagaaactggaccatcacagatgccaacattcggttccggttcatgggcattgaaaatattcatgttatgcgctcgagcctccaaaagctgctcgaagtttgtgaactgaaaactcctactatgagtgaatttctatctgggctggagtcatccggatggctgaggcacattaaggccataatggatgcaggaatctttatcacaaaggctgtgaaagtggagaaagcgtcagtattggtgcactgtagcgacggctgggacagaaccgcacaagtctgctccgtcgccagcatcctgctggatcctttttacaggaccttcaaggggctcatgatcctaattgagaaggaatggatctctatgggacataagtttagccagagatgcgggcacctggacggcgactccaaggaggtttcacccatttttacccaattccttgattgcatttggcaactgatggaacagttcccctgtgcattcgagttcaacgagaattttctactggagatccacgatcatgtcttctcctgtcagtttgggaacttcttggggaattgtcaaaaggacagggaggacttgcgcgtctatgaaaaaacccatagcgtgtggccgttccttgtacagcgcaaacccgatttcagaaaccctctctacaaggggtttactatgtatggcgtcctgaacccctcaactgtcccgtacaatattcagttttggtgtggaatgtacaaccgcttcgataaggggctccagccgaaacagagtatgttggagagcctgctcgagattaaaaagcaacgggccatgctggagacagacgtacacgaactcgaaaaaaaattgaaggttagagacgagcctcccgaggaaatatgtacctgttcacaactgggcaacatcctatcccaacatctcgggtcccctcttactaatccactgggttttatgggcatcaatggggacttgaacacacttatggagaacggcactctgagtcgtgaggggggactgagagcccagatggatcaagtgaaatcccagggagctgaccttcaccacaactgctgtgaaatcgtgggctccctgcgtgccattaacattagcggagatgtggggatttccgaggctatgggtattagcggagatatgtgcacattcgaagctactggtttcagtaaagacctgggcatctgtggtgccatggacataagcgaggctacagggatctctgggaatttgggcatctctgaagcacgaggcttttccggcgacatgggcattctgggagacaccggaattagtaaggcgagcactaaggaggctgattactcgaagcatcagtag

SEQ ID NO: 196388 - DNA, 2115 bp, Artificial Sequence
  Description of Artificial Sequence: Synthetic coding sequence
atggaccacatcaccgtgcccaaggtggagaacgtgaagctggtggatcgctacgttagcaagaaaccagctaacggcattctgtatttaacagccacccacttaatttatgtggaggcaagtggcgcggcgagaaaggaaacatggattgctctgcaccacatcgccactgtggaaaaactgcccatcaccagcctgggctgccctttaacactgcggtgtaagaacttccgggtggcccacttcgtcttagattcggacctcgtatgccacgaggtttatatctcactcttaaagttgtcacagcccgcactccccgaggacctgtacgccttcagctacaacccgaaatcgtcgaaggaaatgcgtgaatccggttggaagctgattgatcccatctctgactttggccgcatgggtattcctaacaggaattggaccataacggatgcgaaccggaactacgaaatctgcagtacataccctcccgaaatagtggttccaaagtctgtcactctgggcacagtggttggctccagcaaattcaggagtaaggagcgagtaccggtcctgtcctacctatataaagaaaataacgccgccatttgcaggtgcagtcaacctctgtctgggttctacacaaggtgcgtcgacgacgaacttctgttagaggccatttcccagactaaccccggctcccagttcatgtatgtcgtagacacaaggcccaaactaaatgctatggccaaccgagcagcaggtaaaggctacgaaaacgaggacaattatgcaaatataagattccggtttatgggcatagagaatatccacgtaatgcgctcttccttgcagaagctgttagaggtctgcgaactcaagaccccaaccatgtccgagttcctcagcggtcttgagagcagtggatggctccgtcatattaaggccataatggacgcaggcatctttataactaaggccgtgaaagtggaaaaggcttctgttttggtccattgtagcgatggatgggatcgcacggcacaggtctgcagcgttgccagcatcttgctcgatcccttctacagaacatttaagggtttaatgattctgattgaaaaggaatggatatccatgggccataaattctcgcagaggtgtggccacttagacggcgactccaaggaagtctcccctatctttacccaatttctggattgtatctggcagttgatggaacagtttccctgtgcattcgaattcaacgagaattttctgcttgaaattcacgaccacgttttcagctgccagttcgggaattttctgggcaactgccaaaaagatagggaagatttaagggtgtacgagaagacccactccgtgtggccctttctggttcagcgcaaaccggatttccgcaatcccttatacaaaggatttaccatgtacggtgtattaaacccttccaccgtcccatataatatccagttctggtgtggcatgtacaacagatttgataaaggcctgcagcctaagcaatccatgctggagtctctgctggaaatcaaaaagcagcgggcaatgctagagactgatgttcacgagctcgagaagaagttgaaggtacgggatgaaccgcccgaggaaatttgtacctgtagccagcttggcaacattctgtctcagcacctcgggagcccccttaccaatccactcggattcatgggcataaacggcgatctgaacaccttgatggagaatgggacgctctccagagaaggtggactgagggcacaaatggatcaagtgaagagtcagggggctgatctgcatcacaactgctgcgagatagtcggctccctccgggccattaatatttcaggtgatgtgggcatctccgaggccatgggcataagcggcgacatgtgtaccttcgaggccaccggctttagcaaggatttgggtatctgcggggccatggatattagcgaggctaccggaatttctggcaaccttggcatcagtgaggctcgaggattttctggcgatatgggcattctgggggatacaggcatctcaaaagcctctacaaaggaagcagactattcaaagcaccagtag

SEQ ID NO: 196389 - DNA, 1527 bp, Artificial Sequence
  Description of Artificial Sequence: Synthetic coding sequence
tgagacagcgacctggtgtgccacgaggtgtacatcagcctgctgaaactctcacagcccgctctaccagaagacctttacgccttttcttacaacccgaagtcttccaaagagatgcgcgaatctggttggaaactgatcgaccccatcagtgactttgggcgcatgggcatcccaaaccgcaactggacaattactgacgctaatattagattcaggtttatggggatcgaaaacatccacgtaatgagatcctcgctgcaaaagctgctcgaagtctgtgaactgaagacaccaacgatgtcagaatttctcagcgggttggaatcgtccggctggctgagacatataaaagctatcatggacgccggaatttttattacaaaggccgtgaaagtggaaaaggccagcgttcttgtgcattgcagcgatggctgggatagaacagcccaggtatgctccgttgccagtatactactcgaccccttttaccggacctttaagggactgatgatactcatcgagaaggaatggattagcatggggcacaagttctcacagagatgtggacatctggatggcgacagcaaagaggtgtctccaatcttcacccagtttctggattgtatctggcagcttatggaacagttcccatgcgccttcgaattcaacgagaacttcctgctggagatacatgatcacgtatttagttgtcagtttggcaatttcctagggaactgccaaaaagaccgcgaagatctccgcgtatacgagaagacccacagcgtctggccttttttagtccagagaaaacccgacttccggaaccccctatacaaaggattcaccatgtatggcgttctgaatcctagtaccgtaccgtacaatatacagttctggtgtggcatgtacaataggttcgataagggtctacagcccaagcagtcaatgttagagtctctgttagagatcaagaagcagagagccatgttagaaactgatgtccacgaacttgaaaagaaactcaaagtgcgggacgaaccgcccgaagaaatatgtacctgttcgcagctgggcaatatactcagccagcacctgggctccccccttacgaacccactcggctttatgggtattaatggcgatcttaatacactgatggaaaatgggaccctgtctcgggagggagggctgcgcgcccagatggaccaggtgaagagccagggagcagacctgcaccacaactgttgtgagatagtggggagtcttcgcgcgattaacatttccggcgacgtagggatcagtgaggcaatggggatctccggcgacatgtgcaccttcgaagccacgggattctctaaagacctcggtatctgcggcgcgatggacatttccgaggccactgggattagcggcaacttaggcatctcagaggccaggggattctcaggtgacatggggattctgggtgacacagggatctccaaggctagcacaaaggaagctgactactcgaagcaccagtag

SEQ ID NO: 196390 - DNA, 2082 bp, Artificial Sequence
  Description of Artificial Sequence: Synthetic coding sequence
atggaccacatcaccgtgcccaaggtggagaacgtgaagctggtggacaggtacgttagcaagaagccggcgaacggcatcctgtatctgacagctacgcatctgatttatgtcgaggcctctggcgccgcgcggaaagagacttggatcgccctccaccatatcgccaccgtggaaaaactgccgatcactagcctggggtgcccactaaccctccgctgcaaaaactttagagtggctcactttgtcctggacagcgatctcgtctgccacgaggtctatattagtctactgaagctgtcccagccagcattgccagaggatctgtacgccttctcttataaccccaagtcctctaaagagatgagggaatccggctggaagttaattgatcccatttctgacttcggcagaatgggcattcctaataggaattggacaatcacagatgctaatcgaaactacgagatttgttctacatatcctcccgagatcgtggtacccaagtctgttacactgggcacagtcgtcggcagtagtaaattccggagcaaggaaagggtccccgtgctttcttatctctacaaggagaacaacgcggccatttgtaggtgctcgcaacctctcagtggcttctatacccgctgtgtggacgatgagctgctccttgaggcaatcagccagactaatcctggtagtcagttcatgtacgtcgtggacacaagacccaaacttaacgctatggccaatcgtgcagcaggcaaaggctatgaaaatgaggacaactacgcgaatatccgttttcggttcatggggattgaaaacatccacgtcatgcgaagctccttgcagaagctgctagaagtctgcgagctgaagaccccaactatgtccgagttcctaagcggcttggagtcaagtgggtggttgcggcatattaaggcaattatggatgcgggaatatttataaccaaggccgtgaaggtcgagaaggcttccgttctggttcactgttcggacggatgggacaggaccgcccaggtttgtagcgtggcttccattctgctggatcccttttatagaacattcaaaggtctgatgatttggcacttcctggtcctgattatgcgaatcgtgctgcagcttgctaagatgaatcttatggacataaccaagatctttagtctgctgcagcccgataaggaagaggaggataccgatacagaagaaaagcaagcgctcaaccaggcagtatatgataatgactcctatactctggatcaactgctgcgacaagaaagatacaagcgttttatcaattcgaggtcaggctggggcgtgcctggtacccctctcaggttggcagcatcttatggacatctgtcgtgtctccaggtcttactggcgcatggagctgatgttgacagccttgatgtcaaggctcagacccctctctttaccgccgtgagccacgggcaccttgattgtgtgcgggttctcctcgaggctggcgcaagccctggtgggtccatctataacaattgcagcccggtgctgaccgctgccagagacggggccgttgctattttacaggaactgctagatcacggggctgaagccaacgtcaaagctaagctgccggtctgggcttctaacattgcatcttgctctgggccactttacttggctgccgtctacggtcatctggattgctttaggctgctgcttctacacggagcagaccccgactacaactgtactgatcagggactactggcgagggtccctcgcccacgcacgctgctggaaatctgcctgcaccataattgtgaacctgaatatatccagctgctgatcgacttcggcgctaacatctatctgccaagcctgagcctcgatcttaccagccaggatgataaaggaattgcactgttgctgcaggcccgcgcgacccctcgaagcctgctatcacaggtccgtctggtggtgagaagggccctgtgtcaggcaggacagccccaggccattaatcaactggatatccctccaatgttgatcagctatctcaaacaccagttgtag

SEQ ID NO: 196391 - DNA, 861 bp, Artificial Sequence
  Description of Artificial Sequence: Synthetic coding sequence
atgggcggcgagcggagcggcgtgcggggcaacaagatggccgccgccgaaccctcaccacggcgcgtagggtttgtaggagcggggcgcatggctggcgctatcgcacaaggcctgatcagggccggcaaggtggaagcccagcatatactagcatccgcaccaaccgatcggaatctatgtcacttccaggctctcggctgcaggaccactcatagcaaccaggaggttctgcagtcttgtttgttggtgatattcgccactaagccccacgtgttaccagcagtcctggctgaggtggcccccgtagtaacaactgagcatatcctagttagcgtcgctgccggcgtatcactcagtaccttggaggagctgctacctcctaacacccgcgttctgcgcgttctgccaaatctgccgtgcgtggtacaagagggggctatcgtcatggcaagggggagacatgtcggcagctctgagaccaagctcctgcaacatctgcttgaggcctgtggcaggtgcgaggaggtcccagaagcctacgtggatattcacacgggcctatctggcagtggcgtggcttttgtgtgtgccttcagtgaggctttagcagaaggcgcagtgaagatgggcatgccctcttctttagcccatcgcattgcagcccagacactgctgggcaccgcaaagatgcttcttcacgaaggacaacatccagcgcagctgcgcagtgatgtttgcacccccggtggtactactatttacgggctccacgctctggagcagggcggtcttagggccgcaaccatgagtgcggtggaggctgcaacatgcagggctaaagagttatcgaggaaatag

SEQ ID NO: 196392 - DNA, 900 bp, Artificial Sequence
  Description of Artificial Sequence: Synthetic coding sequence
atgcccctgagcggcacccccgcccccaacaagaagcggaagagctccaaattaattatggagctgactggaggagggcaggagtcaagcggcctcaatctcggtaagaagatcagcgtccctcgcgacgtgatgctagaggaactgagtttgctcactaacagaggctccaaaatgtttaagctgagacagatgcgtgtcgaaaaatttatctacgagaaccatcccgacgtattcagtgactctagtatggatcactttcagaagttcctccccacagttggcgggcagctgggcactgccggccaaggtttttcctattcaaagtccaacggacgtggaggttcccaggcgggcggatctggtagcgccggccaatatgggtctgaccagcagcatcatctggggtcaggcagcggggccggaggaaccgggggcccagccggccaggccggacgcggcggcgctgctggcacagcgggcgtgggcgagacaggtagcggtgatcaggctgggggagaagggaagcacataaccgtatttaaaacgtatatttccccatgggaacgggccatgggcgtcgacccacagcagaagatggaactgggtatcgacctgctcgcatacggggcaaaagcagagcttccaaagtataagtctttcaacagaaccgcaatgccgtacggcggatatgaaaaggcaagcaagcgcatgacttttcagatgccaaagtttgacctggggccccttcttagcgagccccttgttttgtataaccagaatctgtccaatcgtccaagcttcaataggacgccaatcccatggctgagcagcggggaacccgtcgactataacgtagatatagggatcccactcgacggcgaaacagaggagctgtag

SEQ ID NO: 196393 - DNA, 795 bp, Artificial Sequence
  Description of Artificial Sequence: Synthetic coding sequence
atgctgagccacaacaccatgatgaagcagcggaagcagcaggccaccgccattatgaaagaggttcatggtaacgacgtggatggcatggatttgggtaaaaaagtgtcaattccacgcgatatcatgctcgaagagttgtcgcacttatccaacaggggggctagactgttcaagatgcggcaacgaagatctgacaaatacacattcgaaaactttcaatatcagtcccgcgctcagattaaccacagtatagccatgcagaatggaaaggtggacggctctaacctggagggcggttctcagcaggccccgctcactccacccaatacgcccgatccgagatctccccctaatcctgacaacatcgcgcctggatacagcggcccccttaaggagatcccccctgagaagtttaataccacagctgtccctaaatattaccagtccccttgggagcaagcaatctctaacgatcccgaactgctggaagcactgtaccccaagctcttcaagcctgagggcaaagccgagttgccagattaccgctccttcaaccgcgtagcaaccccattcggcggcttcgagaaggccagtaggatggtgaaatttaaagtgcctgattttgagttgcttctgctgaccgaccctcgttttatgtccttcgtcaacccactgtccggacgtcgctccttcaatcgcactccaaaaggctggataagtgagaacatccctatagtaattacgacggaacccactgatgatactaccgtacctgagtccgaggacttatag

SEQ ID NO: 196394 - DNA, 756 bp, Artificial Sequence
  Description of Artificial Sequence: Synthetic coding sequence
atgatccccaaggagcagaagggccccgtgatggccgccatgggcgatctgaccgagcccgtacccacgctggatctcggaaagaaattgtccgtgccgcaagacctcatgatggaagaactctctctaagaaataatcggggctctctgctcttccagaagcgacagcgacgagtgcagaagtttaccttcgagctcgccgcctcgcagcgtgccatgttggcagggagcgctaggaggaaggtcactggtactgccgagtctgggacagtggctaatgccaacgggccagagggacccaattaccgttccgaattacacatcttccccgcttcccccggggcttcactgggcgggcccgaaggcgcacacccagcagccgctccagcaggctgtgtgccatccccaagcgcgctcgctcccggctacgccgagcccctaaagggggtgccccccgagaagttcaatcatacagccatcagcaaaggatacaggtgcccatggcaagagttcgtttcgtacagagattatcaatcggacggaaggtcccacactccaagcccaaatgactataggaacttcaataagactccagtgccttttggcggacccctggttggggggacttttccgcggccaggcacacctttcattccggagcccctgtcaggcctagagcttctgaggctgaggcctagctttaatagggtcgcgcaaggatgggtgcggaatctgcccgagtctgaagaactctag

SEQ ID NO: 196395 - DNA, 756 bp, Artificial Sequence
  Description of Artificial Sequence: Synthetic coding sequence
atgatccccaaggagcagaagggccccgtgatggccgccatgggcgaccttaccgaacccgtgcccacgctcgacttaggtaagaagctatccgtcccccaggatctgatgatggaagagctgagcctgaggaataatcgcggtagcctgctgttccagaaaaggcagcgccgggtgcagaagttcaccttcgagttagcagcatcgcaacgcgctatgctggcaggctcagcaagacggaaagtgaccggcacagccgaatcaggcaccgtggccaatgcaaatgggcccgaaggccctaactacaggtccgaactacatatcttcccagctagccccggagccagcctaggtgggcccgagggtgcccacccagcagccgcgccggccggttgtgtgccatcccctagcgccctggcacccggatacgcagagcctttaaagggcgtccccccagaaaagtttaaccatactgctatttccaagggctatagatgcccatggcaggagttcgtgtcttatcgggattaccaaagtgatggtaggtcccatacaccctcccccaacgactatagaaatttcaacaaaactccagtgcccttcggcggaccccttgtcgggggaacttttccaaggcccggaactccatttatccctgagcctctctctgggctggaattactccggctgcgccctagcttcaacagggtcgcacagggctgggtgagaaacctccccgaatccgaggagctctag

SEQ ID NO: 196396 - DNA, 1989 bp, Artificial Sequence
  Description of Artificial Sequence: Synthetic coding sequence
atggtggtgagcgaggtggacatcgccaaggccgaccccgccgccgcctctcatccgctcctgttaaacggggacgccaccgtggcccagaagaatccaggctcggtcgccgaaaacaacctgtgctcacagtacgaggaaaaggtcaggccttgcattgacctgatcgattcgctgcgggccctcggagtcgagcaggatcttgcgctgccagccattgctgtcatcggcgaccagagcagtggcaaatcaagcgtgttggaggccctgagcggggtggcactgccacgtgggtccggcattgttaccaggtgtcccctggttctgaagctcaaaaaattagtgaacgaagataaatggcgaggcaaggtcagctatcaagactatgagattgagatttccgatgcctccgaggttgagaaggagatcaataaggctcagaatgcaattgctggcgaggggatggggatttctcacgagcttattaccctggagatctcatcaagagatgtgcctgaccttactctaattgatctcccaggcataacccgggtagccgtgggaaaccagcccgccgacatcggttataagattaaaactttaatcaaaaagtacattcaacggcaggagactatttcactcgttgtggtcccctcaaatgtagatatagcaactactgaagccctgagcatggcccaagaggtcgatcccgaaggagaccgaacaattggcattctgactaaacccgatctagttgataagggcaccgaggataaggtggtggacgtggtccggaatctcgttttccatctgaaaaaaggctacatgatagtaaagtgcagaggccagcaggagattcaagaccagctttccctgagcgaagccctgcagcgcgagaagattttctttgaaaatcatccctatttccgtgacctgctggaggaaggcaaagccaccgttccatgtctggcagaaaaactcacctctgagttgatcactcacatttgtaagtccctgcctctgctggagaatcagatcaaagaaactcaccagcgcattaccgaggaactccagaaatacggggtggacatcccagaggacgaaaatgagaaaatgttcttcctgattgataaagtgaacgccttcaatcaagacataaccgctctgatgcagggggaggaaactgtcggcgaagaggacataagattgttcacacgactccggcatgaatttcataagtggtctactatcattgagaataattttcaggagggtcacaagattctgtcaagaaaaatacagaaatttgagaaccaataccggggtcgtgaattgccagggttcgtcaactaccgcacctttgagacaatagtcaaacagcaaattaaggcgctcgaggagcctgctgtcgatatgttgcacacagtcaccgatatggtcaggttggccttcaccgacgtctccattaagaacttcgaagagtttttcaacctgcatagaaccgctaagagtaagatcgaagacatcagggctgagcaggaacgagaaggagaaaagctcatacgattgcactttcaaatggaacagattgtgtattgccaggaccaggtatatcggggggctctccaaaaagtaagagaaaaggagttggaggaggaaaagaagaaaaagtcttgggattttggtgccttccagtccagctcagctactgacagcagtatggaggaaatattccagcacctgatggcatatcaccaggaagcctcaaagagaatctcctctcatatccctttaatcatccaattcttcatgcttcagacatatggtcagcagcttcagaaggccatgcttcaactgctgcaggataaggatacctattcttggctcctgaaagagcgctccgatacatcagataagcggaaattcctgaaagaacgtctggcaagactcacccaggcaagacgaagattggcccagttcccaggatag

SEQ ID NO: 196397 - DNA, 1989 bp, Artificial Sequence
  Description of Artificial Sequence: Synthetic coding sequence
atggtggtgagcgaggtggacatcgccaaggccgaccccgccgccgctagtcatccgttgcttctgaatggtgatgccaccgtcgcccagaaaaatcccggtagcgtagccgagaacaacctctgctcacagtatgaggagaaagtacggccatgcatcgacctgatcgactccctgcgcgcactgggagtggaacaggatcttgccctcccagcgatcgccgtcatcggggaccagagttctggaaaaagttccgtattggaggccctcagcggggtcgcacttcctcgtggcagtggtattgtgacacggtgtccactcgtgctcaagttgaaaaaacttgtcaatgaggacaaatggcgtggcaaagtctcttaccaggactacgaaattgaaatatcagacgcaagcgaagtcgagaaagagataaacaaagcccaaaacgccattgccggcgagggcatgggtattagccatgaactgattactctggagatatcctctagagacgtacccgatctcaccctgatcgacctgccagggatcacaagagtggccgtaggaaaccagccggcagacattgggtataaaatcaaaacgctcatcaagaaatatatccagcggcaggagacaatatctctcgtggtagttccctccaatgttgacattgctactacagaagctctctcgatggcacaggaggttgatcccgagggcgaccgcacaatcgggattcttacgaagccggacttagtcgataagggcactgaagacaaagtggtcgacgtcgtgaggaatctggttttccacctcaaaaagggctatatgattgtgaagtgtaggggacagcaggagattcaagatcagttaagcttgtcagaggccctgcagcgcgagaagatcttttttgagaaccacccttattttcgggatcttctcgaagagggcaaggccaccgtcccgtgcttagccgaaaaactaacatcggaactcatcacccatatctgtaaatccctgccactgctcgagaatcagatcaaggagacccaccagaggattaccgaggaactgcagaaatacggagtcgacatccctgaggacgaaaacgagaaaatgtttttcctcatcgacaaggtgaatgccttcaatcaggacatcaccgctctgatgcagggcgaggaaaccgttggggaggaggacatacgcctgtttactaggcttagacacgagtttcataaatggagcacgataatcgagaataatttccaagagggccacaaaatcctgtcccggaaaatacagaagttcgagaatcagtatcggggaagggaactccctggcttcgttaattatcggaccttcgagacaatcgttaagcagcagataaaggccttagaagaaccagctgttgacatgctgcacaccgtcaccgatatggtgaggcttgccttcaccgacgtatctattaaaaacttcgaagagttcttcaacctgcatcgaacagccaaatctaaaatcgaggatataagagctgagcaggaacgtgaaggtgaaaaactgatcagactgcattttcaaatggaacagattgtgtactgtcaggaccaggtgtataggggggcactccaaaaggtaagagaaaaagaactagaagaggagaaaaagaagaagagctgggactttggtgcttttcaatcatctagtgccacagacagcagtatggaagagatattccagcacctgatggcgtaccaccaggaagcttctaaacggatttccagtcatatccccctcattatacagttctttatgctgcagacctacgggcaacaactgcaaaaggctatgctacaattgttacaagacaaagacacttactcttggctactcaaagagaggagcgacacttccgacaagagaaaattcttaaaggaaaggctcgcccggctgacccaggcccgcaggcggctggcccagttccccgggtag

SEQ ID NO: 196398 - DNA, 207 bp, Artificial Sequence
  Description of Artificial Sequence: Synthetic coding sequence
atggtggtgagcgaggtggacatcgccaaggccgaccccgccgccgctagtcaccccctgctgttgaatggcgacgccacggtcgcccagaaaaaccccggatctgtggcagagaacaatctttgcagccagtatgaagaaaaagtgagaccttgtatcgatttgatagattccctgcgcgcattgggggtggaacaggacttatag

SEQ ID NO: 196399 - DNA, 606 bp, Artificial Sequence
  Description of Artificial Sequence: Synthetic coding sequence
atggtggtgagcgaggtggacatcgccaaggccgaccccgccgccgcatcccatcctttgttgctgaatggagacgccacagtggctcaaaaaaatccgggctccgtagctgaaaacaatttatgttctcagtacgaggaaaaggtgcgcccatgtattgatctgattgattctttgcgtgcattgggcgtggaacaggacttagccctaccagcgatcgctgttattggagaccaaagctcgggtaagtcaagcgttctggaggccctgtccggagtagcactcccaagggggtcaggcattgtgacccggtgtccccttgttctgaaacttaagaaacttgtcaacgaagacaagtggaggggtaaagtctcttaccaggactacgaaatcgagatatcagacgcttccgaagtggaaaaggagataaacaaggcgcagaacgctattgcgggggagggcatgggtatctcccacgaactgattacccttgagatcagtagtagggatgtacccgacttaactctcatcgatttgcccggcatcacgcgcgtggctgtggggaatcagcctgctgacattggatataagatcaagactctctag

SEQ ID NO: 196400 - DNA, 81 bp, Artificial Sequence
  Description of Artificial Sequence: Synthetic coding sequence
atggtggtgagcgaggtggacatcgccaaggccgaccccgccgccgctagccacccattgttgctaaatggcgatgcctag

SEQ ID NO: 196401 - DNA, 594 bp, Artificial Sequence
  Description of Artificial Sequence: Synthetic coding sequence
atggtggtgagcgaggtggacatcgccaaggccgaccccgccgccgcttcacatcctctcttgctcaatggggacgccacggtggctcagaagaatcctggtagtgtcgcagaaaataatctgtgctcgcagtacgaagaaaaggtgaggccatgcattgacctgattgactccttgcgggccctgggcgtggaacaggatttggctttacctgcgatcgcggtaatcggggatcagtcgtctgggaaatcctcggtcctcgaagcgctgagcggcgtggccctgccgcgtgggtcagggatagtgactaggtgccctctcgtgctgaaattaaagaaactggtcaatgaggataagtggaggggaaaagtgagctatcaggattatgagatcgagatttctgatgcaagcgaggtcgaaaaggagataaataaggctcagaacgcaatcgccggagagggtatggggattagccacgagttgatcaccttagaaatttccagccgtgatgtgccggacctgactcttatcgacctgcccggcataacgcgtgtggctgtagggaaccaacctgcggatatcggttacaaatag

SEQ ID NO: 196402 - DNA, 108 bp, Artificial Sequence
  Description of Artificial Sequence: Synthetic coding sequence
atggtggtgagcgaggtggacatcgccaaggccgaccccgccgccgcctcgcacccacttctgcttaacggggatgcaactgtggcccaaaagaaccccggttcctag

SEQ ID NO: 196403 - DNA, 234 bp, Artificial Sequence
  Description of Artificial Sequence: Synthetic coding sequence
atggtggtgagcgaggtggacatcgccaaggccgaccccgccgccgccagccacccgctgctgctgaacggggacgccaccgtggcacaaaagaatccagggtctgtggccgaaaacaatctttgctcacagtatgaggaaaaggtgagaccctgtatcgacctgattgattctctgagagccctgggagtggagcaagacctggctctacctgcaatcgcagtgatcggctag

SEQ ID NO: 196404 - DNA, 1989 bp, Artificial Sequence
  Description of Artificial Sequence: Synthetic coding sequence
atggtggtgagcgaggtggacatcgccaaggccgaccccgccgccgcttcccacccgctcttgctgaatggcgacgctactgtggcacaaaagaacccgggcagcgtggctgagaacaatctgtgttcccagtacgaagaaaaagtgaggccctgtatagacttgattgacagtctgagagcgcttggcgtcgagcaagatctcgccctccccgccattgctgttattggggaccagtcaagtgggaaatcttctgtgctcgaagcgctttcgggggtggcccttccacgcggaagcgggatcgtgactcgctgccccctagtgttgaagctaaagaagttagttaacgaagataaatggagagggaaagtttcttaccaggactatgagatcgagatcagcgacgcatctgaggtggagaaggaaattaacaaagctcagaacgctatcgctggcgaagggatgggaatcagccacgaacttatcaccctcgagatctcgtcccgagacgtcccagacttaaccctcatcgatctgccagggataacacgggtcgccgtgggcaaccaacccgctgacattggctacaagataaaaaccctcattaaaaaatacattcagagacaggagactataagtcttgtggtggtgcccagcaatgtagatatcgcaacgacggaggctctgtctatggctcaggaggtcgatcccgagggcgataggactattggaatacttacgaagccggaccttgttgacaaaggtaccgaagataaggttgttgatgttgttcgaaacctggtttttcacttgaaaaagggctacatgatcgtcaagtgtcgggggcaacaggaaatccaggatcaactctctctctctgaagcactgcagagggagaaaatttttttcgagaaccacccatacttccgggatttgcttgaggaagggaaggctaccgtgccgtgtctggcagagaagctgactagcgaacttatcacccacatttgtaaaagcctcccgcttctggaaaatcagattaaggagacgcatcaaagaatcaccgaagagctgcagaaatacggtgtggacattcccgaggatgagaatgaaaaaatgttcttcctaatcgacaaggtaaacgcctttaatcaagatataaccgccctgatgcagggcgaggaaactgtgggcgaagaagacattcggctgtttacaagactgagacacgagttccataagtggtcaactataattgaaaataactttcaggagggtcataagattttaagtcggaaaatccagaagttcgagaaccagtaccgcggacgggaactgcctggcttcgtgaactatagaaccttcgaaaccattgtgaagcaacaaattaaagccctcgaagagccagcagtagatatgctccacacagtcacagacatggtgcgattggccttcaccgacgtctctattaaaaactttgaggagttttttaacctgcaccgcactgctaagagtaagatagaggatatccgagccgaacaggaacgcgagggagaaaagctcattaggctgcacttccagatggaacagattgtgtactgccaggaccaggtgtatcgcggagctctgcaaaaagtcagggagaaagaactggaggaagaaaaaaagaagaagtcctgggacttcggcgcattccagtcgtcctccgcgacggacagcagtatggaggagatatttcagcaccttatggcttatcatcaggaggcaagcaagcggatatcaagccacataccactaattatacaatttttcatgctccagacatacggccagcagttacaaaaggctatgttgcagctattgcaggataaggatacctactcatggctactgaaagaacgaagtgatacttcagacaaacgtaaatttctgaaagagcggctggccaggcttacgcaggcccggcgacgtctggctcagttccccggctag

SEQ ID NO: 196405 - DNA, 2148 bp, Artificial Sequence
  Description of Artificial Sequence: Synthetic coding sequence
atgagcaaggcccacaagccctggccctaccggcggcggagccagttcagctcccggaagtacctcaagaaagagatgaatagttttcagcagcaaccccctcctttcggcacagtaccgccccaaatgatgtttccaccaaactggcagggtgccgaaaaagatgcagccttcctggcaaaagattttaattttctgactttaaacaaccagcctcccccagggaaccgtagccaaccaagggcgatgggtcccgaaaacaacttatactctcagtacgagcaaaaggtccgtccttgcattgaccttattgattcactcagggcgctgggggtggagcaggatcttgccctgccagctatcgccgtgataggcgatcaaagcagtgggaagtcttccgttttggaagctctgagcggcgtcgcgttgccccgggggtctggaatcgtgacgcgttgtccgttggtcttgaagcttaaaaagcagccgtgtgaggcctgggccggacggatttcttaccgtaacacagagctagaactgcaggaccctggacaagtggaaaaagaaattcataaggcccagaacgtcatggccggcaacggacgtggaatcagtcacgagttaatcagccttgagatcacctcacccgaggttccagatctgacgatcattgacctccccgggattacacgcgttgcagttgacaatcagccacgtgacatcgggctacaaatcaaggccctcattaaaaaatacattcagagacagcagacaattaatttggtcgttgtaccttgtaacgtggatatagcaaccacggaggcattatctatggcacatgaggtggatcccgaaggagaccggaccatcggaatccttacgaaacccgatcttatggacagaggaacagagaagagcgtgatgaatgtggtaagaaacctgacatacccattgaagaaagggtacatgattgtgaagtgccggggccagcaggaaatcactaatcgtctgtccctcgcagaggccactaagaaggagattacatttttccagacacatccgtattttcgagtgctcctagaggagggctccgcaaccgtcccaagactggcagagcgactgacaacggagctgatcatgcacattcagaagtccctccccctattagaggggcagatcagggagtcccatcagaaggctactgaggagttgcgaagatgcggcgcggatatcccttcacaggaagcagataagatgttctttcttatcgaaaagatcaagatgttcaaccaggatatcgaaaaactggtggagggggaagaggtagtgcgggagaatgagaccagactttacaacaagatccgcgaagattttaaaaactgggtaggaatcttggccaccaatactcagaaagtcaagaatattatacacgaggaggtcgaaaagtatgaaaaacagtatcgagggaaagaactattggggttcgtcaattacaagacattcgaaatcatcgtgcaccaatatatccagcaactggtggaacctgcactgtccatgctgcagaaggctatggagattattcagcaggcatttatcaacgtcgccaagaagcatttcggtgagttttttaacctgaaccagaccgttcagagcacaatcgaagatatcaaagtgaagcataccgccaaagcggaaaatatgattcagttgcaatttagaatggaacaaatggtgttttgccaagatcaaatctactctgttgttctgaagaaggtccgggaagaaatctttaaccctttggggactccctctcagaatatgaagcttaatagccacttcccctctaacgaatctagcgtgagttctttcactgagattggcatacacctgaacgcttacttccttgaaacttctaaaaggctggcgaaccagatcccctttataatacaatactttatgttgcgcgagaatggtgatagcttacagaaggccatgatgcagatactccaggaaaagaacaggtactcatggctcctacaggagcagtccgaaaccgcaaccaagaggaggatactaaaggaacggatctacaggctgacacaggcacgacatgccctgtgtcagttttcttccaaggaaatccattag

SEQ ID NO: 196406 - DNA, 45 bp, Artificial Sequence
  Description of Artificial Sequence: Synthetic coding sequence
atgagcaaggcccacaagccctggccctaccggcggcggagctag

SEQ ID NO: 196407 - DNA, 405 bp, Artificial Sequence
  Description of Artificial Sequence: Synthetic coding sequence
atgagcaaggcccacaagccctggccctaccggcggcggagccagtttagctcacgtaaatatctgaagaaagagatgaacagttttcagcaacagccgccaccgtttggcacagtgcctccccagatgatgttccccccaaattggcaaggcgcggaaaaggacgccgccttcttagccaaggatttcaatttcctgacacttaataatcagcccccccccggcaatcgatcacagcctcgcgccatgggaccagagaataacctgtactcccaatacgaacaaaaagtacgcccctgtattgatctcattgatagcttacgcgccttgggagtcgagcaggatttggcacttcccgccatcgctgtgataggagaccagtccagcgggaagagcagtgtgtag

SEQ ID NO: 196408 - DNA, 378 bp, Artificial Sequence
  Description of Artificial Sequence: Synthetic coding sequence
atgagcaaggcccacaagccctggccctaccggcggcggagccagttttctagtagaaaatatctgaaaaaggagatgaatagcttccagcaacagcccccaccgtttggtaccgtgcccccacagatgatgtttccacctaactggcagggggccgagaaggacgccgcatttctcgctaaagatttcaactttctgaccctgaacaatcagccacctccggggaatagatcccaaccacgtgcaatgggtccagagaacaatctctattcacaatatgagcagaaagtcaggccgtgcatcgatctcattgattcactgcgggcactcggtgtggagcaggacctcgccttgccagcaattgcagtgattggatag

SEQ ID NO: 196409 - DNA, 390 bp, Artificial Sequence
  Description of Artificial Sequence: Synthetic coding sequence
atgagcaaggcccacaagccctggccctaccggcggcggagccagtttagcagtagaaagtacctgaaaaaagagatgaactctttccagcagcagccacctccatttggcaccgtccctcctcagatgatgtttcctccgaactggcaaggagcagaaaaagatgcagcatttctcgcgaaagatttcaattttctgacccttaacaaccaaccccctccagggaatagaagccaacccagggcaatgggcccagagaacaacctgtacagccagtacgaacaaaaggttaggccatgtattgatctcattgactccttgagggctctgggagtggagcaagatttggctttaccagcgatcgctgtgatcggcgatcagagtagctag

SEQ ID NO: 196410 - DNA, 606 bp, Artificial Sequence
  Description of Artificial Sequence: Synthetic coding sequence
atgagcaaggcccacaagccctggccctaccggcggcggagccagttctctagtagaaagtacctcaagaaggagatgaattcattccagcaacagccacctccctttgggaccgttccaccacaaatgatgtttccaccaaattggcagggcgccgagaaggacgctgcttttctggcgaaggactttaactttctgactctcaacaaccagccaccgccaggcaataggtctcagccccgcgcaatgggcccagaaaataatctttattctcaatacgagcagaaggtgcgcccttgtatcgacctcatcgactctcttagagctctgggagtggaacaagatctcgcactgccggccatcgccgtgatcggggaccaatccagtggtaagagcagcgtcctcgaagccttatctggagttgccctgcctagaggatcggcgcagaacgttatggccggcaatggcagaggcattagccacgagctgatctctctcgagatcacttctcctgaggtccctgatcttaccatcatcgacctaccaggtatcacccgggttgccgtcgataatcagcctcgtgatattggcctgcaggtgagttag

SEQ ID NO: 196411 - DNA, 663 bp, Artificial Sequence
  Description of Artificial Sequence: Synthetic coding sequence
atgaacatccggaacgcccggcccgaggacctgatgaacatgcagcattgtaatctgctgtgtctgcccgagaactatcagatgaaatactatttttatcacgggttaagctggccacagctgtcttatattgctgaagatgagaacggcaagatagtggggtatgtactggcaaagatggaggaggaccctgacgacgtccctcacggacacatcacatctttggcagttaagagatcccataggagactgggcctggcccagaaactcatggaccaagcttcccgagccatgattgagaatttcaatgccaaatacgtctcgctgcacgttcggaaaaggatttccgaagtggagccaaaatattacgctgatggggaggatgcttatgcaatgaaacgggacctgacccaaatggccgacgagctgcgccgccatctggaactaaaagaaaaggggcggcatgtggtgctgggcgcaatcgagaataaggtggagtcaaaagggaacagccctccttcaagtggagaggcttgtagggaggaaaaaggcctggctgctgaggatagcgggggggacagcaaggaccttagtgaggtgagcgagaccacagaaagcacggatgtgaaggacagctccgaagcttccgacagcgcctcatag

SEQ ID NO: 196412 - DNA, 708 bp, Artificial Sequence
  Description of Artificial Sequence: Synthetic coding sequence
atgaacatccggaacgcccggcccgaggacctgatgaacatgcagcactgcaacctgctgtgcctgcctgagaattaccagatgaaatattacttttaccacggcctcagctggccacagcttagctatatcgccgaggatgaaaacggaaaaattgtcggctacgtattagctaagatggaggaggatcctgacgacgtgccacatggccacataacgagcctggccgtaaagcgcagccatagaaggctcggactggcccaaaaactgatggaccaggccagtcgcgccatgatcgagaatttcaacgccaagtatgtttctcttcacgtgcgcaagtctaaccgcgctgccttgcatctatactctaatacactcaacttccagataagcgaagtggaaccgaagtactacgccgacggagaggacgcatatgcgatgaagagggaccttactcaaatggccgatgagctgagaaggcacctagagctgaaggagaaaggccgtcatgtcgtgcttggagccatcgagaacaaggttgagagcaaaggcaacagtcctccaagctccggagaggcatgtcgggaggaaaaagggttggccgccgaggactccggaggggatagtaaggacctgtctgaggtctccgaaaccaccgagagcacagacgtaaaagattcgtctgaggcctctgactctgccagctag

SEQ ID NO: 196413 - DNA, 396 bp, Artificial Sequence
  Description of Artificial Sequence: Synthetic coding sequence
atgaacatccggaacgcccggcccgaggacctgatgaacatgcagcactgcaacttgctctgcctccccgaaaactatcaaatgaagtactatttctaccacggactctcttggccacagctgagctatattgccgaagatgagaatggtaagatcgttggctatgtactggcaaaaatggaagaagacccggacgacgtcccccacgggcacatcacttccctggcagtgaaacgcagccaccggcgcttgggattggcccagaagctgatggaccaggcaagccgcgccatgattgagaattttaacgctaaatatgtcagtctgcacgtgagaaagaggagcgtaaaatggagccctaacaccatgcagatggggagaacgccaatgccgtag

SEQ ID NO: 196414 - DNA, 534 bp, Artificial Sequence
  Description of Artificial Sequence: Synthetic coding sequence
atgatcgtggccgagatcaagaaccggaccaagatccacaaggaggacggggacatcctcgctagtaacttctctgtggacacgcaggttgcttacatcctctcattgggggttgtgaaagaatttcgaaaacatggcataggtagcctgctactggaatccctgaaggatcacatatctacaactgctcaagaccattgtaaggcaatatatctgcatgtgttgaccaccaacaataccgccataaacttttacgagaaccgcgatttcaagcagcaccactacttgccatattactattccatccggggcgtgctcaaggacggctttacgtatgtgttgtacataaatggaggtcaccccccgtggaccatcctagattacattcagcaccttggcagtgccctcgcctctctcagcccttgtagcatcccccaccgggtgtaccgtcaggcacactctctgctttgcagcttcctaccctggtcaggcatttctagcaaatctggtatcgaatacagcagaactatgtag

SEQ ID NO: 196415 - DNA, 729 bp, Artificial Sequence
  Description of Artificial Sequence: Synthetic coding sequence
atgaccgaggtggtgcccagcagcgccctgagcgaggtgagcctgagattactctgccatgacgatatagatacagttaaacacctgtgtggtgactggttccccattgagtatcccgattcttggtacagagacattacaagcaacaaaaagtttttttccttagctgcgacctatagaggcgccatagtcggaatgatcgttgcagagataaagaatagaaccaaaatccataaagaggatggagacatacttgcatcgaacttcagtgtcgacacgcaggtggcctacatcctctctctgggtgtggtgaaagaattccgtaaacacggaatcggaagtctgttgttggagagcctgaaagaccacattagcaccactgctcaggatcattgcaaggctatctacctccacgtgctgactaccaataacacagccattaatttctacgagaatcgtgactttaagcagcaccattatcttccctactattatagcatccggggtgtccttaaagacggcttcacctacgtgctctacatcaatggggggcatccaccgtggacaattctggactacatacaacacctgggatccgccctggcatccctctccccatgtagcatcccccacagggtctacaggcaggcccactcactgctttgtagcttcctgccatggtccggcatttcatccaagtctgggatcgagtattcgcggacaatgtag

SEQ ID NO: 196416 - DNA, 729 bp, Artificial Sequence
  Description of Artificial Sequence: Synthetic coding sequence
atgaccgaggtggtgcccagcagcgccctgagcgaggtgagcctgaggctactgtgccatgatgacattgacacagtgaaacatctgtgcggggattggtttccaatcgaatatccggacagctggtatcgagatatcacgtccaataaaaaattctttagcttggccgctacataccgaggagccatcgtggggatgatcgtggcagagatcaagaatcgcacaaagatccacaaggaagacggtgacatactagctagtaacttttccgtggatactcaggtcgcatatatcctctctttgggcgttgtgaaggagttccggaaacatggaattggaagtctgctcttagagtccctaaaagatcacatctctactacagcacaagatcactgtaaggccatttatcttcatgttttgaccacaaataatacggccattaatttttacgagaatcgggattttaaacagcaccattacctgccctactactactccattcgtggggtcttgaaggacggatttacctatgtgctttacatcaatggcgggcatcctccttggacaattctggattacattcaacaccttggcagtgccctagcatctctgtccccttgctcaataccacacagagtgtacagacaagctcattctcttttgtgctccttcctgccgtggagtggaatctcaagtaagtctggcatcgaatattcacgcactatgtag

SEQ ID NO: 196417 - DNA, 573 bp, Artificial Sequence
  Description of Artificial Sequence: Synthetic coding sequence
atgaccgaggtggtgcccagcagcgccctgagcgaggtgagcctgagattgttgtgccacgatgatattgatacagtcaaacacctgtgtggagattggtttccgattgagtacccagatagctggtatagggatataacgtccaataagaaatttttttccctagccgccacatatcgcggcgccatagtcgggatgatcgtcgcagagatcaaaaatagaactaaaatccataaggaggacggcgacattcttgcaagtaacttcagcgttgacacccaagtcgcctacatcttaagccttggggtcgtcaaggaattccggaagcacggcattgagccccatggactgcaccctgcccccggcttatgtacttcccaacctgaaccacttttgcattcagctcaatccttaccccctggccctcagcctgctctccagctgcccgctatggttgggcacctgttccaagaatggcatagggtccagccagatcacgtgatgtcagccggtcagccacctcctggaccaactctgagaccacccgctgaacccgcattcctctccatttag

SEQ ID NO: 196418 - DNA, 750 bp, Artificial Sequence
  Description of Artificial Sequence: Synthetic coding sequence
atgttcccccggcggcggaccgagcggcggctgggcgacaccggcactagaaaaaaaatcgcctaccgaaaagcagttcccggcggccgcaagtgcggagcctccctcagctgggaaaaatcaagtagagagtacccagattcttggtaccgggacatcaccagtaacaaaaaatttttctcactagcagccacctatcgcggcgctattgtgggtatgatcgtggccgaaataaaaaacaggacaaagatacacaaggaggacggcgacattttagcctccaacttcagcgtcgatacccaggtcgcctatatcctcagtctcggcgtggtcaaggagtttcggaagcatggcatagggagtctcctgctcgaatctttgaaggaccacatcagcacaaccgcacaggaccactgtaaggctatctacctacacgtcctgacaacaaacaatacagcgattaacttttacgagaatagagattttaagcagcaccattatctaccatactattacagcattcggggggtgctaaaagatggatttacctacgtgctgtacattaatggtgggcaccccccctggactatcctggattatattcaacatttgggctctgctctcgcaagcctgtctccatgttccataccccatcgtgtgtatcgccaggctcactctttactttgctcatttctgccctggtctggcatctcctctaagtctgggatcgaatattcgaggacaatgtag

SEQ ID NO: 196419 - DNA, 492 bp, Artificial Sequence
  Description of Artificial Sequence: Synthetic coding sequence
atggccgtgatcctgggcatcttcggcaccgtgcagtaccggagcagatatttaatcctgtatgctgcatggctcgtgctttgggttggctggaatgctttcatcatttgcttctacctggaagtggggcagctgtcccaggatcgagacttcattatgacttttaacacaagtctgcacaggtcctggtggatggaaaacggcccagggtgtctggtaaccccggtgctgaactcccggctggcgcttgaggaccaccatgtgatatcagtaacgggctgcctgctcgactatccctatatagaggccctttcctccgcactgcagatattccttgctctgtttgggtttgtctttgcctgctacgtgagcaaagttttcttggaagaggaggacagttttgactttattggtggtttcgatagttacggctaccaggccccccagaagacctcccacctgcagctccagccgttatatacatcaggatag

SEQ ID NO: 196420 - DNA, 624 bp, Artificial Sequence
  Description of Artificial Sequence: Synthetic coding sequence
atgggcaagtgcagcggccggtgcaccctggtggccttctgctgcctgcagctcgttgctgcattggaaaggcagattttcgattttcttgggtaccaatgggccccaatactcgctaactttctgcacatcatggccgtaatcctcggaatcttcgggactgttcaataccgctcccgatatctcatactgtacgctgcttggctggtgctgtgggtgggttggaacgcctttatcatatgcttctacctcgaagttgggcaactgtctcaggatcgggatttcatcatgacattcaatacttccctacaccgatcctggtggatggagaacggacctggttgtctggttactcccgttctaaactctcggctcgcgctcgaagaccatcacgtgatatctgtgactggatgtttattggactatccttacattgaagctttatccagtgccctacagatcttcctcgccttgtttggtttcgtgtttgcttgttacgtgtcaaaggtttttctggaagaagaggactcattcgattttattggtggcttcgacagttacggttaccaggctccccagaaaacaagccatctgcagctccaaccgctttacacgtctgggtag

SEQ ID NO: 196421 - DNA, 411 bp, Artificial Sequence
  Description of Artificial Sequence: Synthetic coding sequence
atggccgtgatcctgggcatcttcggcaccgtgcagtaccggagcagatacctaattctggacagggacttcatcatgacattcaatacctccctccacagatcttggtggatggagaatggccccggctgcttggtgacgcctgtccttaatagtagacttgctctggaagatcaccatgttatcagcgttaccggctgtctcctggactacccatacatagaggccctgtctagtgccctccagatcttcctggctttattcggctttgtatttgcgtgttatgtgtctaaggtattccttgaggaggaggacagttttgacttcattggtgggtttgatagttatgggtatcaagcacctcagaagaccagccacttacagctgcagccactgtacacgagcggctag

SEQ ID NO: 196422 - DNA, 567 bp, Artificial Sequence
  Description of Artificial Sequence: Synthetic coding sequence
atgggctactgcagcggccggtgcaccctgatcttcatctgcggcatgcaattggtgtgtgtcctcgagagacagatcttcgattttctaggttaccagtgggcccccatcctcgccaatttcgtgcatatcatcattgtcatcctggggctgtttggcactatccaatatcgcccgaggtatatcaccggctatgccgtgtggctggtgctgtgggttacctggaacgtatttgtgatttgcttctacctggaagccggagatctgtccaaggaaaccgatttgatcctcaccttcaacatctctatgcacaggagttggtggatggaaaatggccctggatgtactgtcacaagtgtgacacctgcccccgactgggcaccagaggaccaccggtacatcaccgtgtcaggttgcctcttagagtaccagtacatagaagtggcccattcttcgctgcagatcgtgttagccgtgtctgttggttcacagccacttctgcttgtccctctgggtctgttctacttctgcgctaatagcgtccacactaatggaatctgcgggtag

SEQ ID NO: 196423 - DNA, 627 bp, Artificial Sequence
  Description of Artificial Sequence: Synthetic coding sequence
atgggctactgcagcggccggtgcaccctgatcttcatctgcggcatgcaattagtatgtgtgctcgaacgacagattttcgacttcctcggatatcagtgggctccaatccttgctaacttcgttcacattatcattgtgattttagggctgtttgggaccattcagtaccggcctaggtatatcacaggctatgcggtatggctagtcctgtgggtaacttggaatgtctttgtgatctgcttctacctcgaagcaggggacctgagtaaagagactgatctgatcctaaccttcaatatttctatgcatcgctcgtggtggatggagaatgggccaggatgtactgtcacgagtgtcacccctgcaccggactgggcccccgaggaccacagatatatcactgtgagcgggtgcctgcttgagtatcagtacatcgaagtcgctcactctagcctccagattgtgcttgccttggccggattcatttacgcatgttatgttgtaaagtgcattaccgaagaggaggatagcttcgactttatcgggggatttgattcgtacggctatcaggggccacaaaaaacctcacatcttcagctgcagcccatgtacatgagcaaatag

SEQ ID NO: 196424 - DNA, 624 bp, Artificial Sequence
  Description of Artificial Sequence: Synthetic coding sequence
atgggcatcatccggttcctgctgctgtactgccccaccaacatccttaccgtgtgcgtactggagagacagatctttgattttctgggatatcagtgggctcctattcttgctaactttgtgcatatcatcatcgtgatcctaggactattcggtaccattcaataccggccaagatacatcaccgggtatgcagtgtggctggtgctgtgggtgacctggaacgtctttgtgatatgtttctatttagaggcaggagatctttcaaaggagactgacctgattctgacgttcaacatcagcatgcaccgaagctggtggatggaaaacggccccgggtgcaccgtaacaagcgtcacacctgctccagattgggcccccgaagaccaccgctacattaccgtgtccgggtgcctgttagagtatcaatacatcgaagtcgcccacagctctcttcaaatcgtcctggccctggctggcttcatctatgcctgctatgtggttaagtgcatcacagaggaggaggattcttttgattttattgggggcttcgacagttatgggtaccaaggaccgcagaaaacaagccatttacagctacagcccatgtatatgtcaaagtag

SEQ ID NO: 196425 - DNA, 576 bp, Artificial Sequence
  Description of Artificial Sequence: Synthetic coding sequence
atgaagatcgtgtgcgtgctggagcggcagatcttcgacttcctgggttatcaatgggcccccatcctggcgaacttcgtgcatataattatagtgatcctggggctcttcggcaccatccagtatcgacctcgctatatcactggttacgccgtttggcttgtgctctgggttacatggaacgtttttgtcatctgcttctacctagaggctggcgacctcagcaaggaaactgacttgatcctaacattcaacattagtatgcatcggagttggtggatggagaacgggcccgggtgtactgtaacttctgtcactcccgcacctgactgggcacccgaagaccatcggtacatcactgttagcggctgtctgttagagtaccagtacatcgaggtggctcatagcagcctgcaaatcgtgctggccctggctggctttatctatgcctgttacgtggtgaaatgcattacagaggaagaagactcctttgactttatcgggggctttgacagctatggttatcaaggcccacagaaaacctctcacttacaactccagcccatgtacatgtag

SEQ ID NO: 196426 - DNA, 420 bp, Artificial Sequence
  Description of Artificial Sequence: Synthetic coding sequence
atgggctactgcagcggccggtgcaccctgatcttcatctgcggcatgcagctggtctgtgtcctcgagaggcagatcttcgacttcctgggctaccagtgggcccccatcctggccaactttgtccatatcatcatcgtgatacttggtctctttggaaccattcagtatcggccccgctacataaccggctacgccgtgtggctagtgctctgggttacctggaatgttttcgtaatctgcttctacttggaagctggtgacctgtccaaactcgcaggctttatctacgcttgctacgtggtgaaatgtattactgaggaagaagatagctttgacttcattggcggatttgattcatacggatatcaaggcccccaaaagactagccatctgcaactgcagccgatgtatatgtag

SEQ ID NO: 196427 - DNA, 594 bp, Artificial Sequence
  Description of Artificial Sequence: Synthetic coding sequence
atgggctgctgcaccggccggtgcagcctgatctgcctgtgcgccctgcagttggtttctgctctcgaacggcagattttcgactttcttggcttccaatgggccccaatcctggggaacttcctccatatcattgtagtgattctgggcctcttcggcacaatacagtacaggcccagatacataatggtctacaccgtttggaccgccttgtgggtgacctggaacgttttcatcatctgtttttatcttgaggttgggggcctgtccaaagataccgatttaatgaccttcaacatttccgtgcacagatcttggtggcgggaacacggaccaggctgtgttagaagagtgctgcccccctccgcacatgggatgatggacgattatacttacgtgtctgtgacgggatgtattgttgatttccagtacttagaggtgatccactctgcagtgcagatcctattatcactggtgggtttcgtgtatgcatgttatgtgatatccataagtatggaggaagaggacacatactcgtgtgacttgcaggtctgtaaacacctcttcattcagatgctgcagataatagagtag

SEQ ID NO: 196428 - DNA, 594 bp, Artificial Sequence
  Description of Artificial Sequence: Synthetic coding sequence
atgggctgctgcaccggccggtgcagcctgatctgcctgtgcgccctgcaacttgtctccgctctggaacgccagatttttgatttcctgggctttcaatgggcacctattctcgggaatttcttacatattatcgtcgttatcctgggcctcttcggaacaatccagtacaggcctcggtatattatggtgtatacggtttggaccgccctttgggtgacatggaacgtttttatcatttgcttttaccttgaggtggggggcctcagcaaagacactgacttaatgaccttcaatattagcgtgcacaggtcttggtggcgggagcatgggcccggttgcgttaggcgagtgctcccacctagcgcacatggcatgatggatgattatacctacgtgtcagtgactggttgcatcgtggatttccaatacttggaggtgatccatagcgctgtacagatccttctgagtctcgtgggctttgtatatgcttgttacgtgatttccatttccatggaggaagaggacacatactcttgtgatcttcaggtatgtaaacacttgtttattcagatgctgcaaattatcgagtag

SEQ ID NO: 196429 - DNA, 486 bp, Artificial Sequence
  Description of Artificial Sequence: Synthetic coding sequence
atgggctgctgcaccggccggtgcagcctgatctgcctgtgcgccctgcagctggtctcatgggtgttcgatcgtcagatcttcttactttcctttcagtgggcccctatattaggaaattttctgcacattatcgtggttatcctggggcttttcgggaccattcagtatagaccacgttacataatggtgtataccgtgtggaccgctctctgggtaacttggaatgtgtttattatctgtttctacctggaggttgggggactgtctaaggatacagatctcatgacgttcaacatttccgtgcatcgatcatggtggagagagcacggtccaggctgtgtgcggagagtgctgcccccttctgcacatgggatgatggacgactacacctacgtgtccgtgacaggctgcatagtcgacttccagtacctggaggtgatacattcggctgtccagatcctcttgagcattttcttcctgtag

SEQ ID NO: 196430 - DNA, 627 bp, Artificial Sequence
  Description of Artificial Sequence: Synthetic coding sequence
atgggcagctgcagcggccggtgcgccctggtggtgctgtgcgccttccagctggtggcagccctggaaagacaggtctttgattttctgggatatcaatgggctccgatattagccaactttgtgcacatcatcatagtgatcttgggcctcttcggcaccattcagtacagactcaggtatgttatggtgtatacgctgtgggctgccgtgtgggtaacctggaatgttttcatcatctgcttctatctggaggtggggggcctcctgaaggacagcgagcttctgacgtttagcctttcccgccacaggtcttggtggcgggaaaggtggccgggatgcctgcacgaagaggtcccagcggttggcttgggcgccccacatgggcaggcactggtgagcggagccggatgcgcactcgaaccttcctatgtggaagccctgcactcttgcttacagatcctgattgccctgttgggctttgtctgcgggtgtcaggtggtttccgtcttcactgaggaagaggacagttttgacttcatcggcggttttgaccctttccccctttaccatgtcaacgaaaagcccagcagcctgttgtccaagcaggtttacctgcctgcctag

SEQ ID NO: 196431 - DNA, 267 bp, Artificial Sequence
  Description of Artificial Sequence: Synthetic coding sequence
atggccgagagccggggccggctgtacctgtggatgtgcctggccgccgctctggcttcgttcctcatgggatttatggtcggctggtttatcaaaccactgaaggagacgacaacaagtgtgcgataccatcagtcgatcagatggaagctggttagcgagatgaaagcagagaatattaaatcattcttgcgatcttttacaaagctgccccatctcgctgggacagagcaaaacttcctcttggcaaagaagatccagacctag

SEQ ID NO: 196432 - DNA, 2223 bp, Artificial Sequence
  Description of Artificial Sequence: Synthetic coding sequence
atggccgagagccggggccggctgtacctgtggatgtgcctggccgctgctctcgcgtccttcctgatggggtttatggtgggttggtttataaagcccctcaaagagaccactacgagcgtgcgttatcaccagtccataaggtggaagttggtgtccgagatgaaggccgaaaacatcaaatcattccttcgtagtttcaccaaattgcctcacttggccggcaccgaacagaattttctgcttgctaaaaagatccaaacccaatggaaaaaatttggcttggattccgctaagcttgttcactacgatgtccttctatcctatcctaatgagaccaatgccaattatatctcaatcgtggatgagcacgaaaccgagattttcaagacaagctatttagaaccacctcccgatgggtacgagaacgtgactaacatcgtacccccatacaacgctttcagtgctcaaggtatgcccgagggtgatctggtatacgttaactacgctcgcacagaagattttttcaagttggaacgggagatggggattaactgcactggaaaaattgtcattgctcggtatggtaagattttcaggggtaacaaggtgaaaaacgctatgctggccggggccattggaatcattctctactccgaccccgcggattactttgcaccggaggtgcagccctaccccaagggctggaatctgccaggcacggcagcccagagaggaaatgtcttaaacttaaatggagccggagatcctttgacaccagggtatcctgccaaggaatatacgttcagactggacgtagaagaaggcgtgggaattccgaggataccagtgcacccaatcggttataacgatgccgagatcctactccggtatctagggggcattgcacctcctgacaaatcctggaaaggcgctctcaacgtgagctactcaatcggccccggatttacggggagcgactcctttaggaaagtaagaatgcacgtctataatataaataagattacacgtatctacaacgtcgtgggcaccatcagaggctctgtggagccagaccggtacgtgatcctgggtggtcaccgcgacagctgggtgttcggggctatcgatcccacttccggtgtcgccgtcctccaggaaatcgcacgatcctttggcaaacttatgtcgaaaggatggcgacctcgccgtacaatcatcttcgcatcttgggacgcggaagaattcggcctgctcggatccactgagtgggcggaggagaatgtcaagatcctccaagagagaagcattgcctatataaacagtgactcaagcatcgaaggcaattacactctgcgcgtggactgtacaccccttctgtaccagctggtgtataaactcaccaaggaaatacctagccctgacgacggctttgagtccaaatccctctatgaatcctggctggagaaagacccttctcctgagaacaagaacctgcctcgtattaacaagctgggaagcggatcggacttcgaagcttacttccagagactgggcatcgcgtcaggtagagcaaggtacactaaaaacaagaagaccgacaagtactccagctatccagtctatcacaccatctacgagactttcgagctggtggagaagttctacgacccaaccttcaagaagcagctcagtgtcgctcagttgcggggcgccctggtgtacgaactggtggactcaaagatcatacccttcaatatccaggattacgccgaagctctgaaaaattatgcagctagcatctacaacctttcaaagaagcacgaccaacagctgaccgaccacggcgtgtcttttgattcccttttctctgctgttaagaacttctccgaggcagcaagcgattttcataagaggctgatacaggttgatctgaataacccaattgccgtgcgaatgatgaatgatcaactgatgctgcttgagcgagcattcatcgatcccctcgggctgcccggaaaattattttatcgacatattatctttgccccaagctctcacaacaagtacgctggggaatcttttccggggatatacgacgcgatatttgacatcgaaaataaggccaatagtcgcctggcttggaaggaagtgaaaaaacatatatccattgccgcattcaccatccaggccgcagctggcacccttaaagaggtcctgtag

SEQ ID NO: 196433 - DNA, 1635 bp, Artificial Sequence
  Description of Artificial Sequence: Synthetic coding sequence
atgcagtggaccaaggtgctgggcctgggcctgggcgccgccgccctgctggggctgggtataatcctgggacactttgcgatcccaaagaaagctaacagcctggcacctcaagacttagacctggaaattctggagactgtcatggggcagctggatgcgcaccgtattagagaaaatctgagggaactgagccgggagccccatctggccagcagtccccgggacgaagacctcgtgcagctcctgttgcaaaggtggaaagacccagaatcaggactggactctgctgaggcatctacttacgaggtgttactgagctttccctcccaggaacagccaaatgttgtagatatcgtcggccccactggtgggatcatccatagttgccacaggacagaggagaacgtaacaggcgaacaggggggtcccgatgtggtccagccttacgcggcgtacgcccccagcgggaccccgcaagggctgctggtttacgcgaatcggggcgccgaagaagacttcaaggagttgcagacacaggggattaagctggagggcacgatagccctgaccagatacggaggcgtgggccgaggagctaaggcagtcaatgctgcaaaacacggggtggccggggtcctcgtgtacaccgacccagcagatattaacgacggattgtcttcacctgatgaaacattcccaaatagctggtacctgccaccatcaggcgtagaacgcggcagctactatgagtattttggggacccactcacaccttacctgcccgcggtgccttcatcattccgggtggatttagcaaatgtcagtggcttccctccaattcccacccaacctattggattccaggatgcccgtgacctgctgtgcaatttaaatggcaccctggcccccgcaacttggcagggagccctcggatgtcattacaggttggggcctggcttccgacccgatggagacttccccgcggacagccaagtgaacgtgagcgtgtataaccgcctagagctaaggaacagctccaatgtgctcggtatcattcggggcgctgtagaacccgaccgttacgtcctctacgggaatcacagagattcatgggtgcatggcgctgtggaccccagcagtgggaccgccgtgctgctggagctcagccgcgttcttggaaccttacttaaaaagggaacttggcgccctaggcgcagcatcgttttcgcatcctggggggccgaggagtttgggctgataggctccacggaatttactgaagagttcttcaacaagctgcaagagcggactgtcgcttatatcaacgtagatatttctgtgtttgctaacgctactctgcgtgtacagggcacaccaccagtccagtcagtggttttctccgcgacaaaggagattcgtagccccggccccggggacctgtctatttatgacaactggattcgatattttaacagatccagccccgtgtatgggctggtgcctcgtgctaggctgcagcctggtagcactccaccgaccacccagcccctgaccccgcttactatgtggaccagtttctggaccagagcctctgccgccattcggttatggccgggacagaggggtgtatag

SEQ ID NO: 196434 - DNA, 1569 bp, Artificial Sequence
  Description of Artificial Sequence: Synthetic coding sequence
atgcagtggaccaaggtgctgggcctgggcctgggcgccgccgccctcttggggctgggcatcatccttggtcatttcgccatcccaaaaaaggccaactcactagcgcctcaggaccttgaccttgagattctggagaccgtaatgggccagttggacgcacatcggatccgagagaaccttagggaacttagcagggagccccacctcgcaagctcccccagggacgaggacctggtccaactattgctgcagcggtggaaggaccccgagtcaggcctggattctgccgaggcatccacctacgaggttttactgtcgttcccgtcccaggagcaacccaatgtggtcgatattgtgggtccaaccggcgggattattcactcttgccacagaactgaagaaaacgtcactggggagcaagggggacctgatgtcgtgcagccgtacgccgcctacgctccatccggaactccccagggcttgctcgtgtacgccaaccggggggcagaggaggacttcaaggagctccagacacaaggaataaagctagagggcactatcgctctgactaggtacgggggggttgggagaggcgctaaggctgttaatgctgccaaacatggagtggccggcgtgctggtgtacaccgacccagctgatataaacgacggcctcagctctcctgacgaaacatttccaaactcttggtatcttcccccgagtggagttgaacgaggttcctactacgaatacttcggtgaccctcttacgccttacctgcccgccgtgcccagctccttccgcgtcgatcttgccaatgtgagcgggttcccaccaatccccacacagccaatcggttttcaggacgctagagatctcctctgtaacctgaacggaacactcgcccccgcgacatggcagggggccctggggtgtcattataggctcgggcccgggttccgccctgacggagattttcccgcagatagccaagtcaacgtcagcgtgtacaataggctcgagctaagaaacagtagcaatgtgctgggcatcatccggggggcagtggaacccgacagatacgtgctttacggaaaccatcgagattcatgggtgcacggcgccgtggacccctctagtgggactgctgtcctcctcgagctgtcgcgcgtgctggggactttgttaaaaaaaggcacatggcgcccccgtcgtagcattgtgttcgcgagttggggagcagaggagtttgggctcatcgggagcacagagttcactgaagagttttttaataagctgcaggagaggactgtcgcctatataaacgtcgatattagcgtctttgccaatgcaaccctaagagtgcaaggaacccccccagtgcagtctgtggtatttagcgccaccaaggaaatcagatcaccaggccctggagacctgagcatttacgacaactggatcagatactttaaccgctcttcaccggtgtacggtttggtaccacggctccagcaaccatcgggttgcgggcccgacagcggggagtgcgacagccctgcccagtag

SEQ ID NO: 196435 - DNA, 2223 bp, Artificial Sequence
  Description of Artificial Sequence: Synthetic coding sequence
atgcagtggaccaaggtgctgggcctgggcctgggcgccgccgccttgctcggacttggtataattctcggccacttcgcaatccccaaaaaagcaaattctctggcaccacaagacctagacttagaaattttggagacagtgatgggacaactggacgcccatcgcattagggagaaccttagggagctgagtcgtgagccccatctcgctagtagccctcgagacgaggatttggtgcagctgttactgcaacgctggaaggatccagagtccggcctagactccgccgaggcaagcacctatgaggtgctgttaagcttcccctcgcaggaacagcccaacgtggtggatattgtggggccaactggcggtattattcacagctgccaccgcaccgaagaaaatgtcactggcgagcaaggaggcccagatgtggtccaaccctacgcagcttatgctccaagcggaactccccagggactgttggtgtatgctaatagaggggcagaggaggattttaaggagctgcaaactcagggcattaaactggaggggactatcgcccttacccggtatggaggtgtcggacgtggcgcaaaagcagtaaacgcggccaaacacggagtcgctggcgttctcgtctacaccgatcctgccgacattaacgatgggctaagttctccagatgaaaccttcccgaacagttggtacctgcctccaagtggagtcgagaggggcagctactacgagtacttcggcgatccccttaccccttacctacctgcggtcccctctagtttcagggtagaccttgcgaatgtctctgggttcccaccgattcctacgcagccaattggatttcaggatgcaagggatctactgtgtaacttaaatgggaccttggccccagcgacatggcaaggggctctcgggtgtcactacaggctcggcccaggattccgacctgatggcgatttcccggcggacagccaggtgaatgtgagtgtgtataacagattggaattacgaaattcttctaacgttctcggcatcataagaggtgcagtcgagcctgatcgatacgtcctgtatggaaaccaccgagactcttgggttcatggcgcagttgatccatcctctggaactgccgtgctcttggagctgagccgcgtgttaggaaccctattgaaaaagggaacatggcggcctaggaggtccatcgtcttcgcctcttggggcgcagaagagttcggtcttatcggttcaactgagttcactgaagagttcttcaacaagttgcaggagcggaccgtcgcatatatcaacgttgacatcagcgtcttcgctaatgccactctgagagtacaggggacaccacccgtgcaatctgtggtattctccgccaccaaggaaatcagatcgccaggccccggcgacctctctatctatgacaactggattaggtattttaatcgcagttcgccagtctatggattggtcccttctcttggcagtctgggggccggaagtgactacgcccccttcgtgcacttcttaggaatttcaagcatggacatcgcatacacctacgataggagcaaaaccagcgcaagaatttaccctacataccatactgccttcgataccttcgactatgtggacaagtttctggatcccgggttcagcagccaccaggcagtagctaggacggccggatctgtcatcctgaggcttagcgacagctttttcctgccgctgaaggtaagtgactatagtgaaacacttagaagctttctgcaggctgcgcaacaagacctgggagccctgctcgagcaacattcaatttcgctgggaccgctagtcactgccgttgagaagttcgaagctgaagcagccgcattaggacagcggatttctactctacagaaaggatcacctgaccctcttcaggtgagaatgctgaacgatcagttgatgcttctagaacggacatttctaaatcctcgagcatttccggaagaaaggtattattctcatgtactttgggcacctcgtaccgggtcagtggtgacgtttcccggactaagcaatgcgtgttcacgggccagagacactgcctcaggatccgaagcctgggctgaagtccaaaggcagctgtccatagttgtgaccgcattggagggagccgctgccaccctgcgtccggtggcggatctctag

SEQ ID NO: 196436 - DNA, 2220 bp, Artificial Sequence
  Description of Artificial Sequence: Synthetic coding sequence
atgcagtggaccaaggtgctgggcctgggcctgggcgccgccgccctattggggctggggatcattttgggtcacttcgcaatacccaaaaaagctaactcacttgctccccaggacttagacctcgagatcctcgagaccgtcatgggccagctggacgcacaccggattcgcgagaacctgcgcgaactcagccgggagcctcacctcgcttcatcccctagggatgaagatctggtgcagctcctcctccagagatggaaggaccccgagagcggcctggatagtgccgaggcaagcacatacgaggtgcttctgagctttcccagccaggagcagccaaatgtagtcgacatagttggcccaacaggaggtatcatccacagttgccataggaccgaagagaacgtcacaggtgagcaaggtggtcccgatgttgtgcagccatacgctgcgtacgctcccagcgggaccccccagggcttactcgtgtatgcaaataggggtgctgaggaggacttcaaagaactgcagacccagggcatcaagctcgaaggaacaatcgccctcacacgctatggcggcgtcggcaggggcgctaaggccgtcaacgcggccaagcacggagtcgcaggggtgttggtgtacaccgacccagcagatattaatgacggcctgtcctcaccggacgaaactttcccaaacagctggtatctccctccatctggagtagagcgtggctcttactatgagtactttggcgacccgctcaccccgtaccttcccgccgtcccttctagtttccgagtagacctggcaaacgtgtctggctttccccccatccccactcagcctatcggtttccaagatgctagagatctcctgtgcaatctgaatggcacactcgcccccgcgacctggcagggcgctctgggatgtcactataggttaggaccaggatttcggcccgatggggactttccagccgacagccaggtcaatgtctccgtttataaccgccttgagctacgcaacagctccaacgtgctcgggattattaggggcgcggtcgagccagatcgctacgtgctgtatgggaatcatagagattcctgggtgcatggagcagtcgacccctcatctggcactgccgtgctgctcgagttgagtagagtgttaggcactttgctcaaaaagggtacctggcggcccagaaggagcatcgtgtttgcctcctggggcgcagaagagttcggtctgatcgggtccactgaattcacagaggaattcttcaataagttgcaggaacgtaccgtagcctacattaatgtagacattagcgtgttcgccaacgccaccttaagagtccagggcactccgccggtgcagagcgtggtctttagcgctacaaaggagataaggtctcccggtccaggtgatctgtcgatttatgataattggattaggtactttaataggtcatcacccgtgtacggtctggtgccctcactgggcagcctcggggcgggcagtgattacgcaccctttgtccacttccttggaatctccagcatggatattgcttacacttatgatagatctaagacaagcgctagaatttacccaacctatcatactgcctttgatacttttgactacgtggacaagttcttagaccctgggttttcaagccaccaagccgtcgcccggacggccgggagtgtgattctgaggttgagtgactcttttttcttgcctcttaaggtgtccgactattccgagacattgcggagctttctacaagccgcacagcaggacctgggcgctctgctagagcaacacagtatatccctcggcccattggtgaccgcggtggagaaatttgaggcggaggccgccgccctcgggcaacgtatttctaccttgcagaaaggcagccccgatcccctccaggttcgcatgctgaatgaccagctcatgctgctggaaagaacctttctgaatcccagggcctttccagaggagagatattacagtcacgttctttgggcccctcgaggactacggtctcacatcccagggttatctaacgcctgctctagggcaagagatactgcctctggtagcgaggcatgggcggaggtgcagagacaattgtcaattgtggtgacggccctggagggtgcagccgccacactcagaccagtggccgatctttag

SEQ ID NO: 196437 - DNA, 405 bp, Artificial Sequence
  Description of Artificial Sequence: Synthetic coding sequence
atggagatcagcaagaagatcaagacccagtggaccagcctgggccttgaggatgtccagtttgtcaactatagtgtgctacttgaccttcctggaccatcaccgtccaccgttactttgtcatccagcggccagtgcttccacccaaatggccagccctgtagtgaggaagctagaaaggactcttcccaggatcttctctattcgtatgctgcttatagcgctaagggtactctgaaagctgaagtcattgatgtgagctacggcatggccgatgacctaaaaaggatcagaaaaattaaaaatgtgaccaatcaaattgctctgctaaaacttggcaagctgccgctgctctacaaaatgaaggtcctggacaaggccgaccaaacgtcacctctctactag

SEQ ID NO: 196438 - DNA, 2388 bp, Artificial Sequence
  Description of Artificial Sequence: Synthetic coding sequence
atgggcgagaacgaggccagcctgcccaacaccagcctgcagggcaaaaaaatggcttaccagaaggtgcatgcagaccagagagcgccgggccattcccagtatctggataatgatgacttgcaggcaactgctttggacctcgagtgggacatggagaaggaactggaggagagcggcttcgaccagtttcagctggacggcgccgaaaaccagaacttgggccattcagagactattgatcttaatttagatagcattcagcctgccacatctcccaagggccggttccagaggctccaggaagagtcagattatatcacacattacaccagatcagcccccaaaagcaatcggtgtaacttctgccacgtgctcaagatactgtgtaccgcaactattctgtttatctttgggatcttgatcggctactacgtgcatacaaattgtccctcagacgccccctcaagtggcaccgtggatccacaactgtaccaggagattctaaagaccatccaagccgaggatatcaaaaagagcttcaggaacttagtccagctgtataagaacgaagacgatatggagatctcaaaaaagattaaaactcagtggacctcccttggactggaggacgtgcagtttgtaaattatagcgtactcctcgacctgcccggccccagcccttctaccgtgacactctctagcagtggccagtgctttcaccccaatgggcagccttgttcagaggaagctaggaaggatagctcccaggatcttctgtactcctacgcagcttattccgcaaagggcacccttaaggctgaagtgatcgacgtttcttacggcatggccgacgacttaaagcgtatacgaaaaatcaagaacgtgacgaatcaaattgccctgctgaaactcggaaagctcccgctgctctataagctcagctctttggagaaagcagggtttggtggagtgctgctgtatatcgacccctgcgatctccccaagacggtgaatccctcacatgacacattcatggtgagtctgaatcctgggggtgatcctagcacacctggatatccctcagttgacgaatcgtttcggcagtcccggtcgaacttaacgtcactgctggtgcaaccgatctcagctcccttagttgccaagctcataagctctccgaaggcccgaaccaagaatgaggcttgcagctcactggagctgcccaataatgagattagggtcgtgtccatgcaggtgcagactgttaccaaacttaagactgtcaccaacgtcgtagggtttgtgatgggcctcacgtctccggatagatacataattgtggggagtcaccatcatacggctcattcgtataatggacaggagtgggcttcatcaaccgccattattaccgccttcataagggccctgatgtccaaggtgaagaggggttggcgtccagaccgtaccatcgtgttctgttcctgggggggcactgctttcgggaacatcgggtcttatgagtggggcgaagactttaagaaggtgcttcaaaaaaacgtggttgcttacatatccttacactctccgattcgcggaaacagttcgctgtaccctgtggcttcgccatccctgcagcagctagtggtagaaaagaataatttcaactgcacacgacgggcacagtgccctgagacaaatattagctctattcaaatccagggagacgccgactatttcatcaaccacctgggcgtgccgatcgtgcagttcgcctatgaggatattaagactttggagggtccctctttcctgagcgaagcccgatttagtactagggctacaaagatcgaggaaatggacccatcttttaatcttcatgaaaccataacaaagctctctggggaggtgatattacagattgcgaacgagccggtgttgccttttaatgcattagacatagcattagaggttcaaaataacctgaagggagatcaaccgaatacacatcagctgctggcaatggcgcttagacttcgcgagtcagcagagctgttccaaagtgacgagatgaggcctgctaatgaccccaaggagcgtgccccaattcggatccgaatgctgaacgatatccttcaggacatggaaaaatctttcctggtgaaacaggcccctccaggtttctaccgcaacatactttaccacctcgatgagaagacttctcgcttttctatcctgattgaagcctgggagcattgcaagccactcgcttctaacgagaccctgcaagaggcactcagtgaggtcctgaacagtattaattctgcgcaggtgtactttaaggctggtctggatgtgtttaagagcgtattggacggcaagaattag

SEQ ID NO: 196439 - DNA, 1236 bp, Artificial Sequence
  Description of Artificial Sequence: Synthetic coding sequence
atgctgctgaagaccgtgctgctgctgggccacgtggcccaggtgctgatgctcgacaatgggcttctgcagaccccacccatgggatggctggcctgggaacgtttcaggtgtaatatcaactgcgatgaggaccccaaaaattgcatcagtgaacagctgtttatggagatggcagatcggatggcccaggatgggtggcgggacatgggctacacctacctgaatatcgatgactgttggataggaggaagagatgccagcggccgcctaatgccagacccaaagcgattcccacacggaattcctttcctggccgactatgtgcactcattgggtctgaagttgggaatctacgctgatatggggaattttacttgcatggggtacccaggcactaccctggacaaggtggtccaggacgctcaaacctttgcagagtggaaggtggatatgctcaaactggacgggtgttttagtaccccggaggaaagagctcagggataccctaagatggctgccgcactcaacgccaccggacgccctatcgctttttcttgtagttggcccgcatacgaagggggactgccgccacgggtgaactatagcctgctagcggacatatgtaatctatggcggaattacgacgatattcaagattcatggtggtcagtactctctatacttaactggttcgttgagcatcaagatattctccagcctgtagccggacccggacattggaatgaccccgacatgcttctcattggcaattttggactctccctggagcagagccgcgctcagatggctctgtggactgtgttggctgcgccactgcttatgtccaccgacctacggacaatcagcgcacagaacatggacattcttcagaatcctcttatgattaagattaaccaggatcccctggggattcaggggcgcaggatccacaaagagaagtcactgatcgaggtgtacatgcgcccactgtccaataaggctagtgcattggtttttttctcctgtaggacagatatgccataccgctaccactcaagcttgggacagctgaacttcacggggagcgtgatatatgaggcccaggacgtgtacagcggcgacattataagcggcctgagggacgagacgaatttcaccgtgattatcaacccgagtggagtcgtcatgtggtatctgtaccctatcaagaatttagagatgtcacagcaatag

SEQ ID NO: 196440 - DNA, 1236 bp, Artificial Sequence
  Description of Artificial Sequence: Synthetic coding sequence
atgctgctgaagaccgtgctgctgctgggccacgtggcccaggtgctgatgctggacaatgggcttctacagaccccccctatgggctggcttgcttgggagaggttcagatgcaacataaactgcgacgaagatcccaagaattgcatttccgaacagctcttcatggagatggctgatcgaatggcgcaggatggttggagagacatggggtacacatatttaaatatcgatgattgctggatcggtggtcgcgacgcgtctggccggctgatgccagaccccaaacgatttccccatggcattccattcttagcagactatgttcactccctgggactgaaactgggtatttacgcagatatgggcaactttacatgcatgggataccctggaacaacgttagataaggtggttcaggacgcccagacctttgccgagtggaaggtggacatgctgaagctggatggctgcttctctacgccagaggaacgcgcccaggggtatcccaagatggccgccgccctgaacgcaaccgggcggcctatagccttctcttgtagctggcccgcttacgagggaggattgccccccagagtcaactactctttactcgccgacatctgtaatctgtggagaaattatgacgacattcaagacagctggtggagtgtcctgagtattttaaactggttcgtcgagcatcaggatattctgcagccagtcgccggcccgggccactggaatgacccagacatgttacttatcggtaacttcggtttatctttggagcaatcacgcgctcagatggcactgtggacagtgttggcagctcccttgctgatgagcaccgatttgcgcacaataagcgcgcagaacatggacatcctccagaaccctctgatgataaagatcaaccaggatccactgggcatacaggggaggcgcatacataaggaaaagtcactgatagaggtgtacatgcgccccctgtcgaacaaagcttcagctctggttttttttagttgtaggacagacatgccctatagatatcattcgtcccttggccagctaaatttcacaggaagcgttatttatgaggctcaagacgtgtactcaggcgatatcatatctggactgcgtgatgaaaccaacttcacagtcataataaacccctctggcgtggttatgtggtacctgtaccctataaagaatctggagatgtcgcaacagtag

SEQ ID NO: 196441 - DNA, 1236 bp, Artificial Sequence
  Description of Artificial Sequence: Synthetic coding sequence
atgctgctgaagaccgtgctgctgctgggccacgtggcccaggtgctgatgctcgataacggactcctccagactcctcctatgggctggttagcgtgggagcggtttcggtgcaacattaactgtgatgaagaccctaaaaactgtatatccgagcaactgtttatggaaatggccgatcgaatggcccaagacggatggcgtgatatgggctatacatatctgaatatcgatgactgttggattggcgggcgagatgcatctggtagactaatgccagatcctaagaggttccctcacggaatccccttcttggctgactatgttcattccttgggattaaagctgggcatttacgcagatatgggaaactttacttgcatgggctaccccgggaccactttggataaggttgtgcaggacgcacaaacctttgccgaatggaaagtggacatgctgaagctcgacggatgtttcagcacccccgaggagcgggctcaggggtatcctaaaatggcggccgcccttaacgccaccggcagacccatcgcgttcagttgctcttggcccgcatatgaaggcggcctgccgccccgagtgaactactccctgctcgcagacatttgcaacctctggcgcaactacgatgatatccaggatagctggtggagcgtcctctcgatcctgaattggttcgtggagcaccaggatattttgcagccagtggcaggaccaggacactggaacgatccagatatgctgctgatcgggaattttggtctgtccctggagcagagcagagcacagatggctctgtggaccgtcctggccgccccgcttctaatgtctacggatctccgcaccattagtgctcagaatatggatattctgcagaaccccttgatgattaagatcaaccaagatcccctagggattcaaggccggagaattcacaaggaaaaaagtctgattgaagtctatatgagaccgttatcaaacaaggcttccgcccttgtgtttttctcttgccggacagacatgccttacagatatcattcgagccttggccagctaaacttcaccggtagcgtcatctatgaagcccaggacgtatattcaggcgatatcatctcaggcctgcgggacgagacgaactttacagtgatcatcaatccgtccggagtggttatgtggtatctgtacccaattaaaaacttggagatgagccagcagtag

SEQ ID NO: 196442 - DNA, 1035 bp, Artificial Sequence
  Description of Artificial Sequence: Synthetic coding sequence
atggccgccatctacggcggcgtggagggcggcggcacccggagcgaagtactgctggtttcagaggacggcaagattctggctgaggccgacggactgagcaccaatcactggcttatcgggaccgacaagtgcgtggagaggattaacgagatggtcaaccgagcaaaacggaaggctggcgtcgatcccctggtccctctgagaagcctgggactctctctcagtggaggtgaccaggaggatgcaggcaggatcctgattgaggaactacgggatcgcttcccgtacctaagcgagtcctacttgatcacaactgacgccgctggttcgatcgccaccgctacacctgatggtggcgtcgtgctaatttctggaacggggtccaattgcagattgattaacccagacggaagcgaatccggatgcggtgggtggggccacatgatgggggatgagggctcagcatattggatagcacaccaagccgtgaaaatcgtctttgatagcattgataacctggaggctgccccacacgatattggatatgtgaagcaggccatgtttcactactttcaggtacccgacagactaggcatcctgacacatctttaccgagatttcgataagtgccgcttcgccggcttctgccgaaagattgcagagggcgcacagcaaggggatccattatcccggtacatctttaggaaggctggggaaatgttgggtcgccatatcgttgctgtgctgccagagattgaccctgtcctgtttcaaggcaagattggcttgcctattctctgtgtagggagcgtttggaagagctgggaattactgaaagaaggctttctgctggcccttacacaggggagggagatccaggcgcagaacttcttctccagcttcacactaatgaaactccgtcatagcagtgcccttggcggcgcatcactgggcgcccggcacattggacacctactgcccatggactacagcgcaaacgcgattgccttttattcctatactttcagctag

SEQ ID NO: 196443 - DNA, 1173 bp, Artificial Sequence
  Description of Artificial Sequence: Synthetic coding sequence
atgcggacccggaccggcagccagctggccgcccgggaggtgaccgggtcaggtgctgtgcctcgccagttagaagggcggcgatgccaggccggccgagacgccaatggtggaacatctagtgacggttcttcgtcaatggccgccatttacggcggggtggaaggtggaggaacccgctccgaggtgctgctggttagcgaagatggcaaaatcttagctgaggcggacggcttatcaaccaatcattggcttatcggaaccgataagtgtgtagaaagaatcaacgagatggtgaaccgcgcaaaacgaaaagctggggtggatcctttggtccctctgaggtcacttggcttatctctgtccggcggggaccaggaagatgccggtagaattctaattgaagagcttagagatagatttccgtaccttagcgagtcatatttgataaccaccgacgcagccggctccatcgctactgcaacgccagacggcggcgtagtgttgatctctggcactggatctaactgtaggcttattaatcccgacggttctgaatcgggatgtggtgggtggggacacatgatgggggacgaagggagcgcctactggattgcccaccaggcagtcaagatcgtttttgactcaatcgataaccttgaggccgcgccccatgatattggatatgtcaaacaggcaatgtttcactacttccaggtgccggatcgcttgggcatcctcactcacctgtaccgcgattttgataagtgtcgatttgctgggttctgtagaaaaatcgccgaaggcgcccagcagggggaccctctcagccgatacatttttaggaaagccggcgagatgctggggcgccatatcgtggccgttttgcctgagatcgatcctgtcctcttccagggaaaaatcgggctacccatactttgcgtgggaagcgtgtggaagagttgggagctcctaaaggaggggttcctgctagctctgacgcagggcagggagattcaggcccagaactttttttcgagtttcacactcatgaagctgagacactcttcagccctgggcggcgcctcgttaggcgcaaggcacattggccacttgctcccaatggattattctgcaaacgcaatcgctttctatagctatacattttcttag

SEQ ID NO: 196444 - DNA, 1548 bp, Artificial Sequence
  Description of Artificial Sequence: Synthetic coding sequence
atggccaccagcaccggccggtggctgctgctgcggctggccctgttcgggtttttgtgggaggcctcggggggcctagactccggcgcgtcaagagacgacgatctcctcttaccataccctcgggcccgtgccagattgcctcgggactgcacaagagtcagggcgggcaacagagaacacgaatcctggccgccgcctcctgctacgcctggtgccggtggcctagccgtgcgcactttcgtgtctcatttcagagatcgcgccgtggcaggacacctcacgcgcgccgtggaaccactgcgtaccttttccgttttggaacccgggggccctggaggctgcgccgcacggcgcagagctacagtagaggagacagctagagcggccgattgtcgcgtggctcaaaatggggggttttttagaatgaattccggggaatgtcttgggaacgtggttagtgacgagagacgggtctcaagtagcgggggcctacagaatgcccaattcggcatccgcagagacggaacactcgtgaccggatacctctctgaggaagaagtcctggacacagaaaatccttttgtgcaattgctaagcggagttgtttggctaatccggaatggaagtatttacattaatgagagccaggccacggagtgtgacgagacccaagagaccggaagcttctctaagtttgtcaacgtcatctcagcacgaaccgctattgggcatgatcggaagggtcaactggtactgttccatgccgatggacaaaccgaacagagggggattaatctttgggaaatggccgagttcctgctcaaacaggacgtggtcaacgccatcaacttggacggggggggcagcgccaccttcgtgcttaacgggacattagctagctatccttctgaccattgccaggataatatgtggcgatgccctcgtcaggtgtccactgtcgtgtgtgtccacgagcctcgatgtcaaccaccggattgccatggtcacggtacttgcgtagacgggcactgtcagtgcactgggcacttctggagaggacctggctgcgacgagctggactgcggcccaagtaactgttctcagcacggcctctgtacagaaaccggctgcagatgtgatgctgggtggactggttccaactgcagcgaggaatgccccctggggtggcatggtcccggctgccagcggccttgcaaatgtgagcaccactgtccctgtgatcctaagactggcaactgttctgtttcccgcgtgaagcagtgtttacagccacctgaggccaccctgcgagccggcgagctctcattctttacgcgcaccgcttggttagcactcacattagcgctggccttcctgttgctgatctccaccgccgccaacctgtctcttctcctcagccgagcagaaagaaacagaaggctccacggcgattatgcctaccacccattgcaggaaatgaatggggaacccctggcagccgagaaagagcagcccggtggggcacacaacccatttaaggactag

SEQ ID NO: 196445 - DNA, 1446 bp, Artificial Sequence
  Description of Artificial Sequence: Synthetic coding sequence
atggccaccagcaccggccggtggctgctgctgcggctggccctgttcggctttctttgggaggcctccggaggtctggattcaggggcgtccagggacgacgatctccttcttccctacccccgtgcacgagcacggttgccacgagattgcacaagagtgcgggctggtaatcgcgaacatgaaagttggccaccaccccctgccacccccggggcaggcgggttggcagtgcggacatttgtttcacacttcagagatcgggccgtggcgggacacttgactcgtgccgtggagccactgagaactttcagcgtcctggaaccgggaggtcctggaggctgtgcagcaaggaggcgcgctactgtggaagaaaccgccagagccgcggactgcagagttgcccaaaatggagggtttttccgcatgaattccggtgagtgcctgggaaatgtggtcagcgatgaacgtcgcgtgtcaagctctggggggctgcaaaatgcccaattcggcattagacgagatggcacactggttaccgggtatttgagtgaggaggaagtcttggatacagagaatccattcgttcagctcctcagcggcgttgtttggttgattagaaatggctccatctacattaacgagtcccaggcaactgagtgtgatgagacccaagaaaccggctcattcagcaaattcgttaacgtcatttctgcaaggaccgctattggccacgacagaaaaggacagttggtgctgtttcatgctgatggccagaccgaacaaaggggcattaacctatgggagatggctgagttccttctgaagcaagacgtcgtgaacgccatcaaccttgatggaggcgggtccgccacatttgtgttgaacggtacccttgcgtcctatccgtcagaccactgccaggacaacatgtggcggtgccctcgacaagtcagcaccgtcgtatgcgtgcacgagccccgctgccaaccgccagattgtcatggccacggaacttgcgttgacggacattgtcaatgcaccggccatttctggaggggacctggctgtgacgaactggattgcggacctagcaactgtagccagcatggcctctgtacagagaccggatgccggtgtgatgccggctggacagggagcaattgcagcgaggtcaagcagtgtcttcaacctcctgaggcaacactgcgagccggtgaactatcatttttcacacggacagcctggttggctttgaccctcgccctggctttcttgctgctaattagcacggcagctaaccttagtctgttgttgagtcgagccgaacgtaaccgtcgactccatggagattacgcataccaccctctgcaggaaatgaatggcgagcctttagctgcggaaaaggaacagcctgggggcgcacacaacccttttaaggattag

SEQ ID NO: 196446 - DNA, 2514 bp, Artificial Sequence
  Description of Artificial Sequence: Synthetic coding sequence
atggccgagcccagccaggcccccacccccgcccccgccgcccagccacgtccactccaaagccctgccccagctccgaccccaacaccagccccctccccagctagcgcacctattcccactcccactccagcgcccgcacctgcacctgccgcggcccctgcagggtccaccggaaccggaggtccgggagtggggtcggggggggccggctcaggcggcgatccagccagacccggactgtcacagcagcaacgtgccagtcagcgtaaggcccaggtgcgagggctgccccgggcaaaaaagctggagaaactcggggtgttcagcgcttgtaaggcaaacgagacttgcaaatgtaatggttggaagaaccctaagccacccaccgcgccccggatggaccttcaacagcccgccgccaacttaagcgagctctgcagaagctgcgagcatcccctggctgatcacgtcagtcacttagagaatgtgtcggaagacgaaatcaatcggctccttggcatggtagtggatgtcgagaatctcttcatgtccgttcacaaggaggaggacacagacaccaaacaagtctatttctaccttttcaaactacttaggaaatgtatccttcagatgactaggccagtcgtggagggaagtcttggctccccgccattcgagaagccaaacatagagcagggggtactgaactttgtgcagtacaaattttctcacctggctccaagagagaggcagactatgttcgaactgtcaaagatgtttctcctgtgcctcaattattggaagttagaaaccccagcccagttcaggcagcgctcacaggcagaagatgtggcaacctacaaggttaactacaccagatggttgtgctactgccacgtgcctcaatcctgtgactcattgccacggtatgagaccacccacgtctttggcagaagccttctgcggagcatttttacagttactcggcgacagctattggagaagttcagggttgagaaagacaaattagtgccggaaaagcggaccctgatcctgactcactttcccaaatttctcagcatgctggaggaggagatctacggggccaatagccccatttgggaatccggctttacaatgcccccttcggaggggacccagctggtgccacgtcccgcatctgtgagcgcagcagtggtcccaagtacacctattttctcccccagcatgggaggcggatctaactcgtccctgagcctggattctgctggcgccgaaccaatgcctggcgaaaaaaggactttgcctgagaacctgaccttggaggacgctaaacgactgcgcgtcatgggcgacatacctatggagctggtgaacgaagtgatgctgacaattaccgacccagccgccatgttgggccctgagacaagtctactaagcgccaatgcggcccgagacgaaactgccagacttgaggaacgtcgcggtataattgagttccacgttataggcaattcactgacgcctaaagccaaccgaagagtgctactgtggcttgtcggactccagaacgtcttttcccatcaacttccacgcatgcctaaagagtatatcgcccgcctggtgttcgaccccaagcataagacattagcactgataaaagatgggcgggttattggaggcatctgcttccgtatgttcccaacccagggcttcactgagatcgtgttttgtgcggtgacctctaacgagcaagtgaagggatatggtacccaccttatgaatcacctgaaggaatatcatattaagcacaatattttatactttctgacatacgcagatgagtatgctatcggttattttaaaaaacagggcttctccaaggacattaaggtccccaagtcacgttatttgggatatattaaagattatgaaggcgcaacactgatggagtgtgagctgaatccgagaatcccatacaccgaactgtctcacatcattaagaagcagaaagaaatcataaaaaagttgatcgagcgaaagcaagcccagatccggaaggtgtacccgggtctgtcatgtttcaaggaaggagtgcggcagatcccagtggagagtgtgcccgggatccgggagactggctggaagcccttaggaaaggagaaaggcaaagaattaaaggatcccgaccagctctacaccaccctgaaaaatttgctcgcccagattaagtcgcatccatctgcttggccgtttatggaacccgtcaagaagtctgaggcacctgactattacgaggtcattagatttccaatagacctcaagactatgaccgaacgcctccggtcccgctattacgtaacccggaaactctttgtagcggatctgcagcgtgtcatcgccaattgccgggaatacaaccctccggatagcgagtactgcaggtgtgcatctgcattagagaaattcttctacttcaagctcaaagagggaggcctgatagacaaatag

SEQ ID NO: 196447 - DNA, 1260 bp, Artificial Sequence
  Description of Artificial Sequence: Synthetic coding sequence
ccccagtgctgcctgcacagccggggcatgttcccccggctgagccctgtcgacactgaggccgtgtggctgctgcagggttggctgtttcaacatcaacctcagttttggggcccagcacagatcagagcggtccttggcgccgtgcctcgcggtcgcctcctggttctagatctgtttgcggaatcccagcccgtctacacccgcaccgcctcattccaaggacaacctttcatttggtgcatgttacacaactttgggggaaatcacgggctgtttggagccttagaagccgtcaacggcggtccagaggctgcacgccttttccccaatagcacaatggtggggacgggaatggctcccgagggtatcagtcagaatgaggtagtttatagcctcatggctgaactagggtggaggaaagaccctgtgccagatcttgctgcctgggtcacctcctttgccgcccgacgttacggagtaagccaccccgacgcaggcgcggcctggcggctgctcttaagatccgtatacaattgctcaggagaggcctgcaggggtcacaatcgctctccgctggtacgcagaccgagtttgcagatgaatacctccatatggtataaccggagtgacgtgtttgaggcctggcgcctacttctcacgagcgcacccagcctagcaacatcccccgcctttcgctacgatctgctggacttgaccaggcaagccgtgcaagaactagtgtctctttactacgaagaagcgaggtccgcttacctatctaaagagctggccagcctgctcagggctggcggggtgctggcctacgagcttctcccagcactggacgaggtgctcgcgagtgatagccggttcctcctgggaagttggctggaacaggctcgtgctgctgcggtgtccgaagcggaagctgacttttatgagcagaatagccgttatcagctgacactatgggggccggaagggaacatcttggattacgccaacaagcagctggcggggctcgtcgcaaattactacacccctcggtggcggttgtttttagaggccctagtggactctgtggcacaaggtatcccgtttcagcaacatcagttcgataagaacgtattccaattggaacaagcattcgtgctgagcaagcagcgctaccctagtcagccaagaggagatactgtcgacctagccaagaagattttcctcaagtactaccctcgttgggtggcaggaagctggtag

SEQ ID NO: 196448 - DNA, 963 bp, Artificial Sequence
  Description of Artificial Sequence: Synthetic coding sequence
atggccttccccaagaagaagctgcagggcctggtggccgccaccatcacccctatgaccgagaacggggaaatcaatttctctgttatcggacagtacgtggattacctggtgaaggaacagggggtgaagaatatctttgtgaacggcactaccggagagggcctgtcactgtccgtgtcagagcggcggcaggtggccgaagaatgggtcacaaaaggtaaagataaattggatcaggtgattatacacgtgggggccttgagtcttaaagagagccaggaactggcacagcatgctgccgagattggggccgacggtatagcagtcattgcccccttttttctcaaaccatggacaaaagatattttgattaattttctcaaagaggtggccgcagccgctccagccctccctttctattactatcacatcccagcccttaccggcgtcaagatcagagccgaggagctgttggatgggatcctggacaaaatccctactttccagggactcaaatttagcgacacagatctcttggatttcggtcaatgcgtcgatcagaatagacagcaacagtttgcctttctgttcggtgtggacgaacagctcctcagtgccctagtgatgggtgccaccggcgccgttggcagcacatataactatctggggaagaagacaaatcagatgctcgaagccttcgagcagaaggacttctcactggccctcaactatcagttctgcattcaaagattcatcaacttcgtagtcaagcttggattcggggtctctcaaaccaaagcaatcatgaccctcgtttcaggcatcccaatggggcctcctagacttcctcttcagaaagctagtcgagagttcacagatagcgccgaggccaagctgaagagccttgactttctgagctttactgaccttaaagacggcaacttggaagccggcagctag

SEQ ID NO: 196449 - DNA, 330 bp, Artificial Sequence
  Description of Artificial Sequence: Synthetic coding sequence
atggccttccccaagaagaagctgcagggcctggtggccgccaccataacacctatgactgagaacggtgagattaacttcagtgtgatcggacagtatgttgattatcttgtcaaggaacagggagttaagaatattttcgtcaacggaacgactggcgagggactctccctgtcagtaagcgagcggagacaggtagccgaggaatgggtgaccaagggcaaagataagtctaatcatcacaagctcggaactattcgcactactcagtcccgcagatcttctttccggcgacagttaaaagcctggcactctggatctcatctgtag

SEQ ID NO: 196450 - DNA, 558 bp, Artificial Sequence
  Description of Artificial Sequence: Synthetic coding sequence
atgagccgggcccccggcatcctggccagctggcggcgggccccctcactgagtgtccagaagggttctcaaaccgcccggcacacctgccaccccgaagttccacttggaaattgcttcctccctgtatataaggcctcccccctgactgtgacccgcctctgggctgagagactggatcaagtgatcattcacgtgggggccctgagtctcaaagagtcccaggagcttgcacaacacgcagcagaaatcggcgccgatggaattgcagtcattgcccccttttttctaaaaccatggaccaaagacatccttattaattttctgaaagaggtggcagctgcagccccagccctgcctttctattattatcatattccagccttaacaggcgtcaaaattcgtgctgaggagctgctggatgggatcctggataagattccgacattccaggggctaaagttctccgatactgatctgctcgattttgggcagtgcgtggaccaaaataggcagcagcagtttgcatttctcttcggcgtagacgaacatctctag

SEQ ID NO: 196451 - DNA, 723 bp, Artificial Sequence
  Description of Artificial Sequence: Synthetic coding sequence
atggccttccccaagaagaagctgcagggcctggtggccgccaccatcacccctatgaccgagaacggcgaaataaatttcagcgtcatcgggcagtatgtggactaccttgtcaaggagcaaggcgtgaagaacatatttgttaacgggactacaggcgaggggctgtccctgagcgttagcgagcgtcgacaggtggcagaagaatgggtgaccaagggtaaagacaaactcgaccaggtaataatccacgtcggcgcactgagtcttaaagagagccaggagctggcgcagcacgctgcagaaatcggagcagatggtattgccgtcatcgccccgttcttcctgaaaccttggacaaaggacattctcattaattttcttaaagaagtggccgcagccgcgcctgctctgcccttttactactaccacattccagccctaacaggggtgaagatcagagctgaagagttactcgacggcatcctcgataaaatcccaacatttcaaggcctgaagttcagcgacacagatctcctagacttcggccaatgtgtcgaccagaacagacagcagcagtttgcattcttgtttggcgtggatgaattttgcatacagcgctttatcaatttcgtagtgaagctcgagaactctaaattaaaagtctcaaagaaccagcgtaccttgccgctaggcaccacgaacttccctttcctgcactag

SEQ ID NO: 196452 - DNA, 963 bp, Artificial Sequence
  Description of Artificial Sequence: Synthetic coding sequence
atggccttccccaagaagaagctgcagggcctggtggccgccaccatcacccccatgactgagaacggggaaatcaattttagcgttatcggccagtacgttgactacttggtgaaagagcaaggcgtgaaaaatattttcgtgaatggcaccactggggagggcctctcgcttagtgtgtctgaacgtcgtcaggtggctgaagagtgggtcactaaagggaaggacaaactggaccaggtgattatccacgtgggagcactgtctttaaaggagtcacaggagcttgctcagcacgccgcggagataggtgccgatggtatagccgtgatcgctcctttttttttaaagccttggacaaaggacatcctgatcaactttttaaaagaagtcgctgccgccgccccagcacttccgttttattattatcatatccccgctctgacgggcgttaaaatacgagccgaggagctactcgacgggatactcgacaaaataccaacgttccagggtctcaagttctccgacacagatctgctcgatttcgggcagtgcgttgaccagaatcggcagcaacaattcgctttcctgttcggggtggatgagcaactactctcagccctggttatgggagcaactggagccgtcggatccacatacaactacctgggaaagaagacaaaccaaatgttggaggcttttgagcagaaggacttctcactagccctaaattatcagttttgcattcagcggttcatcaattttgttgtgaagctcggatttggagtgagccagaccaaagcgattatgacccttgtttcaggcattccaatgggaccaccacggcttccccttcaaaaggcgtcccgagaattcaccgacagcgctgaggcgaagctgaaatccttggacttcctctccttcacagatctgaaagatggtaatttggaggcaggatcctag

SEQ ID NO: 196453 - DNA, 906 bp, Artificial Sequence
  Description of Artificial Sequence: Synthetic coding sequence
atgagccgggcccccggcatcctggccagctggcggcgggccccctcgttaagcgtccagaaaggcagccagactgctcggcatacttgtcatcccgaagtgcctcttggcaactgcttcctgcccgtctataaggcgagcccactgacggtaactcgtctctgggctgaacgactggatcaagtgattattcatgtcggcgcactctcgctgaaagagtctcaagaactcgcccagcacgccgccgagatcggcgccgacggaatcgctgttattgcccccttcttcctgaaaccgtggaccaaagacatcctcataaatttccttaaggaagtggccgccgccgcaccagcactgccattctactattatcacatccccgcactgaccggggtaaagattcgggccgaggaattattggatggcattttagacaaaattccaacatttcaaggacttaaattttccgacaccgatcttctcgactttggccagtgcgtagatcaaaacaggcagcagcagtttgcattcctcttcggcgttgacgagcaattgctgagcgcgttggttatgggggcaactggcgccgtgggcagcacttacaattatctcgggaagaagacaaatcaaatgttggaggcattcgagcaaaaggatttcagcctggccctgaattaccagttctgcattcagcggttcatcaattttgttgtaaagctcggattcggggtatcccagacaaaagcgatcatgactctagttagcgggatccctatgggtccaccccgattaccgcttcagaaggcatcacgggagttcactgactccgcagaggccaagcttaagtccctggactttctgtcgtttaccgatcttaaggatggaaacctcgaggccgggtcgtag

SEQ ID NO: 196454 - DNA, 723 bp, Artificial Sequence
  Description of Artificial Sequence: Synthetic coding sequence
atggccttccccaagaagaagctgcagggcctggtggccgccaccatcaccccaatgacagaaaatggagaaatcaatttttccgtgatcgggcagtatgtggactacctggtcaaggagcagggtgtaaagaatattttcgtgaatggcaccaccggtgaagggctaagcctgtccgtttctgagcgacgacaagttgctgaggagtgggttactaaaggcaaagataaactagatcaagtgatcatacacgtgggagccctaagcctcaaggaatcacaggaactagcgcagcatgccgcagaaatcggggctgacgggatcgcagtaattgcaccatttttcctgaaaccatggaccaaagacatccttataaactttcttaaagaggttgccgcagccgcaccggcattgcccttctactattatcacatcccagccctgaccggtgtgaagatcagggcagaagaactgctggacgggattctcgataaaatcccaactttccaaggtctcaaattctcggatacagatctgctcgattttggccaatgcgtcgaccagaatcgccaacagcaattcgctttcctattcggcgtcgatgagttctgtattcagcggtttatcaactttgttgtgaaactcgaaaatagtaaattgaaagtaagtaaaaaccagcgcaccttaccactggggacaacaaactttccattcctacattag

SEQ ID NO: 196455 - DNA, 624 bp, Artificial Sequence
  Description of Artificial Sequence: Synthetic coding sequence
cgggagggccagaagggcagccagaccgcccggcacacctgccaccctgaagtgcctctggggaattgtttccttccagtgtataaagcaagtcctctcactgtgacacgtctctgggctgagagattggaccaggtgatcattcacgtcggcgcactgagcctaaaggagtcccaggagctggcccagcacgcagccgagattggggccgacgggattgcagtgatcgcaccattttttctaaaaccctggactaaagatattctgatcaacttccttaaagaagtggccgctgcagcaccagctctccctttctattactaccacatcccagcgctcactggagtgaagacgactgtggagtgcagtggagacggctcaaactggtcaagcgggcagttctgtatccaaaggtttatcaactttgtagtgaagctcggcttcggcgtgtcccagacaaaggccatcatgactttagtgagcgggatccctatggggccaccccggctgccactgcagaaggcatcacgtgagtttaccgactctgctgaagccaaactgaagtccctcgactttctgtcttttaccgacctcaaggatggaaacttagaagccggcagctag

SEQ ID NO: 196456 - DNA, 747 bp, Artificial Sequence
  Description of Artificial Sequence: Synthetic coding sequence
atgggcctgagccgggtgcgggccgtgttcttcgacctggacaacacactgatcgataccgccggcgcttccaggcgtgggatgttggaggtgatcaaactcctgcagagtaagtatcactacaaagaggaggctgagattatctgtgacaaggtccaggtaaagttgtccaaggaatgttttcatccctataatacttgtatcaccgacctcaggaccagccactgggaagaggctatccaagagactaaagggggcgctgccaatcgcaagctggctgaagagtgctactttctctggaaaagtacaagactgcaacatatgacccttgcagaagatgtgaaagctatgctgaccgagttgcggaaggaggtgcgcctcctcctgctgaccaatggggataggcagactcagcgggagaaaattgaagcttgcgcctgtcagtcgtactttgacgcagtggtcgtgggcggcgagcagcgcgaggaaaaacccgcaccttcaatcttttactattgttgcaacctgctcggtgtccagccaggggattgcgtaatggtcggcgacacactagaaacagacattcaggggggccttaatgcaggcctcaaggcgacggtgtggatcaataaaaatgggatagtcccactgaagtcttctccagtcccccattatatggtgagcagtgtcctggaactaccagctctgctccaatcgatagactgtaaggtatcaatgtccacttag

SEQ ID NO: 196457 - DNA, 1515 bp, Artificial Sequence
  Description of Artificial Sequence: Synthetic coding sequence
atggccgcccaggccctggccctgctgcgggaggtggcccggctggaagctcctctggaggagctccgcgcactgcacagcgtcttgcaggccgtacctctgaatgagcttcggcagcaggctgccgagctgcggctcggcccactctttagcctcctgaatgaaaaccaccgcgagaagaccaccctgtgtgtttctatccttgaacgcttgctgcaagccatggaacccgtacacgttgcccgcaaccttagagtcgatctgcagcgcgggctcatccacccagacgatagcgttaagatcttaactctgtcccagatcgggcgcattgtcgaaaactctgatgccgtcactgaaatcctcaataatgccgagctcttgaagcagatcgtgtactgtattgggggagaaaatctgagcgtcgccaaagccgccatcaagagcttatctcgtatcagcctgacccaagccggcttagaggccctgttcgagtccaatctgttggatgacttgaagagtgtaatgaagaccaatgatatagtacgataccgcgtgtacgagctgatcattgagatatcatccgtcagccccgagagtctgaattactgcacaaccagtggactggtgacgcagctgctgcgggagctcactggtgaagacgtcctcgtccgagccacctgtatcgaaatggtcaccagcctggcctatacacaccatggtcggcagtatctggctcaggagggtgtgatcgaccaaatctccaacatcattgtgggcgcagacagcgatcccttctcatctttttacctgccaggctttgtaaaattctttggcaacctcgcagtgatggactcaccacagcagatctgtgaacgctatcccatattcgtggagaaagtctttgaaatgatagagtcgcaggacccaactatgatcggggtggccgtggacactgtgggaatcctcggatctaatgtagagggcaagcaagttctccaaaaaacaggaactcggtttgagcggctcctgatgcgcattggccaccaatcgaagaatgctccggtagagcttaaaatccggtgtctggatgctatcagctcactgctatacctgccacccgagcaacagacagatgatttactgcgtatgactgagagctggtttagctcattgagtcgggatccccttgagctcttcaggggtattagtagccagccttttccagagctgcactgtgccgccttgaaagtgtttacagcgattgccaaccagccttgggcgcaaaagctgatgttcaatagtcctggattcgtagagtacgtggtggatcggtccgtggaacacgacaaggcttccaaagatgcaaagtacgagttggttaaagccctggcgaactctaagacgatcgccgaaatattcggcaaccctaattacctccgcctgcgcacctacctatctgaaggaccgtactacgtcaagcccgtctctaccacagccgtcgagggcgcagagtag

SEQ ID NO: 196458 - DNA, 423 bp, Artificial Sequence
  Description of Artificial Sequence: Synthetic coding sequence
atggtgctggtgctggactacagcggccggcccatggtgatcagctcaggaatgcagagcatggataccatgaaacaggtttatcagattgtgaagcctctgaatccaaacttctgtttccttcagtgcactagcgcttaccctttgcagcccgaggatgtgaacctaagagtaatctcggagtaccagaagctgtttccagacattcctattggatacagtggacacgaaaccgggatcgcgatcagcgtcgccgccgtcgccctgggggccaaggtgcttgaacgccacatcacactagataaaacttggaaggggtccgatcatagcgccagcctcgagcccggagaactagctgagttggtgcgatcggtccgattggtggagcgtgccctaggaagccccactaagcagttactgtag

SEQ ID NO: 196459 - DNA, 348 bp, Artificial Sequence
  Description of Artificial Sequence: Synthetic coding sequence
gaggacgtgaacctgcgggtgatcagcgagtaccagaagctgttccccgatatccccatcgggtattccggccatgagaccggcattgcaatctcggtggccgctgtagcactgggggctaaggtgctggaaaggcacataaccctggacaaaacttggaagggcagtgaccattcagcaagtcttgaaccgggtgagctggccgaacttgtgcgctctgttcggctcgtagagcgcgccctcggttcccccaccaagcaacttcttccatgtgagatggcgtgtaatgagaaagtgtgtcctgccggcctatattcggtcctgcttccatgcgtggagaagggctag

SEQ ID NO: 196460 - DNA, 873 bp, Artificial Sequence
  Description of Artificial Sequence: Synthetic coding sequence
atggacatcgaggcctacctggagcggatcggctacaagaagagcagaaataagttggacctcgagacattaaccgatatcttgcaacaccagatacgagctgtacccttcgagaacctgaacattcactgcggagacgcaatggaccttgggctggaagcaatcttcgaccaggtggttcgacgtaaccggggtggctggtgtttgcaagtgaaccatcttttgtattgggctctaacaactatagggttcgaaacgaccatgcttggcggctacgtgtattcaaccccagcaaagaagtactcaactggcatgattcaccttttactgcaggtcaccatcgacggacgtaactatattgtagatgccggtttcgggaggtcataccaaatgtggcaacccttagagctgatatccgggaaggaccagccgcaggtgccgtgtgttttccgcttaaccgaagagaatggattttggtatctggaccagattagaagggagcagtacatcccgaatgaggaattcctgcacagtgatctactggaagactccaaataccggaaaatctacagttttacactgaaaccccggacaattgaggatttcgaaagcatgaatacttacctgcagacaagcccgtcttccgtcttcacatcaaagagcttctgttccctgcagactccggatggagtccactgtctggtcgggttcacactaacacacagacgcttcaattacaaagacaacacggatctgatcgagtttaaaaccctgtccgaggaagagatcgagaaggttctgaagaacatcttcaatataagcttacagcgcaaactggtgcccaaacacggcgatcggttcttcactatctag

SEQ ID NO: 196461 - DNA, 873 bp, Artificial Sequence
  Description of Artificial Sequence: Synthetic coding sequence
atggacatcgaggcctacctggagcggatcggctacaagaagagccgcaataagcttgatctggagactctgactgacattctgcagcatcagatcagggctgtcccctttgagaacctgaatatccactgcggcgacgcgatggacctagggctggaagctatcttcgatcaggtggtgcggcgcaaccgcggggggtggtgcttgcaggtcaaccatctgctctactgggccctgaccaccataggctttgaaacaactatgttgggtggctacgtttactcgactccagccaaaaagtactcaaccggcatgatccacttgctgctgcaggttaccatagatgggcgaaattacattgtggacgccgggtttggcaggagttaccagatgtggcagcctctggaattaatcagtgggaaggaccagcctcaggtcccctgtgtttttcggctgacggaggaaaatgggttttggtaccttgatcagatccggagggaacaatatattcctaacgaggagtttctgcactctgacctgttggaggatagcaagtaccgcaagatctactctttcacactcaagccgaggaccatcgaggatttcgagtccatgaatacctacctccagacaagtcctagttccgttttcacatccaaatctttttgtagccttcagacacccgacggagttcactgtctggttggctttacccttacacatcggcgattcaattacaaggataacaccgatcttatcgaatttaagacgctttccgaagaagaaattgaaaaggtattgaagaatatctttaacatttcactgcagcgcaagctggttcctaagcatggcgaccggttctttacaatatag

SEQ ID NO: 196462 - DNA, 873 bp, Artificial Sequence
  Description of Artificial Sequence: Synthetic coding sequence
atggacatcgaggcctacctggagcggatcggctacaagaagagccgcaacaagttggacctcgaaacattaacagacatccttcaacatcaaataagagcagtgccattcgagaatctgaatatccactgtggggacgccatggacttggggctcgaggcaattttcgatcaggtggtacggcggaaccgggggggttggtgtctgcaggttaaccatctgctgtactgggccctcaccacaattggattcgaaactaccatgctgggcggttacgtctattctacacccgcaaaaaagtactctacagggatgatccatctgcttctccaggtgaccattgacggcagaaattatatcgtagacgcgggctttggaaggtcctaccagatgtggcagcccctggagctaatttcgggaaaagaccagccccaggtcccatgcgtgttcaggctaactgaggagaacggcttttggtacttggaccagattaggcgggagcagtatatccctaacgaggaatttctgcacagcgaccttttggaggacagcaaatatcgcaagatctacagctttactttgaagcctagaaccatcgaggactttgagtctatgaacacatatttacagacctcaccttcaagcgtttttactagcaaatccttctgctctttgcagaccccagatggagtccactgcttagtgggtttcactcttactcacaggcggttcaattacaaagacaacacagatctgattgagttcaagactctctcagaagaggaaatcgagaaagtgcttaaaaacatcttcaatatcagcctgcagcgcaaattggtcccgaagcacggagatcgcttcttcactatctag

SEQ ID NO: 196463 - DNA, 873 bp, Artificial Sequence
  Description of Artificial Sequence: Synthetic coding sequence
atggacatcgaggcctacctggagcggatcggctacaagaagagcagaaacaaactggacctggagacccttactgatattttgcagcaccaaatcagggcagtgccattcgaaaacctcaatatccattgcggggacgccatggatctgggcctcgaagccatatttgaccaggtggtgcggaggaaccgcggcggatggtgtcttcaagtgaatcaccttctctactgggccctcacaactatcgggttcgagacgaccatgctgggtggatatgtttacagtacccctgcaaaaaaatatagcacagggatgatccatctgttgctgcaggttaccatcgatgggcgaaattacattgtggacgccggatttggcaggagctatcaaatgtggcaaccacttgaactaatatcggggaaggaccaaccccaggtcccttgtgtgtttcgcctgaccgaagagaacgggttttggtatctagatcaaatcagacgtgaacagtacatccctaacgaagagtttctacacagcgacctgcttgaagactcaaaataccgaaagatctattcttttacactgaaaccacggaccatcgaggacttcgaatccatgaatacatacctgcagacatctccctcttcagtgttcacatccaagagcttctgttccctgcagactcccgacggtgtacactgcttagtcggcttcaccctcacccatcggcgcttcaactacaaggataatactgacctcatcgagttcaaaacactgtctgaagaggagatagaaaaagttttgaagaacatctttaatataagtctgcagcgtaagttggtacccaaacacggcgatagattcttcacaatatag

SEQ ID NO: 196464 - DNA, 873 bp, Artificial Sequence
  Description of Artificial Sequence: Synthetic coding sequence
atggacatcgaggcctacctggagcggatcggctacaagaagagcaggaacaaactagacctggagaccctgaccgatatcttgcagcaccagatcagggcggtcccctttgaaaatctaaatattcactgtggcgatgccatggatctcggcctggaggctattttcgaccaggtcgtccgtcgcaatcggggaggatggtgcctacaggtcaatcacctgttgtactgggctctgactaccattggctttgagaccacaatgttgggcggatacgtgtactctactccagcaaaaaagtatagcactgggatgattcatttactcctgcaggttacaattgacgggcggaactacatcgttgacgctggcttcggacggtcctatcagatgtggcagccgctggagctgattagcggaaaagaccagcctcaagtgccctgcgtgtttcggctgactgaggagaacggattctggtacttggatcaaataaggagggaacagtacatcccaaacgaggagttcctccacagcgatctgctcgaggacagcaagtaccgcaagatctattcgtttaccctcaaaccaaggacaatcgaagatttcgaatctatgaacacatatcttcagacttctccgagctctgtgttcactagtaaatctttttgtagcctccagaccccagacggggtgcactgccttgtgggctttaccctgacccaccgccggttcaattacaaggataatactgacctcattgagtttaaaaccttgtcagaggaggagatcgaaaaagtactgaaaaacatatttaacattagtctccagagaaaactcgtcccaaagcatggcgaccggttcttcaccatttag

SEQ ID NO: 196465 - DNA, 873 bp, Artificial Sequence
  Description of Artificial Sequence: Synthetic coding sequence
atggacatcgaggcctacctggagcggatcggctacaagaagagcaggaataaactggatcttgaaacgttgactgacattcttcagcaccaaattagggctgtgccgttcgagaacctgaacattcactgtggcgacgctatggatctcggtttggaagcgattttcgaccaggtggtgaggcggaatcgtggtgggtggtgtcttcaggtaaatcacctcttgtattgggccttgacgaccattggcttcgagacaacgatgctgggcggatacgtctatagtaccccggctaaaaaatactccacaggaatgatacacctgctgctgcaggtcactattgatggcaggaactatatcgtggatgccggctttggcaggagctaccaaatgtggcagcctctggagctaatctcgggcaaggaccaaccacaagtcccctgtgtcttccggcttacagaggagaacgggttctggtacctggatcagattagaagggagcagtatatcccgaacgaggagtttctgcatagtgacctgcttgaggatagcaagtatagaaaaatttacagttttacccttaaacctagaacaattgaggatttcgaaagtatgaacacctatctgcagactagcccttcgtcagtgttcacctccaaatctttttgtagcttacagacccccgacggggtacattgcctggtagggttcaccttgactcatagacgcttcaattataaggataacaccgacctgatcgaattcaaaacactgagcgaggaagaaatagagaaggtgctgaagaacattttcaatatatctctccagcgaaagctggtgccaaagcacggggacaggttttttacaatttag

SEQ ID NO: 196466 - DNA, 873 bp, Artificial Sequence
  Description of Artificial Sequence: Synthetic coding sequence
atggacatcgaggcctacctggagcggatcggctacaagaagagcaggaataagttggacttagagaccctgactgatattctacaacatcaaatccgggctgtccccttcgaaaacctgaatatacattgcggagatgccatggacctcggcctggaagctatttttgaccaagttgtgcgaagaaatcgtggaggctggtgcttgcaagtgaaccacctcctttattgggcgctgacaactattggcttcgagacaaccatgctgggtggttacgtctattctaccccagccaaaaagtactcaacaggcatgatccacctgctcttacaggtcaccatcgacggccggaattatattgttgatgccggatttggacgaagctaccaaatgtggcagcccctggagctgatttccgggaaggaccagccacaggtcccttgcgtattccgcctgaccgaggaaaacgggttctggtacttggatcagatcagaagagagcagtacattcccaacgaagagtttctccacagcgacctgttagaagattctaagtataggaaaatttacagcttcacgctgaagccccgtaccattgaagacttcgaatcaatgaacacgtacctccagacatctccgagctcggtgttcacgagtaaaagtttctgcagccttcagacccccgatggcgtgcactgcctcgtgggcttcaccttgactcatagacggtttaactacaaagacaataccgacctgatcgagttcaaaacgctctccgaggaggaaatcgagaaggtgctgaagaatatcttcaatatttccttacagagaaagttagtcccaaaacacggagataggttcttcaccatttag

SEQ ID NO: 196467 - DNA, 1059 bp, Artificial Sequence
  Description of Artificial Sequence: Synthetic coding sequence
atgctgctgctgctgctgcacaaggaggccgccctggagccccagggtcctgcagttgggtataactccctgcccgtgagtgatgaccaccatgtctctggcatacaggccaggaagaagcagcagtcagtgttttggatcaagactgaggatcaaccaacatttaacctcctgagaaaaggcattatggacattgaagcatatctggaaagaattgggtataaaaagagccgcaacaagctcgacctggaaactctgacagacatcctccagcaccagatacgcgccgtcccgtttgaaaacctgaacatccattgtggggatgccatggacttgggcctggaggcaatttttgaccaggtcgtgaggaggaaccgcgggggatggtgcctgcaggtcaatcacctcctgtactgggccctgaccacgatcggtttcgagacaacaatgttaggtggctatgtgtacagcaccccagccaagaaatacagtactggcatgattcaccttctgctccaggtgacaatcgatggacggaattatattgtggatgccggattcggccgctcataccagatgtggcagcctctggagctgattagcggtaaggaccagccccaagtgccctgcgtctttcgcctgacagaggagaacggcttttggtacctcgaccagataaggcgggaacagtatatacctaacgaggaattcctccacagtgatctcctggaggatagcaaatatcgcaaaatatactcattcaccctgaaacctcgcacaatcgaggactttgagagtatgaacacatatctgcaaacaagccctagctcagtcttcaccagcaagtcgttctgtagtcttcagactccggacggggtccattgtctggtgggcttcacactgactcatcgcaggttcaactacaaagataacacagacctcatcgagttcaagacactctctgaggaggaaattgaaaaggtccttaaaaacatattcaacattagcttacagaggaaattggtccccaaacacggtgatcggttcttcacaatatag

SEQ ID NO: 196468 - DNA, 873 bp, Artificial Sequence
  Description of Artificial Sequence: Synthetic coding sequence
atggacatcgaggcctacttcgagcggatcggctacaagaacagcagaaataaactagatcttgaaacactgacagacatcctggagcaccagatccgggctgtaccttttgagaatctgaacatgcactgcggtcaagctatggaactgggactggaagctatattcgaccacattgtcaggagaaacagggggggctggtgtcttcaagtgaaccagttgttatattgggcactcacaaccatcggctttcaaactacaatgttgggaggctacttctacatcccccctgtcaataagtatagcaccggtatggtacacctccttctgcaagtgactatcgacggccggaattacatcgtcgacgcaggaagtggctcgagcagccaaatgtggcagcctctggagctaattagtggcaaggaccagccccaggtgccgtgcatcttttgcctgactgaggagagaggcatctggtatcttgaccagattcgtagggaacagtacattactaacaaggaatttctgaattcacaccttctgcctaagaagaaacatcagaaaatttatctgtttacattggagccacggactattgaggatttcgaaagcatgaatacttatctgcagacctctcccacctcatcatttattacaacatctttctgctccctccagaccccagagggagtgtattgcctggtcgggttcattctcacttacagaaaattcaattacaaggacaacaccgatctagtggaattcaagacgctcacggaagaggaagttgaggaagtgctcagaaacatctttaagatctcattgggaaggaatctcgtgcccaagcctggggacggttcgttgaccatatag

SEQ ID NO: 196469 - DNA, 684 bp, Artificial Sequence
  Description of Artificial Sequence: Synthetic coding sequence
atggccccctgccacatccggaagtaccaggagagcgaccggcagtgggttgtaggcctgctttcacggggaatggccgaacatgcgcctgctacatttagacagctcctcaagctgcccaggaccctcatactccttttgggcggtcctctggctctgctgcttgtgtcaggctcctggttgttagccttggttttctccatctcgctctttcctgccctgtggttcctggccaaaaagccctggaccgagtacgtagatatgacactatgtactgacatgagtgacatcacaaaatcgtacctgtctgaaagaggatcatgcttttgggttgctgagtctgaggaaaaagtagtgggaatggtcggcgccctgccagtcgatgatcccacattacgcgagaaaagacttcagctgtttcaccttttcgtggacagcgagcacagaagacaggggatcgccaaggccctggtccgcacggttctacaatttgcaagggaccaaggctactcggaggtcatccttgatacagggaccatccaattatcggcgatggccctgtaccagtctatgggttttaaaaagaccggccagtcatttttctgtgtgtgggcgaggctcgttgccctgcacacggtgcacttcatctaccatctgccatcctccaaagtggggtccctgtag

SEQ ID NO: 196470 - DNA, 405 bp, Artificial Sequence
  Description of Artificial Sequence: Synthetic coding sequence
atggccgacatcgagcagtactacatgaagccccccggcagctgcttttgggtagccgtgctagacggtaacgtggtgggcatcgttgctgcccgggcacacgaggaggacaatacggttgagctcctgagaatgtcagtggacagccgatttaggggtaagggcatcgccaaggccctgggacgtaaggtactggagttcgcagttgtacacaactatagtgctgtggtcctagggaccaccgccgtgaaggtggctgcccataaactgtatgaatcacttggcttccgccacatgggcgccagcgaccactatgtgttgcctggaatgaccttatcactggctgagcgcttattttttcaggtcagatatcatcggtacagactccagctgcgcgaagaatag

SEQ ID NO: 196471 - DNA, 909 bp, Artificial Sequence
  Description of Artificial Sequence: Synthetic coding sequence
atgcactgcggcccccccgacatggtgtgcgagaccaagatcgtggcggcagaagaccacgaggcgcttcccggagcaaaaaaggacgccctcctggcagctgcgggagctatgtggcccccccttccagccgcccctggccctgctgcagctccacccgctccacccccagcacctgtagcccagccccacggcggtgccggtggcgcgggcccccccgggggacgcggggtgtgtatcagagagttccgggcggctgagcaggaagcagctaggcgcatcttctatgatggcattatggagcggattcccaacacagccttccgcggactgcggcagcaccccagggctcagttgctgtatgcgctgttggccgccctgtgctttgcagtgagtcgctctctgcttctgacctgtctcgtgccagccgcactcctgggattgaggtactattatagccgcaaggttattcgcgcatacctcgagtgcgcacttcatacggatatggcagatatcgaacagtactatatgaagccgcccggttcatgcttctgggtggccgtgcttgatggcaatgtcgtcggaatagtggccgcacgtgcacacgaagaagataacactgttgaacttctgcgcatgtctgtcgacagcaggtttcggggaaagggaatcgctaaagctctcggacgaaaagtgttagagttcgcggtcgtccacaactattctgctgttgtcctgggtactacagcagtcaaggtcgcggctcacaagctgtatgaaagtcttgggtttcgccacatgggggcttcagatcactacgtgctgcccggaatgacccttagtctggcagaaagattgtttttccaggtgagatatcaccggtaccgtctccagttaagggaggagtag

SEQ ID NO: 196472 - DNA, 1182 bp, Artificial Sequence
  Description of Artificial Sequence: Synthetic coding sequence
atggacgagaacgagagcaaccagagcctgatgaccagcagccagtaccctaaagaagcggtgagaaaaaggcagaacagcgcccgaaattctggcgcttcagactcttcgcgtttttcccggaaatccttcaaactggattatcgccttgaggaggatgtcactaagagcaaaaaagggaaagacgggagatttgtgaatccatggcctacatggaagaacccgtctattccgaacgtgctgcgctggttaatcatggagaaggatcatagcagcgttccgtcatcaaaggaagagctggacaaagagctcccagtgctgaagccctacttcatcacaaatcccgaagaggcaggggtccgggaggccggcttgagagtgacctggttggggcacgcaacggtcatggtggaaatggacgaattgatcttccttactgaccccatcttttccagcagagccagcccgtctcagtatatgggtcctaagaggtttcggagatcgccttgtacaatatccgagctccctcccatcgacgcagtcctcatttcacataaccactatgatcacctggattataatagcgtcattgccctgaacgaacgatttggtaacgagctgcgctggtttgtgccccttggcctgttagactggatgcagaagtgcggctgtgagaacgtgatcgagctggattggtgggaggaaaactgcgtcccagggcacgataaagtgacgtttgtgtttacaccttcccagcactggtgcaagcggacgttgatggacgataataaagtcttgtggggcagttggagcgtgctgggaccttggaaccgctttttctttgcaggggataccggctactgtcccgctttcgaggagattgggaagagattcgggccatttgatttggccgccatccccatcggggcgtatgagcctagatggttcatgaagtatcagcatgtcgaccccgaggaggcagtgaggatccacaccgacgttcagactaaaaaatcgatggcgatacactggggaaccttcgccctagccaacgagcactacctagagccccccgtgaagctgaatgaagctttggaaaggtacggtctgaatgctgaagactttttcgtgctgaagcatggagagagcagatacttaaataatgacgatgagaacttttag

SEQ ID NO: 196473 - DNA, 375 bp, Artificial Sequence
  Description of Artificial Sequence: Synthetic coding sequence
atggacgagaacgagagcaaccagagcctgatgaccagcagccagtacccgaaagaagccgttaggaaacggcaaaactccgcacggaacagtggggcttctgactctagcagattcagtcgcaagtccttcaagctggattacagacttgaggaagacgtgacgaagtcaaaaaagggtaaggacgggcgcttcgtaaatccctggcccacctggaagaatccctcaatcccaaatgtgctacggtggctaattatggaaaaggatcatagctctgtccctagtagcaaggaggagctcgataaagaactgccagtgcttaagccttatttcatcactaacccggaggaagctggggttcgggaggccggctag

SEQ ID NO: 196474 - DNA, 1182 bp, Artificial Sequence
  Description of Artificial Sequence: Synthetic coding sequence
atggacgagaacgagagcaaccagagcctgatgaccagcagccagtacccgaaggaggccgtacgcaaacgacagaactccgcaaggaattccggcgccagcgactcttctaggttctctaggaagtcatttaaactggactatagactggaagaggatgtgacaaagtctaagaaaggcaaggacggtagattcgttaatccctggcccacttggaagaaccctagcattcctaacgtgctcagatggctcatcatggagaaagaccattcatctgtcccatcgagtaaagaggaattggataaggagctccccgtcttaaagccctactttattaccaatcctgaagaagccggggtgagggaagccggactgagagttacttggctcggccacgcaaccgtgatggtggaaatggatgaactgatctttctgactgatcccatcttcagcagtagagcctcaccgtctcaatacatggggccaaagcgattcaggagaagtccatgcacaattagtgagttaccacccatcgacgctgtgcttatctctcacaaccactacgaccatctagactacaattccgtcatcgccctgaatgaacggttcggcaatgagctccgctggttcgtgccgctgggtcttttggactggatgcagaagtgtggatgtgaaaacgtgatcgaacttgactggtgggaggagaattgtgttcctggacatgacaaggtgactttcgtatttactccttcacaacattggtgcaagcgaaccctgatggacgacaataaagtgctgtggggctcatggtctgtgttggggccctggaacaggttcttcttcgccggtgacacgggttactgccctgccttcgaagagataggcaaacgtttcggtccatttgacctggccgccatccctattggagcctatgaacccagatggttcatgaagtatcagcatgtggacccagaagaagccgttcgcatccacaccgatgtccagaccaaaaagtcaatggctatccattggggaaccttcgcattagccaacgagcactatctcgaaccacctgtgaaactgaatgaagctctggaaaggtacggcttgaacgccgaggatttctttgtcctcaagcatggcgagtctcggtatctaaataacgacgatgagaatttctag

SEQ ID NO: 196475 - DNA, 18 bp, Artificial Sequence
  Description of Artificial Sequence: Synthetic coding sequence
atggacgagaacgagtag

SEQ ID NO: 196476 - DNA, 1182 bp, Artificial Sequence
  Description of Artificial Sequence: Synthetic coding sequence
atggacgagaacgagagcaaccagagcctgatgaccagcagccagtatcccaaggaggcagtgcgaaaaaggcagaacagcgcaagaaacagtggagccagtgatagtagccgtttctctcggaaatcttttaaattggactaccgcctggaagaagatgttacgaagagtaaaaagggtaaggatgggaggtttgtcaacccatggcccacctggaaaaaccccagcatacctaatgtgctgagatggctgataatggaaaaagaccatagcagtgtcccatcaagcaaggaggagctcgacaaggagctgcccgtgctgaagccatactttatcacgaatcccgaggaggcaggggtgagagaagcgggcttgcgggtgacctggctggggcatgcgacagtaatggttgaaatggatgaactgatcttcttgactgatcccattttctcatcccgcgcatctccaagccagtatatgggccccaagcgcttccgtagatccccttgcacgattagcgaactgccccctatcgacgcggtcctgattagccacaatcactacgaccatctggactacaattcggtgattgctttgaatgagaggttcggcaacgaactgcgttggtttgtgcctctcgggttgctggactggatgcaaaaatgtggatgcgagaatgtgatcgaactggactggtgggaggaaaactgtgtgccggggcatgataaagtgacatttgtgtttaccccctcccagcattggtgcaagcgcacactgatggatgacaacaaggttctttggggcagctggtcagtgctgggtccttggaatagattcttttttgccggagatactggctattgtcccgcgtttgaggaaattggaaagcgcttcggcccattcgatcttgccgcgattcccataggtgcctatgaaccccggtggtttatgaagtaccagcatgtggatcccgaagaggcggtccggattcatacagacgtgcagacaaagaagtctatggcgatccactggggtaccttcgcattggccaacgaacactacctggaaccacctgtaaaactcaacgaggccttggagaggtacggcctgaatgccgaggatttcttcgtgctgaagcacggcgagtccaggtatcttaacaatgacgacgagaacttttag

SEQ ID NO: 196477 - DNA, 1401 bp, Artificial Sequence
  Description of Artificial Sequence: Synthetic coding sequence
atggcccggcggcgggagctgaagcggtgcctgcagctgctggccagctcggcggagcctgctaggcgtgctagggtgcggaagaacccttccgcatgtcggggtcgcccgtctagatacgctgcggcactgtgtgcaggcacactgtggcctgaagccgcagagctgaggcgcagggctctccccgccactccttctgcttcatccagcccaaaggacatggatgagaatgagagtaaccagagcctaatgacatccagccagtacccaaaggaggccgtgaggaaacgtcaaaattccgctcgtaattctggcgcaagcgatagtagcagattttcgcggaagtccttcaagctggactatcggctggaggaagacgtgaccaagtcaaaaaaggggaaggatggccggtttgtgaacccctggccgacttggaaaaatcccagcattcccaacgtgctccgatggcttatcatggagaaggatcatagctcggtgccctctagtaaggaagagctggacaaggaacttccagtcctcaagccttacttcatcaccaacccagaggaggctggcgtgagggaagccgggctgcgggtgacctggctgggacacgccacagtaatggtcgaaatggatgaacttatctttctcacagatcccatcttctcgtcgagagccagtccctctcagtacatgggacccaaaaggttcagaagaagcccatgcactatctcagagcttcccccgatcgatgccgtactgatcagccataaccactacgaccacctcgattacaatagcgtgatcgcccttaacgaacgatttggaaatgagcttcggtggtttgtgcctcttggccttctcgattggatgcaaaaatgtggatgtgagaatgtgatcgagctggattggtgggaggagaactgtgtgcctggtcacgacaaggtaaccttcgtattcacaccttcacagcattggtgcaaaaggacactgatggatgataataaggtgttgtggggaagttggagcgtactgggcccatggaatcgtttcttctttgcgggggacacaggatactgtcccgccttcgaagagattggcaaacgctttgggcccttcgacctggccgccattcctatcggggcctacgagccaagatggtttatgaaataccagcatgtggatccagaggaggcagtgcgaattcacaccgacgtccagacgaagaaatctatggctatacattggggcacgttcgcactcgccaacgaacattacctcgaaccacccgtcaagttgaatgaagcgcttgagaggtacggactcaatgctgaggatttttttgtgcttaaacatggtgaaagccgctacttaaataatgatgatgaaaatttctag

SEQ ID NO: 196478 - DNA, 1182 bp, Artificial Sequence
  Description of Artificial Sequence: Synthetic coding sequence
atggacgagaacgagagcaaccagagcctgatgaccagcagccagtatccaaaggaagccgtgcgaaaacggcagaactctgcgcggaacagcggcgcctccgattcttctagattctctagaaagagcttcaagcttgattacaggctggaagaggacgtgacgaaatcaaaaaagggcaaggacggtcgtttcgtgaacccatggcccacctggaagaacccttcaatcccaaatgtgctgcgttggctaatcatggaaaaggaccattctagtgtaccctcgtcaaaagaagagctcgacaaggaactccctgtgttgaagccatacttcattactaatcccgaggaggccggtgttcgcgaggccggtctccgagtaacgtggctaggacatgccaccgtcatggtggaaatggatgaattaatctttcttaccgaccccatcttttcatccagggccagtccaagtcagtatatgggccccaagagatttcggagatccccctgcaccatatcagagttgccgcccatcgatgcagtgttaattagccacaaccattacgaccatctcgattataactccgtcattgcactaaacgagcgttttgggaatgagctcagatggttcgtgccactggggctgttggattggatgcagaaatgcggatgtgagaacgtgatagagctagattggtgggaggagaactgtgtgccgggccacgacaaggtaacgttcgttttcactccaagccagcattggtgcaagaggacactcatggacgataacaaagtgctgtggggtagttggtccgtgctgggaccatggaatagattcttctttgcgggagacactggatactgcccagccttcgaggaaattgggaagcggtttgggccgtttgatctggcagccatcccaataggagcatacgagccgcgttggttcatgaagtaccaacatgtggatccggaagaggctgtgcggatacacacagacgtgcagactaaaaagagcatggccatccactgggggactttcgcgttggccaatgagcactatttggagcccccagtgaaactcaatgaagccctggagcgctatggattgaacgccgaagatttctttgttttaaaacacggagaatcccgttatttaaacaatgacgacgagaacttctag

SEQ ID NO: 196479 - DNA, 2199 bp, Artificial Sequence
  Description of Artificial Sequence: Synthetic coding sequence
atggagcggcaggtgctgctgagcgagcccgaggaggccgccgccttgtaccgcggcctgtcaaggcagccagctctgagcgccgcctgcctcggccccgaggtgaccacccaatacggaggacagtataggacggttcataccgaatggacacagcgtgatttggagcggatggagaacataaggttttgtcgccagtatctggtgttccacgatggagacagcgtcgtgtttgccggccctgcagggaactccgtagaaacgagaggtgagctgctctctagggagtccccatcaggtacaatgaaagctgtgctgaggaaagctgggggaacaggccccggcgaggaaaaacaatttttggaggtgtgggaaaaaaatagaaagttgaaatcatttaacctgagcgctcttgagaaacacgggcctgtctacgaggacgattgctttggatgcctgtcctggagccactccgaaacgcatctgctttatgtcgcggagaaaaaaagaccaaaggctgagtccttctttcaaaccaaggctctggatgtcagcgcatccgatgatgagattgcacggcttaaaaagcccgatcaggcaatcaaaggagatcaattcgtgttctacgaggactggggtgaaaacatggtctctaaatcaatacctgtcttgtgtgtcctcgatgtggagagcggcaacattagtgtgctggagggtgtgccggagaacgtgagcccaggccaggctttttgggctcctggcgacgccggcgtggtctttgtcggatggtggcacgagccctttaggcttgggatccgattctgcaccaacagacgatccgcactgtactacgtcgacctgattggcggcaagtgcgaattgctttccgacgattccctcgcagtgtcgagcccaaggctaagcccggatcaatgcaggatcgtgtacctgcaatacccatccttgattcctcatcaccagtgcagtcaactgtgtttgtacgactggtacactaaagtaacctccgttgtggttgacgtggttccacggcagctgggggaaaatttcagtggtatttattgctctctccttcccctgggctgttggtctgctgactcacagcgagtggtgttcgattcggctcaacgttcgaggcaagacctcttcgctgtcgatacccaagtcggaactgtcaccagtctgacagccggcggcagtggcggatcttggaagctgctcactattgaccaggacctcatggttgcccagttttccaccccaagcctacctccaacgctgaaggtgggcttcctgccatccgcaggaaaggaacagtctgttctgtgggtctctctggaggaggccgaaccgatacctgatatacattggggtatccgcgttttacagcctccaccggagcaagagaacgtacagtatgcaggtctcgattttgaggcgatactgttgcagccaggatcaccaccagacaagacccaggtacccatggtcgttatgcctcatggagggccacactccagctttgtcacagcctggatgcttttccccgctatgctgtgtaagatggggttcgcagttctgctcgtaaactatcgtgggtccaccggctttggtcaggatagcatcctctccctccccggaaacgtgggccaccaggatgtcaaggacgtgcagtttgctgttgagcaggtactgcaggaagaacatttcgatgccagtcacgtggcattgatgggcggctcacatggtggcttcattagttgccatttgatcggacagtacccggaaacataccgtgcatgcgtcgccaggaatcctgtcattaacattgcgagcatgctggggagcactgatatcccagactggtgcgtggtagaggctggattcccctttagctcagattgtctcccagacctctccgtgtgggccgagatgctggacaagagcccaatccgatacattccccaggttaagaccccattgctgctgatgctcgggcaggaggaccgtagggtcccctttaagcaggggatggagtactatcgcgctctgaagacccggaacgtcccagtaagacttctgctctatccaaagagcacacacgcactgtcagaggtggaagtggagtccgatagctttatgaatgccgtcctgtggctgagaacccatctgggctcctag

SEQ ID NO: 196480 - DNA, 1833 bp, Artificial Sequence
  Description of Artificial Sequence: Synthetic coding sequence
gtgctgaaccggctgcagagcaagtacggcagcctgtaccggcgggacaatgtgatactgtcaggaacccacacccatagtggcccggccggttacttccagtacaccgtatttgttattgcaagcgaagggttctccaatcaaacttttcagcatatggtcacaggaatcctgaagagcattgacatcgcccataccaatatgaaacccggcaagatctttatcaacaagggaaacgtcgatggcgtccaaataaacaggtctccttactcgtatctacaaaaccctcaaagcgagcgcgcccgatattctagcaacacggacaaggaaatgatcgtgctaaagatggtggatcttaacggggacgacctaggcttgatcagttggttcgctatccatcccgttagtatgaacaatagtaatcacctggtgaacagtgataacgtgggctacgcatcttatctgctggagcaggagaagaataagggatacttgcctggccaaggtcctttcgtggccgccttttccagcagtaatctaggcgacgtgagccccaacattctcggaccgagatgtatcaacacaggggaatcgtgcgacaacgcgaatagcacctgtcctatcggcggtccgagtatgtgcattgccaaggggcctggccaggacatgtttgatagcacgcaaattattgggagagctatgtatcaacgagctaaggagctgtatgccagcgcctctcaggaggtgaccggccctctcgcatctgcccatcagtgggtcgacatgactgacgtgaccgtttggctgaacagcacacacgcttcaaagacctgcaagccagctctaggctattcattcgcagccggaactatagatggagtaggtggactaaacttcacacagggtaagactgagggggacccgttttgggacactatccgcgaccagattctgggaaagccgagcgaggagattaaggaatgccacaagccaaaaccgattttactgcacaccggcgagttgtcgaaaccacacccctggcaccccgatatcgtcgacgtgcaaataatcactctgggatcgctggcaatcactgctatccccggcgaatttacgaccatgtctggcaggagactcagggaggcggtgcaagccgagttcgcgagccacggtatgcagaatatgactgtggtgatctcagggctgtgtaatgtgtatacccactatataacaacatacgaagagtatcaggcccaaagatacgaagctgcatccacaatctacggtccacacacacttagcgcatacatccagctgtttcggaatctggccaaagcaatcgcaacagatacagtcgctaatctgagtaggggcccggaaccgccgttctttaaacaactgatcgtaccattaatcccaagtattgtggatagggcgcccaaaggcaggacgtttggtgatgtactgcagcctgccaagcctgaatatcgcgtaggggaggtcgccgaagtgattttcgtgggagcaaatccaaaaaactcagtccagaatcagaatcatcaaactttcctaactgtggagaaatacgaggccaccagtacaagttggcagattgtgtgtaacgatgccagttgggagaccagattttactggcataagggcctgctcggactgagcaacgctacagtggagtggcatattccggatacagctcagcccggaatctaccggattcgatactttggacacaataggaagcaagatatcctcaaacctgctgtcatcctatctttcgaagggacgtcgcctgcatttgaggtggtcaccatctag

SEQ ID NO: 196481 - DNA, 1869 bp, Artificial Sequence
  Description of Artificial Sequence: Synthetic coding sequence
atggacagcgagaagagcagcgagtggcggagcgacgtgctgaacagattacagtccaagtatggatcactgtatcggagagataacgtgattctgtctggaacccacactcactcaggcccagctggatactttcagtacactgttttcgttatagcctcagagggcttctccaatcaaactttccaacatatggttacaggcattttgaaaagcatagacattgcccacactaacatgaagcctgggaaaattttcatcaacaaagggaacgtggatggtgtgcaaatcaataggtctccctactcttacttacaaaatccacagtcagagcgggcccgctactcttctaacacagacaaggagatgattgtcctgaagatggtggacctcaacggtgatgacctggggctaatcagttggttcgccatacatccggtgagcatgaataacagcaatcatctcgttaattccgacaacgtggggtatgcgtcatatctcctggagcaggaaaagaacaagggctacttgccaggccagggcccattcgtcgccgccttttcctcctccaatctgggagatgtctcacccaatatcctgggaccacgttgcatcaacactggggaatcctgcgataatgcaaactccacttgccccattggcggcccatccatgtgtatcgcaaagggccccggccaggacatgttcgatagcacccagataatagggcgggcaatgtaccagcgtgccaaagagctgtatgctagtgcatcgcaagaggtgactgggcctcttgccagcgcgcaccaatgggtcgatatgacagacgtaacggtgtggctcaactctactcacgcatccaagacctgcaagcctgcacttgggtattccttcgctgccgggacaattgatggggtaggcgggcttaacttcacacaaggtaaaaccgagggggatcccttctgggacaccatcagggatcagatcctgggcaagccatccgaggaaatcaaggaatgtcacaagccgaagcccatactgcttcacaccggcgagctgagtaaaccacacccttggcatcctgatattgttgacgtgcagattatcaccctgggatcactggccatcacagcaatcccgggagagttcacaacaatgtccggccgtcggttacgggaagccgtccaggccgagtttgcctcccacggcatgcaaaacatgacagtagtgatatccggactctgtaatgtgtacacacattacattactacatatgaagagtatcaagctcagagatatgaggcggcaagcaccatctacggaccccatactctgtccgcctacatccagctctttcgcaacctggcgaaagctatcgccaccgacacagtggctaatctttccaggggcccggagcctcctttctttaagcagctcatcgtgcccctgatcccgagtatcgtggatcgggccccaaaggggcgcacattcggggatgtcctgcagccggccaagcctgaatatcgtgtaggcgaagttgcggaggtcatctttgtgggggcaaaccctaaaaacagcgtccagaaccagaatcaccagacttttttgaccgtcgaaaagtacgaggctacttcaacatcatggcagatcgtctgcaacgacgcttcatgggagacccgcttctattggcacaaagggctattgggcctgtcaaatgcaaccgtagaatggcatattccggacactgcgcagcctggtatctaccgaattcggtattttggtcataaccgcaaacaggatatactgaagcctgccgtcattctttccttcgaaggaacctcaccagcgtttgaggtcgtcaccatctag

SEQ ID NO: 196482 - DNA, 1341 bp, Artificial Sequence
  Description of Artificial Sequence: Synthetic coding sequence
atggagatggagcaggagaagatgaccatgaacaaggagctgagccccgacgctgctgcatactgctgctctgcctgtcacggtgacgaaacgtggagctataaccaccctattcgaggaagagctaaatctcgttcactgtcagccagccccgctctaggctcaactaaggaatttaggagaacccgatccttgcatggaccgtgtcccgtgacgacatttggccccaaggcttgtgttctgcagaaccctcagactattatgcacatccaggacccagcatcacagagactgacttggaataagagccctaagagtgtactggtgattaaaaagatgcgggacgcgtcactcctacagcctttcaaggaactgtgcactcatctcatggaggagaacatgatcgtgtatgtggagaagaaggtcctcgaagatccagctatcgcttctgatgaaagcttcggcgctgtgaagaaaaaattttgtacatttcgcgaggactatgacgatatctccaaccagatcgactttataatttgcctcggaggcgatggcacactgctgtatgcatctagtctgtttcaaggtagcgtccctccagtgatggccttccatctgggttccctaggcttcttaactccattttcatttgagaactttcagtcccaggtcacgcaggttatcgaggggaacgctgccgttgtgctgaggtcacggctgaaagtacgggttgttaaagagcttcgggggaaaaagacagctgtccacaacggactgggcgaaaatgggagccaggccgcaggtctggatatggacgttggaaaacaagcaatgcaatatcaggtgctgaatgaagtggtgattgaccgcggaccgtcttcctacctgtcaaatgtcgatgtctacctcgacggccacctcataactacggtgcagggtgacggcgtgatagtgagcacccccactggttcaacagcctatgctgccgcggccggcgctagcatgattcaccctaatgtgcccgcaattatgataactccaatatgcccacactccttatcatttcgccccatagtggtccctgctggagttgagctgaaaattatgctgtccccagaggcacggaataccgcttgggtgagtttcgacgggagaaaaagacaagaaattcggcacggtgacagcatcagcatcaccaccagctgctaccccctcccgagcatttgcgtcagagaccccgtgtcggactggttcgagtctctggcccagtgtttgcattggaatgttcggaagaaacaagctcactttgaagaagaggaagaggaagaggaggagggctag

SEQ ID NO: 196483 - DNA, 1341 bp, Artificial Sequence
  Description of Artificial Sequence: Synthetic coding sequence
atggagatggagcaggagaagatgaccatgaacaaggagctgagccctgatgctgccgcatattgctgttcagcttgtcatggagatgaaacatggagctataaccatcccattcggggtagagccaagtcacgcagcctcagtgccagtcccgccctaggaagtaccaaggagtttcgccgcactcggagtttacacggaccttgcccggttaccaccttcgggcctaaagcttgtgtgctccaaaatccacaaacaattatgcacatccaggatccggcttcccaaagactgacttggaacaagagtcccaaatcagtgctcgtcatcaagaagatgagggatgccagcctgctccagccattcaaggagctttgtactcaccttatggaagagaatatgatcgtctacgtggaaaagaaagtgctggaggatcctgctatagctagcgacgaatcatttggggctgttaagaaaaagttctgcactttccgagaggactatgatgacatttctaatcagattgacttcataatctgtctcggcggggatgggactctgctttatgcctcgtccctctttcaggggagcgtcccgcccgttatggccttccatctaggatccctgggatttcttacgcccttcagcttcgagaattttcagtctcaagtgacacaagtcatcgaaggtaacgctgctgttgtcctgcggagtcgcctcaaggttagagttgtaaaggaactgcgcgggaagaagaccgctgtgcacaatggtctgggcgagaatggttcccaggcagcaggcctggatatggacgttggaaaacaagcaatgcagtaccaagtattgaacgaggtggtgattgatagaggcccctcttcttacctgtcaaatgtggacgtttatctcgacggccatttgatcaccactgtgcaaggggacggagtgatcgtatcgacacctacagggtctacagcttatgccgctgctgccggagcttcaatgatccacccgaatgtccctgctataatgataaccccaatctgccctcacagcctctctttcaggcccatagtggtccctgccggcgttgaactcaagattatgctctcccctgaagcccgtaataccgcgtgggtgagtttcgacgggcgcaagcgccaggagattaggcatggggattcaataagtatcactacctcgtgttatcctctgccgtctatttgcgtgcgcgaccccgtcagtgactggttcgaatcgctcgcccagtgcctacactggaatgtcagaaaaaaacaggcgcactttgaagaagaagaagaagaagaggaggagggctag

SEQ ID NO: 196484 - DNA, 1245 bp, Artificial Sequence
  Description of Artificial Sequence: Synthetic coding sequence
atgggccggccccgggtgcggcaggcctggcccggctgctgcggccacacaggccgccttcctgcaggcagaggatatctggcgagccacatgtgtgaccccgccggcgcagagcttataggggatgggatgtctgacccgacccctccatccaacgcttgtactggacacatccaggacccagctagccagaggttaacatggaacaagtctcccaagtccgtgctagtgatcaaaaagatgagggacgcgagcctgctgcagcctttcaaggagctgtgtactcatctcatggaggaaaacatgatcgtgtacgttgagaagaaagtcttggaagaccccgcgatcgcatccgacgagagtttcggcgcggtgaagaagaagttctgcacattcagagaagactatgacgacatctctaaccagattgattttataatctgcctgggcggagacgggacccttctatatgccagttcactgttccaaggatccgtcccgccagttatggcattccacctgggctccctcgggtttctcacgccattttctttcgagaactttcagtcacaggtcacccaggtgatcgaaggcaatgccgccgtggttctgaggagcaggcttaaagtccgtgtcgtgaaggaactgcgcggcaagaagaccgccgtccataatggcctaggtgagaacggctcacaggctgccggcctggacatggacgttggcaagcaggcgatgcagtatcaggtactgaatgaagtggtaatcgaccggggccctagcagctatcttagcaacgttgatgtttacctcgacggccatctgattacaactgtacagggagacggcgttattgttagtactcctactgggagcaccgcctatgctgcagccgcgggggcaagcatgatacatcctaacgtacccgctatcatgattacaccaatttgcccccacagcttgtccttccggccaatagtcgtgcccgctggagttgagcttaagatcatgctgagtccagaggcacggaacacagcctgggtgagcttcgatgggaggaaaagacaagaaatccggcacggagactcaatctctatcacaactagttgttacccgctcccctctatctgtgtacgcgatccggtgtctgactggttcgaatcactcgctcaatgcctccactggaatgtaaggaaaaaacaagcccatttcgaagaagaggaggaagaggaggaggaggggtag

SEQ ID NO: 196485 - DNA, 1776 bp, Artificial Sequence
  Description of Artificial Sequence: Synthetic coding sequence
atggagatggagcaggagaagatgaccatgaacaaggagctgagcccagatgcggccgcatactgctgcagcgcctgtcacggggacgaaacgtggtcctataaccatccaatccgggggagggcgaaatctaggtcattatcagcgagccctgccctcggctccacaaaggagtttagacggacacgcagcctgcacggcccctgtcctgttacgacattcgggcctaaggcttgcgtgctgcagaaccctcagacaatcatcgcgactccgctgtctctcgccagccaactgctccccagcccagccgtcagtcacagcgggcagggtggggtgaccggacaggtgcatgtgctcccgcaaccatccgaccagggcgtgctgagtggcccccgggctgcccgcggccagaccgctccgcaggaggaggctgtcacccaggaagaagtagaggccctcgtctgtgggcatacgcaaaggtgggtgcccggacccgtgtacgatgccgcagccgggggaagcgggtgggcacaactgtccctgcgggcgggaatgggtgtcggccaggcaaccggccacattcaggatcccgcttctcagcgcctgacatggaacaagtcccctaaaagtgtgctcgttatcaagaagatgcgagacgcgtcactgcttcagccattcaaggagctgtgcacccacctaatggaggcgagaggagccggtggcaagggcgcctggggcgcccacggggtgggcggggccagcatccatatcacggcccccagagtgggatctgcgggagggatgagcaggcttgctctgtgcttccaggagaacatgatcgtatacgtggagaagaaagttttagaggaccctgcaatcgcttccgacgagtcatttggggccgtcaaaaagaagttctgcaccttcagggaggactacgacgatatcagcaatcaaatcgatttcattatctgtcttggcggcgacggcaccctgctctacgccagttcgctgttccagggctccgtgccacccgtcatggccttccatttagggtctctgggattcttaactccgttcagctttgagaactttcagtctcaagtcacacaggtgattgagggaaacgcagcggtggtcttgcggagccgcttaaaagttcgtgttgtgaaggagctgagaggcaagaaaaccgcagtgcataatggtctcggagaaaacggaagtcaggcagcgggactggacatggatgttggcaagcaggctatgcagtaccaggttcttaacgaagtggtaattgaccgcgggccatcatcatacctgtccaacgtggacgtataccttgatggtcatttgattacaaccgtgcagggggatggggttattgtgagcacgcccacaggatcaacagcctacgctgcggctgctggtgcttctatgatacatcccaacgtgcccgcgattatgatcacccctatctgcccacactcgctgtctttccggcccattgtcgtgccagccggagtcgaacttaagatcatgctctcccccgaggccaggaacactgcctgggtgtcctttgatggtaggaagagacaagaaatccgccacggggattccatatctattacaacttcttgttaccctctgccaagcatctgtgtccgagaccccgtgtcagattggtttgaatcactagcccagtgtttgcattggaacgtgaggaagaagcaggctcacttcgaagaagaggaggaggaggaggaggagggctag

SEQ ID NO: 196486 - DNA, 1776 bp, Artificial Sequence
  Description of Artificial Sequence: Synthetic coding sequence
atggagatggagcaggagaagatgaccatgaacaaggagctgagccccgacgccgctgcctattgttgcagcgcgtgtcacggagacgagacatggagttataaccatccaatcagaggcagagccaaaagcagaagtttgtccgcctcacccgctctcggcagtactaaggaatttcgacggacccgctcactgcatggaccttgccctgtgacgacctttgggcccaaagcgtgtgtactgcagaatcctcagaccatcatagccacaccccttagcctggcctcccagctactgccatctccggcagtaagccacagtggacagggcggcgtgaccggtcaggtgcatgtgctacctcagccttccgatcaaggagttctgtcaggtcctcgggctgccagagggcagaccgcccctcaggaagaggccgtcacccaggaagaggtcgaggccctcgtgtgcggacatactcaaaggtgggtgccggggcctgtctatgacgccgctgctggggggagtggttgggcccaactgagcctgagggccggtatgggtgtgggacaagcgactggtcatattcaggaccccgcctctcagcggctaacatggaacaaatctccgaagagcgtgctggtcatcaagaaaatgagggatgcttcacttctgcagcctttcaaagagctgtgtacccatttaatggaagcccgcggtgccggagggaaaggcgcttggggagcacacggcgtgggcggcgccagtatacacataaccgccccgcgcgtggggtccgctggtggcatgtcacgacttgctttgtgttttcaggaaaatatgattgtgtatgtcgagaagaaggtgctggaggacccagccatcgcgagcgatgaatcctttggagccgtgaagaaaaagttctgcacatttcgcgaggattacgacgacatctccaatcaaatcgattttattatttgcctgggcggcgacggtactctgctgtacgcgtctagcctctttcagggatccgtgcccccggtcatggcctttcacttggggagtctgggatttcttacacccttttcctttgagaattttcagtcccaagtgacccaggtgatcgaggggaacgctgccgtggtgctacgcagcagattgaaagtacgggttgttaaggaactgagagggaaaaagactgctgttcacaatggtctcggcgaaaacggctcacaagctgcgggtttggatatggacgttggtaagcaagcaatgcagtatcaagttctgaacgaagtagtcatcgatagaggaccctcatcctatctctctaacgtggatgtttacctcgatggacatctcattactactgtgcaaggggacggcgtgatagtttccacaccgactggttcaactgcatacgcagctgccgctggggcgagcatgatccacccaaacgtgcctgctattatgattaccccaatatgcccgcactctctcagctttagaccaatcgtcgtaccggccggtgtggaactgaaaatcatgttatccccagaggctaggaataccgcatgggtttcattcgacggcaggaaaaggcaggagattcggcacggcgactcgatatcaattacgaccagttgttacccgctcccctccatatgcgtgagggatcccgtcagcgactggttcgagtcgctggcacagtgcctgcattggaatgtgcggaagaagcaggcccacttcgaagaagaggaggaggaggaagaggaaggatag

SEQ ID NO: 196487 - DNA, 621 bp, Artificial Sequence
  Description of Artificial Sequence: Synthetic coding sequence
atgggccggccccgggtgcggcaggcctggcccggctgctgcggccatacagggcgcctccccgctggccgtggttatctggcaagccatatgtgtgatcctgctggagcagaattgatcggggatggaatgagcgatcccacaccaccttcgaatgcttgtacagggcacattcaggatcctgcctcccagagactgacatggaacaagtccccaaaatcagtattggttatcaagaagatgagggatgcctccctactccaacccttcaaggaactctgcacccacctcatggaagagaacatgattgtgtatgtggaaaaaaaggtacttgaggacccggcgatcgcctcagatgaatccttcggagcggtcaagaagaagttttgcacctttcgtgaagactatgacgacatcagtaaccagatagattttattatatgcctgggaggagatggaactcttctgtatgcaagctctctgtttcaaggaagtgttccacccgttatggcattccatctggggagtctcggtttcctgacaccattctctttcgaaaatttccagtctcaggttacgcaggtgatcgagggaaacgctgccgttgtcctccgctcatag

SEQ ID NO: 196488 - DNA, 2121 bp, Artificial Sequence
  Description of Artificial Sequence: Synthetic coding sequence
atgggccggaaggtgaccgtggccacctgcgccctgaaccagtgggctctcgactttgagggtaacttgcagaggatcctgaagtcaattgaaatagccaagaatcggggcgcgcgctaccggttggggccagaactcgagatctgtggatatggctgctgggatcactattacgagtccgatacgctgctgcacagctttcaagtgttagccgccctggtggagagccctgtcacccaagatatcatttgcgacgtgggtatgcctgtcatgcaccgcaatgttcgctataactgccgcgtcatttttctcaatcgcaaaatcctgctgatccggcctaaaatggccctcgccaatgaggggaattaccgggaactcaggtggttcacaccttggagcagaagccgtcacacagaagaatatttcttgcccaggatgatccaagacttgacaaagcaagagacggtaccctttggcgacgctgtccttgtcacgtgggatacatgcatcggcagcgaaatatgcgaagagctttggactccccactccccccacatcgatatgggcttggacggagtcgaaattattactaatgcgagcgggtcgcaccaagtgcttagaaaggccaataccagggttgatttagtaaccatggttacttctaaaaatggcggcatttacttgcttgcaaatcagaagggatgtgatggcgatagactttattatgacgggtgcgccatgatagcgatgaacgggtctgtattcgcccagggcagccagttcagcttggatgacgtcgaggtgctgacagcaacattagacctcgaggacgtgcgcagttaccgcgccgagatatcgtccaggaatctagctgccagcagggcctccccctatcccagggtcaaagtcgattttgccttgagctgccacgaggaccttcttgcccccatttcagaaccaatcgaatggaaatatcatagccctgaggaggaaatctccttgggacccgcgtgttggctctgggatttcctgagacgtagccagcaggcgggcttccttcttcctctgtctgggggggtcgacagcgccgcaactgcctgtttaatatattccatgtgctgtcaggtgtgtgaagccgtgcgctctggaaacgaggaggtactggcagatgttagaaccatcgtcaatcaaatttcctacaccccccaggacccaagagatctatgtggcagaattctgactacttgttacatggctagtaaaaacagttcccaggagacgtgtacccgtgcacgtgaactcgctcagcaaatagggagtcatcatatatcacttaatatcgatcctgccgttaaagcagtcatgggcatcttttctctagtgacggggaagtctcctttgtttgcggctcacggggggtcgagcagagaaaatctggctctccagaatgttcaggctaggattcggatggttctggcctacctcttcgcccagctctcactttggtcaagaggcgtgcacggcggactcctggtgctgggcagcgcgaacgtcgatgagtctttgcttggttacctaactaaatatgattgttcatctgccgatattaatcctataggtggcattagcaagactgacttgcgtgctttcgtgcagttctgcatacagagatttcagctgcccgcactccaatccattttgctggcaccagctaccgccgagctcgaacctctggctgatggccaggtaagtcagaccgacgaagaagatatgggaatgacctatgctgaactttcagtctacggcaagctgaggaaagtagcaaaaatggggccctactctatgttctgcaagctgctgggtatgtggcgtcacatttgtaccccacggcaggtggctgacaaagtgaaaaggtttttctctaagtactctatgaataggcacaagatgacgacactgaccccagcctatcacgcagagaactactccccagaagacaatcggtttgatttgcgcccctttctctacaatacctcatggccatggcagttccgttgtattgagaaccaagtactgcaattggaacgagcagaaccacagagtttagacggcgtggactag

SEQ ID NO: 196489 - DNA, 1341 bp, Artificial Sequence
  Description of Artificial Sequence: Synthetic coding sequence
atgggcatcagcggccaggaggtgctgaccgccaccctggacctggaagacgtgcggtcctatcgcgctgagatctcttcccggaatttggccgcttctagagcttccccttatcccagagtaaaagtcgattttgctctttcctgccacgaagacctactagctccaatctcagaacccattgaatggaaataccactctccagaggaggagattagccttggaccagcctgttggctttgggacttcctgagaagaagccagcaggccggttttctgttgcccctttcaggtggcgttgacagtgccgcaacagcgtgcctcatctattctatgtgctgtcaggtatgcgaagccgtacgatcggggaacgaagaggtcctcgcggacgtgcgaaccattgtgaaccaaatctcttacacaccccaagacccccgggatctgtgtgggcggatactgacaacctgctatatggcttcgaaaaatagttcacaggaaacctgtacaagggccagagaactcgcccagcaaattggttctcaccatatttctctcaatattgaccctgctgtgaaagctgtgatgggcatattctctcttgtgaccggcaaatctcctttgttcgcggctcacggcggatctagccgagaaaacttggccctgcaaaacgtgcaggcccgcatccgcatggttctggcctacttattcgcccagttgagcttatggagcaggggggtccatggggggctgttggtcttagggtcagcgaacgttgacgaaagcctgcttgggtacttgacgaagtatgattgtagtagtgcagatataaacccaatcggcggaatctctaagacagatctcagggccttcgtccagttttgtatccagcgatttcagctaccagcccttcagagcatactgcttgccccggctacagctgaactggaacctctcgcagacggccaggtatcccagaccgatgaagaggatatggggatgacttacgctgaactgtcggtttatggtaagttgaggaaggtggccaagatgggaccatattctatgttctgtaagctgcttggaatgtggcggcacatctgcacaccacgccaggtggctgacaaagtcaaaaggttcttcagtaagtactccatgaataggcataagatgacaacccttacccctgcatatcatgcagagaactactctcctgaagataatcgatttgaccttagacctttcctgtacaataccagctggccgtggcaattccgttgcatcgaaaaccaggtgttgcagttagaaagagctgaaccccagagtctggacggcgttgactag

SEQ ID NO: 196490 - DNA, 1122 bp, Artificial Sequence
  Description of Artificial Sequence: Synthetic coding sequence
atggagcccgccgtgagcgagcccatgcgggaccaggtggcccggactcacttaaccgaagatacaccgaaagtgaatgccgatatcgaaaaagttaatcagaaccaggcaaaacgttgcactgtgatcggcggaagtgggtttctgggacagcatatggtcgaacagctgctggcaagagggtacgccgtcaatgtgttcgacatacagcagggattcgacaatccgcaggtgcgtttctttctgggcgacctatgctctcgtcaggacctttaccccgccctgaagggcgtgaatacagtgttccactgtgccagccctccacccagcagtaataataaagaactgttttacagagtaaattatatcggcaccaagaacgtgattgagacctgcaaggaggcgggagtgcaaaaattgatcctcactagctccgcgagcgtgatcttcgagggggtggatatcaaaaatgggaccgaagacttaccctacgcaatgaaacctatcgactattataccgaaaccaaaattctgcaggagcgggccgtgctcggggctaatgatccggagaaaaacttccttactaccgccatccgcccacacggaatcttcgggcccagggatccccaactcgtgcctatcctgatcgaggctgctagaaatgggaaaatgaaattcgtgatagggaatggtaagaatctggttgatttcactttcgttgaaaacgtggtgcatggtcacatcctagccgccgagcagctctctagagatagcaccctaggcgggaaggcgttccacataacgaatgacgagcccataccgttctggacatttttatcaagaattctgacaggcctcaactatgaggccccaaagtatcacataccgtactgggttgcctattatttggctctgcttctctcgctgctggtcatggtcatttctcctgtgatacagctgcagcccacctttactcccatgagagtagcgttggccggtacttttcactactacagctgtgaacgcgccaaaaaagctatggggtatcaacctctcgtgactatggatgatgccatggagaggacagtgcagtcatttcgacatttgcgacgtgtgaagtag

SEQ ID NO: 196491 - DNA, 765 bp, Artificial Sequence
  Description of Artificial Sequence: Synthetic coding sequence
atggagcccgccgtgagcgagcccatgcgggaccaggtggcccggacacaccttactgaagatactccaaaggtgaatgccgatattgagaaggtgaatcaaaatcaagcaaagcggtgtaccgtgattggtggaagcgggtttctgggccagcatatggtggagcagctgttagccaggggctacgcggtgaacgttttcgatattcagcaaggattcgataatccccaagtgcggttctttctgggggatttgtgtagccggcaagatctgtacccagcactcaaaggcgtcaataccgtcttccactgcgcttccccgccacccagttccaacaacaaggaactgttttaccgagtcaattatattggtactaagaatgtgatcgagacctgtaaagaagctggagtgcagaagctgattttgaccagttcggcctctgtgatatttgagggcgtagacatcaaaaacgggaccgaggacctcccttatgccatgaagcctatcgattattataccgagactaagattctacaggagagggccgtgctgggagccaatgaccctgagaagaattttctgacaaccgccatccggccccacggaatattcgggcccagagatccacagctcgtcccaattttgatagaggcagctcgcaacgggaagatgaagtttgtgattgggaacggcaagaatctcgtcgattttacatttgtggaaaatgtcgtgcatgggcatattctcgccgccgaacagctgtag

SEQ ID NO: 196492 - DNA, 1122 bp, Artificial Sequence
  Description of Artificial Sequence: Synthetic coding sequence
atggagcccgccgtgagcgagcccatgcgggaccaggtggcccggacccatctgactgaagacactccaaaggtgaacgccgatatcgagaaagtgaaccagaatcaggccaaacggtgcacagttatagggggctccgggtttctgggacagcacatggtggagcaactgctcgcgagggggtacgcagttaacgttttcgacattcaacaggggtttgataatcctcaggtccgattttttttaggagacctgtgctcccgccaggatctctatcccgctctgaagggggtgaatactgtgtttcactgtgcgtctccccctccatccagcaacaataaggagctcttctatcgggtaaactacattggcacgaaaaacgtgatagaaacatgtaaagaagccggtgttcaaaagctgattcttacttccagtgcgtccgtgatatttgagggagttgacataaaaaacggcacggaagatctcccttacgcaatgaaaccaatcgactattacacagaaacgaagattctccaggagagagctgtcctcggcgctaatgatccagaaaaaaacttcctcactacagccatccggcctcatggaatctttgggcctagagatccccagctcgtcccaatcctcatagaggccgccagaaatggaaagatgaagttcgtcattgggaacggaaagaatctggtggatttcaccttcgtcgagaatgtggtgcatggccacattctggcagccgagcagctttcaagggacagtactctgggaggcaaagcatttcacattacgaatgacgagcctattccgttctggacctttctcagcagaattctcacaggcttaaactacgaagcgcctaagtatcacatcccatactgggttgcttactacctggccctactgctttccttgctcgtgatggttatatcacctgtgatccaactacaacctaccttcacccccatgagagtagcacttgcaggcacgttccactactatagctgtgaacgggccaaaaaggcaatgggctaccagccgctggtcacaatggatgacgcaatggaacgcactgtgcagtcgtttagacacctcagacgtgtcaagtag

SEQ ID NO: 196493 - DNA, 825 bp, Artificial Sequence
  Description of Artificial Sequence: Synthetic coding sequence
atggtgggccggcgggccctgatcgtgctggcccacagcgagcggactagtttcaactatgctatgaaagaagctgccgcagccgccttgaagaagaaagggtgggaagtggtcgaatcagatttgtacgcaatgaacttcaatcctatcatttcaagaaaagacattacgggaaaactcaaagatcccgccaatttccagtacccagccgagtccgtccttgcctacaaagagggacatctgtctcccgatattgtggcggaacagaaaaaacttgaggcggcagatctggtcatcttccagttccctctgcagtggttcggtgtacctgctattcttaaaggctggttcgagagggtttttattggagagttcgcctacacttacgctgctatgtacgataaaggaccattcagatcgaaaaaggccgtcctctcgatcacaacgggagggagcggctccatgtatagtctgcagggcattcatggcgatatgaacgtcatactttggcccatacagtccggcatcttacacttttgtgggttccaggtgctggagccccaactcacctattccatcggacacaccccagcagacgccagaatacagattctcgagggatggaaaaagcgtcttgagaatatctgggacgaaactccattgtatttcgccccaagttccctcttcgacctaaactttcaagcaggcttcctgatgaaaaaagaagtgcaggacgaggagaagaataaaaagtttggcctgtccgtgggacatcacctgggcaagtcaatccccacggataaccaaatcaaagccagaaagtag

SEQ ID NO: 196494 - DNA, 711 bp, Artificial Sequence
  Description of Artificial Sequence: Synthetic coding sequence
atggtgggccggcgggccctgatcgtgctggcccacagcgagcggactagctttaactacgctatgaaagaggctgccgcagctgcgctgaagaagaaaggctgggaagttgttgagtcagatttgtacgcaatgaactttaatccaatcatcagtcgaaaggatatcacaggcaaactcaaggacccggcaaattttcaatatcccgcggagtcagtgctggcatacaaagaggggcacctgtcacctgatatagtggcagagcagaaaaagctggaagcagctgacttggtcatcttccagtctaagaaagcagttctgtctataaccacaggtggatctgggagcatgtactcactccagggaatccacggtgatatgaatgtgattctgtggccaattcagagcgggattctacacttctgcggattccaggtcctggagccgcagctgacttactcaatcgggcacacaccagccgacgcccgcatacagatcctggagggatggaaaaagagacttgagaacatctgggatgagactccactgtactttgcccccagttctctctttgatctcaatttccaggctggcttccttatgaagaaagaggttcaggatgaagagaagaataagaaatttgggctttctgttggtcaccatctcggcaagagcatccctacagacaatcagatcaaggccaggaagtag

SEQ ID NO: 196495 - DNA, 723 bp, Artificial Sequence
  Description of Artificial Sequence: Synthetic coding sequence
atggtgggccggcgggccctgatcgtgctggcccacagcgagcggacctccttcaactacgctatgaaagaagccgccgccgccgccctgaagaagaagggctgggaagtagttgagagtgacctgtatgctatgaactttaaccccatcatctctcggaaagatatcacgggcaagctgaaagatccagcgaatttccaataccccgcggaatcagtgctggcgtataaggaaggtcacttgagccccgatatcgttgccgaacaaaagaaactcgaagccgctgatctggtgatatttcaattcccactccagtggttcggtgtgcctgcaattctgaagggttggtttgaacgagttttcattggcgaattcgcttatacctacgctgccatgtatgacaaaggacctttccgatcagggatcttgcacttttgcgggttccaggtgctggaacctcaactaacttattctatcggccatacacccgcagacgctcgcattcaaatactggagggctggaagaaaaggcttgagaatatatgggacgagacgcccttatattttgctccctctagcttattcgatctcaatttccaggcaggattcctgatgaaaaaagaggtccaagatgaagaaaaaaataagaaattcggcctgtctgtaggtcatcatttaggaaaatcaattcccacagacaaccagatcaaggccagaaaatag

SEQ ID NO: 196496 - DNA, 609 bp, Artificial Sequence
  Description of Artificial Sequence: Synthetic coding sequence
atggtgggccggcgggccctgatcgtgctggcccacagcgagcggacgtcattcaattacgctatgaaagaggccgccgccgccgctttgaagaagaaaggatgggaggtggttgaatccgatctctacgcaatgaactttaatccgatcatcagtaggaaggatatcactgggaagttgaaagaccctgctaattttcagtatcccgctgagtctgtgctcgcctataaggaagggcatctgagccctgacatcgtggctgaacagaagaagctcgaggctgccgacctcgtcattttccagagcggtattttacatttttgcggcttccaagtcttggagcctcaactgacctatagcatcggacatacccccgccgatgcccgaatccagatactcgaggggtggaaaaagagactggagaatatttgggacgaaacaccactctacttcgccccttcctccctgttcgatttaaacttccaagccggattcctcatgaagaaagaagtccaggatgaggagaagaacaagaagtttgggttatccgtcgggcatcacttaggtaagtcaatccctaccgataaccagatcaaagccagaaagtag

SEQ ID NO: 196497 - DNA, 696 bp, Artificial Sequence
  Description of Artificial Sequence: Synthetic coding sequence
atggccggcaagaaggtgctgatcgtgtacgcccaccaggagcccaaaagtttcaacggctctttgaagaatgttgctgtggacgaactctcacgacagggctgcactgttactgttagtgatttgtacgccatgaatctcgagccacgtgctaccgacaaggatatcaccgggaccctgtccaatcctgaggtctttaactacggtgtggagactcacgaggcttacaagcagcggagccttgctagtgatattacagacgaacagaaaaaggtacgcgaggccgaccttgtgatttttcagtttcccctttactggttctccgtccctgcaattctaaaaggctggatggaccgtgtcctctgtcagggcttcgcattcgatatccccggcttctatgattctgggttactccagggcaaacttgctcttctctccgttaccacaggggggaccgccgagatgtataccaagacaggagtgaacggagactcgaggtattttttgtggccccttcaacacggcaccttgcacttttgtgggtttaaagtgctggctcctcagatcagctttgccccagagatcgccagcgaggaggagcgaaaaggaatggtggctgcatggtcgcagagactgcagacaatttggaaggaagagccaatcccttgtacagcccactggcatttcggtcagtag

SEQ ID NO: 196498 - DNA, 696 bp, Artificial Sequence
  Description of Artificial Sequence: Synthetic coding sequence
atggccggcaagaaggtgctgatcgtgtacgcccaccaggagcccaagagctttaacggaagccttaaaaacgttgctgtggatgagctgtcccgacagggatgcacagtcaccgtgagcgatctgtacgccatgaatctggagccacgggctacagacaaagacataactggcacactgtctaatcccgaggtctttaactatggagtggagacccacgaagcttacaaacagaggagcttggcttccgacataacagacgagcaaaagaaggtccgggaagctgacctggtaatctttcagtttcctctctactggttctccgtgcccgcgatcttaaaaggatggatggatagggtgctatgccaggggttcgcttttgacatcccaggattctacgatagcggattacttcagggtaagctggcactgttgtcagtcaccaccgggggaacagctgagatgtatacgaaaactggtgtcaacggtgattcccgctactttctgtggccccttcagcatgggacactccatttctgtgggttcaaagtgctggcccctcaaattagtttcgcccccgagatcgccagcgaggaggaacgcaagggtatggtagccgcctggagccagcggctgcagacaatctggaaggaggagcctatcccatgcactgcgcattggcacttcgggcaatag

SEQ ID NO: 196499 - DNA, 582 bp, Artificial Sequence
  Description of Artificial Sequence: Synthetic coding sequence
atggccggcaagaaggtgctgatcgtgtacgcccaccaggagcccaagtcttttaatggctctctcaaaaatgtggcggtggacgagctatcgagacagggatgtaccgtcacagtctcagatctctacgcaatgaatttggagccccgggccaccgataaagatataacaggtactcttagtaacccggaagttttcaattacggggtcgaaactcacgaagcatataagcagagaagtctggccagcgacattactgatgaacaaaagaaagtgcgcgaagcagatctcgtgatcttccagggaaagttggcgctgctaagcgtgactacaggaggcacggcagagatgtacacaaagactggcgtgaacggggacagccgctattttctctggcctctgcagcacggcacccttcacttctgcggcttcaaagttctggcccctcagatatcttttgcaccagagatcgcatccgaagaggagagaaagggcatggtcgccgcctggagccagaggctccagaccatttggaaggaagagccaatcccgtgcaccgcgcattggcactttggtcagtag

SEQ ID NO: 196500 - DNA, 582 bp, Artificial Sequence
  Description of Artificial Sequence: Synthetic coding sequence
atggccggcaagaaggtgctgatcgtgtacgcccaccaggagcccaaatccttcaacggttcactgaagaatgttgctgtcgacgagctttcacggcaggggtgcactgtgactgtttccgatctgtatgccatgaacttggagcctagagctacggataaggacatcactggtactttatccaaccccgaggtctttaattacggggttgaaactcacgaggcttacaaacagaggagtctagcctccgatataactgatgagcagaaaaaggtgcgggaagcggatctggtcattttccagggcaagctggccttactgtccgtcaccacgggggggaccgcagaaatgtacacgaaaaccggcgtgaatggagactctcgctatttcttatggccactgcagcatggcacactccacttttgtggatttaaggttctggcccctcagattagctttgctcctgagatcgcctctgaagaggagcgcaaggggatggttgcagcttggagccagagacttcagactatctggaaggaggaaccgatcccatgtaccgcccattggcattttggacagtag

SEQ ID NO: 196501 - DNA, 696 bp, Artificial Sequence
  Description of Artificial Sequence: Synthetic coding sequence
atggccggcaagaaggtgctgatcgtgtacgcccaccaggagcccaaatctttcaacgggagtctaaaaaatgtcgcagtggatgagctcagccgccaagggtgtactgtgactgtatccgacctgtatgcaatgaacctcgagccccgggccactgacaaggatattactggcaccctgtcaaacccggaggtgtttaattatggcgttgagacacacgaagcatacaaacagcgctcacttgcgtctgatatcacggacgagcaaaagaaagttcgtgaggccgacctggttattttccagtttccgctctattggttcagtgtccctgctattctgaaaggatggatggaccgcgtcctttgtcagggatttgccttcgatatccccggattctacgactcaggacttctgcagggaaagctagctctgcttagcgtgacgacaggcggaaccgcggagatgtacaccaagactggagttaacggagacagtcggtactttttgtggccgcttcagcacgggactctccacttttgcggtttcaaagttcttgccccccagatctctttcgcccctgaaattgcgtccgaagaggagcgcaaagggatggtagccgcctggtctcagcgcctgcaaaccatatggaaagaagagcctattccttgcacggcacactggcacttcgggcagtag

SEQ ID NO: 196502 - DNA, 420 bp, Artificial Sequence
  Description of Artificial Sequence: Synthetic coding sequence
atggccggcaagaaggtgctgatcgtgtacgcccaccaggagcccaagtcattcaatgggtctctaaagaatgtggcagtagacgaattgagccgccaagggtgcactgtaactgtttccgatctgtacgctatgaacctggaacctagagccacagacaaggacattacaggcaccctctccaatcccgaggtgtttaactacggagtggagactcatgaagcatacaaacagcggagccttgcctccgatataactgacgagcagaagaaagtccgcgaggctgaccttgtgatttttcaatttccgttgtactggttctccgtgcctgctattttgaagggctggatggacagagtactgtgtcaaggattcgccttcgacataccaggattctatgattctggacttctccagtag

SEQ ID NO: 196503 - DNA, 420 bp, Artificial Sequence
  Description of Artificial Sequence: Synthetic coding sequence
atggccggcaagaaggtgctgatcgtgtacgcccaccaggagcccaagagctttaacggatctcttaagaatgtggctgtcgatgagctctcccgtcaggggtgtactgtcaccgtcagtgatctgtacgctatgaacttagagcctcgcgccaccgacaaagacattaccggaacactttcaaacccagaggtgttcaactatggcgttgagactcatgaggcctacaaacagagaagcctggctagtgatattacagacgagcagaagaaggtgagagaggcagatctggtcatcttccagtttccattgtattggttctcggttccggccatattgaagggatggatggatcgcgtactgtgtcagggttttgcgttcgacatccccggcttctacgacagcggacttttgcaatag

SEQ ID NO: 196504 - DNA, 192 bp, Artificial Sequence
  Description of Artificial Sequence: Synthetic coding sequence
atggccggcaagaaggtgctgatcgtgtacgcccaccaggagcccaagtcttttaatggcagcctgaaaaatgtggctgtggacgagctgtcccggcaagggtgcaccgtgacggtgtctgacctctatgccatgaacttggagcctagagccactgacaaggatatcacggggactttgtcaaatccatag

SEQ ID NO: 196505 - DNA, 483 bp, Artificial Sequence
  Description of Artificial Sequence: Synthetic coding sequence
acccccggcctgaagcagagcagccacctgagcctgtggagcagctgggactatcgcctgttagatagcttaaagcgggattatgcggggaagccccagcccccaattaaatctgagagaagaaatcccccctcttatgccatggcaggaaagaaagttctcatagtgtatgcccaccaggagccgaagtccttcaacgggagcctaaagaacgtggccgttgacgaactctcccgacagggttgtacagtgacagtcagtgatctgtacgctatgaatctggaaccacgtgcgactgacaaggatatcaccggcaccctctccaatcccgaagtgtttaattacggggttgaaacacatgaggcatacaaacaacgctcattggcctccgatatcaccgatgaacaaaaaaaggtgagagaggctgatctggtgatttttcagatgctgtccacggaattgagcctgacctcacgctgttag

SEQ ID NO: 196506 - DNA, 231 bp, Artificial Sequence
  Description of Artificial Sequence: Synthetic coding sequence
atggccgccgccgccgccagccggggcgtgggcgccaagctgggcctgcgcgaaatcagaatccatctatgccaacgatcaccagggagccagggggtgagagactttatagagaaacgttacgttgagctgaaaaaagccaaccccgacctgcctatcctgattcgcgagtgcagtgatgtccagcccaaactgtgggcccgatacgcctcacgggtccagaattcctag

SEQ ID NO: 196507 - DNA, 213 bp, Artificial Sequence
  Description of Artificial Sequence: Synthetic coding sequence
atgtggttcgagatcctgcccggcctgagcgtgatgggcgtgtgcttactcatcccgggcctggcgacagcctacattcacaggttcacaaatggaggtaaggaaaaacgtgtagctcactttggctatcactggtctctcatggagcgggatcgccgcatcagcggtgttgataggtactatgtgtcaaagggcctggagaatatagactag

SEQ ID NO: 196508 - DNA, 1068 bp, Artificial Sequence
  Description of Artificial Sequence: Synthetic coding sequence
atggccctgcggctgctgaagctggccgccaccagcgccagcgccagagtcgttgccgctggtgctcagcgcgttagggggatccattcatcggtacaatgcaagctgcggtacggcatgtggcattttttattaggcgacaaggcatcaaagcgactgacggagagatcacgcgtgatcaccgtggacggcaatatatgcacaggcaaaggcaagttggcaaaggagatcgccgagaagctgggtttcaaacactttcccgaagccggcatccactatccagactcaaccacaggcgatggaaaaccactggccactgattacaacgggaactgcagcttggagaaattttacgatgacccccgatcaaatgatggaaattcttacagactgcagagctggttatactcttcccgacttctccagtattcagatgcactagagcaccttctgacgactggccagggcgtcgtccttgaacgatctatcttctcagacttcgtgtttctcgaagcgatgtataatcaggggtttatccgcaagcaatgtgtcgaccactacaatgaggtcaaatcagtgacaatctgcgactatctgcccccacacctggtcatctacatagatgtgcctgtgcctgaagtccagagacggatccaaaagaagggtgacccacacgaaatgaagattacctccgcgtacctgcaagacatcgagaacgcgtacaaaaaaacctttttacctgagatgtctgaaaaatgtgaagtgctgcaatattctgctcgggaggcccaggacagcaagaaggtggtggaagacattgagtatcttaagttcgataagggcccttggttgaagcaggacaaccgcacactctaccatttaaggctcttggtgcaagacaagttcgaggtcctcaactatacatcgatacctatattcctgccagaggtgacaattggcgcccaccaaaccgaccgggtgctccatcagttccgcgagcttcccgggcgaaaatatagtccaggctataacaccgaggtaggtgacaagtggatatggctgaagtag

SEQ ID NO: 196509 - DNA, 1068 bp, Artificial Sequence
  Description of Artificial Sequence: Synthetic coding sequence
atggccctgcggctgctgaagctggccgccaccagcgccagcgccagagtggttgccagagccccatccgcttggcgaggaattcactcgagcgtccagtgtaaactgcgctacgggatgtggcatttcctgctcggagataaggcttcaaagaggctcaccgaaagatcaagggtgataaccgttgatggtaacatctgtaccggtaaaggcaagctggcaaaagagatagccgaaaagctcggcttcaaacacttccccgaggcaggcattcattatcctgattctaccaccggggacggaaagccattggccactgactacaacggtaactgttccctggaaaagttctacgacgacccaagatcaaacgatggcaattcttaccggctccagagctggctgtatagttccagactgctccagtactccgacgcgttggagcacctcctgactacaggccaaggcgtagtcctagaacgtagtattttttccgacttcgttttcctggaagcaatgtataatcagggctttatcaggaaacagtgcgtagatcactacaatgaggtcaagtccgtgacaatttgtgactacttacctccccacctggtcatctacatcgacgtgccggtgcccgaagtgcagagaagaattcagaagaagggcgaccctcatgaaatgaaaattacttccgcatatcttcaggacatcgaaaacgcctataaaaagactttcttgcccgaaatgtccgaaaaatgcgaagtacttcagtattctgcccgtgaggcccaagatagtaaaaaggtggtcgaagacatcgagtacctcaagtttgataaaggcccctggcttaagcaggacaatcggaccctctaccatctgaggttgctcgtgcaggataaatttgaggtgttgaattacacttcaataccgattttcctcccagaagttacaattggtgctcatcaaaccgatcgggtgttgcatcagttccgggaactgcctggcaggaaatactcccccggctacaacaccgaggtgggtgacaagtggatctggctgaagtag

SEQ ID NO: 196510 - DNA, 426 bp, Artificial Sequence
  Description of Artificial Sequence: Synthetic coding sequence
atggcccccaaggtgttccggcagtactgggacatccccgacggcactgattgccaccggaaggcctattctactactagcatcgctagcgtcgccggactcactgcggctgcttaccgggttactttgaatccgccagggacatttctggagggcgtcgcgaaagtgggacagtataccttcaccgcagctgcggtgggcgccgttttcggacttactacctgtatcagtgctcatgtacgggaaaagcccgatgacccccttaattactttctgggtggctgcgccgggggtctgaccttgggcgcccgcacgcacaactacggcattggtgctgcggcgtgtgtctactttgggatagcagcttccctggtgaaaatgggacggctagagggatgggaagtatttgcgaagcctaaggtgtag

SEQ ID NO: 196511 - DNA, 687 bp, Artificial Sequence
  Description of Artificial Sequence: Synthetic coding sequence
atggcccccaaggtgttccggcagtactgggacatccccgacggcacagactgccatagaaaggcatattctaccacttcaatagccagtgtggctgggctgactgccgccgcctaccgggtgaccctcaatcctcctggaaccttcttggaaggagtagccaaagtgggccagtatacgttcaccgctgcagcagtaggggccgtctttggccttaccacctgcatatccgcacatgtccgtgagaagcctgatgatcccttgaactattttctcggggggtgtgccggaggtcttactctgggcgcccgcaaaactgggtcccattgcgtggtgcaggctggactgaagctcctcgcctcaagtagtccacacaccagcgcttctcagagtgcaggcattatcgggatgtctcattgtgtgcagaggttttgggtgccatcgagcagtgcctgtttagaagtcctctctggcgagtctactgacgttcacgcctgcagttctacccgaggcgcttgcaattcctccggctctagacccctgcccgagctgggagcgcgcgcatcaggtagcttgcgtaaaggcggtcacacacaccctgcaccacgaggagccggagccctgacccccgtccaggcgttaatcgagtctctacttaacacgctcggctccaaccctagaacatag

SEQ ID NO: 196512 - DNA, 684 bp, Artificial Sequence
  Description of Artificial Sequence: Synthetic coding sequence
atgcaggagccccggcgggtgaccccctgcctgggcaagcggggcgttaagacacctcagctgcaacctggctcggcatttttgcctcgtgtgagaaggcagtcttttcctgcacggagcgactcctatactacagtacgcgacttcctcgctgtcccccgcacaatctcaagtgcctccgcaacgctcatcatggccgtggccgtgtcacatttcaggcctggcccagaagtctgggacaccgctagtatggctgcctcgaaagttaagcaggatatgcctcctccaggtggctacgggccaatagactacaagagaaacctacctaggaggggactctcaggctattctatgctagccatcggtatcggaaccttgatatacggccactggtcgattatgaaatggaatcgcgaacggcgaaggcttcagattgaagattttgaagccagaattgcccttctgcccctactccaggctgaaaccgacagacgcaccttgcagatgctgcgtgaaaacttagaggaggaggctatcattatgaaagatgtccctgattggaaggtaggcgagtctgtgttccataccacaagatgggtgcctcccttaataggagagctctacggattaaggactaccgaagaagccctgcacgcttctcatggcttcatgtggtacacctag

SEQ ID NO: 196513 - DNA, 435 bp, Artificial Sequence
  Description of Artificial Sequence: Synthetic coding sequence
atggccgccagcaaggtgaagcaggacatgcccccccccggcggctacgggccaatcgattacaagagaaatctgccccgtcgcggcctctcaggatattctatgcttgctattgggatcggcacactcatttacggccactggtctataatgaagtggaacagagagcggcggcgtctgcagatagaggactttgaggccaggatcgctctgcttccactattgcaagcagaaactgacaggcgaactttgcagatgctccgggagaatctcgaggaggaggccatcattatgaaggacgttcccgactggaaggtcggcgagtctgtcttccacaccacacgttgggtacctcctctgatcggcgagctgtacggcctgcgcactactgaggaggctctgcatgcgtcacacggatttatgtggtacacatag

SEQ ID NO: 196514 - DNA, 300 bp, Artificial Sequence
  Description of Artificial Sequence: Synthetic coding sequence
atggccgccgccgccgccagccggggcgtgggcgccaagctgggcctgagggagatcagaatccatctgtgccagcgatcacccggctcccagggcgtgagagatttcattgaaaagaggtacgtggagcttaagaaggcaaaccctgacctgcctatcctcattagggaatgttccgacgttcaacctaagctatgggcacgatacgccttcgggcaagagacaaatgtgcccttgaataacttctcagccgaccaggtgacccgcgcattggagaatgtgctatcaggcaaggcctag

SEQ ID NO: 196515 - DNA, 720 bp, Artificial Sequence
  Description of Artificial Sequence: Synthetic coding sequence
atggccggcgtgctgaagaagaccaccggcctggtgggcctggccgtgtgcaacactcctcatgaggtctgcaccttcgtgctatcatcttttctcaattcacagggccgactgaatagctgccacttcgcatattgccgggtgaatggtatacagatgttccaagccctcaattacaagcctagagaacttttgcggcacgggcgatgcccccctacaagtctcatccggtgccatatctttatctatttttgccacgacctctttattaagcctgtgttcttattgactttttctctaactttctcctggctgcacttatgcctgttgctgagcgcccccagccagatctacatctcggtttttcacctcttcagtcttccgtatcggttctgccttggagctctggactacatctatttgggtctcctaaaagttctccctccttttccaagcgtgagatccttcccttccgtgttcactaatgtgttcataaaaaagacacataaattttttattctgttggtgccgagcataattacacccttcctgtgcttcacacttcagattacacaaaagtcttacctttacttcctgcagttcttgtcctatagccccctaaacgcactgtcacacccttggagattcagctccagccccattataagcatgctgcctaatccgatggtgagtagctacttctccccctccctaacatag

SEQ ID NO: 196516 - DNA, 351 bp, Artificial Sequence
  Description of Artificial Sequence: Synthetic coding sequence
atggccggcgtgctgaagaagaccaccggcctggtgggcctggccgtgtgtaataccccacacgaaagattacggattttgtacactaaaattttggacgttctggaggaaattcctaagaatgcagcgtaccggaagtatactgagcaaattactaatgagaaattggctatggtcaaggccgagcctgatgttaaaaaattagaagaccaacttcaagggggacagctggaggaggtaatacttcaggcggagcacgagctgaacttggctaggaaaatgcgtgaatggaagttgtgggagccactagtagaagaacccccagccgaccagtggaagtggccaatttag

SEQ ID NO: 196517 - DNA, 351 bp, Artificial Sequence
  Description of Artificial Sequence: Synthetic coding sequence
atgccctaccgggtgggccagaccaccggcctggtgggcctggccgtttgtaataccccacacgagcggctcagaatcctctacactaaaattctggacgtgttagaggaaatccctaaaaatgcagcctaccgaaagtataccgagcagatcaccaatgagaaattagcaatggtgaaggcagaacctgacgtgaagaagctggaagaccagttgcagggtggccagctggaagaagtcatcctgcaggccgagcacgagctcaacctggcccggaaaatgagggagtggaagttatgggaacctctggtggaagaaccgcctgccgatcagtggaaatggcctatctag

SEQ ID NO: 196518 - DNA, 465 bp, Artificial Sequence
  Description of Artificial Sequence: Synthetic coding sequence
atgggcaaggacatccggccccggagcgcccgggccgcctgcaagggcgtcggcctgtggtcaggttgcttcggcaaaatggccgggtcaggggtacgccaggccacatctactgcctcgaccttcgtaaaaccaattttcagccgagacatgaacgaggcaaaacgccgtgttcgagaactgtaccgcgcatggtacagagaagttcccaataccgtgcaccagtttcagcttgatatcaccgtgaaaatggggcgagacaaagttcgagaaatgttcatgaagaacgctcacgtcacagacccacgggtggtcgacttactggtgattaagggaaaaatcgaactggaggagactattaaagtttggaaacagagaactcatgtgatgcgttttttccacgagaccgaggctccacggcctaaggatttcttgagtaagttttacgttggccatgacccatag

SEQ ID NO: 196519 - DNA, 342 bp, Artificial Sequence
  Description of Artificial Sequence: Synthetic coding sequence
atggccagcgccacccggctgatccagcggctgcggaactgggccagtggacatgatttacaaggcaaactccagttgaggtaccaggagatctctaagcgaactcagcccccccctaagctgccagtggggccttctcataagctttccaataattactactgcaccagggacgggcggcgggagagtgttcccccttcaattattatgtcatctcagaaagctttggtgagcggcaaacctgccgaatctagcgccgtggctgcaaccgagaaaaaggcggttactccggcaccccctattaagagatgggagctcagttcagatcagccctatctgtag

SEQ ID NO: 196520 - DNA, 519 bp, Artificial Sequence
  Description of Artificial Sequence: Synthetic coding sequence
atgcccggcatcgtggagctgcccaccctggaggagctgaaggtggacgaggtgaagatttcttctgccgtcctgaaagctgccgctcaccattacggagcacagtgcgataagcctaataaggagtttatgctgtgtagatgggaggaaaaggatcctagacgttgcctcgaggagggaaagctggtcaacaaatgcgctctcgatttcttccgtcagataaagagacattgcgctgagccctttaccgaatattggacttgcattgactatacgggccagcagctttttcgacactgtcggaagcaacaggctaagttcgacgagtgtgtcctagataagctcggatgggtcaggcctgacttgggcgagctgagtaaggtgactaaggtgaaaaccgacaggccccttcccgaaaatccatatcactctcgccctcggcctgaccccagtcccgaaatagaaggagacctccaacccgcaacccatggcagcaggttttatttctggacaaaatag

SEQ ID NO: 196521 - DNA, 387 bp, Artificial Sequence
  Description of Artificial Sequence: Synthetic coding sequence
atgcccggcatcgtggagctgcccaccctggaggagctgaaggtggacgaggtgaaaataagcagcgcagtcctgaaggccgccgcccatcactacggcgcacagtgcgacaaacccaacaaggagtttatgctgtgccgttgggaggagaaagatccaaggaggtgcctggaggaagggaaactggtgaataagtgcgcgttggactttttccggcagataaaaagacattgcgctgagcctttcacggagtattggacctgcatcgattataccggccaacagttattcagacactgtagaaagcagcaagcgaagttcgacgaatgtgttctcgataagcttggttgggtacggcccgacctgggagaactttccaaaggttag

SEQ ID NO: 196522 - DNA, 1134 bp, Artificial Sequence
  Description of Artificial Sequence: Synthetic coding sequence
atggccgccgccgcccagagccgggtggtgcgggtgctgagcatgagccggtctgccattaccgccatagccacatctgtgtgccatggcccaccatgtaggcagttgcaccacgctttgatgccgcatggaaaaggtgggcggtccagcgtttctggcatcgtggctacggtgtttggggccactggattcctggggcgttatgtggtaaaccacctcggacgtatgggctcacaggtaatcatcccatacaggtgcgataaatacgacatcatgcacctacgccccatgggagacttgggccagctgctgtttctggaatgggatgcacgcgataaggatagtattcgccgtgtcgttcaacacagcaacgtggtcattaacctgatcggcagggactgggagacgaagaatttcgacttcgaggatgtgtttgtcaagatcccacaggctatagcacagttgagcaaagaagctggcgtggagaagtttattcacgttagtcatcttaatgctaatattaaatcaagtagccgttatctacggaacaaggctgttggggagaaggttgtgcgtgacgctttccctgaggcgatcatcgtgaaacccagtgatatatttggtcgcgaggacagatttctcaattccttcgccagcatgcataggtttggccccattccgttaggatccctgggctggaagaccgtgaagcagccagtctacgttgtggatgtatccaaggggatcgtgaacgcggtcaaggatccagatgctaatggcaaaagcttcgccttcgtcgggccatccagatatctcctatttcaccttgtgaagtacatatttgcggtggctcaccggcttttccttcccttcccactccctttatttgcatacaggtgggttgcccgtgtgttcgaaattagtcctttcgaaccatggatcacaagggacaaggtggagcgcatgcacattacagacatgaagctgccacacctgccgggtcttgaggacctggggattcaggccacaccattagaactcaaggctattgaagttctccgtagacatcgcacctaccgttggttgagcgctgagatcgaagatgtcaaacccgctaagaccgtgaacatctag

SEQ ID NO: 196523 - DNA, 984 bp, Artificial Sequence
  Description of Artificial Sequence: Synthetic coding sequence
atggccctggtgcacaagctgctgcggggcacctacttcctgcggaagttcagcaagccgacctccgcactctatcccttcctgggtatccggtttgcggagtactcatccagccttcagaagccggtggcctcccccggaaaggcatcttcgcagaggaaaacggagggagatctccagggagaccaccaaaaggaggtggctttggatattacatcctcagaagagaagcccgacgtaagctttgataaagctattcgcgatgaagcgatctatcactttagactgctcaaggatgagattgtagatcactggcgcggcccggagggacaccctctgcatgaggtgctgctggagcaagccaaggtggtgtggcagtttaggggaaaagaagatttagacaagtggactgttacctcggacaaaaccattggcggccgtagtgaggtattcctgaagatgggcaagaacaatcagagcgccctgctgtatgggacactgagcagcgaggccccacaggatggtgagtccacacgttctggatactgcgcaatgatctcgcggatcccacggggagcatttgagagaaagatgtcatatgattggtcccagttcaataccttgtacctgcgcgtccggggcgacggcaggccttggatggttaatattaaggaagacactgatttttttcagaggactaaccagatgtacagctatttcatgtttactagaggcgggccgtattggcaggaagttaagattcccttcagtaagtttttcttctcaaaccgcgggcgcatcagggacgtgcagcatgagctgcctttggataaaatatctagcattggtttcacactcgcggataaagtagacggacctttctttctcgagatcgattttatcggggtcttcactgaccccgcccacactgaagagttcgcctacgaaaactctcccgagctcaacccacggctgttcaagtag

SEQ ID NO: 196524 - DNA, 576 bp, Artificial Sequence
  Description of Artificial Sequence: Synthetic coding sequence
atggccctggtgcacaagctgctgcggggcacctacttcctgcggaagttttctaaacctacatccgctttatatcccttcctaggaatccggtttgccgaatattccagttccctgcagaaaccggtggcctcccctggaaaggcctcctcccagcgtaaaactgagggcgatctgcaaggcgatcatcagaaagaggttgctttggacataacatcctcggaggagaagcctgacgtgtcttttgataaagcgattcgcgatgaggctatctaccacttcagactgctgaaagacgagatcgttgaccactggcgcgggcccgagggacatcctctgcacgaggtgcttcttgagcaggctaaggttgtgtggcagttccgaggaaaggaagatctggataaatggaccgtcacatccgataagacaatagggggcagatctgaagtgttcctaaagatgggaaagaataatcagtccgccctcctgtatggcacattgagttctgaggctccacaagacggagagagcacaagatctgggtactgcgcaatgattagcagaatcccccgttag

SEQ ID NO: 196525 - DNA, 630 bp, Artificial Sequence
  Description of Artificial Sequence: Synthetic coding sequence
atggccctggtgcacaagctgctgcggggcacctacttcctgcggaagttttcaaagccaacatctgccctgtaccctttcctcggcataagattcgcggaatactcctcatcgctgcaaaagcctgttgccagtcctggaaaggcttcatcacagcggaaaactgagggcgatctccagggcgaccatcagaaggaggttgctctggatatcaccagctccgaggaaaaacccgacgttagctttgacaaagcaattcgcgatgaggctatttatcatttccgccttctgaaagatgagatcgtggatcattggcgcggccctgaaggtcaccctctgcatgaggttttgttggagcaggctaaggtcgtttggcagttccgtgggaaggaagatctggataagtggacagtcacctccgataagacaataggaggtcgctctgaagtctttcttaaaatgggtaaaaacaaccagtctgcgctgctgtatggaaccttgtcctctgaggcccctcaagacggagagagcacccgcagcggctactgcgccatgatctcgaggatcccaagaggggcctttgagagaaaaatgtcttacgactggagtcaatttaatacgttgtactag

SEQ ID NO: 196526 - DNA, 510 bp, Artificial Sequence
  Description of Artificial Sequence: Synthetic coding sequence
atgggctggagccaggacctgttccgggccctgtggcggagcctgagcagagaagtgaaggaacatgtaggaaccgatcagtttgggaacaaatactactacattccacagtacaaaaattggcgaggacaaactatacgcgagaagagaatcgtggaggccgcaaataagaaagaggtggactatgaagccggcgacattcctaccgagtgggaagcttggattcgcaggacgcggaagaccccgcctactatggaggaaatattaaagaatgaaaagcacagagaggagatcaagattaagtctcaggacttctacgaaaaggaaaaactgctgagcaaagagacctctgaagaattgctgccgccgcccgttcagacgcagataaagggccacgcgtccgctccttatttcgggaaagaagaaccatcagtcgccccaagctcaacaggcaaaactttccagcctggctcctggatgcccagagatgggaaaagccataaccagtag

SEQ ID NO: 196527 - DNA, 384 bp, Artificial Sequence
  Description of Artificial Sequence: Synthetic coding sequence
atgtacatcgacagctacaacagccggggcttcatgatcaacggcaaccgcgtcctgggtccttgcgccttgctgccacatagcgttgtacaatggaatgtcgggagccatcaagacattactgaagattcattttcactcttttggctcctcgaacctagaatcgagattgtggttgtgggcaccggcgatcgaaccgagaggctgcagtctcaggtcttgcaggctatgcgccagcgaggaattgctgtggaggtgcaggacacacccaatgcttgcgccacattcaatttcttgtgtcacgaggggagggtgaccggagcggccctaatcccaccaccgggcggaacttcactcacgtctctcggccaggcagcccagtag

SEQ ID NO: 196528 - DNA, 555 bp, Artificial Sequence
  Description of Artificial Sequence: Synthetic coding sequence
atggccaccgccctggccctgcggagcctgtaccgggcccggcccagcctaaggtgtcccccggtggagttgccttgggcacccaggcgtggacacagactcagtccagccgatgacgaactgtaccagcgcactcggatctccctgctgcagagagaagccgctcaggcaatgtacatagacagctacaactcccgcggcttcatgatcaatggaaacagggtgctgggcccttgcgcactactcccccactcggtggtccaatggaacgtcggctctcatcaggatattactgaagacagcttttctcttttttggctcctggagccacgcattgagattgtggtggtgggcactggcgatcgcacagagaggttgcagtctcaggtgctgcaggcaatgcgacagcgcggaatcgcagttgaagtacaggacacccccaatgcatgtgccacgtttaattttttatgccacgaaggcagagtgacaggtgccgcacttattccacccccgggtggcacaagcttgacatccctcggccaggccgcacagtag

SEQ ID NO: 196529 - DNA, 384 bp, Artificial Sequence
  Description of Artificial Sequence: Synthetic coding sequence
atgtacatcgacagctacaacagccggggcttcatgatcaacggcaaccgtgtgctgggcccatgtgcactgcttccccacagcgtggtccagtggaatgttgggtcccaccaggacatcaccgaggactcattcagtttgttctggctgctggagccccgtattgaaatcgtcgtggttggcactggggaccgcaccgaacgcctgcagagtcaagtactgcaggccatgcggcagcgtggtatcgcagttgaggtgcaagacactccgaacgcgtgcgcaacttttaactttctatgccatgaggggcgagtgaccggagcagctttgatcccgcctccgggagggacatcgcttactagtcttggacaggccgcccagtag

SEQ ID NO: 196530 - DNA, 384 bp, Artificial Sequence
  Description of Artificial Sequence: Synthetic coding sequence
atgtacatcgacagctacaacagccggggcttcatgatcaacggcaatagggttctcggtccatgcgccctgttaccccattctgtagttcagtggaatgttggatcacatcaggatattactgaggacagctttagcctcttctggctgctcgaacccagaatcgagattgtggtcgtgggcaccggggaccgcacggagagactccagtcccaggtgctgcaagctatgcgccagcgcggtatagccgttgaagtccaagatacacctaatgcctgtgccacttttaactttttgtgtcacgagggacgggttaccggggccgccctgatccctccgccgggtggtacatctttgacctctctcggccaagctgcacaatag

SEQ ID NO: 196531 - DNA, 528 bp, Artificial Sequence
  Description of Artificial Sequence: Synthetic coding sequence
atgggcgccctggtgatccggggcatccggaacttcaacctggagaatagagcagagagagaaattagtaagatgaaaccatcagttgcacccagacatccatccacgaatagcctcctgagggaacagatctccctctatccagaagtgaagggcgagattgccaggaaggacgagaagctgttgagcttcttaaaagacgtgtacgtggactctaaggatccagttagttccctgcaggtgaaggcggctgagacatgtcaggaacccaaggaattcaggctgcctaaagaccatcacttcgatatgattaacatcaaaagcatccccaagggaaaaatctcaattgtcgaagccctgaccctcctcaacaaccacaagctgttccctgaaacgtggacagcggagaagattatgcaggagtaccaactcgaacaaaaagatgtgaactcactcttgaaatacttcgtcacgttcgaggtggagatatttccaccggaggacaaaaaggcaatccgctccaagtag

SEQ ID NO: 196532 - DNA, 519 bp, Artificial Sequence
  Description of Artificial Sequence: Synthetic coding sequence
atgcccgacagctgggacaaggacgtgtaccccgagcccccccggcggacccctgtccagcccaatccaattgtttatatgatgaaagcatttgatctcatcgtcgacagacccgtgactctggttcgtgagttcattgaacggcagcacgccaagaacaggtactactattaccataggcagtacagacgagtacctgatatcacagagtgtaaagaggaagatatcatgtgcatgtatgaggcagagatgcagtggaaaagagattacaaagtggaccaggaaattatcaacattatgcaagaccggctcaaagcttgtcagcagcgagaaggccagaactaccaacaaaattgcatcaaagaagttgagcagttcacacaggtcgcgaaggcatatcaggatcgttaccaagacctgggcgcatactccagcgcccgtaaatgtctggctaaacagcgacagcgaatgctgcaggagcggaaagcagccaaagaagcagcggccgccacgagttag

SEQ ID NO: 196533 - DNA, 507 bp, Artificial Sequence
  Description of Artificial Sequence: Synthetic coding sequence
atgcccgacagctgggacaaggacgtgtaccccgagcccccccggcggacccccgtgcagccaaaccccatcgtttacatgatgaaagcttttgaccttatcgtggatcgacccgtcactttggtcagagagttcattgagagacagcacgccaaaaaccgatactattattaccacaggcagtatcggcgggtgcctgacattaccgaatgcaaagaggaagatattatgtgcatgtatgaggctgagatgcagtggaaacgggattataaggttgaccaggagatcatcaacataatgcaagataggttaaaggcttgccaacagcgcgaagggcagaactaccagcagaattgcatcaaggaagtggaacaatttacccaagtggcaaaggcctaccaggacaggtgcgcatgtcccactcacccccagcctcctacaatccttttgcggcccggcggccagaatcactgtaagtcctccctgcccagtctggtcctgacctag

SEQ ID NO: 196534 - DNA, 492 bp, Artificial Sequence
  Description of Artificial Sequence: Synthetic coding sequence
atggccgccggcctgttcggcctgagcgcccggcggctgctggccgccgcagctacacgcgggcttcctgctgcgcgagttcgctgggagtcgtcattctctcggacggtggtagcaccctccgcagtggccggaaaaagaccccccgagccaacaactccctggcaggaggatcccgagccagaggatgagaacctgtacgaaaaaaatcccgattcacatggctacgacaaggatcctgtacttgacgtgtggaatatgagattagtgttttttttcggagtctctatcattttggtgctaggatctacattcgtggcgtaccttcccgactaccgctgcacaggatgcccgcgggcttgggacggtatgaaagaatggtccaggcgcgaggcagagaggctggttaagtatagggaggcgaacggcctaccgattatggagtccaattgctttgatccatccaagatacagctaccggaggatgagtag

SEQ ID NO: 196535 - DNA, 462 bp, Artificial Sequence
  Description of Artificial Sequence: Synthetic coding sequence
atggccgccggcctgttcggcctgagcgcccggcggctgctggccgccgcagccaccaggggcctgccggcagcccgggtaaggtgggaatccagtttctcaagaaccgtggttgcccctagtgccgtcgctggtaaacgccctccagagcccactaccccctggcaagaagatcctgaaccagaggacgagaacctgtatgagaagaaccccgattctcacggctatgataaggaccctgttttagacgtatggaacatgcgtctggtgttcttttttggggtgtccatcattctggtgctgggttcaactttcgtggcctacctaccggattacagaatgaaggagtggagcaggagggaggccgaaaggcttgttaagtatcgggaggcaaatgggttgccaatcatggagtcaaactgtttcgatccttcaaaaatacagctgcctgaggacgagtag

SEQ ID NO: 196536 - DNA, 474 bp, Artificial Sequence
  Description of Artificial Sequence: Synthetic coding sequence
gccgcccccagcgtgatggccgccggcctgttcggcctgagcgccagacggctgcttgccgcacgtcgtcgcggcctacctgctgctagggtccgctgggagtcctctttctcacgaacagttgtggcaccgagtgcggtggcaggcaagcgtccaccagagcccactactccatggcaggaggatcctgagccggaggacgagaacctgtacgagaagaacccagactcccatgggtatgacaaagaccctgtgcttgatgtctggaacatgcgactggttttcttctttggagtctccataatccttgtactggggtctacattcgtggcctacctgcccgactaccggatgaaagagtggagccgccgcgaagcagaaaggcttgtcaagtacagggaagcaaacgggctccccattatggagtccaactgcttcgatccgagcaaaatacagctgccagaagatgagtag

SEQ ID NO: 196537 - DNA, 297 bp, Artificial Sequence
  Description of Artificial Sequence: Synthetic coding sequence
atggcccacgagcacggccacgagcacggccaccacaagatggagttgccggactatagacagtggaagatcgaaggcactcctctagagaccatccagaaaaaacttgccgccaaaggtctcagggacccatggggacgcaacgaagcttggcgctatatggggggcttcgctaaaagcgttagcttctcggacgtgttctttaaaggttttaagtggggattcgccgcttttgttgtcgctgtgggcgcagagtattatcttgagtccctgaataaagataagaaacatcactag

SEQ ID NO: 196538 - DNA, 297 bp, Artificial Sequence
  Description of Artificial Sequence: Synthetic coding sequence
atggcccacgagcacggccacgagcacggccaccacaagatggagctccctgactaccgccaatggaaaatcgagggcacacccttagaaactattcagaaaaaactcgccgcaaaaggcctgcgggacccatggggccgcaacgaggcctggcgctatatgggggggttcgccaaatccgtgagcttcagcgacgtctttttcaagggttttaaatggggcttcgccgcctttgtcgtcgctgttggcgccgagtactaccttgagagcctaaacaaagacaaaaagcaccactag

SEQ ID NO: 196539 - DNA, 198 bp, Artificial Sequence
  Description of Artificial Sequence: Synthetic coding sequence
atggcccacgagcacggccacgagcacggccaccacaagatggagctgccggattaccggcagtggaagattgagggcactccgttggaaacaatacagaaaaaattagctgctaaaggattgagagacccttggggtaggaatgaggcatggcgctatatggggggttttgctaaatccgtttctttttcggactag

SEQ ID NO: 196540 - DNA, 297 bp, Artificial Sequence
  Description of Artificial Sequence: Synthetic coding sequence
atggcccacgagcacggccacgagcacggccaccacaagatggagctgcccgattatcgccagtggaagattgaggggacccctcttgaaactatccagaagaagctggcagcaaagggcctgcgggacccctggggacgaaacgaagcatggcgatacatgggagggttcgccaagtctgtttccttctccgatgttttttttaaagggttcaagtggggctttgctgcgtttgtcgtagccgtgggggccgagtattatttagagtctctcaataaggataagaaacaccattag

SEQ ID NO: 196541 - DNA, 741 bp, Artificial Sequence
  Description of Artificial Sequence: Synthetic coding sequence
atgaccaccggcgactgctgccacctgcccggcagcctgtgcgactgcagcggctcccctgcattcagtaaagtggtcgaggctacagggctcggacccccccagtacgtggcccaagttaccagtcgggatggccggctgctctctacagtcattagagccctcgatacgccgagtgatggcccattttgcaggatttgccatgagggagctaatggagaatgtctgctctctccatgtggatgcacagggaccttgggggcggtgcacaagtcttgcttggagaaatggctttcttctagtaataccagttactgtgagctctgccacacggaattcgctgtggaaaagcggccacgaccattaacagaatggttgaaggatcccgggccacggactgagaagcgtaccttgtgctgcgacatggtctgcttcctgtttattacacccttagccgctatcagcgggtggttgtgtttgcggggggcccaggatcacctcaggctgcacagccagttagaagcagtgggtctgatagcattaaccatcgccctcttcacaatctatgtactgtggacactcgtgagttttcgctatcattgtcagctctattcagaatggcggaaaacaaaccagaaagtaaggttaaaaatccgggaagcagattcacccgagggcccccagcattcccctctagcagccgggctgcttaaaaaggtcgctgaggagacacccgtgtag

SEQ ID NO: 196542 - DNA, 561 bp, Artificial Sequence
  Description of Artificial Sequence: Synthetic coding sequence
atggccgtggcccgggccggcgtgctgggcgtgcagtggctgcagcgggcaagtagaaatgtcatgcccttaggagcccgcaccgcatctcatatgacaaaagatatgtttccaggaccttatccaagaacccctgaagagagagcagcggccgcaaagaaatacaacatgagagttgaagattacgagccatacccggacgacggcatggggtacggagactatcctaagctgccagacagaagtcagcacgagagagacccctggtatagctgggaccaaccaggtctgagattgaattggggcgaaccaatgcactggcacttggatatgtataatagaaaccgcgtggataccagccccacacctgtgtcgtggcacgtcatgtgcatgcagcttttcggttttctggccttcatgatctttatgtgctgggtcggggacgtatatcctgtctaccagccagtcggccctaaacagtatccatacaataacctgtacttagagaggggcggcgaccctagtaaggaacctgaaagagtggtgcattacgagatttag

SEQ ID NO: 196543 - DNA, 519 bp, Artificial Sequence
  Description of Artificial Sequence: Synthetic coding sequence
atggccgtggcccgggccggcgtgctgggcgtgcagtggctgcagagggcgtctcggaacgtgatgccactgggcgccagaacggccagtcacatgaccaaagatatgttcccaggtccatatccacgaacaccagaggaacgggctgccgccgcaaaaaagtacaacatgcgggtcgaggattacgagccctaccctgacgacgggatggggtatggcgattaccccaagctgcccgatagatcacaacacgagcgcgatccatggtactcctgggaccagcccggtctcagactgaattggggagagcccatgcactggcatcttgacatgtacaatcgcaaccgcgtcgataccagcccaactcccgtgtcttggcatgtgatgtgtatgcagctctttggatttctggcatttatgatctttatgtgttgggttggcgatgtgtacccagtatatcagccagtgtgcaggcatcattttagctacaacctgggattcctgtccgccctgggttag

SEQ ID NO: 196544 - DNA, 468 bp, Artificial Sequence
  Description of Artificial Sequence: Synthetic coding sequence
atgaccaaggacatgttccccggcccctacccccggacccccgaggagcgcgcagccgcagccaagaaatataatatgcgggtggaggattatgaaccttacccagatgatgggatgggatatggggactaccccaagttgccggatagatcacaacacgaaagggatccctggtacagctgggatcaacccggacttagattaaactggggagaacctatgcactggcacctcgacatgtacaaccggaaccgagtcgatacaagtcctactccagtgagttggcacgtcatgtgcatgcaacttttcggctttttagcctttatgatctttatgtgctgggtcggtgacgtgtatcctgtttaccaaccagttggaccgaagcaatatccttacaacaacttgtatctcgagcgcggcggggacccgagcaaggagccagaacgggtcgtgcactatgaaatctag

SEQ ID NO: 196545 - DNA, 519 bp, Artificial Sequence
  Description of Artificial Sequence: Synthetic coding sequence
atggccgtggcccgggccggcgtgctgggcgtgcagtggctgcagagagcaagcaggaatgtcatgcctctcggggcacggaccgccagtcacatgacaaaggatatgtttcccgggccctatccccgaacgccagaggagcgagcagccgcagctaagaaatataacatgcgcgttgaggactacgagccctatccagacgacggtatggggtacggggactacccaaagctgccagaccggtctcagcacgaaagagacccctggtatagctgggatcagccagggctgaggctaaactggggagaacccatgcactggcacttagatatgtataaccggaaccgggttgacacatccccaactcctgttagctggcacgttatgtgtatgcagctgttcgggtttttggcctttatgatttttatgtgctgggtgggcgacgtgtacccagtctaccagcctgtgtgcaggcaccacttctcttacaatttggggtttctttcagctttgggatag

SEQ ID NO: 196546 - DNA, 540 bp, Artificial Sequence
  Description of Artificial Sequence: Synthetic coding sequence
atggccttcctggccagcggcccctacctgacccaccagcagaaggttctgcgcctttataagcgggctctccgccaccttgagtcttggtgtgtgcagcgcgacaaatacagatacttcgcatgcctcatgcgggccaggttcgaagagcacaagaatgaaaaggacatggccaaagctacacagctcttgaaagaagctgaggaggagttttggtatcgtcagcatccacagccatacatcttcccagattcgccaggcggtacatcatacgagcggtacgattgttacaaagtccctgagtggtgcctggacgactggcatcctagtgaaaaggccatgtatcccgactacttcgcaaagcgagaacaatggaagaaactgcgcagggagagttgggagagggaagtgaaacaactacaggaggagacaccaccaggggggccgcttacagaggctttaccaccggctagaaaagaaggggatctgcctccactttggtggtacatagtcacacgtcccagagagcgacctatgtag

SEQ ID NO: 196547 - DNA, 471 bp, Artificial Sequence
  Description of Artificial Sequence: Synthetic coding sequence
atggccagccgggtgctgagcgcctacgtgagccggctgcccgccgcctttgctcctctgccccgcgtgagaatgttagccgtagccagacctttgagcacagcactgtgcagcgccggtactcagaccagactcggaacccttcagccagccctggtcctggcccaggtgccagggcgagtgacacagctgtgcaggcagtatagcgacatgccccctctgaccctggagggaattcaggacagagtgctctacgtgctgaagctctatgacaaaattgaccccgagaagttgtcagtgaactcccatttcatgaaggatctcggtctggacagcctcgatcaggtcgaaataatcatggccatggaagatgagttcggattcgagatcccggatatcgacgccgagaagctgatgtgcccacaggagattgtggactacatcgcggataagaaagacgtgtacgaatag

SEQ ID NO: 196548 - DNA, 231 bp, Artificial Sequence
  Description of Artificial Sequence: Synthetic coding sequence
atggcccccagcgccctgctgcggcccctgagccggctgctggcccctgcccggctcccaagcggcccatctgttaggtcaaagttctacgtgcgggagccccccaacgcgaagccagattggttgaaggtgggcttcactcttgggaccactgtcttcctgtggatctacctcattaaacagcacaacgaggatattcttgagtataaaaggcggaacggtctcgagtag

SEQ ID NO: 196549 - DNA, 231 bp, Artificial Sequence
  Description of Artificial Sequence: Synthetic coding sequence
atggcccccagcgccctgctgcggcccctgagccggctgctggccccagctaggcttccctcaggccccagtgtacgttctaaattctatgtcagagagcccccgaatgccaagcccgactggctcaaggttggctttaccctggggaccacagtgtttctctggatctatctaataaagcaacacaacgaggacatcttggagtataaacgacgcaacgggctggaatag

SEQ ID NO: 196550 - DNA, 231 bp, Artificial Sequence
  Description of Artificial Sequence: Synthetic coding sequence
atggcccccagcgccctgctgcggcccctgagccggctgctggccccagcccgcctgcctagcggcccaagcgtgcggagcaagttctacgtgcgtgagccccccaacgcgaagccagactggctcaaggtgggctttacactcgggaccaccgtttttctttggatttacctgattaagcagcataatgaggacattctcgagtacaagagacgcaatggccttgaatag

SEQ ID NO: 196551 - DNA, 231 bp, Artificial Sequence
  Description of Artificial Sequence: Synthetic coding sequence
atggcccccagcgccctgctgcggcccctgagccggctgctggccccagcccgcttacccagcgggccaagcgtacgctccaaattttacgtccgggagcctcccaacgcgaaacccgattggcttaaagtcgggtttactcttggcaccaccgtgttcctttggatttatctaatcaaacagcataatgaggacatcttggagtataagcggcggaatggcttggagtag

SEQ ID NO: 196552 - DNA, 231 bp, Artificial Sequence
  Description of Artificial Sequence: Synthetic coding sequence
atggcccccagcgccctgctgcggcccctgagccggctgctggcccctgctagacttccaagtgggccgagcgtccggagcaaattttacgtgcgtgagccgcccaatgcaaaaccagattggctaaaggtcggatttactctcggaactaccgtgtttttgtggatatatcttatcaagcagcacaatgaggatatcctggaatacaaaaggcgcaatggcttggaatag

SEQ ID NO: 196553 - DNA, 231 bp, Artificial Sequence
  Description of Artificial Sequence: Synthetic coding sequence
atggcccccagcgccctgctgcggcccctgagccggctgctggcccccgctcgcctaccttctgggccctccgtgagaagcaagttttacgtacgggagccacccaacgctaaaccagactggctcaaagtgggcttcactttaggaaccactgtatttctgtggatttatctaattaagcagcacaacgaagacatccttgaatacaaacggcggaatggattagagtag

SEQ ID NO: 196554 - DNA, 231 bp, Artificial Sequence
  Description of Artificial Sequence: Synthetic coding sequence
atggcccccagcgccctgctgcggcccctgagccggctgctggcccccgctcgtctgccctccggcccttccgtgagaagcaagttctatgtcagggagccccctaatgccaagccagactggttaaaggtgggatttacactgggcacgaccgtgtttctctggatttatttgataaagcaacataacgaagatattctagaatacaaaaggcgaaacggcctggaatag

SEQ ID NO: 196555 - DNA, 231 bp, Artificial Sequence
  Description of Artificial Sequence: Synthetic coding sequence
atggcccccagcgccctgctgcggcccctgagccggctgctggcccccgcccgcctgccatccggaccgtctgtccgtagtaaattctacgttcgcgagccgccaaatgctaaacccgactggctcaaggtgggatttacgctgggcacgactgtcttcctgtggatctatctcatcaagcaacacaacgaagatatcctagaatacaagaggcgaaatggattggagtag

SEQ ID NO: 196556 - DNA, 915 bp, Artificial Sequence
  Description of Artificial Sequence: Synthetic coding sequence
atgatctacaccatgaagaaggtgcacgccctgtgggccagcgtgtgcctccttctgaatctggctcctgctccgctgaatgctgactctgaggaggacgaagaacatacaataataacagatacggagctgcctcccctgaagctgatgcacagcttttgcgcctttaaggccgatgacggcccatgcaaagccattatgaagagattcttcttcaacatcttcacacggcagtgtgaggaatttatttatggaggctgtgaaggaaatcagaacagatttgagagcctggaggagtgtaaaaagatgtgcacccgcgacaacgctaatagaattatcaagaccaccctgcagcaggagaaacccgacttctgttttctggaagaagatcctggaatctgccgggggtacatcacccgatatttctataataaccaaacaaaacagtgcgagaggtttaagtacgggggatgtctcggaaatatgaacaatttcgagaccttggaggaatgcaagaacatttgtgaggacggtccaaacggttttcaggtggacaactatggaacacaattgaacgcagtgaataatagcctgactccccagtctaccaaagtcccttccctttttgagtttcatggaccttcgtggtgccttaccccagctgacagagggttgtgccgggctaacgagaatcggttctactataactccgtgattggcaagtgcagaccattcaaatactccggctgcgggggcaacgaaaacaacttcacatcaaaacaggagtgccttcgggcctgcaagaagggctttattcagaggatctccaagggcggtcttatcaagaccaaaaggaagcggaagaagcagcgcgttaagatagcctacgaggaaatttttgtgaagaacatgtag

SEQ ID NO: 196557 - DNA, 2013 bp, Artificial Sequence
  Description of Artificial Sequence: Synthetic coding sequence
atgcagatcccccggttctgctaccacgagcggctgagcgtggccggcaactgccgcatgtgtctggtagagatagaaaaagcacccaaggtcgtcgccgcatgtgccatgcccgtgatgaaggggtggaatattttaacgaacagcgaaaagagtaaaaaagctagggaaggcgtgatggaattcctgctagccaatcatcccctggattgtcccatttgcgatcagggtggcgagtgtgacctacaggaccagtccatgatgttcgggaacgatcgaagtcggttcctagaaggaaaacgggcggtcgaggacaagaacatcggccccctggttaagactatcatgacccgctgtatccagtgtacccggtgcatcaggtttgcttctgagattgctggtgtcgacgatctgggaaccacgggccgcggcaatgacatgcaggtcggcacttatattgaaaagatgttcatgagtgagctctccggaaatattatcgacatctgtcctgtcggagctctcacttctaagccatatgcttttactgcaagaccatgggagacgcggaagaccgagagtatcgacgtgatggatgctgtagggtctaatatagtggtgagcaccaggactggagaagtgatgcgcatcctgccacgcatgcatgaggacatcaacgaggagtggataagcgacaagacgagatttgcatatgacggactaaaaaggcaacggctaactgaacctatggtccgtaacgaaaagggactgctcacatatacctcttgggaggatgcgctgtcacgcgttgctggcatgctgcagagtttccagggcaaagacgttgcagccatcgcgggcggtcttgtcgatgctgaagcactggtggcattgaaggatttgcttaaccgcgtagatagcgacacactctgtacggaagaggtgttcccgacagccggtgccggcaccgacttgcgatcaaactacctactgaacaccactatcgccggcgtggaggaagctgacgttgtgctcttagtgggcaccaatccccgtttcgaagctcccttattcaatgcaaggattaggaaaagctggctgcacaatgacctgaaggttgcccttattggttcacccgtggaccttacgtacacctacgatcatttgggcgattcccccaaaatcctccaggatatcgccagtggtagccatcctttttcacaggtactgaaggaagctaaaaaacctatggttgtgctcgggagcagcgccctgcaacgcaatgatggggctgccatcctggccgccgtgtccagtatcgcccagaagattcggatgacgtctggagtgaccggtgactggaaggtgatgaatatcctgcataggattgcaagccaggtagcagcactcgacttaggatataaacccggcgtggaagccatccgtaaaaacccacccaaggtgcttttcctgctgggggccgacggcggctgtatcacacggcaggaccttccaaaggactgcttcatcatttaccaaggccaccatggcgatgtgggggctcccatcgctgatgttatcctgcctggtgcggcatacacagagaagtccgctacctacgtgaatacagaaggaagggctcagcagaccaaagtggccgtgaccccccccggtcttgcccgcgaggactggaagattatcagggcgctgtctgagatcgccggaatgacactgccatacgatacacttgatcaagtcagaaatcgcctggaagaagtgagccccaacctcgtacgttatgatgacatagaaggggcgaattacttccagcaagccaacgagttgtccaaactcgttaaccagcagttgttggccgacccattggtacctccacagctgaccatcaaggacttctacatgactgacagcatctcccgcgcctcccagaccatggcaaagtgcgtgaaagcagttaccgaaggcgcgcaggccgtggaagagccttccatctgttag

SEQ ID NO: 196558 - DNA, 1851 bp, Artificial Sequence
  Description of Artificial Sequence: Synthetic coding sequence
atgtgggagggcgtgatggagttcctgctggccaaccaccccctggattgcccaatctgtgatcagggcggagagtgcgacctgcaggatcagagcatgatgttcgggaacgaccgctctaggtttctcgaaggaaagcgcgccgtagaggacaagaacattggccccctggtcaaaactattatgacacggtgtatccagtgtacccgatgtatacgctttgcatcagaaattgccggtgtcgatgatctcggaaccactggtcggggtaatgatatgcaggtgggaacctacattgagaagatgttcatgtccgagcttagcggcaacatcattgatatctgtccagtgggcgcactgacttctaagccctacgcctttacagcaagaccttgggaaacaagaaaaaccgagagtatcgacgtgatggacgcagtaggtagcaacatagtcgtgtcaaccaggaccggcgaggtcatgcgcatattgcctcgcatgcacgaggacatcaacgaggagtggattagtgacaagacccgtttcgcatacgacggattaaagaggcagcgcctgaccgaaccaatggtgcggaacgagaagggtctgttaacctatacgagttgggaggacgccctctctcgggtagcagggatgttgcagagcttccagggcaaagacgtcgcagcgattgccggcgggctcgtggatgcagaagcgctagtcgctctgaaagatttgttgaacagggtggacagcgataccctctgtactgaagaggtcttcccaactgccggagccggaacagatcttaggagcaattacttactgaatactacaatcgccggggtggaggaggctgatgtagtgctccttgtaggtacgaatcctcgattcgaggctccactcttcaacgctcgaatccgcaaatcttggctccataacgatcttaaagtcgcgcttatcggctctccagtagaccttacgtacacctacgaccatctgggagacagccccaagatactacaagacattgcctcgggctctcaccctttcagccaagtcctgaaagaggccaagaagcccatggtggtccttggcagttctgccttacagcgcaatgatggggctgctatactggccgcagtcagctctatcgcgcagaagatacgaatgacaagtggcgtaaccggcgattggaaagtgatgaacattctacaccgcatcgcttcccaggttgcagccctggacttgggctataaaccgggggtggaagcaatcagaaagaatccccccaaagttctgttccttttaggcgcagacggagggtgtatcaccaggcaggatcttcctaaggactgttttataatttatcagggtcaccacggtgatgttggagctcccattgccgatgttatccttcccggcgctgcctacacagagaaaagcgccacatatgttaataccgaaggaagagctcaacaaacgaaagttgcggtgaccccccctggcctcgccagagaggactggaaaatcatcagagcactttccgaaatagctggaatgacactcccatacgatactctcgaccaggtgagaaataggcttgaggaggtgagcccaaacctcgttcgttacgatgatattgaaggtgcaaactacttccagcaggccaatgaactgtctaagcttgtaaaccaacagctcctggccgacccgcttgtacccccccaactgacaattaaggacttctatatgaccgactctatctcgcgcgcctctcagactatggctaaatgcgttaaggctgtcacggagggagctcaggcggtggaagagccctcgatctgttag

SEQ ID NO: 196559 - DNA, 2076 bp, Artificial Sequence
  Description of Artificial Sequence: Synthetic coding sequence
atgctgcggatccccgtgcggaaggccctggtgggcctgagcaagtcccctaagggatgtgtgagaaccaccgcaaccgccgcttcaaatttgatcgaggtgttcgtggatggccagagtgtgatggtggagcccgggactaccgtgctgcaagtggtggctgcttgtgctatgccagtaatgaagggctggaacattctgactaatagcgaaaagtctaaaaaggcgagagaaggcgtcatggagtttctgcttgcgaaccaccccctggattgccctatttgtgaccagggtggcgaatgcgatctccaggaccaatccatgatgttcggcaacgacagaagcagatttctggaggggaagcgagccgtcgaggataaaaatataggcccactcgtcaagaccattatgaccagatgtatccagtgcacgcgttgcatcagatttgcaagcgagatagcgggagtggacgacctaggcaccaccggccggggcaacgacatgcaagtaggcacttacatagagaaaatgttcatgtccgagctgagcggcaacattattgatatttgcccagtgggagcgttgacttccaaaccctacgccttcacggctaggccctgggagacacggaagaccgaatctatcgacgtgatggatgccgttggatcaaatatcgtggtgtctactagaacgggtgaagttatgcgaatcttgccccgcatgcatgaagacataaacgaggagtggatttctgacaaaaccaggtttgcttacgatggcctgaagcggcagagactcacggaaccgatggtgaggaacgagaaaggactgctcacatatacttcatgggaagatgccttatctcgggtggccggaatgctacaaagttttcaaggaaaggacgtggcggctatagcgggtggtctggtcgacgcagaggcactggtcgcactaaaggatctacttaatcgcgtggacagtgacaccctatgcactgaagaggtgttcccgaccgccggcgccggcaccgatcttaggtcaaattaccttttgaacactacaattgctggagtagaggaggccgacgtagtgctgttagtgggtaccaatcctaggttcgaagctccactcttcaatgccaggatacgaaagtcctggctccacaacgaccttaaggtggccctgattggttcacccgtagacctgacttatacctatgaccacttgggggactcaccgaaaatcctccaagatattgccagcgggagccaccctttttcccaggttctcaaggaggcaaagaagcccatggtggtgctgggcagctcagccctgcaaagaaatgacggagccgctatccttgcagcagtgagctctattgcccagaaaatccggatgacatccggtgtgacaggggattggaaggtgatgaacatcctgcatcgcatagcctcgcaggtggctgccctggacttggggtacaaaccaggcgtggaggcgattagaaaaaatcccccaaaggtcctctttctgctgggcgccgatgggggttgtataacaagacaagatctccctaaggattgctttattatatatcagggccatcacggggatgtgggcgcaccgattgccgatgtgattctaccgggcgccgcctatacagagaaatctgccacctacgtgaatacagagggtagagcacagcaaacaaaggtggctgtgacaccacctggcctggccagggaagactggaagatcattcgggcactttctgaaattgccggtatgactctgccatacgacacgctggaccaggtcagaaaccgcctcgaagaagtcagcccaaatttagtacgttatgacgatatcgagggcgctaattacttccagcaagccaacgagctgtctaagctagttaaccagcagcttttagcggatcctttggtgcctccccagcttacaattaaagacttttatatgaccgatagcataagcagggcctcccaaacgatggccaagtgcgttaaggctgttacagaaggagcacaggctgttgaggaaccttcaatctgttag

SEQ ID NO: 196560 - DNA, 2184 bp, Artificial Sequence
  Description of Artificial Sequence: Synthetic coding sequence
atgctgcggatccccgtgcggaaggccctggtgggcctgagcaagtcccccaagggatgcgtgagaacaaccgcaacagctgcgagcaacctcattgaggtttttgtcgatggacaaagcgtgatggtggagcctggcactaccgtcttgcaggcatgtgaaaaggtaggtatgcagatccctcggttttgttaccacgagcggctcagcgtcgccggcaactgtcgcatgtgtttggtcgagatagagaaggctcctaaagtggtggccgcttgcgccatgcccgtgatgaagggatggaacattttgaccaacagtgagaagtcaaagaaggcacgggaaggagtaatggaatttctgcttgctaaccacccactcgattgtccaatctgtgaccagggtggtgagtgcgatcttcaagatcagagtatgatgttcggaaacgatcgcagtcggtttctggaggggaagagagccgtggaggacaaaaatattggaccactggtgaagactatcatgacacgctgtattcaatgtacgcggtgtatcagattcgccagcgagattgctggcgtcgacgacctgggaaccactggaagagggaatgatatgcaggtcggcacttacatagagaagatgttcatgtcagagctgtccggcaatattattgatatttgtcccgtgggcgctctgaccagcaagccctacgcctttacagcgcgcccttgggagacgcgaaaaactgagtcaattgatgtcatggacgcagtcggaagcaatatcgtcgtgtccactcgtaccggcgaggtgatgaggatactgccaaggatgcacgaagacattaatgaagagtggatttcagacaaaacgaggtttgcctatgatggactgaaacggcagcgccttactgagcccatggtgagaaacgagaagggattgctgacatacacatcttgggaagacgcccttagccgggtagccggtatgctgcaaagttttcagggcaaggatgtcgccgccatcgcaggcggcttagtggacgccgaggctttggttgccctcaaggatttgctcaatagagtcgatagtgataccctgtgcactgaagaagtgttccccacagcaggtgcggggaccgacttgaggtccaattatttattaaacaccaccattgccggcgtagaggaggcagacgtggtactgctggtcggcactaaccccaggttcgaggccccgttgttcaatgcgagaatccgcaagtcctggttgcataacgatctaaaagtggcccttattggctcacccgttgacctgacttatacgtacgaccatctgggcgactcccctaagatcttacaggatatcgccagcggcagtcatccatttagtcaggtgctaaaagaggccaagaaacctatggtggtcctgggatcatccgctctacagcggaacgacggagctgccatactggcggctgtgtcttctatagcccagaagatacgcatgaccagcggtgtaactggcgactggaaggtgatgaatatacttcatcgcatcgcatcacaggtggccgctctcgatctcgggtacaagccaggtgtggaggctatccggaaaaatcctcccaaggtgctattcttattgggggcagatggggggtgcataactaggcaagatctgcctaaggattgctttattatttaccaggggcaccacggcgatgtcggggcacctatagcggatgtgattctgcctggggccgcttacacagagaagtccgccacatatgtgaacactgagggcagggcgcagcagactaaagttgccgtgactcctcccgggctggctcgagaggactggaaaatcatccgtgcactgtctgaaattgctgggatgaccctcccttatgacaccctggaccaggttagaaatagacttgaggaggtgagccctaatctcgtgaggtacgacgatattgaaggagctaactattttcaacaggccaatgagctgagcaaactcgtcaaccagcagctgttggctgaccccctggtgccgccccaattaactattaaggacttctatatgacagacagcatctccagagcttcccagacgatggccaagtgcgtcaaagccgtcactgaaggagctcaggccgtggaggaaccatctatttgttag

SEQ ID NO: 196561 - DNA, 393 bp, Artificial Sequence
  Description of Artificial Sequence: Synthetic coding sequence
atgctgcggatccccgtgcggaaggccctggtgggcctgagcaagagcccaaaaggatgcgtaagaactactgcaaccgccgcctccaatctgatcgaggtgtttgtggatggacagtcagtgatggttgagccggggaccacagttctgcaggcttgcgagaaagtcggaatgcaaatccctcggttctgctatcacgagagactgtccgtcgctggcaattgccgcatgtgcttagtcgagatagaaaaggccccaaaagtggttgccgcatgcgccatgcctgtgatgaagggctggaatatcttgacgaattcggaaaagagcaagaaggccagagagggagtcatggagttcctgctggccaaccatcctctggattgtcccatatag

SEQ ID NO: 196562 - DNA, 2226 bp, Artificial Sequence
  Description of Artificial Sequence: Synthetic coding sequence
atgcggatccggggcagcagcggcaccctgagccggatcaacatgctgcgcattccagtgcgcaaggcccttgtgggtctgtccaaatcccccaagggctgcgtccgcaccaccgctacagcagcatcaaacttaattgaagtcttcgtcgacggccagagcgtcatggtagagcccgggactaccgtcctgcaggcctgcgagaaagtaggaatgcagatacccaggttctgttatcacgaacgactttccgtggcgggcaattgccgtatgtgtctggtggaaatcgagaaggccccaaaggttgtggctgcttgcgctatgcccgttatgaagggctggaacattctgacaaacagcgaaaaaagcaaaaaggctagagaaggagtgatggaatttttgttggctaatcacccgttggattgtcccatttgtgatcaggggggcgagtgcgatctgcaggaccagtcaatgatgtttggcaatgaccgtagtcgcttcttggagggtaagcgggccgtggaggacaagaacatcggccctctagtcaagaccatcatgacccgctgcattcagtgcactagatgcatccggtttgcgagcgaaatcgccggagtggatgatttgggcacaaccggccgcggtaatgatatgcaggtcgggacatacattgagaaaatgtttatgtctgagctgagcggcaacattatagacatatgccccgtgggcgcattgacctccaaaccttacgctttcaccgccaggccctgggagacgaggaagacggaatctatcgacgtgatggatgctgtcggatccaacattgtggtttcgactcggactggcgaggtaatgcggatcctaccaaggatgcacgaggatattaacgaggaatggattagcgataaaacgcgttttgcctatgacggactaaagagacagcggctcacagagcccatggtacggaatgagaaaggcctgctgacgtataccagctgggaagatgccctctctcgcgtggcgggaatgcttcaatcgtttcagggcaaagatgtggcggctatcgctggcggtttggttgatgccgaagccctggtggcccttaaggacctgctgaaccgtgtagactcagacacactgtgtacagaagaggttttccccacagctggagccggcacagatcttagatcaaattacctgctgaacacaacaatagctggcgttgaagaagccgacgtagtgctccttgtgggcaccaatcccagattcgaagcgccgctcttcaacgcacggatccgaaagagttggctgcataatgatctaaaagttgccttaattgggagcccagtggatctgacttacacgtacgaccacctgggagacagccccaaaattctgcaggacatcgccagcggatcacaccccttttcccaggtcttaaaggaagctaaaaaacccatggtcgtgcttggatcctcagcgttgcagcggaatgatggagcagctattcttgctgcagtatcatcaattgcgcaaaagattagaatgactagtggcgttactggagactggaaagtaatgaatatcctccatcggatcgcatcccaggtggccgccttagatctgggctacaagcctggtgttgaggccattcggaaaaaccctcccaaggtactctttctacttggcgctgatggaggctgcatcacgcggcaagatctgcccaaggattgctttatcatttaccagggtcatcatggcgatgtgggcgcccccattgccgatgtgattctcccaggagccgcctatacggagaagtcagccacctacgttaacactgaaggacgcgcccaacagacaaaggttgcagtgacccccccagggctcgcacgcgaggactggaaaattattcgcgccctgagcgaaattgctgggatgacattgccctacgacacactagatcaggtgaggaacagacttgaggaggtatccccgaatctggtaagatatgacgacatcgagggggccaactatttccagcaggccaacgagctaagcaagcttgtcaatcagcagctgttagctgatcctctggtcccgccgcagcttactatcaaagatttttacatgaccgattctatttctagggcgagccagacaatggctaaatgcgtgaaagccgtgaccgagggtgcgcaggctgtggaggaaccgtccatctgttag

SEQ ID NO: 196563 - DNA, 1836 bp, Artificial Sequence
  Description of Artificial Sequence: Synthetic coding sequence
atggagttcctgctggccaaccaccccctggactgccccatctgcgatcagggaggcgaatgcgatctccaggaccaatctatgatgtttggcaatgacagaagtcggtttctggagggaaagcgcgctgtggaagacaagaacatcggtcctttagtgaagaccatcatgaccagatgcattcagtgcactaggtgtatccggtttgcgagcgagatcgcaggagtcgacgacctcggtacgaccggtcgcggaaacgacatgcaggtaggcacctacatagagaagatgttcatgtcggagctgagcggaaacatcatagatatttgccccgtgggtgcattaaccagcaagccctatgcctttactgctaggccatgggaaacacgtaagacggagagcattgatgtcatggatgcggtgggctccaacatcgtcgttagcacacggacaggggaagtgatgcgaatcctaccccggatgcatgaagacatcaacgaggagtggatcagtgataagacccggttcgcttacgatgggctgaagagacaaagattaactgagcccatggtgcggaatgaaaagggattactgacttatacatcttgggaagatgccctctcacgtgtagccgggatgttgcaatctttccagggcaaggacgtagcagcgattgccggagggttggtggacgctgaagcgttggtcgcactcaaggatctgctgaaccgagttgattccgatacattgtgcaccgaagaagtctttcccaccgctggggcgggaactgacctacgctcgaattacctgctgaacaccactattgcaggtgtggaggaggccgacgttgtccttctggttggcacaaaccccagattcgaggcgcctctctttaatgcccggattcgcaagtcgtggcttcacaatgacttaaaggtggcccttatagggtcacctgtggatctcacctatacctacgaccacttgggcgatagccctaagatcctacaggacatcgcctccggaagtcacccgttcagccaggtgttgaaggaagccaagaagcccatggtcgtgctgggaagctccgctctccaaaggaacgatggcgccgctatcctggccgccgtgtcatccatcgcccaaaagattcggatgacatcaggagtcaccggcgactggaaggtgatgaatatattacatcgcatagccagccaagtggctgctctcgatttaggatataagcctggagtagaggcgatccggaaaaatccaccaaaggtgctatttcttctcggcgcagatgggggttgcatcacgcggcaagatttgccgaaagattgctttataatctatcagggccatcacggagatgtcggcgcccccatcgccgacgttatactaccgggggctgcctacacggaaaaaagcgccacctacgtaaacacagagggcagggcccagcagactaaagtggctgttacgcctccagggctcgcgcgggaagattggaagatcatcagagctctaagtgagattgctggcatgaccctgccgtacgacaccctcgaccaggtaaggaacagactcgaggaggtgtcgcccaatctcgtgaggtacgacgacatcgaaggagctaattactttcagcaggccaacgagttatccaagttagtgaaccagcagcttctggcagacccactggtgccaccccagctgaccatcaaggatttctacatgacagactcaatttcccgcgcttcccagactatggctaagtgtgtgaaagcagttaccgagggcgctcaagccgtcgaggaacccagcatctgttag

SEQ ID NO: 196564 - DNA, 1392 bp, Artificial Sequence
  Description of Artificial Sequence: Synthetic coding sequence
atggccgccctgcgggccctgtgcggcttccggggcgtggccgcccaagtgctaaggccaggagctggagtgagactgccaatccagcctagcagaggcgtcagacagtggcaaccagatgtggaatgggctcagcagtttgggggcgcagttatgtacccgtccaaggagaccgcccactggaaaccaccaccttggaatgacgtagatccaccaaaggacactattgtgaagaacatcactctgaacttcggaccacaacatcctgcggctcacggtgtgctgaggctggtcatggagctgtctggagagatggtccgcaagtgcgacccccacatcggcctgctccatcgggggactgagaaactgattgagtacaagacttacctccaggcactgccctattttgacagactagattacgtgagtatgatgtgtaacgaacaggcatactcacttgccgtggagaagttactgaatatccgtccacctccacgcgctcaatggattcgggtgttgtttggcgagatcacccgcttgctgaaccatataatggccgtcacgactcatgcactggacctcggggcaatgacccctttcttttggctctttgaggaaagggaaaaaatgttcgagttttacgagagagttagtggcgccagaatgcacgcggcatacattcgcccagggggcgtccatcaggatctcccacttggcttaatggacgatatttaccagttctccaaaaattttagcttacggctggacgaactggaagagctgttgaccaataacagaatttggaggaaccgaacaatcgacattggagttgtgacagctgaggaggctctaaactatggcttttccggcgtcatgctgcgaggctctggtatccagtgggatcttcgaaagacgcagccgtatgacgtgtacgatcaggttgagtttgatgttcctgttggaagtcgcggcgattgctacgaccggtacctgtgccgcgtcgaggaaatgaggcagtcactgaggataattgctcagtgtctgaacaaaatgccgcccggagagattaaggtggacgacgccaaggttagcccacctaagcgagccgagatgaaaaccagcatggagtcacttatccatcacttcaaactctacaccgaagggtaccaggtgcctccgggcgccacgtacacagccatagaagccccgaaaggcgaatttggggtctacctggtatccgatggatccagtcggccataccgatgtaaaatcaaggcccctggctttgcgcacctggccgggctcgacaagatgagtaaaggacacatgttggccgacgtggttgctataattggaacccaggacattgtgtttggcgaggtagatcgatag

SEQ ID NO: 196565 - DNA, 1374 bp, Artificial Sequence
  Description of Artificial Sequence: Synthetic coding sequence
atggccgccctgcgggccctgtgcggcttccggggcgtggccgcccaggtcttaagacctggcgccggagttcgcctccccatccagcccagccggggagtccgccagtggcaacccgatgtcgagtgggctcagcagtttggtggggccgttatgtatccaagtaaagagactgctcactggaaaccaccaccttggaacgacgtcgatccccctaaagacactatcgttaagaatattaccctaaattttggccctcaacatcccgctgcccatggcgtcctccggttagttatggagctgtccggggagatggtgcgaaaatgtgatccccacatcggcctccttcataggggcactgagaagctgatcgagtacaaaacttacctgcaggccctgccatactttgacagactggattacgtgtctatgatgtgcaacgagcaggcgtattcattggccgtagagaagctgctcaacatccgacccccgccaagagcccaatggatcagggtgctctttggggagataacccggctgcttaatcacatcatggcagtgacaacacacgccttggatctgggtgcaatgactcctttcttctggctcttcgaggaacgcgagaaaatgttcgagttctacgagagggtgtccggtgcacgcatgcacgctgcttacatccgaccaggcggcgtccatcaggacctgcctcttggcctgatggatgatatttaccagttcagcaagaacttctccctgagactggacgagctcgaagaactgcttacaaacaacagaatctggcgaaaccgcactattgacattggggttgtcaccgccgaagaagctcttaattacggtttttccggcgtgatgctgagaggcagcgggattcaatgggatctaagaaagacacagccgtacgatgtctacgatcaggtcgagtttgacgtgccagtaggtagccggggagattgctatgataggtacctttgcagggtagaagaaatgcgccagtccttaagaatcattgcccagtgtctgaataagatgccgccgggtgagataaaggtcgacgacgcgaaggtgtccccgccaaagagagccgaaatgaagacctcaatggagagtctcatacaccacttcaagctatataccgaaggttatcaggtaccaccaggtgccacgtacacagcgatcgaggccccgaagggtgagttcggagtgtatttggtatctgacggctcgagccgcccataccggtgcaagattaaagcccctggctttgcccatctcgctgggctcgataagatgagcaagggtcacatgttggccgacgtggtggcaataatcggtaccagacccatagtttag

SEQ ID NO: 196566 - DNA, 696 bp, Artificial Sequence
  Description of Artificial Sequence: Synthetic coding sequence
atggagctgagcggcgagatggtgcggaagtgcgacccccacatcggtttgctccatagaggaacagagaaacttatagaatataagacttatcttcaggccctaccatattttgatcgactggattatgtgtcaatgatgtgtaacgagcaggcgtactctcttgccgtggagaaactcttaaacatcagaccaccgccgagggctcagtggatccgggtgctgttcggcgaaatcacccggctcttgaaccacataatggccgtgacaacccacgccttagacctcggggccatgacaccctttttttggttattcgaagagagagagaagatgttcgaattttatgagcgcgtgtcaggcgctcgaatgcacgccgcctatattcgacctggtggagtccaccaggaccttcctttagggctaatggatgatatttatcagttttctaaaaatttttccttgcgcctcgacgagttagaggagctgctcaccaataacaggatatggagaaatcgtacaatagacattggcgtcgtgactgctgaggaggcgttaaattacggattttcaggtgtaatgttaagggggagcggaatccagtgggacctgagaaagacccagccatacgacgtttatgaccaagtcgaattcgacgtgcccgtgggttccagaggggactgttatgaccggtag

SEQ ID NO: 196567 - DNA, 162 bp, Artificial Sequence
  Description of Artificial Sequence: Synthetic coding sequence
atgttcgagttctacgagcgggtgagcggcgcccggatgcacgccgcatacatccggccaggaggcgtgcaccaggacctgcccctcgggttgatggacgatatatatcaattctcaaaaaacttctctctgaggctcgatgaattggaagaggttagttag

SEQ ID NO: 196568 - DNA, 795 bp, Artificial Sequence
  Description of Artificial Sequence: Synthetic coding sequence
atggccgccgccgccgtggcccggctgtggtggcggggcatcctgggggcgtccgcactgacccgagggacgggccgaccctccgtcctgttgctcccagtccgacgcgaaagcgctggcgcagacacccgtcctacggttcgacctcggaatgacgtggcccacaagcagttgagcgccttcggggagtacgtggcagaaatccttcccaagtacgttcaacaagtgcaggtatcttgctttaacgagctggaggtctgcatccaccccgatggcgtgatcccggtactgacgttcctgagggatcatacaaacgcacagtttaagagcttggtagatctaactgcggtcgatgtgcccactagacagaatagattcgaaatcgtatataatttgttgtccctgcggttcaactcacgcatcagagtgaagacttatacagatgagcttactcctatcgaatcggcggtaagcgtctttaaggcagccaattggtacgagcgcgaaatctgggacatgttcggggttttcttcgctaaccaccctgacctgagaaggatcttgaccgattacggattcgaaggccatcctttcagaaaggacttccctctgagcggatatgtagaattacgctatgatgacgaagtgaagcgggttgtggccgaaccagttgagctggcgcaggagtttcggaagttcgatcttaatagcccctgggaagcttttcctgtgtataggcagccaccagaaagcctaaaactggaagcaggagataagaagccagacgcaaaatag

SEQ ID NO: 196569 - DNA, 528 bp, Artificial Sequence
  Description of Artificial Sequence: Synthetic coding sequence
atggccgccgtgagcatgagcgtggtgctgcggcagaccctgtggaggagacgagccgtggccgtggccgcactgtccgtcagtagggtgccaactcggtctttacggacctcgacttggagactggcacaggatcaaacccaggatacccaacttattaccgtcgacgagaaactggacatcaccacacttactggcgtgcctgaggaacacataaaaacaagaaaggtacggattttcgttcccgctagaaataacatgcagagcggggtgaataacaccaagaaatggaaaatggagtttgacacccgcgaacgctgggagaatcccctgatgggttgggccagcaccgcagaccctctttctaacatggttctcaccttttctactaaagaagatgctgttagtttcgctgaaaagaacgggtggtcatacgacatagaagagaggaaggtgccaaagcctaagtccaagtcttatggggccaacttctcttggaataagaggactcgcgtgagcacaaaatag

SEQ ID NO: 196570 - DNA, 321 bp, Artificial Sequence
  Description of Artificial Sequence: Synthetic coding sequence
atgcccttcctggacatccagaagcggttcggcctgaacatcgaccggtggctcacaatccagtctggagagcagccttacaagatggcgggacggtgccatgcttttgagaaagaatggatcgaatgtgcacatggcattggttacactagggctgagaaggaatgcaaaatagaatatgatgattttgttgagtgccttctccggcaaaagacaatgcggcgagccggaaccatacgtaagcagagagacaagctgataaaagagggcaagtacacccctcctcctcaccacatcggcaagggggaacccaggccttag

SEQ ID NO: 196571 - DNA, 321 bp, Artificial Sequence
  Description of Artificial Sequence: Synthetic coding sequence
atgcccttcctggacatccagaagcggttcggcctgaacatcgacagatggcttacgatccagtcaggagaacagccatacaagatggctggaagatgccacgctttcgaaaaggagtggattgaatgcgcccacggcattggatatacccgggctgaaaaggaatgtaaaatcgagtacgacgatttcgttgagtgtttgctgagacaaaagaccatgcgtcgtgcaggaacgatacggaagcagagagacaagctcattaaggagggcaagtatacgccccctcctcaccacattggtaaaggggagccgaggccatag

SEQ ID NO: 196572 - DNA, 375 bp, Artificial Sequence
  Description of Artificial Sequence: Synthetic coding sequence
atggccgccgccatgaccttctgccggctgctgaaccggtgcggcgaggcagcccgttccttgccattaggcgccaggtgttttggagtccgggtgtctccaaccggcgagaaggtgacacatacggggcaggtgtatgacgataaggactatcgccgcattaggtttgtggggcggcaaaaagaagtgaacgaaaatttcgccattgatcttatcgccgaacaacctgttagcgaagtagagaccagagttatcgcctgtgacgggggggggggagcactgggtcatcctaaagtctacattaatctggacaaagagacaaagaccgggacatgcggatattgcggcttgcagtttcgccagcatcatcactag

SEQ ID NO: 196573 - DNA, 1560 bp, Artificial Sequence
  Description of Artificial Sequence: Synthetic coding sequence
atggcccccatccccaagaccgtgggccggatcaagctggactgctcactccgacctagctgccctctcgaggtagccgctgccccaaaactttgtaaggaatttgggccagaagattatggcgaggaggacattgttgactttctcagaagactcgtggaatctgacccccagggccttcatagaatccacgtggatgggtcatcgggccgactgcaactctggcatcacgactatctgctaggccatttggacgacgaaggcaaaagcacaggccagagcgatagaggcaaaggcgccgaaggactgggaacctactgtggtctgcgtaaatccttcctataccctccacaggaaagcgaaccgtgcccccagtctccatcagcctccgcgacatttccatccgtgtccgattccctgctccaggtggcgatgccacagaaactgctggtgacagaggaagaggcaaatcggctcgctgaggagttggttgccgaggaggagagaatgaaacaaaaggctgagaagaaacgacttaaaaaaaaaagacagaaagagaggaagcgacaggagcgcctagagcagtattgcggcgaacctaaagcctccactacctcagatggggacgaaagcccgccgagctcccccgggaatccagtgcagggtcagtgtggcgaagaagaggactccctggatctgagctcaacatttgtgtccctcgcactccgaaaggtcggtgactggcctctgtccgccaggagggagaagggactcaaccaggagcctcaggggcgtggcctggccctgcagaagatgggccaagaggaagagtcaccgcctcgcgaagaacgaccacagcagtcccctaaagtccaggcctctccaggactcttggcagcggcgctccagcagagccaggagctggccaaactgggtacgtcgttcgctcaaaacgggttctaccatgaggcagtcgtgctgtttacccaagccctgaaactgaatccgcaagaccataggctgtttggaaatcggtcattctgtcatgaacgcttggggcaaccagcttgggctctggccgacgcccaggtggctcttaccctgcggccaggttggccacgggggcttttcaggctgggcaaggccctaatgggcctacaacggtttcgggaggctgcagccgtcttccaggaaaccctgagagggggcagccagcctgacgcagcccgggaattacgtagctgtttactgcatctcacccttcagggacaaagaggcggtatctgcgctcctcccctgtcacctggggcattgcagcctctccctcacgctgagcttgcaccaagtgggctgcctagtcttcggtgccctcggagtaccgcactgaggtctcctggattgagcccacttttacattacccaagttgccacaggtcccaccctaaccagcccttgagccaaacccaaagtcgacgccctcaccctctcaagccacaagacccgtctaaaggctgggatatcttgggcctgggcctccagcatctctcacaggctagatag

SEQ ID NO: 196574 - DNA, 621 bp, Artificial Sequence
  Description of Artificial Sequence: Synthetic coding sequence
atggccgtgctgagcgcccccggcctgcggggcttccggatcctgggactcagaagctctgtgggacccgccgtccaggccagaggtgtgcaccagtccgtcgctactgacggaccgtcctccacacaacccgctctgcctaaagctagagcggtagcacccaaaccttccagccgaggagaatatgttgtggcgaagttggacgatttggtaaattgggcacgtcgctcgtcactctggcccatgacatttgggcttgcttgctgcgccgtcgagatgatgcacatggctgccccccggtatgatatggaccgattcggagttgtgttccgcgcaagtccaagacagagcgacgtgatgatagttgcgggtacactgactaataagatggctcccgccttaaggaaggtgtatgaccagatgcccgagccccggtatgtggtctccatgggtagttgcgccaatggtggtggctactaccattattcctatagcgtggtacggggatgcgacagaattgttcccgttgatatttacatccctggcagggctggcacagcgcctcctacccgggagctggaaacaggcccggctccccatggtgctcggcgccctttgtag

SEQ ID NO: 196575 - DNA, 885 bp, Artificial Sequence
  Description of Artificial Sequence: Synthetic coding sequence
atggccgtgctgagcgcccccggcctgcggggcttccggatcctgggacttaggtccagcgtcgggccagccgtacaagcgaggggcgtccatcagagcgtggccaccgacggtccctctagcactcagcctgcgttgcctaaggctagggccgtggcccccaagccttcttcccgcggagagtatgtggtggccaagttggacgatttggtgaactgggcacgacgggtatcaacgatgagctgccgtccatcgtccagcgcgagggcgtctctgcatacccaccgccacacacacactcatacgaatgttcagacacgaacacacacaacccatgcctgcaccctcacttgcgctcatgtgcacgcaagctctcatgtgtggactgacgtttacacggaccacacccacactcatgctcacaacgcacacatgcataccagaactcacgctcacctacatactcatgcccacacatctacttgcgcacacactctcgcgcacatccacacgtgcaccctggcacttatgcacactcacgcacatatatatacatgcacccgcactttggctcatacttgtacatacatgcacagtcatgctcatacatgtacgctcacccatatgcacacccgcccctgtgtggacacttgtatgtgtgcgtgctggcatgcgtgcactcaagcacactccctcatgcatactcacccttgcggcaggggcgctggcagaaccttgcctgaagcacccgttctggcatggtggcctgttgtaccatccgaagactcagatccagctggggacgatccctctgttagtgtaatcttatttctggcctctgtgtgcagcagttgcttttcattcaaagtaaaggcagtcttctag

SEQ ID NO: 196576 - DNA, 645 bp, Artificial Sequence
  Description of Artificial Sequence: Synthetic coding sequence
atggccgtgctgagcgcccccggcctgcggggcttccggatcctgggcctacgctctagcgtgggccccgcagttcaggcacgaggtgtacaccagtccgtcgcaaccgatggtccaagttccacccagcctgcactaccgaaggccagggccgtcgcccctaagccttcatctcgtggggagtacgtggtagccaagctggacgatctggtcaattgggcccgaaggtcttctctgtggcccatgacctttggcctggcctgctgtgctgtggaaatgatgcacatggccgctcccagatacgatatggaccgcttcggagtagtgttcagggccagccctcggcagtctgacgttatgatagttgcggggacacttaccaacaagatggccccagcgcttcgcaagtctagtctgagaccagatgctggcgccgctctgagaggactccacggcgagttgcggcaacgaaggcggctactccccctgttcctgctgggtggagaagggcttcgcccacaccgtgcccggggtcacttgcaccctcgcttgcccacaactgccgaggccttgttatacggtatcctgcagcttcagcgtaaaatcaagagggaacggcgtcttcagatctggtatcggcggtag

SEQ ID NO: 196577 - DNA, 621 bp, Artificial Sequence
  Description of Artificial Sequence: Synthetic coding sequence
atggccgtgctgagcgcccccggcctgcggggcttccggatcctggggttgcggagttctgtggggccggcggtgcaggccaggggtgtgcaccagagcgtggcaactgacggtcccagcagcactcaacccgccttacctaaggccagagctgttgcacctaaaccttctagccgtggggagtacgtggtcgctaaacttgacgaccttgtgaactgggcccggaggagcagtctctggcccatgacttttggtttggcttgctgcgctgtcgaaatgatgcacatggccgcccctcgatatgacatggaccgttttggcgttgtgttcagagctagccctcggcaatctgacgtcatgatcgtagcaggaacacttacaaacaaaatggctcccgctctccggaaggtgtacgatcagatgcctgagccaagatacgtggtgagcatgggatcatgcgccaacggcggcggttactatcactatagctacagcgttgtgcgcgggtgtgaccggatcgtgcctgttgacatttacatacctggccgagccgggacagctcctcctactcgggagcttgaaactggaccagcgccgcatggagccagacgccccctctag

SEQ ID NO: 196578 - DNA, 633 bp, Artificial Sequence
  Description of Artificial Sequence: Synthetic coding sequence
atgcggtgcctgaccacccccatgctgctgcgggccctggcccaggctgcacgggctgggcctcccggcggtaggtccctgcacagctccgctgttgctgccacatataaatacgtcaacatgcaggatccagagatggacatgaaaagcgtcaccgatagggccgcgcgaaccctcctatggactgagctgtttcgtggtctggggatgactctctcatatctgtttcgagagcccgccaccatcaattaccccttcgaaaaagggccactgagtcctcggttcagaggggagcatgcattacgaagatacccctccggagaggaacgctgcatcgcgtgcaagctttgtgaggccatctgccctgcccaggctatcacaatcgaggctgagcctagggccgatgggtctagacgcacaactaggtacgacattgatatgacaaagtgtatttactgcggattctgtcaggaagcttgtccagttgatgccatcgtggagggtccgaacttcgagttctccactgaaacacacgaagagctcctgtacaacaaggagaaattgctaaacaatggcgataaatgggaggctgagatagccgcgaatattcaggccgactacttatataggtag

SEQ ID NO: 196579 - DNA, 375 bp, Artificial Sequence
  Description of Artificial Sequence: Synthetic coding sequence
atgcggtgcctgaccacccccatgctgctgcgggccctggcccaggccgcccgggcaggacctccgggcgggcgctccctccattcttccgctgtggcggcaacttataagtacgttaacatgcaagatccggagatggacatgaagagcgtgaccgaccgagcggccagaactttgctgtggactgagctgtttaggggattgggcatgactctgtcctatttatttagagagcctgccacaatcaattaccctttcgagaaaggccccctttcacctagattcaggggagagcacgctctgcgaaggtatccaagcggggaggagaggtgcatagcctgtaagttatgtgaagccatttgcccggctcagtag

SEQ ID NO: 196580 - DNA, 333 bp, Artificial Sequence
  Description of Artificial Sequence: Synthetic coding sequence
atgcggtgcctgaccacccccatgctgctgcgggccctggcccaggccgccagagccggaccccctgggggaaggagtctgcacagttctgccgtggccgccacttacaaatacgtgaatatgcaggaccccgagatggacatgaagagtgtgactgatcgcgcagctcgcactctattgtggactgaactattcagaggactgggaatgactctgtcctacctatttagggagcctgctactattaactatccgttcgaaaagggccccctgtcccccagatttcggggagaacacgctctgaggcgatatcccagcggggaggaaagatag

SEQ ID NO: 196581 - DNA, 555 bp, Artificial Sequence
  Description of Artificial Sequence: Synthetic coding sequence
atgcggtgcctgaccacccccatgctgctgcgggccctggcccaggctgcaagagctgggccgcctgggggccggtcattgcatagtagtgctgtcgccgccacatacaagtatgttaatatgcaggatcccgagatggatatgaagtctgtcacagaccgtgcagcgaggacattgctgtggacggagctcttccgcgggctgggcatgacattaagttatttattcagggagcctgccactattaactatcctttcgagaagggtccactttcacctaggttcaggggcgaacacgccctgcgccgatatccatcaggggaggagaggtgcattgcttgtaaactgtgtgaggcgatttgtcctgcacaggctatcactatcgaggcagagccccgggccgacggttccagacgaaccacgagatacgatattgacatgaccaagtgcatctattgcgggttctgccaggaagcctgtcccgtcgatgcaatcgtggagggcccaaatttcgagtttagcacagagacgcacgaggaactgctgtacaattag

SEQ ID NO: 196582 - DNA, 195 bp, Artificial Sequence
  Description of Artificial Sequence: Synthetic coding sequence
atgaccaagtgcatctactgcggcttctgccaggaggcctgccccgtggatgctatcgttgagggccctaactttgaattttccaccgaaacccacgaggaactactttataacaaggaaaaattactcaacaacggcgataaatgggaagctgagatagccgccaatatccaggccgactatctgtaccgatag

SEQ ID NO: 196583 - DNA, 1395 bp, Artificial Sequence
  Description of Artificial Sequence: Synthetic coding sequence
atgctggccacccggcggctgctgggctggagcctgcccgcccgggtgtccgtgcgcttctctggggatactactgcaccaaaaaagacctcgtttgggagtctgaaagacgaggaccgaatttttacaaatctctacgggaggcatgactggcgtctgaagggttccctcagcaggggtgactggtataaaacaaaagagattctgctgaaaggtcctgattggattttgggcgagattaagacctccggactcagaggcaggggcggagccggtttccccaccggactgaagtggtcttttatgaacaagccttccgatggccggcctaaatatctggtcgttaacgcagacgaaggagagcccggaacttgcaaggaccgggagattctgcggcacgatccccataaactgctggaaggctgcttggtgggtggccgagctatgggagcccgcgccgcgtacatctacataagaggggaattttacaatgaggcgagtaatttacaagtcgcaatcagggaggcctatgaggccggccttataggaaagaatgcctgcggctctggttacgacttcgatgtgttcgtagtgcgtggggccggtgcctacatttgcggcgaggagactgcgctcattgagtctatagaagggaagcagggaaagcctaggttaaagcccccgttccctgccgacgtgggggtcttcggctgtcccactactgtggctaatgtggaaaccgtcgcagtctctccaactatttgccgtcgaggtggcacatggttcgccggatttggccgggagaggaactccggaacaaaactgttcaatatctctggacacgttaaccatccttgtacagtggaagaagagatgagcgtgccccttaaagagctgatcgaaaagcatgcaggtggggtgacaggcggctgggacaaccttctggctgtgattccagggggatccagtacccctttaatacctaagtcagtttgcgaaactgtgctgatggactttgacgccctggtgcaagcacaaacaggcctcggcacagcagccgttattgtcatggataggtctaccgatatcgtcaaggcaattgctaggctgattgaattttataagcacgaaagctgtggccagtgcaccccatgcagggagggggttgattggatgaataaggtaatggcccggttcgtgcggggcgatgctcgacctgccgagatagactcattgtgggaaattagtaagcagatcgaaggacacaccatctgcgccctaggagatggcgcagcctggcccgtgcagggtctgatacgccatttcagacctgagctggaggagagaatgcagagattcgcccaacagcaccaggccagacaggcagccagttag

SEQ ID NO: 196584 - DNA, 1374 bp, Artificial Sequence
  Description of Artificial Sequence: Synthetic coding sequence
atgctggccacccggcggctgctgggctggagcctgcccgcccgggtgtcaaccgctcctaaaaaaacctcatttggcagcctcaaagatgaagaccgaatcttcacaaatctctatggtcggcatgactggaggttgaaaggctcgttgagcagaggtgattggtacaaaacgaaagaaatcctgttgaagggcccagactggatccttggcgagattaaaaccagcggactgcgaggacgggggggagccgggtttcccacaggcttgaagtggtcatttatgaataagccttccgacgggagacctaaatacctggtggtaaatgctgacgagggcgaacccgggacctgcaaagatcgggaaattctgcgccacgatccccataagctcttggaaggctgcttagtgggaggccgggccatgggggcgcgcgccgcgtatatctatatccgtggggaattctataacgaggccagcaacctccaagtcgctataagagaggcgtatgaagctggccttatcggcaaaaatgcctgtggcagtggctacgacttcgatgttttcgtcgtgcggggggcgggagcctacatttgcggggaggaaactgccctcattgaaagtatcgagggaaagcaaggaaaacctcggctgaaaccgccctttccagctgatgtgggagtgttcgggtgccccaccactgtggccaatgtcgaaacggtcgctgtatctcccaccatttgccggagaggaggaacgtggtttgctgggtttgggagagagcgaaactctgggacgaaactcttcaatatctctggacacgtgaaccacccctgtacagttgaggaggaaatgagcgttcccctaaaggaactgatagagaagcacgcgggtggcgtgaccggtggctgggataaccttctggccgtcatccctggtggtagtagtacgccactgatcccgaaatctgtgtgcgaaactgtgctgatggacttcgacgctctggttcaagctcagactggccttggcacggctgcagtgattgtcatggatagatccacagatatagttaaggccattgcccggctgatcgaattctacaagcatgaatcatgtggacagtgtaccccatgcagagagggcgtggactggatgaacaaagttatggctcgatttgtgcgaggggatgccaggccagcagagatcgactcactttgggaaatcagcaagcagattgagggacacaccatctgcgctcttggcgatggtgctgcatggcccgtgcagggattaattcgtcatttccgccccgagcttgaggagcgcatgcagcgattcgcccagcagcatcaggcccgacaggcggcaagctag

SEQ ID NO: 196585 - DNA, 1008 bp, Artificial Sequence
  Description of Artificial Sequence: Synthetic coding sequence
atgctggccacccggcggctgctgggctggagcctgcccgcccgggtgagcgtgaggttttccggggacaccacagcccctaagaaaacatcctttggttctctgaaagacgaggatcggatttttaccaacctgtacggacggcacgactggcgactcaaaggatcactaagtcgaggggattggtacaagacgaaggagattcttctaaagggtccggattggattctcggagaaatcaagacctccgggctacgaggtcgcggaggtgctgggtttcctaccggcctcaaatggagttttatgaataaaccctcggatggatctcctacaaccgttgctaatgtggagacggtcgctgtgtctcccaccatctgccggcgcggaggcacttggtttgcaggcttcggccgggaacggaattctggcaccaagcttttcaacatctccggccatgtgaaccacccttgcaccgttgaggaggaaatgagcgttcccctaaaggagctcattgagaagcacgctggtggagtcacgggtggttgggacaaccttcttgcagtaattcctgggggttcaagtacacctttaattccaaaaagtgtgtgtgagaccgtcctgatggacttcgacgccctggtccaagcacaaactgggcttggaacagcagccgtgatcgtgatggaccggtccactgatattgtgaaggcaatcgccaggttgattgagttctataagcatgagagctgtgggcagtgcaccccttgtcgcgaaggtgtagactggatgaacaaagtcatggcccgtttcgtgcgcggcgacgcccgaccagccgagatagattccctctgggaaattagtaagcagatagaggggcacaccatatgcgccctgggcgatggtgctgcctggccagtacagggtttaatacgtcatttccgtcccgagctggaagagagaatgcagaggttcgcccagcagcatcaggcaaggcaagccgcatcttag

SEQ ID NO: 196586 - DNA, 1368 bp, Artificial Sequence
  Description of Artificial Sequence: Synthetic coding sequence
atgctggccacccggcggctgctgggctggagcctgcccgcccggaccgcccctaaaaagacttcatttggctctctgaaggacgaagatcggatttttaccaacctttacgggcgccatgactggcgtttgaaagggtccctaagtagaggcgactggtacaaaacaaaagaaatcctattgaaagggccagactggatcctgggggagatcaaaacatccggacttcgggggcgtgggggtgcaggatttcctaccgggctcaagtggtctttcatgaataaaccgtctgacggaaggccaaagtatctcgtggtaaacgctgatgaaggcgagccagggacttgcaaggatagggagatccttaggcacgacccccataaactgctggaaggatgtctcgttggaggaagagcgatgggtgcacgagccgcttatatatatattagaggggagttttataatgaggctagtaacctgcaggtggccattagggaagcctatgaggccggtctcatcggtaagaatgcctgcggctctgggtatgacttcgacgtctttgtggtccggggcgcgggcgcctacatctgcggcgaagaaaccgctctgattgaaagtattgagggcaaacagggcaagccgaggcttaagcccccttttcctgcggacgtaggcgtgtttggatgcccgactaccgtggccaatgtcgagacagtggccgtaagtccaactatatgtaggagaggtgggacctggtttgctggctttggacgagaaaggaactccggcaccaagctcttcaatatctcaggccacgtgaatcacccatgtaccgtcgaggaagaaatgtccgtcccacttaaagagctgatcgagaagcacgccgggggggtcacaggcggttgggacaacttgctagcagtgattccaggaggctcttcaacccctctgatccccaaaagtgtgtgtgagacagtattgatggacttcgatgcactggtccaggcacaaacgggtctgggcactgcagccgtaattgttatggaccgctctacggacatcgtaaaggcgattgctaggttgattgaattttacaaacacgagtcatgcggtcaatgtactccatgtcgggagggcgtggactggatgaacaaggtcatggctagattcgtgcgcggagacgcaaggcctgccgagattgactcattatgggagatttctaagcaaatcgagggccataccatttgcgctctgggcgacggagctgcctggccagtgcagggccttatccgccattttcgccctgaactggaagagcggatgcagagatttgcccagcaacaccaggcacgtcaagccgcatcctag

SEQ ID NO: 196587 - DNA, 1092 bp, Artificial Sequence
  Description of Artificial Sequence: Synthetic coding sequence
atgaacaagcccagcgacggccggcccaagtacctggtggtgaacgccgacgaaggggaacccggcacatgtaaggatagggaaattttgcgacatgatccacataagttactggaagggtgtctggtgggcggtcgagccatgggagctcgtgcagcgtacatttatattcgcggagagttttataacgaagcaagcaacctgcaggttgcgatacgggaagcctatgaggcaggccttataggaaaaaacgcttgtggttcaggatacgatttcgatgtcttcgttgttcgaggcgcgggggcctatatatgtggtgaagaaacagcactgattgagtctatagaaggaaagcagggcaagccgcggcttaaaccccccttcccagctgacgtcggcgtctttggctgccctactactgtagccaacgtggagacagttgccgtgagcccgacaatttgtcgcagaggcggtacctggttcgctggtttcggtcgtgagaggaattctgggaccaaactatttaatatctctgggcatgttaaccatccatgtaccgtcgaagaggagatgtctgttccactcaaagagctcattgagaaacatgctgggggagtgacagggggctgggataatctcctggccgttatccctggaggtagtagtacacccctcattcccaagtcagtctgtgaaaccgtcctcatggatttcgatgctctcgtgcaggcacaaaccggcctcggaacagctgctgttattgtcatggatcgttcaacagacatagtcaaggcaatcgcgaggctcatcgaattctataagcatgagagctgtggccaatgtactccgtgtcgtgagggggtggattggatgaacaaggtaatggctaggttcgtgcgcggtgacgctagacccgcggaaatcgatagcctctgggaaatctcgaaacagatcgaaggtcatactatctgcgccctgggcgacggagccgcctggcccgtccaagggctaattcgtcacttcagacccgagctcgaagagaggatgcaaagatttgcacagcagcatcaagcacggcaggctgcaagttag

SEQ ID NO: 196588 - DNA, 750 bp, Artificial Sequence
  Description of Artificial Sequence: Synthetic coding sequence
atgttcttcagcgccgccctgcgggcccgggccgccggcctgaccgctcactggggccgacacgtgagaaatctacacaagaccgtcatgcagaacggtgccgggggtgcgctgtttgtccaccgagacacgcccgaaaacaatcccgatacaccttttgacttcacacccgagaactataagcgaatcgaagccattgtgaagaactaccctgaagggcacaaagccgcggcagtgcttcccgtcctggacctggcacagagacagaatgggtggcttccaatctctgcaatgaacaaagtggccgaggtgctgcaggtccctccgatgcgggtgtatgaggtggctactttctacacaatgtacaacagaaagccagttgggaaatatcatattcaggtgtgcaccactactccttgcatgctgcgtaactccgatagcatcctcgaagcgatccagaagaagctgggcatcaaagtgggcgagacgactcctgataagctgtttactctaattgaggtcgagtgccttggcgcttgtgtcaacgccccaatggtgcagatcaatgacaactattatgaggatcttaccgccaaggatattgaagaaattatcgatgagcttaaggccgggaagattcctaagcctggccccaggagcggccgcttcagctgcgagcccgctggtggactgactagcctgacagaacctcctaaaggccccggcttcggcgtgcaggcgggcctgtag

SEQ ID NO: 196589 - DNA, 327 bp, Artificial Sequence
  Description of Artificial Sequence: Synthetic coding sequence
atggccgccccctgcctgctgcggcagggccgggccggcgccctgaaaactatgctgcaagaggcccaggtgttcagggggctggcctctacggtcagcctttcagccgaatccggcaagagcgagaaaggtcagccacagaattcgaagaaacagtcacccccgaaaaagcctgcgcccgtgcccgccgaaccttttgacaatacaacatacaagaatctccaacatcatgactactcgacctatacctttcttgacctcaatctggagctcagcaaatttaggatgcctcagccatcctccgggcgagagtcacctcggcattag

SEQ ID NO: 196590 - DNA, 1422 bp, Artificial Sequence
  Description of Artificial Sequence: Synthetic coding sequence
atggccgccccctgcctgctgcggcagggccgggccggcgccctgaagacgatgctgcaggaggcgcaggtatttagaggacttgcgtcgacagtctccctgtcagcagagtctggaaagagcgaaaagggccagccacaaaactcaaaaaagcaaagtcctcctaagaatgttgtggaacccaaggagcggggcaagttgcttgcaactcaaaccgcggccgagctgagtaagaacctgtctagtccatccagctacccgcccgccgtgaacaagggcagaaaggtggccagcccttcacctagcggctccgtcttgttcactgatgagggcgttcccaaatttttgtctagaaagacactggttgagtttcctcagaaagtgctctcccccttcaggaagcaaggcagcgatagcgaagctaggcaggtggggcggaaagtcacttcaccaagctcctcttcctctagttctagctccgatagcgaatcagacgatgaggctgacgtctccgaagttacccctagggtggtttcgaaaggacgcggcggcctccgaaaacccgaggcttcgcactctttcgagaaccgggcccctcgcgtgacggtatctgccaaagagaaaacgctgctgcagaagccgcatgtggatatcaccgatcctgaaaagcctcaccagccaaagaagaaaggatcccctgccaagcccagcgaaggtcgcgaaaatgcccgcccgaagaccactatgcccaggtcccaggtggacgaagagtttctgaagcagagcttaaaggagaagcagctgcaaaaaacttttcggctcaacgaaattgataaagaaagtcaaaagccttttgaggtgaagggtccgctgcccgtccatactaagtctgggctgagcgcccctcccaagggatcgcccgcccccgccgtgctggcagaagaggcacgggccgaggggcagctgcaggccagcccgcccggagctgccgaggggcacctggaaaaaccagttcccgagccccaacgcaaggcagctccccctctgccacgcaaagagacctccggcactcagggaatcgagggtcacctcaaaggtgggcaggctatcgttgaagatcaaatcccgccaagtaatctggaaactgtcccagtggagaacaatcacggcttccacgagaagacagccgctctgaaactcgaagccgagggtgaggcaatggaagatgcggcggctcccggtgatgacaggggaggcacccaggaaccagccccggtacccgccgaaccattcgataatacaacatacaaaaacctgcagcaccacgactactcaacctatacatttctcgatctaaatctcgaactttcaaagtttcgtatgcctcagccgtcctcagggagagaatcacccagacactag

SEQ ID NO: 196591 - DNA, 339 bp, Artificial Sequence
  Description of Artificial Sequence: Synthetic coding sequence
atgctgcaggaggcccaggtgttccggggcctggccagcaccgtgtccctgagcgccgagagcggcaaaagcgagaaaggacagccacagaacagtaaaaaacagagtccaccgaagtccgtgccaactccgcacaggaggtattcaccttgcggcgactggaaagacgcatcgagccttaagccagcgcctgttccagcagaaccattcgacaacactacgtacaagaacctgcagcaccatgattactcgacgtacacattcttggatctaaatctcgaattgagcaagttccgcatgccccagccctcatctggcagagagagcccgagacactag

SEQ ID NO: 196592 - DNA, 2223 bp, Artificial Sequence
  Description of Artificial Sequence: Synthetic coding sequence
atggagaagctgggcgtggagcccgaggaggagggcggcggcgacgacgacgaggaagatgccgaggcttgggccatggagctagcagatgttggagccgccgcaagtagccaaggtgtgcacgaccaggtcctgcccaccccaaacgcttctagccgggttatcgtgcatgtggatctggattgcttctacgctcaggtggagatgattagtaatcctgagctaaaggacaagccacttggggtccagcagaagtacttggtcgtcacgtgtaattacgaggcgaggaagctgggcgtaaagaaattgatgaacgtccgcgacgccaaagaaaagtgccctcagttggtactcgttaatggcgaagacctcacaaggtacagagagatgagttacaaagtgactgagttactggaggagttctctcccgtagtggagaggctaggctttgatgaaaatttcgtggacctgactgagatggtagagaagagactacaacaactgcagagtgacgagttaagcgcagtgacagtgagcggtcacgtgtacaacaatcagtccattaatctgctggacgtcctccatatccgtctattggtgggctcccagatagcggctgaaatgagggaggcaatgtacaatcagttgggtttgacaggatgtgccggcgtggcttctaacaaattgttggcaaaattggtgagcggtgtgttcaaacccaatcagcagaccgtgctgctacctgaatcttgtcaacatctgatccattctctgaatcacataaaggaaattccggggatcggatacaaaaccgccaagtgcttggaggccttaggcattaattccgtgcgagatctgcagacctttagccccaagattctagaaaaggagctgggaataagtgtggcccagcgcatacaaaagctgtcttttggggaagacaactcgcccgtcatcttgagcggccccccccagtccttctccgaagaagactctttcaaaaagtgttccagcgaggtcgaggccaagaacaagatcgaggagctgttggcgtccttgctaaatcgtgtatgccaggacggacgtaagccccataccgtgaggttgattatcaggcgctattctagcgagaaacactacggcagggaatcgagacaatgtcctataccctcacatgtgattcagaaacttgggaccgggaactatgacgtcatgactcctatggtggacattctcatgaagctgtttcggaatatggtgaacgtcaaaatgccttttcacctcaccttgctatctgtgtgcttttgcaatttaaaggccctcaatacagcaaagaaaggattgattgactattatcttatgccatcactctccaccacctcccggtcaggcaaacactcttttaagatgaaagacacccacatggaggattttcctaaggacaaggagactaacagagacttcctgccctcaggcagaatcgaatccacacgaacacgcgaatcgccactggataccaccaatttttctaaagagaaggacatcaatgaattcccgctgtgtagcctgcccgaaggagtggatcaggaagtgtttaaacagctgcccgtcgatatacaagaagaaatcctgtccgggaagtcacgagaaaagtttcagggcaagggctcagtgagctgtcctttacacgcaagtcggggcgttctgagcttttttagcaaaaaacagatgcaagacattccgatcaaccccagagatcacctgtcaagctcaaaacaggtgtcaagcgtttcaccttgcgaaccagggacgtccggtttcaacagcagcagcagcagctatatgtctagccaaaaggactattcttattatttggacaatcgcctgaaggacgagagaatttcccagggccccaaggagccacaaggcttccactttacgaattcgaacccagccgtgagtgctttccattcgtttcccaaccttcaaagcgaacagctattttcaaggaatcacactacggactcccacaagcaaacagttgccacggattcccatgagggcctaaccgagaacagagaacccgactctgttgatgagaagataacgttccctagcgatatagatccccaagtcttttacgaactgcccgaggcggtacagaaggaattgctggctgaatggaaacgcgccgggtcagattttcatatcgggcataaatag

SEQ ID NO: 196593 - DNA, 540 bp, Artificial Sequence
  Description of Artificial Sequence: Synthetic coding sequence
atgaacaagcggggcttcagcatggaggtgggccagtacatcttcgttaattgccctagcattagcctgttagagtggcaccccttcactctaacatctgcaccggaggaggattttttctcaattcacataagggccgccggggactggacagagaacttaatccgggcctttgagcagcagtactcccctatccctagaatagaggttgacggcccatttggtactgccagcgaagatgtcttccagtacgaggtcgccgtcctggtcggtgccggcatcggcgtgaccccgttcgcgtctattttgaagtcaatctggtacaagtttcagtgtgctgatcacaacctgaagacaaaaaaaatttacttttactggatatgtcgcgagactggagcctttagttggtttaataatctcctgacaagcctggagcaggaaatggaggaactgggaaaatccttgcggaagtgttgccatcgctattcaagcttggaccccagaaaagtgcagttctacttcaataaagaaaatttctag

SEQ ID NO: 196594 - DNA, 1584 bp, Artificial Sequence
  Description of Artificial Sequence: Synthetic coding sequence
atgggcaactgggtggtgaaccactggttcagcgtgctgttcctggtggtctggttagggctgaatgtgttcctgttcgtggacgccttcttgaagtatgagaaggccgataaatactactacacccgcaaaatcctggggttttgctctcggactttacggaaacagctagatcacaatctgacgtttcacaagctggtagcctacatgatctgcctgcatactgctatccacatcattgcacacctgttcaacttcgactgctactctcgttcccgccaggccacagacgggagcttggcgtccatcctgtccagcctgagtcacgacgagaaaaagggcggctcttggttgaatcccattcagagccgcaatactacagtagagtatgttaccttcacttctatcgccggcctcaccggtgtcattatgacgattgcactaatcctgatggtgactagcgctactgagttcattagacggtcctactttgaggtgttttggtacacccaccacttattcatcttttacatcttgggtcttggcatccacggcatcgggggaatagtccgggggcagactgaggagagcatgaatgaatcccaccctcgtaagtgcgctgaatcatttgagatgtgggacgatcgcgatagtcactgccgccgcccaaagtttgaaggccaccctccggagtcatggaaatggatcctggcgcccgtgatcttatacatctgcgagcgcattctcagattctatcgcagtcaacaaaaagtggtcatcacaaaggtagtgatgcatccatcaaaagtactggaactgcagatgaacaagcgggggttttctatggaagttggtcaatacatctttgtaaactgtcccagtatctcactgctggaatggcatcctttcacactgacctctgcgcccgaagaagatttttttagcattcatatacgagccgctggcgactggacagaaaatctgattcgggcctttgagcagcagtatagccccattcctaggatcgaagttgacggacccttcggaactgcctcagaggatgtatttcagtacgaagtcgccgtcctagtcggagcaggaattggagtgacaccgttcgcttctattctcaaatcaatttggtataaatttcagtgcgcagatcacaacctgaaaacaaaaaaaatttacttttactggatctgcagggagacaggcgcattcagctggttcaataatttacttaccagtctggaacaggaaatggaagagctgggaaaggtgggcttcttgaactaccggctgttcttaaccggatgggattccaatatcgtggggcatgcagcacttaattttgataaagctacggacattgtcacagggttgaagcagaaaacctcatttggacgaccaatgtgggacaacgaattctctacaatcgcaacatctcaccccaagtccgtggtcggggtgttcctttgcgggcctcgcactctagcaaaaagcctgcggaagtgttgtcacagatacagctctctggatccaaggaaggtccaattttatttcaacaaagaaaacttctag

SEQ ID NO: 196595 - DNA, 579 bp, Artificial Sequence
  Description of Artificial Sequence: Synthetic coding sequence
atgggcaactgggtggtgaaccactggttcagcgtgctgttcctggtggtatggcttggcctgaatgtgtttctgttcgtcgatgcctttctgaagtacgagaaagctgacaagtactattacacacgtaagatcctgggtagtaccctggcctgcgcccgggcatccgccctttgcctaaacttcaacagcactctcatattgctgcccgtgtgccggaacctcctgagtttcctgcgaggtacttgctccttttgtagccgcactcttaggaagcagcttgaccacaatctgacgttccacaaactggtggcatacatgatctgccttcacaccgccattcacattatcgctcacctgttcaattttgattgctattcgcgcagtcgccaggccacagacggaagcttggccagcattctgtcatccctctctcacgatgagaagaaaggcggctcatggctgaatccaattcatccccacattacccctaccgtttacatgtttacagtcacattcgatatggtcctgtcctccgttaattcaaatttgttcctctttcttctgatcaaaaagtag

SEQ ID NO: 196596 - DNA, 579 bp, Artificial Sequence
  Description of Artificial Sequence: Synthetic coding sequence
atgggcaactgggtggtgaaccactggttcagcgtgctgttcctggtggtgtggctagggctgaatgtgttcctgttcgttgatgccttcctgaagtacgagaaggctgataaatattattatacgcgaaaaatcttggggagcacactcgcctgtgccagagcgtcggcactgtgcctcaacttcaactctacactcatccttctgccagtgtgccgtaacctgctgagtttcctgagagggacttgttcattctgctcgcggacgctccggaagcagctcgatcacaatttgacgttccataagcttgtcgcatacatgatttgcttgcataccgctatccatataatcgctcatctattcaatttcgactgttactctcggagtcgacaagcaacggacggcagtctagcctccattctttcctccctgtcacatgatgaaaaaaagggaggtagctggctgaaccccattcaccctcacattacccctacagtttacatgttcacggttacattcgatatggtgctttcaagtgtaaattccaaccttttcctgtttcttctgatcaaaaaatag

SEQ ID NO: 196597 - DNA, 1695 bp, Artificial Sequence
  Description of Artificial Sequence: Synthetic coding sequence
atgggcaactgggtggtgaaccactggttcagcgtgctgttcctggtcgtgtggcttgggctcaatgtttttctctttgtggatgcattcttgaagtacgagaaggccgacaaatattactacaccaggaaaattctcgggtccacacttgcttgcgctcgcgcttccgctttgtgcctgaactttaattcaacactgatcttgctgcctgtctgccgaaacctgctgagcttcttgcggggaacgtgctccttttgttcaagaactttgcgaaaacaactggaccacaatctaacattccataagctcgtggcatacatgatttgtctgcacaccgcgatccacattatagctcacctgtttaactttgactgctattctagatctcggcaggccaccgacggatccctcgcttccatcctgtcaagcctgagtcacgatgaaaagaaaggggggagttggttgaatcccatccagagtaggaacactacagtggagtatgttacttttacatctatcgccggtctaactggcgttataatgactattgctctgatccttatggttacttctgccacagagttcataagaagaagttatttcgaggtgttttggtacacacaccatctctttattttttacattctcggcctgggcatacacggaattggtggaatcgtgcgcggccagaccgaggaatcaatgaacgaaagccatcctcggaaatgcgccgagtcattcgagatgtgggacgaccgggactcccactgcaggcggccaaagtttgagggacaccctcccgagagctggaagtggatactggccccagtcatcctgtatatatgcgagaggatcctgcggttctacagaagccagcaaaaagtcgtgatcaccaaagtcgtaatgcacccttctaaggtcctggaacttcaaatgaacaagagaggattctcaatggaggttggacagtacatttttgtaaactgcccaagtatttcactgcttgagtggcaccccttcactctgacatccgctccggaagaggatttctttagcatccacatccgcgctgctggcgactggacagagaacctgatccgcgcctttgaacagcagtattcaccaatccctcgtattgaagtggatggccccttcggtacggccagtgaggatgtgtttcagtacgaggttgctgtgctggtcggggctgggattggcgtcacccccttcgcaagcatactgaaatctatttggtataaatttcagtgcgctgatcacaacctcaagactaaaaagatatatttttactggatctgccgagagacaggggcattctcctggttcaataacctgctgaccagcctcgagcaggagatggaggaactcggaaaagtggggtttctgaactaccgcctgttcctcacaggctgggacagtaacatcgtgggtcatgcggcattaaacttcgataaggcgactgacattgtgaccgggcttaaacagaagacaagcttcggaagacccatgtgggacaatgaattttctacaatcgctacctcccaccccaagagtgttgtaggcgtcttcttatgtggtcccaggactcttgcaaaaagcctgcggaagtgttgccatcgttacagttcactggatccacgtaaggtgcagttctacttcaacaaggagaatttttag

SEQ ID NO: 196598 - DNA, 528 bp, Artificial Sequence
  Description of Artificial Sequence: Synthetic coding sequence
tgattcagcatggaggtgggccagtacatcttcgtgaactgcccctccatttctctcctggaatggcatccctttactttgacctccgctcctgaagaggactttttcagcatacacattcgcgccgcaggcgactggacagagaatttaatcagagcctttgaacagcaatacagtcctattcctagaattgaagtggatgggccttttggtactgcctctgaagatgtgttccagtatgaagtcgccgtcctggttggggccggtatcggcgtgacccccttcgcatcgatcctgaagagcatctggtacaaattccagtgcgccgatcacaatctgaaaacaaaaaaaatctacttttattggatatgtcgtgagaccggggcctttagttggttcaataatcttttgaccagcctggaacaggaaatggaagaactaggcaaatccctgaggaagtgttgtcataggtattcatcgctggacccaaggaaggtgcagttctacttcaataaagagaatttttag

SEQ ID NO: 196599 - DNA, 1707 bp, Artificial Sequence
  Description of Artificial Sequence: Synthetic coding sequence
atgatgggctgctggatcctgaacgagggcctgagcaccatcctggtgctctcttggttaggtatcaacttttacctcttcatcgataccttctattggtatgaggaggaagaaagcttccattacacacgcgtcatactaggcagtactctcgcctgggcccgcgcctcggctctctgtctgaattttaattgtatgctaatactgatacccgttagccggaatcttatttcttttatcaggggtacctccatatgttgtcgagggccgtggaggcgccagctcgacaaaaatcttaggttccataaattggtcgcatatggaatcgcggtgaacgcgaccatccacatcgttgctcatttctttaacttagaacggtaccattggtctcagagtgaggaagcgcagggactcttggcagccttaagtaagctgggtaacacaccaaacgagtcatatctgaatccagtacgtacattcccaacaaacactacaaccgaactcctcaggacaattgcgggcgtgacaggactggtgatttctcttgcactggtgttaataatgacctcctccacggagttcatcagacaagcctcctacgagctgttttggtatacacatcacgtgtttatcgtcttctttctcagtctcgcaatccacggaaccgggcgcatcgtgcggggacagacacaagactcactcagtctgcacaatatcactttttgtcgggaccgctacgccgagtggcaaaccgttgcgcagtgcccagtcccacaattttctgggaaggagcccagtgcttggaagtggatcctggggcccgtcgtactatacgcatgcgagcggataatcaggttctggcggttccagcaggaagtagtgatcacaaaagttgtgtctcacccgagtggtgtgttggaacttcacatgaagaaacgggggttcaaaatggcccccggccaatatattctggttcagtgtccggccatatcctcactggaatggcaccccttcacacttacctcagcaccgcaggaggactttttttccgtccacattcgggctgctggtgattggacggccgctctgcttgaggcttttggcgcagaggggcaagctctccaggagccatggtcccttccgcggctggccgttgacgggccattcgggactgccctcactgacgtgtttcactaccctgtctgcgtttgcgtcgcagccggaattggggtaacccctttcgctgctctgcttaagagtatctggtataagtgctctgaagcccaaacgcccttgaagctgtctaaagtatacttttactggatttgcagagatgccagggcctttgagtggtttgctgatctgttactgtcattagagactagaatgtctgaacaggggaaaactcacttcctttcataccatatctttctgaccggttgggatgagaaccaggctctgcatattgctttgcattgggatgagaacacagacgtgataaccggcttgaaacaaaaaaccttctatgggcgacccaattggaacaatgagtttaaacagattgcctataaccatccctcaagttctataggagtgttcttctgcgggcccaaggctctttctcgcacattacagaagatgtgccatctgtatagctctgctgatccaagaggggtgcatttctattataacaaagagtctttttag

SEQ ID NO: 196600 - DNA, 1737 bp, Artificial Sequence
  Description of Artificial Sequence: Synthetic coding sequence
atggccgtgagctggcggagctggctggccaacgagggcgtgaagcacctgtgcttgtttatttggcttagcatgaacgtgttgctgttctggaagacttttcttctctataatcaaggacctgagtaccactacctgcatcagatgctcggactgggtctctgtctctcgcgcgcttctgctagcgtcctcaatctcaactgttctcttatcctgctgcctatgtgcaggacacttttggcctatcttcgtgggtcacagaaagttcctagtcggcgaacccggcggcttctggacaaatccagaaccttccacatcacttgtggcgtgaccatctgtattttctccggcgtgcacgtggcagcacatcttgtcaatgcactcaatttctctgtcaactacagcgaagactttgtcgagctgaacgctgcccggtatagggatgaggacccacgcaaactgctattcacaacagtgcctgggttgactggagtatgcatggtggtggtgctcttcctgatgatcactgccagcacatatgccatcagggtgagcaactacgacattttttggtacacccacaacctgttcttcgtgttttatatgctactgacccttcatgtcagcggggggctgttaaagtaccaaacaaacttggatacccatccacccggctgtatctccttaaatcgcacttccagccagaacattagcctgcccgagtatttttcagagcactttcacgaaccttttccggagggcttttcaaaacctgcagagtttactcagcacaaattcgtgaaaatctgtatggaggaaccgcggttccaggccaactttccacaaacttggttatggatatccggacctttatgtctctattgtgccgagagattatatagatatattcgcagcaataaacctgtgacaatcattagcgtgatgagtcacccttctgatgtgatggagatccgtatggtgaaggaaaactttaaggcaaggcccgggcagtatatcacccttcactgcccctccgtttctgccctggaaaaccacccattcaccctgaccatgtgccctacagaaactaaggctacttttggagtccacctgaaaatcgtgggggattggactgaaaggttcagggacctgctgctgccacctagcagccaagattccgaaatcttgcccttcatccagtcaaggaactaccccaaactttacatcgacggaccattcggaagcccttttgaagagtctttgaattacgaagtctccctgtgtgtggccggcggtatcggagtgactcctttcgcatccattttgaatacgctattggatgattggaaaccatacaagctgaggaggttatatttcatctgggtttgccgagatattcaatcttttcggtggttcgctgacctcctgtgcatgctgcataataaattttggcaggaaaatcgtcccgactatgtgaacatccagttatacctatcacagactgatggcattcagaaaattattggcgaaaagtaccatgcgctgaacagcagactgtttatcgggagacctcgctggaagctgctgtttgatgaaatcgcaaaatataatcgaggaaagactgtgggggtgttttgttgcggccccaactccctgtctaagacacttcacaaactctcgaatcagaataattcctacggcacccggttcgagtataataaagagagtttttcctag

SEQ ID NO: 196601 - DNA, 1665 bp, Artificial Sequence
  Description of Artificial Sequence: Synthetic coding sequence
atgaacgtgctgctgttctggaagaccttcctgctgtacaaccaggggccagaataccactatctgcaccagatgttggggctggggctctgtctttccagagcctcagccagcgtcctgaatcttaactgctccctgatcctgctccctatgtgtaggactctgctggcttacctgaggggttcccagaaagtgcccagcagaaggacacgcaggttgctggataagagccggacattccacatcacgtgtggagtgactatctgcatcttttcaggcgtgcatgtagctgcacaccttgtgaatgcactaaatttcagcgtgaactattctgaagattttgttgagctgaacgcagctcgctatagagacgaggaccctcggaagcttctgttcacaacagtaccaggtctgactggcgtatgcatggttgtggtcttgttcctgatgatcaccgcatccacctacgctattagagtttccaactacgatatcttttggtatacccataacctgtttttcgtcttttatatgctgctcacgttacacgtaagtggcgggcttcttaagtaccagacaaacttggacactcaccctcctggttgtattagcctgaaccggacaagtagccaaaatatttcgctacccgagtatttctccgagcacttccatgagccgtttccagaagggtttagtaagcctgccgaattcacacagcacaaatttgtgaagatttgcatggaggagcctcgtttccaggcaaatttcccacaaacatggctttggatctcaggaccgttgtgcttatattgcgctgaaagactttaccgatatattcgatcaaacaagccagtaacgattatttcagtcatgagccaccctagcgacgtgatggaaattcgtatggtgaaagagaatttcaaagccagaccaggtcagtacataacactgcactgtccttcagtgtctgccctagagaatcaccctttcaccctgacgatgtgccctactgaaaccaaagcaacattcggcgtacatctcaagattgtgggagactggacagagcggtttagggatctcctgctacccccctccagccaggacagcgagatcttgccttttatccaaagcagaaactacccgaagctttatatcgacggaccgttcggtagtccattcgaggagtctttgaactatgaagtgagtctgtgtgtggccggcggaataggagtgacccccttcgcttcaattttgaacacgttacttgacgattggaagccatacaaactgcggaggctgtatttcatttgggtgtgcagggatatacagtcctttaggtggtttgcagatctcctgtgcatgctccacaacaagttttggcaggagaacaggccagactatgtaaacatccagctttacctcagccaaaccgatggcattcagaagatcattggtgagaagtatcatgcgctgaattctagacttttcattggaaggccgagatggaagctgctatttgatgaaatcgccaagtataaccgcggcaaaacagtgggcgttttttgctgtgggcctaattcactatctaagaccctgcataagctcagcaaccagaataacagctatgggacccgctttgagtacaacaaagaatccttttcctag

SEQ ID NO: 196602 - DNA, 816 bp, Artificial Sequence
  Description of Artificial Sequence: Synthetic coding sequence
atggccgtgagctggcggagctggctggccaacgagggcgtgaagcacctgtgccttttcatttggctctcgatgaacgtcctgctgttctggaagacatttttgctctacaaccagggacccgaataccactatctgcatcaaatgcttggatgcccaaccgaaaccaaagcaacctttggcgtgcatcttaaaattgtgggagactggaccgagcgcttccgcgatctgttactgccacccagcagtcaggatagcgagatcctccctttcatacagtcaagaaattatcccaagttatacatcgatggcccattcggttcgccttttgaggaaagtctcaattatgaggtctctttatgcgtggctggcggaataggggtcacaccattcgcctccatcctgaacacactcctcgacgactggaaaccttataagttacggaggctgtactttatctgggtgtgcagagacattcagtcttttcggtggttcgccgacctgctgtgtatgcttcacaacaagttttggcaagagaatcgacccgactacgtgaacatccagctttatctctcccagaccgatggcatccagaaaataataggggaaaaatatcatgcgctgaattctaggctgtttatcggacggcccagatggaaactactgtttgacgaaatcgcgaagtacaatcgcggaaagaccgtgggcgtgttttgctgcggcccaaacagccttagtaaaaccctccataagttatctaatcagaacaatagctatggcactagatttgagtacaataaggagagcttctcctag

SEQ ID NO: 196603 - DNA, 165 bp, Artificial Sequence
  Description of Artificial Sequence: Synthetic coding sequence
atggccgtgagctggcggagctggctggccaacgagggcgtgaagcatctgtgtctgtttatctggctctccatgaatgttttactcttttggaagacttttttactgtacaaccaaggcccggaatatcattacctccatcaaatgctgggcgagctgagctag

SEQ ID NO: 196604 - DNA, 1800 bp, Artificial Sequence
  Description of Artificial Sequence: Synthetic coding sequence
atgggcgagatgtggcggaagcgggaggaggtgatcttccgggagtacagcttttcgttttaccctctgaacatctttgctcccttcgtgctgttcccggattacttttgcctcttggggtttatttggctatcaatgaacgtgctcctcttctggaagacattcctactgtataaccagggtccagaataccactatcttcaccagatgctgggactgggtctgtgcctgagcagagcctccgcaagcgtgctgaacttgaattgctccctcattttgctgcccatgtgccgcacgttacttgcatatctgcgaggctctcagaaggttcctagtcgtaggaccagacgtttactcgacaagtcccggacttttcacatcacctgtggagttactatttgcattttctcaggcgttcacgtagccgctcatttggtgaatgccctgaacttttcagtgaattattctgaggatttcgtggaacttaacgccgctcgctatagggacgaggatcctcgtaaactgttattcaccacagttcctggtttgacaggagtatgtatggtagtcgtgctgttcctcatgataactgctagtacctatgccatacgtgtttccaactacgacatcttttggtatacccacaatctttttttcgtcttctacatgctcctgaccttacacgtgtcaggcggactgctcaagtatcagaccaatctggacacacaccctcctggttgtatatctctcaatcgcacaagttctcagaacatctctctgcctgaatacttcagtgagcacttccacgagccattccccgagggcttttctaaaccggcagaattcacacagcacaaatttgtcaagatttgcatggaggagccaaggttccaggccaacttcccacagacttggctgtggatttccggtcccctgtgcctttattgcgctgaacgcctgtatcgatacattcgctccaataagcccgtcactataatatctgtcatgagccacccatcagacgtcatggagataagaatggtgaaggaaaacttcaaagccagacccggacagtatataactctccactgcccatctgtcagcgctctggagaaccacccattcaccctaacaatgtgcccaaccgaaacaaaagcaaccttcggggttcacctaaaaatagtgggggactggacggagcggtttagagacctcctcctgcccccatcctcccaggactctgaaattctgcccttcattcagtccagaaattacccaaagttgtacatcgacggacctttcgggtccccattcgaggaatccctaaactatgaagtttccctgtgtgtcgcaggcggaattggagtaaccccctttgcgagtatccttaacaccctactggacgactggaaaccatacaaactccgacgactctacttcatttgggtgtgccgcgacattcagagcttccgctggttcgctgacctcctgtgcatgttacacaacaagttctggcaagaaaatcgcccagattacgtgaatatccagctgtacttgagccaaacagatggcatacaaaagataattggagagaaatatcatgcactgaattctaggctcttcataggccgccccagatggaagctcttgtttgacgagatagccaagtacaatagggggaagacggtcggcgtgttttgttgcgggccaaacagcctgtctaagaccctccacaaactctctaatcagaacaacagctatggtactcgattcgaatacaataaggagtcttttagctag

SEQ ID NO: 196605 - DNA, 1665 bp, Artificial Sequence
  Description of Artificial Sequence: Synthetic coding sequence
atgaacgtgctgctgttctggaagaccttcctgctgtacaaccagggccccgaatatcactacttacatcagatgttgggacttggcctctgcttgtcacgcgcttcagctagcgttctcaatttgaattgctcactaatcttacttccaatgtgtcgcaccctacttgcctacttgcgcgggtctcaaaaggtgcccagccggagaacacgccgactcctagacaagtcgaggacattccatattacttgcggcgtgaccatctgcatctttagtggagtgcacgtggctgcccatctggtgaacgcccttaacttctctgttaattattctgaagatttcgtcgaactaaatgccgcccgctaccgcgatgaggacccccgaaagctactatttacaactgtccccggactgactggagtctgcatggtcgtggtgctgttccttatgattacagctagcacctatgctatccgagttagcaattacgacatattctggtacacccataatttgttctttgtgttctatatgctgttaaccctgcacgtcagtggcggattactcaaataccaaactaacctggacacccatcctcctgggtgtatctctctgaacagaacgtcttcccagaacattagtctgccggagtatttcagcgagcacttccacgagccatttccagagggtttctcaaagccagccgaattcacacagcataaatttgtgaaaatttgtatggaagaaccaagattccaggcaaactttccacagacttggctttggatttccggtcccttgtgtttgtattgtgccgagaggttgtaccgctatattcgatccaataaaccagtgaccatcattagtgtaatgtctcatccttctgatgtgatggaaattcgcatggtcaaggaaaattttaaggctcgccctgggcaatacataacccttcattgtccctccgtatccgccttagagaatcacccttttacactgaccatgtgcccaaccgagacaaaagccacttttggggtacacctgaagattgttggggattggacggagcgtttcagggatctgttgctgcccccctcatcccaggactctgaaatactgcctttcatccagagccggaattacccaaagctttatatagacggcccctttggttcgccatttgaggagtctctgaattacgaagtgagcctgtgcgtggccggcgggatcggcgttaccccctttgccagcatcttaaacacactgctcgatgactggaaaccgtataaactccgtaggttatacttcatctgggtatgcagagacatccagtcattccggtggtttgccgatctcctgtgcatgctgcataataagttctggcaggagaatcgcccagattacgttaatatccagctgtacctgtcgcaaacagatggcattcaaaagattattggggagaagtatcacgcactgaactctagactgtttatcgggcgccctaggtggaagttgttgttcgatgagatcgcaaagtacaatcgcggtaagactgttggcgttttctgttgcggtccaaacagtctgtcaaagacattacataagctgtctaatcagaataattcttatggtacaagatttgagtacaataaagaatcctttagctag

SEQ ID NO: 196606 - DNA, 1665 bp, Artificial Sequence
  Description of Artificial Sequence: Synthetic coding sequence
atgaacgtgctgctgttctggaagaccttcctgctgtacaaccaggggccggagtaccactatctgcaccaaatgctgggcctcgggctgtgcctttccagagcttccgcgtcagtactaaatttgaactgtagcctcatattgctgcccatgtgtcgcactttgctggcttacttgcgggggtctcagaaggtgccgagcagacgtacccgccggctgttggacaaaagccgaacgttccatattacatgcggagtcacaatttgcatcttttctggggtgcacgttgcagcacacttagtcaacgccctcaatttttctgtgaactattccgaggacttcgtcgagctgaatgctgcgagatacagagacgaggacccgagaaaacttttgtttacaaccgtacccggcctcacaggggtgtgtatggtcgtcgtcctgttcctaatgatcacagcatccacttatgctatcagggtttccaattatgatatattttggtacacacataatctgttcttcgtgttttatatgctactgacgctccacgtcagcggggggcttctcaaataccagacaaatttagacacgcatccacctggatgcatatctctcaacaggaccagcagccagaatattagcctgcctgagtactttagtgagcattttcatgagccttttcctgagggcttttctaagcccgctgagtttacccagcataagtttgtcaaaatatgcatggaggaacctcgatttcaggccaactttccccagacttggctttggatctcaggccccctttgtctctattgcgctgagaggctttataggtacattcggagtaataaacccgtgactataatcagcgtcatgtctcatccatccgatgttatggaaatccgaatggttaaggagaattttaaagctaggccaggacagtatatcacacttcattgtccaagcgtttctgccctagagaaccacccttttacgctcacaatgtgccccaccgagactaaggctacctttggcgtgcatctgaaaattgtgggagactggacagagcggttccgcgacctcttgctgccaccatcaagccaggattctgaaatcctaccttttatccaatcccggaactaccctaagttgtacattgatggcccctttggttctcccttcgaggaatcgctgaactacgaggttagcctgtgcgtggccggcggcatcggggtcactccatttgcatcaatcctaaataccctgctagatgattggaagccgtacaagcttcgaaggctctatttcatttgggtgtgccgagatatccaatcttttagatggttcgccgatctgctgtgtatgctgcacaataagttttggcaggaaaatcgcccagactatgtaaatatccagctctacttatcacaaactgacggaatccaaaaaatcattggcgagaagtatcacgcgctgaatagccgcttatttatcggccggcctaggtggaaactgctattcgacgaaatagctaagtataatagaggtaagaccgtcggggtgttttgttgcggccctaatagcttgagcaaaaccttgcacaaactgtctaaccaaaacaacagttacggtacccggttcgaatacaataaggaaagtttcagttag

SEQ ID NO: 196607 - DNA, 696 bp, Artificial Sequence
  Description of Artificial Sequence: Synthetic coding sequence
atggccgtgagctggcggagctggctggccaacgagggcgtgaagcatctctgccttttcatctggctgtccatgaatgtgttattattctggaagaccttcctcctgtacaatcagggtccagagtaccactatctccatcagatgcttggctgtcctacggaaacaaaagcaacttttggcgtgcatctcaagatcgtaggggactggacagaacgattccgcgatttgctcttaccaccatctagtcaggacagcgaaattctcccatttattcagtccaggaattaccccaaggatgactggaaaccgtacaaactgaggcgactttacttcatttgggtgtgcagagacatccagtccttccgatggttcgcagacctcttatgtatgctgcataacaaattctggcaggagaaccgccctgactatgtgaacattcagctgtacctgagtcagaccgatggaattcagaagattataggcgaaaaataccatgcgctgaacagtagactgtttatcgggcggccccgatggaaactgctgtttgacgagattgcgaaatacaacaggggcaagacagtgggagtgttttgttgcgggcccaactccctgtccaaaacattgcataaattgagcaatcagaataactcttacggaacacgtttcgaatataacaaagagtccttttcttag

SEQ ID NO: 196608 - DNA, 1617 bp, Artificial Sequence
  Description of Artificial Sequence: Synthetic coding sequence
atggccgtgagctggcggagctggctggccaacgagggcgtgaagcatctgtgtctgttcatttggctttcaatgaacgtcctcctgttctggaaaacatttctgttgtataatcaaggcccggagtaccattatctacaccaaatgcttggcttgggcctttgtctgtcaagagcctctgcatcggtactgaaccttaattgctctcttatcctgctccctatgtgcagaaccctgctagcttacctacggggctctcagaaggtacccagtagacgaacacggcgcctattggacaagagtcgtaccttccacatcacttgcggcgtgactatctgtattttttccggtgtgcacgtggcggcccacttggtgaatgcccttaatttctccgtaaattattcggaagatttcgtagaattaaatgctgccagatacagggatgaagatcctcggaaactgttgttcaccaccgtgcccggactgaccggcgtgtgcatggtcgtggtgctgttcctcatgatcacagcttcaacatatgcaattcgtgtgagcaattacgacatcttctggtacacgcacaacctgttctttgttttttacatgctgttgaccttgcacgtcagcgggggcctcctcaagtatcagactaacctggatacccacccgccgggatgtattagcctcaaccgcacctctagccaaaatatctctctccccgagtatttctcagagcactttcatgagccatttccagagggatttagcaagcccgcagaattcacgcagcataaattcgtgaagatctgtatggaagaacccagatttcaggccaacttcccacagacttggctgtggatatccgggccattgtgcctgtattgcgctgagaggctctacagatatatccggagcaataagccagtgactattatcagcgtgatgagtcacccttccgacgtaatggagataagaatggttaaagagaacttcaaggcccgtcccggtcagtatattaccttacattgccctagtgtgtcagcccttgaaaaccatccattcactttaactatgtgccctacagagaccaaggccacttttggcgtgcacctgaagattgtgggtgattggaccgagaggtttcgagacctgctcctgcctcccagctctcaagacagtgaaatcctaccattcatccagagtcggaattacccaaaagacgattggaaaccttacaaattgcgccgactgtatttcatttgggtgtgtagagacatccagtctttcagatggttcgcagacctgctctgcatgctccataacaaattctggcaggaaaataggcccgactacgtgaacattcagctttacctgtctcagaccgatggcatccagaagataatcggggagaaatatcatgctctgaatagtagactgttcatagggcggcccagatggaagttgctttttgacgagatagcaaagtacaataggggtaagacggttggtgtcttctgttgcggccccaattccctttctaagacactacacaagctgagtaatcagaataattcctatggcacgcggttcgagtacaataaggaaagcttctcttag

SEQ ID NO: 196609 - DNA, 1665 bp, Artificial Sequence
  Description of Artificial Sequence: Synthetic coding sequence
atgaacgtgctgctgttctggaagaccttcctgctgtacaaccagggacctgagtaccactacctccatcaaatgttaggcctcggactctgcctctcccgtgcttctgcctcagtgctgaatctgaattgttctcttattctgctgccaatgtgtcgtaccctgctggcatatttgcgggggtcacagaaggtgccatctcgtcggacccgacggttactagataaatctaggactttccatattacttgtggggttaccatttgcatcttttctggggttcacgtcgccgctcacttagtcaacgctctcaatttctcagtgaattactcagaggattttgttgaactaaacgcggctcggtaccgggacgaagaccccaggaagctgcttttcaccacagtcccaggattaacaggcgtctgtatggtcgtggtgctgtttctgatgattaccgctagcacgtatgctattagagttagtaactacgatatattctggtatactcataacttattcttcgtgttctacatgctgttaacactgcacgtcagcggcggtttgctaaagtaccagaccaacctggatacacacccacctggatgtatttcgctgaatagaacgtcatcacagaatatctcacttcctgagtatttctcggagcactttcacgagcctttccctgaggggttctccaaacctgccgagtttacccaacataagtttgtgaaaatttgcatggaagagccgagattccaggcaaatttcccccagacctggctttggatttctggccccctgtgtctgtattgcgccgagagactttacaggtatattcggtcaaataaacctgtaactataatttctgtcatgtcccacccctcagatgtaatggagatccggatggtcaaggagaatttcaaggcgagacccggtcaatatatcacactgcattgtcccagcgtaagtgcactggagaaccacccattcactttgacaatgtgcccgacagaaaccaaagccacttttggtgtacatctcaaaatagtgggagattggacagaacgctttcgcgatcttttgctgcctccttcttctcaagacagtgagatcttaccattcatccagtccaggaactaccctaaactttatatagacggccctttcggaagtccattcgaagagagcctgaactatgaggtgtcactttgcgtagccggtggaattggcgtaacaccttttgcgagtatcctcaacacgttactcgacgactggaagccctacaaactccgccgattgtacttcatctgggtatgtcgagatatacagtcttttcgatggttcgccgatctgctgtgcatgttgcataataagttttggcaggagaatcgcccagactacgtgaacatacagctctatctgagccagacagacggaatccagaagattattggggaaaaataccacgcgctaaacagtcgattgtttatcggccgaccgcggtggaagttgctgtttgatgaaatagccaagtacaaccgcgggaaaacagttggggttttttgttgtggacccaatagcttgtctaaaacactccacaagctgtccaaccaaaataacagctatggcacaaggttcgagtacaacaaggaatctttttcttag

SEQ ID NO: 196610 - DNA, 1665 bp, Artificial Sequence
  Description of Artificial Sequence: Synthetic coding sequence
atgaacgtgctgctgttctggaagaccttcctgctgtacaaccagggacctgaatatcactacctgcatcaaatgctcggtttgggcctgtgtctctcacgggctagtgcatctgtgctaaatctgaattgcagcctgattctgcttcccatgtgtcgcaccttactggcgtacctgcgtggctcccaaaaggtgccgtccaggcggaccaggcgcctcttggacaagtccaggacctttcatatcacatgtggcgttactatttgcatcttctctggagtgcacgttgcagctcaccttgtgaatgcgctgaacttttccgttaactattctgaggactttgtggaactgaatgctgccagatacagggatgaggaccctaggaaactgctattcacaaccgtccccgggctaacaggggtatgcatggtggtagtcctgtttctgatgattacggcatcgacttacgccatcagagtatctaattatgatattttttggtatacccataatctgttcttcgtgttttacatgctcttaactctgcacgttagtggggggttgttgaagtaccagaccaatttagacactcacccacccggatgcatttctctgaaccgcaccagcagtcagaacatttccctgcccgagtacttcagcgaacattttcatgagcctttccccgaaggcttctcaaagcctgcggaatttacacaacataaatttgttaaaatatgcatggaagagcctcgtttccaggccaatttcccacagacctggctgtggatcagtggccctctctgcctttactgcgccgagcggttgtataggtatatacggtctaataaacccgtgaccattataagtgtcatgagtcacccctcagatgtcatggagatccggatggtgaaagagaactttaaggctcggccaggccagtacatcaccctgcactgtccgtcagtaagcgctttagaaaaccacccattcacgcttacaatgtgcccaactgaaacgaaggctacatttggtgtgcacctgaagattgtgggcgactggactgaacgctttagagacttgctcctgccccctagcagtcaggactctgagatactgccatttatccaaagcagaaactatccaaagctttacatagacggaccctttggcagtccattcgaagaatcactgaactacgaagtgagcttgtgtgtggcggggggaatcggcgttacccctttcgcctctatcctgaacaccctgctcgacgattggaagccttacaagctgcggaggttgtattttatctgggtatgcagggatatccagagcttccgctggttcgccgatttactgtgcatgctgcataataaattttggcaagaaaaccgccccgactacgtaaatatccagctgtatctgtctcagactgatggcatccaaaagataatcggagagaagtaccacgctctcaactctcggctttttatcggcagacctcgctggaagctgttattcgatgaaatcgctaagtataatcgcggcaaaactgtcggcgtattttgctgcggcccaaattcactcagtaaaactctgcacaaacttagcaaccaaaacaacagctatgggaccagatttgagtataataaggagtcattctcatag

SEQ ID NO: 196611 - DNA, 2193 bp, Artificial Sequence
  Description of Artificial Sequence: Synthetic coding sequence
atggccttcgtgtgcgccggcctgagcgacaccatgagcgccgaggaggatgccagatggctgaggtgggtaacgcagcagtttaaaacaattgctggagaggatggtgaaatcagcctccaagagtttaaagccgcactccacgtcaaggagtccttcttcgctgagcgcttctttgccctgtttgatagtgatcggagtggtacaatcacgcttcaggaactgcaggaggcgctcacactgctgattcacgggtcccccatggataagctgaaattccttttccaggtgtatgatatcgacggcagcggctcaattgaccccgatgagctccgcaccgtcctgcagtcctgcctacgggagtccgcgatctcgctgccagatgaaaaactggaccaattaactctggcattgttcgagtccgccgacgccgacggtaacggggctataacctttgaggagctccgggatgagctacagcggttcccgggcgtaatggagaacctgactattagtgctgctcactggttgactgcccccgcgcccaggccccggcccagacgcccccgccagttgacccgggcctattggcataaccaccgatcccaactgttctgcctggccacctacgctggcttacacgtgctgttatttgggctggcggcctccgcgcatagagaccttggagcttcagtaatggtggcgaaaggctgtggccagtgtttgaactttgactgcagctttatcgccgtgctgatgcttcgaaggtgcctcacgtggctgagggccacatggttagcccaggtattgccgctcgatcagaacatacaattccaccagctcatgggctacgtggtagtcggattatccttggtacatacggtggcacacaccgtaaactttgtactgcaagctcaggctgaggcatctccattccagttttgggagctgctgttgacaactcgacctggcatcggctgggtgcatgggagcgccagccctacaggggttgctctgttgttgttactcttgctgatgtttatttgtagcagctcatgcataagacgttccggtcacttcgaggtcttttactggacacatctgtcttatctgttggtgtggttgttattgatcttccacgggcccaacttctggaagtggctgttggtgcctggcattctttttttcctggagaaggcaattggactggctgtctccaggatggcagcagtgtgtataatggaagtcaacctcctccctagtaaggtgacccacttgttaatcaaaagaccgccattcttccactaccgtcccggagactatctctatctgaacattccaacgattgccagatacgagtggcatcccttcactatcagcagcgccccagagcagaaagatacgatatggctgcacatacgctcacagggacagtggaccaaccggctgtacgagtcattcaaggcttctgatccattaggccgcggcagcaaaaggcttagtcgcagcgttaccatgcgaaaatcccaacgatcctcaaaagggagcgagattctgctggaaaagcataaattttgcaacattaagtgctatattgatggtccctacggcacccccacacgccggatttttgccagtgagcacgccgtactgataggagccggaatcggaatcacaccatttgcctcgattctgcaatccattatgtatcgccatcagaaacggaagcatacttgccctagttgccagcacagctggatagagggtgttcaggacaacatgaagcttcacaaggtggattttatctggatcaatcgagaccagcggagcttcgaatggtttgtcagcctgctcactaagctcgaaatggatcaggccgaggaggcacagtatggtagatttttagaacttcacatgtacatgacttcagcactgggtaaaaacgacatgaaggcaataggcctgcagatggcgttggacctgctcgctaataaggagaagaaggactcaatcactggcctgcagacacgcactcagccagggagacctgattggtcaaaagtgtttcaaaaagtggcagcggagaaaaaagggaaggttcaggtatttttctgcgggtccccggcactggcaaaggtcctgaaaggtcactgcgaaaagtttggcttccgattttttcaggagaacttctag

SEQ ID NO: 196612 - DNA, 2298 bp, Artificial Sequence
  Description of Artificial Sequence: Synthetic coding sequence
atgaacaccagcggcgaccccgcccagaccggccccgagggctgccgggggactatgagcgcagaggaggacgcacgctggctacgctgggttacgcagcagttcaaaacaatcgctggagaagacggcgaaatctcactacaggagttcaaagcagccctccacgtcaaggagtccttcttcgctgagaggtttttcgcactttttgacagcgatcgttcaggcaccataacacttcaggagcttcaggaagcacttactctcctgattcatgggagccctatggataagttgaaatttctattccaggtgtatgatattgacgtatgcgctcgccagggggcttccgcgggaaccgaatggggggccggcgcaggccctcattgggcttccagtcccctagggactgggagcggctcaattgatccggatgagctgcgcacagtcctgcagtcctgtcttcgagagtccgcaatttctttaccagacgagaagcttgatcagctgacactcgccctgtttgagtctgctgacgccgacgggaacggggcgataacctttgaggagttacgtgatgagctgcagcggttcccaggcgtcatggaaaaccttaccatttccgctgcccactggttaacggcccctgcccctcgtccaaggccccgcaggccaaggcagctgacccgggcctattggcataaccaccgctcccagttattttgtctcgccacatatgccggcctgcatgtgcttctgtttgggctggctgcttccgcacatcgggatctgggcgccagtgttatggtggcaaaggggtgtggccagtgtctcaactttgactgttcctttatcgcagtgctcatgctaagaaggtgcctgacctggctgagggctacctggctcgctcaggtcttgccgttggaccagaatattcagtttcaccagcttatgggctacgtggttgtaggcctgtcattggtccatacggtggctcatacagttaactttgtgctccaagcccaagcagaggcaagcccattccagttctgggagctcctgctgactaccaggcctggcatcggttgggtccacggaagtgcctctccaactggtgtggcccttctgttgttgctccttcttatgttcatttgtagctcttcttgtattagaaggtctggtcactttgaagttttttattggactcacctttcctacctcctcgtctggcttctcctgattttccatggccctaacttctggaaatggttgttggtgcctgggattcttttcttcttggaaaaggccatcggtcttgcagtaagtagaatggcagcagtgtgcatcatggaggtgaaccttctcccctccaaagtcacccatctgctgatcaaaagacctccgttctttcactaccgccctggtgattatttgtatcttaatatccccaccatcgcacgctacgaatggcaccccttcacaatatcatccgcccctgaacagaaagacacaatctggttgcacatccgatcacagggacaatggaccaataggctgtatgaaagcttcaaagcctcagatcccctaggccggggctcaaagcgcttgtcacgatccgtcaccatgcgcaaatcccaacgaagctctaaggggagtgagatccttcttgaaaagcataagttttgcaatatcaagtgttacatcgacggtccatacggaacaccaacccggagaatctttgcatctgaacatgccgtgctgattggcgctgggattgggatcactccctttgcttcgattctccagtccatcatgtaccgccatcaaaagaggaaacatacttgcccatcctgccaacacagctggatcgagggagtgcaagataacatgaaactgcacaaggtagatttcatctggataaatagggatcagcggagttttgaatggtttgtgagcctcttaaccaagcttgagatggaccaggcagaagaggcccagtacggaaggtttcttgagttacatatgtacatgacatctgccctgggaaagaatgatatgaaagccatcggccttcagatggcattggacttactcgccaataaggagaagaaggactcgatcaccggactgcaaacaagaacgcagcctgggcggccagattggagcaaggtgttccagaaggtggcagcagagaagaagggaaaggtccaggtgttcttttgtggatcacccgcactggccaaggtgcttaagggccattgcgagaaatttggcttccggttttttcaggaaaatttctag

SEQ ID NO: 196613 - DNA, 2214 bp, Artificial Sequence
  Description of Artificial Sequence: Synthetic coding sequence
atgaacaccagcggcgaccccgcccagaccggccccgagggctgcagggggactatgtcagcggaggaagatgcaaggtggctgcgctgggttacacagcagtttaaaacaattgcaggagaggatggggagatctccctgcaggaattcaaagccgcactgcatgtcaaagaatccttctttgcagagcgctttttcgccttgtttgactccgatagaagcggaacaattacattgcaggaattgcaggaggccctcactctgctgatccacggtagccccatggataaactgaagttcctcttccaagtttacgacatcgacggttctggatccattgatcctgatgaactccgcacagtgctgcagagctgcttgagagaatccgccatcagcctgcccgatgagaagctcgatcagctgactctcgccctctttgaatcagcagacgccgatggcaacggggctattactttcgaggaactgcgtgatgagctacagaggtttcccggagttatggagaacctcactatttcagccgcccattggctgaccgcccccgccccccggccgcgcccacgaaggcctaggcagttgactagggcttactggcacaatcacagatcacaattgttttgtctcgccacatacgctggccttcacgtgctgttatttggcttggccgcttctgcccatcgggatcttggagccagtgtgatggtcgctaaagggtgtgggcaatgtcttaattttgactgtagtttcattgctgtcctcatgctgaggcgttgtcttacgtggctgagagccacgtggctcgcacaagtactgcccttggatcagaacatccagttccatcaactcatggggtacgttgtcgtcgggctgagtctcgtccacacggtcgcgcacacagtgaattttgtcctgcaggcacaggccgaagccagccctttccagttctgggagttgctcctgactacacggccgggtataggctgggtacatggatccgcatctccgacgggtgtagctctcctacttctcctcctcctcatgttcatctgcagcagcagctgcatacgcagatctggccatttcgaagtgttttactggacacatcttagttaccttctggtgtggttgctgctgatcttccacggtcccaacttttggaagtggcttctggtgccaggcattctcttttttttagagaaagcaataggattagccgtcagtcgcatggcagcagtctgtataatggaggtaaatctcttacctagtaaagtgacccatctattaattaagagaccgccatttttccactatcggcccggggactacctgtatctcaacattcctacaatcgctcgttatgaatggcacccattcactatcagcagcgcaccggaacagaaagacacaatctggctgcacattaggtctcagggtcagtggacaaatagactttacgaatcattcaaagcctctgaccctctcggcagaggcagcaagcgtctgagtagaagcgtgactatgaggaaatcccagcgcagtagcaaggggtcagagattctgctggaaaagcacaagttctgtaatataaagtgctacatagatggaccttatggaacacccacgcgccgaatcttcgcctccgaacacgcagtgttgattggagccgggatcggtattacccccttcgcatctatactccaatcaattatgtaccggcaccagaagcggaagcacacttgccctagttgtcagcacagctggatcgaaggagtgcaggacaatatgaagctacacaaagtggacttcatttggatcaaccgggaccagaggtcattcgaatggtttgtttctctcctgacgaaacttgagatggaccaagcggaagaggcccagtatgggaggtttcttgaactccacatgtacatgacaagtgctttaggtaagaatgatatgaaggccatcggtctgcagatggccctagatctgttggccaacaaagagaagaaagatagcattacaggacttcagacccggacccaacctggcaggcctgactggagtaaggtgttccagaaagtcgccgccgaaaaaaagggaaaagttcaggtcttcttttgcggaagccccgccctggccaaggtgctgaaaggccattgcgagaaatttggattcaggttcttccaggagaatttctag

SEQ ID NO: 196614 - DNA, 4419 bp, Artificial Sequence
  Description of Artificial Sequence: Synthetic coding sequence
atggacaacgccctgttctgcctggccgccgtgagcaacctggacattgaatctaagctctccgtgtactatcgggccccatggcatcagcagagaaacattttcctgcctgctacacgccccccttgtgtcgaggaactgcatcgccacgcccgccagtctctgcaggcactacgccgtgagcatcgctcacgctcagatcgtcgcgaacagcgcgcagctgctcccctttccatcgcagcccccccgctccccgcttatccccccgcacattctcagcgcaggagggagtttaaggaccggcacttcttaacatttaactccactagatcaccctcacccactgaatgctgccacatgaccccatggtccaggaagtctcatccaccggaagatgaagacaccgatgtgatgctcggccagcggcctaaaaatccaattcataacattccctccacacttgataagcaaacaaattggtccaaggcactgccactaccaactccagaggaaaagatgaaacaggacgcccaggtcatctcatcatgcatcattccaatcaacgttaccggagtggggttcgatcgggaagcttctattcgctgttccttagtgcactcacagagcgtgttgcagcggagacgcaaactgagaaggagaaaaacgatctctgggatcccacgcagagtacagcaagaaatagacagcgacgaaagccctgttgctcgcgagcgtaacgtaatcgttcacactaatcccgacccatcgaataccgtgaatcgtatcagcggtaccagagatagtgaatgccaaaccgaggacatccttatcgccgctcctagtagacgaagaatccgggctcaacgaggacagtctattgccgctagcctgagccactctgccggcaatatctcagccttagccgacaagggggacacaatgtttactcctgcggtgtcctcaagaactagaagccgcagtctacccagggagggcaaccgaggaggcgatgcagagccgaaggtgggagcaaaaccctcagcttatgaggaaggcgagtctttcgttggtgaccacgaacggacccctaacgatttctcagaggcaccctctagtccgtctgctcaggatcaccagcccaccctgggactcgcttgctcccagcacctgcatagccctcaacataaactttccgagcggggccgctcacgcctttcaagaatggctgcggattcaggatcctgcgacatttctagcaacagcgacacattcggtagcccaattcactgcatatccaccgcaggcgtcttgctctcgtctcatatggatcaaaaagatgatcaccagtcttcttcagggaactggtctggttcgagcagcacatgcccatcacaaactagtgagacaatacctcccgccgccagcccccccctgacaggctcatcccattgtgattctgaattatccctgaacacagcaccacacgcaaacgaggacgcttctgtttttgtcactgagcagtacaatgaccacctggacaaggttcggggccacagggcaaattctttcacctcaaccgtcgctgatcttctggatgacccgaacaacagtaacacctccgactcagagtggaattaccttcatcaccatcacgatgcgagctgtagacaagacttctcccccgagagacccaaggctgacagtctaggctgcccctcattcacttctatggccacatacgattctttcctcgagaagtcacccagtgacaaagctgacacctcttctcatttctcagtggacacagagggttactatacctcaatgcattttgactgcggcctgaagggaaacaaatcttacgtctgtcactatgctgccttagggccagaaaatggccaaggggtgggcgcatcccctgggctccccgattgcgcatggcaggactacttggaccacaaaagacagggacggccatcaatttcctttagaaagcctaaggccaagccaacccctcctaaaagaagcagctccctgagaaagagcgacgggaatgccgacatatctgagaaaaaagagcctaagattagtagtggccagcacctcccccactcttcaagggagatgaagctccccttagatttcgccaacaccccctcccgaatggagaatgctaatctgcctaccaaacaggaaccatcttggatcaaccagtctgagcaggggatcaaggaaccgcagctggacgctagcgatataccgcccttcaaggacgaagtggcagagtcaactcactacgctgatctctggttgctgaatgatctgaagactaatgacccctatcgctcactgtctaatagttcaactgctaccggaaccaccgtgatcgaatgcatcaagtcccccgagtctagtgagtctcagacctctcagagcgagagccgcgccacgacccctagcctgcccagcgtggacaatgagttcaagttagcctcccccgaaaaactcgctggactggcctcgccttctagtggatactccagccagagtgaaacacctaccagcagcttcccaacagcctttttttccgggcctctttcccccggaggctctaagaggaagccaaaggtcccggagcgtaagtcctcactgcagcagcctagcctgaaggatggaactatctccctgtcaaaagatttggagctacccattattcctccgacccacctggatctgtccgctttacataatgtgctgaacaaaccatttcaccacagacaccccttgcacgtgtttacacataataagcaaaatacagtaggtgaaacccttaggtcgaatcctccaccgagcctcgcaattacccctaccatccttaagtccgtgaatctgaggtccattaacaagtctgaagaggttaagcagaaagaggagaacaacaccgacctcccctatttggaggaatccacactgaccactgccgcactgtcaccatccaagattcggccacacaccgctaacaaatctgtatccaggcagtatagtacagaagacacaatcctctctttcctcgattctagcgcagtggaaatgggacccgacaaactacacttagagaaaaactctacatttgatgtgaaaaaccggtgtgaccctgagactattaccagtgccggttccagtctgctggattccaacgttacaaaagaccaggtgaggacagagaccgagcctatcccagagaacacacctaccaagaactgcgcctttccaacagaaggattccaacgtgtctcggccgcacgacctaacgatctagacggcaagatcattcaatatggtccgggccctgacgagacactggagcaggttcagaaagctcccagcgctggcctggaagaggtagctcaacccgagagcgtcgatgtaattacctctcagtccgactctccgaccagggcaaccgacgtatctaatcaattcaagcaccaattcgtgatgtcacgacaccacgataaggtgccagggacaatttcgtacgaatcagagatcacaagcgtcaactctttccctgaaaaatgttccaagcaggaaaacatcgcatctgggatatctgctaagtccgccagcgacaattcaaaagctgaggaaacccagggtaacgtggatgaggcatctctaaaagagagtagcccttctgatgatagtataatctctcccctgtcggaagacagccaagcagaagcagaaggagtgttcgtgagccccaataaaccgagaactacagaagatctgttcgccgtcattcaccgctcaaaacgtaaggttttggggcgtaaagattctggggacatgagtgtgagatcaaagtctagagctcccttgtctagctcatcgagctcagcttcctctatcaccagcccttcatccaacgtcaccaccccaaactcacaaaggtctccgggacttatctaccgaaatgcaaagaaatcaaataccagcaatgaggagttcaagctgctgctcctgaaaaagggtagtcgcagtgactcctcataccgaatgagcgcaaccgaaatcctaaaatcacctatcctgccaaagccccccggggagctcacagcagagtcaccacaatcaaccgacgatgcacatcaaggttcacagggagccgaagcactaagtccactgtctccctgttccccaagggtaaacgctgagggctttagtagcaaaagcttcgccaccagcgctagtgctagggtggggaggtctagagcgccccctgctgcgagtagttccaggtatagcgtgaggtgtcgattgtataataccccaatgcaggccatttccgaaggcgagacagagaacagcgatggcagccctcatgacgatagatcatcacagagcagcacctag

SEQ ID NO: 196615 - DNA, 4893 bp, Artificial Sequence
  Description of Artificial Sequence: Synthetic coding sequence
atgcccttcgccaagcggatcgtggagccccagtggctgtgccggcagagacgccctgcacctggtccagctgtggatgccagcggcggcagcgcagagcccccccccccactgcagcctcccggccggcgtgacctggacgaggtggaagcacccgggcctgaggagcccgcgagggcagtgcccgctccaagcggactcccccccccacctccacccctccccgctcccgcagaccagacacagcccccccacggcgaggcatctgtagcaggagaagagtccacggccggcattcccgaagcggcgcccgccgcaggtgaggcctcctccgctgctgccgccgccgccgtgttgctgatgcttgacttatgtgccgtgtcaaatgctgcactcgcccgggtactgcgacaattgtccgatgtcgcccgccatgcttgcagcctattccaggagcttgagtcggacattcagctcacccaccgacgcgtttgggcactgcagggtaagctcggcggcgtgcagcgagtgctcagcaccctcgatccgaaacaggaggccgttcctgtgtcaaatttagatatagaatctaaactcagcgtgtattaccgggccccttggcaccagcagcgaaatattttcctccccgcaacccgccctccttgcgtcgaagagctgcatagacacgctcggcagagtcttcaggctttaagaagggagcatcggtcacgatctgatcgaagagaacagagagcggccgcacccttgtctattgctgcacccccgcttccagcctacccccccgcccactctcagaggagacgtgagtttaaggaccgacacttccttacatcacacccccctgaagacgaggacacagacgtcatgttaggtcagaggccaaagaaccccatccacaacatcccctctactttagacaagcagaccaattggagtaaggcactgcctcttccaacccctgaggagaaaatgaagcaggatgctcaggtcattagtagttgtattatcccgatcaatgtgactggggtcggatttgacagagaagcatctataagatgctctctagtgcatagccagtccgtccttcagcgacgcagaaagctgcgacgccggaaaactatttctggaataccaagacgcgtccaacaggaaatcgatagcgacgagtccccagttgcgcgggaaaggaatgttattgtgcacaccaatcccgacccaagtaataccgtgaataggatctcagggacgagagactcagagtgtcaaactgaggacatcttaattgcagcgccaagccgcagaagaatccgggcacaacgtggccagtccatagcagcaagcctcagccatagcgctggtaacattagcgctctggccgacaagggagacacaatgttcacaccagctgtctcatcccgcacccgctcgcgcagcttgcctagggagggaaatagggggggtgacgccgagcccaaagtgggagccaagccgagtgcctatgaggagggagaaagtttcgtgggcgatcatgagcgtacgcccaatgacttctctgaggccccaagcagtcccagtgcacaggaccaccagcccactctgggcttggcgtgctcccaacacttgcacagtccacagcacaagttatctgaacgcggaagatctcgcctcagccggatggccgcggattctggctcctgtgatattagctcaaactccgacacatttggatcccctattcactgcattagcaccgctggcgtcctcctcagttcccacatggatcaaaaagacgaccatcaatcgtccagtggaaactggtctggctcatcgtctacatgcccgtcgcaaacaagcgagaccatcccgcctgccgcatcaccccccctgaccggaagctctcattgcgactcagagctcagccttaacactgcacctcatgccaatgaggatgcctccgtgttcgtgacagagcaatacaacgaccacctcgacaaggtgaggggccatagagctaacagcttcacaagtaccgtcgctgatctcctggacgacccaaacaactccaacacgagcgatagcgaatggaattacctgcaccaccaccatgatgccagctgccgtcaggacttttcgccagagagacccaaggctgatagtttgggctgtccatcatttacaagtatggcaacatacgattcttttctcgagaaatcgccatccgacaaagcggacacttcaagccacttttccgtggatactgagggctactatacatcgatgcacttcgattgtgggctgaaaggcaataagagttatgtctgtcactacgccgccttagggcccgagaatggccaaggtgtgggagcttctcctggtctcccagactgcgcatggcaggactatctggaccacaagaggcagggtagaccctcaatctcctttcgtaagcctaaggccaaacctacacctccaaaaaggtcctctagcctgcgtaagtcagacgggaatgctgacatttcagagaagaaggaacctaagatatcaagcggccaacacctcccacactccagtagggaaatgaagcttccactcgactttgctaataccccctcacgcatggagaacgcaaatctgcctaccaaacaagaacctagttggatcaatcagtccgagcaggggattaaagagccacagctcgatgcctctgatatccccccttttaaagacgaagttgccgaaagtactcactatgcagacctgtggctgctgaacgacttaaagaccaacgacccttacaggagtttgagcaactccagcacagcaacaggcactacggtgatcgaatgtattaagtcaccagaatcttctgagagtcaaacaagtcaaagcgagtcccgggccaccactccgtcactgccatcggtggataatgagttcaagcttgcgtctccagagaaacttgccgggctcgcctctccttccagcgggtattcgagtcagtcagagacacccacttcaagctttcctactgccttcttcagcgggcccctctcaccaggtggcagtaaacgtaagcccaaggttcctgaacgaaaatcaagcctccagcagcctagcctaaaggatggtacgataagtctctctaaggatttggagctgccaattattccacccactcacctggacctctccgccctgcataacgttcttaataagccctttcatcacaggcatccactgcacgtgttcactcacaataaacaaaataccgtgggagagacgctccgatctaatcctcctccctctcttgctatcaccccaaccatactcaagtccgtgaatttgaggtctattaacaagtctgaggaggtgaagcaaaaggaagagaacaataccgaccttccatatcttgaggagtcaacactcactacagccgcgctttcgccctctaagatcaggccacatacagccaacaagagcgtgagccggcagtactcgaccgaagacacaatcctgagttttctcgactctagtgctgtcgagatgggtcccgataagctgcacctcgagaaaaactccactttcgatgtaaaaaaccgatgcgacccggagaccattacgtcagccggttctagcctgctagactccaacgtcaccaaagaccaggtcaggaccgagaccgaacccattcccgagaatacacctactaaaaattgtgcgtttccgacagaaggctttcagcgagtttccgcagctaggcccaatgacctggatgggaagatcatacaatatggccctggcccagacgagacgttggagcaggtgcaaaaggcaccctctgcgggcctagaggaagttgcacaacccgagtcagttgacgttattacgagccagtccgattcacccaccagagctacagacgtcagcaaccagttcaaacatcaattcgttatgagcaggcaccacgacaaggtgccaggcacaatttcctatgagtccgaaattacctctgtgaatagcttccctgagaaatgttctaagcaggagaacatcgcctccggtattagcgcgaaaagcgcctccgacaatagtaaagctgaggaaacccagggcaatgtagacgaagcctcactcaaggagagttcacccagtgatgatagtatcataagtcctctttcagaagactctcaagcagaagccgaaggcgttttcgtgtcacccaacaaaccacgtaccacagaggatctatttgctgtaattcaccggagtaaacgtaaggtgctgggccggaaagactcaggtgacatgtctgtgagatccaaatctcgtgcgccactcagttctagctcaagcagtgcatccagtatcacgagcccctctagtaatgtgacaactcctaatagtcagcgcagccccgggcttatctataggaatgctaagaagtccaataccagcaacgaggaatttaagctgctcctcttgaagaaaggttccaggagcgattcctcgtatcggatgtcagctactgaaatcctgaagagcccaattctgccaaaaccccctggggagctgactgccgagagcccgcagtcaacagacgatgcccaccaaggtagccagggcgcggaagctctgtcccccttatctccttgcagccccagagtcaacgccgaagggttctctagcaagtcctttgccacctccgcgagcgccagggtgggccgatcacgggctcctcctgcagcatccagctcacggtactccgtgagatgtcggctgtataacacacccatgcaggctatctctgaaggagaaacagagaattccgacggcagtccgcacgacgataggtcttctcaatccagcacgtag

SEQ ID NO: 196616 - DNA, 4425 bp, Artificial Sequence
  Description of Artificial Sequence: Synthetic coding sequence
atggccctggcctgctgcatgcccaagaacgccgccgtgagcaacttagacattgaatctaagctatccgtgtactatcgcgcgccctggcaccagcagcgcaatatattcctaccagcaaccaggcctccgtgcgtagaagaacttcataggcacgcgcgtcagtctctgcaggctctgcgccgagagcacaggagtaggtcagatcggcgtgagcagcgcgccgctgcccccttgagcattgccgcgccaccattgcccgcatatcccccggcccattcccagcgaagaagagagttcaaggatcgtcactttctgacttttaactcaacccgctcacccagtcctaccgagtgttgccacatgacaccgtggagtcgcaagagtcatccccctgaggacgaagataccgacgtgatgctgggccagagaccaaaaaaccctattcataatattccttccacactggacaagcagaccaactggtccaaggctctaccacttcccacccctgaggaaaaaatgaagcaagatgcccaggtaatcagttcctgcatcattcctattaacgtgacgggcgtcggattcgaccgggaagcttcaatccgatgcagtctggtccactctcagtcagtcctgcagcgccgtcgcaagctccgccgccgaaagacgattagcggcattccgagacgggtgcaacaggaaatcgattctgatgaatccccagtagcacgagagaggaacgttatcgtgcatacaaaccctgatccgtctaacactgtcaataggatcagtggaacgcgggattcagagtgccagactgaagatattcttattgcagctccttcacggcgacgtatccgggcccagaggggccagagtatcgcggcttcacttagtcacagtgccggaaatatctccgccttggccgataagggggataccatgtttacccctgcagtttctagccggacaaggtctagaagtctaccgagggaagggaatagagggggagatgccgaacctaaggtaggggccaaacccagcgcatacgaagaaggagaatcctttgtgggcgaccacgaacggactccaaatgatttctccgaggctccctcctcaccatccgctcaggaccaccagccaaccttaggattggcatgtagtcaacatctgcactcacctcagcataaattgagcgaacggggcaggtctagactgtcgcgcatggctgctgatagcggctcctgtgacatttcctccaacagcgatacattcgggtcacctattcactgcattagcacagcaggcgtacttttgagctcccatatggatcagaaagatgaccaccagtcctcctccggcaactggagcggctcctcaagtacttgcccatcacagaccagtgagaccatccccccagcagcaagcccgccactgacaggtagttcccattgtgactccgagctcagtctgaacactgccccccacgctaacgaggatgcctctgtatttgtgacagaacagtataatgatcacctcgacaaagttcgcggtcatagggctaattcattcacgagcaccgtcgccgacctgttggatgaccccaacaacagcaataccagcgatagtgagtggaattacctgcatcaccaccatgatgcctcttgtcgacaagatttctcccccgaaaggcccaaagctgattcactaggatgcccttccttcacttcgatggcaacctatgactcctttctagaaaaatcacccagtgacaaagcggatactagctcccactttagcgtcgataccgaaggatactacacctccatgcactttgactgcgggctgaaaggcaacaaatcttatgtctgtcattacgccgccctgggtcctgagaatggacagggggtaggcgcctccccaggactgcccgactgcgcatggcaggattacctcgaccacaagcgtcaaggcaggcccagcatttcattcaggaaaccgaaggcgaagcccacaccccccaagcgcagcagttccttgagaaagtcagatggaaacgctgatatctccgagaagaaggaacccaaaatttcatctggccaacacctgccacatagcagccgagagatgaagctgccacttgatttcgctaacacccccagtaggatggaaaatgccaatctgccgactaagcaggaaccatcttggattaaccagagtgaacagggcataaaagagcctcaactcgatgcctctgacattcctccctttaaggacgaggtcgcagagagtacccactacgccgatctctggcttctgaatgatcttaaaactaacgacccttaccggtcactgtcaaattcatccaccgcaactggcaccacagtgatcgagtgtatcaaaagccccgagtctagcgagtcacagacgagccagagcgaatctagagccacaacgccttccttgccctccgtggacaacgagtttaagctggcctctccagagaaactggctggtctagccagccctagcagcgggtactcatcccagagcgagacacccacatcatctttccccacagccttctttagcggtcctctgagccccgggggaagcaagcgtaagccaaaagtgccagaacgtaaaagctctctccagcagccttcgcttaaggatggcaccattagcctgagtaaggacttagaactgcccattatcccacctacgcacctcgatttatctgctctccataatgtgctcaataaaccgtttcatcatcgccaccctttgcacgtcttcacccacaataagcagaacactgtcggcgagacactaaggagcaatccacccccgagcctcgcgatcactcctacaattctgaagtccgtgaacctgaggagcatcaataaatctgaagaggttaagcaaaaagaggaaaacaataccgacctaccctacctagaggaatcaaccctgacaacggctgctctttcaccatctaagatccgacctcacacggccaataaatcagtgagccgccagtacagcactgaggacaccattctgagcttcctggatagttcggctgtggagatgggtccggacaagcttcatctggagaagaacagcacatttgacgtgaagaaccgatgtgatcccgagactatcacatccgctggaagctctctcttggattccaacgtgactaaagatcaggtcaggacagagacagagcccataccggagaatacacccacaaaaaactgcgctttccccaccgaggggttccagcgcgtttctgccgctcgacccaacgacctagacggaaaaataattcagtatggccctggccctgacgaaaccttggagcaggttcagaaagcacctagtgccggtctggaagaggttgcacagcctgaatctgttgacgtaatcacttctcagtcagacagccctacaagggcgacagatgtgagcaaccagtttaagcatcagttcgtgatgtcaagacaccatgataaggtgcctggcacaatcagctatgagtcagagatcactagtgtgaactcatttcccgaaaagtgtagtaaacaagagaacatcgcttctggaatctctgccaaatctgccagcgacaacagcaaggccgaggaaactcaaggcaatgtggacgaagcctctttaaaagagtcttcacccagcgatgattccattatttctcctttgagcgaggacagtcaggcagaagccgaaggtgtcttcgtgtctcccaacaaaccccgcaccaccgaggatctttttgcggttatccatcggtctaagcggaaagtcttaggacggaaggacagtggagatatgagtgtgaggtccaagtccagggctcctttgtcaagtagctcgtccagcgctagtagtatcacctctccctctagcaatgtcacaaccccgaactcccaacgctcccctggcttgatttatcgcaatgcgaaaaaatccaatacttctaacgaagagtttaagcttctccttctgaaaaaggggtcccgctccgactcttcctacaggatgtccgctactgagattctgaagagtccgatcctcccaaagccaccaggcgagttgaccgctgaatcaccccagagtaccgacgatgcacaccagggttcacaaggggccgaagccctcagtcctctgagcccctgcagtccaagagtcaacgcggagggtttttcatcgaagtcatttgctaccagtgcatctgctagagttggccgcagtcgcgcccctcctgctgcttctagtagtcgatattccgtgcggtgcaggctctacaatactcccatgcaagcaatctcggagggtgaaacagaaaattctgacggcagtccccacgatgataggtcaagtcagagctccacttag

SEQ ID NO: 196617 - DNA, 255 bp, Artificial Sequence
  Description of Artificial Sequence: Synthetic coding sequence
cccgagctgcaggtgtgcgtgttctgccggaacaacaaggaggccatggcactctataccactcatatactgaagggcccagatggtcgtgtactgtgccctgttctgaggcgctatacttgccccttgtgtggagcctctggggacaacgctcacaccatcaagtattgccctctcagcaaggttccacctcctccagctcggcctccacctcgctccgctcgggatgggccaccaggaaagaaactacgctag

SEQ ID NO: 196618 - DNA, 879 bp, Artificial Sequence
  Description of Artificial Sequence: Synthetic coding sequence
atggaggccttcccctgggccccccggagcccccggcggggccgggctccacccccaatggccttagtgccatccgcacgttatgttagtgcgccaggccccgcccatccccaacctttttctagttggaacgactacctgggtctcgcgacactgattaccaaagccgttgacggagagccccgtttcggttgcgccagaggaggtaatggcggtggcgggtcaccaccctcgtcctccagttctagctgttgcagtccgcacacgggtgctggcccgggagcattaggcccagcgttgggcccgccagattatgacgaggatgacgatgacgatagtgatgaacctgggagcaggggcagatacctcggctccgctttagagctccgagctctggagctgtgcgccggccctgctgaggcaggactgctagaagagcgttttgccgagctttcccctttcgccgggagagccgccgccgtactgctgggctgtgcgcctgctgccgctgcagccgcgacaaccacctctgaggccacccctcgagaagagagggctccagcatgggctgcagaacctcgcctgcacgcggcatcaggggctgccgctgccaggctcctaaaacctgagctgcaggtgtgcgtgttctgcagaaataataaggaagcaatggccctgtacactacccatattctaaagggcccagacggaagggtgctttgccctgtgctgaggaggtacacttgtcccttgtgcggggcttctggtgacaatgcccacacgatcaagtattgcccacttagtaaagtacctcctccccctgcccgacctcctcctcgaagcgcccgcgacgggcctcccgggaagaagttacggtag

SEQ ID NO: 196619 - DNA, 3456 bp, Artificial Sequence
  Description of Artificial Sequence: Synthetic coding sequence
atgctgcggcgggtgaccgtggccgccgtgtgcgccacccggcggaaactgtgtgaggctggtagagagttggccgcactatggggcatcgagactcgcggaaggtgtgaagacagcgcagctgccaggccgtttcctattctagcaatgcccggcaggaacaaggcaaaatccacatgctcctgcccggatctacagcctaacggacaagacctgggcgaaaactcacgagtggcccgcctgggggctgatgaatcagaagaggagggtaggcgtggaagcttgtccaacgccggagaccccgaaatagtaaagagcccatcagatcctaagcagtatcggtacatcaagctgcagaatgggctacaagccctgttgatcagtgatctgtccaatatggagggcaagactggtaatacaacagacgacgaggaggaagaggaggtagaagaggaggaagaagatgacgatgaggattctggagctgaaattgaggatgatgatgaggaggggttcgatgatgaagatgaatttgacgacgaacacgatgacgatcttgacaccgaggataacgagctcgaggagctggaggagcgagctgaggcgaggaagaagacgacagaaaagcagagtgccgctgccttatgcgtgggcgtgggctcgtttgcagatcccgacgatctccccggcctcgcacactttctcgagcatatggtgttcatggggtcattaaagtaccccgatgaaaacggatttgatgcttttctaaagaagcatggaggatctgacaacgcttccactgattgtgagagaacagtgtttcagtttgacgtacagcgaaaatactttaaagaagctcttgacaggtgggctcaatttttcattcaccctttaatgataagggacgcaatcgatcgagaagttgaggctgtcgattctgagtaccagttagcacgtccttccgacgcgaatcggaaggagatgctgtttggctcgctcgctcggcccgggcatcctatggggaagtttttctgggggaatgcagagactctcaagcatgaaccccgcaagaataatatcgatacacatgctcgactgcgcgagttctggatgagatattactcctcccattacatgacccttgtggtgcagtcaaaggaaaccttagatactcttgagaagtgggttaccgagatcttctctcaaatacctaacaacggtctgcctaggcctaacttcgggcatctgacggacccttttgacactccagccttcaataagttatatagagtcgtccctatccgtaagattcatgctctgactataacttgggctctgccacctcaacagcagcattaccgagtaaaaccccttcactatatttcctggctggtaggtcatgagggcaaaggcagtatcctgtctttcctgcggaaaaagtgctgggccctcgccctgttcggtggcaacggcgaaaccggattcgaacagaactctacatattctgtcttctccatttctatcactctgacggatgaaggatacgagcacttctatgaggtagcctacactgtgtttcaatacctgaaaatgctccaaaagctcggaccggaaaagcgaatatttgaggagatacgtaaaatagaagacaatgagtttcactaccaagagcagaccgatccagtggagtatgtggagaatatgtgcgagaacatgcagctctaccctctgcaggatattctgacaggcgatcagctgctcttcgagtataaaccggaagtcatcggcgaagcattgaaccagctggtgcctcaaaaggctaacctcgttctgttaagcggcgccaatgaaggaaagtgtgacttgaaggaaaaatggttcgggacacagtattctatcgaggacattgagaattcgtgggccgaactctggaattccaatttcgagcttaatcctgatctacatctccccgccgagaataagtacatcgccaccgattttaccttgaaggcttttgattgccccgaaactgaataccccgtcaaaatagtgaatacaccccagggctgtctctggtacaagaaggacaataaatttaagatcccaaaagcgtacatcagattccacctaatttctcctcttatccaaaaaagtgccgcaaacgtggtgttattcgatatattcgttaatatcctgactcacaatctggcagaaccagcctacgaagcagatgttgcacagctggaatacaaacttgtcgcaggagaacatggcttaattatcagagtgaagggttttaatcacaaactgccactgcttttccagctgattatagattatctggccgagtttaactccactcctgcagtctttacaatgattactgagcagctgaaaaagacatactttaatatccttatcaagcccgagacccttgcgaaggatgtacgtctgttaatcctggaatatgcccggtggtccatgattgacaagtaccaagccctgatggatggcttaagcctggagtcccttctgagcttcgtcaaggagtttaaatcccagttattcgttgagggattggtgcagggcaatgtgacctccaccgagagtatggatttcctgaagtatgtggtcgacaagttaaatttcaaacctctggaacaggaaatgccggtccagttccaggtggtcgaacttccgtccgggcaccatctttgcaaagttaaagccttgaataagggagacgcaaattccgaagttactgtatattaccaatcgggcacccgcagtttgcgtgagtacaccctgatggaactcttagttatgcacatggaggaaccgtgttttgactttctgcgtaccaagcagacactgggctaccacgtgtatcccacgtgtcgtaacaccagcggaattcttggatttagtgttaccgtgggtacgcaggccaccaaatataatagtgaagtggtcgacaagaagattgaggagttcctgagctcctttgaagagaaaatcgaaaacctgacagaagaggcattcaatacacaggtcaccgcccttatcaagctgaaagagtgcgaagatacccatcttggagaggaggttgacaggaattggaacgaggttgtgacgcagcagtacttatttgataggctcgcacatgagatagaggctctgaagagctttagcaagagtgatctcgtcaattggttcaaagcccatagagggccaggctctaaaatgctttctgtgcatgtggtgggctacggaaagtatgagttggaggaggatggtacaccatccagcgaggatagcaattcctcctgcgaagtgatgcagttgacttatttgcccactagccccctactggccgattgcataatcccaatcacggacatacgggcctttacaaccacccttaatctgttgccctatcacaagattgtaaagtag

SEQ ID NO: 196620 - DNA, 3660 bp, Artificial Sequence
  Description of Artificial Sequence: Synthetic coding sequence
atgctgcggcgggtgaccgtggccgccgtgtgcgccacccggcggaagttgtgcgaggccggcagagaactggctgccctctggggtattgaaaccagaggtcggtgcgaagactccgcagccgcacggccgttccccatcctggcgatgcccggcaggaataaagccaaaagcacctgcagttgtcctgatctgcagcccaacggtcaggacttaggcgagaattcccgggtcgcacggctcggggccgatgaatctgaggaagagggaagacgcggatccctgagcaacgcgggggaccccgagattgtcaagagcccctcagacccgaagcagtatcgttatattaagctgcaaaatgggttacaagccctcttgatcagcgatctgtccaacatggagggcaagactggaaataccactgacgatgaagaagaggaagaagtggaagaggaggaagaggatgatgacgaggatagcggagccgagattgaagatgatgacgaagagggatttgacgatgaagatgagtttgatgatgagcacgatgacgatctggatacggaagacaacgagcttgaggaactggaagagagggctgaggccagaaagaaaacaacggaaaaacagcagctgcagagtctttttctgctgtggtccaaactgaccgatagactttggtttaaaagcacttatagtaagatgtcttccacactgcttgtagagacacgaaacctgtatggggtggtcggcgccgagtccagaagcgcgcctgtgcagcacctggccgggtggcaggctgaggaacagcaaggtgaaaccgatactgtcctcagcgctgccgcattgtgcgtgggagttggcagcttcgctgacccagacgacctgcctggcttggcccatttcttagaacatatggtatttatgggctctctgaaataccccgatgagaacgggttcgatgccttcttgaaaaagcacggcggcagcgacaacgcctctactgactgcgaacggaccgtcttccagttcgacgtgcagcgaaagtactttaaagaggccctggaccggtgggcccagttctttattcaccccttgatgatacgggacgcaatcgacagggaagtcgaggccgtggatagtgagtatcaattggctaggccctccgacgccaatcgcaaggagatgttatttggaagcctggcgcggccaggccacccgatggggaagttcttttggggcaacgcagagacattaaagcacgagccaaggaaaaacaatattgacactcacgcgcgattaagagagttctggatgagatactacagttcacactatatgactcttgtcgtgcaaagcaaagagacgttagatactcttgaaaagtgggtgacagaaatattttcacagatacctaacaacggactaccaagaccaaattttggtcatcttacagatccattcgacacccctgcttttaataaactttaccgggtagtcccaattcgcaagattcatgctctcaccatcacctgggccctgcccccccagcagcaacattacagggtgaaacctctccattatatctcgtggctcgtgggtcacgaaggaaaagggagtatcctgtctttcctccgtaaaaagtgctgggctctggccctattcggggggaacggcgaaactgggtttgaacagaacagtacgtactctgttttttcaatatctatcaccctgacagatgaggggtatgagcatttctacgaggttgcatatacggtgttccaatacctgaagatgctgcaaaaactaggtcccgagaaaagaatctttgaggaaatccggaagatcgaagataacgagttccattaccaggaacagaccgacccggtggagtatgtggagaatatgtgtgagaacatgcaactgtaccccctgcaagacattctcacgggagaccagctcctgtttgagtataaacctgaggttataggcgaagcactgaaccagcttgtccctcagaaggccaatctcgttttgctctcaggtgcaaatgaaggaaagtgtgaccttaaggaaaaatggttcgggacgcagtactccatcgaagatatcgaaaatagctgggcggagttgtggaacagtaatttcgagcttaatcctgacctgcacctccctgctgagaacaaatacattgccaccgacttcacactcaaagcattcgattgcccagagacagagtaccccgtcaaaattgtcaataccccccagggttgtctatggtataagaaggacaataaatttaaaattcccaaggcctacatcaggttccatctgatctctcctttaattcaaaaatctgccgccaacgttgttctttttgacatctttgtgaacatcttgacccacaatctggcagagcccgcttacgaagccgacgtcgcgcagctcgagtacaagctggtggccggggagcatggactcatcattcgcgtgaaagggtttaaccataaactgcctctgttgtttcagctgatcattgactacctggcagaatttaactccacccccgctgtgttcaccatgatcaccgaacaactcaagaagacttattttaacattcttatcaagccggagaccctcgcgaaagacgttaggctgctgattcttgagtatgctagatggtccatgattgataagtaccaagcactgatggatgggcttagtttggaaagcctgttatcgttcgtcaaggagttcaagtcgcagttattcgttgaaggcctcgtgcagggaaacgtgactagtacagaaagcatggatttcctgaagtacgtggtcgataaactcaactttaagccattggaacaagagatgcctgtgcagtttcaagtggtggaactaccttctggacaccacctgtgtaaggtcaaagcactcaacaaaggggacgccaacagtgaggtcactgtgtactatcagagcggaacccgaagcctgcgcgagtacacactcatggaactcctcgtgatgcatatggaggagccctgctttgattttctgcggacaaagcagaccctcggctaccatgtatacccaacctgccgtaatacttccggtatcttaggcttttctgtcaccgttgggacacaggccacaaagtacaatagcgaagttgtggataagaagatcgaggagtttctctcttcattcgaagagaagatcgagaaccttaccgaggaggcctttaatactcaggtgacagccctgataaagcttaaggagtgtgaagacacacacctgggagaggaagtagatcggaactggaacgaggtggtgacccagcaatacctatttgacaggctagctcatgagatcgaagcactaaaatctttcagcaaatctgatctggtgaattggtttaaggcacatagggggcctgggtctaagatgctttcagtgcacgtcgtcgggtacggcaaatatgaacttgaagaggacgggactccctccagcgaagatagtaacagcagctgcgaggtcatgcaactgacctacctcccaacgtctcccctgctggctgactgtatcatccccatcaccgacatcagagcctttaccactaccttgaacctgctgccttaccataagatcgtaaagtag

SEQ ID NO: 196621 - DNA, 1662 bp, Artificial Sequence
  Description of Artificial Sequence: Synthetic coding sequence
atgctgcagaagctgggccccgagaagcggatcttcgaggagatccgcaagattgaggataacgaattccactaccaggagcagacagacccagttgagtacgtagaaaatatgtgcgagaacatgcagctatatccactccaggacattcttacaggggatcagctgctcttcgaatacaaacctgaagtgattggcgaggccctgaaccagctggtgccccagaaggccaacctagtccttttatccggcgccaatgagggcaagtgcgacctgaaagaaaagtggtttggtacccagtactccattgaggacatcgagaattcctgggctgaactttggaatagcaactttgagctgaacccagacttgcacctacccgcagaaaataagtatattgcctatatacgctttcatttgattagccctctcattcagaagagtgcagccaacgttgtcctctttgatattttcgtgaacatactcacccacaacctggctgagcctgcctatgaagccgacgttgcacaactggaatacaagttggtcgccggtgaacatggcttgatcatccgagtcaagggatttaatcacaagcttcctctcctgtttcagcttatcatcgattatctggctgagttcaacagtacccccgcagtgtttacaatgatcaccgaacagctgaaaaaaacctatttcaacattctgatcaaacccgaaacactggctaaagacgtccgactgttaatcctcgaatatgcacggtggtccatgattgacaagtaccaggctttgatggatggactgagcctggagtctttattatcctttgtaaaagaattcaaaagccagctctttgttgaaggtctggtccaagggaacgttacctctacagagtcaatggatttcttaaagtatgttgtggataaactaaatttcaagcctctggagcaggaaatgcctgttcaatttcaggtggtagagctcccgagtggccaccacctttgcaaggtaaaagccctgaataagggcgatgccaatagcgaagttaccgtctattaccagagtggaactagatccctccgggaatacactctgatggagctgctggtcatgcatatggaagaaccgtgcttcgactttctgcgaacaaagcagacactgggaagtgaggtcgtggacaaaaaaattgaggaattcctgtcaagtttcgaagagaaaattgagaatctgaccgaggaggcgttcaatacgcaagtaacagcgctcataaaacttaaggagtgtgaggatactcacctaggcgaagaagtggacagaaactggaatgaggtggtaacacaacagtacctgttcgaccgcctggctcatgaaatcgaagcactgaaatctttttctaagtccgaccttgttaattggtttaaagcccaccgcggcccagggagcaagatgctttccgttcacgttgttggatatggcaagtacgagctggaagaggacggtacaccctctagtgaagacagcaactcttcttgcgaagtgatgcaattgacttacctcccaacttctccactgctggcagactgcataatccccattaccgacatcagggccttcacgactacgctgaatctgcttccataccataaaatagtcaagtag

SEQ ID NO: 196622 - DNA, 1617 bp, Artificial Sequence
  Description of Artificial Sequence: Synthetic coding sequence
tgaaagatcgaggacaacgagttccactaccaggagcagaccgaccccgtggaatatgtggagaacatgtgtgagaacatgcagctgtatccactgcaagatattctcactggggatcaattattattcgagtataagccagaagtgatcggggaagctttaaaccagttagtgcctcagaaagccaatcttgtgttgctgagtggggctaatgagggtaaatgcgacctgaaagaaaaatggttcgggacacaatacagcatcgaggacatcgaaaactcctgggcagaactctggaacagtaacttcgagctgaacccagatcttcacctgccagcagagaacaaatatatcgcttacataagattccatcttatcagccccttaattcagaagagtgcagccaacgttgtcctttttgatattttcgttaatattcttacgcacaatttagcagagccggcatatgaagccgacgtcgctcagctcgaatacaagttggtggcaggggagcacggcctgatcatacgtgtcaaaggcttcaaccacaagctgccactactgtttcagttgatcatcgattacttggccgagtttaatagtactccagctgtttttactatgataacagaacaactgaagaagacctatttcaacattctgattaagccagagactcttgcaaaggacgtgcggttactgatcctcgagtacgcacggtggtctatgatcgacaaataccaagcactgatggatggactatctctggagtcactcctctcttttgtgaaggaatttaagtctcagctattcgtggagggattagtccagggaaacgttacatcaaccgagtccatggattttcttaaatatgtagttgacaaactgaattttaagccactggaacaagagatgcccgtgcagttccaggtcgtcgaactaccaagtgggcaccatctttgtaaggtcaaggccttaaataagggcgatgccaatagtgaggtgactgtctattaccagagtggcactcggtctctccgtgagtacaccttaatggaactattggtcatgcatatggaagaaccttgtttcgattttttaaggaccaaacagacattgggatctgaggtggtagacaagaagattgaggagtttctcagtagcttcgaggagaaaatcgaaaacctaacagaagaggcatttaacactcaggtcaccgcccttatcaagctgaaagagtgtgaggacactcatttaggcgaggaagtcgaccggaactggaacgaggttgtaacacagcagtatcttttcgaccgtctcgcacacgaaattgaggccctgaaaagctttagtaaaagcgacttggtgaattggtttaaagcccataggggaccaggaagcaagatgctctcagtacacgtcgttgggtacggcaagtatgagctagaggaagacggtacgccctcctcagaggacagtaattcatcgtgcgaagtcatgcagctgacttatttgccgacctcccctctactggccgattgcatcattcccatcactgatattagggcgtttacaaccaccttgaacctcctgccttatcacaagatcgtcaaatag

SEQ ID NO: 196623 - DNA, 3264 bp, Artificial Sequence
  Description of Artificial Sequence: Synthetic coding sequence
atggagggcaagaccggcaacaccaccgacgacgaggaggaggaggaagtggaagaagaggaagaagacgacgacgaagacagcggtgctgagatcgaagacgacgatgaggagggattcgatgatgaagatgagtttgatgacgagcacgacgacgatctggacactgaagacaatgagctggaagagctggaggaacgcgcagaggcacgcaagaagaccaccgagaagcagcagctgcaaagccttttcctgctttggagcaaactgacagatcggctgtggtttaagtccacatacagcaaaatgagctcaaccctgttagttgagacccggaacctgtacggggtggtgggcgcggagagtcgatccgcacctgtacagcacttggccggatggcaggcagaggaacaacagggggagacagatacggtgctcagtgccgccgccctttgcgttggtgtgggctcgtttgccgaccctgatgaccttccaggtctcgcccacttcctggaacacatggtgttcatggggtcattgaagtacccggatgaaaacggatttgacgcattccttaaaaagcacggggggagtgacaacgcaagcaccgactgtgaacggactgttttccagtttgacgttcagagaaagtattttaaggaggctttggacaggtgggcacagttcttcatccacccgctgatgatcagagatgccattgacagagaagtcgaagcggtcgattcggaataccagcttgcaaggcctagtgatgcaaacaggaaggagatgctgttcggttccctcgccaggcctgggcaccccatgggaaaattcttctggggcaatgcagaaacattgaagcatgagccgcgcaagaacaatatcgatacccatgcccggctgagggaattttggatgcggtactattcatctcactacatgacactggttgtccagtctaaggagacactggatacgctggaaaaatgggttaccgaaatctttagccagatccctaataatgggctgcctcggccaaatttcgggcaccttaccgacccctttgataccccagctttcaacaaactttatagagtggttcccatacgcaaaattcatgccctaaccattacatgggcgttacctcctcaacaacagcactacagagtgaaaccgctacattatatcagttggttagtgggtcacgaagggaaaggctctatcctgtcttttctccgaaagaagtgttgggccctggcccttttcggcggcaacggcgagacaggcttcgagcagaactctacctatagcgtgtttagtatttcaatcaccctgactgacgaaggatacgagcacttctatgaggttgcctacactgtctttcaatatctaaagatgcttcaaaagctggggccagagaaacggatattcgaggagattagaaagatcgaggataacgaatttcattatcaggagcaaacagatccagtcgagtatgtggaaaacatgtgcgagaacatgcagctctacccgctccaagacatattgacgggggaccagctcttattcgaatataaaccggaagtaataggggaggcactgaatcagttagttccgcagaaagccaatctggtcctgctcagtggggcaaacgagggcaaatgcgacctgaaagaaaagtggttcggtacacaatacagtattgaggacattgaaaactcatgggccgagctctggaactcaaacttcgaactgaatcctgaccttcatctgccagcagaaaacaaatacatcgccaccgattttactctgaaggcttttgactgtccagaaaccgagtatcctgtgaagatcgtcaacactccacaagggtgcttatggtataagaaggataacaaattcaaaattcctaaagcctacatccggttccacctgatttcacccttgattcagaagtcagcggccaacgtggttctgtttgacatttttgtgaacatcctgacacacaacctggccgaaccagcgtacgaggccgacgtcgcccagctggaatataagctcgttgcaggagaacacggtctgatcatcagggtcaaaggtttcaatcacaaactgcctctgctgtttcagctgatcatcgattatttggccgagttcaattctactccggccgttttcaccatgattacagagcaactgaaaaagacttatttcaacatcttaattaaacccgagactttagcgaaggacgtgcgacttctgatactagagtatgctcgctggtccatgatcgacaagtaccaggcgttgatggacggactgtctttggaaagcttgttatcctttgtgaaggaattcaagtcgcagctgtttgttgagggcctagtccaaggcaacgtgacttcaacagaaagcatggacttcctgaaatacgtggtggacaaactgaattttaaaccactagagcaggaaatgccagtgcagttccaagtggtagagctgcctagtggccatcacctttgtaaggtgaaggcacttaataagggtgatgctaattctgaggtaacggtgtattatcagagtgggacccggagcctgcgggagtatacacttatggagctattggtgatgcatatggaggagccttgctttgatttccttcgaactaaacagacactcggctaccatgtctatcctacttgcagaaacacgtccggcatcctcggtttttcagtgaccgtcggtacgcaggcaacaaaatataacagtgaggtcgtagacaagaaaattgaagaatttcttagctcatttgaagaaaaaattgaaaatctcacagaggaggcctttaacacccaggtgactgctctaatcaaactgaaggagtgtgaggatacgcacttgggggaggaggtggatcgtaattggaatgaggtggtgacccaacagtatctgttcgaccgcctcgctcacgagattgaagcactcaagtcctttagcaagagtgatctggtaaattggttcaaggcccacaggggccccggcagcaaaatgcttagcgtgcacgttgtgggttacggtaaatatgagctcgaggaggacggcaccccatcatctgaagacagtaattccagctgtgaagtcatgcagttaacatacctcccaacttcccccctcctcgcggattgtatcataccaatcaccgatattagagctttcactaccaccctcaatcttctgccttaccacaaaattgtgaagtag

SEQ ID NO: 196624 - DNA, 2244 bp, Artificial Sequence
  Description of Artificial Sequence: Synthetic coding sequence
atggagggcaagaccggcaacaccaccgacgacgaggaggaggaggaagtagaagaagaggaggaggatgacgatgaagatagcggtgcggaaattgaagatgacgacgaagagggattcgacgatgaggacgagttcgatgacgagcacgacgacgacctcgatactgaagataacgagcttgaggagctcgaagagcgcgccgaagcccgcaaaaagaccaccgaaaagcagtccgccgccgccctttgtgtcggggtcggctctttcgctgatcccgatgatctcccaggactggcccattttctggaacatatggtgtttatgggatccctaaaatatcccgacgaaaacgggtttgacgcgtttctgaaaaaacatggcgggtcagacaacgcctctacagattgcgagagaactgttttccagtttgatgtacagcggaagtactttaaagaagcattggaccggtgggcccagttttttatccatccactaatgatcagagatgctattgaccgtgaagtggaagcagtggactccgaataccagctcgcacgcccaagcgacgcaaatagaaaggagatgctctttgggtccctagctcgacccgggcacccgatgggcaagttcttttgggggaacgccgagacactgaagcatgagccccgaaaaaataatatagatacacatgcgcggctgcgagagttctggatgagatattactccagccactatatgacactggtagttcagtcaaaagaaaccctggacactttggagaagtgggttaccgaaatcttttctcagattccaaacaatggactccctcgtcccaattttggtcatctgaccgaccccttcgatactcccgcattcaacaagctatatagggtggtccctattcgtaagattcacgctctgacgataacctgggctctaccccctcagcagcagcactaccgagtgaagccactccattatatttcctggctcgtggggcatgaggggaaggggtcaatcttgagctttttaaggaagaagtgctgggctctcgctttgttcggcgggaacggagaaaccggctttgaacagaatagcacctattctgttttttccatttccataaccctcacagatgaaggatatgaacatttctacgaggtggcttacacggtctttcagtatttgaagatgctacagaagctcggcccagagaagagaattttcgaagagattcgcaaaattgaggacaatgaattccattaccaggagcagaccgaccccgtggaatacgtagaaaacatgtgcgaaaacatgcaactataccctctgcaggacatcttaactggcgaccagctccttttcgagtataagcccgaagttattggtgaggccctcaaccagctggtgcctcaaaaggccaatctggttttgctcagtggagccaatgaggggaagtgtgatctcaaggagaagtggttcggaacacaatactccatcgaggatatcgaaaacagctgggcagagctctggaactcaaacttcgaactgaacccagatctgcacctgcccgctgagaataagtatattgcaacagacttcaccctgaaggccttcgattgcccagagaccgaatatcccgttaagattgttaataccccacagggctgtctgtggtacaagaaagataacaagtttaaaatacccaaagcctatattagattccaccttatctccccgttaattcagaaatccgcagccaatgtggttttatttgacatcttcgtgaacatactcacacataatttagccgaacctgcctacgaagccgacgtcgcccagttggaatataagttagtcgcgggagaacacggccttattatacgagtgaaaggcttcaaccataagctgccactactcttccagttaatcatcgattacttggctgaattcaactcaacgccagctgtcttcactatgatcacggaacagctgaaaaagacctatttcaacatcctaataaagccggagaccttggccaaggacgtccgtttgttgatcttggagtacgcccgatggtccatgattgataagtaccaggcacttatggatggtctcagccttgaaagtctgctctcattcgtgaaggagttcaagtcacagctgttcgtagagggtctggttcagggcaatgtaacctcaaccgtgctgtgtcagtgggcccaagattctgaaacctag

SEQ ID NO: 196625 - DNA, 3447 bp, Artificial Sequence
  Description of Artificial Sequence: Synthetic coding sequence
atgctgcggcgggtgaccgtggccgccgtgtgcgccacccggcggaagctgtgcgaggccggccgcgaactggccgccctgtggggtatcgaaactcgcggacggtgtgaagatagcgctgcggctcgaccttttccaatcctggcaatgccagggagaaacaaggcgaagagcacctgctcgtgtccagatctgcagcccaatgggcaggatctgggagagaacagccgagtcgctcgcctcggggccgacgagagtgaggaagaaggacgccgggggtccctctcaaacgctggtgacccagaaatcgtcaaatcaccatccgatcctaaacagtataggtacattaaacttcaaaacgggttgcaagcgctgttaatttctgatttatccaacatggagggtaagaccggcaacacgacggatgacgaggaggaagaggaggtggaggaggaagaggaagatgacgacgaagatagtggagcggagatcgaagatgacgatgaggagggatttgatgatgaggacgaatttgatgatgagcacgacgacgacctggacaccgaagataacgagcttgaggagctggaagaacgcgccgaagctcgcaaaaagaccacggagaagcagagtgctgcggctctgtgtgttggcgtcgggtccttcgctgaccctgacgatctccccggcctcgcacactttctggagcacatggtgttcatgggaagcctgaagtatccagacgaaaacgggttcgacgcatttctgaagaagcatggcggatcagataacgccagcacagactgtgaacggacggtgttccagttcgatgttcagcgcaaatacttcaaggaggcccttgaccggtgggctcaatttttcatccacccgctcatgatccgcgacgccatagatcgagaggtcgaagcggtggacagcgagtatcagctggcgcggccaagtgatgcgaaccgcaaggaaatgctatttggtagcctagccagacccgggcatccgatgggtaagtttttctggggcaatgcagaaacactcaagcacgaacctcggaaaaataacattgacacgcatgcaaggctgcgcgagttctggatgaggtattatagcagccactatatgactctggtggtccagagcaaagagactctcgacacactggagaagtgggtaaccgaaatcttctctcagattcccaacaacggcctgcccaggccaaactttggccacctcacggaccccttcgacactccagctttcaataagctgtacagggtggtgccaatcaggaaaatccacgcccttacgattacatgggccctccccccacagcaacagcactatagggttaagcccttgcactacataagttggctggttggtcacgaaggcaagggaagcattcttagcttcctgagaaaaaaatgttgggccctcgcactgtttggaggtaatggtgagaccggattcgaacagaactctacatactcagtgtttagcattagtatcactctgactgatgaggggtatgagcacttttacgaggtcgcttatacggtctttcagtatctgaagatgctgcagaaactggggcctgagaaaaggattttcgaggaaattcgcaaaatcgaggacaacgagttccattaccaggaacagaccgatccggtggagtatgtagaaaatatgtgcgagaacatgcaactgtatcctctgcaggatatcttaaccggggaccagctgctcttcgaatataagcccgaggtaatcggcgaggccttgaaccagttggtgccgcaaaaggccaacctcgtcttgctgtcgggggccaacgagggcaagtgtgatctaaaggaaaagtggttcggcacacagtatagcatagaggacatcgagaacagctgggccgaactgtggaactctaacttcgagttgaaccccgacctgcatctcccagcagagaacaaatatatagctactgacttcaccctcaaggcctttgactgccctgaaacagagtatcccgtcaagattgtgaatactccccaggggtgcctctggtacaaaaaggataacaagtttaagataccgaaggcctatatcagattccacctcatcagtccgttgattcagaagagtgcggcgaacgtggtcttgtttgacatttttgtgaatattctcactcacaaccttgccgaacctgcctacgaggcagatgtcgcccagttagagtataagctggtggccggagagcatggcctcatcatcagggtgaagggatttaaccataagttgcccctgctcttccagctgatcattgactatctcgccgaatttaactcaaccccggcagtctttaccatgatcacagagcagctaaaaaagacctacttcaatattctcatcaagccagagacattggccaaggatgtcaggctattgatcctggagtacgctaggtggagcatgattgataagtatcaggctctgatggatggtctgtcccttgagagcctgttgagctttgtgaaagaatttaaatctcagctctttgtggagggacttgtccaaggaaatgtgacctcaactgaaagtatggatttcctcaagtacgtggttgataaacttaacttcaagcccctggaacaggagatgcccgttcaattccaggtcgtggaactcccttccggtcaccatctgtgtaaggtaaaggccctgaataaaggcgatgcaaacagcgaagtaacagtgtactaccagtctggcacccgctcactaagggagtacaccctgatggagttgttggtgatgcacatggaggagccttgctttgattttctgcgcaccaaacagacactcggctaccatgtctatcctacctgtcgaaacacctccgggatccttgggttcagcgtcacagtagggactcaggcgaccaaatataattctgaggtcgtcgataaaaagatcgaggagtttctgtccagctttgaagaaaaaatcgaaaatcttaccgaagaggcatttaacacccaggtgacagccttgattaagctgaaggaatgcgaagacacacatttgggggaggaggttgatagaaactggaatgaggttgtgactcagcagtacctttttgatagactggcccacgaaatcgaagccctcaagagctttagtaaaagcgacctcgttaattggttcaaagcccacagagggcccggaagcaagatgctctctgtgcatgttgtgggctacggcaagtatgaattggaggaggacggcacacctagcagtgaagactcaaactcctcctgtgaggtgatgcaattgacttacttgccaacgtccccgctcttggcgattgtgagctcgcctctattaatctccggcctaagccagcagcatagtaccttcagcccaaccattaagtag

SEQ ID NO: 196626 - DNA, 1587 bp, Artificial Sequence
  Description of Artificial Sequence: Synthetic coding sequence
atgggcgccgccgccagccggcggcgggccctgcggagcgaggccatgtcatcagtggccgcgaaggtgagagccgctagggcctttggcgagtatctatctcaatcccatccagagaaccgtaatggtgctgatcacttgctcgccgatgcatattcgggtcacgacggaagccccgaaatgcagcccgcacctcaaaacaagcgccgcctgagcctggtgtctaacggatgctatgagggatccttgtcagaagagccttccatcagaaaaccagctggtgagggacctcagcctcgcgtgtatactatttctggagaaccagcactgttacccagcccggaagctgaagctatcgaactggcggtagtgaaaggcaggaggcaaaggcatccacaccaccactcccagcctttgagggcaagcccaggcggctcacgcgaggacgtcagccgcccttgccagtcatgggctggctccaggcaggggagtaaagaatgtcctggctgtgcacagctcgctcctggccctaccccaagagcttttgggcttgaccaaccccccttgcctgagacaagcgggcgcagaaagaagcttgagcgcatgtatagcgtggatagggtgtctgacgatattccaatacggacctggttccccaaggaaaatctgttctcatttcagactgctaccaccacaatgcaggccgtgtttcgggggtatgcggagagaaaacgccgcaaaagagagaacgattccgcaagcgtgatacaacgcaactttcgcaagcatctcaggatggtgggttcccggcgcgtcaaggctcaaacgtttgcggaacggcgcgagaggtcatttagccgatcctggtctgatcctacccccatgaaggctgatacatctcatgactcaagggattctagtgacctccagagcagccattgtacgttggatgaggcgttcgaggacctagactgggacacggaaaagggtctggaggccgttgcatgtgacaccgagggatttgtcccacccaaggtaatgctgatttcttctaaggtgcccaaagccgagtatatccctacaatcatccgacgcgatgacccatcaataattcccattctgtatgaccacgagcacgcgaccttcgaggacattctggaggaaattgaacggaaacttaatgtgtatcacaagggagctaagatttggaagatgctgatcttctgtcaagggggacctggacacctctatctcctcaaaaacaaggtggcaacttttgcaaaagtcgaaaaagaagaggatatgatacacttctggaaacggctcagccgcctgatgagcaaggtgaacccagaacccaatgtgatccatattatgggctgttatattctgggcaatccaaacggcgagaagctattccagaaccttagaacattgatgaccccctatagggtgacctttgaatctcccctcgagctgagtgcgcagggaaagcagatgattgaaacttactttgattttcgactctaccggttgtggaaatctagacaacatagcaaacttttggacttcgatgatgtactgtag

SEQ ID NO: 196627 - DNA, 984 bp, Artificial Sequence
  Description of Artificial Sequence: Synthetic coding sequence
atgtacagcgtggaccgggtgagcgacgacatccccatccggacctggttccccaaggagaacctgttttccttccagactgcaaccaccacaatgcaggcggtgtttcgagggtatgccgagcggaagaggcgaaagagggaaaacgactcagcgagcgttatacaaaggaactttcggaaacaccttcgaatggttgggtctcggagagtcaaggcacaaacctttgcagaaagacgagaacgtagcttttcaaggtcgtggagcgacccaacaccaatgaaagcagacactagtcacgactccagagatagctcagacctgcagagttcacactgcaccctggacgaagcgttcgaggatctggattgggataccgaaaagggccttgaggccgtggcctgtgatacagaggggttcgtacctcccaaagtgatgctgatctcttcgaaggtccccaaggccgagtatattcccacaatcattaggagagacgacccttctattatacctatcctgtacgatcatgaacatgccacattcgaggatattctggaggagattgagagaaagttgaatgtgtaccacaaaggcgctaaaatctggaagatgctgattttttgtcagggaggcccaggccatctttacctcctgaagaataaagtggcaacctttgctaaggttgagaaagaggaagatatgattcacttctggaagcgcttgtctcggctgatgtcaaaagtgaatcccgagcccaatgtgattcatattatggggtgttatatcctcggcaaccccaacggggagaagctctttcagaatctcagaaccctgatgaccccttacagggttacttttgagagtcctctggaactgagtgcccagggtaaacagatgatcgagacatatttcgattttagactgtataggctatggaaatctagacagcactctaagttgctggattttgacgatgtgctctag

SEQ ID NO: 196628 - DNA, 438 bp, Artificial Sequence
  Description of Artificial Sequence: Synthetic coding sequence
atggtgggcagccggcgggtgaaggcccagaccttcgccgagcggcgggaacggtctttttcccgcagctggagtgaccctacgcccatgaaggccgatactagtcatgactccagggattcatctgacctgcagtcatcccattgcactctggatgaagctttcgaggacttggattgggacacagaaaagggcctggaggccgtggcatgcgatactgagggattcgttccacccaaggtgatgttgatttcgagtaaggtcccaaaagctgaatatattcctacaatcatcaggcgggatgatccttcaatcattcccatcctgtacgtatcccctgctcctggactgcctccaaccgacgcgctcctcagaccccatccagggcctgcccctgctcctcaggtgcccagagtcctctggagatgttggttgtag

SEQ ID NO: 196629 - DNA, 1587 bp, Artificial Sequence
  Description of Artificial Sequence: Synthetic coding sequence
atgggcgccgccgccagccggcggcgggccctgcggagcgaggccatgtcaagcgttgccgctaaagttcgcgctgcacgagcattcggtgaatatttgtcccagagccatcctgagaacagaaatggagcagatcatctgttagctgatgcatactccggacacgacggcagccccgaaatgcagccggcgccacaaaacaagcggagactaagcctggtctccaatggatgttatgaggggtctctaagtgaggagccctctatccgtaagccggcgggcgaggggccacagccccgagtgtataccatttctggtgagcccgccctcttgccgtctccggaagccgaggcgatcgagttagccgtcgttaagggcaggcggcagaggcaccctcaccaccattcgcagccactgcgagcgagccctggcggctcccgcgaggatgtctctaggccatgccagtcatgggccgggagccgccagggttctaaagagtgccccggttgcgcccaactcgcgcctggaccaacacccagagcgtttggattagaccaacctccattaccagagacttcaggccgacgcaagaaactcgaacggatgtacagcgtggatcgggtatctgacgacatccctattcgcacatggtttcccaaagagaatctgttctcgttccagaccgccaccacaactatgcaagccgtgtttaggggatatgcagaaagaaaaagacgcaagcgcgaaaacgacagcgccagcgtgatccagcggaatttcagaaaacaccttagaatggtgggtagccggagagttaaagcccagacctttgcggagagacgggaaagatcattttcaagatcttggtctgaccccacccctatgaaggcggatacctctcacgactcaagggacagttctgacttacagagtagccattgtacacttgacgaagctttcgaggacctcgattgggacactgagaaagggctagaggccgtggcttgcgatacagagggtttcgtgccaccaaaggtgatgctgatttcatccaaagtgccaaaagccgaatatatccccaccatcattcggcgggatgatccttctatcataccaatcttgtacgatcacgaacacgcaactttcgaagatattctggaggagattgagcgtaagctgaacgtgtaccataagggtgcaaagatatggaagatgctgattttctgccaggggggccctggccacctgtacctgttaaagaataaggtcgccaccttcgcaaaggtggaaaaagaagaggatatgattcatttttggaagcggctctcacgcctaatgagtaaggttaaccccgaacccaacgtcatccacatcatgggatgctacattcttggaaatccgaacggagaaaagctcttccagaatctaagaacactaatgacgccgtatagggtcacattcgagtctccactggagctgtccgcacaggggaagcagatgatcgaaacctatttcgattttcgactataccggctctggaagagcaggcagcattcaaaactgctcgacttcgatgacgtcttgtag

SEQ ID NO: 196630 - DNA, 1503 bp, Artificial Sequence
  Description of Artificial Sequence: Synthetic coding sequence
atgggcgccgccgccagccggcggcgggccctgcggagcgaggccatgtctagcgtggcagcaaaggtgcgcgccgcaagggcgttcggagaatacttgtcccagtcccaccctgagaatagaaatggcgccgaccatttgctggctgacgcttactctggtcacgatgggtcgcctgaaatgcagcccgcacctcagaataagagaagactgagcttggtcagcaatggatgctatgaggggagtttgagtgaagagccaagcataagaaagcccgcaggcgagggaccacaaccccgcgtgtatactatttctggagaaccggcattattaccatctcccgaagctgaggcaatcgagttagcagtcgtgaagggtcgccggcagcggcaccctcatcaccatagccagccgttacgtgcctctcccggcggctcccgcgaggacgtatctcggccttgccagtcctgggcaggttccagacaggggtcgaaggaatgtcccggctgcgcccagctcgccccaggaccaacgcccagggccttcgggctcgatcagccacctctcccagaaacctcagggcggcggaagaagttggagcgcatgtacagtgtagaccgggtttcagacgatattcctattcgcacctggttccccaaagaaaatctttttagctttcagaccgccactaccaccatgcaagctatcagcgtcttccgcggatacgcagaacgcaagagaagaaaacgcgagaacgactccgcatccgtgatccaaaggaactttagaaaacacctgcgtatggttgggtcccggagagtgaaagctcaatctagcgatctgcaatcttcccactgtactttggacgaggcttttgaagatctcgattgggataccgaaaaaggcctggaggccgttgcttgcgatactgaaggcttcgtccctcctaaggtcatgttaatttcgagcaaagtgcccaaggccgagtacatccccacaataattcggagagacgacccttccatcattccgattctttacgaccatgagcatgccacctttgaggacatcctcgaagaaattgagaggaagcttaacgtgtatcacaagggtgctaaaatctggaaaatgcttatattctgccagggaggccccgggcatctgtatttgttgaagaataaggttgccacctttgccaaagtcgagaaggaagaagatatgatccacttttggaaacggttgtctcgcttaatgtctaaagtgaatccagagccaaatgtcatccatataatgggttgctacatccttggcaatccgaacggtgagaaactcttccagaacctgagaaccctaatgacaccctatagggtgactttcgagagcccgctcgagctctccgcccagggcaagcagatgatcgaaacctacttcgatttcagactctaccgcttatggaaatccaggcagcactctaaactgctggattttgatgacgtgctgtag

SEQ ID NO: 196631 - DNA, 1518 bp, Artificial Sequence
  Description of Artificial Sequence: Synthetic coding sequence
atgggcgccgccgccagccggcggcgggccctgcggagcgaggccatgtcttcagtggcagccaaagtccgggctgcgcgagcgtttggagagtaccttagccaatcacacccagaaaaccgcaacggcgccgaccaccttttggccgatgcatactccgggcacgacggaagcccggagatgcagccggccccccagaacaagagacggctctccctggtgtctaacggctgctacgagggtagcctgtctgaagaaccttccatccggaagcctgcgggcgaaggtccccagccccgcgtttacaccatttccggtgagcctgcccttcttccttcccctgaagccgaggccatcgaactcgctgttgttaaaggacggagacaaaggcatccccaccatcattctcaaccactgcgggccagccccggaggctctagggaagacgtatcccgaccttgccaaagttgggccggctcccgtcaagggagtaaggagtgccccggatgcgcgcagctggcaccgggcccgaccccaagagcattcgggctcgatcagcctcctcttccagagacatccggacggcgcaagaaactggaaagaatgtattccgtcgacagggtcagcgacgatattcctatacgcacgtggtttcctaaagagaaccttttctcgttccaaaccgccactactacgatgcaagcaaattttaggaaacatttgaggatggtagggtccaggcgggtgaaagcccagacgttcgctgaaaggcgggagagatctttttcccgctcctggtccgatccaactcctatgaaggcagatacgtctcatgacagcagagattcttccgacctgcaaagctcacactgcactttggacgaggcctttgaagatctggactgggacacagagaaaggactcgaggctgtggcgtgtgacactgaggggtttgtccctccaaaggtgatgctgatcagctccaaagtacccaaggcagaatatatccccacaatcatcaggcgagatgatccgtctattatacctatcctgtatgaccacgaacatgctacgttcgaggacatcctggaggagattgaacggaaactcaacgtgtaccataagggagcaaaaatctggaagatgctcatcttctgccaaggcgggcctggccatctatacctgctaaaaaataaggttgccacctttgctaaggtcgaaaaggaagaagatatgatacatttctggaagcggctatcacgcctgatgagtaaggtgaaccctgaacccaatgtgatccacatcatgggatgctacattctgggcaatcctaatggcgaaaagctcttccagaacctacgcaccctcatgacaccgtaccgggtgacttttgagagtcccctagaactctcggctcaagggaaacagatgatcgagacttactttgattttcggctttaccgtctttggaagagtaggcagcactcaaaacttttggactttgacgacgtgctgtag

SEQ ID NO: 196632 - DNA, 1593 bp, Artificial Sequence
  Description of Artificial Sequence: Synthetic coding sequence
atgggcgccgccgccagccggcggcgggccctgcggagcgaggccatgtctagtgtggccgctaaggtgagggctgcaagggcctttggggagtatttatcccagagtcatccagaaaacaggaatggagcggaccatctgcttgccgacgcctacagtggccatgacggttcgcccgagatgcagcctgcgcctcagaacaaacgcaggctgagtctggtgagtaatggctgttatgagggatcgctcagcgaggagccttccatccggaagcctgccggggagggcccacagccccgggtgtacactatttctggggaacctgcgctgctgccctctccagaggccgaggcgatcgaactcgcggtcgtgaagggccgaagacagcgccaccctcaccaccacagccaaccattacgagcatcaccaggagggtccagagaagacgtttcgcgcccttgccagagttgggcaggctctcgtcaaggtagcaaggaatgtcctggttgtgcacagctggcacctgggccaacaccccgagcattcggcctggatcagcctcccttaccggaaactagtgggcgtcgcaaaaagttggagcggatgtactccgttgatagggtgagcgatgacattcctatccggacctggttccctaaagaaaatttattcagcttccaaactgcgacaacaactatgcaggcaatatccgtgttcagaggatatgccgagcgtaaacgcagaaagagggaaaacgactccgcttccgtaatacagcgcaacttccgaaaacacttgagaatggtcggaagccgaagggtcaaggcacagaccttcgccgaacgtagagaacgctcatttagtagatcatggtcggaccccacaccaatgaaagcggatacgagccacgatagccgggactcttccgacctgcaaagttctcactgcaccctcgacgaggcatttgaggatctcgactgggatacggagaaaggcctggaggcggtcgcctgtgacacagagggcttcgtcccacccaaagtcatgctcatttcttccaaagtccccaaagcagaatacatcccaactattattcgccgcgatgatccctccataatcccgattctttacgaccatgaacatgccacattcgaggacattctagaagagatcgaacgcaaacttaacgtttatcacaagggcgcaaagatctggaaaatgctgatattctgccagggaggccccggacacttgtacttactgaagaacaaggtggcaaccttcgctaaggtcgaaaaagaggaagacatgatccacttctggaagcgattgtcgcgtctaatgagcaaggtcaatcccgaaccgaacgtgatccacataatgggatgttatattcttggcaatcctaacggcgaaaaattgtttcagaacttacgtacattaatgacgccctatcgggttaccttcgaaagcccccttgaattatccgctcagggcaagcagatgattgagacctactttgacttcaggttgtacaggttgtggaaaagccgtcagcacagcaaactgctggactttgatgacgtcctgtag

SEQ ID NO: 196633 - DNA, 585 bp, Artificial Sequence
  Description of Artificial Sequence: Synthetic coding sequence
atgggcctgggccccctgagcagcagcctgagcccccagctgatctcttctaaagtgcccaaagcagagtacatcccgaccatcatacggcgcgacgacccatctattatccctattctgtacgaccacgagcatgctacattcgaagacatcctcgaggagattgagaggaagctgaatgtgtatcacaagggcgcgaaaatttggaaaatgctgatattctgtcagggaggacccggacatctgtatcttttaaaaaacaaagtcgcaacttttgccaaggtcgaaaaggaagaggatatgatacatttctggaaacggctgtccagacttatgagtaaggttaatcctgaacccaacgttatccatataatgggttgctacatactgggcaatccaaacggggagaaactgtttcagaacttaaggactctaatgaccccatatagggtcacgttcgagtcgcccctcgagctgtctgcacagggaaaacaaatgattgaaacatatttcgactttcgactgtacagattgtggaagagcagacagcattcaaaattactcgactttgacgacgtcctttag

SEQ ID NO: 196634 - DNA, 1524 bp, Artificial Sequence
  Description of Artificial Sequence: Synthetic coding sequence
atgggcgccgccgccagccggcggcgggccctgcggagcgaggccatgtcatccgtggctgctaaagtgagggccgccagagccttcggtgagtatctcagccagagccaccccgagaatcgcaacggggcggaccatctcctggccgacgcctattccggtcatgacggtagcccagagatgcagcccgcccctcaaaacaagcgtcgtctctccttggtcagtaacggctgttacgagggctccttgagcgaggagccctcgatccgcaagcccgccggagaagggccacagcccagagtgtataccatctctggggagccagcgttactaccatcccccgaagctgaagccattgaactcgccgtggtgaagggaagaaggcagagacacccccaccatcatagccagcccctcagagcctcccctggtggatcaagggaggatgtgtcaagaccctgtcagtcttgggctgggagtagacaggggagcaaggaatgcccaggttgtgcccagctggcccccggccccacaccccgcgcgtttggcctcgatcagcccccacttcccgagactagtggcagaagaaagaagctggagcgtatgtatagcgtggacagagtgtcagacgacattcccatccgcacctggtttccaaaggaaaatctgtttagcttccagactgcaaccactactatgcaagcagtgggcaacttcagaaagcatctgcgaatggttggctccaggagagttaaagcgcagacttttgccgaaaggagggagcgcagtttttcacgatcttggtctgatcccacgcccatgaaagccgatacaagccacgactcccgcgatagcagcgacctgcagtcttctcactgtacgctagatgaagcgttcgaggacctggactgggacaccgagaaagggttggaggcggtcgcatgcgatacagaagggtttgtgccacccaaggtgatgcttatcagcagtaaagtacctaaggccgagtacatccctaccatcattcgacgggacgacccctctatcatacccatcctctacgaccacgaacatgcaaccttcgaagacattctcgaagagatcgaaaggaagctgaacgtttatcacaaaggggccaagatctggaagatgctcatcttttgccagggagggcccggacacctgtacctgctgaagaacaaagtggctactttcgccaaagtagaaaaagaggaagacatgattcacttctggaaaagattgagccggctgatgtccaaggtgaatccagaaccaaatgtgatccacatcatgggctgctacatcctggggaatcccaacggagaaaagttgtttcagaatttgcggacactcatgaccccttatagggtcacttttgagtccccattggaattgtctgcacagggcaagcagatgatagaaacctattttgatttccggctgtataggttgtggaagtctaggcagcacagtaaactactggatttcgacgacgtactgtag

SEQ ID NO: 196635 - DNA, 1524 bp, Artificial Sequence
  Description of Artificial Sequence: Synthetic coding sequence
atgggcgccgccgccagccggcggcgggccctgcggagcgaggccatgtccagcgtggcggcgaaggtgcgcgcagcccgagcatttggggagtatcttagtcagtctcatcccgagaatcggaacggcgccgaccacctgctggcagacgcatattccggacacgacgggagtccagagatgcagcctgctccacagaacaaacggaggctatctctcgtgtctaatgggtgctatgaaggtagtctgagtgaagagccatccattcgcaagcccgccggagagggccctcagccacgcgtctacacaataagtggtgagcccgccctgttgccatctcctgaagctgaggctatcgagctagccgtggtcaagggccgtcggcagaggcacccgcaccaccatagccagcccttacgcgccagcccgggtgggtctcgagaagatgtatctcggccctgtcagagctgggcaggcagcagacagggctcaaaggaatgtccaggttgcgcacagctggcccccggaccaacgcctagagcatttgggcttgatcagccaccgttgcctgagacctccgggcgccgaaagaagctagagcgcatgtactcagtggatagagtgtcagacgatatacctatcagaacttggttcccaaaagaaaacctgtttagttttcagacagccaccaccaccatgcaggccatctctaacttccgcaaacatttgcggatggtcggctcgcggcgggtgaaagcacagaccttcgccgagcgacgggaaagatcattttcaaggagttggtctgatccaacccctatgaaagccgacacatcccacgatagcagagatagctcggacctgcaaagtagtcactgtaccctcgacgaagcttttgaggacttggactgggatacagaaaaaggactcgaggcagtagcctgtgatacagaggggtttgtgcctcctaaggtgatgcttatttcatcaaaggttcccaaggccgaatatattcccacaattattcgccgggacgacccatcaattatccccattctctacgatcatgaacacgctaccttcgaagacatattggaggagatagagaggaagctcaatgtctaccacaagggggcaaaaatctggaaaatgctcatcttttgtcagggcgggcctggacacctgtatctcctgaagaacaaggtcgccacttttgcaaaggtggagaaggaagaggatatgattcacttttggaagaggttaagcaggctgatgagtaaagtcaacccggaaccgaacgtgattcatataatggggtgttacattctgggtaacccgaatggagaaaagctgttccagaatttgagaaccctaatgacaccctacagagtcacctttgaatctcctctcgaactttccgctcagggcaagcagatgattgaaacgtactttgactttcgtctgtaccgattatggaagtcccgccagcactctaagctcctggactttgatgacgttctgtag

SEQ ID NO: 196636 - DNA, 984 bp, Artificial Sequence
  Description of Artificial Sequence: Synthetic coding sequence
atgcagctgggccggcggctggaccccgagcggcaggccctgcacctgtgcagtggagtcgagggcgaaccctggaaagccgttgctggccgagccctggggggaatatgcctttgggtgggcggcggagcccgatcgcagggcgagcattggctgcctaccccgaagggaaacttcagaaagcacctgcgcatggtgggcagccggcgcgtcaaagcacagactttcgcagagagacgagagagaagtttctccaggtcatggagcgatcctactccaatgaaagccgatacatcccacgattcaagggacagctcggatctgcagtctagccactgtaccctggacgaagcttttgaggacctggactgggacactgaaaaaggactggaggcagtggcttgtgatacagagggcttcgtgccaccaaaggtcatgttgataagttctaaggtgccaaaagcagagtacatccctaccatcataagaagggacgaccctagcattatccctatcttatatgaccacgagcacgcaacgttcgaggatatccttgaagaaatcgagcgcaagttaaatgtgtatcacaaaggggcaaagatctggaaaatgctaatcttctgccagggtggtcctggccacctgtatctgctgaagaataaagttgcaacattcgctaaggttgagaaggaggaggacatgattcatttttggaaacgattatcgcgcctcatgagcaaggtcaatccagaacccaatgtgatccatatcatgggatgttatatcttgggaaacccaaatggcgagaaactctttcagaacctacgcaccctcatgacgccttatcgcgtgacttttgaatctccgcttgagcttagcgcgcagggcaagcaaatgatcgaaacatatttcgacttcagactctataggttgtggaagtctagacagcacagcaagctgctggatttcgacgacgtcctctag

SEQ ID NO: 196637 - DNA, 648 bp, Artificial Sequence
  Description of Artificial Sequence: Synthetic coding sequence
atgcccggcgaggccaccgagaccgtgcccgccaccgagcaggagctccctcagccgcaggcagagaccgggtccggcacagagagcgactctgacgagtccgtccctgagttagaagaacaggacagtacacaggccacgacccagcaggcgcagctcgccgctgccgctgaaattgacgaagagcccgtgtcaaaagctaaacaatctcggtccgaaaagaaggctaggaaggcaatgagcaagctcgggttacgacaggtgactggagtgactcgggtgaccattcgtaaatcgaaaaacattttattcgtgatcaccaagcctgacgtttataagtcaccagcatccgatacctatattgtgttcggagaggcgaagatcgaggacctctcccagcaggcccaactcgccgccgccgagaaattcaaagtgcagggcgaggctgtctcaaatatccaggagaacactcagacccccacggtgcaggaggaatcggaggaggaagaggtggacgagacgggcgtcgaagttaaggacatcgagctcgtaatgagccaggctaacgtgagccgagccaaagcggttagagccctgaagaacaatagtaacgatatcgtcaatgccatcatggagcttacaatgtag

SEQ ID NO: 196638 - DNA, 648 bp, Artificial Sequence
  Description of Artificial Sequence: Synthetic coding sequence
atgcccggcgaggccaccgagaccgtgcccgccaccgagcaggagcttccacaacctcaggctgagaccggaagcggcacagagtcagactcagacgaaagcgtgcccgaacttgaggagcaggatagtacccaggctactactcagcaggctcagctggcagctgctgcggaaatcgatgaggaacccgtgtctaaagcaaagcagagtcgcagtgagaaaaaagcacggaaagccatgagcaaactgggcctcaggcaagtaaccggcgtcacaagagtaacaattcgcaagtcgaaaaacattcttttcgtgattaccaagcccgatgtatataagtctcccgcttctgatacgtatatcgtgttcggagaagccaaaattgaggacctgtctcagcaggctcagctagctgccgcagagaagttcaaggtgcagggtgaagccgtgtccaacatccaggagaatacccagacacctactgtccaggaagagtcagaggaagaggaagtcgacgaaacgggggtggaggtgaaagacattgagttggtaatgagtcaagccaacgtcagcagggcaaaagccgtaagggctttgaagaataacagcaacgacatcgtaaatgcgatcatggagctgaccatgtag

SEQ ID NO: 196639 - DNA, 6237 bp, Artificial Sequence
  Description of Artificial Sequence: Synthetic coding sequence
atgcccggcgaggccaccgagaccgtgcccgccaccgagcaggagctccctcagccacaggcggaaactgccgtgttacccatgtcttcagccctgtccgtaaccgccgccctcggtcagccaggccccactctccctcctccgtgctcccccgccccgcaacagtgccccctcagcgctgcaaatcaggccagcccttttccatcaccttccacaatagcgtcgaccccactggaagtccctttcccccagtcttcttctggcacggcactaccgctcggcactgccccagaggctccaacttttctgcccaacctcataggacctccgatctcacccgctgcactggccctggcttcccctatgatcgcaccaaccctgaaaggcaccccgtcctcttctgctccactggcactggtagcgctcgcaccccatagcgtgcaaaaatcctccgcctttcctcccaacctcctgacaagtcccccctcagtggcagtggccgaaagtggttcagtgataaccctatcagcacccatcgcgccgagcgaacctaagaccaaccttaacaaagtccccagcgaggtcgtaccaaacccaaagggcactccatcgccaccatgcatcgtctcaaccgtgccctaccattgcgtgacaccaatggccagtatccaaagtggcgtagccagcttgccgcagaccacaccaaccactacacttgcaattgctagcccacaggtgaaagatacgaccattagtagcgtactgatctcaccccaaaaccccggctccctaagtcttaaagggcccgtatcaccacccgcagcgctgagcctcagtactcagtcgctgcctgtggtgacatcttcacagaaaaccgccgggccaaatacaccccctgatttcccgatatccctcggcagtcacctcgctcctctacatcagagttccttcggctcagtgcagctgctgggacagaccgggccatccgcattgtccgatccgacagtgaaaaccatttccgtcgaccacagtagcacgggagcatcctatccctcacaaaggtctgtgattccaccgttaccatcaagaaatgaggtagtccccgccaccgttgccgccttccccgtggtggctcccagtgtggataagggcccgtcgactatttcatccatcacgtgctcaccttctggttcactgaacgtggcgacgagcttctcactgtcccctacgaccagtttgatccttaaatcctccccaaatgccacgtatcattatcccctggtggcccaaatgccggtgtcttccgttgggaccacacccctagtggttacgaatccttgcaccattgcagcagcccccaccaccacgtttgaagtagctacatgtgtaagccccccaatgagctcaggcccgatcagcaatattgagccgacttctcccgccgcactggtgatggccccagtggcgcccaaggagccaagcacgcaggtagcaacgactttgaggattcctgtcagtccacccttgcctgaccccgaggacctcaaaaatctgccatcttcagtgctagtcaaattccctacccaaaaggatctgcagaccgtacccgcgagcctcgagggtgccccgttcagccccgcgcaggccggcctcaccactaaaaaggaccctacagtactgccactggtccaagccgcccccaagaattctcctagtttccaatctaccagttccagtccagagattccgcttagtcccgaagcaactctggccaagaagagtctgggagagcctctgcctattggcaaacccgcatctagcatgactagtccactgggcgtgaatagtagtgcctcagtgattaaaacagatagctacgccggcccagactccgctgggcctctactgaagagctctttgatcacgccaaccgtggctgcctttcccctcgaaagtgccgatcccgccggggttgcccccactaccgcgaaaggcactagtacctacacaacaacggcttctccattcttagaaggaacagtatcattagctcccaagaaccatccggttaaagagggcactctgactacgttacctctggtcccaacagcctcagaaaactgcccagtggccccctcgcctcagaacacctgcgcaccactggccacactggtgctggccccggaaatccccaaaagtgtgccttcaccgtctctgccccccgctggcactccacccggaacaaagaaggtagacggaatctctcacacttcagcacttgcccccgtggcctcgagccccaaagaatgtccgacagaggattccggtgctagtgccacggcgagttctaaaggaacgctgacttatctcgccgactctccttcaccattaggtgtgagcgtgagtccccagaccaagcgtcctcctaccaagaagggcagcgcaggcccagacacccctatcgggaacctctctagcccggtgtcacctgtagaagcttcattcctgcctgaaaattctctctctttccagggcagtaaggactcacccgccacaacgcactctccaacaccaccaagccccaagggcgctccaaccccctctgctgtgacgcctctgagccctaagggggttaccctgcctccaaaggaaacaccgactccatctgtggttaacctcccattccctaaagaggggcccgctacccctgcccctaagcaggcacccgcgctctcaatgacatcctcgagtcccaagaaagcccgcgcaacccccgctcccaaaggaatccctgccagtccttcccctaagggtgctcctaccccccccgcagcaacaccgccttcgcccaaggggggtcccgcgaccccatctccaaaatgggcccccactcccccagcagccacgcctccctccccaaagggcgggcccgccacaccttcaccaaaaggcgcaccaacaccccctgcggcaacaccaccatccccgaaagggggccccgcaaccccatcccctaagggcgctcctacacctcccgccgtgacccccccatcaccgaagggctcacccgctgcaactccgtttccaaaaggggctagcacgccaccggcagctactccgccctctccaaagggatcgcccgctgctacaccactgcctaagggagccccaacaactcccgctgccacactgccatctcccaaggggggtcccgcaacaccaagtctcaagggtgctcctacaccacctgcagcgaccccgccctcccccaaaggcggccccgccacaccgtcacccaagggtgccccaatgcccccagcggcaaccccacccagtcccaaaggcggcctggccacccccccccataagggcgctcccaccactccggcggcaaccccgccatccccgaagggagggctggctactcccccgcccaagggggcccccaccacaccagccgcaacaccaccatcgcctaaaggcggactggctactccacctcccaaaggcgcccccaccacccctgccgccaccccgcccagtcccaagggaggcctcgccacgccatcaccaaagggagccccgacaacacccgccgctacaccacccagccccaaaggcgggctggccacaccttctcctaaaggagccccaacaacccctgcagcgaccccccctagtccaaagggggggctcgctacaccgagtcccaaaggtgcccccaccacacccgcagccactcccccatctcctaaaggcgggcccgcaacccctccacctaaaggcgcccctacaccccccgcagccactccaccctcgctgaaaggagggcttgcaacccctccccacaagggcgcgcctaaccctgcagtggttacacctccctcacccaaagggggtccagcaacctctccccccaaaggggctccgaccccccccgccgccactccacctagcccaaagggatcgcccggaaccccccccccaaagggagccccaactccccccgccgtcacacctcccagtccaaaggggactcccacgctgcctgccaccacgccatcatccaagggagggccaacaacccctagtagcaaggagggaccaacaccccccgctgccacaccttcacataaaggcggccctgccatgactcctccgtcccctaaaagaggccctgccatcccgtccccaaaaggtgaccccacttcccctgctgtaataccattgtcacccaaaaaggcccccgccacccccgtcacacgcgagggggctgcgactcctagtaaaggtgatttgactccgcctgcggttacccctgtgtctttgaagaaagccccggccacttcagcccctaagggtggcccggcaactcctagctctaagggagaccctaccctgcccgccgtcaccccaccttcacctaaagaaccgcccgcacctaaacaggtagcgacctcatcgagtccaaaaaaggccccggctactcccgcccctatgggcgcccctactttacccgccgtcatccctagtagccccaaggaggtccccgccaccccttcctccagaagagatccaatcgctccaactgcaactctgctgtccaagaagacaccagcaactttggcccccaaggaggccctcatccccccagctatgaccgtgccctcgcctaaaaaaactcccgcaatcccaaccccaaaggaggcccctgctacaccctcttccaaggaagcctcatctccaccagccgtgaccccttctacctataagggtgcgccctctcctaaagaactgctgatacccccggccgtaacgagcccatcccccaaggaggctcctactcctccagctgtgaccccgcctagtcccgagaaaggaccagccacaccagctccgaagggtaccccaacctcgccccccgttacaccctccagcctgaaggactccccaacctctccagcctccgtcacttgtaagatgggtgccacggtaccccaggctagcaaggggctgccggcaaagaagggccctaccgcgctgaaggaggtcctggtcgcccctgcccctgagtcgaccccaatcatcaccgcgccaacacggaagggaccgcaaacaaaaaaatcatctgctacttccccccctatttgtcccgatccctctgccaagaatggtagtaagggacctctttccacagtggcccccgctcccttgctgccagtacagaaggacagtagtaaaaccgctaaagggaaagatgcctctcattcaccaaaagggccactcgctccccccgagagtaaagcctcaacaccgttgactgccgcagcgttcgaaaaggtgctccctaaacctgaatctgcctctgtttccgcagctccctccccacctgtctccctccccctggccccctcaccggtcccgacattgcctccaaaacagcagtttctgccttcttcaccaggcctggttctggaatcaccctcgaagccactcgctccggctgatgaggatgagcttctgccgctgattcctcctgagccgatcagtggaggtgttccattccaaagcgttctggtgaatatgcctacacccaagtccgcaggaatacccgtgccaacccccagcgcaaaacaaccagtgaccaagaacaataaaggttccggtactgagtcggatagtgatgagtctgtgcctgagctggaggaacaggactcgactcaggccacaacacaacaggcacaactggctgctgccgcagaaatcgatgaagaaccagtaagcaaggcaaagcaatcgaggtcagagaaaaaggcccgcaaagcgatgtcaaagcttgggctgcgccaggttacaggagtcacccgggtcaccattcgcaagtcgaaaaacatcctgttcgtaatcactaaacccgatgtctacaaatctcccgccagcgatacatacattgttttcggtgaagccaagattgaagacctaagccagcaggcccaactggcagcagctgagaaatttaaggtccagggggaagcagtaagtaacattcaagaaaatacccagactccaactgtccaagaggaaagtgaggaggaggaggtggacgaaaccggcgttgaggtgaaagacatcgaactggtcatgtcccaagctaatgtaagccgagccaaagcagtgcgggcacttaaaaacaacagcaacgacatcgtgaatgccattatggagttaacaatgtag

SEQ ID NO: 196640 - DNA, 648 bp, Artificial Sequence
  Description of Artificial Sequence: Synthetic coding sequence
atgcccggcgaggccaccgagaccgtgcccgccaccgagcaggagcttccacagccccaagcagagaccggatcagggaccgagtccgatagcgatgaatctgtgcccgaactagaagagcaggatagtacacaggctactactcagcaagcccagctggccgcagctgcagagatagacgaagaaccagtctccaaggctaaacagtctagatcagaaaaaaaggccagaaaagcaatgagtaagctgggcctccggcaagtgacgggtgtgactagagtgaccattaggaagtccaagaacattctcttcgtaatcacgaagccagacgtatataagtcgccagcctccgatacatatatagtcttcggcgaggcgaagatcgaggatctttcgcaacaagctcagctggccgccgccgagaaatttaaggtgcagggcgaggccgtctcaaatattcaggagaacacccagacccctactgtgcaggaagagtctgaagaggaagaagttgacgaaaccggcgtggaagtcaaggatatcgagctagtaatgagtcaagcgaacgtctcccgagcaaaagctgtgagagcgctgaaaaacaacagtaacgacatcgtcaacgccataatggaactgacgatgtag

SEQ ID NO: 196641 - DNA, 21 bp, Artificial Sequence
  Description of Artificial Sequence: Synthetic coding sequence
atgcccggcgaggccacctag

SEQ ID NO: 196642 - DNA, 597 bp, Artificial Sequence
  Description of Artificial Sequence: Synthetic coding sequence
atgcccggcgaggccaccgagaccgtgcccgccaccgagcaggagttgccacagccacaagccgaaaccgggagcgggacagaatccgattctgatgagtccgtgcccgagctagaagaacaggacagtactcaagcaacaacccagcaggcccagctagccgccgctgctgaaatcgatgaggagcccgtgagcaaagctaagcagagccgcagcgaaaagaaggcgcgcaaggccatgagcaaacttggcctgagacaggtgaccggcgtgactagggtaactatcaggaaatcaaagaatatactattcgttatcaccaagccagatgtgtataaatctccagcctctgacacctatatcgtctttggtgaggctaagatcgaagatcttagtcagcaggcccagctcgctgcagcagagaagtttaaggtccagggggaagccgtctctaatattcaggagaacacccagacccctacagtgcaggaagaaagcgaagaggaggaggtcgacgagaccggcgtggaggtaaaggatatagagttggtgatgtctcaggccaatgtttctcgcgcaaaggctgtgcgcgcctag

SEQ ID NO: 196643 - DNA, 381 bp, Artificial Sequence
  Description of Artificial Sequence: Synthetic coding sequence
atgcccggcgaggccaccgagaccgtgcccgccaccgagcaggagctacctcagccccaggccgagacaggctccgggaccgaaagcgactctgatgagtccgtgccagaactggaggagcaagattccacccaggccaccacccaacaagcacagctggccgccgccgctgagattgacgaagagcccgtaagtaaggcaaagcagtcccgctccgagaagaaagcaaggaaggccatgagtaagctcggcttgcgccaggttaccggagtcacccgggtgacaatacgcaaatccaagaatatcctgttcgtgatcaccaaaccagatgtatataagagtccggcgagcgacacctacatcgtctttggggaagcatag

SEQ ID NO: 196644 - DNA, 648 bp, Artificial Sequence
  Description of Artificial Sequence: Synthetic coding sequence
atgcccggcgaggccaccgagaccgtgcccgccaccgagcaggagttaccacagccacaggcagagacaggaagtggcacggaaagcgattcagacgagtcagtgcctgagctcgaggagcaggacagtactcaagccacaacgcagcaggctcaattggccgctgccgcggagattgacgaggagcctgtgagtaaggcaaagcaaagccgatctgagaaaaaggctaggaaggctatgagcaagttagggcttcgccaggtaacaggagtgacaagagtgacaatcaggaagtcaaagaacatcctctttgtgatcaccaaacctgacgtctacaaatcccctgcaagcgatacatacattgtgttcggtgaggcgaagatagaggatttgtctcagcaggctcagctggcagcagcggagaaatttaaggtccagggcgaggcagtatcaaatattcaggaaaatacgcagactccaacagtgcaggaggagagcgaggaggaggaagtcgatgagactggcgttgaggtcaaggacatcgagctggtcatgtcccaggcaaatgtgtccagggcaaaggccgtccgagcactgaagaacaatagcaacgatatcgtcaatgccatcatggagctgacaatgtag

SEQ ID NO: 196645 - DNA, 2778 bp, Artificial Sequence
  Description of Artificial Sequence: Synthetic coding sequence
atgcccggcgaggccaccgagaccgtgcccgccaccgagcaggagttgccccagccccaagccgagacagccgtgctcccgatgagctctgcattaagcgtgactgcagcgttaggacaacccggccccaccctacctccaccctgttctccagccccccagcagtgccccctctccgccgcaaaccaggcctcgcccttcccaagtcccagcacaattgctagcaccccgctggaagtcccctttccacagagcagttccgggactgccctccctcttggtaccgcacccgaagcccctacatttctgccaaacctgattggaccaccaatctccccagctgcactcgccttagcttctcccatgatcgcccccaccctcaaaggaactcccagcagtagtgcgccactggctttggtagcattagctccacactccgtgcaaaaatcctcggcgttcccgcctaatcttttgacttctcctccttccgtagctgtcgcggagtctggatcagtcatcacactgagcgccccaatagcgccctctgagcccaagactaacctcaacaaggtcccaagcgaagtggttcccaatcccaaggggacaccctctcctccctgcattgtctcaacagtcccctaccactgcgttacccctatggcttcgatccagagcggagtggcctccctaccacagactacccccaccacgacactggccatagcaagcccccaagtcaaagacaccacaatctcatctgtcctcattagtccccagaatccggggtcactgtcactgaaggggcctgtatccccacctgcagccctctctctttccacacagtcacttcctgtcgtcacctcctcccagaagactgccggaccaaatacaccacccgatttccctatttctctgggatcccatctagctccactccaccagagctctttcggttccgtccaactgctcgggcaaacagggccttccgccctgtctgatccgacagtaaaaaccatttccgtcgaccatagcagcaccggtgcctcttacccttcccagagaagcgtgatccctcccctgccctctagaaacgaagtggtccccgccacagtcgctgcgtttcctgttgttgcccccagcgtggacaaaggaccaagtacaatcagtagtatcacatgttctccctccggctctctgaacgttgctacctccttctcactgtcccctaccacctctctcatcttgaaatcttctccaaatgccacctatcactatcctctggtggcccagatgcccgtttcaagcgtggggaccactcccctagttgtgacaaacccctgtacaatcgccgcggccccaacaaccaccttcgaagtcgctacatgtgtctcaccccccatgtcctctggcccaattagcaatatcgagcccacaagccccgccgctcttgtcatggctccagtggcccctaaggagcccagcacccaagtggctaccacccttagaatccctgtaagcccacctcttccagaccctgaggacttgaagaatctgccctcctctgtgctcgtgaagttccctacccagaaagaccttcagacggtgcctgccagtctcgagggagcgcccttctctccagcacaggccgggcttacaaccaagaaagaccccacagtcctgccattagtccaggctgcccccaagaattcccccagcttccagagcaccagctcttcacctgaaataccgctttctccagaagccaccctcgcaaagaagtcactgggtgagccactgccaattgtggccgcgtttccactggagagcgctgatcctgcgggcgtagctcccactactgcgaaggctgctgctttcgaaaaggtattgccaaagccagagtctgctagtgtctcggcagcccccagcccaccagtctcattgcctctggcacctagccctgtcccaacccttcctcccaaacagcagttcctgccgtcgagccccggtctagtactggaatcccccagcaagcctctggcacccgccgatgaggacgaattgctccctctgatccccccagaacccatcagcggcggtgtaccattccagagcgtgctggtcaatatgcctactcctaaatctgctgggatccccgtgccaactcctagcgccaagcagcctgtgactaagaataacaaggggtcagggacagagagcgactcagacgagtccgtgccagaactggaagaacaggattcaacccaagccacaacccagcaggcacagctcgctgcagccgccgagatagacgaggagccggtgtctaaagcgaagcagtctcggtccgagaagaaggctcgaaaggctatgtccaagctagggttgagacaggtgacaggcgtcacccgggttacaataaggaaatccaagaacattctgtttgtcataactaaacccgacgtgtacaagagtcctgcctctgacacatatatcgtctttggcgaggctaaaattgaagacctgtcccaacaagcccaactggccgccgcggagaagtttaaggtgcagggggaagccgtttcgaatatccaggagaacacccagaccccaactgtgcaggaggaaagcgaagaggaagaagtggatgagaccggggtcgaagtgaaagatatcgagcttgtaatgtctcaggccaatgtaagtagagcgaaggcagtaagggcgctgaagaataatagcaatgacatcgtgaatgctattatggaattgactatgtag

SEQ ID NO: 196646 - DNA, 306 bp, Artificial Sequence
  Description of Artificial Sequence: Synthetic coding sequence
atgcccctggaggacgaggtggtgcccccccaggtgctgagcgagccaaatgaggaggccggcgctgctctaagccccctgccagaagtacccccctggaccggggaggtaagtcccgcccagcgcgatggtggagccttaggccgggggccgtgggactccagcgaccggagtgcccttttaaagtcgaaactgagagccctcttaacagcacctagatccctccgcagaagttcgtgctttggcgggagaatggatcgcattggggctcagagcgggctgggttgcaattccttccgctactag

SEQ ID NO: 196647 - DNA, 456 bp, Artificial Sequence
  Description of Artificial Sequence: Synthetic coding sequence
atgagcagcttcagcaccaccaccgtgagcttcctgctgctgctggcttttcagctgctcggccagactcgcgctaaccctatgtacaatgcagtatctaacgcagatcttatggattttaagaacttgctggaccatcttgaagagaaaatgcctcttgaagatgaggtggtccccccccaagtactgtctgaacctaatgaggaggcaggagctgctttatcccccctgcccgaggtgcctccctggaccggagaggtctcacctgcacaacgcgacggaggtgctttaggacgcggtccgtgggattcatccgatcggagcgccctcctgaagtcaaagctgcgggccctcctgaccgcaccacgctcactgagacgcagttcatgctttggtggcaggatggaccggattggagctcaatccggcctggggtgtaacagcttcaggtactag

SEQ ID NO: 196648 - DNA, 768 bp, Artificial Sequence
  Description of Artificial Sequence: Synthetic coding sequence
atggagcagtacgccaacaacctggaggagctggtggaggagcggacccaggcctacctggaagagaagcgtaaggccgaagccctgctgtaccagattctgcctcattccgtcgctgagcagctcaagcggggagagaccgtgcaggctgaagcctttgacagtgtgactatctattttagtgatatcgttggattcaccgccctctctgccgagagcacacctatgcaggtggtcacacttttgaacgacctgtacacttgtttcgacgcagtcatcgataatttcgacgtctacaaagtggaaactataggtgatgcctatatggtggtgtctggacttcccgttagaaatggccgcctacacgcctgcgaggtcgctaggatggcgctggctttattagacgccgtcagatctttccgtatccgtcacaggccccaggaacagctccggttgaggataggtattcacaccggaccagtctgtgccggtgtggtcgggctgaaaatgccgcggtactgtctatttggcgacactgtcaacaccgcttctcgtatggagagcaatggggaagctctgaagatccacttaagctcagaaactaaagctgttctggaggaattcggaggattcgaactggagcttcgcggtgatgtggaaatgaaagtggagggagaggcttctgccctcccaactttttggggcccacgaggttcctatccatcccaggcagccaacgctacaccaattccgaaggctctgatctag

SEQ ID NO: 196649 - DNA, 3186 bp, Artificial Sequence
  Description of Artificial Sequence: Synthetic coding sequence
atgcccggcccccggcggcccgccggcagccggctgcggctgctgctgttactgctacttccccctctattgctccttctgaggggaagtcacgccggtaacctaaccgtggcagtcgtgctgcctttggcaaacacatcatacccatggtcatgggcccgcgtgggacctgccgttgaactggcactcgcgcaagtaaaggcccggccggacctgttaccgggctggacagttagaaccgtactaggctctagcgagaacgccctgggtgtatgttccgacaccgcagcgcccctcgcagctgtcgatttgaaatgggagcataatccggccgtttttctgggacctgggtgcgtgtatgcggctgctccagtcggccggttcactgcacattggcgggtgcctctgctgacggctggagccccagcccttgggtttggtgttaaagatgagtatgctctaacgaccagggccggccctagttacgcaaagttaggtgattttgtggccgcacttcaccggcggttaggttgggagcggcaggcgttgatgctctacgcctatcgccccggtgacgaggaacactgttttttccttgtagaggggctgttcatgagggtccgagatcgactgaatattaccgttgaccatttggagtttgccgaggacgatctcagtcattatacacgcctcctgagaacaatgccgcgcaaaggccgcgtcatctatatttgcagttcgcctgacgccttcagaactcttatgttgctggcactagaggcaggactgtgcggcgaagactacgtcttcttccacctggatatatttggccaatctctccagggaggccagggccccgctccacgacgaccgtgggaacggggcgacggccaggatgtatctgccagacaggcgttccaagctgcaaagattattacgtataaagacccagataaccctgaatatctcgagtttttgaaacagttgaagcatctggcttacgagcagtttaattttaccatggaagacggactggtgaacactattccggcatcttttcatgacgggttactgctttacattcaagccgtgaccgagacactcgcccacgggggtacggtcacagatggagagaatattacccagagaatgtggaataggtcttttcaaggagttacagggtacctgaaaatcgatagctctggtgacagggagaccgacttcagcctgtgggacatggaccccgagaacggtgcttttagagtggtgctgaattacaatgggacgtctcaggagctggtggcagtgtctggacgaaaacttaactggcctttggggtatcccccaccagatatacctaagtgtgggtttgacaacgaagatcccgcttgtaatcaagatcacttatctacactcgaagtactggccttggtcggttctctgagtttattggggatcctgatcgtttcattcttcatttataggaagatgcagttagagaaggaacttgcctctgaattgtggcgcgtaaggtgggaggacgtggagccttcatccctcgaaagacatctgagaagcgcaggtagtcgactgacattaagcggacgtggttcaaattacggatctttgctaactacagaagggcagttccaagtgttcgccaaaactgcttattataagggcaatctggtcgctgtaaagagagtgaatcgaaagagaatcgaactcacccgaaaggtgctgttcgaacttaagcacatgcgggatgtgcaaaatgaacacctcacccgttttgtcggcgcatgcacggatccccccaatatttgtattctcacagaatattgtcccagaggcagtctgcaggatatccttgaaaacgagtcaatcacattggactggatgttcagatattccctcaccaatgacatcgtcaaagggatgctcttcctgcacaacggggctatctgctcccatgggaaccttaaaagctctaactgtgtggttgacggtcgatttgttctgaaaataaccgactatgggttagaatcttttcgggatctcgatcccgagcagggccacactgtgtacgcgaaaaagttatggacagcccctgaattactgcgaatggcatctccgccagtgcggggatcgcaagccggtgacgtgtactcattcggcattattttacaagaaattgctctgcggtctggggtttttcacgttgaaggattggatctgtctcccaaagagatcatcgaaagggtgacacgcggggagcagcctcctttccgacctagtcttgcacttcagagccatttggaagaattaggcttgctgatgcaacgctgctgggccgaggacccccaggaaaggcccccattccagcagatccgtttgacattgcgcaagttcaatagagagaacagctccaatattctcgacaatctgctgagccgaatggagcagtatgccaataatctcgaggagttggtggaagaacggacacaggcgtacttggaagaaaaacgcaaagcagaggcgttgctgtaccagatactgccccacagcgttgctgagcagctgaaacgcggtgagaccgtccaggccgaggcgtttgacagtgttactatatacttctccgacattgtggggtttaccgcactgtcagccgaaagcacacctatgcaggtggtgactctgctgaatgacctttacacctgctttgacgctgtcattgacaattttgacgtctacaaagtggagaccatcggagatgcttacatggttgtgtccgggctccccgttaggaatggccggctacacgcatgcgaggtggcgcggatggctctggccttactcgacgccgtgcgttccttcagaatcaggcaccggccgcaagagcagctcaggcttcggatcgggatccatactggtcccgtttgcgcaggggtggtggggctcaagatgcccagatactgtttattcggggacaccgtgaatacagccagcagaatggaatccaacggggaggctctgaagatccacctctctagtgaaacaaaggctgttctggaagaattcgggggattcgagctggagctgaggggggacgtcgaaatgaagggcaagggaaaggtacggacctattggcttctgggagaacgtgggagctccactcgagggtag

SEQ ID NO: 196650 - DNA, 1623 bp, Artificial Sequence
  Description of Artificial Sequence: Synthetic coding sequence
aagatgcagctggagaaggagctggccagcgagctgtggcgggtgcggtgggaagacgtggagccaagctctcttgaaaggcacttaaggtcagctggaagccgtcttacactgagtggacgtggaagcaattatggaagtctacttacgaccgagggacagttccaggtattcgctaagaccgcctactataagatgcgggacgttcagaatgaacacctgacaaggtttgtcggggcgtgtaccgatccccccaatatctgcattctcacggagtattgcccaaggggatccctgcaggacattctcgagaacgagagcatcactctcgattggatgtttaggtactcactaacgaacgatatcgtgaaagggatgctgttcctgcacaacggcgccatctgtagtcatggaaacttaaagagctctaattgtgtggtggacggcagatttgtgctcaagattacagattatggcctcgagagtttcagggatcttgacccggagcaaggccacaccgtctacgccaagaaactgtggacggctccagaactcttacggatggcttcgcccccagtgcgaggatctcaggccggcgacgtgtactcgttcggaatcatcctgcaggagatcgcccttaggtcaggcgtgttccacgtagaaggcctggacctgtcacccaaggaaataatagagagagtgacgcgaggcgagcaaccccccttccgcccctctcttgccttgcagagtcaccttgaagagttgggcctgctgatgcagcgctgttgggcggaagacccccaagagcggccaccatttcagcaaatcaggcttactctccggaaattcaaccgagagaactcctcgaacatcctggacaatctgctgtctcgcatggaacagtacgcaaacaatctggaggagctcgtagaggaacgcacacaagcttacctggaggaaaagaggaaggctgaagccctactgtaccagatccttccacactcagtggccgaacaactcaagcgcggtgagactgtccaagccgaagcctttgactctgtgactatatacttcagcgatatcgtcggtttcacagcgctttcagcagaaagtacacccatgcaggtggtgactctgctgaacgacctgtatacttgtttcgatgccgtcatcgacaacttcgatgtgtataaggtcgaaacaatcggcgatgcatacatggtggtttccggacttcctgtgcggaatggccgactgcacgcctgtgaagtggcccgaatggccctggcactccttgatgctgtgcggtccttccgaatccgccatagaccacaggagcagctgcggctccggattggcatccacactggaccggtatgcgctggggtcgtgggccttaagatgccacgctactgtctgttcggggatacagtcaatacagccagtaggatggaatccaatggagaagcacttaaaattcacttatccagcgaaacaaaggccgtactcgaagaatttggtggatttgagctagagttaagaggtgatgttgaaatgaagggcaaaggcaaggtccgcacttactggctcctgggagaacggggtagctcaacccggggttag

SEQ ID NO: 196651 - DNA, 3144 bp, Artificial Sequence
  Description of Artificial Sequence: Synthetic coding sequence
atggccctgcccagcctgctgctgctggtggccgccctggccggcggagtgcgcccccccggcgctcgaaacctgacacttgccgtggtgctacctgaacataacctctcttatgcgtgggcctggcctcgcgtcggtccggccgtggctctggctgtcgaggctctggggagggcccttccagtggacctccggttcgtgtcatcagagctcgagggggcctgctctgagtacctagcccctctctcagccgtggaccttaaactgtaccacgaccctgacctactgctgggccctggctgtgtctatcccgccgcctctgtggctcgatttgcttcccactggaggctaccattgctcaccgcgggcgcggtggccagtggcttctctgctaaaaacgatcactatagaacattagtccggacaggtccgagcgccccaaagctcggcgagttcgtggtcacccttcacggccactttaactggactgcacgcgcggcactgctctacctggacgctcgaacggacgaccgcccccactattttacgatcgagggagtgttcgaggccttgcaggggtcgaatttgtccgtgcagcatcaggtctatgcccgcgagcccggtgggccagagcaagccacccacttcattagagcaaacggacgtatcgtctacatctgtgggcccctcgagatgttgcacgaaatcttgcttcaagctcagagagagaatctgaccaatggagactacgtttttttctacctagacgtgtttggggaatcattgagggcaggccctacacgggccacggggcggccttggcaagacaatcggacccgggaacaggctcaggctcttagagaggccttccaaactgtccttgtgattacctatagggaaccccccaaccccgaataccaggaatttcaaaaccgtttactcataagggctcgagaagattttggtgtggaactcgggccttctctcatgaacctgattgccggttgcttctatgacggcatccttctgtacgccgaagtgctgaacgaaaccattcaggaaggaggaacgagggaggacggcctgaggatagtcgagaaaatgcaggggagacgataccatggcgttacaggattggtggtaatggacaagaacaacgaccgtgagaccgatttcgtgctgtgggccatgggggatctggattctggggactttcagcctgcagctcactactctggagccgagaagcagatttggtggaccggtagaccaatcccatgggtgaaaggggcccctcccagcgataacccaccctgcgcatttgatctggacgatccatcctgcgacaaaacacccctcagtacactggctatagtcgccctggggaccggcatcactttcatcatgtttggggtgtccagcttcctgatcttcagaaaactgatgctcgagaaggagctcgcttccatgctttggcggattaggtgggaagagctgcagttcggaaatagcgaacgatatcacaagggcgcaggcagccggttgaccctgtctctgcggggctcgtcatatggaagcttgatgactgcccacgggaagtaccagatcttcgcgaatactggccattttaaaggaaatgtcgtagccataaagcatgttaacaagaagagaatagagctaacccggcaggtcctctttgaacttaagcatatgcgggacgtccagttcaatcacctgacgagattcattggcgcttgcatcgaccccccaaatatctgcatcgtcacggagtactgccctagggggtccctgcaggacattctggagaacgactcaatcaatctggattggatgttcagatactccttgatcaacgatctcgtcaaaggaatggccttccttcataattccatcatatccagccatgggtccctcaagtcctctaattgcgtggttgactctaggtttgtcctcaaaataaccgactatggtctggcaagtttccgctctacggctgaaccagatgacagtcacgctctctacgccaaaaaactctggacggccccagaactgcttagtggcaaccctctccctaccaccggtatgcagaaagcagacgtatactcattcggaattattctccaggagattgctctcagatcgggccccttttatctggaaggtctagatttgtcccctaaagaaatcgtgcagaaagtgcgcaacggacagagaccttacttccggccatccatcgatcggactcagctgaacgaggagcttgtcttgcttatggaacgttgttgggctcaagatccagctgaacgtcctgattttggccagatcaaggggtttattaggaggtttaataaggagggtgggacatccattctggacaatctgcttctgcgtatggaacagtatgccaataatctcgagaaacttgtcgaagagagaacccaggcatacctggaggaaaagcgtaaagccgaagcgctgctgtatcagattttgcctcactctgtcgcagagcaattgaagcgcggggaaaccgtgcaagcggaagcctttgactcagtgactatatacttctctgatatcgtaggctttacggccctcagcgctgagtcaacacctatgcaggtcgtaacactgctgaatgacctctatacctgcttcgacgcaattatcgataatttcgatgtatataaagtagagacgattggcgacgcctacatggtggtctccggactgccaggtagaaacggtcagcgccatgcacctgaaatcgccagaatggcactggctctgctcgacgccgtctcaagtttcagaataaggcatcggccccacgaccagttacgcttacgtattggagtgcacacgggccctgtttgcgccggcgtggtcggcctgaaaatgcctaggtactgtttgtttggggacaccgtgaacactgcttcccgcatggagtccaacgggcaggcacttaagatccacgttagttccacaacgaaggacgcactcgacgagcttggatgctttcagctggaactgaggggagacgttgagatgaaaggcaagggcaaaatgaggacttactggctacttggtgagcgcaagggcccacccggcctactctag

SEQ ID NO: 196652 - DNA, 1626 bp, Artificial Sequence
  Description of Artificial Sequence: Synthetic coding sequence
atgcccagcctgctggtgctgaccttcagcccctgcgtgctgctgggttgggccctgctggccggtgggactggcggaggaggcgtgggcgggggcggcggcggcgctggcattggaggcggaagacaagaacgcgaggcactgcccccccaaaaaatagaggtcctcgttttgctgccacaggacgattcttacctattcagccttacaagggtgcgccctgccattgagtacgcactgaggtccgtagaaggtaatggaactgggcgtagactgcttccacctggtaccagattccaggtggcatatgaagattctgactgtggaaaccgcgccctattctcactggtagacagagtcgccgcggctagaggcgctaaacccgatctgattctaggccccgtctgtgaatacgccgcagcccccgtggcacgactggcaagccattgggacttgcctatgctttcagccggtgccctcgccgccgggttccagcacaaagattctgagtactctcatttgacaagggtggctccagcatatgcaaagatgggcgaaatgatgttggccctttttagacatcatcactggagcagggccgcgttagtttacagcgacgacaagctagagaggaactgttatttcacgcttgagggcgtccacgaggtgttccaggaggaagggctacacactagcatttatagctttgatgagacgaaagatctcgacttggaagacatcgtcagaaacatccaggcaagcgagagggtcgtgataatgtgcgcaagcagcgatactatccgttccatcatgctcgtcgcccatcggcacggtatgactagcggcgattatgctttcttcaacatagagctgttcaactcgtctagctatggtgacggcagttggaagcgcggcgataaacacgactttgaagccaagcaggcatatagttccctgcagacggtgaccctcttaaggaccgtgaagccagagttcgagaagttttccatggaagtaaagtcctccgtggagaaacaagggctgaatatggaggactacgttaacatgtttgtggagggttttcacgatgccatactactctacgttctggccctgcatgaagtgctcagagctggttacagcaaaaaggacggcggtaagatcatccagcagacatggaatcggacatttgaggggatcgccggacaagtgagtatcgacgctaatggcgatcgctacggcgacttcagtgtgatagccatgacagacgttgaggctgggacccaggaggtcatcggggactatttcggaaaggagggcagatttgagatgaggcccaacgtgaagtacccgtggggaccactgaaattacggatcgatgaaaatcgtattgttgaacacacaaatagcagcccttgcaagagcagcgggggtctggaggagtccgcagtaacagggatagtagtaggggcactgctcggagccgggctactgatggccttttatttttttcgcaaaaagtatagaatcactatcgaacggcgtacgcagcaggaagagtcaaatctgggaaagcaccgcgaattgcgggaagacagcatccggtcccatttctctgtcgcatag

SEQ ID NO: 196653 - DNA, 1623 bp, Artificial Sequence
  Description of Artificial Sequence: Synthetic coding sequence
atgcccagcctgctggtgctgaccttcagcccctgcgtgctgctgggctgggctttgttggcaggcgggacagggggaggtggggtgggcggtgggggcggcggagcaggaatcgggggtggccggcaggaaagagaagctctgccccctcagaagatcgaagttctcgtgctgttacctcaagatgactcttatctttttagcctcacacgggttcggccagccatagaatacgcccttaggtccgtggagggtaacggcacaggccggcggttactcccaccgggaaccagattccaggtagcttatgaggacagcgattgcggcaaccgggctctgttttctctggtcgacagggtggcggcagcccgaggggccaagcctgacctcattctgggcccagtgtgcgaatatgcagctgctccggtggccagactcgcctcccattgggacctcccaatgctcagcgctggcgcgttggcagccggttttcagcacaaagacagcgagtattctcacctcacgagggtcgcacctgcttacgctaagatgggagagatgatgctggcactgttcagacaccaccactggtcgcgagcagcactggtgtacagcgacgacaaattggaaaggaactgttacttcactctcgaaggggtgcatgaggtgttccaggaagaaggcttacatacttccatctacagttttgatgagaccaaagacctggacttggaagatattgtgaggaatatccaggcatcagaacgagtcgttataatgtgtgctagcagcgacaccattaggagcattatgctggttgcccaccgacatgggatgacctctggcgactacgcattcttcaacatcgaacttttcaacagcagttcttatggggacggatcttggaagcgcggggataaacacgattttgaagccaagcaggcatattcgagtctgcagactgttacgctgctccggacagtgaaacctgagtttgaaaaattcagcatggaggttaagagcagtgtcgaaaaacagggtctcaacatggaggactacgtcaatatgttcgtggaaggattccatgatgccatcttgctgtatgtgttggccttacatgaagtcctacgggccggctattctaagaaagatggcggaaagatcatacagcagacttggaaccggacttttgaaggcatcgccggccaagtatccatcgacgccaatggcgatagatacggcgatttttccgtgattgcgatgaccgatgtggaagccgggacccaggaggtaatcggggactacttcgggaaagagggacggttcgaaatgagaccaaatgtgaaatacccctggggcccacttaagctgcggattgatgaaaatcgcattgtggagcacaccaacagctcaccttgtaagtcctgcggtctagaagaatccgccgttaccggaattgtggtaggcgcacttctgggtgccgggttactgatggcattttatttctttcgaaagaaataccgtattaccatcgagcgccgaacccaacaagaggaatcaaacctgggaaagcatagggagttgcgcgaggattctattaggagccatttctccgtggcctag

SEQ ID NO: 196654 - DNA, 975 bp, Artificial Sequence
  Description of Artificial Sequence: Synthetic coding sequence
atggagcccagcgccctgggcccctggagcctgttccccgacctggcccctcgcgaccaggagggccaggtgctcgcacctcgccgttgtttccgtcgggagtgtggacaaaacgagaaagtcgtgattatgtgcgccagttctgacacgattaggtcaatcatgctggtggcacacagacatgggatgacctcaggcgactacgcatttttcaacatagaactttttaactcctcatcttacggcgatgggagctggaagaggggagacaaacatgacttcgaggcaaaacaggcctactcatcactgcagaccgtcactttgttaagaaccgtcaagcctgagttcgagaaattcagcatggaggttaaatccagcgtcgagaaacagggcctgaacatggaagattatgtaaacatgttcgttgagggatttcacgatgcaattctgctctacgtgcttgctctgcacgaagtcctccgggccggttatagtaagaaagatggcggaaagatcatccagcaaacgtggaaccgcacattcgaaggcatagcagggcaggtgagtattgatgccaatggagacaggtacggcgactttagtgtaatcgccatgaccgatgtcgaggctggcactcaagaggtgattggagattacttcggcaaagagggcaggttcgagatgcgccccaatgtcaagtatccctgggggcctctgaaactgcgcatcgacgaaaataggattgtggagcacacaaacagttccccttgcaaaagttgcggccttgaggagtcggccgtgacgggcattgtggtgggtgcgctgctgggagcaggattgctgatggctttttacttttttcgtaaaaagtaccggatcaccatcgagagacgtactcaacaagaggagagcaatctgggtaagcatagagagctgagggaagatagcatacgatctcacttcagtgtggcttag

SEQ ID NO: 196655 - DNA, 915 bp, Artificial Sequence
  Description of Artificial Sequence: Synthetic coding sequence
atgagcagcaccctgcccgccctgctgtgcgtgggcctgtgcctgagccagcgtatatcagcacagcaacagactttgcccaagccatttatttgggccgagcctcacttcatggtccccaaggaaaaacaagttacaatatgctgccagggcaattatggcgccgttgagtaccaactgcacttcgagggctcactcttcgcagtggacagaccgaagcccccagagcgcattaataaagtgaagttctacatccccgacatgaattccaggatggcaggacagtatagttgcatatatagggttggtgagttgtggtctgagccatcaaatctcctggacctggtggtcactgaaatgtacgacactccaaccctgtccgtgcaccccggaccggaagtcatcagcggggagaaggtcaccttttactgcaggctggatacggccacatcaatgtttcttctgctcaaggaaggacgcagctcacacgtacaacgcgggtacggaaaagtacaggccgaattcccattaggcccagtgacgaccgcccatagagggacatatagatgcttcggatcctacaacaatcatgcctggtcgtttccctccgaaccagtgaagctcttagtaaccggagatattgaaaatacaagtctggcgccagaggatccaacctttcccgcagatacctggggcacataccttcttaccaccgaaactggtcttcagaaagaccacgcattgtgggatcatacggcacagaatcttctgaggatgggcctggcattcctcgtgctggttgcgttagtgtggttcctcgtagaggactggctgtcaaggaagcgcacacgggagcgggcctctcgggcaagtacctgggagggcagacgcagactaaatacacagactttgtag

SEQ ID NO: 196656 - DNA, 864 bp, Artificial Sequence
  Description of Artificial Sequence: Synthetic coding sequence
atgagcagcaccctgcccgccctgctgtgcgtgggcctgtgcctgtcccaacgcatcagtgcccagcagcagacattacctaagccatttatttgggccgagccacattttatggtacccaaagagaagcaagttacaatctgctgtcaggggaactatggcgctgttgaataccagctgcactttgagggctcactattcgccgtcgacagaccaaagcctcccgaacgcattaataaagtgaagttctatatcccggacatgaattcacgcatggccggtcagtacagctgcatttacagggtcggagagctttggagcgaaccttccaatctgttggacctggtggtcaccgagatgtatgacacgccgaccctgtccgtgcatcccggccccgaagtcatttctggggaaaaagtgaccttttattgtcggctggatactgcgacttctatgttcctgctgttgaaggagggtcggtctagtcatgtgcagcgtggatatgggaaggtgcaggcggagttcccgctgggcccggttacaacagctcatcgaggaacctatcggtgttttggctcctataacaaccacgcttggtcctttcctagtgagccagtgaagctcctcgtaacaggggacatagagaatacctcccttgctccagaagaccccacattccctgaccacgccctgtgggaccacacagcccagaatctgctcagaatggggctggctttcctcgtactggtagccctggtttggttcctggtggaggattggctgtcccggaagcgcacccgtgagagggcttcgcgcgcttcgacttgggaaggacggcgaaggctgaatacccaaaccctctag

SEQ ID NO: 196657 - DNA, 630 bp, Artificial Sequence
  Description of Artificial Sequence: Synthetic coding sequence
atgagcagcaccctgcccgccctgctgtgcgtgggcctgtgcctgtcccaacgcatatccgcccagcagcagatgtacgataccccaactctttcagtgcaccccggtccggaggttattagcggcgagaaggtcactttttactgccgactggatacggcaacgtccatgttcctcctgttgaaggaaggccgctcttcccacgtacagcggggctatggaaaagtccaggcggagttccctctgggccccgtgacgacagctcataggggtacctatcgctgttttggttcctataacaaccacgcctggtcttttccgtctgagcccgtcaagctgctggtcacaggggacatagagaacacgagcctggccccggaagatcctacctttccggccgacacttgggggacatatctccttacaactgagacgggccttcagaaagaccacgccctgtgggaccatacggcacaaaatctgctccgcatgggtctggctttcctggtccttgttgccctggtctggttcctagtcgaggattggctcagccgcaagcggacaagggaaagagctagtcgcgcctccacatgggagggtcgtagacggttgaacacccagaccctgtag

SEQ ID NO: 196658 - DNA, 594 bp, Artificial Sequence
  Description of Artificial Sequence: Synthetic coding sequence
atgagcagcaccctgcccgccctgctgtgcgtggagatgtacgacactccgacactcagcgttcaccccggtccagaagtgatctccggggaaaaagtgacattctattgccggctggacaccgcaacctcaatgttcttgctcctgaaggagggacgttccagccatgtgcagagaggctacggcaaggtgcaggcagaattccctctgggcccagtaacaacagcccacagaggcacttatcggtgttttggatcatataataaccacgcttggagctttccttcagaacctgtgaagctgctggttacgggcgacattgagaataccagtctcgcccccgaagatcctaccttccctgctgacacatggggaacatatttgcttacaaccgagacaggcttgcagaaggaccacgctctatgggaccatacagcgcagaacctgctcagaatgggactggcctttctagtgctggttgcacttgtgtggttcttggtggaggactggctctctagaaagcgtactcgcgagcgagcttctagggccagtacatgggaagggcggcggagattaaacacccagacattgtag

SEQ ID NO: 196659 - DNA, 912 bp, Artificial Sequence
  Description of Artificial Sequence: Synthetic coding sequence
atgagcagcaccctgcccgccctgctgtgcgtgggcctgtgcctgtctcagcggatttcagctcagcaacagacgctgccaaaaccatttatctgggccgagccacacttcatggttcccaaagagaaacaggtgacaatctgctgccagggcaattacggggccgttgaataccagctccacttcgaagggagcctgttcgccgtggatcgcccgaaaccgcccgagcggattaacaaggtaaaattttacattcctgatatgaacagcaggatggcgggacagtacagttgtatatatcgggtaggcgagctctggagtgaaccaagcaatctgctcgatcttgtcgttaccgagatgtatgacactcccaccttgtctgtccacccaggacccgaagtcatatctggggagaaagtgactttctactgtcgactagataccgccacatccatgtttcttctgctgaaagagggacggagctctcacgtgcagcgcggctacggtaaagttcaggctgagtttccccttggccctgtaaccaccgcgcacaggggaacgtataggtgctttggttcctacaataaccacgcctggtcattcccatccgagcctgtgaagttactcgttactggcgatattgagaatacttcacttgcccctgaagaccccacctttccagacacttggggaacctacttgttgaccacggagaccgggctgcagaaggaccacgctctgtgggatcatacggcccaaaacttactacggatgggtctcgcgtttctggtgcttgtggccttggtgtggttcttggtcgaagattggctcagtcgcaagcgcacccgggaacgggccagtcgagctagtacatgggaagggcgtagacggctaaacactcagacactctag

SEQ ID NO: 196660 - DNA, 777 bp, Artificial Sequence
  Description of Artificial Sequence: Synthetic coding sequence
atggcctggcgggccctgcaccccctgctgctgctgctgctgctgtttccgggatcccaggcccaatccaaggcccaggtgcttcagagcgtggccggtcaaaccctgaccgtccgctgccaatatcctcccacgggcagcctgtacgagaagaaaggatggtgcaaggaagctagcgccctggtttgtatccgtctagtgacaagctctaagcccagaactatggcttggactagcagatttaccatttgggatgaccctgatgccggattctttacagtaacaatgacagacctaagagaagaggatagcggtcactactggtgccggatttacaggccttccgacaatagtgtgtccaagtccgtaagattctacttggtggtttctcccgcctcagcatccacacaaacctcatggacgcccagggacctggtatcctcccagacgcagacccagtcctgcgtgcctcccaccgccggagcacgccaggcgccggagtctccatccaccatcccagtgcctagccagccacagaatagcaccctgcggccgggtcccgctgcccctattgccctggtcccggtgttttgtggcctcctggtggccaaatctcttgtcttgagtgcactgcttgtgtggtgggttcttcggaatcgccacatgcagcaccagggccgatcccttttgcaccccgctcagcctagacctcaggctcatagacactttcccctgtcccaccgcgcacccggggggacttatggaggcaagccctag

SEQ ID NO: 196661 - DNA, 813 bp, Artificial Sequence
  Description of Artificial Sequence: Synthetic coding sequence
atggcctggcgggccctgcaccccctgctgctgctgctgctgctgttccccggtagtcaggcacagtccaaagcccaggtcctccaaagcgtagctggccagactctaaccgtcagatgccaatacccccctacaggcagtctgtatgaaaaaaaaggctggtgcaaggaagctagtgcgctggtgtgtatcagactcgtgacttcatctaaaccaaggaccatggcctggacctctcggttcacaatttgggatgaccccgacgccggatttttcacggtgacaatgacagacctgcgggaagaggactcaggccattattggtgtcgcatttatcgaccgtccgataacagcgtgtccaagtcagttagattctatttggtggtgtcccctgcttccgcctcaacacaaacttcctggacgccacgcgacctggtgagctcccagacccagacccaaagctgcgtgcctccaacggcaggggcacggcaggccccagaatcacctagcacaatcccagtgccgtctcatccaagcagtccactccccgttccactgcccagtcgtccacaaaactccacacttagaccaggtccagccgcgccaattgccctggttccggtgttctgcggcttactggttgcgaagtcccttgtgctgagcgccttactcgtctggtgggttttgcgcaacaggcatatgcagcaccagggtaggtcactgctgcaccccgctcaacctcggccgcaggcacacaggcattttcctctgtctcatagggcaccaggcggaacttacggtggtaaaccttag

SEQ ID NO: 196662 - DNA, 831 bp, Artificial Sequence
  Description of Artificial Sequence: Synthetic coding sequence
atggcctggcgggccctgcaccccctgctgctgctgctgctgctgttcccagggtcccaggcccagagtaaggctcaagtgctgcagtctgtagccggacagactctcactgtcaggtgtcaataccctccaaccggcagcttatacgaaaagaaggggtggtgcaaagaagcttccgcgctggtgtgcattagactcgtgacatcctctaagcctcggaccatggcatggacctcccgcttcacaatctgggatgatccggatgcgggcttttttacagtgacaatgacagatctgagagaggaagactctggacattattggtgccgtatctacaggccaagtgacaactccgtgagtaaaagcgttaggttttacctcgtagtttccccagcgtcagcatctacacagacatcatggactccaagagatctggtatcctctcaaacacaaacccaaagctgtgtgccacctaccgcaggtgcaagacaggcccccgaaagcccctctaccataccagtgccgtcccagccccagaactctacactcagacccggaccggcagctcccatagccctcgtgccagtgttctgtggcctgctggtggcaaagagtctggtgttgagcgcactgttagtctggtggggagacatctggtggaaaaccatgatggaattgaggtccctggacacccagaaggcaacatgccacctgcagcaggtgacagatcttccctggacttccgtgtccagccccgtggagagggagattctttaccacactgtcgcccgcaccaagatatccgatgatgatgacgaacacacactgtag

SEQ ID NO: 196663 - DNA, 606 bp, Artificial Sequence
  Description of Artificial Sequence: Synthetic coding sequence
atggcctggatgctgctgctgatcctgatcatggtgcaccccggcagctgcgccctgtgggtgtcccagccacccgagatcagaacgctggagggtagcagtgccttcttgccatgctcattcaacgcttcgcagggccgcctggcaatcggttccgtgacctggttccgggatgaagtggtgccagggaaagaagtgcggaacgggaccccagagtttcgcggtcgacttgccccattggcttcatcaaggtttctgcatgaccaccaggcggaactccatatcagagacgtgcgggggcatgatgcttccatatacgtctgtcgggtggaggtcctgggcctgggggtcggcaccggaaacggtacgcggctcgttgtggagaaagaacatccacagcttggtgccggtaccgtcctcctattgcgggcaggattttatgcggtgagttttcttagtgtggccgtaggcagcaccgtatactatcagggcaaatgtctgacctggaaagggccaagaaggcagctgcccgctgtcgttccggctccactaccccctccatgcggctcttcagcccatttgttacctccagtgcctgggggatag

SEQ ID NO: 196664 - DNA, 498 bp, Artificial Sequence
  Description of Artificial Sequence: Synthetic coding sequence
atggcctggatgctgctgctgatcctgatcatggtgcaccccggcagttgcgctctatgggtcagtcagcccccggagatccggacactggagggctccagcgcattcctaccatgtagcttcaacgcctctcaaggacgcctggccattgggagtgttacttggttcagagacgaggtagtcccaggaaaagaagcggagctgcacatccgcgatgtaagaggtcacgacgcctcaatttatgtttgtagagtggaggtgttaggcctgggggtgggaaccggcaatgggacaaggctcgtggtggagaaagaacacccccagcttggggcaggaacagtgctgctcctccgcgccggcttctatgccgtgtccttcctgtccgtggctgtgggtagtaccgtttactaccagggcaaatgccactgccatatgggaacacattgccactcaagcgacggaccccgaggagtgatcccagaaccccgttgcccatag

SEQ ID NO: 196665 - DNA, 573 bp, Artificial Sequence
  Description of Artificial Sequence: Synthetic coding sequence
atggcctggatgctgctgctgatcctgatcatggtgcaccccggctcttgcgcgctgtgggtctcccagcctccggaaatccggactctggaaggcagctccgcctttctgccctgctcttttaacgcttctcagggtagactggctattggatctgtgacatggtttcgtgacgaagtagtaccagggaaagaagtcaggaacggaacccctgaatttcgaggacggctcgcaccgcttgcaagctctcgttttcttcacgaccaccaggccgagctgcacataagagatgtgaggggtcacgacgcttccatctacgtgtgtcgggtggaggtattgggtttgggggtcgggactgggaatggtactcggctggtggtggaaaaagagcacccccagcttggcgcaggaactgtgctcctgctgcgcgctggcttttacgcggtaagcttcctctctgtcgccgtaggaagcaccgtttactaccagggcaaatgccactgccatatgggcacacactgccacagcagcgacggtcctcggggcgttatcccggagccgagatgcccttag

SEQ ID NO: 196666 - DNA, 534 bp, Artificial Sequence
  Description of Artificial Sequence: Synthetic coding sequence
atggcctggatgctgctgctgatcctgatcatggtgcaccccggctcatgtgcactctgggtcagccagccccctgagatcagaaccttggagggaagttccgcctttctcccctgctccttcaacgcctcacagggcagactggctattggatctgtgacttggttccgggacgaggttgtccccggcaaagaagtccgcaacggaacacccgaatttagagggcgtctggccccactggccagttctcggttcctgcatgatcatcaggcggagctgcacatacgggatgtccgggggcacgatgcatctatttacgtttgccgggtcgaggtgttgggtctgggagtagggaccggcaatgggacaaggctcgtagtggagaaagagcacccacagctcggcgccgggaccgttctgctgctacgcgcgggcttctatgcagtttctttcctcagcgtggcagttggatctactgtgtattatcagggtaaatacgcaaagtccacactgagcgggttcccccagctttag

SEQ ID NO: 196667 - DNA, 573 bp, Artificial Sequence
  Description of Artificial Sequence: Synthetic coding sequence
atggcctggatgctgctgctgatcctgatcatggtgcaccccggctcctgtgctttgtgggtaagccagccgcccgaaattcgtaccctggagggatctagcgctttcctaccttgtagtttcaacgcttcccagggccgcttagctatcggctcggttacctggttccgcgacgaagttgttccgggaaaggaagtgcgcaatgggacccctgagttccgaggccggctggctcctctggcctcttctaggtttctgcacgatcaccaggctgagctgcatatacgagatgtgaggggccacgacgcatcgatctatgtgtgccgcgtcgaggtactggggcttggagtgggaaccgggaacggaacaaggttggtggttgagaaagagcacccccagctgggagcaggcacagtcttgctcctacgcgcaggcttctatgctgtttcttttctgtcagtggcagtggggtccacggtgtactatcaaggcaagtgccactgccacatgggtactcactgccactcaagcgatggaccccgcggcgttatcccagaacctaggtgtccatag

SEQ ID NO: 196668 - DNA, 606 bp, Artificial Sequence
  Description of Artificial Sequence: Synthetic coding sequence
atggcctggatgctgctgctgatcctgatcatggtgcaccccggcagctgcgcactctgggtgtcacaaccccccgaaatccggacattagaaggttcttccgcttttctcccatgtagctttaatgctagccagggaagactggctataggcagtgtcacgtggtttcgagatgaggtggttcctgggaaggaggttaggaacgggacgccggagtttcgaggtcgcttagcccctctcgcatccagccgatttcttcacgaccaccaagctgaactgcatatccgggacgttcggggccatgacgcatccatttacgtgtgcagagtagaagtgctggggctcggcgtcggaaccggcaatgggactcgcttggtcgttgagaaggagcacccacaactgggagctgggaccgttctcctccttagggcaggattctatgctgtttcgttcctgagtgtggctgtgggcagtacagtgtattaccagggaaaatgcttgacctggaaggggccacgtcgccaactcccagctgtcgtgcctgcccccctcccacccccttgcggcagcagcgcgcacctgctgcctcctgtcccagggggatag

SEQ ID NO: 196669 - DNA, 534 bp, Artificial Sequence
  Description of Artificial Sequence: Synthetic coding sequence
atggcctggatgctgctgctgatcctgatcatggtgcaccccggcagttgcgcgttgtgggtgagtcagccacccgagattcgaaccctggaagggagcagcgcatttctaccctgcagctttaatgccagtcagggtagattagccattgggtccgtaacgtggtttagggatgaggtggtccccggaaaggaggtgcgaaatggtacaccagagtttcgcgggagattagcgcccctggccagcagcaggttcctgcatgaccaccaggctgaactccacatccgtgatgtgcggggccacgatgccagcatctatgtttgccgagttgaggtcttgggcctgggggtgggtactggtaatggtacaaggttggtggtggaaaaggagcaccctcagctcggggccggtaccgttctactgttgagagcaggcttctacgcggtctcctttttgagtgtcgcagttggatctacggtgtactatcagggcaagtacgctaagagcaccctgagtggctttccccaactgtag

SEQ ID NO: 196670 - DNA, 498 bp, Artificial Sequence
  Description of Artificial Sequence: Synthetic coding sequence
atggcctggatgctgctgctgatcctgatcatggtgcaccccggctcatgtgcactttgggtgtcccagccaccggagatcaggactctcgagggcagcagcgcattcctgccttgctcctttaacgcaagccaagggagacttgccatcggctccgtcacctggttcagggatgaggtcgtccctggaaaggaggccgaacttcatatccgggatgtacgagggcacgatgccagcatatatgtgtgccgggtggaggtactcggactcggagtaggaacaggcaacggcacgcggctggtagtggaaaaagagcatcctcagcttggcgcggggaccgtactgctgctgagagccggtttttacgccgtaagttttctcagcgtggccgtcggttctactgtttactatcagggaaaatgccactgtcacatgggaacgcactgccacagttccgacggcccccgcggggttattcccgaaccccgatgcccatag

SEQ ID NO: 196671 - DNA, 573 bp, Artificial Sequence
  Description of Artificial Sequence: Synthetic coding sequence
atggcctggatgctgctgctgatcctgatcatggtgcaccccggctcttgtgctctatgggtgtcacagcctccagaaattcggactttagaaggatcctcagctttcctgccctgctctttcaacgccagccaaggtcgtctcgcaatcggctctgtgacttggttcagagatgaggtcgtgcccggcaaagaggtgagaaacggaaccccagagtttcggggcaggctcgcccctcttgccagttcaaggttccttcacgatcatcaggcggaactgcacatccgggacgttcgaggccacgacgcctccatctacgtatgccgcgtggaagtgcttggattgggagtgggaaccggtaatggcaccaggctagtggtcgagaaggaacacccacaactgggtgcaggtacagtgctcctgctgcgggccgggttctatgccgtgtcattcctgtctgtggccgtagggtcaactgtgtactaccagggaaaatgccattgccacatgggcacgcattgccacagctctgacgggccaagaggggtaatacctgaaccacggtgtccgtag

SEQ ID NO: 196672 - DNA, 606 bp, Artificial Sequence
  Description of Artificial Sequence: Synthetic coding sequence
atggcctggatgctgctgctgatcctgatcatggtgcaccccggcagctgcgcactgtgggtttcccagcctccggaaatacgcaccttggagggtagcagtgctttcttgccttgctcttttaacgcctcccaagggcgactggcgataggtagtgtcacctggtttagagatgaggtggtgcccggtaaggaagtgcgcaacggtacacccgagttccgtggacgattggcacccttagcctcatcgagatttttacacgatcaccaggccgagttgcacatccgcgacgtaagaggccacgacgctagtatatatgtgtgtagggtggaggtgctcggcctaggcgtgggaaccggtaacggtactcgcctggttgtcgaaaaagagcacccccagctgggcgccggaaccgttctgctactgagggcaggtttctatgcggtatcatttttgtcggtggccgtggggagtacagtttactatcagggaaaatgtctaacatggaagggaccacgccgtcagttgccggcggtcgtgcctgcccccctccctcccccgtgcggatcttcagcacatctgttgcctcctgtgccgggagggtag

SEQ ID NO: 196673 - DNA, 573 bp, Artificial Sequence
  Description of Artificial Sequence: Synthetic coding sequence
atggcctggatgctgctgctgatcctgatcatggtgcaccccggcagctgcgctttgtgggtatcacagccacccgagatccgcaccctcgaggggtctagtgcattccttccctgttcctttaacgcttctcaggggagattggctatcggttctgtgacatggttcagggacgaggtggtgcctggcaaagaagtccggaatggcacacctgagtttagaggtcgactggcacccctggcgtcttccaggttcttgcatgatcaccaggccgagttgcacattagagatgttcgggggcacgatgcttcaatctacgtttgtagagtagaagtcctgggactgggggtcgggaccggcaacgggaccagactcgtagttgaaaaggagcacccacagctcggcgccggcaccgtactgctccttagagccggtttttatgctgtctcatttctaagcgtggcagtcggctctaccgtctattatcagggcaaatgtcactgtcacatggggacacactgccattcttccgatggcccaagaggagtcataccagagccccgttgcccctag

SEQ ID NO: 196674 - DNA, 498 bp, Artificial Sequence
  Description of Artificial Sequence: Synthetic coding sequence
atggcctggatgctgctgctgatcctgatcatggtgcaccccggctcatgtgccctgtgggtaagccagcctcctgagattcgcactctagagggttcttctgcgtttctgccctgctctttcaacgcgtcacaggggcgactggcaatcggcagcgtcacctggtttcgggatgaggtggtccctgggaaagaagcagaattacatattcgcgatgttagggggcacgatgcttccatctacgtctgtcgagtagaggtactgggcctgggggtaggtacagggaacgggacacgcctcgttgtcgaaaaggagcaccctcagctgggcgcagggacagtgctcctgttgagagccggattctatgctgtgagctttctgagcgttgcagtagggtctaccgtctactaccagggaaaatgccactgccatatgggcactcactgccatagcagcgacggacccagaggagtgatcccagaacccagatgcccatag

SEQ ID NO: 196675 - DNA, 498 bp, Artificial Sequence
  Description of Artificial Sequence: Synthetic coding sequence
atggcctggatgctgctgctgatcctgatcatggtgcaccccggctcctgcgctctctgggtgtctcagccgcccgagattcggaccctcgaaggcagcagcgctttcttgccctgcagttttaatgcctcccaggggaggctggccataggatcagtgacctggtttagggacgaagtggtccccggaaaggaagccgaactgcatattagggatgttagaggtcatgacgccagcatctacgtgtgccgagtcgaagtcctcggtctcggtgtcgggaccggtaatggtaccagattggtggtcgagaaggaacatccccagttgggggctggcaccgtgctcttgctgcgcgctggattttacgcagtgtcattcttgtccgttgccgtggggagcactgtatactatcagggcaagtgccactgtcacatgggcacccactgccacagctcagatggacctagaggcgtgatcccggaaccacgctgtccttag

SEQ ID NO: 196676 - DNA, 498 bp, Artificial Sequence
  Description of Artificial Sequence: Synthetic coding sequence
atggcctggatgctgctgctgatcctgatcatggtgcaccccggcagctgcgccctctgggtcagccagccccccgagatcaggaccctcgaaggctcttctgcatttctcccttgcagcttcaacgccagccagggcagactggcaatagggagtgttacatggttccgagatgaggtggtgcctgggaaggaggcagagctccatatcagggatgttcgagggcacgacgcctcgatttatgtatgccgtgtggaggtgctgggactcggtgtgggcacaggaaatgggaccagactcgtcgtcgaaaaggagcacccacagctaggcgcaggcaccgtactgctgctccgggccgggttctacgcggtgtcttttctgtcagttgccgttgggagtaccgtgtattaccagggcaagtgccactgccacatgggtactcactgtcactcatccgatgggccacggggcgtcataccagaaccaagatgtccatag

SEQ ID NO: 196677 - DNA, 606 bp, Artificial Sequence
  Description of Artificial Sequence: Synthetic coding sequence
atggcctggatgctgctgctgatcctgatcatggtgcaccccggcagttgcgcactctgggtgagccagccccctgaaatacgcactcttgagggcagcagtgcctttttaccctgtagcttcaatgccagccagggcaggctggcgatcggtagtgttacatggttccgcgatgaagtggtccctggaaaggaagtgcgcaatggaaccccagaattccgggggcgattagctcccctggcctctagccggttcctccacgaccaccaggctgagctccacattagagatgtcaggggccacgatgcctcgatttacgtgtgtcgagtggaggttcttgggctaggagtgggtaccggcaacggcactcgactggtagtggagaaagagcacccacagctcggagccggtaccgtgctgctacttagagctggtttctatgccgtgtctttcctgagtgtggctgtcggaagcaccgtgtactatcaggggaagtgccttacatggaaagggccacgaagacagttgccagccgtggtgccagcccccctgcctcccccttgcggttcttcagcccacttactgccacccgtacccggcgggtag

SEQ ID NO: 196678 - DNA, 606 bp, Artificial Sequence
  Description of Artificial Sequence: Synthetic coding sequence
atggcctggatgctgctgctgatcctgatcatggtgcaccccggcagctgcgctctatgggtgtcacagccacctgaaattcgcactctggaggggtcaagcgcattccttccctgttcctttaatgctagccagggccggctggccattggcagtgttacatggtttcgggatgaagtagtgccaggcaaggaggtcagaaacggcaccccagaatttagagggaggcttgcccccctcgcctcctctagatttttgcacgatcaccaggcagaactgcatatcagggacgtccgagggcatgacgcaagcatatatgtgtgtagggtggaggtactcggcctcggagttggcaccgggaatgggacccgcctcgtggtggagaaagagcatcctcagcttggcgccggtacggtccttcttttgcgtgccggcttttatgccgttagttttctgtccgtggccgtcggttcaaccgtctattaccaggggaaatgtctaacatggaaggggcctcggaggcagctgcccgcagtcgtgcccgctccgttgccacctccctgcgggtcctccgctcatcttttgccaccggtgccaggaggatag

SEQ ID NO: 196679 - DNA, 534 bp, Artificial Sequence
  Description of Artificial Sequence: Synthetic coding sequence
atggcctggatgctgctgctgatcctgatcatggtgcaccccggctcctgtgcactctgggtcagtcagccacctgagataagaactctcgaggggtcatctgcattcctgccctgttcctttaatgcttcccaggggcggctcgccattggaagtgttacatggttccgggacgaggtcgtccccggtaaggaggtgcgcaatggaacacccgaattcaggggacgcctggcccccttggcctccagtcgcttccttcacgaccaccaagccgaactgcacattcgcgacgtcagaggccacgatgcctctatctatgtctgtagagtcgaggtattagggttaggagttggaactggcaatggaaccaggctggtggtcgaaaaagaacatccccagcttggtgccgggaccgtgttgctactgcgcgcagggttctatgcagtgtcgttcctgtccgtggccgtgggaagtacagtgtattaccagggcaaatatgccaaatctacactcagcggtttcccacagttatag

SEQ ID NO: 196680 - DNA, 534 bp, Artificial Sequence
  Description of Artificial Sequence: Synthetic coding sequence
atggcctggatgctgctgctgatcctgatcatggtgcaccccggcagctgtgccctgtgggtctctcagcccccggaaatcaggactctcgagggatctagcgctttccttccctgttcgttcaatgctagccagggtcgtctggctattggctccgtgacctggtttagagatgaagtggtgcctggcaaggaggttagaaacggaaccccggaattccggggcagactggcacctctcgcttctagccggttcctgcacgaccatcaagcggagctgcatatacgcgacgtccggggccacgatgccagtatttatgtttgccgcgtggaggtcctgggactaggagtgggaactgggaacggcacgagactggtggtggaaaaggagcacccacagctaggggccggaactgtactattgctccgtgctgggttttatgcggtgagttttctaagcgtggccgtgggctcaaccgtgtattatcagggaaagtacgctaaaagcacgctgagtggcttccctcagctgtag

SEQ ID NO: 196681 - DNA, 606 bp, Artificial Sequence
  Description of Artificial Sequence: Synthetic coding sequence
atggcctggatgctgctgctgatcctgatcatggtgcaccccggctcatgtgctctctgggtctcgcagccccctgagatcagaacacttgaaggcagtagcgcatttctaccgtgttcatttaatgccagccagggcagactggcaatcggatccgtgacgtggttccgagacgaagtggtcccgggaaaagaggtgcgcaatggcacacccgaatttaggggaagactggcccctcttgcctcctccaggttcctgcatgaccaccaggctgagctacacatcagggacgtacgtggacacgatgcctcgatttacgtctgtcgcgtggaagtgctaggcctgggcgtcggcacaggcaatggtacacggttagttgtggagaaagaacacccacaactaggtgccggcacagtcctcttactgcgggcaggtttctacgccgtgagcttccttagtgtggcagtggggtccacagtttactatcagggcaaatgtcttacctggaagggccctcgccgtcagctgcctgccgtcgtgcctgctccactgccaccaccttgtggttcctcggcccacctgctgccaccagtaccaggaggatag

SEQ ID NO: 196682 - DNA, 534 bp, Artificial Sequence
  Description of Artificial Sequence: Synthetic coding sequence
atggcctggatgctgctgctgatcctgatcatggtgcaccccggctcatgtgccctttgggtttcacaaccgcctgagatcaggactctggaagggtctagcgcgttcctcccctgttcatttaacgccagccagggccgactggcgattggctccgtgacttggtttcgcgacgaggtggtgcccggtaaagaggtccgtaacggaacccctgagttccgtggacggctcgcccctctggcgtcttctcgcttcctgcacgaccaccaagcagagcttcacatcagggatgtgcggggacacgatgcaagtatctatgtgtgcagggtggaggtgctgggcctgggcgttggcaccggaaacggtacccgattggtggtagagaaagaacatccacagcttggcgctggtactgtgctgctgctcagggctggcttttacgccgtctcatttttgagtgtggcagtgggctcaaccgtgtattatcaaggtaagtatgccaagagtactctcagtgggttcccccagttgtag

SEQ ID NO: 196683 - DNA, 573 bp, Artificial Sequence
  Description of Artificial Sequence: Synthetic coding sequence
atggcctggatgctgctgctgatcctgatcatggtgcaccccggcagctgcgccttgtgggtatctcagccaccagagataaggaccctggaaggcagcagcgcattcctcccttgctccttcaacgctagtcaggggcggctggcaattggcagtgtgacgtggtttcgcgacgaagtggtccccgggaaagaagtcagaaatgggacccctgaattccgaggccgtctggcccccttggcttcaagccgatttcttcatgatcatcaggcggagctccacatccgtgatgtcagaggccatgacgcctcaatttacgtctgtagggtagaagtcctgggactgggcgtggggaccgggaatggcacaagacttgttgtagagaaggaacaccctcagttgggagctgggactgtactgctgctacgcgctggcttctatgccgtctcatttttgtcagtagcagtgggttccaccgtctattatcagggcaaatgccattgccatatgggcactcactgtcattcttccgatggtcctcggggagtcatcccagaaccccgctgcccctag

SEQ ID NO: 196684 - DNA, 606 bp, Artificial Sequence
  Description of Artificial Sequence: Synthetic coding sequence
atggcctggatgctgctgctgatcctgatcatggtgcaccccggctcatgcgcactctgggtgtctcagccaccagagattcgaactctcgagggaagctcagcgttcctgccctgtagtttcaatgccagccagggtcggttggccatcggctcggtcacatggtttagagacgaagtcgtgccagggaaagaggtgagaaatggcacacccgaattccgcggccgcctcgcaccgctagccagttcacgattcctgcatgaccatcaggctgaactccacatcagagatgttagagggcatgatgcctccatctacgtttgcagggtggaagttttgggcttaggtgtgggaacagggaacggtacccggttggttgtggagaaagaacacccacagttaggcgccggcaccgtccttctcctccgcgccggattttacgcagtgtcctttctgagcgtggccgtaggctctacagtctattaccaagggaagtgtttgacgtggaaaggtcctagaagacagctccccgccgtagtgcctgcacccctgcctccaccctgtggctcatctgcccacttgctgccaccagttccagggggatag

SEQ ID NO: 196685 - DNA, 498 bp, Artificial Sequence
  Description of Artificial Sequence: Synthetic coding sequence
atggcctggatgctgctgctgatcctgatcatggtgcaccccggctcttgtgcattatgggtgagtcaaccacctgagattcgcaccctcgaaggcagttcagccttcttgccgtgctcctttaacgcttcccagggccggctagccatcggctctgtcacttggttccgagacgaggtagtacccggaaaggaagctgagctgcacatcagagacgtgcggggacacgatgcctcgatctacgtatgtcgcgtcgaggtgctgggcctgggggtcggtacaggaaatggtacgagactggtcgtcgagaaggagcatcctcagttgggagccgggactgttctgctgctgcgcgcagggttttatgcagttagcttcctgtccgtggcggtgggcagcactgtgtactaccagggtaagtgccactgtcacatgggcacgcattgtcacagctccgacggtccaagaggcgttatcccagaaccccggtgtccttag

SEQ ID NO: 196686 - DNA, 534 bp, Artificial Sequence
  Description of Artificial Sequence: Synthetic coding sequence
atggcctggatgctgctgctgatcctgatcatggtgcaccccggcagttgtgccctctgggtatcccagccaccggagattcgtaccttggaaggatcaagcgcctttcttccatgttcgttcaatgcatcccagggacggttggcgatcggctctgtcacctggttccgcgacgaggttgttccagggaaagaggttcgtaatgggacacccgaatttcgcgggcggcttgcacccctggcctcatcgagattcctccacgaccaccaggcagaacttcacattagagatgtcagaggccacgacgccagtatatatgtgtgtcgggtggaggtgctggggctgggagtcggcaccggaaatggcacgcgtttagtagtggaaaaagagcatccccagttaggcgctggaaccgtgctcctgctccgggccggcttctatgctgtcagttttctgtcggtggcggtgggatctactgtctattaccaggggaaatatgcgaaaagtacactctcagggtttcctcagctgtag

SEQ ID NO: 196687 - DNA, 573 bp, Artificial Sequence
  Description of Artificial Sequence: Synthetic coding sequence
atggcctggatgctgctgctgatcctgatcatggtgcaccccggctcttgcgccttgtgggtttctcagccacctgaaatcagaactctggagggctcatctgccttcttgccttgcagcttcaacgcctctcaggggaggctggccatcggctcagtgacctggtttcgggacgaggttgtgccaggaaaggaagtacgtaatgggactcccgagtttagggggaggctggcacctctggcgagtagccggtttctgcatgaccaccaagcggaactccacatccgggatgtgcgcggacacgatgccagcatatatgtgtgccgcgtggaagtgctgggcctcggggttgggaccgggaacgggactcgacttgtggtcgaaaaggagcaccctcaattaggggccggcaccgtgctgctcctgagagccggattctatgccgtgtcatttctgtcggtggcagtggggtcaactgtctattaccagggtaagtgccattgccatatgggcacacactgtcattcctctgacggccccaggggcgtgattcccgaaccccgttgcccttag

SEQ ID NO: 196688 - DNA, 534 bp, Artificial Sequence
  Description of Artificial Sequence: Synthetic coding sequence
atggcctggatgctgctgctgatcctgatcatggtgcaccccggctcttgtgccctctgggtcagccagccgccagagatacgcaccctggaaggctccagtgctttcctcccatgctcttttaacgctagccaggggcgactcgccattgggagcgtcacatggttccgcgatgaggtggtacctggcaaggaagtgcgcaacgggactcccgaattccgcgggcgcttagccccactggcgtctagcaggttcctgcatgatcaccaggccgaactccacattcgcgacgtgaggggtcacgatgcaagcatatacgtctgcagggtggaagtgctcggactgggcgtcggaaccggcaacggaacccgcctagtggtcgaaaaggagcatcctcagttaggagccggcaccgtattactgcttagagctgggttctacgctgtgtcatttctctcagtggccgttgggagcaccgtgtactaccagggcaaatatgcaaagagcacgctcagcggatttcctcagttgtag

SEQ ID NO: 196689 - DNA, 606 bp, Artificial Sequence
  Description of Artificial Sequence: Synthetic coding sequence
atggcctggatgctgctgctgatcctgatcatggtgcaccccggctcatgcgcgctttgggtgtctcagcctcccgagatcagaactctggaagggtcaagcgcatttctaccctgttcattcaatgccagtcagggcaggctagccatcgggtccgttacatggtttagggacgaggtggtacccgggaaagaggtgcgcaatgggacaccagaattcagaggcagactcgctcctcttgcgagctccagattcctgcatgatcaccaggcggaacttcatatcagagatgtgagaggtcacgacgcttccatctacgtctgccgagtggaagtgcttggactgggtgtgggcacagggaacgggacccgtctcgtggtcgagaaggagcatccacagctgggggcaggtactgtactgctgctcagggcaggattttacgccgtctcatttctgagcgtcgctgtggggagtactgtatattaccagggaaaatgtctcacatggaaggggccacggagacaactacctgcagtggttccggccccactcccaccaccatgtgggtcttccgctcacttactgccgcctgtcccagggggatag

SEQ ID NO: 196690 - DNA, 573 bp, Artificial Sequence
  Description of Artificial Sequence: Synthetic coding sequence
atggcctggatgctgctgctgatcctgatcatggtgcaccccggcagctgcgcactatgggtgagccagccgcctgagattcgcacactggagggatcctccgctttcctaccctgttcattcaatgcaagccagggaaggctggccattgggtccgtgacctggttccgcgatgaagtagtccctggaaaggaagtgcgaaatggcactcctgaattcagggggcggttagcacctttagcctcatctcgctttctgcatgaccaccaggctgaattgcatatcagagacgttaggggccatgatgcctctatctacgtgtgccgcgtggaggtcctgggcttaggggttggcacaggtaatgggacgcgccttgtggtggagaaggagcatccccaactcggggcaggaactgtacttctcctgagagcaggattttacgccgtcagtttcttaagcgtcgcagtgggaagtaccgtctattatcaggggaagtgccattgtcacatgggaactcactgccacagtagcgacggacctaggggcgtcatcccagagcctcgatgcccgtag

SEQ ID NO: 196691 - DNA, 498 bp, Artificial Sequence
  Description of Artificial Sequence: Synthetic coding sequence
atggcctggatgctgctgctgatcctgatcatggtgcaccccggcagttgcgcactgtgggttagtcagcctccagagatcaggactctggagggttcctctgcctttctaccttgttcattcaacgcatcccagggtcgcctggccatcggcagcgtaacctggttccgcgatgaagtggtgcctggaaaagaggccgaactgcatatacgggacgtgagagggcatgatgcaagtatctacgtgtgtagggtggaagtccttgggctgggtgtgggaacaggaaacggtacacggctcgtcgtggagaaagagcatccccagctgggtgccggcacagtgctcctgttgagggctgggttttacgccgtctctttcctgagtgtggccgtcgggtctacggtctactatcaggggaagtgtcattgccacatgggaacccactgccacagctcagacggaccgcggggagtaatacccgagccgagatgcccttag

SEQ ID NO: 196692 - DNA, 498 bp, Artificial Sequence
  Description of Artificial Sequence: Synthetic coding sequence
atggcctggatgctgctgctgatcctgatcatggtgcaccccggctcctgcgctctctgggtctcccagcctccagagattagaaccctagaggggtcaagtgcttttttgccctgtagtttcaacgcatctcagggccgactggctattggctcggtaacctggttcagggacgaagttgtgcctggcaaagaggccgaattgcatatcagagacgtcagaggccacgacgcttcaatctatgtgtgccgtgtggaagtgttgggacttggcgtcggtacaggaaatggcactcgcttagtcgtggaaaaggagcacccgcaactcggcgcaggaactgtcttgcttcttcgggccggtttttacgccgtctctttcctgtcggtggctgtgggaagcactgtgtattaccaaggaaagtgccactgccacatgggaacccactgccacagcagtgacggcccccgcggtgtgattccggaaccccgttgcccctag

SEQ ID NO: 196693 - DNA, 534 bp, Artificial Sequence
  Description of Artificial Sequence: Synthetic coding sequence
atggcctggatgctgctgctgatcctgatcatggtgcaccccggctcttgcgccctttgggtgtcgcaacctcccgagatacgcacactggaggggagcagtgcttttctgccttgcagctttaatgcctctcagggccgcttggctatcggcagtgtgacttggttcagagacgaggtcgtgccaggaaaagaggtgcgcaatggaaccccagagttccgcgggcggctcgccccccttgcctcatcacgcttcctgcacgatcaccaggccgagcttcatattagagatgtgcgcggccacgatgcaagcatctatgtctgcagagtggaggttcttgggctgggcgtgggcacggggaatgggactcgtctagtggttgagaaagaacacccccagttaggagccggtaccgtcctgctcctgcgtgctggcttttacgctgtttcattccttagcgtcgccgtaggatcgacagtctattatcaggggaagtacgccaagtccacattaagcggcttcccccagctgtag

SEQ ID NO: 196694 - DNA, 573 bp, Artificial Sequence
  Description of Artificial Sequence: Synthetic coding sequence
atggcctggatgctgctgctgatcctgatcatggtgcaccccggcagctgtgccctgtgggttagtcagccccctgaaatacgaaccttggagggctcctcagcgttcttaccatgctcctttaacgctagccaagggcgcttagctattggaagcgttacctggtttcgagatgaggttgtgccgggcaaagaagtgcgcaacgggaccccagagtttcgcgggagactcgcccccctagccagctcccggttccttcacgaccatcaggcagaattgcacatacgagatgtccgcggccatgacgcctctatctacgtatgcagagtggaagtgctgggtctcggtgtggggacaggcaacggtacccggctcgtggttgagaaagaacacccccagttgggggctgggacagtgcttctactacgtgctggtttctatgcggtctcttttcttagcgtcgccgtagggtccacagtctattaccagggaaaatgccattgtcatatgggaacgcattgtcattccagcgatggtcctcggggagtcatccccgaaccccgctgcccttag

SEQ ID NO: 196695 - DNA, 486 bp, Artificial Sequence
  Description of Artificial Sequence: Synthetic coding sequence
atggacgacatctacaaggccgccgtggagcagctgaccgaggagcagaagaacgagttcaaagcagcctttgacatttttgtgcttggagcagaggatggttgcatctccacaaaggagctgggtaaagtgatgagaatgctgggtcagaaccctactcctgaggagttgcaggaaatgatcgatgaggtggatgaggatggctcaggcacagtagactttgatgaattcctagtaatgatggtcagatgcatgaaggacgattccaaagggaaaagcgaggaagagctgtcagatctcttccgcatgtttgacaagaatgccgacggatacattgatctggatgagctgaaaatcatgttgcaggcgaccggagagaccatcactgaggacgatatcgaagagctgatgaaagacggcgataagaataatgacggaagaattgattacgatgagtttctggagttcatgaagggagttgaatag

SEQ ID NO: 196696 - DNA, 315 bp, Artificial Sequence
  Description of Artificial Sequence: Synthetic coding sequence
atgggcgcccaggaccggccccagtgccacttcgacatcgagatcaaccgggagccagtgggacggatcatgttccagctcttttccgacatttgcccaaaaacgtgcaagaattttctctgcctgtgctctggagagaagggactgggtaagacgaccggcaagaagttatgctataagggcagtacctttcatagagtcgtgaaaaacttcatgatacaggggggggatttttccgaagggaacggcaaagggggagaaagcatctatggtgggtatttcaaggagaacgtggtcttctgcaagatgaaatag

SEQ ID NO: 196697 - DNA, 2805 bp, Artificial Sequence
  Description of Artificial Sequence: Synthetic coding sequence
atggccgtgcagcccaaggagaccctgcagctggagagcgccgccgaggtggggtttgtgagatttttccagggaatgcccgaaaaacctacaacgacagttcgactctttgaccggggggacttttacactgcccacggagaagatgcattattggcagccagagaggtgtttaagactcagggagtcatcaaatacatgggacccgccggggctaaaaacttgcagagcgtcgtgttgtctaagatgaactttgagtcatttgttaaggacctcctgctggttcggcagtaccgcgttgaggtctacaagaaccgggccggcaacaaagcttccaaggagaacgattggtacctggcatacaaggcttccccagggaacctgagtcaattcgaagacatcttgttcggcaacaacgacatgtccgcctcaatcggagtcgtcggcgtgaagatgtctgcagttgatggacagcggcaggtgggcgttggctatgttgacagcatccaacgtaagctcggtctctgtgaatttcccgacaacgaccagtttagtaatctcgaggcgcttcttatccaaattggacctaaggagtgtgtgctccccggcggggaaacggccggggatatggggaagttaaggcagatcattcagcggggaggaatcttgattacagagaggaagaaggccgatttctccacaaaagacatctaccaggacctcaatcggctgctgaaaggcaagaaaggagagcaaatgaacagcgccgtgttgcctgagatggagaaccaggtggcggtgtcttcactgagcgcggtcatcaaattccttgagctgctttctgacgactcgaattttggccagttcgagctaactacatttgattttagccagtacatgaagctggatatcgctgccgtgcgcgcacttaacctgttccagggaagtgttgaggatacaaccgggagtcagtccctggcagccctcctgaacaagtgcaaaacgccacaggggcagcgcctggtgaatcagtggataaaacaacccctgatggacaagaataggattgaggaacggctcaatctggttgaagcgtttgtggaggatgccgaactcagacagactctccaggaagatctgcttaggcgtttcccagacctgaatcgactcgcaaagaagttccagcggcaagcagcgaatctgcaggattgttaccgcctataccaaggcattaatcagctgcctaatgtgatccaggctctggaaaagcacgagggaaaacatcagaaactcctgctcgctgtcttcgtgactccgctcacagacctccgcagcgacttttcaaagttccaggagatgattgagactaccctcgacatggatcaggtcgaaaatcacgagttcttagttaaacccagctttgacccaaatttgtcggagctgagagagataatgaatgatctggaaaagaaaatgcagagcaccctcatcagcgctgcccgcgacttgggcctggaccccggaaagcaaatcaagctcgacagctctgcacaatttgggtattacttcagagtcacttgtaaggaggagaaggtccttcgaaataacaagaacttctccactgttgatattcagaagaatggtgtgaagttcaccaactccaagcttacctcactcaacgaggaatataccaaaaataagactgaatacgaagaggcacaagacgccatcgttaaagagatcgtcaacattagcagcggatacgttgagccaatgcagacactaaatgacgtcttggcacagttggatgccgttgtgagcttcgctcacgtgtctaacggcgctcctgtgccttacgtcagacctgcgatcttggagaagggccaaggccgtataattcttaaggcatcaaggcacgcctgtgtggaggttcaggacgaaatagccttcatacctaatgacgtgtattttgagaaggacaagcagatgttccatattattacaggccccaacatgggaggtaaaagtacctacatcagacaaaccggcgtgatcgtactgatggctcagattgggtgttttgtcccatgcgaatccgccgaggtttccattgtggattgtatcctcgctcgcgtgggagctggagactcacagcttaagggggtgtccacattcatggccgagatgctggagaccgcttcaatactgaggtctgcgacaaaggacagcctgatcatcatcgacgagctgggaaggggcacaagtacttatgatggcttcgggttggcctgggcgatcagcgaatatatcgcgacaaaaattggggctttttgcatgtttgctacccactttcacgaacttacggcactggccaatcagatccctaccgtgaacaacctgcatgttacagccctgacaaccgaggaaacacttacaatgctttaccaagtgaaaaagggcgtttgtgatcagagtttcggaatccacgtggccgaattagccaactttcccaaacacgtgatcgagtgcgccaagcagaaggcgctggagttggaggagttccagtatatcggtgagtcccaggggtatgacatcatggaacctgcggccaagaaatgctacctggaaagggaacagggtgaaaaaataattcaggaattcttgtcaaaggtgaaacagatgccattcaccgaaatgtctgaggaaaatataaccataaaactgaagcagttaaaagcagaagtaatcgctaagaataacagcttcgtgaacgaaatcataagtaggattaaggttaccacgtag

SEQ ID NO: 196698 - DNA, 435 bp, Artificial Sequence
  Description of Artificial Sequence: Synthetic coding sequence
atgaccgaggaggtgatcgtgatcgccaagtgggactacaccgcccagcaggaccaggaactggacattaagaaaaacgagaggctttggctcctggacgattctaaaacttggtggagggtacgcaacgcggcgaatcgtacggggtacgttccttcaaactatgttgagcggaaaaacagcctgaagaaggggtctcttgtaaagaacttaaaagatacactcgggctgggaaagacacgaagaaagaccagcgcgagagatgcaagtcctaccccttccacagacgcggaataccctgcgaacggaagtggggccgatcgaatatacgaccttaacattcctgccttcgtgaagtttgcatacgtcgcagaacgcgaggatgaacttagtctcgtgaagggcagccgcgttaccgtcatggagaaatgttag

SEQ ID NO: 196699 - DNA, 1143 bp, Artificial Sequence
  Description of Artificial Sequence: Synthetic coding sequence
atgaccgaggaggtgatcgtgatcgccaagtgggactacaccgcccagcaggatcaggagctggacatcaaaaagaacgaaagattgtggcttctggacgacagtaaaacgtggtggagggtgcgaaacgctgccaacagaactggttatgtccccagcaattatgttgaaagaaaaaattcactgaaaaaaggttcattggtgaagaacctgaaggatacactgggcctcggaaaaaccagaagaaaaacaagcgcgagagacgccagcccaacacccagtacagatgcagagtaccctgccaacggctcgggagcggatagaatttacgacttaaatattcccgcattcgttaaattcgcctacgtggctgagagagaagatgaactgtctctggtgaagggatccagggtcacagtgatggagaagtgctcggacgggtggtggagaggttcctacaatgggcagattgggtggtttcctagtaactatgtgctggaggaagttgacgaagccgccgcagagagtccttcctttctttccctcagaaaaggagctagcctttccaatgggcagggctccagggtgctgcacgtagttcagacactgtacccattcagcagcgtcaccgaagaagagttaaacttcgaaaaaggagaaaccatggaagtgatcgagaaacccgagaatgaccccgagtggtggaaatgcaaaaacgccagaggccaagttggcctcgtcccaaagaattacgtggtggttctttcggacggtccagcactccaccccgctcacgcaccacagatcagctacacaggacctagctcaagcggcagattcgccgggagagagtggtattatggaaatgtgacaaggcaccaagccgaatgtgccctgaacgagaggggagtcgaaggagacttcctgattcgtgattctgaatcctcaccttccgacttctccgtttccctcaaagcctccgggaaaaataagcactttaaggtgcagctcgtggacaacgtgtactgtatcggccagaggcggttccatactatggacgaactggtggaacattacaaaaaagcacctattttcacctccgaacacggcgagaagctgtacctggtgagggctctccagtag

SEQ ID NO: 196700 - DNA, 333 bp, Artificial Sequence
  Description of Artificial Sequence: Synthetic coding sequence
atgaccgaggaggtgatcgtgatcgccaagtgggactacaccgcccagcaagatcaggagttagatattaagaagaacgagcgtctctggctgctggacgactccaagacatggtggcgagtgagaaatgccgctaacaggacgggttacgttccttctaactacgttgagcgcaaaaatagcctcaagaaaggttccttagtcaagaatttaaaggacaccctgggattgggcaaaaccagacggaagacatccgcaagagacgcaagcccaacaccctctactgacgcagagtatccagccaatggatccggcgcggaccggatatattag

SEQ ID NO: 196701 - DNA, 252 bp, Artificial Sequence
  Description of Artificial Sequence: Synthetic coding sequence
atgaccgaggaggtgatcgtgatcgccaagtgggactacaccgcccagcaggatcaggaactggatatcaagaagaacgaaaggctatggcttttggatgatagtaagacatggtggagggttagaaatgccgccaacaggactggctatgttcccagcaactacgtggagagaaagaatagcctgaaaaaaggctccctggtaaagaaccttaaagacacacttgcccaacgtttgctccgggtcccatag

SEQ ID NO: 196702 - DNA, 252 bp, Artificial Sequence
  Description of Artificial Sequence: Synthetic coding sequence
atgaccgaggaggtgatcgtgatcgccaagtgggactacaccgcccagcaggaccaagaactcgatataaagaagaatgagcgattgtggctgctcgacgactcaaagacctggtggagggttagaaacgcggctaatcgcacaggatacgtccccagcaactacgtcgaacggaaaaactccctgaaaaagggctcactcgtaaagaacctgaaagataccctggctcagaggctgctgcgagtgccctag

SEQ ID NO: 196703 - DNA, 2169 bp, Artificial Sequence
  Description of Artificial Sequence: Synthetic coding sequence
atgtaccgggccctgtacgccttccggagcgccgagcccaacgccctggccttcgcagcgggcgagacctttctggtcctagagcgctcttctgcacattggtggctcgcggcaagagctcgtagcggggagactggttacgtgcccccggcctatcttcgaagacttcaaggtcttgaacaagatgtgctgcaagccattgaccgggccattgaagccgttcataatactgccatgcgtgatggtggcaaatactctttggagcagcgcggggttctacagaaactcattcaccaccggaaggagaccctgagccgtcggggaccatctgcctcaagcgtggccgtgatgactagcagtactagcgatcaccatctggatgcagctgccgctcggcagcccaatggggtttgcagggccggatttgaacgccagcattccctaccatcctcggaacaccttggcgctgacggcggcttataccaaatccccttgccctcatcgcagattccaccgcagcccagacgtgccgccccgacaacacctcccccccccgtgaagcgcagagacagggaagctttaatggcttccggcagtggtggccacaacacgatgccgtccggtgggaactctgttagttcaggctctagtgtgtcttctacctccctggatactctatacacatcgtcttccccgtccgagcccggctcatcctgctcaccgacacccccgccagtccctagaaggggcacccacaccacagtgtcccaggtgcagcccccaccttcaaaggcctccgctcccgaaccccctgcagaagaagaagtggccaccggcacgacatctgccagcgatgacctggaagcattgggaactctctcattggggaccaccgaagaaaaagctgccgctgaagctgcagtgcctcggaccatcggcgcagagttaatggaactcgtgcgacgaaatacaggcctttcccacgagctctgcagagtcgctattggcatcatcgtcggccacatacaagccagtgtgcccgcttcttcccccgtcatggagcaggtgttgttgtccttagtggagggtaaagatctgtccatggcactgccttctggtcaggtatgccacgatcagcagagactggaagtgatttttgccgacctcgcaagacgtaaagacgacgcacaacagcgttcatgggctctgtacgaagatgagggagtgatcaggtgttatcttgaagagctgctccacattctgactgacgctgaccccgaagtttgcaagaagatgtgtaagcgaaatgaatttgagtccgtgttagccctggtcgcgtactatcaaatggagcaccgcgcttcgctgcgtttgttgctccttaaatgtttcggagcaatgtgcagccttgatgctgcaattatcagcacattagtctccagtgtcctccctgtcgaactcgcccgtgacatgcagaccgacacacaagaccatcagaaactgtgctactctgcacttatcctcgccatggtgttctcaatgggagaagcagtgccctacgcccattacgaacacctgggaaccccatttgcccagttcctgctcaatattgtagaggacggcttgcctttggacacaacagaacagctgccagacttatgcgtgaacctcctcctcgcactgaaccttcatctgccggcggccgaccagaatgtcatcatggcagccctctcaaaacacgccaatgtcaagatcttcagcgaaaaactgctcctcctgctgaacagaggcgatgatcctgtgcgcatattcaaacacgaacctcaacccccgcactcagtcctgaagttcctgcaggacgtttttggaagccctgccaccgctgctatcttctatcacactgatatgatggcccttatcgatatcaccgtgcgccacatcgccgatctcagtcccggagataagctacgcatggaatacctttccctgatgcacgctatcgttaggacgaccccctacttgcaacaccgccacagacttcctgatctacaggcaatcttgcgccgtatcctgaacgaagaagagacaagccctcagtgccagatggatcggatgatcgtgcgtgagatgtgcaaagagtttctcgtgctgggcgaagcaccctcctag

SEQ ID NO: 196704 - DNA, 2169 bp, Artificial Sequence
  Description of Artificial Sequence: Synthetic coding sequence
atgtaccgggccctgtacgccttccggagcgccgagcccaacgccttggcttttgccgctggtgagacctttttggtgctcgaacggtctagcgctcactggtggttggcggcacgggcaagatctggggagaccggttacgtaccgccagcttacctcagacgcctccagggactagaacaggatgtgctccaagcgatagatcgggcaattgaggcagtgcacaataccgctatgagagacggaggtaaatattccctcgagcagcgtggtgttctccagaagctcatccatcatcgcaaggaaacattatccaggcgcgggcccagtgcttcaagtgtggccgtgatgacatcttcaacgagcgatcaccatcttgatgccgctgcagcccgccaacccaacggtgtatgtcgggctggcttcgagagacagcattcccttccctcatctgagcacttgggagccgatggaggtttataccagatcccccttccctctagccagattcctccgcagccccggcgcgcagctcccacgacccccccacctcctgtcaagagacgagatcgggaggctctgatggcatccggtagtggcgggcacaatacgatgccgtccgggggcaactccgtgtcttccggcagctcggtaagcagcacctctctggatacactatataccagttcgtcgccctctgaaccaggcagctcctgttctccaacaccccctcctgtcccccggcgtggaacccacaccaccgtgagccaggtgcagcctcctccaagcaaagccagcgctcctgaaccgcctgctgaggaggaagtcgccactggtactacttcagcttccgatgacctggaagcactcgggactttgtctctgggcactacagaagaaaaggctgccgccgaggccgccgtcccccggaccataggcgccgagctgatggagcttgtccgcaggaataccggactgtcacacgagctgtgtcgcgtggcgattggcatcatcgtgggccatatacaggccagtgtaccagcatcatcccccgtcatggaacaggtactgttgtctctggttgagggaaaggatctgtccatggcacttcctagcgggcaggtctgccacgatcagcagcgcctcgaagtgatcttcgcggatctggcgcggcgaaaggacgacgcccaacagcgcagttgggccctgtatgaggatgaaggtgtaatcaggtgttatctggaagaactgctgcatattctgacagacgccgaccccgaggtgtgcaagaaaatgtgcaaaagaaacgaattcgagtccgtgttggccttagtcgcctattaccagatggaacatagagcgtctctgagactcctgctgctcaagtgttttggagccatgtgcagcctggacgccgcgatcatttccacattggtgtcatctgtactacccgtcgaactcgctcgggacatgcagaccgacacccaagaccaccaaaaattgtgttatagcgctctcatcctggcgatggtgttctcaatgggggaggctgtgccatatgcacactacgagcatctgggcaccccattcgcacagtttttgctcaacattgtggaggatggcttgcccttggatacgaccgaacagctgcctgatctgtgtgtgaatctactgctggccctaaacctccacctgccagccgccgaccagaacgtcattatggcagcgttgtctaagcatgcaaatgtgaagatttttagcgagaaactcctcctcttactgaaccggggtgatgacccagtcaggattttcaaacacgaaccccagccaccccacagtgtgctgaagtttctccaggatgtattcgggagccccgcaacagcagcaattttttaccatacagacatgatggctctgatagacataaccgtgcggcatattgccgaccttagtcccggggataaaggccccttcggtgcaggtcagcggccgtggcctggcgtcccgcggttgcttgaacccggctccactccttctcgtgagccccaccccgtggagcgatcaggagtcccagcactcactagctcctgggcatccggctgtccacgcccactgcatccggctctgcagttggtaattgacagtgcgttcggcggtcgatccgtgtag

SEQ ID NO: 196705 - DNA, 2148 bp, Artificial Sequence
  Description of Artificial Sequence: Synthetic coding sequence
atgtaccgggccctgtacgccttccggagcgccgagcccaacgccctcgcctttgcggctggcgagacttttctggtgttggagcggtcatctgctcactggtggctggccgcccgggcccgcagcggcgaaacaggctacgtgccacccgcatatctgagaaggcttcagggccttgagcaggatgtcctgcaagcgattgaccgcgccatcgaagctgtccataatacagcaatgagagatggggggaaatactccttggagcagcgaggagtactgcaaaaactaatacatcatcgaaaggagacactgtcacggcgcgggccttctgcttcttctgttgcagtgatgacatcatccacctcagaccatcatctggacgccgccgccgcccgccaacccaatggagtgtgtagggcaggctttgagagacaacattcactgccatctagcgaacacttgggcgccgatggtggcctataccagattcctccgcagccccggagagcagcgccaaccactcctccacccccagtgaagagaagagatagggaggcactaatggcctccggcagcggcggtcacaacactatgcccagtgggggaaattcagtctcatctggatcatccgtgagctctacaagcctggacacactgtatactagctccagcccaagcgagccaggatcctcctgcagccctaccccacctcctgttccaagacgtggaactcacaccacagtttcacaagtacagcctcccccatcaaaagccagcgccccggagcctccagcagaagaggaagtggccacaggcactacatccgcctccgacgatctggaagcactgggcacattgagcctgggtaccaccgaggagaaagccgctgccgaagccgccgtgccccgaaccatcggtgctgagcttatggagctggtccgccggaacacgggtctatcccacgaattgtgccgagtagctatcggcattatcgtcggccacatccaggccagtgtgccagcgagctcaccggtgatggagcaggtcctgctgtcgctagtggaaggaaaggatttgtcgatggcgttacccagcggacaggtctgccacgaccagcagagactcgaggtgatattcgccgatttggccagaagaaaggacgacgcccaacagagaagctgggcactctatgaagacgagggggtaatccggtgctacctggaggagctcctacacattcttaccgatgccgacccggaagtgtgcaagaagatgtgtaagagaaatgagtttgagtccgtgctggcactggtggcatactatcagatggagcacagagcatcattgaggctacttctgctcaagtgttttggagcgatgtgctctttagacgccgccataattagtacgctggttagttcagttctgcccgtggagttagccagggacatgcagactgacacacaggaccatcagaagctttgttattcagccctgatactggcgatggttttttccatgggcgaggctgtaccatatgctcactatgagcatctcggcactccgtttgcccaatttctcctgaatattgtggaggatggtctacctctcgatactactgaacaacttccagatctctgcgttaatcttctcttggccttgaacctgcacttaccggcagcagaccagaatgtcattatggccgccctgagtaaacatgctaatgtcaagatcttctctgagaagctgctcttactgttgaatcgtggagatgacccggtgcggatatttaaacatgagccgcaacccccacacagcgtgcttaagtttttacaggacgtgttcgggagtcccgcgaccgcagcaattttctaccataccgatatgatggccctgatcgacattacagtcagacatatagctgacctatctcctggcgacaaacttagaatggagtatctttctttaatgcacgctatagtgaggaccacaccctacttgcagcacaggcaccggctgcccgacctccaggccattctgaggagaatcctgaacgaggaggaaaccagtccgcagtgccagatggatcgtatgatcgtgcgggagatgtgtaaggaattcctggttttaggggaggctccaagttag

SEQ ID NO: 196706 - DNA, 3405 bp, Artificial Sequence
  Description of Artificial Sequence: Synthetic coding sequence
atgagccggagcgtgctgcagcccagccagcagaagctggccgagaagctcactatactgaatgataggggggtgggaatgttaacccggctctacaatatcaagaagcagggtcaggtttggaaagcctgtggcgacccgaaagccaagccttcttacctgattgataaaaatctggagtcggctgtgaaattcattgtgcggaagtttcctgctgtagagacccgcaacaataaccagcaactggcacagctccagaaggaaaaaagtgagattctgaagaatcttgccctgtactatttcacgttcgttgacgtcatggaattcaaggatcacgtctgcgagctcctgaataccatcgatgtctgtcaggtgttctttgatatcaccgttaactttgaccttactaagaattaccttgatctgatcatcacgtatactacattgatgatcctgcttagtcgcatcgaagagcgaaaggctattattggattgtataattatgctcacgagatgacacatggggccagcgatagagagtatcctagactaggacagatgatcgtggactatgagaatccactgaagaagatgatggaggagtttgtccctcacagtaagtctctgtccgatgccctcatctccctgcagatggtgtatccgaggcgaaacctctcagccgatcagtggaggaacgctcagctcctgtccctgattagtgcccccagcacaatgttaaacccagcacagtcagacaccatgccttgcgagtacctttccctggacgccatggagaagtggatcatcttcgggtttatcctgtgtcacggtatcctgaacaccgatgcgacagcccttaatctgtggaagctcgcactgcagagctccagctgtctatccctgttccgcgatgaagtgtttcacatacataaggcagcagaagacctctttgtaaatatccggggatacaacaaaaggattaacgatattagagagtgcaaggaagcagctgtgtcccatgctgggagcatgcacagggagaggagaaagtttctacgctcagctttaaaggagcttgccaccgtgctgagcgatcaaccaggcttactgggccctaaggccttgttcgtgtttatggccctgagcttcgcgagggacgaaatcatctggttgctgcgacatgctgacaatatgcctaagaagagtgcggacgattttattgacaagcacatcgctgagcttattttctacatggaggagcttcgcgctcacgtaagaaagtatggccctgtcatgcagcgttactatgtgcagtacctatcaggcttcgatgctgtggtgctgaatgagttggttcagaacctgagcgtctgccctgaagacgaatcaatcattatgtcatccttcgtcaacacaatgacgtcactgagtgtaaagcaggtggaggacggtgaggtgttcgactttagaggaatgaggttagattggttcaggttgcaggcatacacaagtgttagcaaagcgagcctggggttggctgatcatcgtgagctgggcaaaatgatgaataccatcattttccacaccaaaatggtggactcactggtggagatgctggtggagacatcagatctgagcatcttttgtttttattcccgggccttcgaaaagatgttccagcaatgtttagaattacccagtcagtctcggtactccatcgcatttccactgctctgcacccatttcatgagctgcactcacgagttatgtcccgaggaaaggcaccatattggcgaccggagcttgtcattatgtaacatgttcctggacgaaatggccaaacaggctcggaatttgattacagatatctgtacagaacagtgcacactgtcagaccagctgctaccaaagcattgtgctaaaacgatctcccaggctgtcaacaaaaaaagcaaaaagcagactggcaaaaaaggcgagcccgagagggagaagcccggtgtggagtccatgaggaaaaacaggctcgtggttaccaacctggataaactgcacactgcactgagtgagctctgcttctccattaattacgttccaaacatggtggtgtgggaacacacctttaccccgcgggaatatttaacaagccatctcgaaattagattcactaaatccatcgtgggaatgacaatgtacaaccaggcgacgcaggagattgccaaaccttcagaacttttaacctcagttagggcgtacatgaccgtactgcaatcaatcgaaaactacgtgcagatcgacattacgcgggtgtttaataacgtcttgctccagcaaactcagcaccttgatagtcacggtgagcccacaatcacctcattgtacactaattggtatctggaaactctgttgcgccaagtctctaatggacacatcgcttatttcccagccatgaaagcattcgtgaatttaccgaccgagaatgagctgaccttcaacgccgaagagtactctgatataagcgaaatgcgctcattatcggaactcttaggcccctacgggatgaagttcctgtccgaatctcttatgtggcatatctcgtctcaggtcgccgagctcaaaaagctggtcgtagagaacgtggatgtattaacacagatgagaacatcctttgataagccagatcagatggcggctctctttaaacgtctgagtagcgttgacagcgtcctaaagcgtatgactattattggggtgattctctcctttcggtcgttagcccaagaggcactgcgggatgtgctgtcttaccatatccccttcctggtcagctccatcgaggatttcaaggaccacatcccaagagagacagatatgaaggtggctatgaacgtgtatgaactctcctccgccgccggcctgccctgcgaaatagatcccgcactcgtggtggccttgtcttcacagaaatctgaaaacatcagccccgaggaagagtataagatcgcctgcctcctcatggtgttcgttgccgtgtctctacctactctggcatccaacgtgatgagtcaatatagccctgctatcgaaggccactgtaataacatccactgtctggccaaggccataaatcagatcgctgccgccctgtttacaatccacaagggatccatcgaagatcgcctcaaggaattcctggctctcgcttcgtcctccctgcttaaaatcggccaggaaaccgataagacaacgacacggaatagagaaagcgtgtaccttttgctcgacatgatagtgcaggaatctcctttcctgacaatggacctacttgagtcatgtttcccgtacgtgctgctgcggaatgcctatcacgctgtctacaagcaatctgtgacctctagtgcatag

SEQ ID NO: 196707 - DNA, 3387 bp, Artificial Sequence
  Description of Artificial Sequence: Synthetic coding sequence
atgagccggagcgtgctgcagcccagccagcagaagctggccgagaagctcacgattcttaacgatagaggagtgggaatgctgacaagactgtacaatatcaagaaggcttgtggcgaccctaaggctaagcctagctacttaatcgataagaatttagaaagcgcagtcaagttcatcgtgaggaagttcccagcagtggaaaccagaaacaacaaccaacagctggctcagctacagaaagagaagtccgaaatcctcaaaaatctggcactctattattttacgtttgtggatgtgatggagttcaaggatcatgtgtgtgagttgttgaacaccatcgacgtgtgccaggtgttttttgacataacagtaaacttcgacctaactaagaactatctggatctcattatcacatatacaactctaatgattcttcttagccgaatagaggagcggaaggccatcatcggtttatataactacgcccatgagatgacccatggcgcgtccgatagagagtacccaaggctgggccaaatgattgtggattatgagaatcctctgaaaaaaatgatggaggagtttgtgcctcatagcaagtcactgtccgatgcactaatttccttgcagatggtatatccgagacggaacttgagcgcagatcagtggaggaacgcgcagctgctcagtcttatctccgcgcctagcaccatgctcaaccccgctcagagtgacactatgccctgcgagtatctcagccttgacgcgatggagaagtggatcatattcgggtttattctttgccacggcatcctcaatacagatgcaacagctctgaatctgtggaagttagccctgcagtcctcatcttgcctgagcctgttccgtgacgaagtatttcacatacataaggctgctgaggacctttttgtgaatatcagagggtacaacaagagaatcaatgacatacgggagtgtaaagaggccgcagtgtctcacgccggcagtatgcatcgcgagcgccgcaagtttttgaggtctgcgctgaaggagctcgctaccgtcctgagtgaccaacccggcctcctgggacccaaagcgctgttcgtttttatggccctcagctttgcccgggacgagattatctggttgctgcggcacgccgataacatgccaaaaaagtcagcggacgacttcatcgacaagcacatcgcagagctcatcttctacatggaagaattgagggcccacgtaaggaagtacgggcccgtgatgcagcggtactacgttcagtatctatctggcttcgacgcggtcgttttgaacgagctggtccaaaaccttagcgtgtgtccagaggatgagtctattatcatgtcgagcttcgtcaataccatgacaagcttaagcgttaagcaggtagaggacggagaagtctttgacttccgaggcatgcggctcgactggttccgcctccaggcgtacacctctgtgagcaaggcctcactgggcctggcagatcatagggaactgggaaagatgatgaatactattattttccataccaagatggttgactcactggtggaaatgttggtggaaacttctgatctgtcaattttctgcttctacagtcgggcattcgagaaaatgttccagcaatgcttagaacttccatcacagtcgcgctacagcattgcttttccactcctttgtactcactttatgtcatgtacacatgaactgtgtcctgaagaacgccaccatataggagaccgatcgctgagcctatgtaacatgttcctggacgaaatggctaagcaggctcggaatcttataactgacatatgtaccgagcagtgtacactttctgaccagctgttgcccaagcactgtgccaagaccattagtcaggccgtgaataagaagtccaagaaacagaccggaaaaaagggggagccagagagagagaagccaggcgtggaatcaatgcggaaaaaccgcctggtggtgacaaatctcgataagctgcacacagccctgagcgaattgtgttttagcatcaactacgtacctaatatggtcgtgtgggaacatacgtttacccccagggagtacttgacatcccaccttgagattagattcacgaagtccattgtgggcatgactatgtacaaccaggctacacaagaaatagcaaagcctagtgaactgttaaccagcgtgcgcgcgtacatgacagtcctgcagagtatcgagaactacgttcaaattgacattacacgcgtgtttaataatgttctgctgcagcaaacccaacatttagacagccatggcgaacccactatcaccagcctgtataccaactggtatttagaaactttacttcgtcaggtcagtaacggacatattgcgtacttccccgccatgaaagccttcgtcaatctgccaaccgaaaatgagctgactttcaatgctgaagagtattccgacatctcagagatgcgaagtctcagcgagctcctgggaccatacggtatgaaatttctctccgaatccctgatgtggcacatttcaagccaagtcgccgagctcaaaaaactggtggtggaaaacgttgatgtactgacacaaatgagaactagcttcgataagcctgaccagatggccgcactgttcaagcgtctctcgtctgtcgacagcgtactgaaaagaatgacgataatcggggttattttaagctttagatccctggctcaggaagcgttaagagatgtgctctcatatcatattcccttcctcgtgagctcgatagaggacttcaaggaccatatcccacgggagacagacatgaaagtggccatgaatgtttacgaactgagcagcgctgcaggactgccttgcgagatcgacccagccttggtcgtcgctctctctagccagaagagcgagaacatttcccctgaggaggaatacaagatcgcgtgtttgcttatggtttttgtggcagtttcattacccaccctggcctcaaacgtgatgagccagtattcacccgcaattgagggtcattgcaataatattcattgcctggccaaagccatcaaccaaattgccgccgccctctttaccatccataagggctccattgaggacaggctgaaggagttcctggctcttgcaagcagctctttgttaaagatcggacaagagactgataagaccaccacaaggaaccgagaaagcgtgtacctgctgctggatatgatcgtgcaagagtccccttttttgacaatggaccttttggaatcgtgcttcccgtatgttcttttgagaaatgcttatcacgccgtatataagcaatcagtgacatctagcgcctag

SEQ ID NO: 196708 - DNA, 2649 bp, Artificial Sequence
  Description of Artificial Sequence: Synthetic coding sequence
atgcccgccctggcctgcctgcggcggctgtgccggcacgtgagcccccaggctgtgttgttcctcctcttcatcttctgtttattctcagtgttcatttctgcctactatttatatgggtggaagcgcgggctagagccttctgcagatgctcctgagcctgattgtggagaccctccgcctgtggccccgtcccggctgctacccctgaagcctgtacaggcagcaacaccatcacgaacagacccattagtcctcgtgttcgtagagagcctctattcccaattagggcaagaggtcgtggctattctggaatccagtagatttaagtacaggaccgagatagctcctgggaagggagacatgcccacactgaccgacaaaggccggggccgcttcgcgctgattatctatgaaaatattcttaagtacgtgaatctcgacgcctggaaccgggagctgctcgacaaatattgcgtcgcctacggggtgggaatcatcggatttttcaaggcaaacgaaaatagcttgctttccgcccagcttaagggttttccactgttcctgcatagtaacctgggactcaaggattgttccatcaacccaaaaagtcctttgttgtacgtcactcggccttcagaagttgagaagggtgtcctgcctggcgaagattggacagtcttccagtctaatcactcgacatacgaacctgtattactggcaaagacgaggtcgtcggaaagcatcccacatctcggtgctgacgcggggctccacgcagcacttcacgctaccgtggtgcaggacctggggctgcatgatggcatacagagagtcctatttggcaacaatctcaacttttggcttcacaagttggtgttcgttgacgctgtcgcatttctgaccggaaaacgtctgtctctgcctctggatcgatatatcctcgttgacatcgatgacatctttgtaggaaaggagggcacacgaatgaaagtggaagatgtgaaggctttatttgatacccagaatgagcttcgagcccacatcccaaattttacattcaatctggggtactcaggcaagtttttccacaccggaaccaacgcagaggatgctggtgacgatctgctcctttcttatgtgaaagaattttggtggttcccccatatgtggtcccacatgcagccccacctgtttcataaccagtcagtactcgccgagcaaatggctctgaataagaagtttgccgtggaacacggcatccctactgacatgggctatgcagttgcccctcaccatagcggagtgtatcccgtacatgtgcagctgtacgaggcgtggaagcaggtgtggagtattagggtgaccagcactgaggagtaccctcacctcaaacccgcccggtataggcggggtttcatacataacgggataatggtcttaccccggcagacttgcgggctctttactcataccatattctataatgaatacccagggggttcatccgagctggacaagattattaatggaggggagctcttcctgactgttctgctgaatccgattagtatcttcatgactcatctatctaactatggaaatgacagattagggctgtacaccttcaagcatctggttcggtttctccacagctggacaaacctcaggcttcagactttacctcccgtccaactggcacagaagtattttcaaatcttctccgaggaaaaagaccccctctggcaggatccgtgtgaagataaacgtcacaaggacatctggtctaaggaaaaaacctgtgaccgatttccaaagttgctcataatcgggcctcagaagactgggaccactgccttgtacttgtttctgggtatgcacccagatctttcttccaactacccttcttccgaaacatttgaggagatccagtttttcaatggccataattaccacaagggcatcgactggtatatggaatttttccctatcccatcgaatacgacgagcgatttttactttgagaaaagtgccaactacttcgattctgaggtggccccccggcgagccgccgcactacttcccaaagctaaagtcttgacaatcctgattaacccagccgaccgcgcatattcctggtatcagcaccagcgcgcacacgacgaccctgtggctttgaaatacaccttccacgaggtcatcactgctggatccgacgcctccagcaaactgcgggcgcttcagaacagatgcctcgttccgggatggtacgctacccacattgagcggtggttgagcgcctatcacgccaatcagatcctggtccttgacggtaagctcctgagaacagaaccagctaaagtgatggacatggtgcagaagttcctcggcgttacaaatactattgattaccataaaaccctcgctttcgaccctaagaagggattctggtgccagctcctggaaggagggaagactaaatgcctgggaaagtcaaaaggccgtaaataccccgagatggaccttgactctcgagcttttcttaaggactattaccgggatcataatatcgaactgagcaaactgctctataagatggggcagactctgccaacctggctcagagaagacctgcagaacaccagatag

SEQ ID NO: 196709 - DNA, 72 bp, Artificial Sequence
  Description of Artificial Sequence: Synthetic coding sequence
atgcccgccctggcctgcctgcggcggctgtgccggcacgtgagccctcaggccgttctgtttcttctgtag

SEQ ID NO: 196710 - DNA, 480 bp, Artificial Sequence
  Description of Artificial Sequence: Synthetic coding sequence
atgcccgccctggcctgcctgcggcggctgtgccggcacgtgagccctcaagcggttctttttctgctcttcatattttgtctcttttccgtgtttatcagtgcatactacctgtacgggtggaagaggggtctagaaccatcagctgacgcgccggaacctgactgtggggatccccctccggtcgctccatcccgccttctgccgcttaagcccgtgcaagcagcaacaccctcaaggactgacccacttgtgctggtgtttgttgagtccctctatagccaacttggacaggaagtcgtggctatcctcgagagttccaggtttaagtacagaactgagattgcccccggtaagggcgatatgccaacactcacggataaagggaggggtcggttcgcgttaattatctacgaaaacatcttgaagtatgtgaacttagatgcttggaatagggagctcctggacaagtattgctag

SEQ ID NO: 196711 - DNA, 207 bp, Artificial Sequence
  Description of Artificial Sequence: Synthetic coding sequence
atgcccgccctggcctgcctgcggcggctgtgccggcacgtgagccctcaggctgtcttgttcttactgttcatcttttgcctattcagtgtgttcatttcagcctactatctgtacggctggaaacgcggactggagcctagcgccgacgccccagaaccagattgcggtgatcctccacctgtggctccttcaagactgctctag

SEQ ID NO: 196712 - DNA, 2283 bp, Artificial Sequence
  Description of Artificial Sequence: Synthetic coding sequence
atgcccaccctgaccgacaacacccacggccggtacgtgctggtgatctacgaaaacctgctgaaatacgtgaaccttgatgcttggtcaagagaactcttggataggtactgcgtagaatatggtgtgggtatcatcgggttctttcgggcccacgagcactccctcctcagcgcgcaattaaaaggatttcccctctttttgcacagtaatctggggctgagggactatcaagtgaacccgtcggcccccctactacacctgacccggccgtcacgccttgagcccggcccgttgcctggagacgactggactatattccagtcaaaccactcaacttatgagcccgtgcttctagcatctctgaggccagcggaaccagcagtgcctggccctgtactccggcgggcgcgtttacccacggtagtgcaggatcttggactgcacgacggcatccaaagggtactgtttggacacggcctttctttctggttgcataaacttatctttgtcgacgcagtggcttacctcacagggaagcggctctgtttggatctggacaggtatattttggtcgatatagacgacatttttgtcggcaaggagggtacaaggatgaaggtagcagatgtggaagccctcctcacgactcagaacaaactgcggactctcgtgcctaacttcaccttcaatttgggattctctggaaagttctaccacaccggtacggaggaagaagacgcgggggacgacatgttgctgaagcatcgaaaagaattttggtggttccctcacatgtggtcacatatgcagccacacctgttccataaccgtagtgttcttgccgatcagatgcggctgaataagcagtttgcactggagcacggtatccccacagatctggggtatgccgttgccccacaccacagcggagtttatcctatccacacacagctttatgaggcttggaagtcagtctggggcatccaggttacatcaactgaggagtacccccacctgcgccctgctagatatcggcgagggtttattcataacgggattatggtcctgcctcgtcagacctgcggcctctttacccacaccattttttacaacgagtaccctggaggatctagagagcttgaccgctcaataagggggggcgaactgtttcttactgtgcttcttaatccaatcagcatctttatgacccatttatccaactacggcaacgatcggctggggctctacacttttgaaagtctcgtgcgcttcctgcaatgctggacaagactccgcttacagacgctacccccggtgcctctggctcagaaatacttcgaactctttccacaagagcgaagccctctgtggcagaacccatgtgatgataagaggcacaaggacatatggagcaaagaaaagacatgtgatagactcccaaaatttttaattgtcgggccccagaaaaccggcaccactgccattcatttcttcctaagtctgcatcccgctgtgacctccagtttcccaagccctagcacattcgaagagatccaattcttcaacagccccaattatcacaaggggattgactggtacatggactttttcccagtaccgagcaacgcttctaccgattttctgtttgaaaagagtgcaacgtatttcgactccgaagtggtccctcgaagaggtgcagccctcctgcccagggctaaaattattaccgtgttgaccaacccagcagaccgggcctactcctggtaccagcaccagagggctcacggggaccccgtcgccctgaattacactttttatcaggtcatttccgcctcatcacagacgcctctcgcattgcggtccctgcaaaaccgctgtctggtacccggatactattctacccatctccaacgctggttgacttattatcccagtgggcagctgctcattgtggatggacaagaactgaggactaatcccgccgcaagtatggagtcaatccagaaattcctgggcattacgccattcctgaattatacccgcacactgaggttcgacgacgacaaagggttctggtgtcaagggctcgagggcggcaaaacccgctgtctgggaagaagcaaaggtcgaagatatcctgatatggatacagagtcacgtctcttcctcactgactttttccggaaccataacctagaactatctaaacttctgtctagacttggtcagcccgttccctcttggctgcgagaagaattgcagcactcatccctaggatag

SEQ ID NO: 196713 - DNA, 2652 bp, Artificial Sequence
  Description of Artificial Sequence: Synthetic coding sequence
atgctgcagctgtggaaggtggtgcggcccgcccggcagctggagctacacaggcttatcctgctgcttattgccttttcactcggtagtatgggctttctggcttattatgtctccacctctcccaaggctaaggagcccttacctctgccactgggcgattgttcatcgggcggcgcggctggcccggggccggctcggcccccggtgcctccccggccgcccagacctccagaaacagccaggacagaacctgttgtgctagtgtttgttgaatctgcatactcacagctcgggcaagagattgtcgctatcctggaatcatccagattcagatactccacagagctggcacccggaagaggggacatgccaactctgactgacaatacacacggcagatacgtgctcgtcatctacgagaatttgttgaagtacgtcaacctcgatgcctggagtagggagttgttggatagatactgcgtggaatacggagtcggaattattggtttttttagggcacatgaacacagcctcctttcagcacagctaaagggctttcctctctttctgcatagcaacctgggtctgcgggattatcaggtgaatccttcagccccgctgctgcatttaaccaggcccagtcggctagaaccaggccctctgccaggagacgactggacaatattccaaagtaaccattcgacttacgagccggtgctgctcgctagcctcaggcccgccgagcctgcagtaccggggcctgtgcttcgacgagcacgtttgcctacagtggtgcaggatctggggctgcatgacggtatccagcgcgtactcttcggacacggcctcagcttctggctgcataagctaatctttgtcgacgccgtggcttacttaactggaaagaggttgtgcctagatctagataggtatattctggtagacattgacgatatcttcgttggcaaagaggggacccgcatgaaggtggcggatgtggaagctctgctcaccacccaaaacaaacttcgcactttggtgcccaactttaccttcaatctggggttctccggcaagttctaccacactggaaccgaagaggaagatgccggcgacgatatgctgcttaaacatcgcaaggaattctggtggtttccacatatgtggagtcatatgcagccccacctgttccataaccgcagtgtgctggccgatcagatgagactcaataagcagtttgctctcgaacatggtatcccaacggacctgggatatgcagttgcaccccatcacagtggtgtatatccgattcatacccagctgtacgaggcatggaagtctgtgtggggcattcaggtcacatctacggaagagtatcctcatctacgacctgcccgttaccgtcggggatttatccataatggcatcatggtgttgccacgacagacctgcggcctattcacacatactatcttttacaacgagtatcctggcgggagccgtgaactggaccgcagcattcgaggcggagaactgtttctgaccgtcttactcaaccccatcagcattttcatgacacacctatcaaattatgggaacgaccgcctcggtctgtataccttcgaatccctggtcaggttccttcagtgttggactcgcctgcgcctacagaccttaccgcccgtgccccttgcccagaagtacttcgagctgttccctcaggagcggtctccactgtggcaaaatccctgcgatgacaagcggcacaaagatatatggagtaaggaaaagacgtgtgaccgactacccaagtttttgatcgtgggacctcagaagaccggcacgaccgctatacattttttcctatccctgcatcccgccgtgacatctagctttccctctcctagcacatttgaggagattcagtttttcaactccccaaactatcacaaaggaatcgactggtatatggatttctttcctgttccttctaatgcttctacagacttcttgtttgagaaatcagccacctatttcgatagcgaagtggtgccccggaggggagctgccttgctccccagggcaaagattataacagtgcttaccaatccggccgaccgagcctatagctggtaccagcaccagagagcccacggcgatcctgtggcactcaattataccttctatcaggttatctcagcgagcagccaaacacctttagcactgagatccctgcagaatagatgcctcgttcccggatactactctacacacctccaaagatggcttacatattacccatctggacaattactcatcgtggacgggcaggagttgcgaaccaaccccgctgcttctatggagagcattcagaaatttctgggaattactccgttcctgaactacactcgcacgctgcgcttcgatgacgacaaggggttttggtgtcaaggtttggagggtggcaaaacacgatgtcttggacgttctaaggggcggcggtacccagatatggacactgaatcgcgcttgttcctgaccgacttttttcggaaccacaacctcgagctgtccaaactgctatcacgacttggacagcctgtgccatcctggttgagggaggagctgcagcattcttctctggggtag

SEQ ID NO: 196714 - DNA, 450 bp, Artificial Sequence
  Description of Artificial Sequence: Synthetic coding sequence
ggcgaccccgtggccctgaactacaccttctaccaggtgatcagcgcatcctctcagaccccactggcgttacggagcctgcaaaataggtgtttagtgccaggctactattcaactcatctacagagatggctgacctactatcccagcggccagcttctgatcgtggacggacaagaactgaggactaatcccgccgctagtatggaaagtatacagaagtttctaggtataacgcctttcctgaactacacaaggactttaaggtttgacgatgacaagggattttggtgccaaggattggagggcggaaaaacccggtgtcttggccgatcaaaaggacggaggtaccccgacatggataccgaggtcagtaaagcaagaggacgaggcattcctctccacttccaggacctgatcctgtgtcctacttcttaccatttttgttag

SEQ ID NO: 196715 - DNA, 696 bp, Artificial Sequence
  Description of Artificial Sequence: Synthetic coding sequence
atgcgggtgcccgtgttcgaggacatcaaggacgagaccgaggaggaaaagatcggcgaggaagaaaacgaagaggatcaggtgttctataagccagtcatagaggatctttcaatggagctcgccagaaaatgtacagagttaatttcagatatccgctacaaagaagaatttaaaaaatccaaggataagtgcacgtttgtgacagacagtcccatgctcaatcacgtgaagaacatcggtgcctttatttcagaagccaagtacaaaggcaccattaaggcggatctgtccaattccctctataagagaatgccagcgacgattgactccgtgtttgccggggaggtgacacagctgcaatcggaagtggcatataaacagaagcacgacgcagcaaaaggcttctcggattacgcacatatgaaggaaccgcccgaagtgaagcacgcaatggaggttaataagcatcagtccaacattagctacaggaaggatgtgcaagacacccacacatactctgctgaactagatagaccagatataaagatggccacacagatatccaaaattatttcaaacgctgaatataaaaaaggtcagggtatcatgaacaaggagcctgcagttattggacgtccggatttcgaacacgctgtggaagctagcaaattgagctcacaagtaaggttatag

SEQ ID NO: 196716 - DNA, 3045 bp, Artificial Sequence
  Description of Artificial Sequence: Synthetic coding sequence
atgcgggtgcccgtgttcgaggacatcaaggacgagaccgaggaggagaagatcggagaagaggaaaacgaggaggatcaggttttctataaaccggtgattgaggatctctccatggagttagcccggaaatgtaccgagctgatatccgatataaggtataaggaagagttcaaaaaaagtaaggacaaatgcactttcgttaccgactcaccaatgctgaatcatgttaaaaacataggagcttttattagcgaggccaaatacaagggaacaatcaaggcagacctgtcgaacagcctgtataagcgtatgcctgccaccattgatagcgtctttgctggcgaagtaacacaacttcagagcgaggttgcgtataaacagaagcatgacgcggccaaagggttctccgactacgcccacatgaaggaaccccccgaagtgaagcatgcaatggaggtcaacaagcatcagagcaacatctcctaccggaaggatgttcaggatactcacacatatagcgccgaactggatagacccgatatcaagatggcaacacagatttccaagataattagtaatgctgagtataagaaaggccagggcattatgaacaaagagcccgccgtgataggccgcccagattttgagcacgccgtggaggcgagcaagctgtccagccaaattaagtacaaggagaagtttgataacgagatgaaagataagaagcatcattataaccccctggagagcgcatcgtttcgacagaatcaactggccgctactctggccagcaatgtcaaatacaagaaagatatccagaacatgcatgaccccgttagcgatctaccgaatctcctattcttggatcacgtgcttaaggctagtaaaatgctgtctggccgagagtacaagaagctgttcgaggagaataaaggcatgtatcatttcgatgcggatgctgtagagcacttgcatcataaagggaacgcggtgcttcagagccaagtgaagtacaaagaggagtatgaaaagaataaaggaaaacccatgctagagtttgtggaaacaccaagttaccaagcgtccaaagaggcgcagaaaatgcaaagcgaaaaggtctacaaagaggacttcgagaaagaaatcaagggccgctcttccctggatctggacaaaacgcccgaatttctacatgtaaagtacataacaaatctgctccgtgaaaaagaatataagaaagatctggagaacgaaatcaagggcaagggaatggagctcaattctgaagtgttggacattcagcgggctaagcgggctagcgagatggcctctgagaaggaatataaaaaagatctggagagtataatcaaaggtaaagggatgcaggccggcacagacacactcgagatgcagcatgccaaaaaggctgcagaaatcgcctctgagaaagactacaagagagacctggagaccgagatcaagggcaagggtatgcaggtgtcaacggacactctcgacgtccagagagctaaaaaggcctcagagatggcaagtcagaaacagtacaaaaaagatctggaaaatgagattaagggcaaaggaatgcaggtgtccatggacataccagacattctgcgagctaaaaggacctcagaaatatattcccagagaaaatataaagacgaagcagagaaaatgctatctaactactccacaattgcagataccccagaaatacagagaattaagactacacagcagaacatcagcgccgtcttttataaaaaagaagtcggtgcaggcacagcggtcaaggattccccggagatagagcgcgtcaagaaaaatcagcagaatatatcgtctgtcaaatacaaggaagagatcaagcacgctaccgctatttcggaccctccggagctaaagcgcgtgaaggagaaccagaagaacatatctaatctccaatacaaggagcagaactataaggctaccccagtctcaatgacacccgagattgagcgagtgcgcaggaatcaggaacagctgtccgccgtgaagtacaaaggcgagctccagcggggcaccgctatcagcgatcccccagagctgaagagggctaaggaaaaccagaaaaacatatcaaatgtatattatcgcggacagcttggaagggcgacaactctgtcagttacacctgagatggaacgcgtaaaaaagaatcaggaaaacataagctcagtcaagtatacacaagatcacaaacagatgaaaggacgtcctagtctgatcctggacactcccgccatgagacacgtgaaagaagctcagaatcatattagtatggtcaagtaccatgaagacttcgagaaaactaaaggccgaggattcaccccagttgtggatgatcccgtaacagagcgtgtcagaaagaatacacaggtggtgagtgacgccgcctataagggagtacacccccacatcgttgaaatggaccggaggcctgggataattgtggatttgaaggtatggcgtacagacccaggttccatatttgatcttgaccctctcgaggacaacatccaatcccggtctctgcatatgctttcagaaaaggcctcccactatagacggcactggagcagaagccacagtagctcaacatttggcactggtctcggagacgacagaagtgagatctccgaaatctacccctcctttagctgttgttcagaggtcacccggccaagtgacgaaggggcacccgtcttgccaggcgcctaccaacagtctcatagtcagggatacgggtacatgcatcaaacctcggtttcctccatgagaagcatgcagcactcaccaaatttgcggacttacagagcaatgtacgactacagcgcccaggatgaagacgaggtgtcgtttcgtgacggagactacattgtcaacgtacaaccaatcgacgacggttggatgtatggtaccgtgcagcgtacgggccgtaccggcatgctacccgccaactatatcgaatttgtgaactag

SEQ ID NO: 196717 - DNA, 711 bp, Artificial Sequence
  Description of Artificial Sequence: Synthetic coding sequence
atgctgcacttctactacgagtggctgcacagcggcagccggggcgctgtgcccaaacccttgcactaccccaaacagtcattcaccaccgttgcagacacccccgaaaaccttagactgaagcaacagtctgagttacaaagccaggtgaaatataaacgcgacttcgaggagtccaaggggcgtggattctccatcgttactgacacacccgagctgcagcgactgaagcgcactcaggaacagattagtaatgtgaaataccacgaagattttgaaaaaactaagggccgcggttttaccccggtcgtcgatgatcctgttaccgaacgggtgagaaaaaacactcaggtcgtcagtgatgctgcctacaagggcgttcatccccacatcgtcgaaatggaccgccggcctggtatcattgtggcgcccgtgctgcctggtgcttaccagcagtcccactcccaaggctacggttacatgcatcagactagtgtgtcttccatgaggtcaatgcagcattccccaaatttgagaacctacagagctatgtacgattactccgctcaagatgaggatgaagtgagcttcagggacggagactacatcgtgaatgtccagcccattgacgacggttggatgtatggtacagtacaaaggaccggccgcaccggcatgctgccagctaattacatcgagtttgttaattag

SEQ ID NO: 196718 - DNA, 813 bp, Artificial Sequence
  Description of Artificial Sequence: Synthetic coding sequence
atgaacccccagtgcgcccggtgcggcaaggtggtgtaccccaccgagaaggttaactgcctggacaagtattggcacaagggctgttttcattgtgaggtgtgtaagatggcgctcaatatgaataattataagggctatgagaaaaagccatactgtaacgcccactacccaaagcagagttttacgacggttgcggacactcccgagaacttacgtctgaaacagcagagcgagttacagagccaggtgaaatataagagagatttcgaagagtccaaaggaagaggcttttcaatcgtcacagacacaccagaactgcagcgcctgaagcggactcaagaacagatctctaatgtgaagtatcacgaagattttgagaaaaccaagggacgaggcttcaccccggtggtagacgacccggttacggaaagagtgcgcaagaacactcaagtcgtgagtgatgcagcgtacaagggggttcacccgcacatcgtggaaatggaccgccgtcctggaataattgtggctcctgtccttccgggcgcttaccagcaaagccattctcagggatatggttacatgcaccaaacctcggtgagcagcatgcgctccatgcagcatagtccaaacttgaggacatacagggccatgtacgattacagcgcacaggatgaagacgaggtgagtttcagagacggcgattacatcgtgaacgtgcagccaatcgatgacgggtggatgtatggaacagtccaacgcacaggtcggactggaatgcttcctgccaattatatcgagtttgttaattag

SEQ ID NO: 196719 - DNA, 354 bp, Artificial Sequence
  Description of Artificial Sequence: Synthetic coding sequence
atgcggaacaactgcaccgccagcctgatgaaggtgttctacaagcccgtcatcgaggacctgagcatggagttggcgcgaaagtgtaccgagctgattagtgacattaggtacaaagaggagtttaaaaagagcaaagacaagtgtacctttgtgaccgattcccctatgctgaatcatgtgaagaatatcggggcatttatctcagaagcgaaatacaagggcaccattaaggcggacctgtcaaactcactatacaagaggatgcctgctactattgacagtgtcttcgccggcgaagtgacccagctgcagtccgaggtggcgtataagcagaaacacgacgccgcttag

SEQ ID NO: 196720 - DNA, 20010 bp, Artificial Sequence
  Description of Artificial Sequence: Synthetic coding sequence
atggccgacgacgaggactacgaggaggtggtggagtactacaccgaggaggtcgtgtatgaggaggtcccgggcgaaacaattactaaaatttatgagaccactacaacccggacctccgactacgagcagtctgaaacttctaagcctgccctcgcccagccagctctcgcccagcctgcgtcggcaaagcctgttgagcggagaaaagtgataaggaagaaagtcgacccaagtaaattcatgaccccctatatcgctcactcccagaagatgcaggacctgttctctcccaacaagtacaaggagaaatttgagaagaccaaagggcagccctacgccagcaccaccgataccccagagttacgaagaatcaaaaaggttcaggatcaattatcggaggtgaaataccgcatggacggcgacgttgccaaaactatttgtcatgttgacgagaaagcgaaggatatcgaacacgccaagaaagtaagccaacaggtaagcaaggttctctataaacagaattgggaagacacaaaagataagtaccttctgcctcccgatgcgcccgagctggtccaggccgtgaagaatactgccatgttttctaagaagttgtacaccgaagactgggaggcagacaagtctcttttttacccgtataacgacagtccagagctccggagagtggcacaggctcaaaaagctctctctgatgtggcttacaagaagggactcgcggagcaacaagcccagttcacaccactggctgatcctcctgacattgaattcgccaagaaagtcaccaaccaggtctcaaagcagaagtacaaggaggattacgagaataagatcaagggtaagtggagcgagacgccctgtttcgaggtggccaacgcacgaatgaacgcggataatattagcactcgcaaatatcaggaggactttgaaaacatgaaggaccaaatatacttcatgcagacagagacaccagaatataaaatgaacaagaaagctggcgttgcagccagtaaagtcaaatataaagaagattacgagaagaacaaaggtaaggctgattataacgtgctgccggccagcgagaaccctcagctgaggcaactcaaggcagcgggagatgctctctctgacaagctatacaaggagaactacgagaagacgaaggctaaaagcataaactactgtgaaaccccaaagtttaagctggacactgtgctgcagaactttagcagcgataaaaagtataaagactcatacctgaaagacattcttgggcactacgtgggctccttcgaggatccttatcactctcactgtatgaaagtaacagcacagaattccgataagaattacaaggctgaatacgaagaggaccgtggcaaggggttctttcctcagaccattacgcaagagtacgaagccattaaaaaattagatcagtgtaaggaccatacgtacaaggttcatccggataaaacaaaatttacccaagtcaccgactcccctgtgctcctgcaagcacaggtgaactcaaaacagctctccgacctgaattacaaggcgaagcacgaatctgagaaattcaaatgccatattcctccagacacccctgcctttatccagcacaaggttaatgcctacaacctttctgataacctctacaagcaagactgggaaaagtctaaagcgaaaaagtttgacatcaaggtggacgcaatccccctcctggctgccaaggctaacacaaagaacacttctgatgttatgtataaaaaggactatgagaagaataaggggaagatgatcggcgtgctatccattaatgatgaccctaaaatgcttcattcccttaaagtcgccaagaaccagtcagacagactctataaggaaaactatgagaaaaccaaagctaagtcaatgaattattgcgagactcctaagtaccaattggacacccagttgaagaacttcagtgaagctagatacaaggacctctatgtgaaagatgttctcgggcattacgtgggctcgatggaggacccctaccatacacattgtatgaaggtcgcggctcagaatagcgacaaaagctacaaagccgaatacgaagaagataagggaaagtgctacttcccacagactatcacacaagaatatgaggcgattaaaaaattagaccaatgcaaagaccatacctacaaggtgcatccagacaaaacaaagtttaccgccgttacagattctccagttcttctccaagcccagttgaataccaaacagctctcagacctcaactacaaggccaagcacgagggtgaaaagtttaagtgccacattccagctgatgctccacagttcattcaacaccgggtcaatgcgtacaatctatccgataacgtgtacaagcaggactgggagaagtctaaagccaagaaattcgatataaaagttgatgccataccgttgctggccgctaaagcaaatactaagaacacctcggatgttatgtataagaaggactatgaaaagtcaaagggcaaaatgattggcgccctgtcaattaacgatgatccgaagatgctgcattccttaaaaacggcgaaaaaccagtcggaccgtgagtaccgaaaggactacgagaagagcaaaaccatctataccgccccacttgacatgctgcaggtgactcaagccaagaaaagccaggctattgccagcgacgtcgattacaagcatatcctgcacagttacagttaccctcctgacagcattaacgtcgacctggccaagaaggcttatgctctgcaatccgacgtggagtataaagctgactacaattcatggatgaagggctgcggctgggttccattcggttctcttgaaatggaaaaagcaaaaagggccagcgatatactcaatgagaaaaagtaccgtcaacacccagacaccctgaagttcacttccattgaggatgcccctattactgtgcagtcgaaaataaatcaggcgcagcggtctgacatcgcctataaggccaagggggaagagatcattcacaaatacaacctcccaccggatctcccccagtttattcaggctaaagtgaatgcatataatatctcagagaatatgtataaagcagacctgaaggacctgtctaaaaaaggctatgacttgcggacggatgctatcccaatcagggcagccaaggccgcccgccaggctgctagcgatgtgcagtacaaaaaggattacgagaaagcaaaaggtaaaatggtaggcttccagtctctgcaggacgatccaaaacttgtgcactacatgaatgttgcaaaaatccagtcagacagggagtataaaaaagattacgaaaaaaccaagtcaaagtacaacactcctcacgatatgtttaacgtcgtcgccgcgaaaaaggcccaggatgtggtgtcaaacgtaaattacaaacattcactgcatcactacacatacctgccagatgctatggatctggagttgtcgaaaaatatgatgcagattcagtccgataatgtctacaaagaggattacaacaattggatgaaggggatcgggtggattccaatcggtagcctggacgtggagaaggtcaagaaagcaggagacgcactcaatgagaagaaatacagacagcatcctgacaccctgaagtttactagcattgtggacagccctgtgatggtacaagccaaacagaatacaaaacaagttagtgatattttatataaagcaaagggagaagacgtgaaacataaatatactatgtctccagacctgcctcaatttctgcaggctaagtgcaatgcctataatataagcgacgtgtgttacaagagggactggtatgacctcattgccaaggggaataacgtcctgggagacgccattccgatcacagcagccaaggccagtaggaacattgcatcggactacaagtacaaagaggcgtatgagaagagcaaaggtaaacatgtgggttttcgaagtctccaggacgaccctaagctggtgcactatatgaacgtcgctaagctgcagagtgaccgggagtataagaaaaattacgaaaatacaaaaacctcctaccatacacccggggatatggtaagtatcacagccgcgaagatggcacaggacgtagccaccaacgttaattacaagcagcctctacaccactatacttaccttccagacgccatgtctctggaacacacccggaatgtgaatcagatccagagcgacaatgtctataaagacgagtacaactcctttcttaagggcatagggtggatccctatagggtcactggaagtggagaaggtcaaaaaggccggggacgccctcaatgagagaaagtacaggcaacacccggatactgtaaaatttacatctgtgcccgacagcatgggtatggtgctagcgcagcataatacaaaacagctgagtgatctgaattataaagtagaaggagagaaactgaagcacaagtacaccatcgatcctgaactgccgcagttcatccaagccaaggtcaacgcgctcaacatgagcgacgcccattacaaagctgattggaagaaaacaattgccaaggggtatgatcttcggcccgacgccatccccatcgtggccgccaaatcaagccggaatattgcatctgactgcaagtacaaggaagcgtatgagaaggccaagggtaagcaggtgggctttctctctcttcaagatgaccctaagcttgtgcactacatgaatgtggcaaagatccagtctgaccgcgagtataaaaagggctacgaagccagtaagactaaataccatactcccttggacatggtcagcgtaactgcagccaagaagagtcaggaggtcgctaccaatgctaattaccgccagtcataccatcactacacgctgctaccagacgcattgaacgtagaacactcacgtaacgctatgcagatccagagcgataacctgtacaaatctgatttcacaaactggatgaagggtataggttgggttccaatcgagtctctggaggtcgagaaagccaagaaggcaggagagattctgtctgagaaaaagtatcgacagcaccctgaaaagcttaaatttacctatgctatggatactatggagcaggccctgaataaatcgaacaaattgaacatggataaacggctttacaccgaaaagtggaataaggacaagacgactatccatgtcatgccagatacccccgacattttactgagtcgggtaaaccagatcacgatgtcggacaagctgtacaaggccgggtgggaggaagagaaaaagaaagggtatgatttgaggcctgacgctatcgctatcaaagcggccagagccagtagggacatagcctcagattacaagtataaaaaggcctacgagcaagcaaaggggaaacacattggatttaggtcgcttgaggatgatccaaaactggttcattttatgcaagtggccaaaatgcagtccgatcgcgagtataagaaagggtacgagaagagcaagacaagtttccacacacccgttgacatgctctcagtagtcgctgccaagaaatcccaggaagtggcaaccaacgctaattacagaaatgtgatccacacttataatatgcttcccgacgcaatgtctttcgagctcgcgaaaaatatgatgcagattcagtcggataaccagtacaaggccgactatgcagactttatgaagggcattggctggctgcctctcggaagtctcgaagctgagaagaacaagaaagctatggagataatctctgaaaagaagtataggcagcacccagacaccctgaaatactcgaccctcatggacagcatgaacatggtgttagcacagaacaatgctaaaataatgaatgagcatctgtacaaacaggcctgggaagcagacaagaccaaggtgcacataatgcctgacattccgcagataattctggccaaggcgaatgcaattaacatgtccgataagctgtacaagttgtccctggaggagagcaagaagaaggggtacgaccttaggccggacgctattcccattaaggcagccaaagcaagcagggatatcgcctccgactataagtataagtataattacgagaaaggtaaaggcaagatggttgggtttcggtcactcgaagatgatccaaagctggtccacagcatgcaggttgcaaagatgcaaagtgatagagaatataaaaagaattatgaaaataccaaaacatcctaccacacccccgctgacatgttaagtgtcacagctgcaaaagatgcacaggccaacataaccaacacgaattataaacatctgatccacaagtatatactgttgccagatgcaatgaatattgaacttactaggaacatgaaccgaatccagagcgataacgaatacaaacaggattacaatgaatggtacaaaggcctggggtggtccccagccgggtccctggaggtggaaaaagccaagaaagccacggagtacgcttcggatcagaaatacagacaacaccccagcaattttcaattcaaaaaactaacggactctatggatatggtgttagccaaacagaacgcccacaccatgaataagcacctttatacaattgactggaataaggacaagacaaaaattcacgttatgccggatacaccggacatcctgcaggctaagcagaaccagacgctgtactcccagaaattgtataagctgggctgggaagaggcgttaaaaaagggttatgatctgcctgtggacgctatctcggtgcagttagccaaagcaagccgcgatatagcctccgactacaagtacaagcaggggtatcggaaacagctaggccatcacgttggctttaggtctctgcaggacgatcctaagctcgtgctgagcatgaacgttgcgaaaatgcagagcgagagggaatacaaaaaagattttgagaaatggaaaacaaagttcagctctcctgtggatatgctaggggttgtgttggccaagaagtgtcaggagctcgtaagcgacgttgactataaaaattatctccatcagtggacatgtttgccagaccagaatgacgtggtgcaggccaagaaggtttatgagctgcagagcgagaacttgtataagagtgacctggagtggttacggggcattggctggagcccgcttgggagtttagaggcagagaaaaacaagagggcgtctgaaattatttcagaaaaaaaatatagacagccacctgatcgtaataaatttacatctataccagatgcgatggacatcgtgctagcaaaaactaatgccaaaaataggtccgatagactttacagagaggcttgggacaaggacaaaactcagattcatattatgccagatactccggatattgttcttgctaaagcaaatttgatcaataccagtgacaaattgtaccggatgggctatgaagagttgaagagaaagggctacgatttgcccgtggatgcaattcctatcaaggcggcaaaggccagccgagagattgcatccgagtacaaatacaaggaagggttccgtaagcaattgggtcaccatattggggctcgcaatatcgaagacgatcccaaaatgatgtggagcatgcatgtggctaaaatccagtccgaccgcgagtacaagaaagattttgagaagtggaagacaaagttctcctctccagtggatatgctgggcgttgtcctggccaagaaatgccaaactctcgtgagtgatgtcgattataaaaattatctgcaccaatggacttgcttgcccgaccagagtgacgtcatccacgcaagacaggcgtatgacctccagtccgataatctgtataagtcagatttgcaatggttaaaaggtataggttggatgacgtccggttcactcgaggatgaaaagaacaagagggctacacagatccttagcgaccacgtctaccgccaacaccctgaccagtttaagttctcctccttgatggattccattcccatggtgttggcgaagaataacgccataacaatgaaccaccggctctacaccgaggcctgggataaagataaaaccactgtccacataatgccagacacgcccgaggttctcctggccaaacagaacaaggtcaattactctgagaagctgtataaattaggattagaagaggccaaaagaaaagggtacgacatgagagtggatgcaataccaattaaggccgctaaagccagccgcgacattgcgagtgagtttaagtataaagagggctatcgtaaacaactgggccaccacattggggctcgcgccatacgcgatgatccaaagatgatgtggagcatgcacgttgctaagatccagtctgatagagagtacaaaaaagatttcgaaaagtggaagactaagttttcgtccccagttgatatgctgggtgtggtcctcgccaaaaaatgtcagaccctcgtctccgacgttgactacaagaattatctccaccagtggacttgtctcccagatcagagtgacgtcatccacgcccgccaggcttatgatctgcagtctgacaacatgtataagagtgatctccaatggatgagaggtattggatgggtgtctatcggatcacttgatgtcgaaaaatgtaaacgggctacagagatcctctcagacaagatttatcgccagcctcctgatcgctttaagttcacatcagttactgacagccttgagcaggtgctggctaaaaataacgcaatcacaatgaacaagcggctgtacacggaggcatgggacaaagataagacacagattcatattatgcccgatacacccgagattatgctagcccgccagaataagattaactacagcgagaccctgtataagctcgccaacgaggaggctaagaaaaaggggtacgacctgaggtctgacgccatcccaatcgtggcggccaaggcctctcgggacgtgatctctgactataaatacaaagatgggtaccggaagcagcttggacaccacattggcgcccggaacatcgaggacgatcctaaaatgatgtggtccatgcatgttgccaagatccagtccgatcgcgagtataagaaggatttcgagaagtggaaaacaaagttctcttctcccgtcgatatgctaggcgtggttctggctaaaaagtgccaaacactcgtctcagatgtagattataagaactacctacatgagtggacttgtcttcctgatcagaatgatgtaattcatgctcgccaagcatatgacctccagagcgataatatctataagtcagacctccagtggctacgcgggattggctgggtaccaattgggtccatggatgtagttaaatgtaagcgagcagccgaaatcctgtcggacaacatctatcgtcagccgcccgataagctcaaatttacctctgtgaccgattccctggagcaggtgctagctaaaaacaatgcgttgaacatgaacaagcgtctttacactgaagcttgggacaaagataagactcaggtgcacatcatgccggacacaccagagattatgctcgcacgtcaaaacaaaatcaactattcggagtccttgtataggcaggccatggaggaggctaaaaaggaggggtatgatctacgcagcgacgctatcccaatagtggcggccaaagcttcccgtgacattgcatccgactacaagtataaggaagcatatcggaagcagctcggacaccacattggtgcacgagcagtgcacgacgacccaaaaatcatgtggtcacttcacattgctaaggtgcagtctgatcgcgaatacaaaaaggactttgaaaagtataaaacccggtatagcagccccgtcgacatgctggggatagtgctggcaaagaaatgccaaacattggtttccgatgttgactataagcacccgctccatgagtggatctgtttacctgatcaaaatgatatcatccacgcccgcaaggcttacgatctgcagtctgataacttgtacaagagcgacttagaatggatgaagggcatcggatgggtgcccattgattctctcgaagtggtgagagccaaaagggccggggaattgctaagcgatactatctaccggcagaggcccgagacactgaaatttacctctataaccgataccccagagcaggtgctcgcaaaaaataatgcgctgaatatgaataaacggctctatactgaggcatgggataatgataagaagacaattcacgtgatgcccgacacgccggagattatgctcgccaagctgaatagaatcaattattccgacaagctctacaaactggccctggaggaatctaagaaggaaggatacgacctacgtcttgacgccatcccgattcaggccgctaaagccagccgagatattgcttccgattacaagtacaaagaaggataccgtaaacagttgggccaccacattggtgcccggaatataaaggacgaccctaagatgatgtggtcgatccatgttgcaaaaatccagagtgacagagagtacaagaaggaatttgaaaagtggaagaccaagttcagcagccccgtcgacatgctcggtgtagtgcttgctaaaaaatgccagattctcgtctctgacatcgactacaaacatccactgcacgagtggacctgtctgcctgaccaaaatgacgtaatccaggcccgaaaggcatacgatttacaatctgacgccatctacaagtcagatctggagtggctccgaggaatcggatgggtgccgatcgggagtgttgaggtggaaaaggtaaagagggccggagagatcctgtccgatcggaagtacagacagccagcagaccaacttaagttcacctgcattaccgacacccctgagattgtactggcgaagaacaacgcccttacaatgagcaagcacctctataccgaggcctgggatgcagacaaaactagtatacacgtgatgccggatacacccgatatcctgttggcaaagtctaattcggcgaatatttcacagaaactgtacactaaaggttgggacgagtcgaaaatgaaagactacgacctccgcgccgatgccatttctatcaaatcagctaaggcaagccgggatattgcctccgattacaaatataaggaagcctacgaaaagcagaagggccatcatattggagcccagtctatcgaagacgacccgaaaatcatgtgcgccatccatgctgggaagatccagagcgagagagagtataagaaagaattccagaaatggaagacaaagttcagctctccagtcgatatgttaagcattctcttggcaaagaagtgccaaacactggtcactgatattgactatcggaactacctgcacgagtggacgtgtatgcctgaccagaatgatattatacaggctaaaaaggcctatgacttgcagagcgacgcgttatacaaggcagatttggagtggcttcggggcatcggttggatgccacagggctccccagaagtccttcgagtcaaaaatgctcagaatatcttttgcgactctgtgtatagaactcccgtggtgaatctgaagtacacttccatagtcgatacacctgaagtcgtcctcgccaagtcaaacgccgagaatatctctattcctaagtaccgcgaggtgtgggacaaagacaaaacaagcattcatatcatgcctgataccccagagattaacctcgctcgcgctaacgccttgaatgtgtccaataaactgtaccgcgagggttgggacgagatgaaagccggctgtgacgtgcgcttagacgctatccccattcaggcggctaaagcaagccgtgaaatagcttccgactataaatacaagttagatcatgagaaacagaagggccactacgtaggaactttgacagcccgcgatgacaataagatccgatgggccctgattgctgacaaattacagaacgagagagagtatcggctggactgggccaaatggaaggccaaaatccagagcccggtggatatgctcagcatcctgcatagtaagaacagccaggccttggtcagcgacatggactatcggaattacctgcaccagtggacttgcatgcctgaccagaatgatgtgatccaggccaagaaagcatacgaactccagtccgataacgtgtacaaggcagacctggagtggttacgaggtataggctggatgccgaatgatagcgtgtccgtgaatcacgccaagcacgcagcggatatcttcagcgagaagaaataccgaaccaagattgaaaccttgaatttcactccagtagacgatcgcgtcgattacgtcaccgccaagcaatccggagaaattctggacgacataaagtacaggaaggattggaatgcgactaaatcaaagtacacactcacggagactcctcttcttcacactgcacaggaggccgcaagaatcttggaccagtacttgtataaagaagggtgggaacgtcagaaagcaactgggtacatcctcccaccagacgccgttccttttgtgcacgcacaccattgcaacgacgttcagtctgagctcaagtataaagctgagcacgtaaaacagaaaggacattacgttggggtgcctacaatgcgtgacgaccctaagttagtgtggtttgagcatgccggtcaaattcaaaatgagaggctttacaaagaggactaccataaaaccaaggctaagatcaatattccggccgatatggtcagtgtcctggcagccaagcagggacagacactggtcagcgatatcgactatcgtaactacctccaccagtggatgtgccacccggatcagaacgacgtaattcaggccaggaaagcgtatgacctgcagtcagacaacgtgtaccgcgctgatctggaatggctccgtggaatcgggtggattccactcgattcagtagatcatgtaagggtgaccaaaaaccaagagatgatgagccagattaaatacaagaaaaacgctctcgaaaattatcccaatttcaggtcagtggtagatcctccagaaatcgtcctggccaagataaattctgtcaatcagagtgacgtcaagtataaagagaccttcaataaggctaaaggcaaatacactttctcgccagatactccacatattagccacagcaaagacatggggaagctctacagcaccattctgtacaaaggtgcatgggaggggacaaaggcgtacggatacactctggacgaacggtacatcccaatagtcggggcaaagcacgcggacttagtcaactctgaactgaaatacaaggagacttatgaaaaacagaaaggccattatctcgccggcaaggtcatcggagaattccccggcgtggtccactgcctcgattttcagaaaatgaggtctgcgctgaattatcgaaagcattacgaagataccaaagccaacgtccatatcccgaatgatatgatgaaccatgtcttagcaaagcggtgtcagtatatcctcagtgacttagagtacaggcactattttcaccagtggaccagcctgctggaagaacccaacgtgatccgagttagaaatgcccaggaaatattaagtgacaacgtatacaaggatgacctgaattggctgaaagggattggatgttacgtgtgggacacgcctcaaatcctgcatgccaaaaaatcttatgacctccagagtcaactccaatacaccgcagctggcaaggagaatctgcaaaactacaatttggtcaccgatacgcctctgtacgtaaccgctgtgcagtccggtatcaacgcaagcgaagtaaagtataaagaaaactatcatcagataaaagacaaatacaccacggtgctggagacggttgattacgatcgaaccagaaacttgaaaaacttatattcctcaaatctctacaaagaagcttgggaccgggtgaaagccacatcctatattctccctagctctacgttatcactgacacacgccaagaatcagaagcacctggcgtctcacatcaaatatagggaggagtatgagaagtttaaagcgctgtacaccctacccagatcggtggatgacgatcctaataccgccaggtgcctcagggtcggcaagctgaacatcgatagactctatcggtcagtttacgaaaaaaataagatgaaaatccatattgtccccgacatggtcgagatggtgactgctaaggattcacaaaagaaggtttcagagatcgactatcgcctgcgactccacgagtggatttgccacccagacctccaggttaatgaccatgtgcggaaagtgactgaccagatcagcgacatcgtgtataaagacgacctgaattggttgaagggcattggatgctatgtgtgggacactcccgagattttgcatgcgaagcatgcctacgacctaagggatgatatcaaatataaggctcatatgctaaagacacggaacgattataagttggttaccgacactcctgtctacgtgcaggcagtgaagagcggaaagcagctctccgacgctgtctaccactacgattatgtacactccgtgcggggtaaagtcgcccccaccactaagaccgtggacttggaccgcgcactgcacgcttataagctgcagtccagtaacttgtacaagacctctctccgcacgttacctaccggatataggctgcccggcgatactccacattttaaacatatcaaggatacccggtacatgagttcgtatttcaagtacaaggaggcctatgagcacactaaggcttacggctacactctcggccctaaggacgtcccgtttgttcacgtgaggagggtgaataatgtcactagtgagcggctgtatcgcgagctgtaccacaaactaaaagataagattcatacaactcctgataccccagagataagacaggtgaaaaaaactcaagaggccgtgtcagaactaatttacaagtccgacttctttaagatgcagggacatatgattagcttgccttacactccacaggtgattcattgccgatacgttggagacattacctcggatatcaagtacaaggaagacttacaggtgcttaagggtttcggatgtttcctatacgataccccagacatggtacggtcacgacacctccgcaagctgtggtctaactacctgtataccgataaagcgcggaagatgagggacaagtacaaggtagtgctggatacccccgagtatagaaaagtgcaggagctgaagacccacctctccgagcttgtctaccgggcagcaggaaaaaagcagaaaagcatcttcacgtcagtgcctgacacccccgatctcctaagagccaagcggggacagaagctacagtcacagtacctttacgtagaactggccacgaaggaacgcccgcaccaccacgcgggaaatcagactaccgccctgaagcacgctaaagatgttaaggacatggtctctgaaaaaaagtacaagatccaatacgagaaaatgaaagataagtatacccctgtgcctgacacacccattcttattagagccaagagagcctattggaatgcatccgatctccgatacaaagagacatttcagaagaccaagggtaagtaccacaccgttaaagacgccctcgacatcgtgtatcatagaaaagtcaccgatgacatcagcaagatcaagtataaagagaattacatgagccaactggggatctggcggtccattccagataggccggaacacttccatcacagggcagtgacagataccgtgagtgacgtaaaatataaggaagatctcacctggctgaagggcatcgggtgctacgcatatgatactccggactttacactggctgagaagaataagactttatactctaagtacaagtacaaggaggtgttcgagcggactaagagtgacttcaagtacgtggcggattcccctatcaatagacatttcaagtacgctacacagctgatgaatgagaaaaagtaccgggcagactatgaacaaaggaaggacaaataccaccttgtggtagatgagcctaggcacttgctggccaaaacagccggagatcagatctcccaaattaagtaccgaaagaactacgagaaaagcaaggacaaatttacttccattgtcgatactcctgagcaccttaggactaccaaagtcaataagcagattagtgatattctctataagctggaatataacaaggccaagcctcgcggctacaccactatccatgatactcccatgctgttacacgtcaggaaggtaaaggatgaagtttcggatcttaagtacaaagaagtgtaccagaggaacaagtctaattgcaccatagagcccgacgctgtgcacataaaggcagccaaggacgcttataaggttaataccaacctggactataaaaaacaatacgaagctaacaaagcccattggaaatggacgcccgaccgtcctgatttcctgcaggcggctaaatcttcgctgcagcagagtgattttgagtacaaacttgacagagaatttctgaagggatgcaaactaagcgttacagatgataaaaacactgtgctcgccctgagaaacacattgattgaatcggaccttaagtataaggaaaagcacgtgaaagaaagagggacctgccatgcagttcctgacacaccccagatccttcttgcaaagacggtatctaacctcgtcagcgaaaacaaatacaaggaccacgtgaaaaagcatctcgctcaagggtcctatacgacactgccagagactcgagatacagtgcatgttaaagaagtcacgaaacacgttagcgacacaaattacaagaagaaatttgtcaaagaaaaaggaaaatccaactatagcatcatgctggaacccccggaagtaaagcacgcaatggaggtggcaaagaaacagtcagatgtggcctatcgcaaggacgctaaggagaacctgcattataccacagtggctgacaggccagatattaagaaggctacccaggcggctaagcaggccagcgaagtggagtacagagcaaagcacagaaaagaaggctcccacggactgtcaatgttggggagacccgacattgagatggccaagaaagccgcaaagctcagttcccaggtcaagtaccgtgaaaatttcgacaaggaaaaagggaaaacccctaaatataatcctaaggactctcagctgtacaaagtcatgaaagacgctaacaaccttgctagcgaggtcaaatataaagcagaccttaaaaagctccataagcccgtgactgacatgaaggagtctttaattatgaaccacgtgctgaacacaagtcaactcgctagcagctatcagtataaaaaaaagtatgaaaagtctaagggacactaccacactattcctgataatctcgaacagctccacctgaaagaagcaacagaactccagtccattgtaaagtataaggagaagtatgaaaaagagcggggcaaaccaatgctggactttgaaactcctacttacattactgccaaagaaagccaacagatgcagtcaggcaaggaatatcgtaaggactacgaagaatccataaagggccgcaatctaacaggacttgaggttactcctgccctactgcatgtcaaatatgctacaaagattgcatcggaaaaggagtacaggaaggatttggaggaatcaatccgcggcaagggtttgactgaaatggaagatacccctgacatgctccgggcgaaaaacgcaacccaaatacttaacgagaaggagtacaaacgcgatttggagcttgaagtgaaaggccggggtctcaatgccatggctaatgaaactccagattttatgagggcaaggaacgctaccgatatcgcgagccagatcaagtataagcaatcagctgaaatggaaaaagcaaatttcacttcggtagtggacacccctgagattattcatgctcaacaggtaaaaaatcttagcagtcagaaaaagtataaggaagacgcagaaaagtccatgagctattatgaaactgttttagacacaccagaaatacagcgcgtccgcgaaaatcaaaaaaactttagtctgctgcagtatcagtgtgacctcaagaactcaaagggtaaaatcaccgtggtgcaggataccccagagatcctccgcgtgaaggaaaatcagaaaaatttttcttctgttctatataaggaagatgtgtctcccgggactgcaattggcaaaacacccgagatgatgcgggtgaaacagacacaagatcacatctcgtccgtcaaatacaaggaagctattggccaggggactcctatcccagacttgcctgaagtgaaacgcgtaaaggagacacagaagcacatctcatccgttatgtacaaggagaatctcgggacaggcatccccaccacagtgaccccagaaatcgagagggtgaaacggaatcaagagaatttcagttccgtgctgtacaaagagaatctgggaaaggggatcccgacgcccatcacccccgagatggaaagggtaaagagaaatcaggagaacttctcaagcgttctgtataaggaaaatatgggaaaagggacccccctcgctgtgacgcccgagatggaaagagtcaagcacaaccaagaaaacatttcgtcggtactgtataaggagaacgtgggaaaggccactgctacccccgtcacccccgagatgcagcgagtaaaaaggaaccaggagaacattagttcagtgctatataaggagaacctcggcaaagccacgcctactccctttacccctgagatggagagagtgaaacgcaaccaggagaacttttcgtccgttctatacaaggaaaacatgagaaaagccacacccaccccggtgacccctgaaatggagcgggcaaagagaaaccaggagaacatcagctcggtcctgtatagtgattcgtttagaaagcagattcaaggtaaagctgcttatgtgctagacacacctgagatgagacgggtgcgggagacccagcggcatattagtactgtgaagtatcacgaggatttcgaaaagcataaaggctgctttacccctgtcgtgaccgacccaataactgagagggtgaaaaagaacatgcaggacttttcagacataaactaccgaggcatccagaggaaggttgtcgagatggagcagaaacggaatgatcaggatcaagaaacaatcaccggcttaagagtctggcggacaaacccgggcagcgtttttgactatgatccagcagaggataatattcagtctcgctccctacatatgattaatgtgcaggcccagaggagatctcgtgaacagtcacggagcgccagcgccctatcaatcagtggcggtgaggagaagtccgagcattcagaggcgccagaccaccatctgtcaacttatagcgacggaggtgtctttgccgtctccactgcctacaaacatgccaagaccaccgagttgcctcagcagagatccagctctgttgcgacgcagcaaaccacagtcagtagcattccgtcccatcccagcacagccgggaaaatctttcgggctatgtatgattacatggccgcggacgcggacgaagttagctttaaggacggagatgccattattaacgtgcaggcgatcgacgaaggatggatgtatggcaccgtgcagcgaaccgggaggaccgggatgctgcctgctaactatgtcgaggcgatatag

SEQ ID NO: 196721 - DNA, 1503 bp, Artificial Sequence
  Description of Artificial Sequence: Synthetic coding sequence
atggagcgggtgaagcggaaccaggagaacttcagcagcgtgctgtataaagaaaacctgggcacgggaatccccatcccgatcactccagaaatgcagcgcgtaaaacacaatcaggaaaatctgtcttccgttctttataaggagaacatgggaaaggggacaccactgcccgtgaccccagagatggagagggtgaagcataaccaggagaacatctctagtgtcttgtataaggaaaatatgggcaagggaaccccgttgcccgttaccccagaaatggagcgcgtcaaacataaccaggagaatatctccagcgtcttgtacaaagaaaatatggggaaaggtacacctttggccgtcacacctgagatggagagagtgaagcacaaccaggaaaatatttcctctgtcctttataaggaaaatgtcggcaaggcgaccgctactccagtcacaccagagatgcagagagtgaaacgcaaccaggaaaatatctcttctgtgctgtataaggaaaacttgggaaaagccacacccaccccatttaccccagagatggaaagggtgaagaggaatcaggagaacttcagctccgtgctatataaagaaaacatgaggaaagccacccccacccccgttactccagaaatggaacgcgctaaacggaaccaggagaacatcagctccgttttgtactcagactctttccgcaagcagattcagggaaaggctgcttacgtactggacactcccgagatgcgtcgcgtgagagagacccagcgacacatctcaactgtgaagtatcatgaggacttcgagaagcacaaaggatgcttcacaccggtggtaactgacccaataactgagagagtgaagaaaaatatgcaggacttttctgatatcaattatcgcggcatccagcggaaagtggtggagatggagcaaaagcgcaacgaccaggaccaggaaactataaccggtctccgcgtgtggcggacaaaccccggctccgtgttcgattacgatccagctgaggacaacatccagagccggtcccttcatatgatcaacgtgcaagcccaacgacgatccagggagcagagcaggagcgccagcgccctttccattagtggtggagaagagaagtcagaacacagcgaggccccagaccaccatctgtccacgtatagcgacggaggagtatttgccgtgtctaccgcatataagcacgctaaaaccaccgaattaccacaacagcgatcttctagtgtggctacccagcaaactacagtgtcaagtatccccagccaccctagcaccgccggaaagatttttagagccatgtacgactatatggccgcagacgccgacgaagttagcttcaaggacggggatgccatcatcaatgtccaagcaatcgacgaaggatggatgtacggaaccgtgcaacgcaccggcagaacggggatgcttccggccaactatgtagaggctatttag

SEQ ID NO: 196722 - DNA, 7878 bp, Artificial Sequence
  Description of Artificial Sequence: Synthetic coding sequence
atgcccgacacccccgagatcaacctggcccgggccaacgccctgaacgtgagtaataagttatacagagaaggatgggatgagatgaaggctggatgtgatgttaggctggatgccatcccaatacaggcagctaaagctagccgtgaaatcgccagtgactataaatataagttggaccacgagaaacagaaaggacattatgttggcaccctgacggcccgagacgacaataagattcgatgggccctgatcgcagataaactgcagaacgagcgagagtaccgactggactgggcaaaatggaaggccaagatccagagtcccgttgacatgctcagcatacttcactcaaaaaacagccaggccctggtgagcgacatggactacaggaattatcttcaccaatggacatgtatgcctgaccagaatgacgttattcaggccaaaaaggcatatgagctgcagtcggataacgtgtataaggcagatcttgaatggctcagaggtatcgggtggatgcctaatgactctgtttcagtcaaccacgccaaacacgccgccgatatcttttccgaaaaaaagtataggaccaagatagagactttgaactttacacctgttgacgaccgagttgactacgtgacagccaagcaatctggtgaaattttagatgacattaagtaccgcaaagattggaatgccaccaagagtaaatacactctgacagaaacacccctgctgcacaccgctcaggaagccgcccgcatccttgatcagtacctctataaggagggttgggaacgacaaaaagctaccggttacatactccctcctgacgcagtcccttttgtccacgcgcatcattgtaacgacgtgcaatcagaactaaagtataaagcagaacatgtcaaacagaagggacactatgttggtgtgccgactatgagagacgatccaaagcttgtgtggttcgaacatgcagggcaaattcaaaacgagaggctgtataaggaagattaccacaagaccaaggctaaaatcaacattcccgccgacatggtcagtgttctcgcagctaagcagggacagaccctggtttcagacatcgactatcggaactatctccatcagtggatgtgccatccagatcagaacgatgtgattcaggcgcggaaagcctacgaccttcagagcgacaatgtgtatagagccgacttagagtggctgaggggcatcggttggattcccctggactcggttgaccatgtgcgcgtgacaaaaaaccaggagatgatgagccaaattaaatacaagaagaacgcccttgagaattatccgaacttccgttcagtcgtggatccccccgagattgtactggcgaagattaatagcgtcaatcagagcgatgtgaaatataaggaaacttttaacaaggctaaggggaaatacacgttctctcccgacaccccccacatcagccatagcaaggatatgggcaagctgtatagcaccatcctctacaagggggcgtgggaggggactaaagcttacggctatactctggacgaacggtacattcctattgtgggtgctaagcacgctgatctcgtaaactctgagctgaagtacaaagaaacttacgaaaaacagaaagggcattacctggccgggaaggttattggggaatttccaggggtcgtccactgccttgattttcaaaagatgagatcagccctaaactatagaaagcactatgaggatactaaggctaacgtccatattcccaacgatatgatgaaccacgttctggcgaaacggtgtcagtacatcctaagtgatcttgaatacaggcactactttcaccagtggacctcgttattagaagaaccaaatgttataagggtccggaatgcccaggagatcctttctgataatgtctacaaggacgacctcaattggctgaagggcatcggttgctacgtttgggatacacctcagattttgcacgccaagaaaagttatgacctgcagagccagttacagtatacagctgcaggcaaagagaacctgcagaactataacctcgtgacagacacccctctatatgtgactgccgtgcaatctgggatcaatgcctcagaggtgaaatacaaggagaattatcatcaaatcaaagacaagtacactacggtgcttgaaacggtggactatgatcgcacacgcaatctgaaaaatctgtatagctccaacctctataaagaggcgtgggaccgggtgaaagcaacctcatatattctgcctagtagtaccctgtccctaacacacgctaaaaaccaaaagcacttagcttcccacatcaaatatcgggaagaatacgaaaaattcaaggctctgtatacactccctcggtcagtcgacgacgatcctaacactgccaggtgtctccgagtgggtaagttaaatattgacaggctttatagaagtgtttacgagaaaaacaagatgaaaattcatatcgtgccagatatggttgaaatggtcacagccaaggattcccagaagaaggtgagtgagattgactatcgccttagactgcatgaatggatctgccatccagacctgcaagtgaacgaccacgtgcgcaaggtgacagaccaaatcagcgacattgtctataaagacgacttgaactggctcaaagggatcggctgttatgtttgggatacacctgagatcctgcacgccaagcacgcctacgacctgcgcgacgatatcaaatataaggctcacatgctgaagacaagaaatgattacaaattggtcacagatacacccgtctacgtgcaggccgtgaagtccggcaaacagctgtctgatgctgtgtaccactacgattacgtgcactctgtccggggaaaggtggctcctactactaagacggttgaccttgatcgtgccctgcatgcttacaagttgcagtctagtaatttgtacaagacgagcttgcgaaccctcccgactggctaccgcttgcccggcgacactccacacttcaagcacatcaaggatacgaggtatatgagctcttacttcaagtacaaggaagcctacgagcacactaaggcatatggttacacactggggcctaaggatgtgccctttgtgcacgtgcgacgggtgaataatgttacaagtgagcgactttatcgcgaactgtaccacaagctcaaggataaaatacacaccacccctgatacgcccgagatcagacaggtgaagaaaacgcaggaggccgtgagcgaattaatctataagtccgatttctttaagatgcaggggcacatgataagtttgccatacacaccccaggtcatccactgtcggtacgtgggagacattacatctgatattaagtataaggaggaccttcaagtgctcaaggggttcggctgcttcttgtacgacactcctgatatggtgcgcagccggcatcttcgcaaactctggtcgaattatttgtatacagataaggccaggaagatgcgagataaatacaaggttgtgctcgatactcctgagtacagaaaagttcaggaactcaagacccacttatctgaactggtctatcgagccgcaggaaaaaaacagaaatcaatcttcacatcagtccccgatacccctgatctgttgagggccaagcgcggacagaaactgcagtctcaatacctctacgtggaactggccacaaaggaaaggccacatcatcacgcagggaaccagaccaccgctctgaaacacgccaaagatgttaaggatatggtctcagagaaaaaatacaaaatccagtatgagaaaatgaaggataagtataccccagtgcccgacactcctattctgattagggctaaacgggcatattggaatgcctccgacctgaggtacaaggagacattccagaagacaaagggtaagtatcacacagtgaaagacgccctagacatagtgtatcatagaaaagtcacagatgacatttcaaagatcaaatacaaggagaactacatgtcccagctggggatctggcgctccataccggacagaccggaacactttcaccaccgcgctgtcacagacaccgttagtgatgtgaaatacaaagaagaccttacctggttgaagggcataggatgttacgcctacgacacgcccgattttacactggctgagaagaataaaactctttatagtaaatacaaatacaaggaagtgtttgaacggaccaaaagtgatttcaagtacgtggcagactctcctataaatagacacttcaaatatgcaacgcagctaatgaatgaaaaaaagtatagggccgattacgaacagagaaaagataaatatcatcttgttgtcgacgagccccggcatctgcttgctaagacagcgggggatcagatatctcagatcaagtaccgcaaaaattacgaaaagtctaaggacaagttcacctcgattgtggatacacccgagcatctcaggaccaccaaggtgaataagcagatcagtgatatcctgtataaactggagtacaataaggccaagccacgcgggtatacaactattcacgatactccgatgctgctgcatgtgaggaaagtcaaggatgaggtgtcagacctcaagtataaagaagtgtatcaaagaaacaaaagcaattgtacgatcgaaccggacgccgtccacataaaagcagccaaggacgcctacaaggtgaacaccaacctggactataaaaagcaatacgaagccaataaagcccattggaagtggaccccggaccggccagacttcctgcaagctgccaagagtagcctccagcaaagcgattttgaatacaagttggacagagaattcttaaagggctgcaagctgagcgttaccgatgataagaacaccgtgctcgccctgagaaatacactcatagagagcgatctgaagtataaagagaaacacgtgaaagaacgaggtacttgccacgccgtcccagacaccccccagatcctcctcgctaagaccgtatctaacctggttagtgaaaacaagtataaggatcacgtgaagaagcacctagcacagggctcctacaccaccctgcccgagaccagagacaccgttcacgtgaaagaggttactaagcacgtaagcgatactaattataagaagaaattcgtgaaagaaaagggcaagagcaactactcaatcatgttagagcccccagaagtgaaacatgcaatggaagtcgccaaaaaacagagtgacgtggcttatcgcaaggatgcaaaggagaatctacattatacaaccgtcgctgaccgacccgacataaagaaagctacacaggccgctaaacaggcatccgaagttgaataccgagctaagcaccgaaaggagggtagccacggcctgtccatgttgggccgcccagatatcgaaatggccaagaaggccgcaaaactgtctagccaagtcaagtaccgcgagaacttcgacaaagagaaaggaaaaaccccaaaatacaaccctaaagattcccaactctacaaggttatgaaggatgcgaataatttggcgtcagaagtcaagtataaggcggacctgaagaagttacacaaaccagtcaccgatatgaaagagtcactgatcatgaaccacgtactaaatacgtcccagctcgcgtctagctatcaatacaagaagaaatacgaaaagtctaagggccactatcacaccatccccgataacctcgaacagcttcatctgaaggaggcaacagagctgcagtcaattgtgaaatataaagaaaagtacgagaaggagagaggaaaacccatgctcgacttcgagacacccacctacataacagcaaaagagtctcaacagatgcaatccgggaaggaatatcgcaaggactacgaggaaagcatcaaaggacgaaatctgaccggacttgaagttacaccggccctgctgcacgtgaaatatgccaccaagatcgcctctgagaaggaataccggaaggatctggaggagtctatcaggggaaaggggctgacagagatggaggacacccccgatatgttgcgggcaaagaacgccacccagattctgaacgagaaggagtacaagcgtgaccttgaattagaagtcaagggtcgcggcctgaatgcaatggctaacgaaaccccagattttatgcgggcacgaaacgcaactgacatagcttcacaaattaagtataaacaaagcgctgaaatggagaaggctaatttcacaagcgtcgtggacacaccggaaatcatccatgctcagcaagtcaagaatctttcatctcagaaaaaatataaggaagacgccgaaaagtccatgagctactacgagactgtgcttgacacccctgagatacagagggtaagagagaatcagaagaatttcagcctgctgcagtaccagtgtgacctcaagaatagcaagggcaaaatcacagtagtgcaggatacgccagagatcctgcgagtcaaggaaaaccaaaagaatttcagctccgtgttgtataaagaggatgtgtcacctggcacggccattgggaaaacgccagagatgatgagggtgaagcagactcaagatcatatcagctctgtgaagtacaaagaggccattgggcaggggaccccaatccctgatctgccagaggtcaaaagagttaaggaaacacaaaagcacatctcatcagtaatgtacaaagaaaacctcggcacaggcatccctacaactgtgacaccagagatcgagcgcgtgaaacggaatcaagaaaacttctcctctgtcctgtataaagaaaatatggggaaaggtacaccactgcctgtaacccctgaaatggagagggttaagcacaatcaagaaaacatctcctctgtcctctataaggagaacgtgggcaaggcgaccgcgacccctgtgacacccgagatgcagcgtgtgaagcgaaatcaggagaatatttctagcgtgctatactcagattcttttcggaagcagatccagggcaaagctgcttatgtgctcgatactcccgagatgcgcagggtgagggaaacacagaggcacatttccactgtgaaatatcatgaggattttgagaagcataaaggctgcttcacccccgtggtcaccgatccaattacagaaagggtaaagaaaaatatgcaagacttttctgacattaactatcggggtattcagcgcaaagtcgttgagatggaacagaaacgcaacgaccaggatcaggagactatcaccggacttagggtttggcggactaatcccggctccgtgttcgactatgatccagccgaagacaatatccagtcccggagtctccatatgattaacgttcaggcccagagaaggagccgcgaacagagccggagtgcatccgcattgtcaatcagtgggggcgaggaaaagagcgaacattcagaagcccctgatcatcacctcagcacctatagcgatggcggtgtattcgctgtgtcaaccgcgtacaaacacgccaagacgacagagctcccccaacagcgatccagcagcgtggccacgcagcaaacgactgtcagctccattccctcacacccaagcacagctggaaagatctttcgagccatgtacgactacatggcagcagatgctgatgaggtgtcatttaaggacggagacgctattattaacgtgcaggccattgacgaaggatggatgtatgggacggttcagagaaccggtcgtaccgggatgctgcccgcaaactacgtggaggccatctag

SEQ ID NO: 196723 - DNA, 25578 bp, Artificial Sequence
  Description of Artificial Sequence: Synthetic coding sequence
atggccgacgacgaggactacgaggaggtggtggagtactacaccgaagaggtggtttatgaagaagtgccaggagaaaccattacgaagatctacgaaaccactacaacacggacctctgactatgagcaatccgaaacctcaaagccagcactggctcagcctgcgttggctcagccagcaagcgccaaaccggtcgagagacggaaagtgatccgcaagaaggtggatccaagcaagttcatgactccctacattgcgcacagccagaagatgcaggatctcttcagccctaacaaatataaagaaaagttcgagaagactaagggccagccgtatgcgagcaccacagacaccccagaattgaggcgtataaagaaggttcaggaccagctgagcgaagtgaagtataggatggatggggatgtggccaagaccatttgtcacgtggacgaaaaggctaaagatatcgagcacgcgaaaaaggtgagtcagcaggtgtcaaaagttctttacaaacagaactgggaggacaccaaggacaaatatttactccccccagacgctccggagctggtgcaagcagttaagaacacagctatgttcagcaagaagctgtacactgaagactgggaagcggacaaatcactgttttatccatataatgacagtcccgagctgcgtagagtagcccaggcacaaaaagcactctccgatgtcgcctacaagaaggggttagccgagcagcaggcgcagttcacgcctctagcagacccacctgatatcgagttcgccaagaaggttaccaatcaagtctctaaacagaaatacaaggaagattatgaaaataagataaaggggaaatggtctgaaactccctgctttgaggtcgccaacgccagaatgaatgcagataatatttctacaagaaagtatcaggaggatttcgagaatatgaaggatcaaatatactttatgcagacagagactccggaatacaaaatgaacaaaaaggctggcgtcgccgcttcaaaagtcaaatacaaggaagactacgagaagaacaaaggaaaagctgattataatgtgctgcccgcctctgaaaatcctcagttacggcagctgaaggccgccggagacgctctttctgataaactctacaaagagaattacgagaagacaaaggctaagagtattaattactgtgaaacacctaagtttaagcttgataccgtgctccagaacttttcatcagataaaaagtataaagatagttacctcaaggatattttgggccattatgtggggtcctttgaagatccttatcacagccactgtatgaaggtcactgctcagaatagcgataagaactataaggccgagtatgaagaagaccgaggcaaagggttctttccccaaactatcacgcaagaatacgaggccataaagaaactggaccagtgtaaggatcatacctataaagtgcatcctgataaaactaaattcacccaggttaccgattcccccgttctactgcaggcccaagttaattcaaaacagctctctgatctaaactataaggccaaacatgagtccgagaagttcaagtgccatatcccaccagatacccctgccttcattcaacacaaggtcaatgcatataatctctctgataacctgtacaaacaggactgggaaaagagcaaggctaagaaattcgacataaaggttgatgccatcccactcctcgctgcaaaggcaaacactaagaatacaagcgacgtcatgtataaaaaggattatgagaagaataagggcaaaatgatcggcgtactctccatcaacgacgatccaaagatgctgcattccctcaaagtcgcgaaaaaccagtccgatcgtctgtacaaggaaaactatgaaaagacaaaggctaagagcatgaactactgcgagacaccgaaataccagttggacacacagctcaaaaacttttcagaagcccgttataaagacctgtacgtcaaggatgtgctcgggcactacgtaggctcaatggaagatccctatcacacgcactgtatgaaagtagctgcgcagaattcggataaatcttacaaggctgaatatgaagaggataaaggaaaatgttacttcccccaaactatcacccaagaatacgaggccatcaaaaagctggatcagtgcaaagatcacacctacaaagttcaccctgacaagacaaagtttactgcagtgaccgactcccccgtgttactccaagctcagttgaacacaaaacagctctccgaccttaactataaggccaagcacgaaggcgagaagtttaaatgtcatatacccgctgacgcaccccaatttattcagcatagagttaacgcttacaatctgtcggataatgtgtataagcaagactgggagaaaagtaaagccaagaagttcgatattaaagtggatgcgatcccgctattggccgccaaagcgaacactaaaaacactagcgacgttatgtataagaaggactacgaaaaatccaagggaaaaatgatcggcgccctcagcataaacgacgatcccaaaatgcttcattccttgaaaacggctaagaaccagtcagatcgcgagtatcgaaaagactacgagaagtcgaagacaatctacacagcccccctggacatgctgcaagtgacacaggcaaaaaaatcgcaggcgatagcaagtgatgtggactacaagcacatactacattcttacagttacccaccagattccatcaacgtggatttagcgaagaaagcctatgccctgcagagcgatgtggagtataaggctgactacaactcttggatgaaagggtgcgggtgggtcccgtttggcagcctggagatggagaaagccaagcgggcctccgacatcctaaacgaaaagaagtaccggcagcatccagatacgctgaagtttacctcaatagaagacgccccaatcacggtgcagagcaaaatcaaccaagctcagagaagtgacatcgcatataaggccaaaggagaagaaatcatccacaaatacaaccttccgccggacttgccacagtttatccaagcgaaggtaaacgcgtataatatttcggagaacatgtataaagccgatctcaaggacctaagcaagaagggctacgatttgcggactgacgctattcccatcagagcagcgaaggctgcgagacaggccgcctcagatgtccagtacaaaaaagactacgagaaggccaagggcaagatggtgggcttccaaagtttacaagacgatcctaagcttgtgcattatatgaacgtagcgaaaatacagagtgatagagagtataagaaggattatgagaaaacaaagtcaaagtataatactcctcacgatatgtttaatgtagtcgccgcaaagaaggcccaagacgtggtatctaatgtcaactacaaacacagtctgcaccactacacctaccttcctgacgccatggatctcgagctcagcaagaacatgatgcagatccaatccgacaatgtttataaggaggattacaataactggatgaaaggaatcggctggatccccatcggttcccttgacgtcgagaaggtcaaaaaggcgggagatgctttgaacgaaaagaaataccgtcagcatccagacactctgaagttcaccagtattgtcgacagtcccgttatggtgcaggcaaaacagaacacaaaacaggttagcgacattctctataaggccaaaggcgaagacgtgaaacacaagtatacaatgagcccagacttaccacagtttctccaggcaaagtgcaacgcttacaacatttcagacgtgtgttataagagggactggtacgaccttatcgctaaaggcaacaatgttcttggggacgccatccctatcaccgctgcaaaagccagccgcaatatcgcatccgattacaaatacaaggaggcttatgagaagagcaagggcaaacatgtgggattccggtcccttcaggatgaccctaagctggtccactacatgaacgtagccaagctccagtccgaccgggagtacaagaagaattacgagaatacgaaaaccagctatcacacacctggagatatggtctctatcaccgcagccaagatggcccaggacgtcgcaactaacgtgaattacaaacaaccgctgcatcattatacatacttgcctgacgccatgtcccttgaacatacccgaaacgtgaatcagattcagagtgataacgtctataaggatgagtataacagcttccttaagggcatcgggtggattcccatcggatctttagaggttgagaaggtgaagaaggctggggatgccttaaacgagcgcaagtaccggcagcaccctgatactgtcaaattcacttctgtgcccgacagcatgggtatggtcctggctcagcacaatacaaagcagctgagtgatctaaactacaaggttgagggggagaaactcaaacacaaatacacaatcgaccccgagctgccgcagtttattcaggccaaggtaaacgccttgaacatgagcgacgcacattacaaggccgattggaagaagaccatcgcaaagggctatgacctgcgcccagatgccatccccattgtggccgccaagagttcacgcaacattgcaagtgactgtaagtataaagaggcttacgagaaagccaaaggaaagcaagtgggtttcctctccttgcaggatgaccctaagctggtgcactatatgaatgtcgccaagatccaatccgatcgggagtacaagaaaggctatgaggctagtaaaactaagtaccatacgcccttagatatggttagcgtcacagccgctaagaagagccaggaagttgccaccaatgccaactaccggcagagttaccatcattacacgctactgcccgatgccttgaacgtcgaacactcccgcaatgcgatgcaaatccagtctgataatctgtataagtccgattttacgaattggatgaaggggatcgggtgggtgcctatcgaatctctcgaagtggagaaagccaagaaggctggagagatcctgagtgagaagaagtacagacagcaccccgagaagttgaagttcacatacgctatggataccatggagcaagcgctgaacaaatcaaataaattgaacatggataagcgactatacacagagaagtggaacaaggataagactactatacatgtaatgcccgacacccctgatattttactgtctagagttaaccagattaccatgagcgataagctttacaaagccggctgggaggaggaaaaaaagaagggctacgatttgcgcccagacgcgatcgccatcaaggctgcccgggcctcgagggatatcgccagtgattataaatacaaaaaggcatatgagcaagccaagggtaagcacataggattcaggagtctagaggatgaccctaaattggtccactttatgcaggttgctaaaatgcagtccgatcgggagtacaagaaaggctacgagaaaagcaagactagcttccatacccccgtcgacatgctgtcagtcgtggcagcgaaaaaaagccaggaggtggccaccaacgcaaactacaggaacgttattcacacgtataatatgttgccagatgcaatgtccttcgagctagccaaaaacatgatgcagatccagtcagacaatcaatacaaggctgactacgcagatttcatgaaaggaataggctggctaccccttggcagtctcgaggctgaaaagaacaagaaagccatggagattatctctgagaaaaagtaccgccagcatccggatacactcaagtacagcaccttaatggacagtatgaatatggtgctggctcagaataacgccaagatcatgaacgaacacctgtacaaacaggcctgggaggccgacaagactaaggttcatatcatgccagacatcccacagattattctggccaaagccaacgctatcaacatgtcagacaagttatataaactgtcgctggaggaaagtaagaagaaagggtatgatcttcgcccagacgcaatccctattaaggccgcaaaagcgtcacgcgatatcgcctccgactacaagtacaaatacaattacgaaaaggggaagggcaagatggtgggcttccgctcccttgaagatgatcctaagcttgtccattcaatgcaggtggccaagatgcagtcggacagagaatataagaagaactacgaaaatacgaagacctcctatcatacccccgccgacatgctcagtgttaccgctgccaaagacgcccaggcgaacataactaatacgaattacaagcatctcatccataagtacattttgttgcctgacgccatgaacatcgagctcactcgcaatatgaaccgtatccagagcgataacgagtataaacaagactataacgagtggtacaagggacttggctggtctcctgccggctccctggaggtggagaaagctaaaaaggctaccgaatatgcttctgaccagaagtaccggcagcatccatccaacttccagtttaaaaaactcaccgattcaatggatatggtgctggcaaagcagaacgcccatactatgaataaacatctgtacacaatcgattggaacaaagataaaaccaagatccatgtgatgccagatacaccggatatcctgcaggccaagcagaaccagactctgtattctcagaaactttacaaactcggatgggaggaggcactaaagaaagggtatgacctgcctgtggatgccatatccgtgcagctggccaaagcatccagggacatagcttcagattacaaatataagcaaggatatcgcaaacagctggggcatcacgttggcttcaggtctttgcaggatgatccaaagttggtactctccatgaatgtggctaaaatgcaatcagagcgagagtacaagaaagactttgaaaagtggaaaacaaaattctctagccctgttgacatgctcggcgtggtgctcgccaaaaagtgtcaagaactcgtgagtgacgtagactacaaaaactatcttcaccaatggacttgcctgcctgatcaaaacgacgttgtgcaggccaagaaagtgtatgaactacagagcgagaatttgtataagtccgatctcgaatggctgagagggatcggctggtcgccactaggaagcctggaggcagagaagaataagagagccagcgaaattatttctgaaaagaagtataggcagcctcccgaccggaacaagtttacgtcaattcctgacgctatggacatagttctggcaaagactaacgctaaaaaccggagcgacaggctttaccgggaagcttgggacaaagacaagacacagattcacatcatgccagataccccagatatagtgctggccaaggcaaatttgataaacacaagtgacaaactgtaccgcatgggatatgaagagcttaagcgcaagggatacgatttacctgtggacgcgatccccataaaagcagcaaaagccagcagagaaatcgcctcggaatacaagtataaagagggctttagaaagcagttgggccaccatatcggtgcaagaaatatcgaagacgatcctaagatgatgtggtcaatgcatgttgcaaagatccagtccgacagagagtataagaaggactttgagaagtggaagaccaagtttagctcacctgtggacatgctgggcgtcgttttagctaaaaagtgccagactctcgttagtgatgtggattacaagaactaccttcaccagtggacttgtctgcccgatcagagtgatgtgatacacgctagacaagcttacgatcttcaatcagataacctgtacaaatccgacttacagtggctcaaagggattggctggatgacatcagggagtctggaggacgagaaaaataagagagcaacgcagattctatctgatcacgtgtacaggcagcaccccgatcagtttaagttctcctcactaatggatagcatacccatggtattagccaagaataatgctatcacaatgaaccatagactgtacaccgaggcgtgggataaagacaagacgacagtccacataatgcccgataccccagaggtgttattggctaaacagaataaggtgaactattctgagaagctatataagctggggttagaggaggcaaaacgcaagggctatgacatgagagttgacgcaattcccatcaaagcagctaaggctagcagagatatcgctagcgagttcaagtataaggagggataccgtaagcagctaggacatcacattggagcacgcgctatacgagatgacccgaaaatgatgtggtccatgcatgttgccaagatacaatcagatagggagtataaaaaagatttcgagaagtggaagaccaagttctccagccctgttgacatgctgggagttgtccttgcaaaaaagtgtcagaccctggtgagtgacgtcgactataagaattacctgcaccaatggacgtgcctacccgatcaatccgacgtcatccacgctaggcaggcctatgacctgcagagtgataatatgtataagagcgacctgcaatggatgagagggatcggctgggtgagcattggctccctggatgttgagaagtgcaagcgtgccaccgagatcctgagtgataaaatttatagacagcctcccgaccggtttaagttcacatccgtgaccgactccctggaacaggtcctcgccaagaacaatgctattacgatgaataagagactctatacagaagcatgggacaaggataagacacagatccacatcatgccggacacccctgagatcatgcttgctcggatgaacaaaatcaattatagcgagagcctgtataagctggcaaacgaggaggctaagaagaagggatatgatctgcgatccgacgcaattcccatcgtggccgccaaagcgtcgcgagacatcattagcgactataaatataaggatggatactgtaaacagctagggcaccacatcggggccaggaatatagaagacgatcctaaaatgatgtggagcatgcatgttgccaagatccagagtgacagggaatataagaaggattttgagaaatggaaaaccaagttctcttccccagtggacatgctgggcgtcgtcctggctaaaaaatgccaaaccctagtctccgacgtggactacaagaattacctgcatgaatggacctgcttgccagatcagtcagacgttatacacgcccgtcaagcatatgacctgcagtcagataacatctataaaagtgatttgcagtggcttcgagggataggctgggtgcccatcgggagcatggatgtagtgaaatgtaagagagccaccgaaatcctctccgataacatttatagacaaccgccggataaactgaagtttactagcgtgactgattcattagagcaggtgctagctaaaaacaacgcactcaacatgaataaacgactctatacggaagcctgggacaaagataaaacccagattcacatcatgccagataccccagaaattatgcttgcacggcaaaataagattaattacagcgagactctgtataaactggcgaatgaagaggccaaaaaaaaaggctacgaccttaggagcgatgctattccaatcgtggcggctaaggctagccgtgacgtcatatccgattacaagtataaagacggttaccgcaagcagcttggacatcacattggggctaggaacattgaagatgatcctaaaatgatgtggagcatgcatgtagcgaagatccagagcgacagagagtacaaaaaagacttcgaaaaatggaagaccaaattttcttcccccgtcgatatgctgggggtggtgctcgctaaaaagtgccagacgctggtgtccgacgtggattacaaaaattatcttcacgagtggacgtgcttgcctgatcagaacgacgtgatacacgccaggcaggcctatgatctccaatcagataacatctataaatccgacctgcagtggctccgtggcatcggctgggtccccattgggtcaatggatgtggtgaagtgcaaacgtgctgccgaaatactgtcagataacatctatcgacagccacctgataagctaaaatttacctcagtgaccgactccctcgaacaggtactagccaaaaacaatgcccttaatatgaataaaagactgtataccgaggcctgggataaagacaaaacacaagttcacataatgcccgatacacctgagataatgctggcgcgccagaacaaaatcaattacagcgaatccttatatcgacaggctatggaggaagccaaaaaggaggggtacgatctgcgttccgacgctattcctatcgtggccgctaaggcttctcgcgatattgccagcgactataaatataaagaggcttatcgcaagcaactgggccaccatatcggcgcaagagcagtacacgatgatcccaaaatcatgtggagtttgcatattgccaaggttcagtccgaccgcgagtataaaaaggacttcgaaaaatacaagactaggtacagctcacccgtggacatgttgggaatcgttctagctaagaagtgccagaccttagtgtccgacgtggactacaagcatcccttacatgaatggatctgcctccccgaccaaaatgatataatacacgcgcgtaaggcctacgatctccaaagcgacaatctctacaagagcgacctcgagtggatgaaaggcatagggtgggttcctatagacagcctcgaggttgtgcgcgccaagcgggccggcgagctgctgagcgacacgatttacagacaacggcctgagacactcaaattcaccagtattactgatacacctgagcaggtgcttgctaaaaacaacgcgctgaatatgaacaagcggttatacacggaagcttgggataacgacaagaaaactattcatgtgatgcctgataccccggaaatcatgctagccaaacttaaccgaatcaactatagtgataagttgtacaagctcgccctcgaagaatctaagaaagaggggtacgacctacggcttgatgccattccaattcaggctgcgaaagcctccagggatatcgcaagcgactataagtataaggagggctacaggaaacagctgggccaccacataggtgcaagaaatatcaaagatgaccctaagatgatgtggagcatccacgtggcaaagatacagtccgaccgagaatataagaaagagttcgaaaagtggaaaactaaattttcctcaccagtggacatgctcggcgtggtcttggcaaagaagtgccagatcctcgtgagcgatattgattataagcatccattgcacgagtggacgtgcttacccgaccagaacgatgttatccaagcccgtaaagcttatgacctgcagtcagatgcaatatacaagtccgatcttgaatggcttaggggcattggatgggtgcctatagggtcagtcgaggtggagaaagtcaaacgggcgggggagatactatccgatcggaagtaccggcagccggctgatcagctcaaattcacctgcatcacagacacccctgaaatcgtcttggccaagaacaacgcactaacaatgtccaagcatctgtacaccgaagcatgggacgctgataagacttcaattcacgtgatgcccgatacacctgacattctgcttgccaagtcgaacagcgcaaatatctctcagaaactgtacacaaagggctgggatgagtccaagatgaaggactacgatctccgtgctgacgctatttccattaaaagtgcaaaggcttcccgcgacattgcttcggattataagtacaaggaggcgtatgaaaaacagaagggccaccacatcggcgcacaatccatcgaggacgaccccaagatcatgtgcgccattcacgcaggtaaaattcagagcgaacgagaatacaagaaggagtttcagaagtggaagaccaaattttcctctccagtcgatatgttgtctatcctcctcgccaagaaatgccagactctcgttacggacattgactatcgcaattacttgcacgagtggacatgtatgcctgatcagaatgatattatccaggcaaaaaaggcctacgatctacaatccgacagcgtgtataaggctgacctggagtggctacgcggcattggctggatgccggagggtagcgttgaaatgaacagagtgaaggtcgcacaggaccttgtgaacgagaggttatataggacaagacctgaagccctttcattcacatccattgtggacacccccgaggtggtcctcgccaaggctaactccctgcagattagcgagaaattgtaccaggaggcctggaataaggacaaatcaaatattactataccctcagacacaccagaaatgctccaggcccatattaatgccttgcagatctccaataaattgtatcaaaaagattggaacgacgccaagcagaaggggtatgacattagggccgatgcgatagagatcaaacatgccaaggcttcccgcgagatagctagtgagtacaagtacaaggaaggatatagaaagcaactaggccatcacatgggattccggacactgcaagatgatccgaaaagcgtctgggctattcatgccgcaaaaatccagagcgatcgagagtataaaaaggcttacgagaagtctaagggcattcacaacactccgcttgacatgatgtcgatcgtacaggcaaaaaagtgccaggtgctggtgtctgacattgactacaggaattacctccaccagtggacttgcctgcccgaccagaatgacgtgatccaagccaagaaagcatatgacctgcaaagcgataacctgtataaatccgacttagaatggttgaagggtattggctggctgcccgaaggaagcgttgaggtaatgcgcgtgaaaaacgcccagaatttactgaacgagcgcctgtacaggattaaacccgaggctcttaagttcacttccattgtcgatacaccagaagtgatccaggcaaagataaacgccgtgcagatctccgaacctttgtatcgtgatgcctgggagaaagagaaggcaaacgtgaacgtcccggccgacacccctttgatgttacagtccaaaatcaacgcactccagatctctaacaaaagatatcagcaggcttgggaagacgttaagatgactggttacgacctcagagcggacgcgatcggcatccagcacgcaaaagcctcacgcgacatagcttcggattacctctataaaaccgcttacgaaaaacagaagggtcactacattggctgccggtcggccaaagaggaccctaagctggtgtgggctgctaacgtcctgaaaatgcagaacgatcgattatacaagaaagcctataacgatcacaaggctaaaatctccattccagtagatatggttagcatcagtgcagctaaggagggacaggccttagcatcagacgtggattatcgacactacttgcaccactggtcatgcttccctgaccagaacgacgtgattcaggcacggaaggcgtacgacctgcagagtgactccgtctataaggctgaccttgagtggcttcgggggatcgggtggatgccggaaggatcagtggagatgaacagagtcaaagtggctcaggatttagtcaatgagcggctctatcggacacgtcctgaggctttatccttcaccagcatcgtcgatacccctgaggtcgtgttggccaaagccaactctctacaaatctcagagaaactgtatcaggaggcctggaataaagacaagagcaacatcaccatcccttcggacacacccgagatgctacaagctcatattaatgccctgcagatttccaacaagctataccagaaggactggaacgacactaaacagaagggctatgacattcgcgccgatgcaatcgagatcaaacatgctaaagcgagccgagagatagctagcgagtacaagtacaaggagggttacaggaagcagctgggtcaccatatggggtttcggacgcttcaggacgaccccaagtccgtgtgggcaatccacgctgcaaagatacagtcagacagggagtataaaaaagcctatgaaaaatctaaaggtatccataatacacctctggatatgatgtccatcgtgcaagcaaagaagtgccaagtgctcgtgtccgatatcgactaccgtaattacctgcatcaatggacatgcctgccagatcagaacgacgttatacaggcgaagaaagcttacgaccttcagtcggacaacctgtacaagagcgacctggaatggctaaaggggattgggtggctaccggaagggtccgtggaggtgatgagggtgaaaaacgcccagaatctgttgaacgagcggctgtaccgcatcaagcctgaggcactaaagtttacgagcatcgtagatactccagaggttatccaggccaagatcaacgccgttcagatctcagaacccctgtacagaaatgcgtgggaaaaagaaaaggctaacgtgaacgtacccgccgatacgcccctgatgttacagagcaagatcaatgcccttcagatatcaaacaagaggtatcaacaagcatgggaagacgtcaagatgactgggtacgacctgagagctgacgctatcggcattcagcatgctaaggccagcagagacattgcttccgactacctctacaagaccgcatacgagaaacagaaagggcattacattggatgcaggagtgcgaaggaggaccctaaactggtgtgggctgccaatgtcctgaagatgcagaatgatagactgtacaagaaagcttacaatgaccacaaggccaagatcagtatacccgtggacatggtcagcatatcagccgctaaagaaggccaggctctggcttcagacgtggattacaggcattacctgcaccactggtcctgcttccctgaccagaatgacgtgatccaggctaggaaggcctacgatcttcagagtgacagcgtatataaagccgatctcgaatggctgcggggtatcggctggatgcccgagggctctgttgaaatgaacagggtcaaggtggctcaggacctggtcaatgagcggttatatcggacgcgccccgaagccctgtctttcacgagcattgtcgacaccccagaggtggtgctggcaaaggctaacagtctgcagattagcgagaagctttatcaggaggcctggaataaagacaaaagtaacattaccataccctctgacaccccggaaatgctgcaggcccacatcaacgccttacagatctcgaacaaactgtaccagaaggattggaacgatacgaagcaaaaaggctacgatatccgggcggatgctatcgagattaaacatgctaaggccagccgcgagattgcaagcgaatataaatataaagagggctacaggaaacagctaggacaccacatggggttccgcaccctgcaggacgaccctaaatccgtatgggctatccatgcggctaaaatccagtctgaccgggagtataagaaagcctacgaaaagagcaagggcatccacaataccccccttgacatgatgtccattgtacaagccaaaaagtgtcaggtgctggtgtctgacatcgattacaggaattaccttcatcagtggacatgcctgcccgatcagaatgacgtgatccaggctaagaaggcgtatgacctgcaatctgataacttgtacaaatccgatcttgaatggttgaagggcatcggctggctgcccgaggggtccgttgaggtcatgcgagtgaaaaacgcacagaatctgttaaacgaacgtctgtataggatcaaacccgaagcgctcaagttcacaagtatagttgatacccccgaggtcatccaggcgaaaataaacgctgtacagatctcagagcccctttaccgcgacgcctgggaaaaagagaaagcaaacgtgaacgtaccagccgacactccactgatgctgcaatctaagattaatgctctacaaatctcaaacaagcggtatcagcaggcttgggaagacgtaaaaatgacagggtacgacctgagagctgatgctattgggatccagcacgcaaaagcctctcgggacatcgcctctgactacctgtataagacagcttatgaaaaacagaaaggccattacattggatgtcgctccgcaaaggaggacccgaagctcgtatgggctgctaacgtgctgaaaatgcagaacgaccgattgtacaagaaagcttataacgaccacaaggccaaaatttctatccctgtggacatggtttcaatcagtgcagccaaagagggccaggcactggcctcggacgtggattaccggcactacttgcaccgctggtcatgtttccccgaccagaatgatgttatccaggcccgtaaagcttatgacctgcagtctgacgcactctacaaagctgacctggagtggttacgcggcatcggatggatgccccagggttctccagaggtactgcgcgtaaagaacgcccagaatatcttttgcgacagtgtgtacaggactcccgttgtgaatctgaaatacacttcgatcgtggacacaccggaggtggttttggcgaaatccaacgctgagaatatctctataccaaagtaccgggaagtttgggacaaggacaaaacaagcattcacattatgcctgatacccctgaaattaatctggctagagcgaatgcccttaatgtctctaataaactgtatcgggagggctgggacgaaatgaaagccggctgcgatgtgaggctagacgctatccctatccaagctgcaaaggcttctcgtgaaatcgcctctgattataagtacaagctggaccatgaaaaacagaaagggcactatgtgggaactctgacggccagggatgataacaagattcgctgggctctcattgccgataaacttcagaacgaacgagaatataggctggattgggctaaatggaaggccaaaatccaatcccccgttgacatgctctcaattttgcactcaaaaaacagtcaggcccttgtctctgacatggattacaggaactatctccaccagtggacatgtatgcccgaccaaaacgacgtgatccaggcaaaaaaagcttatgagttacagtccgataatgtatataaggccgacctcgaatggctccgcggaatcggctggatgccaaatgattcagttagtgttaaccacgcaaaacacgccgcagacatcttcagtgaaaaaaagtacaggaccaagatagaaacattgaattttacacctgtggacgaccgagtggattatgtgactgccaaacagtcaggggaaatcctggatgatattaagtaccgcaaggactggaacgctaccaagtccaagtatacactgacggaaacccctctacttcatacagcccaggaagccgccagaatcctcgaccaatacctgtacaaggaaggatgggagaggcagaaagctactggctacatcctgcctccagacgcagtcccttttgtgcacgcccatcattgcaatgacgtgcagagtgagctgaaatataaggctgagcatgtgaagcagaagggccactacgtgggcgttcccactatgcgagacgatcctaagctagtgtggttcgaacatgccgggcagattcagaacgagagattgtataaggaggattaccacaaaactaaggccaaaattaatatacctgccgatatggtgtcagtgctggcagccaaacagggacagaccttggtctccgatattgattacagaaattacctacatcaatggatgtgccaccctgaccaaaatgatgtgattcaagcacggaaagcctacgatttgcagtcagataatgtgtacagagctgatctggaatggctacggggcattggctggatccctttagatagtgtcgaccacgtgcgagtaacaaagaaccaggaaatgatgagtcaaattaagtataaaaagaatgctctggaaaactacccaaatttccgcagcgtcgtggatccgcctgaaatagtgctcgcgaagatcaacagcgtcaatcagtcagatgtcaagtataaggagacgttcaacaaggctaaggggaaatacacctttagtcccgatactccacatatatcccacagtaaggatatgggcaagctttactctactattctgtacaagggagcttgggagggtactaaggcttatggctacaccttagatgagaggtacattcccattgttggtgccaaacacgccgatctcgtgaactccgaactgaagtacaaggagacctacgagaagcagaaaggccactacctggccggcaaggtgataggagaatttccgggcgtcgtgcattgcctagactttcagaagatgcggtcagccctgaactaccgtaaacactacgaggatactaaagcaaacgtgcacatccctaacgacatgatgaaccatgttctggccaagaggtgccagtacattctcagcgatctggaatacagacactacttccaccaatggacatcgttgctggaggagccgaatgtcatccgtgtgcgaaacgcccaggaaatcctgagtgataacgtctataaagacgacctgaactggctgaagggcataggctgctacgtgtgggacacaccacagatccttcatgctaagaagtcgtacgatttacagtcccagctgcagtatactgccgccggaaaagaaaatctgcagaactacaacctagtgactgacacacccctctacgtgacagccgttcaaagcggaatcaatgcctcggaagttaaatataaggagaattaccaccagataaaagacaaatacacgactgtgttagaaacagtggactacgaccgaacacgcaacctcaaaaatctgtacagcagcaatctgtataaagaagcgtgggatcgagtgaaggctactagctatattctgccatcctccaccctaagtctgacccatgcaaaaaatcaaaaacatttggccagtcatattaaatacagagaggaatatgaaaagtttaaagccctgtacacgctgccgcgaagcgtcgacgatgaccctaatacagccaggtgtttacgggtgggaaaactgaatatcgacaggctctacaggtccgtttatgagaaaaacaagatgaaaatacacatcgtgcctgatatggtcgaaatggttacagcgaaggactctcagaaaaaagtgtctgagatagactatcgcctaagactgcacgagtggatatgccaccctgacctccaggttaatgaccatgtccggaaagtgacagatcagatctctgacatcgtgtacaaagacgacctgaattggttaaaggggattggctgctacgtgtgggacactccagaaattctgcatgccaaacacgcctacgacctaagggacgatattaagtacaaagcacacatgctgaagacaaggaacgattataaactcgtgaccgacaccccagtctacgttcaggcagttaaaagcgggaaacagctgtccgacgccgtgtaccattatgactacgtgcacagcgtacgggggaaagtcgctcctaccactaagaccgttgacctggatagagctttgcatgcgtacaagttacagagcagcaacctgtacaagacctcccttcgcaccctccctactgggtacaggctgccgggcgacacccctcattttaaacatatcaaagacactcgctatatgtccagttacttcaagtacaaggaagcttatgaacacactaaggcgtacggctacaccctgggacctaaggacgttccttttgtgcacgtgaggcgcgtgaacaacgtgacatccgagagactgtatagagaactgtatcacaaactgaaggataaaatccacaccacacctgacacaccagaaatccgccaggtaaagaaaactcaggaggcggtctcagaacttatctacaagtccgatttcttcaagatgcagggacatatgattagcctgccctacaccccacaggtaatccactgccgctatgtaggagatattacttcagatatcaagtataaagaagacctccaggtcctcaaaggcttcggatgttttctttatgatactcctgatatggtgcggtcccgtcatctgaggaagctgtggagtaactacttgtatacggacaaagctaggaagatgcgtgataaatataaggtggtgcttgataccccggaataccgcaaggtgcaggaactaaaaactcatctctcggaactcgtttaccgggctgcaggaaagaaacagaagtccatattcacttccgtccctgatacacccgatctccttagagcaaagcgaggacagaagctgcaaagccagtatctgtacgtggagttggctacgaaggagaggccgcaccaccacgcagggaaccaaacaacagccctgaagcacgccaaggacgtgaaagacatggtgagtgagaagaagtacaaaatccagtacgagaaaatgaaggataagtatactcctgttccggacactccaatcctgattagggccaagagagcatactggaacgctagcgaccttaggtacaaggagacgtttcagaagactaaaggtaagtatcatactgttaaggatgcgctcgatatcgtctatcaccggaaagtgaccgatgacatttccaagattaaatacaaggaaaactacatgtctcagctgggtatctggcggtcaatccccgatagacccgagcacttccatcacagagcagtaactgatacagtctcagacgtcaagtacaaggaggatctcacatggctgaagggcatcggctgctacgcctacgatacccccgactttacactcgctgagaaaaataaaaccctctattccaaatacaaatacaaagaggtgtttgaaagaacgaaaagtgattttaaatacgtcgctgactctcccattaaccgacatttcaaatatgccacccagcttatgaatgagcgtaaatacaagtcatccgccaaaatgttcctccagcacggctgcaatgagatactgaggccagacatgctgaccgccctgtacaactctcacatgtggtctcagatcaaataccggaagaattatgagaaatctaaggacaagttcacatccatcgtggatacgccggaacacctgaggacaacgaaagtcaataagcaaatatccgatattctgtataaattagaatacaacaaggccaagccacgcgggtatactacgatccatgacacacctatgctgcttcatgttcgtaaggtcaaggacgaggtgagtgacctgaagtataaagaagtgtatcagcgtaataaatctaactgtactattgaaccggatgccgtccatattaaggccgcgaaagacgcctacaaggtcaacactaatctggactataaaaaacagtacgaagccaacaaggcccattggaaatggacacccgacaggcccgattttctccaagcggctaagagttctctgcagcaatcagattttgagtataagcttgatcgcgagttccttaagggttgtaagttgtcagtgaccgatgataagaatacagttttagcactcagaaatactctgatcgagtccgacctgaagtataaggaaaagcacgttaaagagagaggaacctgtcacgccgtaccagatacacctcaaattctcctggcgaaaacggtaagcaatttagtgagcgaaaataaatataaggatcacgtgaagaaacacttggcccaaggatcgtatacaactcttcctgaaacaagggacactgttcacgtgaaggaagtgaccaagcacgtgagtgatacaaattataagaaaaaatttgttaaagaaaagggtaaaagcaactactccattatgttggaacctcctgaggtcaagcatgctatggaagtcgctaaaaaacaaagcgatgtggcttatagaaaggacgcaaaggagaacctgcactacaccacagtagcagacaggcctgatataaagaaagctacccaggctgctaagcaggcgtccgaagtcgagtacagagccaagcaccgcaaggaagggtctcacgggcttagcatgctcggacggcctgatattgagatggctaaaaaggcagctaagttgtcctctcaggtgaagtatcgtgaaaatttcgataaagaaaagggaaagacaccaaagtacaatcctaaggatagccaactgtacaaggtgatgaaggatgcaaacaatttggcctcagaagtgaaatacaaagcagacctcaagaagctacacaagcccgtcaccgatatgaaagagagcctgatcatgaaccacgtgttaaacaccagccagctcgcttcctcttaccagtataagaaaaagtacgaaaagtccaagggccactatcataccatccccgataatctcgaacagctgcatttaaaggaggcaacagaactgcaatcaatcgtgaagtataaggagaagtatgaaaaggagcgggggaagcctatgttggattttgagacacctacatacatcaccgctaaggagtctcaacagatgcagagcggcaaggaataccggaaggactacgaagagtcaataaaggggagaaacctgacaggactggaagtcacgccagcgcttctgcacgttaaatatgccacgaagattgcttccgagaaagagtaccggaaagatcttgaggaatccataaggggcaaaggactgaccgagatggaggatacaccggatatgctcagagccaagaatgctacacagattctaaacgagaaagaatacaaaagagacctcgaactggaggttaagggtcgcggactgaacgccatggctaatgagacccctgacttcatgcgagcccgtaatgcgacagatattgcatcacagatcaaatacaaacagagcgcagaaatggaaaaggcaaattttacatcggttgtcgacacgcctgagatcattcacgcccaacaggtcaagaatttgtccagccaaaagaaatataaggaagatgccgagaagagcatgagttattatgaaaccgtgctcgatactccagaaatacagcgggttcgggaaaaccagaaaaactttagtttactccagtatcagtgcgatctcaagaatagcaagggcaagataacggtggtgcaagatacgccggaaattctgagggttaaagagaatcaaaaaaatttctcctccgtcctctacaaagaggacgtgtcccctggaaccgccattggcaaaacgcccgagatgatgagagtaaagcaaacccaagatcatatcagtagcgtaaaatacaaagaggccataggacaagggacccctatccctgacctccccgaggtgaaaagagtcaaagaaactcagaagcatatcagtagtgtaatgtacaaagagaacctggggacaggaatcccaacgactgtgaccccggaaatcgaaagagtgaagcgaaatcaggagaattttagttcagttctatacaaagaaaatttggggaaagggataccgaccccaattacacctgagatggagagagtaaagcgaaatcaggaaaatttttctagcatcttatataaagagaacctgagcaagggcactccgctgcctgtgaccccagagatggaacgcgtcaagctaaatcaggagaacttctctagcgtgttgtacaaggagaacgtgggaaaagggattcccatacccatcacaccagaaatggagcgtgtgaagcataatcaggagaacttttccagtgtactgtacaaggaaaatctgggaactggtatcccaatcccgataaccccagaaatgcagagggtgaagcacaatcaggagaaccttagttctgtcttgtacaaagagaacatggggaaggggacacccttacctgtcacccctgagatggaacgcgttaaacataaccaggagaatattagctctgttctgtataaggagaacatgggcaaggggactcctttgccagtcaccccagagatggaaagggtgaagcataatcaggaaaacatctcctctgttctttataaagagaatatgggaaagggaacccccctggcggtgaccccagagatggagcgcgtgaaacacaaccaagaaaacatcagttctgttctatataaggaaaacgtggggaaggcgacagctaccccagtcacgcctgagatgcagcgcgttaagcggaatcaagagaatataagcagtgtcttatataaggaaaatcttggaaaagcaacgcccactcctttcacgcctgaaatggagcgcgtaaagcgaaatcaggagaattttagttccgttctgtacaaagagaacatgcgcaaggctacaccaactcctgtgacccctgagatggagagggctaaaagaaatcaggaaaatatcagcagcgttctgtattccgacagttttcgtaaacagatccagggtaaagctgcctacgtgctcgacactccagagatgcgccgggtccgcgaaacgcagcgccatattagcaccgtcaagtatcacgaagactttgaaaagcataaaggttgtttcacacctgtggtaacagaccccataaccgaaagagtaaaaaagaatatgcaggatttctctgatatcaactatcgggggattcagcgcaaggtggtggagatggagcagaagcggaatgaccaggatcaggaaaccattaccgggctgagggtatggcggaccaacccaggatccgtcttcgactatgatccagcagaagacaatatccagtcgagatccctgcacatgataaacgtgcaggcgcagcgccgaagccgtgagcagtctagatccgcctccgccctgagcatatccggcggagaagagaagagtgaacattccgaagcaccggatcaccacttatcaacttactctgatggaggcgtgttcgcagtctccactgcatacaaacatgctaagaccaccgagctaccccagcagaggtcgtccagtgtagccacacaacaaacaacagtaagttcaatcccctctcatcctagcaccgcaggcaagatttttagggctatgtacgactacatggccgccgacgccgacgaggtgagttttaaagatggggatgcgatcatcaatgtccaggctatcgacgaaggatggatgtatggcactgttcaacggaccggccgtactggaatgctgcccgcaaattatgttgaggcaatctag

SEQ ID NO: 196724 - DNA, 20010 bp, Artificial Sequence
  Description of Artificial Sequence: Synthetic coding sequence
atggccgacgacgaggactacgaggaggtggtggagtactacaccgaggaagttgtctacgaagaagttcctggggagaccattaccaaaatctacgaaacgacaacgaccaggacatccgactatgaacaatccgagacttcaaagcctgcactggctcagcctgcactggcccagcccgcttcagcaaagcctgtcgagcgccgaaaagtcatcagaaaaaaagtagatcccagcaagtttatgaccccctacattgcacactcccagaaaatgcaggacctgttttctcctaacaagtacaaagaaaaatttgagaaaacgaaagggcagccatacgcgagtactacagacacgccagaactgaggaggatcaaaaaagtgcaggatcagctgtccgaggttaagtacagaatggacggcgatgttgctaaaactatctgccatgtagacgaaaaagccaaggacatagagcacgccaagaaggtatcacagcaagtcagtaaagtgctatacaagcagaattgggaggacaccaaggacaagtacttattaccgcccgatgcccctgagttggtgcaggctgttaagaacaccgctatgttctctaagaagttgtacactgaggactgggaggccgacaaaagcctattttatccctataacgattcaccagagttgcgtcgggtagcccaagcacagaaggccctttcagacgtagcctataagaaaggcctggcagaacagcaagcccaattcactcctctcgccgatccgcccgacatcgagtttgccaagaaggtcactaaccaggtcagcaagcagaaatataaggaggattacgagaataaaataaaagggaaatggtcggagaccccgtgttttgaggtggctaatgccagaatgaatgccgacaacatttccaccaggaagtaccaggaagacttcgaaaatatgaaagatcaaatatacttcatgcagaccgaaacgcctgagtataagatgaacaaaaaggcaggggtggccgcatccaaggtcaagtacaaagaggactacgagaagaataaggggaaggcggattataacgttctgccagctagcgagaacccccagctccgacagcttaaggccgctggtgatgccctcagcgataaactttataaagagaattacgagaagactaaagcgaagtctatcaactactgcgagacaccaaagtttaagctggatactgtgcttcagaacttctcttccgataagaaatataaagactcatacctgaaggacattttgggacactatgtaggatcttttgaggacccttaccacagtcattgtatgaaagtcaccgcgcaaaacagcgacaaaaactataaggcagagtacgaggaggaccgaggcaagggcttcttcccgcagactataacccaagaatacgaggcaataaaaaagttggaccagtgcaaggatcacacgtacaaggtccacccggacaaaacaaaattcacgcaagtgactgatagccccgtactgctccaggctcaggtcaacagcaagcagctgtccgatctaaattataaagctaaacatgaaagtgaaaagttcaagtgccatattcccccggatacacccgcgtttatccaacacaaggtgaacgcctataacttgtccgacaacctatataaacaggattgggagaagtccaaggccaagaaatttgacattaaggtggacgccatcccgctgttagccgccaaggccaataccaagaatacctccgatgtcatgtacaaaaaggattatgagaagaataaagggaagatgatcggggttttaagcatcaatgatgatcccaaaatgctccacagcctgaaagtcgccaaaaatcagtccgacagattgtataaggagaattacgagaaaaccaaagcgaagagcatgaactattgcgagacgccaaagtatcaactggacacgcagttgaagaatttcagcgaggccagatataaggacctatatgtgaaggatgtgttggggcactatgtcgggtccatggaagatccatatcatacacactgtatgaaagtcgccgctcagaattccgataagtcttataaagcagaatacgaagaagacaaggggaagtgctacttcccacaaacaatcacccaggagtatgaggcaattaagaaattagaccaatgcaaagaccatacgtataaggtgcaccccgataaaacaaagtttacggccgttaccgactcccccgtgctgctgcaagcccaactgaatactaaacagttgtccgacctgaattacaaagccaaacacgagggtgagaaattcaaatgtcacattcccgcagacgctccacaattcattcagcacagggtgaacgcgtataacctgagcgataatgtgtataagcaggactgggagaagtcaaaggcgaagaagttcgacattaaggtcgacgccatccctctgctggcggcaaaagcaaacaccaaaaacacctctgacgtgatgtataagaaagattatgagaaaagcaaaggtaagatgatcggagccctgagcattaatgatgatcccaagatgctgcactctcttaaaactgctaagaaccaatctgatagggaataccggaaggattatgaaaagagtaagactatctacaccgctccccttgatatgctgcaggtgacgcaagctaaaaagtcacaggctatcgctagcgacgtggactacaagcacatcctacactcctatagctaccccccagatagcatcaatgttgaccttgccaagaaggcctatgcactgcagtctgacgtggagtataaggccgactataatagctggatgaaggggtgcggctgggtgccttttgggtccctggagatggaaaaagccaaaagggcaagcgatatcctgaatgaaaagaagtaccgtcagcacccagatacccttaagtttacatcaatcgaggacgccccgatcactgtgcagtcgaagattaaccaggcgcagcgctcagatattgcttacaaggccaaaggggaggagatcatacacaaatacaacctgccacctgaccttcctcagtttatacaagcaaaggtaaatgcatataacatcagcgagaacatgtacaaggctgatctgaaagatctgagcaagaagggatacgatctgagaacagacgctatcccaatccgcgctgctaaagcagcaaggcaggctgcttccgatgtgcagtacaagaaggattatgagaaggccaagggcaagatggttgggttccagtcacttcaggatgatcctaagttggttcattacatgaacgtggccaagattcaaagtgatcgggagtataaaaaagactacgaaaagaccaaaagcaagtataatactccccatgacatgtttaacgtcgtcgcggccaaaaaggcacaagacgttgtgtctaatgtcaactataaacactccctccatcactatacttatctgcctgacgccatggatttggaactgagtaaaaacatgatgcaaatccaatccgacaatgtatacaaagaggattataataattggatgaagggtatcggttggattccgattggctcacttgatgtggagaaggtgaagaaggccggtgacgctctgaatgagaaaaagtatcgtcagcacccggacacactgaaatttacatctatcgtggactctccagtgatggtccaggccaaacaaaataccaaacaagtctcagatattctgtacaaggccaagggagaggatgttaagcataagtatactatgtcccctgatcttccccaattcctgcaagccaagtgcaacgcatacaacattagcgacgtgtgctataaacgcgactggtacgatttaatagcaaagggcaataatgtactgggcgacgcaattcccattactgcagctaaggcttcccgcaacattgcctcggactataagtacaaggaggcttacgagaagtccaaaggcaagcacgttggcttcaggtcacttcaggacgaccctaagctagtgcattacatgaacgtcgcaaaactgcagagcgatagggaatataagaaaaactatgagaacacaaaaacaagctatcatacacccggggacatggtcagtattacagctgctaagatggcacaggacgtggctacgaacgtcaactacaagcagccccttcaccactatacatatctccccgatgccatgagcctggaacatacaaggaatgtaaaccagattcagtctgacaacgtgtacaaggatgaatacaactcttttttgaaaggcattggctggatacctatcggttccttagaggtggagaaagtcaaaaaggccggcgatgccttaaatgagcggaaataccgccagcaccccgatacggtaaaatttactagtgtccctgattccatggggatggtgctggcgcagcataataccaagcagctgtcggacctgaactataaggtagagggggagaaattaaaacataagtatacaatcgacccagagttgccgcagtttatccaagctaaggtcaatgctctcaatatgtccgacgctcattacaaagcggactggaaaaagactatcgccaagggttacgatctgaggccagatgccatccccatcgtggcagctaaatcaagccggaacattgccagtgactgtaagtacaaggaagcctatgagaaggcaaaaggaaagcaagtgggctttctgtctttgcaagacgacccgaaactcgtgcattacatgaacgttgcaaagatccagtccgaccgagagtataagaagggctatgaggctagtaagacaaagtaccatacccccctggatatggtaagtgtaacggccgctaagaaaagccaagaagtggcaaccaacgccaattaccggcaatcctaccaccactatactctcctgcccgacgctctgaacgtggaacacagccggaacgcaatgcagattcaaagcgataatctatacaagtccgactttacaaactggatgaaaggaatcggatgggtacctatcgaaagcttggaggtcgaaaaagctaaaaaggccggggagattctcagcgaaaagaagtatcgccagcacccggagaaacttaagtttacttacgctatggataccatggaacaagctttgaataaatccaacaaattgaacatggacaagcggctttacaccgaaaaatggaacaaggacaagaccaccattcacgtcatgcccgacacccccgacatactgttgtcccgggtgaaccagattactatgtcagataagctgtacaaagctggttgggaggaggaaaagaagaaaggctatgatcttagacctgatgccatcgccatcaaagcagcccgggccagtcgagatatcgcatctgactacaaatacaagaaagcttacgaacaagcaaagggtaagcacatcggatttcggagccttgaggacgaccccaagcttgtccacttcatgcaggtagcaaagatgcagtcagatcgcgagtacaagaagggttatgaaaagtccaaaacatcattccatacccccgtggacatgctgtctgttgtggcagctaagaagtcccaggaggtcgctaccaatgccaactacaggaacgtgattcacacatacaatatgctgcctgacgcaatgtcattcgagctagcaaaaaatatgatgcagatccagtcagataaccagtataaagcagattacgctgatttcatgaagggcatcggttggttgccattgggctcccttgaagccgagaaaaacaagaaggcaatggagatcattagtgaaaagaagtaccgacagcaccctgatactttgaaatacagcactctaatggactccatgaacatggtgctggctcagaacaatgccaagattatgaatgaacatctgtataaacaggcgtgggaggccgataagactaaagttcacatcatgcctgatatcccccagattatcctggctaaggcaaatgctatcaatatgtcagataagttgtacaagttgtcactcgaagaaagcaagaaaaagggctacgatctgcggccagatgctatcccaattaaagctgctaaggccagcagagacattgcttctgattataagtataagtataactacgagaagggtaagggaaagatggtaggatttaggtcactcgaagatgatccaaaactggttcactccatgcaggtggccaagatgcagagcgaccgggaatataagaaaaattatgagaacacgaagacttcctaccatacgccagccgacatgctgtccgtcactgcagcgaaagatgcccaggcgaatataaccaacacaaattacaaacacctgatccacaagtacattctgctcccagatgccatgaatattgagctcaccagaaacatgaacagaattcaatcagataacgagtataaacaggactacaatgagtggtacaagggcttaggctggtctccagccgggtcacttgaagtcgagaaagccaaaaaggcgaccgagtatgcaagtgatcagaaataccgccagcatccatcgaactttcagttcaagaagctcaccgactccatggatatggtactcgctaagcagaatgcacacactatgaataaacatctgtatactattgactggaataaggataagaccaaaatccacgttatgccagatacccccgatatactccaggccaagcagaaccagacactgtacagccagaagctgtacaagcttggttgggaagaagcactcaagaagggctacgatctgccagtggacgcaatttccgtgcagctagccaaagcatcacgcgatatcgctagtgattacaagtacaagcaaggctaccgcaagcaattgggtcaccatgttggtttccgctcgttacaagacgaccctaagttagtcctgagcatgaatgtggcaaaaatgcaaagcgagcgggaatacaagaaagattttgagaaatggaagactaagttcagttcccccgtggatatgctcggggtggtgttggctaagaaatgtcaagagttggttagcgatgtagattataaaaattacctgcaccagtggacatgcctgccagatcagaacgatgtggtccaggccaaaaaagtatacgaattgcagagtgaaaatctttacaagagcgatctggagtggctacgaggcatagggtggagtccattggggtccctggaagctgagaagaataaacgggcctccgaaattatctcggaaaagaagtaccgccagccccctgatcggaataaattcaccagtattccagacgcgatggacattgtcctcgccaaaaccaatgcgaaaaatagaagcgatcgcctgtaccgggaagcatgggacaaggataagactcagattcacataatgcccgacacacctgatatcgtgttggccaaggccaatctaataaacaccagcgataagttgtatcgaatgggctacgaggaactgaagaggaagggctacgacttaccagtggatgccatccccataaaagctgccaaagcaagccgagagatagccagtgaatacaagtacaaggaaggcttccggaagcagctcgggcaccacattggagcaagaaacatcgaggatgatcccaaaatgatgtggtcgatgcatgtggccaagatacagtccgacagagagtataaaaaggactttgaaaaatggaagaccaaattttcatctcccgtggacatgctgggggtggtactggccaagaaatgtcagacgttagtgtctgacgttgactataaaaactacctgcaccagtggacctgtctgcccgaccaatcagatgtgattcacgcgagacaggcatacgatctgcagagcgataacctctataaaagcgatttacagtggcttaaagggatcggctggatgactagcgggtctctcgaagatgaaaaaaataagagagcaacgcagattctctccgaccacgtgtatagacagcacccggatcaattcaagttttcctcgcttatggattccatccccatggttctggcaaagaacaatgccataaccatgaaccatcgtctgtatacagaggcatgggataaggataaaacaaccgtacacattatgcctgacaccccagaagtgctgttggcgaaacagaacaaagtgaactactcagagaaactgtacaagctaggattggaggaggcaaagcggaagggctacgacatgcgcgtcgatgcgatcccaatcaaagccgctaaggcttcccgtgacattgcatcggaattcaagtacaaggaaggctaccgcaagcagctcggacatcacatcggtgcaagggccattcgggacgaccccaaaatgatgtggagcatgcacgtcgccaaaatacagtctgacagagagtacaagaaggatttcgaaaaatggaagacaaagttttccagtcccgtcgatatgctaggcgtggtgctcgctaagaaatgccaaactctcgtttcagatgtggactataaaaactacctgcaccaatggacctgcctccctgatcagtctgacgtaattcacgcccgtcaggcatacgatttgcagagtgacaatatgtataaaagcgacttacagtggatgcggggcatcggctgggtatcaatcgggagcctcgatgtggaaaaatgcaaaagggctaccgagatcttaagtgacaagatctaccggcagccgcccgaccgcttcaaattcacatccgtgaccgacagccttgaacaagttctggccaagaacaacgccctcaacatgaataaaagactctataccgaggcatgggacaaggacaaaacacagatccatatcatgccagacacacccgagatcatgctggccagacagaataaaatcaattactccgagacactgtacaagctcgccaatgaggaggctaagaagaagggatatgacctgcgctccgacgctattcccatcgtggccgccaaggcttctagggacgtgatatccgactacaagtacaaggacggctatcggaaacagctcgggcatcatatcggcgcacgcaatatagaggatgatccaaaaatgatgtggtctatgcacgttgctaagatccaaagcgatagggagtacaaaaaagattttgagaagtggaagaccaagttctcttcacctgtagacatgcttggggtggtgctcgctaagaaatgtcaaactctggtgtccgatgtggattacaaaaactacctccatgaatggacctgcctccccgaccagaacgacgttattcacgctcggcaggcatacgacctgcagtccgacaacatctacaagagtgacctgcagtggttgcggggcattggttgggtgcccataggttcaatggatgtagtcaaatgcaaaagagcggcagagattctcagcgataatatttaccggcaaccccctgacaaactgaagttcacttccgtcaccgacagtcttgaacaagtgttggcaaagaacaatgcattgaatatgaacaagcgcctctacaccgaagcctgggataaggacaagacacaggtacacattatgcccgacaccccagagattatgttggcacgtcagaacaagattaattacagcgagtctctgtatcggcaagcgatggaagaggctaaaaaagagggctatgatctgagatcagacgcgatccccattgtcgccgctaaagccagccgagacatcgcttctgattacaagtataaagaggcttataggaagcagctggggcatcacataggagcccgagcggtacacgatgaccccaagataatgtggagcttgcacatcgctaaggtgcagtcagaccgggagtacaagaaagattttgaaaaatacaaaaccaggtattcttcaccagtggacatgctaggcattgtgttggccaaaaaatgccagaccctggtctcggacgtggactataagcaccctctgcacgaatggatttgtctcccggaccagaacgacattatccatgcaagaaaagcttacgatctgcaatcagataatttatacaagtcagacctggaatggatgaagggaatcggatgggtgcctatcgactcccttgaagtggtgagggccaaaagagctggggaactgctcagtgatacaatctatcgccagagacccgagaccctgaaattcacttcaataaccgacacacccgagcaagtgcttgctaagaataatgccctaaacatgaataaaagactctacactgaggcttgggacaacgataagaaaaccatccatgttatgcccgacaccccagaaattatgctggcaaaactcaacagaattaattatagcgacaagctgtataaactggcgctggaagagagcaagaaagaagggtatgacctgcgattggatgccatcccaatccaggccgcaaaggcatcaagggacattgccagcgattacaagtacaaggagggatataggaagcaactcggacaccacatcggggcaaggaatatcaaagatgatcccaaaatgatgtggagcatccatgttgctaagatccagagcgacagggagtacaagaaggaatttgaaaaatggaagacgaagtttagttctcccgtcgacatgctgggcgtcgtcttggcgaaaaagtgtcagatcctagtgtctgatattgattataagcatcctttgcacgagtggacttgcctaccggaccagaacgacgtcattcaggctcgcaaagcgtatgacctgcagagtgacgctatttacaagtcagacttagagtggctgaggggaattggatgggtgccgattggaagcgttgaggtcgaaaaggtcaaacgcgcaggcgaaatcctcagtgatcgcaaataccgacaaccagccgatcagcttaaattcacttgtattacagacactcctgaaatagtccttgctaaaaataacgctttgacaatgtcaaaacatctttacaccgaggcgtgggacgctgacaagacctcaatacacgtaatgccggatacgcccgatatcctcttggctaagagcaacagtgctaatatttcccagaagctatataccaagggctgggatgagtcaaagatgaaagattatgatctacgcgctgatgcaatctccatcaaaagcgcaaaggcctcaagagacattgcttcagattataagtacaaggaggcctatgagaagcagaaaggccaccatatcggagcccagagcattgaagatgacccgaaaataatgtgcgctattcacgctgggaagattcagtcagagcgggagtacaagaaggaatttcagaaatggaagacgaaattctcctctccggtggacatgctgtctatactgctggcaaaaaagtgccaaacactggttacagacattgactaccggaactacttgcacgagtggacatgtatgccagaccagaacgacataatccaggcaaagaaggcctatgatctgcagagcgatgccttgtataaggctgatcttgagtggttgcgggggatcgggtggatgccacaggggagccccgaggtgttgcgagtcaaaaacgctcagaatattttttgtgacagtgtataccgaacccccgtggtgaatcttaagtatacctccatcgtcgacactcccgaggtagtgctcgctaagtctaatgccgagaatatttcgatcccaaagtacagggaggtgtgggataaggacaagacctccatccatatcatgcctgatacccctgagattaatctggcgcgcgcaaacgccctgaacgttagcaacaagttgtaccgagagggctgggatgaaatgaaggccggttgtgatgtacggttggatgctatcccaattcaagccgctaaagcttcacgtgaaatcgcctctgactacaagtataagctagaccatgagaaacaaaagggtcactacgtcggaactttgactgctcgcgatgacaacaagatcagatgggcgctgatcgcagataaattgcagaatgaaagggagtatagacttgattgggctaagtggaaagccaaaatccaatctccggtcgacatgctgagcatactgcacagtaaaaatagccaggcattggtgtccgacatggattacagaaattatctgcatcagtggacgtgcatgcctgaccagaatgacgtcattcaggcaaaaaaggcatacgagctgcagagcgataacgtatacaaagccgacctggaatggctgagaggtattggctggatgccaaatgactcagtgtcagtgaaccatgccaaacatgcagccgacatcttctcggaaaaaaagtaccgcactaaaatcgagactctgaacttcactccggtggacgatcgagtcgattatgtaacagcgaagcaatccggggaaatcctggacgacatcaagtatcgcaaagactggaacgctacaaagtccaaatatacattgaccgagacgccactgctgcacaccgcacaggaggccgcgcgtatcctcgatcagtacctgtacaaggaaggatgggagcgccagaaggctaccggatacatcctgccacctgatgctgtccccttcgtgcacgcgcaccactgcaatgacgtgcaaagcgaactgaagtacaaggcggagcatgtaaaacaaaaagggcactatgtgggtgtcccaaccatgcgtgacgaccccaagctcgtgtggttcgagcatgcaggacaaattcaaaacgagcgcctatacaaagaggactaccataaaacaaaagcaaagataaatatcccagccgacatggtgtccgtgctggcagctaagcaggggcaaacactcgtgtccgacattgactaccgaaattacctccaccaatggatgtgtcacccagatcaaaatgacgtaattcaggcgcggaaggcttatgatctccagtctgataacgtctatcgagccgacctggagtggctgcgtggcattggctggatcccactggactcagtggaccacgtgcgtgtcacgaaaaatcaagagatgatgtcacagattaaatacaagaaaaacgcactagaaaactatccaaatttcagatccgtggttgaccccccggagatcgtgttggccaaaatcaactctgtgaaccagagcgacgtgaagtataaggagacattcaacaaggccaagggaaaatatacattttcaccagacacccctcatatcagccactctaaggacatggggaaattatattctacaattctgtataaaggggcctgggagggcactaaggcgtatggctacaccctggatgagcgttacattccgatcgtcggcgccaaacatgccgatctggtgaattcagagctgaagtacaaagaaacttatgagaaacagaagggccactacctggccggcaaggtcataggggaattccctggggtggtgcactgtctggacttccagaagatgcggagcgccctgaactacaggaagcactatgaggatactaaagctaatgtacacatcccaaacgatatgatgaaccacgtgctggcgaagcgttgccagtatatcctttccgatttggaatacagacactacttccatcaatggactagtttactggaagagcctaatgtcatcagggtgaggaatgcacaagagatcctcagtgacaacgtgtataaagatgaccttaattggctaaagggtatcggctgttatgtgtgggacactccccagatcttacacgctaagaaaagctacgacctgcagtctcaactgcaatacactgccgcaggcaaagagaacctgcagaattacaacctagtgactgataccccgttatatgtgacggccgtgcagtcaggcatcaatgcatcggaggtgaaatataaggagaattatcaccagataaaggataagtataccaccgtgctcgaaacagtggattacgatagaaccagaaacttgaagaacctctattcaagtaacctgtacaaggaggcctgggatcgggttaaggccacaagttacatattgccttcgtctacactcagtctgactcatgctaagaaccagaaacatttagcatctcatatcaagtacagggaggagtacgagaaatttaaagctctatatactctgcctcgctccgtggatgatgatccgaacacggctcggtgcctgcgggtcgggaagctgaatatcgatcggctgtatcggagtgtgtacgaaaaaaataagatgaagattcacatcgtgccagatatggtagaaatggtcacagccaaggactcacagaaaaaggtgtccgaaatcgactatcgactgcgtctccatgagtggatatgccatcctgacctgcaggtgaatgatcacgtgcgtaaggtgaccgatcagatcagcgacattgtctacaaggatgacttaaattggctcaaggggatcggatgttatgtttgggacacccctgagatattgcacgctaagcacgcatacgatctccgtgatgatattaagtataaagctcacatgctaaagaccagaaacgattacaaacttgttacagatacccccgtttacgtccaggcggtgaaatccggcaagcagctgagtgacgccgtgtatcactatgactatgtccatagcgtcagaggtaaggtagcgccaacaacaaaaaccgtagacctggaccgtgccctgcacgcctacaaactgcagtcaagtaacctgtacaaaacttcccttaggaccctgccaacaggctaccgtctgcccggggacaccccccatttcaaacacattaaagacactaggtatatgtccagttattttaagtataaggaggcttacgagcacacaaaggcttacgggtacactttagggcccaaggatgtgccattcgtgcacgtcagaagggtgaataacgtgacgagcgagcgactttaccgcgagctctatcacaaactgaaggacaagatccacacgaccccagatacacctgagatccggcaggtgaagaaaacacaggaggcggtttcagagctgatctacaaatctgacttctttaagatgcaaggacacatgatcagcttgccatatactcctcaagttatccactgccgatacgtcggtgacatcacctccgatatcaaatataaggaagatctgcaggtcctgaagggctttggatgctttctgtatgatactccagatatggtaaggtccaggcatttacgaaaactctggagcaattacctgtacaccgataaggcaaggaagatgcgggacaagtataaagtcgtcctagatactccagagtacagaaaagtgcaggagctcaaaactcacctgtcagagttagtttatcgagcagcagggaaaaagcagaaatcaatattcacttccgtgcccgatacaccagacctactcagagctaaacggggccagaaactccaatctcagtatctgtacgtcgaattggctaccaaggaacgccctcatcaccacgccggcaatcaaaccacagctctgaaacacgccaaagacgtgaaggatatggtctctgagaagaagtacaaaatccagtatgagaaaatgaaggacaaatatacccccgttcctgacacccccattttaattagggctaaacgagcttactggaatgcaagtgatctgcggtataaggagacattccaaaagactaaaggtaagtaccacacagtcaaggacgccttagacattgtttaccatagaaaagtcacagacgacatatctaaaatcaagtacaaggagaactatatgtcacagctcggtatttggcggtccattcctgatcggccagagcacttccatcacagggctgtgacagatacggtgtcagacgtgaagtacaaagaagatctgacatggctgaagggaattgggtgctatgcatacgatacgcctgacttcaccctggccgaaaaaaataagaccctgtactccaagtataagtacaaagaagtgttcgaaaggactaagtctgacttcaaatacgtggcagactcaccaataaatagacatttcaaatatgctactcagcttatgaatgagaagaagtatcgggctgactacgaacaacgaaaggataagtaccaccttgtcgttgacgagccccggcacttactggcaaaaactgctggggaccagatcagtcaaattaaatatcgtaagaattatgaaaagagcaaggacaagttcacttctatcgtcgataccccagagcacctcagaaccacgaaggtgaataaacagatctcagatattttgtacaaactggaatataataaggccaaaccacgagggtatactaccatacatgatacccctatgttattgcatgtccgcaaggttaaggatgaagtttctgaccttaaatataaggaggtatatcaacgaaataaatctaactgcacaattgaaccggacgcagttcatatcaaggctgccaaagatgcctacaaggtgaacacaaacttagactacaaaaagcagtacgaggccaataaggcccactggaaatggaccccggacaggcccgattttctgcaagccgccaagagctccctgcaacagtccgatttcgaatacaaacttgatagggaattcctgaaaggctgtaaattaagcgttactgacgataagaacacggtgctcgccctgcgcaacacccttattgaatcggacttgaaatacaaagagaagcatgttaaggagcgtggaacgtgccacgcagtccctgatacccctcagatcctgctggcgaagactgtgtctaacctcgtgtctgagaacaagtataaggaccatgtgaagaagcacctagcacaagggtcttatacaaccctgcccgaaacacgggataccgtacatgtgaaggaggtcacgaaacacgtctctgacactaattacaagaaaaaattcgtaaaggaaaaaggaaaaagtaattatagtattatgcttgagcccccagaagtcaagcacgctatggaggtcgcaaagaagcaatccgacgttgcctaccggaaggacgccaaggagaatctgcactacaccactgtggcggaccgccctgatatcaagaaggcgacccaggctgctaagcaggccagcgaggtggaatatcgggccaaacataggaaagagggcagtcatggcctgtcaatgctggggcggcccgatattgaaatggcgaaaaaagccgcgaaactgagctcacaggtaaagtaccgcgagaatttcgacaaggagaagggtaaaacaccgaagtacaatcctaaagactctcagctgtacaaagtgatgaaggatgccaacaatctggcctctgaagtcaaatataaggctgacctcaagaagctccataaaccggttactgacatgaaggagagtctcatcatgaatcacgtgctgaatacatctcagctcgcgtcttcctaccagtacaagaagaaatacgagaagtccaagggacactaccatacaattccagataacctggagcaactgcatctgaaggaggccacagaactgcagtcaattgtgaaatataaggagaagtatgagaaggaacgcggaaaaccaatgctcgacttcgaaacacccacgtacatcacggctaaagaatcccagcagatgcagtcaggcaaggaatatagaaaggattacgaagaatccatcaagggacggaatcttacgggtctcgaggtgacccccgcactgcttcacgtgaagtatgctacaaaaatagcctccgaaaaagagtatcgaaaggaccttgaggagtccattaggggcaaaggtcttacagagatggaagacacccccgatatgctcagagcaaagaatgctacacaaattctgaatgagaaagaatacaagcgggacctggaactggaggtcaagggtagaggattgaatgctatggccaatgaaactccagacttcatgagagcccgaaacgctacagacattgcatcacagatcaaatacaagcaaagcgcagagatggaaaaagcgaattttactagcgtggtcgacacaccagaaattatccacgcccagcaagtgaaaaacctttcttcgcaaaaaaaatataaagaagatgccgagaagagtatgtcctactatgaaaccgtccttgataccccagagatccaaagagttcgagaaaatcaaaaaaactttagcttactgcagtaccagtgcgatctcaagaactctaagggcaaaattacagtggttcaagatacgccagaaatccttcgtgtcaaagaaaaccaaaaaaacttctcttctgttttatacaaggaagacgtaagcccagggactgctatcgggaagacaccagagatgatgcgcgttaaacagactcaggaccatatcagctccgtgaagtacaaagaagccattgggcaggggacaccaattccagacctgccagaggtaaagagagtgaaagagacccagaagcacatctccagtgtaatgtacaaggagaacctgggaaccggaatccctactacagtaacaccagaaatcgagcgtgtgaaacgcaaccaggagaacttcagtagcgtcctgtacaaggagaatctggggaaaggcattcctaccccaatcacccctgaaatggaacgcgttaaacgaaatcaggagaacttcagctctgtactgtacaaggagaacatggggaaaggcactcccctggctgtgacaccagagatggaaagagttaaacacaaccaggagaacattagttcagtgctgtataaagagaacgttggcaaagccacggcaactccagtcacccctgagatgcagcgcgtgaaacgcaaccaggaaaatatctcctcagtactgtataaagagaacctgggcaaagctaccccgaccccatttacccctgaaatggagagagtaaagcgcaatcaagagaacttctctagtgtgctgtacaaagagaatatgcgaaaagccacgcctactccggtgacccccgaaatggagcgggccaagcgcaaccaggagaatatctctagtgtgttgtactccgacagcttccggaagcaaatccagggcaaagccgcttacgtgctggacacaccggagatgcggagggttcgggagacacagaggcacatttcaaccgtgaaataccatgaggactttgagaagcacaaaggctgtttcaccccagttgtcacagaccccatcactgaaagagttaagaagaatatgcaagatttttcagacataaactaccggggcatacaacggaaggtggtggaaatggagcagaagagaaatgatcaggaccaagagacaatcacaggcctgagggtgtggagaaccaatccaggcagtgtgttcgactacgatcccgccgaggacaatatacaaagtaggtcccttcatatgattaacgtgcaggcacagcgtagatctcgagaacaatcaaggtctgcgtcagccctttcaattagcggcggagaggagaagtccgaacacagcgaggcgcccgatcaccatctctcaacctacagcgacggaggggtctttgccgtcagtacagcatacaaacacgccaagaccacagagctccctcagcaaagatcttcctctgtggcgacacagcagaccacagtatctagtatcccgtctcacccgagcactgcagggaaaatatttagggcaatgtacgattacatggccgcagatgcagatgaggtctcgtttaaggatggggacgccatcatcaacgttcaggccattgacgaaggttggatgtacggaacagtgcagcgaaccggtcgaaccgggatgttgcccgcgaactatgtcgaggctatttag

SEQ ID NO: 196725 - DNA, 25578 bp, Artificial Sequence
  Description of Artificial Sequence: Synthetic coding sequence
atggccgacgacgaggactacgaggaggtggtggagtactacaccgaggaggtggtgtacgaagaagtccctggtgagaccattacgaagatctacgagactaccaccacccgcactagcgactacgagcaatctgaaacttctaaaccagcgcttgcgcagcccgcccttgctcaacccgctagcgcaaaaccagtcgagcggcgtaaagtgatacgcaagaaagtcgacccatccaaattcatgaccccatatatcgcacactcacagaagatgcaagacctgttctcccccaacaagtataaggagaaattcgagaagacaaaggggcaaccctacgccagtaccactgacactcctgaactgaggcggataaagaaggtgcaggaccagcttagtgaggtgaaatacaggatggatggggatgttgctaagacgatctgtcacgttgatgagaaggctaaagatatcgagcacgcaaagaaagtatctcagcaggtgagcaaggtcctctacaagcagaactgggaagatacaaaggacaaatacctgctgccacccgatgctcctgaactggttcaagcagtcaagaacaccgcaatgttctctaagaaactttacacagaggactgggaagccgacaagtccttattttacccctataatgactcacctgaactgaggcgggtggctcaagcccagaaggccctgagcgacgtagcatacaagaagggactcgccgagcaacaggcccagttcactcctcttgcggacccaccagatatcgagtttgccaagaaggtgactaaccaggtcagtaagcagaagtacaaggaagattatgagaataaaatcaaagggaagtggtccgagacgccttgcttcgaggtggcaaacgcgcgaatgaatgccgacaacattagcactcgaaaataccaggaagactttgagaatatgaaagaccagatctacttcatgcagacagaaactcctgaatacaaaatgaataagaaggccggtgtggctgcctcaaaggtgaagtataaagaggattacgagaaaaataaaggcaaggcagactataacgtgctgcccgcgtccgaaaacccacaactgcgacagcttaaggcagcaggcgacgcactttctgacaaactctataaggagaattatgagaaaactaaagctaagagtataaactactgcgagactccaaagttcaagctcgatacagtcctacagaattttagttcagacaaaaagtacaaggattcttacctaaaagatatcctcggacattacgttggctcctttgaggacccttatcactcccattgcatgaaagtcacagcgcaaaattccgataagaattataaggccgaatacgaagaggataggggcaaaggtttttttccccagaccatcacacaagaatacgaggccatcaagaagctcgaccagtgcaaggaccatacttacaaggtacatccagacaaaaccaagtttacgcaggtgacagactctcctgtgctgctgcaggctcaggtcaattctaaacaactgtcagacctgaattataaggcaaaacatgagtcagaaaaatttaaatgccatattcctccagatactcctgcatttattcaacataaggtcaatgcatataaccttagtgacaatctttacaaacaggattgggagaaatctaaggctaagaagtttgatatcaaggtggatgccatccctctcctggctgcgaaggcaaatacaaagaatacctccgatgtcatgtataagaaggattacgagaaaaacaagggcaaaatgatcggcgtattaagtataaacgacgatcctaaaatgctccactctttaaaagtggctaagaatcaaagcgatcgactgtacaaggaaaattacgaaaagaccaaggctaagtccatgaactattgcgagacacccaaatatcagctggacacccaactgaagaacttttcggaggctaggtacaaggacctctatgtgaaagacgtgttaggacactacgtcggatcaatggaggacccttaccatactcattgcatgaaagtcgcagcacagaacagtgacaagtcgtacaaggccgagtacgaggaggataaagggaaatgctatttccctcagacaataacccaggaatatgaagccattaagaaactcgatcagtgtaaagaccatacctataaagtgcacccggataaaaccaaattcaccgcagttacggacagccctgtcctgctgcaggctcagctgaatacgaaacaattaagcgacctgaactataaagctaagcacgagggcgaaaaatttaagtgccacatcccggccgatgcaccccagttcattcagcaccgggtgaacgcatataacttgagtgacaatgtgtataagcaggactgggaaaaaagtaaggcgaagaagtttgatattaaggtggacgccattcccctcctcgccgccaaggctaacacgaagaataccagtgacgttatgtacaagaaagattacgagaagtctaaaggcaagatgataggggccctgagcataaatgacgaccccaagatgcttcactccttgaagactgccaaaaaccagagtgatagggagtataggaaagattatgagaagagcaagacgatctacaccgctcccctggatatgttgcaggtgacccaggccaagaaaagccaagccatcgcctctgacgtcgattataaacacatactccactcctactcctaccctcccgatagcatcaacgtcgacctggctaaaaaagcatacgcactgcagtctgatgtagaatacaaagctgactataattcatggatgaaaggttgcggttgggttccattcgggtcgcttgaaatggaaaaagctaaacgcgcctctgatattctgaatgaaaagaagtataggcagcaccccgatactctgaaatttacatcaatcgaggacgcaccaatcacagtccagagcaagatcaaccaggcgcagcggtctgacattgcctacaaggccaagggagaggagatcatacacaagtacaatctgcctcctgacctgcctcaattcatccaggctaaagtcaacgcctacaatatcagcgagaacatgtataaagctgatctgaaggacctgtccaaaaaggggtatgatctgcgcactgatgcgatcccaatcagggcagccaaggcggctcgccaggctgcgtccgacgtgcagtataagaaagattacgaaaaggcaaagggtaaaatggtgggatttcagagtctacaggacgatcccaaactggtacattacatgaatgttgctaagatacagtccgacagggaatataagaaggattatgaaaagacaaagagtaaatataacacaccccatgatatgtttaacgtggtggccgctaagaaggcacaggatgtcgtgtcaaatgttaattacaagcattcactgcatcactacacctatctgcccgatgccatggacctggagctctcgaaaaatatgatgcagatccagagcgacaacgtctacaaagaggattataacaactggatgaaaggcatcgggtggatccctatcggcagtcttgacgttgaaaaggtaaagaaagctggggatgctctcaatgaaaaaaagtatcgccagcacccggacacactgaaatttacatcgattgttgactccccggtgatggtgcaggcaaaacaaaacacgaaacaagtgtcagacatactttataaagctaagggcgaggatgtaaaacacaagtatacaatgtctcccgacctccctcagtttctgcaagctaagtgtaatgcgtacaatatctcagatgtgtgttataagagggattggtatgatctcattgcaaaaggcaataatgtgcttggagatgcaatcccaattacagcggccaaggctagccgcaatatcgcatcagactataagtacaaagaggcttatgaaaagtccaaaggtaaacatgttggattcagatctctgcaagacgaccccaagcttgtgcactatatgaacgtcgccaagctgcagagtgacagggagtacaagaaaaattatgagaacacaaagacatcttatcacacaccaggcgacatggtgtctattactgcagccaagatggcccaggacgtagcaactaacgtcaattacaaacagcctctccaccattacacctatctgcccgatgctatgtcactcgaacacacacgaaatgttaatcagattcagtcggataatgtttataaagacgaatacaattctttcctaaagggaatcggttggattcccattgggagcctggaggtcgagaaggtgaaaaaagctggggacgcgctgaacgaacgtaagtatagacagcaccccgacacggtcaagttcactagcgtccccgattccatggggatggtgcttgctcagcacaataccaaacagcttagtgatctgaattacaaggtggagggggaaaaactcaaacataagtatactattgaccccgagctgccccagtttattcaggccaaagtgaatgcccttaatatgagcgatgcacactacaaggctgactggaaaaagactattgccaagggttacgatttaaggccagatgccatccctattgttgcggccaaatctagccggaacatcgccagcgattgcaagtataaggaggcttatgagaaggctaagggaaagcaggttggctttcttagcctacaggatgatcccaaactggtgcactacatgaacgttgccaaaatacagagtgatagagaatacaaaaagggctacgaggcaagcaagactaaatatcacactcctctggacatggtgtccgtaacagccgccaaaaaatctcaggaggttgctacgaacgctaactaccggcagagctaccaccactatactcttctcccagacgcattaaatgttgagcactctaggaatgccatgcagatccagtcagataatctgtataagagcgacttcacaaactggatgaagggaataggttgggttccgattgagtccctcgaagttgaaaaggccaaaaaagcaggcgagattctttccgagaagaagtataggcagcatccagagaagctcaagttcacctacgctatggacacaatggaacaggccctaaacaagtccaataaactaaatatggataaaaggctgtacacagagaaatggaacaaggacaagacaactatccacgttatgcccgacaccccggatatcctactttcacgagtcaatcaaatcacgatgtctgataagctttacaaagccggatgggaagaggagaaaaaaaagggatatgatcttcggcctgacgctatcgccattaaggccgcacgggcgagccgcgacatagcgagcgactataaatacaagaaggcctacgaacaggctaagggcaagcatatagggtttcgcagtctggaagacgacccaaagcttgtacactttatgcaggtggccaagatgcagagtgatcgcgaatacaaaaagggctatgaaaagtccaagacctccttccacacgcccgtggatatgctctccgtcgtagccgccaaaaagagccaggaagtcgcgaccaatgccaattatagaaacgtcatacacacttataacatgctgcctgatgccatgtccttcgagctggccaaaaacatgatgcaaattcaaagcgataaccagtacaaagcggactatgcggacttcatgaaaggtatcgggtggctgccactgggatcactcgaggcagaaaagaacaagaaggctatggagatcatctccgagaaaaagtaccggcagcaccccgacaccctgaaatattcaactctcatggacagcatgaatatggtgctggcccagaataatgcgaagattatgaatgaacatctgtataagcaagcatgggaagctgataaaactaaggttcacattatgcccgacattccacaaatcattctggccaaggctaacgcaatcaatatgtccgataaactttacaagcttagtctggaagaatctaagaagaagggctatgatctccgacccgatgctatacctatcaaggccgcaaaagcctcccgtgacatcgcatcggactacaaatataagtataactatgagaaggggaaggggaagatggtgggttttcgatccctggaggacgatcccaagctggtacattcaatgcaggtagctaagatgcagagcgacagagagtacaagaagaactacgagaacacaaagacatcttaccatacccccgctgatatgctatccgttactgccgcaaaggacgcccaagctaacatcacaaatacaaactacaagcacctcatccacaaatatatccttttgccagacgcgatgaacatagagctgaccagaaacatgaatcgtatacagtctgacaacgaatataagcaggactacaacgaatggtacaaaggactcgggtggagtcccgccgggtctctggaggtcgaaaaggccaagaaagccaccgaatatgcttccgaccaaaaatacaggcagcatccctccaacttccagttcaaaaaactcaccgactccatggatatggtgctggctaagcaaaatgcacacacaatgaacaaacacttgtacactattgattggaacaaagacaagaccaagatacatgttatgcctgatactccggatatcctgcaagcaaaacagaaccagactttatatagccagaaactctataaactggggtgggaggaggcactgaaaaaaggttacgacctgcctgtggacgccatctcagtgcagttagcaaaggcctctcgggacattgcctctgactacaaatacaaacagggttaccggaagcagctgggacatcacgtgggcttcaggtcgttacaggatgaccctaagctggtactgtccatgaatgtcgctaagatgcaaagcgagagggagtacaagaaggatttcgaaaagtggaagaccaagttcagtagccctgtggacatgttgggggtagttctagccaagaaatgccaggagctagtgagtgacgttgattataagaactacctccatcagtggacctgcctgcctgaccagaacgacgttgtgcaggcgaagaaggtgtatgagcttcaaagcgagaatctgtacaaatctgatctagaatggctccgcgggatcgggtggtcccctctcggctcactcgaagccgagaagaacaagcgggcatcagagatcatcagtgagaaaaagtatcgccaaccgccggaccggaataagttcacaagcattcctgatgccatggacatcgtgctggccaagaccaacgctaaaaaccgctccgataggctgtaccgggaggcatgggataaggataagacccaaatacacattatgcccgacactccagacatcgtgctggccaaggccaatttaataaacacctctgataagctctaccgcatgggatacgaggagctcaaacgcaaaggatacgacctacctgtcgacgccatcccaatcaaggcagcaaaggcgagcagggaaatcgcatcagaatataagtacaaggagggttttaggaagcaacttgggcaccatatcggagcgcgcaacattgaggacgacccaaagatgatgtggtctatgcacgttgctaaaattcagagcgaccgagagtacaagaaagactttgaaaagtggaaaactaaattctcctcccctgtggacatgctcggggtggtcctggcaaaaaagtgtcagaccctcgtatctgatgtggattataaaaactacctgcaccagtggacgtgcctgcccgaccaatccgatgtaattcacgcccgtcaggcgtatgatctccaatccgacaacttatacaaaagtgacctacagtggctcaagggaatcgggtggatgacaagcggtagtctcgaagacgaaaagaataaacgcgccacgcagatcctctccgaccacgtttatcggcaacatcctgatcagtttaaattctctagcttgatggattctatccccatggtgctggccaaaaataatgccatcacaatgaaccatagattgtatactgaggcgtgggacaaggacaagaccaccgtccatatcatgccggacacaccagaagtactattagccaagcagaataaggtaaactactctgaaaaattgtacaagctggggttggaggaggcaaagaggaaaggctatgacatgagagtagacgccattcctatcaaagctgcaaaggcctcgcgcgatatcgccagcgagttcaagtacaaggagggctaccggaagcagctcggccaccatatcggagcccgtgcaattagggacgatcctaagatgatgtggtctatgcacgtggctaaaattcagtccgacagagaatataaaaaggatttcgagaagtggaaaaccaaattttcgtcgccggtggacatgttgggtgttgtgttagccaagaagtgccagaccctagtgtcagatgtcgattacaaaaactatttgcatcagtggacttgtttgcctgaccagagcgatgtcatacacgcccgccaggcctatgatctgcaatctgacaacatgtataagtccgatctccagtggatgaggggaataggctgggtgtctatcgggtccttggatgttgagaagtgcaagagagcaactgagatactgtccgacaagatctatcggcagccaccagataggttcaagttcacttctgtgacagactcactcgaacaggtgctggccaagaacaacgcgatcaccatgaataaaaggctctacaccgaggcctgggataaagataagacacaaatccacataatgccagatacacccgagatcatgctcgccagaatgaacaaaatcaactactctgagagcctttacaagctggcaaacgaggaggcaaagaagaaggggtatgatctgcgctccgacgctattcctattgtggctgctaaggctagccgcgatattatctcagactataaatacaaggacggctactgtaagcagcttgggcatcacattggcgccagaaatatcgaggatgaccctaagatgatgtggtctatgcatgtggctaagatccagtcagatagggagtataagaaagactttgagaaatggaagacaaagttcagctcacccgtcgatatgttgggcgtcgtattagcaaaaaaatgccagacactggtgtcagatgtggattacaagaactacctgcacgaatggacatgtctaccagatcagagtgatgtcattcacgcaagacaggcatacgatttgcagagtgacaacatctacaaatccgacctgcagtggctgcgtggcattggatgggttcctatcggctctatggacgttgtcaagtgcaagcgcgcgacagagattctatctgataatatctaccgacaacccccggataaactcaagttcacaagcgtgaccgactcactggagcaggtcctcgccaagaataatgccctgaatatgaacaagaggctgtacacggaagcctgggataaggacaaaacccagattcacattatgcctgacacacccgagatcatgcttgcgcgccagaacaagatcaattatagcgaaacgctgtacaagctggcaaacgaagaggcgaaaaagaaaggatatgacctgagatccgatgcaataccaattgttgctgcaaaagcatcccgagatgtgatctcggactacaaatacaaggacggctatcgcaaacagctgggccaccatatcggtgctcgaaacatcgaggacgacccaaaaatgatgtggagcatgcatgtggcaaagatccagagcgatcgcgaatataaaaaagatttcgagaagtggaaaactaagttttcaagcccggtcgacatgctgggagtggtactggctaagaagtgccaaactctggtgagcgatgtcgactacaagaactacttacacgagtggacatgtctgcctgaccagaatgacgtcattcacgcccgccaggcgtacgacctgcagtccgacaacatctataagtctgacttgcaatggttgagaggaatcgggtgggtcccaattggttccatggatgtggtgaaatgcaaaagagccgctgaaatcctgtctgataatatttaccgtcagccccccgacaagctcaaatttacctcagttacagacagcctggaacaggtgctggccaaaaacaatgctcttaacatgaataagcggttgtatacggaggcgtgggataaagacaaaacccaagtccacatcatgccagacacacctgagattatgctcgcccggcagaacaagatcaactactctgaatcactctataggcaggcaatggaggaagcgaaaaaggagggttacgatctccgtagtgatgctattcctatcgtcgccgcgaaggcctcccgagacatcgcaagcgactataagtacaaagaggcttataggaaacaattaggtcaccacatcggcgctagagcagtgcatgatgatcctaaaattatgtggtcgctacatatcgctaaggtgcaatccgaccgcgagtataagaaggattttgaaaagtacaagacacggtatagctcccctgtcgacatgctgggcatcgtgctcgcaaagaaatgccagacactggtttctgacgtggactataagcacccactgcatgagtggatttgtctaccagatcagaacgacatcattcacgcacgcaaggcctatgacctccagagcgataacctatataaatcagatttggaatggatgaagggtattggatgggttccaatagattctttggaggtggtgagagccaagcgtgcaggcgaactgttgtccgatactatttatcgtcagcggcccgaaactctcaagttcacaagcatcactgacacacccgaacaagttctagccaaaaacaatgctcttaatatgaacaagaggctgtataccgaggcttgggacaatgataaaaaaacgatccatgtaatgcctgataccccggagattatgctggccaagctgaatagaataaactacagcgacaagctgtacaaactcgccctggaggagtctaagaaggagggctacgacttacgcctggacgccattcccatacaggctgcaaaggcatcccgggatattgcatccgactacaaatacaaagagggctatcggaagcagttggggcaccacataggagctcgaaacatcaaagatgacccaaagatgatgtggtcgatccatgtcgctaagatccagtccgaccgcgagtacaaaaaggagtttgaaaagtggaagaccaagttctcttctccggtcgatatgctcggagtggtcctcgctaagaagtgtcagatcctggtgagcgacatcgactataagcatccactgcacgaatggacttgcctccctgatcagaatgatgtgatacaggcgcggaaggcttacgacttgcagagtgacgctatctacaagagcgatctggaatggctgcggggcataggatgggtgccgattggcagcgttgaggtcgagaaagtgaagcgcgctggcgagatcctaagcgaccgcaagtatagacagcccgctgaccagttgaaatttacgtgcattacagatacgcccgagattgtactcgcaaagaacaatgccctgacaatgtctaagcacctctacaccgaggcatgggatgctgacaaaaccagcatccatgtcatgcccgataccccagacatcctattagcaaagagcaatagcgctaacatctcccagaagctgtacactaaggggtgggacgagtctaaaatgaaggattacgacttacgggccgacgccatctcgattaagagcgccaaagcttccagagatattgcgtccgactacaaatataaggaggcttacgaaaaacagaaaggacatcatatcggagctcagtcaatagaggatgaccccaagattatgtgcgccatacacgcggggaagatccaaagcgagcgggagtacaagaaagaattccaaaaatggaagacaaagtttagttcaccggtggatatgctgagtattctgctggctaaaaagtgtcagactttagtgaccgatatcgattatcgtaattacctgcatgaatggacatgcatgccagatcagaacgatatcattcaagctaaaaaagcctatgatcttcagtctgactccgtgtataaggctgacttggaatggctgcgcggcattggatggatgccagaaggctctgtggagatgaatagggtcaaagtagcacaggatcttgtgaatgagcggctgtaccgcacacgacctgaggccttatcctttactagcatcgtagatacccccgaggtggtgcttgcaaaagccaatagccttcagatttctgagaagctgtatcaggaggcttggaataaagataagtcaaatatcacaatacctagtgacacacccgagatgctacaggcccacatcaacgctttgcagatcagcaacaagctgtaccagaaggattggaatgatgccaagcagaagggatatgatatccgggcggacgcgatcgagataaagcatgcaaaggcgtcccgtgaaatcgcctccgagtacaagtacaaagaggggtaccggaaacagttagggcatcacatgggctttcgtactctccaagacgatcccaaatcagtgtgggctattcacgcagcaaagatccagtccgatcgggagtataagaaagcctacgaaaagtcaaagggaattcataacactccattggacatgatgtcaattgtacaagcgaagaagtgtcaggttctggtctcagacatcgactacaggaattatctgcatcagtggacctgtctgccagatcagaatgacgtcattcaggcaaagaaggcctatgatttacagtcagataatctgtacaaatcagatctggagtggttgaagggcatagggtggctccccgaggggagcgtagaggtgatgcgggtgaagaatgctcagaatctcctcaatgagcgactgtatagaatcaagcctgaggcactcaaatttacatcaattgtagatacacctgaggtgatacaggcaaaaattaacgctgttcagatctctgagcccctctatagggatgcctgggagaaagaaaaagcaaatgttaatgttccagccgacacaccgttgatgttacagtcgaaaatcaacgcgcttcagatctccaacaagaggtaccagcaggcctgggaagatgtgaaaatgaccgggtatgacctcagggctgacgccataggtatccagcatgctaaagccagccgagatattgcctctgactacctctataaaactgcctatgagaagcagaagggccactacatcggctgcaggtccgcaaaagaagacccaaagttagtgtgggccgctaatgtactgaaaatgcagaacgatagattgtataaaaaggcttataacgatcataaggccaagatttccattccagttgatatggtctccattagtgccgccaaagaggggcaggcactggcatcagatgtggactaccgacattatctccatcactggtcctgcttccccgaccaaaatgacgttatccaagctcgaaaagcttatgacctccagtctgactcagtctataaggccgatttagaatggctacggggcatcggttggatgcctgagggcagcgtggagatgaacagggtcaaagtggcccaagatctggtaaacgaacgactttaccggaccaggcctgaagctctgagcttcacctccatagtggatacaccagaagtggtattggctaaggccaattcccttcagatttctgaaaagttatatcaggaagcctggaacaaagacaaaagcaatattaccatcccttcggatacaccagagatgttgcaagcccatataaatgctctgcaaatcagcaataagctctaccagaaggactggaacgacacaaagcaaaagggatatgatattagagccgacgccattgagatcaaacacgctaaagccagccgcgagattgcgtctgagtataaatacaaggaggggtatcgtaaacagctcgggcaccatatgggctttcggaccctgcaggatgatcccaaatctgtctgggctatccatgccgctaaaattcagtctgatagggagtacaaaaaggcttatgagaagtctaaggggatccacaatactcccctggatatgatgtccatcgtacaagcaaagaagtgtcaggtactcgtgtctgacatcgactaccgcaactacctccatcagtggacttgtctgccagatcagaatgacgtgatccaagccaaaaaagcctatgatcttcagtctgacaacctgtacaagagcgatctggagtggttgaaggggatcggatggctgccagagggaagcgtcgaggtcatgagagttaagaacgcacagaacctgcttaacgaacggctttataggattaagcccgaggccctgaaatttaccagtatagttgacacccccgaggttatccaggctaaaattaatgcggtgcagataagcgaacccctatatcgcaatgcttgggagaaagagaaagcgaacgtgaatgtccctgctgacactcctctcatgctccaaagtaaaattaatgcactccagataagcaacaagcggtaccagcaggcgtgggaagatgtgaagatgaccggttacgatttgcgggccgatgctattggcatacaacatgctaaggccagccgcgatattgctagtgattatctatataagactgcatatgaaaagcagaaaggccactacatcggctgtaggagcgctaaagaagaccccaagctcgtgtgggcagcaaacgtgcttaaaatgcagaatgacagactctataagaaagcatataacgaccataaggccaagatcagcatccccgttgatatggtctctatcagcgcagctaaagaagggcaggccctcgcttctgatgtagattatcgccactacctgcatcactggtcttgtttccctgaccagaacgatgttattcaagcccggaaggcatacgacctgcagtctgacagtgtgtacaaggccgacctcgaatggctcagaggtatcggttggatgcctgaaggatctgtggagatgaaccgcgtcaaggtggcccaggatctcgtcaacgaacggctctatcgaactagaccggaagcgctgagcttcacatccatcgtggatacgcctgaagtcgtgttggcaaaggcaaatagccttcaaatatccgagaagttgtatcaagaggcttggaataaggacaagagcaacattactatcccatccgacacaccagagatgctgcaggctcacattaatgcactacaaatctctaacaaactgtaccaaaaggattggaacgatacaaagcagaaaggctacgacataagggccgatgcgatagagattaaacatgccaaggcctcccgggaaattgcatccgaatacaaatacaaagaaggataccgcaagcagctggggcaccacatggggtttcgcacgctgcaagatgaccctaagtctgtctgggccatccacgccgcgaaaatacaaagcgatagggagtacaagaaggcctacgagaagtcgaagggcatccataatactcccctggacatgatgagcatcgttcaggctaagaagtgccaggtactggttagcgatatcgactatcgcaattacctacatcagtggacctgcctacctgatcagaatgacgtgattcaggcaaagaaggcatacgacctgcagagcgacaatctgtacaagagcgatcttgaatggctgaagggcataggctggctgcctgagggatccgtggaagtcatgcgagtaaagaatgcacagaacctgctcaacgaaaggctctaccgcattaagccagaagctctgaaattcacttctatagtggatacccccgaggtgatacaggcgaagataaacgccgtgcagatatctgaaccactctatcgcgacgcctgggaaaaagaaaaagcgaacgtgaatgtccccgctgacactcctttaatgttgcagagcaaaattaatgccttacagatcagcaacaagaggtatcagcaggcatgggaagacgtgaagatgactggctatgatttgcgtgccgatgccatcggaatccaacatgctaaagcttctagagacatcgcctccgattacttgtacaaaactgcctacgaaaagcaaaaaggtcactacatcggctgtaggtcggccaaggaagatcccaagctggtgtgggccgcgaatgttcttaaaatgcagaacgaccgcctctataaaaaggcatacaacgaccacaaggccaagatcagtatcccggtcgacatggtttcaatttcagccgccaaagaggggcaggcattggctagtgacgtagattatcgccactacttacatcgttggtcctgcttccctgatcagaacgacgtgattcaggcccgtaaggcgtacgatttgcagagcgatgctctttataaagctgacttagaatggctcagggggattggatggatgccccaaggtagcccagaggtcctgagagtgaaaaatgcccagaacattttctgcgattccgtgtataggactcccgtggtgaatctcaagtatacatcaatcgtggacacaccagaagttgtgctggcaaaaagtaacgccgagaatatttctattcccaagtaccgggaggtttgggataaagataagacctctatacatattatgccagacaccccagaaatcaatcttgcccgagcaaatgctttgaacgtgtcgaacaaactttatagagaaggatgggatgaaatgaaggctggatgtgacgtaagactggacgctatccctatccaagccgctaaagcttctagagagattgcatccgattacaagtacaaactggaccatgagaagcagaaaggccattacgttgggacgcttacagccagggacgataataaaatccgatgggcactgatagcagataaattgcaaaacgaaagggaatatcgcttagattgggctaagtggaaggcaaagattcaaagtcccgtcgatatgctgagtattttgcattctaagaactcccaggccctagtgtcagacatggattaccgtaattacctccaccagtggacatgtatgcccgaccagaacgatgtgattcaggccaaaaaggcgtacgaacttcagagtgacaatgtgtacaaggcggatctcgagtggctgagaggaatcggctggatgcccaatgactctgtctctgtgaatcatgctaagcacgccgctgacatcttttcagagaagaaatatcgtaccaaaatcgaaaccctgaactttacgcctgtggatgaccgggtggactatgtcaccgccaagcaaagcggggagatccttgacgatattaaatatagaaaggactggaacgccacaaaaagcaaatatacacttactgagacacctctgctccatacagcgcaggaagcagccagaattctcgaccagtatctgtacaaggagggctgggaacgtcagaaggccacggggtacatcctcccgcccgacgcagtgcccttcgtccatgctcaccattgcaatgacgtgcagtctgaactgaagtataaggctgagcacgtgaaacagaaggggcattacgtaggtgtccccactatgagggacgatccgaaactcgtgtggtttgagcacgcaggccaaatacagaatgagcggctttacaaagaggactaccataaaacaaaagcaaagatcaatattcctgccgacatggtgtccgtcctggccgcaaagcaaggccaaaccttagtgtctgatattgattaccgcaattacctccaccaatggatgtgtcatcccgatcagaacgacgtgattcaggcaagaaaagcttatgacctccagagcgacaatgtctatagggctgacctggagtggctgcgcggaatcggttggatccctctcgacagcgttgaccatgtcagagtgaccaagaaccaagagatgatgagtcaaatcaagtacaagaagaacgctcttgaaaattaccccaatttcaggtcagtggtggatccacctgaaatcgtgctggcaaagataaattctgtaaaccagtctgacgtcaagtacaaagagactttcaataaggccaagggcaagtacaccttttctccagacacaccgcatataagtcatagcaaagatatgggtaaactctacagcactatcctctataagggcgcatgggaaggaacgaaagcgtacggttacacgctcgatgagcggtatataccaatagtgggcgcaaagcatgctgatctcgtgaacagtgagctgaagtacaaagaaacttatgaaaagcagaaggggcactacctcgcggggaaagtcataggcgagtttcctggggtggttcattgtcttgacttccagaaaatgaggagtgcattaaactatcgcaaacactatgaagacaccaaagctaatgtccatatcccaaatgacatgatgaaccatgtgctggccaaacgttgtcagtacattttatctgacctggagtatcggcattactttcaccagtggacttcattactagaggagccgaatgtcattcgggtccggaacgcccaggaaatccttagtgacaacgtatataaggatgacttgaattggctgaaaggtattggatgctacgtttgggatacaccccaaatactccacgcaaagaaatcttacgatctgcagtcccagctccagtatacagcagccggtaaggagaatcttcagaactataacctggtgacagacacccctctgtacgtgacggcagttcagagtgggataaacgcctccgaggtgaagtataaagagaactatcaccaaattaaagacaagtacaccacagtgttggaaacagtggactatgacaggacaagaaatttgaaaaacctgtatagttccaacctctacaaagaggcctgggatcgcgttaaagccactagttacattctcccatcatccacgctctcgctcacacacgctaaaaatcaaaagcacttggccagtcacattaagtatcgcgaggaatatgagaagttcaaggctctgtatacgttgccgcggagcgtcgacgacgacccgaacaccgccaggtgtctgcgcgtaggcaagctgaatatagaccggctgtacaggagcgtgtatgagaaaaacaagatgaagattcatattgtgccagacatggttgaaatggtgaccgcgaaggactctcaaaagaaggtgagcgagattgattatagattgagactgcacgagtggatctgtcacccagacttacaggtgaacgatcacgtgcggaaagtgaccgatcagatttctgacatagtgtataaagatgacttaaactggctgaagggaatcgggtgttacgtctgggatacaccagaaatcctccacgcgaagcacgcctacgaccttcgggatgacataaagtacaaagctcacatgctaaaaactcgcaacgactataaactggtgaccgacactcctgtgtacgtccaggccgtgaagagcggcaagcaactcagtgacgccgtttaccactacgattacgttcatagtgtccgcggtaaggttgctccgactactaagaccgtggatttggaccgagccctccatgcttacaagttacagtccagcaacctgtataagacttcactccgtaccctgccaacaggatacagactgccaggcgatacaccgcatttcaagcatatcaaagacactcgctatatgagctcttattttaaatataaagaggcttatgagcacactaaggcgtacggatatacactgggtccaaaggacgtgccctttgtccatgttaggcgcgtgaataacgtaactagcgaacgattgtacagagaactgtaccataagctgaaagataaaattcacacaacccccgatacgccagagatccgccaagtgaaaaaaacccaagaggctgtttcagaacttatatataagtcagacttctttaagatgcagggacacatgatttctttgccatataccccacaggtgattcactgcagatacgttggggacattacgtctgatatcaagtataaggaggacctgcaagtactgaaaggatttggctgtttcttgtacgacacccctgatatggtgcgctctcgtcacctaagaaaactgtggagcaactatctctacaccgataaagcccgaaaaatgcgggacaaatacaaagtcgtgttggacacccccgaatacagaaaagtccaggaattgaagactcatctttcagaactggtctatcgggccgctggcaaaaagcagaaatcaatcttcacgagtgttcccgacaccccagacctcctgcgggcgaagcggggccaaaaactacaatcgcagtacctctacgtggagttagctaccaaagagagacctcatcaccatgccgggaaccagactactgcattgaagcacgccaaggacgtaaaagacatggtgagcgagaaaaaatacaagatacagtacgagaaaatgaaagacaaatataccccggtccccgacacgccaatcctcatcagggcgaagcgcgcttattggaatgcatccgatcttcgttataaagagacattccaaaagacaaaggggaaataccacactgtcaaggatgccctggatattgtgtatcaccgaaaagtcaccgacgatattagcaaaataaagtataaggaaaactatatgtcacaactgggcatctggagaagcatccccgacagacccgagcacttccatcaccgcgccgttacagacacagtgagcgatgtgaagtacaaggaggaccttacctggcttaagggcatcggatgctacgcctacgatacaccagactttactctggccgaaaaaaacaaaacactttacagtaaatataaatataaagaggtctttgagaggacaaaaagtgactttaaatatgtggcagatagcccaattaaccggcacttcaaatacgctacccagttaatgaatgagaagaaatatcgggctgattatgagcagcggaaggacaaataccacctggtggtcgacgagccacgccatctgttagccaagactgctggtgatcagatctctcagataaagtacaggaagaactatgaaaagagtaaggacaagttcacctctatcgtggacacacccgaacacctgagaacaactaaagtcaacaaacagatttctgatatattgtacaagttggaatacaataaagcaaaaccccgcgggtatacgacaattcacgatacaccaatgcttttgcatgtgaggaaggtgaaagacgaggtcagtgacttaaagtacaaggaggtgtaccagaggaataaaagtaattgtacaattgaacccgacgctgttcacattaaagcagctaaggacgcatacaaggtaaacacaaaccttgactacaagaaacagtacgaggccaacaaagcccattggaaatggacacccgaccggccagactttctgcaggccgcaaagagcagtttgcaacagtcagattttgaatacaaacttgaccgggagttcctgaagggatgcaaactgagcgttaccgatgacaagaataccgtgctggctctgcgaaacactctcattgagagtgatctcaaatacaaggagaaacacgtgaaggaacgggggacctgtcacgccgttccggacacaccccagatattattggccaagactgttagtaaccttgtgagcgagaacaaatataaggaccacgtgaagaaacatcttgcgcagggttcttacacgacattacccgaaaccagagacaccgtgcacgtaaaggaggtgacaaaacatgtctccgatacaaactataagaagaagttcgtgaaagagaagggtaagtctaattactcaattatgctggaacccccagaggtgaaacacgctatggaagtggctaagaagcagtctgacgtggcatatcgaaaggatgcaaaagagaatcttcactacaccactgtggcggaccgcccagacatcaaaaaagcgacacaagcagcgaagcaggcttccgaggttgaataccgtgccaaacaccggaaagagggctcccacgggctgagcatgttgggacgcccagatatcgagatggctaagaaagcagctaagcttagctctcaggtgaagtatcgggagaatttcgataaggaaaaggggaaaacccctaagtataatcccaaagactctcagctgtacaaagttatgaaagatgcaaataacctagccagcgaggtaaaatacaaggccgacttgaagaaattgcataaacccgtcaccgacatgaaagaatctctgattatgaatcatgtgctcaatacctctcagctggcttcttcctatcagtataagaaaaaatatgagaaaagtaaaggccactatcacaccatccctgataatctagagcaactccacctgaaggaggccaccgagttgcagtctatcgttaagtacaaagaaaaatacgagaaggaaagaggtaagccaatgcttgatttcgaaaccccaacttatattacagcaaaggaaagtcagcagatgcagagcggcaaggaataccggaaggactacgaggagtctatcaaaggcaggaacctcacaggcctggaggtgaccccagccttacttcatgtgaaatacgcgacaaaaatagctagcgagaaggaatatcgaaaagacctagaggaaagcatcaggggtaagggacttactgagatggaagacacaccggatatgctccgcgcaaagaacgctacccaaatacttaatgagaaggaatacaaacgggatctcgaactggaagtcaagggaaggggactgaatgcgatggccaacgaaactccggattttatgagagctcgcaacgccacagatatagcctcacaaatcaagtacaagcaatccgccgaaatggagaaagccaactttacctccgtggtggacactccagaaattatacacgcccaacaggtaaagaacctgtcgagccagaagaaatacaaggaagacgccgaaaagtctatgtcctattacgagaccgtcctggacacgcccgagatccagagagttcgcgagaaccaaaaaaacttctcacttctgcaataccagtgcgatctgaaaaattccaaagggaagatcacagtcgtacaagacaccccagagatcctcagggttaaggaaaatcagaagaatttctcctctgtcctgtataaggaagacgtctctcctggcaccgcaataggcaagacacctgaaatgatgagagttaaacagactcaggaccatatctcttcagtgaagtacaaggaggcaatcggccaggggaccccgattcctgacctgcccgaggtgaagcgagttaaagagacccaaaaacacattagtagtgtgatgtataaagaaaatcttggcaccggcatccccaccactgtaactcctgagatcgagagagtgaaacgtaatcaagaaaacttttctagcgtactctacaaggagaatctgggcaagggcatccctaccccaatcactccggagatggagcgagttaagaggaatcaggagaactttagttctatactttataaggaaaacttatccaagggaactcctttaccagtgacaccagagatggaacgagttaagctgaatcaggagaatttcagcagcgtcctgtacaaagagaatgtgggcaagggtatcccaattcctataacccctgagatggaacgcgtcaagcataaccaggaaaacttctcatccgtgctgtacaaagagaatttaggaactggcattcctatcccaatcacccctgagatgcagcgcgtaaagcacaatcaggagaatctttcatctgttttatataaagagaatatgggcaagggaacaccgctgccagtgacgcctgagatggaaagggttaaacataaccaggagaatatttcgagcgttctgtacaaggagaacatgggcaaaggtaccccactcccagtgacccctgaaatggagcgcgtgaagcacaatcaggaaaacattagctccgtgctatataaagaaaatatgggcaaaggcacccctttagccgtcactcccgaaatggagcgggtgaagcataatcaggagaacattagctccgttctctacaaggagaatgtgggtaaagcaactgctacacccgtgaccccagagatgcagcgggtgaagcgcaaccaggaaaatatctcttctgtgttgtacaaggagaatttaggcaaagcaacaccgacaccgtttacacccgagatggaaagagtgaaacgtaaccaggagaactttagcagtgtgctttataaagaaaatatgcgcaaagctacccctacccccgtgactcctgagatggagcgtgctaaaagaaatcaggagaacatttcatctgtcttgtacagcgactcatttcggaaacagatccagggaaaagccgcatacgtgttggacacgcccgagatgaggcgggtgagagaaacacagaggcacatcagcaccgtgaagtatcacgaagattttgagaagcacaagggctgttttacccctgtcgtgacagatcccataactgagcgggtgaagaagaatatgcaggatttctccgacataaactatcgcggcattcaaagaaaggttgtcgagatggaacaaaaaagaaacgaccaggatcaggaaacgataacaggattgagagtctggcggacgaatcctggctctgttttcgattatgatccggccgaagataacattcagtctagatcccttcatatgatcaacgtgcaggcccagagacgttcacgcgagcagagcaggagcgcatccgctctaagcattagcgggggggaagaaaaatctgagcactccgaggcaccggatcaccacctcagtacttattctgatggcggtgtgtttgccgtgagcaccgcttataaacatgctaaaaccacagaacttcctcagcaacggtcctcttccgtggctacacagcaaacgaccgttagttcaattccaagccatcccagcacggcaggtaagatcttccgggcaatgtatgattacatggccgccgatgccgatgaagtctcgtttaaggatggagacgccattattaacgttcaggccatcgacgagggctggatgtatggtaccgtccagcgtacagggcgaaccgggatgttaccagccaactacgtggaagccatctag

SEQ ID NO: 196726 - DNA, 864 bp, Artificial Sequence
  Description of Artificial Sequence: Synthetic coding sequence
atggccgacgacgaggactacgaggaggtggtggagtactacaccgaagaggtcgtctacgaagaagtgccaggtgaaaccattactaaaatctatgagaccaccacaacgcgcacaagcgactacgaacagagcgaaaccagcaagcccgcactagcccagcccgcactggcacagcctgccagtgccaaacctgtggagagaaggaaagtcattagaaagaaggttgatccctccaagttcatgaccccatatattgcccactcacagaagatgcaggacctcttttcaccaaacaagtacaaagaaaagttcgagaaaaccaagggacagccctatgcatctactacagacacgcctgaactcagaaggatcaagaaggttcaggaccagctcagcgaagtcaagtatcgcatggacggcgatgtagctaagacgatctgtcatgtcgacgaaaaagctaaggatatagaacatgctaagaaagtatcacagcaagtgtcaaaagtcctgtacaagcagaattgggaggacacaaaagataagtacctcctgcccccagatgcgccagagctggtgcaagctgtcaaaaatacagccatgtttagcaagaagctctatacagaagactgggaggcggataagtcacttttctatccatacaacgatagtcccgagcttcggcgcgttgcccaggcccagaaggccctctcggacgtcgcctacaagaagggcctcgcagaacaacaagcacagttcaccccactggcagacccacccgatatagaattcgctaaaaaggtgacaaaccaggtgagtaaacagaaagaaaagaagaggaagaaaaaaagaaaaaaagtgtag

SEQ ID NO: 196727 - DNA, 1317 bp, Artificial Sequence
  Description of Artificial Sequence: Synthetic coding sequence
atgatgcgggtgaagcagacccaggaccacatcagcagcgtgaagtacaaagaagccatcgggcagggtacccccatacccgacctgcccgaggtaaaacgcgtgaaggagacccagaagcacattagcagcgtgatgtataaggagaacctcgggacgggaataccgactacagttaccccagagattgaaagagtgaagaggaaccaggagaacttctcctccgtcctctataaggagaacatgggtaaaggtacaccactggccgtcacacctgagatggaacgagtcaaacataatcaagaaaacatatcctcagtgttatacaaagaaaatgtcggcaaggccacagctacccccgtgacccctgagatgcagagggtaaagcgaaaccaggagaacatctcttccgtgctgtataaagaaaacatgcgcaaagctacccccactcccgtcactccagagatggagagggccaagcgcaatcaggaaaacatctcatccgtgctctattccgactcatttcgcaaacagatccaaggcaaggccgcatatgttcttgacacccctgagatgaggcgggtgagagagacccagcgacacatttccaccgtgaagtatcacgaagactttgagaaacacaagggatgtttcacacccgtggttaccgaccccattacagagcgggttaagaagaacatgcaggatttctcggatatcaactacagagggatacagagaaaagttgtggaaatggagcaaaagcggaacgatcaggaccaggagacgatcaccggcttgcgcgtctggaggaccaatccaggctccgtctttgactacgatcctgcagaagataacatccagagccggtctctccacatgattaatgtgcaggcccagcggcggagtcgggaacagagtcgatccgcttcggccctttcaatatctggcggggaagaaaagtccgagcattccgaagcacccgaccaccaccttagtacctactctgatggaggggtctttgcagtatcaaccgcatacaaacatgctaaaacaactgaactgccccagcagcggagctcatcagtggctacccagcagaccacagtctcctccatcccctcgcacccctcaaccgcgggaaagatttttcgagccatgtacgactatatggccgccgatgcagacgaagtcagctttaaggacggagatgctataattaacgtgcaagctatcgatgagggttggatgtacggcaccgtgcaaagaacagggagaactgggatgctccccgccaattatgtagaggctatttag

SEQ ID NO: 196728 - DNA, 1014 bp, Artificial Sequence
  Description of Artificial Sequence: Synthetic coding sequence
cagaagtacaaggaggactacgagaacaagatcaagggcaagtggtccgaaacaccttgcttcgaagttgctaacgcacgaatgaacgctgataacatctcaacacggaagtatcaagaggattttgaaaatatgaaggatcagatctacttcatgcaaaccgagacacccgagtacaagatgaataaaaaagctggggtggctgccagtaaggtcaagtacaaagaagactacgagaagaataaaggaaaggccgactacaatgtgctgccggcaagtgaaaacccccaactgaggcagcttaaagctgccggagatgccttatcagacaagctgtacaaagaaaattatgagaagacaaaagccaagagcataaactactgtgaaacccccaagttcaagctggacaccgtgttgcagaacttctccagcgataagaaatacaaggacagctatttaaaagacattcttggtcactacgtaggatcatttgaagatccctaccattctcactgcatgaaggtcaccgcccagaattccgataagaattacaaggccgaatacgaggaggatcggggcaagggctttttccctcaaacgatcacgcaggagtacgaggccataaaaaagcttgaccagtgtaaggaccacacttacaaggttcatcctgataagaccaagtttactcaagtgaccgattcacctgtgctactgcaagcccaggtaaactccaaacagctaagtgacttgaactataaggctaagcacgaatcggagaagtttaaatgccatatccccccggacactcctgcctttattcagcataaagtaaacgcctataacttgagtgataatctgtataaacaggattgggaaaaatctaaggctaagaagttcgacataaaagtcgacgcaatacctctcctggccgcaaaggccaacactaaaaacaccagcgatgttatgtacaagaaagactatgaaaagaataaggttaaggtgcagcagcgctag

SEQ ID NO: 196729 - DNA, 5193 bp, Artificial Sequence
  Description of Artificial Sequence: Synthetic coding sequence
atgaacgtgcagccctgcagccggtgcggctacggcgtgtaccccgccgagaagatatcttgtattgatcagatttggcataaggcatgcttccattgcgaggtgtgcaaaatgatgctctccgtcaacaacttcgtgagccaccaaaagaagccctattgtcacgctcataatccaaaaaacaacacattcacatccgtgtaccatacccctctaaatttgaatgtcagaaccttccccgaggcaatctcaggcatacacgaccaggaagatggtgaacagtgtaagagtgtattccactgggacatgaagtcaaaagataaagaaggagcccccaaccgccagcctttggcgaatgagcgggcatactggacgggatacggggagggaaatgcgtggtgccctggagcacttccggacccagaaattgtgcgaatggtggaggcccgcaaaagcctgggtgaggagtacaccgaggattatgagcagccgcgcggaaagggctctttcccagctatgatcaccccggcgtaccagcgcgccaagaaggctaatcagctcgcctctcaggtggagtataaaagaggccatgatgaacggatttcccgtttctcgactgttgtggacacaccagagcttctcagatccaaagccggcgcccaactgcagagcgatgtcaggtacactgaggattacgagcagcaacgggggaaagggagcttcccagccatgatcaccccggcatatcagatcgcaaagcgggctaatgagcttgcatcagatgtgcgataccatcaacaataccaaaaagagatgcgcggcatggccgggcccgctataggggccgaaggcatactgactagggaatgcgcagaccaatatggccaggggtatccggaagaatacgaggaacaccgaggtaaaggtagctttcccgctatgataacccctgcatatcaaaacgctaagaaggctcacgagctggccagcgacatcaaatacagacaggacttcaacaaaatgaagggggcagctcactatcacagcttaccagcgcaggacaatctggtacttaagcaagcccagtctgtcaataaactcgtgtctgaagtggagtataaaaaggacctcgaatcctcacgcggacatagtattaactactgcgagacccctcagtttaggaatgtgagcaagatctccaaattcacctcagacaataaatacaaggagaactatcagaaccatatgaggggcagatacgaaggcgtgggcatggatcgacggacactgcatgccatgaaagtcggatctctcgctagcaatgtggcgtacaaagccgactataagcacgatatagtcgattacaattaccccgctacactcacccctagctaccagaccgccatgaaactggttccgctgaaagacgctaactataggcaatcaatcgataagcttaaatactcatccgtgaccgacactccccagatcgtgcaagcaaaaattaatgctcagcagttgagtcatgttaattacagggcagattacgagaaaaataaactaaattacacacttcctcaggatgtcccacagttggtgaaagcaaagaccaacgcgaaattgttctctgaagtcaagtacaaggagggatgggagaagaccaaaggtaaaggcttcgaaatgaagctcgatgcaatgtcattgttggctgctaaagcctccggcgagctcgcctccaacattaaatataaggaagagtatgagaaaaccaaggggaaggccatgggaacagcggattctcgcctgctgcattccttgcagatagcaaagatgtcgtctgaggtcgaatacaaaaaggggtttgaggaatccaaaactcgctttcacctgcctatggacatggtgaatatcaggcatgccaagaaggctcagacgctcgcctccgaccttgattatcgaaaaaagcttcacgagtatacagtccttcctgaggacatgaagacacagtgggccaaaaaagcatacgggctgcagagtgagctccagtacaaagccgatttggcttggatgaaaggggtgggctggctcaccgagggttctctgaatctggagcaggcaaaaaaggcaggtcagctcgttagcgaaaagaattaccggcagcgtgtcgacgagctaaaatttacatccgtgaccgattccagccagatggaacacgccaagaaaagtcaagagttgcagtctggggtggcttataaagctggcaacgagcagagcgtgcaccagtacaccatcagcaaagatgaaccactctttctccaggctagagcgaacgctgcaaacctgtccgaaaagctgtataaatcatcatgggagaaccaaaaagcaaaaggattcgagctgcggctggacagcctcacgttcctcgcggcaaaggccaagcgggacctcgcttccgaggtcaaatataaggaggactacgaacgctcacgcggaaaactgataggggcaaaagatgttcaaggtgacagccaaatgtcccactcgctgcaaatgagcaagttgcagtctgagttggagtataagaagggatttgaagacacgaagtctcagtgccatgtgtccctggatatggtccatttggtgcacgctcgtaaggctcagcacctagcaactgacgttgggtacaaaacagcagaacatcacttcaccgctctcccaacagacatgaaagtggagtgggccaagaaggcctacggactacagagtgacaatcagtatcgggctgatgtgaagtggatgaagggtatgggatgggtcgccacaggctctctgaacgtggagcaggcgaagaaggccggtgaactaatctcagagaagaaataccgccagcacccagacgcccttaagttcacttccattaaagacacacccgagatggtccaggctaggatttcgtatactcaagccgtggatcgcctgtatcgggaacagggcgagaacatcaagcaccattatactcccaccgcagacctcccagaggtgctcctcgcaaagctaaatgcgatgaacatctctgaaacacggtataaggagagctggtccaaactccgcgatggggggtataagctccgactggacgccttgcctttccaggccgctaaagcgagcggggaaattatcagcgattacaagtataaagaggcttttgaaaaaatgaaagggcaaatgttgggaagccggagtttggaggacgatatcagtctcgcccactccgtgtatgccacctccctccagtcagacgtgaattataagaagggattcgaacactctaaggcccaatttcatctccccctcgatatggctgctctggtgcacgcaaagaaagcccagacccttgccagcaaccaggattataagcacccactgccacagtacacctcgctggccgaggacctccggctttcttgcgcaaaaaaggctcataagcttcagagcgagaatctctatcgcagcgaccttaactttatgagaggcgtggcttgtgtcatccccggcacactggaaatcgaggggcggaaaaaggcgagtgagctgatatctgagtcaaagtacagacagcacccccacagttttaagtacactgccgtgaccgatactcctaacctgctgcacgccaagttttctaaccagataaccaatgagcgattatacaaagctgccggagaggatgcccgccatgagtataccatgactcttggactgcctgagtttatccgggccaagactaacgccgccaacctctcagacgcaagatacaaagagagctggaggaatcttagggcccagggttataaacttactattgaggccttgcccttccaggctgctagggcttcgggcgacatcgcaagcgactttttatataggcatgactttgtaaaagagagagggaagctgatcggtccacagagtgtgcgcgatgatccccggattcagcattgtcgccgcatggggcagttgcagtccgaactgcaatatcggcgtggcgctacatcaagccaggcgcagttccacctgccaatggatatggtgcatctggttcatgcgaagaatgcccaggcgcttgcttcagaccacgattacagaacgcagtaccacaagttcacagcactccctgaggatctgaagatggcctgggctaagaaagcccacgcgctgcaaagtgagctgagatataagtctgatttaattggtatgaagggcattggatggctggcccttcgcagcccccagatggagtcagcaaaaaaggcaggcgagttgatctccgaaactaagtatcgcaagaagccagatagtatcaaatttactacggtagtagattcccctgacctagtgcacgctaagaatagttacatgcactgtaatgagcgcatgtataggagcggtgatgccgaatcccttcacagatacactctcattccggaccatcctgatttcactcgggcccgcctaaacgcactgcacctgtcagacaaggtatataggaactcctgggaacagacaagggccggatcctatgatttccgactcgacgccattcccttccagactgcacgggcgtcccgggaaattgcgagcgacttcaggtacaaggaagcctttttgagagaccgcggcctgcagatcgggtatcggtccgtggacgatgacccccggatgaagcattttcttaatgtgggcaggctgcagagtgacaacgaatacaagaaggattttgcgaagtcccgaagccagttccacagcagcaccgaccagcccggtcttctgcaggcaaaaaggtctcagcagttggcctcggatgtgcactatcgccaaccattaccccagccaacttgcgatcctgagcagcttggcctgcggcacgcacagaaagcccaccagcttcagagcgatgtgaaatataaaagcgacttgaacctcactcggggagtggggtggacgcctccaggctcctataaggttgaaatggcccggcgtgccgccgaacttgcaaatgcacgaggcttggggctgcagggtgcatacaggggggccgaagccgtggaggctggggaccatcagtcaggggaggtcaaccccgatgctaccgaaattctgcacgtgaagaaaaagaaagccttattactgtag

SEQ ID NO: 196730 - DNA, 5088 bp, Artificial Sequence
  Description of Artificial Sequence: Synthetic coding sequence
atgaacgtgcagccctgcagccggtgcggctacggcgtgtaccccgccgagaagatatcttgcattgatcagatatggcacaaagcgtgcttccactgtgaagtgtgcaaaatgatgctgtctgtcaacaactttgtatcacaccagaagaagccatattgtcacgctcacaacccaaaaaacaacactttcacaagcgtctaccatacaccactcaatttaaacgtgcgtacttttccagaggctatcagtggcattcacgaccaggaggatggtgagcagtgtaagtccgtctttcattgggacatgaaaagcaaggataaggaaggggcccccaaccgccagccgctcgccaacgagcgtgcctattggacgggctacggagaagggaatgcatggtgccccggtgcattaccagatccagaaattgtgcgtatggtagaggcaagaaaaagcttaggggaagagtacaccgaggattatgaacaaccacgcggtaaagggagttttccagctatgatcacccccgcctatcagagggccaaaaaggctaaccagctggcttcgcaagtggagtacaaaagagggcatgacgagaggattagccggttctcaacagttgtggacacccccgagctactgcggtctaaggctggcgctcaactgcagtctgatgtcagatacactgaggattatgaacagcagagaggaaagggaagtttccctgctatgattactccagcctaccagattgccaaacgagccaacgagcttgcctccgatgttagataccaccagcagtaccagaaggagatgcggggcatggccggacctgccatcggagccgagggtatcctgacccgcgaatgcgccgaccagtacggccagggctatcctgaggagtatgaggagcataggggaaagggtagctttccagccatgatcacacccgcataccagaatgccaagaaagctcacgagctggcttctgacatcaaatatagacaggacttcaacaaaatgaagggcgcagcacattaccactcattgcccgctcaggataacctggtactgaagcaagctcagagtgtcaataagttggtgagtgagaataagtataaggagaattatcagaaccatatgaggggacgctatgagggcgttggcatggacaggcggacgttgcacgcaatgaaagtaggaagcctggcatcaaacgtggcctacaaagctgattataaacacgacattgtcgactacaactaccctgctaccctcaccccaagctaccagaccgccatgaagttagttcccctgaaagatgcaaattacagacaatctatagataagctcaagtacagctctgtcacagacacaccacagattgtgcaggcgaaaataaatgctcaacaactgtcccatgtgaactatagggctgattacgagaagaataaacttaactataccctcccccaggacgtacctcagctggttaaagccaagaccaacgcaaagctcttttccgaagttaagtacaaggaaggctgggagaagaccaaaggtaaaggttttgaaatgaagctggatgctatgtccttgctggcggccaaggcttctggcgaactagcgagcaacatcaaatacaaggaggagtacgagaagacgaagggcaaggccatgggcacagcagatagtaggcttctccatagcctgcagatcgctaagatgtcatcagaggtggagtacaaaaaaggctttgaggagtccaaaaccagattccacttgcccatggacatggtgaacattaggcacgctaagaaagcacagacattggcgtccgatctcgactacagaaagaagctgcatgaatacacggtgctgcctgaagacatgaaaacccagtgggctaaaaaagcctatggccttcagtccgagcttcagtataaagctgacctggcatggatgaagggagtgggctggcttaccgagggatccctcaatctagagcaggcaaaaaaagccggccaactggtatccgagaagaattatcgccagagagtggatgagctcaaatttacttcagttacagacagctctcagatggagcatgcaaaaaaaagccaggagcttcagtccggcgtagcttacaaagcaggaaacgaacagtctgtgcatcagtataccatatctaaggatgagccattgttcctgcaagcccgcgccaatgctgctaacctttccgaaaaactatataagtccagctgggagaatcagaaagctaaaggattcgagttacggctcgatagtttgaccttcttggcggccaaagccaagagagacctggccagtgaggtgaagtacaaggaggactacgagaggagccgaggcaaactgatcggggccaaagacgttcaaggagattcccagatgtcgcactcccttcagatgagtaagctgcagagcgaactggagtacaagaaagggtttgaggacactaaaagccagtgccacgtttctctcgacatggttcacctggtgcacgcgcgaaaagcccagcaccttgcaacagacgtggggtacaagacagcggagcatcatttcacagctctgccaactgacatgaaggtggagtgggccaaaaaggcctacggcttacaaagcgataaccaataccgggccgacgtcaagtggatgaaagggatgggctgggtggcaactggctccctgaatgtagaacaggccaagaaggccggggagttaattagcgaaaaaaagtaccgacagcatccagacgctctaaaatttacttctatcaaagatacacctgagatggtgcaggctcgaatcagttatacccaggctgtcgatcgcctgtatagagaacagggagaaaacatcaaacatcactatacccctaccgccgaccttccagaagttttactggccaaactgaatgccatgaatatttctgaaacaaggtataaagaaagctggtcaaaactgagagatggcggctataaattgcgcttagacgcgctgccttttcaggcagccaaagcttctggcgagattatctcagactataagtataaggaggctttcgagaagatgaagggtcagatgttagggtctcgtagcctggaggacgacatttctctggcgcactccgtatacgcaacatcattgcagagcgacgttaactataaaaagggttttgagcactccaaggcccaattccaccttcctctggacatggccgcactggtgcatgcgaagaaggcccagacccttgcttcaaatcaggactacaagcacccactgccacaatatacttctctggctgaggacttgcggctgtcttgtgccaagaaggcccataagctgcaatcagagaacctgtacaggtcagacctcaattttatgagaggcgtggcatgcgtaattccaggtaccctcgagattgaagggagaaaaaaggcaagcgagctcataagcgaatcaaaatatagacaacatccacactctttcaagtacacagcagttaccgatacacccaacctgctccatgccaaattcagcaatcagattactaacgagcggctgtacaaagcagcaggggaggatgcacgacatgaatacaccatgacactgggcctccccgaattcatcagagcaaaaaccaatgccgctaatcttagcgacgctagatacaaggagtcatggcgcaacttgagggctcagggatataaactgaccatcgaggcactgccctttcaggccgcgagagctagtggggatattgctagtgatttcctctatcgtcatgatttcgtgaaagagcggggcaagctcataggtccccagtcggtcagggatgacccccgtatccagcattgccgtcgaatgggacaacttcagagcgaactgcagtaccgccgaggggcaacctcttctcaggctcaattccacctgccaatggacatggtccacctcgtccatgcgaagaatgctcaggctctagccagtgatcacgactatcgaactcaatatcacaagtttaccgccctgccagaggacctcaaaatggcgtgggcaaagaaagcacatgctttacagagtgagctgaggtataaaagtgatcttattggaatgaagggcatcgggtggctggcgctgagatctccacagatggagagtgccaaaaaggcaggtgagcttattagtgagactaaataccggaaaaagcccgactctattaagtttacgacagttgtcgactctcccgatctcgtgcatgccaaaaattcatacatgcactgcaatgaacggatgtacaggtccggcgacgccgaaagtctgcacaggtacactcttatccccgatcacccagactttacccgggcccggttgaacgctctgcatttgagtgataaggtctaccgtaacagttgggaacagaccagggccggcagctacgactttcgattggacgcaatacctttccagactgctagagcaagtcgagagatcgcatccgatttccgctacaaggaggcattccttcgagatcgaggacttcagatagggtatcggagtgtggacgatgatcccagaatgaagcattttctgaacgtgggtcggttgcagagcgataatgagtacaaaaaggattttgctaagtcaaggagtcaatttcacagctccacagatcaacctggcctcctgcaggcaaagcggagtcagcagctcgcctccgatgtccactaccggcagccccttcctcaacccacatgcgacccagaacagctgggcctgaggcatgcccagaaagcccaccagttacagtcggatgtgaaatataagagcgatctgaacttgacccgcggagtcggctggacccctccagggtcgtataaggtcgagatggctcgtagggccgccgagctggccaacgcccgtgggctgggactgcaaggggcttatcgtggagccgaggcagtagaagccggcgatcaccagtcaggtgaagtgaaccctgatgctactgaaatcctccacgtgaaaaagaagaaggccctgcttctgtag

SEQ ID NO: 196731 - DNA, 2559 bp, Artificial Sequence
  Description of Artificial Sequence: Synthetic coding sequence
atgcggggcatggccggccccgccatcggcgccgagggcatcctgacaagggaatgcgctgaccaatacggccagggttatcccgaagagtacgaggagcaccgtggaaaaggatcctttcccgccatgattacccctgcttaccagaatgccaagaaggcacatgagttggcctctgacatcaagtacaggcaggattttaataagatgaagggggccgcacattatcatagcctccccgcccaggacaaccttgtcctgaaacaggcgcaaagcgtcaataaactggtttctgaagttgaatacaagaaggaccttgagtcttcacggggccactccatcaattactgcgaaactcctcaatttaggaatgtgtctaagatctccaagttcacctctgacaacaagtacaaggaaaactatcagaaccacatgagagggaggtacgagggcgtcggtatggataggcgaactctgcatgcgatgaaggtgggctcgttagcaagcaatgtggcatataaggcagattacaaacacgatatcgtggactataactaccccgccacccttactcccagctaccagacagcgatgaagcttgtgcccctgaaggacgctaactaccggcagtctatcgataagttgaagtactctagcgtgactgatacgccccagattgtgcaggccaagataaatgcccaacagctcagccacgtaaactatagggctgactatgagaaaaacaagctgaattacactctcccccaggacgtgcctcagctggttaaagcgaagaccaatgctaagctctttagtgaagtgaagtataaagaggggtgggagaagaccaagggaaaaggtttcgagatgaaattggacgcaatgagtctgctggccgcaaaagcgagtggtgaactcgctagtaacgttcatttgctgctctccctgaaaatcaaatacaaagaagagtacgaaaagaccaagggcaaggctatgggaactgccgactccaggttgctccattctctgcagatcgcaaaaatgtcctccgaagtcgagtataagaaaggatttgaagagagcaaaacacgcttccatctgcctatggatatgggcgtgggatggctaactgaaggcagcctgaacttggaacaggctaaaaaagcaggccagctggtttccgaaaagaattaccggcagagggtcgatgaactgaaattcacttccgtgaccgactcaagtcagatggaacatgcaaagaaaagccaggaacttcagtcgggcgtggcttacaaagcaggcaatgaacaatcggttcaccagtataccatatccaaagatgagccgcttttcctacaggctagagctaacgccgctaacttgtcagaattcctgtatcgccacgactttgtgaaggagcgcggaaagctgataggcccacagtcggtcagggatgaccctcgcatacagcactgtagacggatgggacaacttcaatccgagctccaatatcgtcggggggccacatcatctcaggcccagtttcacctgccaatggacatggtgcacctggtccacgccaagaatgcacaggcccttgccagcgatcacgactacaggacgcagtaccataagtttacagccctgccagaggacttgaagatggcatgggcaaaaaaagctcacgcattacagtctgaactgaggtacaagagtgatctgattggcatgaaggggattgggtggctcgccttgagatcgcctcaaatggagtcagctaaaaaagccggggagctgatcagcgaaaccaaatatcggaaaaaacccgatagcattaagttcactactgtggttgactcacccgatctggtgcacgccaagaattcgtacatgcactgtaatgagcgaatgtatcggtccggcgacgccgagtccctgcatcgctacacactcatcccagaccaccccgacttcactcgcgcacggctcaacgctttgcatctctccgacttccgctataaagaggcattcctgcgcgatagaggcctgcagattgggtataggtccgtcgatgatgaccctaggatgaaacattttttgaacgtggggagactccagagcgacaacgagtacaaaaaggactttgcgaagtcaagatcgcagttccattcctccacagaccagccaggcttgctgcaggcaaagcgaagtcagcagctcgccagcgatgtgcactatcggcagcctctgcctcagccaacatgtgaccctgagcaactcggactgaggcatgcccagaaggcccaccagttacagtccgatgtgaagtataagagcgacctgaaccttacgcggggcgtgggatggacaccccctggatcttacaaggtggaaatggcacgcagagccgccgagctcgcaaacgccagagggctggggctccagggcgcctatagaggagctgaagctgtcgaggcaggggaccaccagtccggcgaggttaatccggacgcaaccgagatcctacatgtcaagaagaagaaagctctgctgttgtag

SEQ ID NO: 196732 - DNA, 5217 bp, Artificial Sequence
  Description of Artificial Sequence: Synthetic coding sequence
atgaacgtgcagccctgcagccggtgcggctacggcgtgtaccccgcggaaaagattagttgcattgaccaaatatggcacaaagcatgtttccactgtgaagtttgtaaaatgatgctctctgtgaataactttgtcagccatcagaagaaaccttactgtcacgctcacaatcccaaaaacaacacttttacctcagtgtaccacactcctttgaacctgaacgttcgcacgtttccagaagctatctccgggatccacgaccaggaggacggagagcagtgtaagtctgtctttcactgggatatgaagtctaaggacaaagagggtgcaccaaacagacaaccattggccaacgagcgggcttactggacaggttatggggaaggaaatgcctggtgcccaggagctctgccggatcccgagatcgtgcggatggtagaggcgcgaaagagtctaggagaggagtatactgaggattacgaacagcctcggggtaaaggctctttccctgccatgattacccctgcttatcaacgggcgaagaaggcgaaccagctcgcttcacaggtggaatacaagcgcgggcacgacgaacgaatatctaggttctcaaccgtggtggacactccagagctgctccgcagcaaggccggtgcgcagctccaatcagacgtgagatacaccgaggattacgagcagcagagaggcaaaggcagctttcctgccatgatcaccccagcctatcagattgctaaaagagcaaatgagttagcatccgatgttaggtaccatcagcagtaccagaaggaaatgcggggaatggcagggccagccatcggagctgagggcatactgacccgagaatgtgcagatcagtatgggcaggggtatccggaggagtacgaagagcacaggggcaagggctcctttccggccatgattacccccgcataccaaaacgcaaaaaaagcccatgaattggcatccgacattaagtatcgacaggatttcaacaagatgaagggggcagcccactaccacagcctgcccgcacaggacaacctggtgctgaagcaggcccaatccgtaaacaagcttgtttccgaagttgagtataaaaaggatctggagagtagcagaggccattcgataaactactgtgagacaccccagttcaggaacgtgagtaagatcagtaagtttacatccgacaacaagtacaaagaaaattaccaaaatcatatgcggggaaggtatgagggcgtgggcatggacagacggactctacatgcaatgaaggttggaagcctcgcaagtaacgtggcctacaaagcagactataagcacgatattgtggactataattacccagctactctcacccctagttaccaaaccgccatgaaacttgtccctctcaaagacgcaaattaccggcagagtattgacaagctgaaatacagctccgtcactgatactccccagatcgtccaggctaaaatcaatgcgcagcagctatcccacgtaaactaccgcgcggattatgagaagaacaagttaaactacacactgccacaggacgtgcctcagctcgtgaaagcaaaaacaaacgcaaaattgttcagtgaggtaaaatataaggaaggctgggagaagaccaagggaaagggtttcgaaatgaaactggacgcaatgtctttgttagcagctaaagcaagtggtgaactggcaagcaacgttcatctgctgctgtcattgaagattaagtacaaggaggagtatgagaagaccaagggcaaagccatgggcacggccgattccagactgttgcactccctgcagattgctaaaatgtcttccgaagtcgagtacaaaaagggctttgaagaaagtaaaaccagattccacctgcccatggatatggtgaatatccgtcacgctaagaaagcacagacgcttgcaagtgacttggactatcgcaagaagctccatgaatataccgtgctgcccgaagatatgaagactcagtgggccaagaaagcttatggattacagtccgaactgcagtataaggctgaccttgcgtggatgaagggcgtcgggtggctgacagagggcagcctgaacctggaacaagcgaagaaggccggacagctagtgagcgaaaagaactatcgacagagagtcgatgagctaaaatttacgtctgtgaccgacagcagccagatggagcacgctaagaaatcacaagagctgcagtcgggggtcgcttacaaggccgggaacgagcagtcagtgcaccaatatacaatatcaaaggacgagcctctgtttttacaagctcgagcaaacgccgccaacctgtccgagaaactttataagtcttcctgggaaaaccaaaaggcgaaaggcttcgaactgcgattggatagcctcacttttttggcggccaaggccaaaagagatttggcttctgaggtcaaatacaaggaagattatgaacggagcagaggtaagctcattggggccaaagatgtccagggcgattcccaaatgagccacagcctgcagatgtcaaaacttcagtcggaattggaatataaaaagggattcgaggacacaaagagccaatgtcacgtctccctggatatggtccaccttgtccatgctagaaaggcccagcatctcgccactgacgtgggttacaaaactgccgagcatcactttactgccttgcccacagatatgaaggtcgagtgggcaaagaaagcctatgggctgcagtcagacaatcagtacagggccgatgtgaagtggatgaaagggatgggctgggttgcaactggatctctgaatgttgagcaggctaagaaggctggggaactgatcagcgagaagaaatatagacagcatcccgatgccctgaaatttactagtatcaaagatacacccgagatggttcaggcccgaatctcgtatacacaggccgtggaccgactttatagagaacagggggagaacattaaacatcactataccccaactgctgatttgcctgaggtactgcttgcgaagctaaatgctatgaacatcagtgaaacccgctacaaggagtcttggtctaaattacgggatggcggatacaagttaaggctcgatgccttgcccttccaagccgccaaggcttccggggagataataagcgactacaaatataaggaggcatttgagaagatgaagggccagatgctgggcagccggagcctggaggatgatatcagtctggcccactctgtctacgcaacaagcttgcagagcgacgttaattacaaaaagggcttcgaacacagcaaggcacagttccacttgcctctcgacatggcagctctggtgcatgctaagaaagctcagaccctcgcctcgaaccaggattacaaacacccactcccacagtacaccagtttggccgaggaccttagactgagctgcgccaagaaggctcataagctccagtcagagaacttgtatcgatccgacttaaatttcatgaggggtgtggcttgtgtcatacctgggaccctggagattgagggacgcaagaaagcctctgagctgatttcagaaagcaagtaccgacagcaccctcacagcttcaaatatactgcagtcaccgatactccaaacctgctccacgcgaagtttagtaatcaaatcaccaacgagaggctctacaaggcagcaggcgaggacgctaggcacgaatacaccatgactttaggcctgcctgaatttataagagccaaaaccaacgcagcaaatctctccgatgctcggtacaaagaaagttggaggaatctccgagctcaaggttacaagctgacaattgaggcactaccgttccaggcagcccgcgcctccggagatatcgcctccgactttctgtacaggcatgactttgtgaaggagcggggcaagttgattgggcctcaatctgtacgcgatgaccctcggatacaacattgtcgccgcatggggcagctccagtccgagctccagtaccggcgcggggccacttccagccaggcccagtttcacttaccaatggacatggtgcatctggttcacgcgaagaacgcccaggctttggcttcagaccacgattaccgcacccagtaccacaagttcactgccctgccggaagacctcaaaatggcatgggccaagaaagctcatgccctgcagtctgagctccggtataaatccgacttaatcggcatgaaaggcatcgggtggctagcactgagaagcccgcagatggagagtgccaaaaaagcaggggagctgatctctgaaacaaaatacaggaaaaaaccagacagcatcaagtttacgacagtggtggactcaccagaccttgtccacgccaaaaacagctacatgcactgcaatgaacggatgtatcgctccggcgacgctgaatccctccatagatacacactgatcccagatcatccggactttacaagagctaggttaaatgccctccatctttctgataaagtgtaccgtaactcttgggagcagacaagagccggttcttacgactttagactagatgccatcccctttcagactgctcgcgcttcaagggagatcgcgtcagacttccggtacaaggaagcttttctgagagaccggggacttcagatcggctaccgcagcgtggatgatgaccctaggatgaaacacttcctgaacgtgggaaggctgcagtctgacaacgaatacaagaaagattttgccaaaagccggtctcaattccactcttcaaccgatcagcccggtctgcttcaagccaaaaggagtcaacagctggctagcgatgtccactaccggcaaccactgccacaacctacatgcgatccagagcagctgggattgcggcacgcccagaaagcacaccagctgcagagcgatgttaagtacaaaagtgacctgaatctcacccgcggtgtgggttggacgccaccagggtcatacaaggtggagatggctcggcgtgctgcagagctcgcaaatgcaagaggattggggttgcagggcgcctacagaggggcagaagccgtcgaggccggggatcaccagtcgggtgaggttaatcctgacgcaaccgaaattctgcatgtgaaaaagaagaaggctctcttactctag

SEQ ID NO: 196733 - DNA, 5112 bp, Artificial Sequence
  Description of Artificial Sequence: Synthetic coding sequence
atgaacgtgcagccctgcagccggtgcggctacggcgtgtaccccgccgagaagattagttgcatagatcagatctggcacaaagcgtgcttccactgcgaagtctgcaagatgatgctgtccgtcaataatttcgtctcccatcagaagaaaccatactgccatgcccacaaccccaagaataacacttttacctccgtgtaccatacacccctgaatcttaatgttcggactttccctgaggccatctcgggtatccatgatcaggaagacggggaacaatgcaaaagtgttttccactgggatatgaagtcaaaggacaaggagggggcccctaaccggcagccactggcaaacgagagagcatattggacaggctacggcgagggcaatgcctggtgtcctggagcactccctgatcccgagattgtaaggatggttgaggcccggaaatctcttggtgaagagtacaccgaagactatgaacaaccccggggcaaggggtcattccccgcaatgatcacgcctgcataccaacgagctaagaaggcgaatcagctggcaagccaggtggagtataaaagaggtcatgatgagaggatctccagattctcgactgtggtggatacccctgagctgctgcgctccaaggcgggggcccagctccagagcgatgtgcggtatacggaagactatgagcagcaaagaggcaaggggtcttttcccgcaatgattacacctgcttaccagatcgctaaacgagcaaacgaactcgcctcagatgtgcgttaccaccagcagtaccagaaagagatgagaggcatggcaggccccgccatcggcgctgagggcatcttaacacgtgagtgtgccgatcaatacgggcaaggttaccctgaagaatatgaggagcatagagggaagggctcattccccgccatgatcacccccgcctaccagaacgcaaagaaagcccacgagctggcaagtgatattaagtacaggcaggacttcaataaaatgaaaggcgccgcccactaccatagcttaccagcccaagataatttggtccttaagcaggcccagtctgttaacaagctggtgtccgagaacaaatataaagagaactatcaaaaccacatgaggggacgatacgagggggtaggcatggatcgaaggactttacatgcaatgaaggtcgggtccctcgcctcgaatgtcgcatataaggccgactacaagcatgatattgtggattacaactacccagcaaccctgacaccctcctaccagactgctatgaagctggtaccacttaaagacgccaactaccggcaatctatcgacaagttgaaatacagttcagtgacagacacgccccagatcgtgcaggcgaagatcaacgcccagcagctttctcacgtgaattaccgggcagactacgaaaaaaataaactgaattatactctacctcaggatgtgccccaactggtcaaggcaaagacaaacgctaagctgttttctgaagtgaagtacaaggagggatgggagaaaacaaaggggaaaggattcgaaatgaagctagacgctatgtctctgttggcagctaaagcctctggcgagcttgcgtcaaatgtccaccttctcctgtccctgaaaatcaagtacaaagaggagtacgagaagacaaaaggtaaagctatgggtaccgcagactcccgcctgcttcactcactccagattgccaaaatgagttccgaagtcgaatacaaaaaaggtttcgaggagagcaagactcgatttcacctgcccatggatatggtaaacattagacacgcaaaaaaagcccagaccctggccagcgatctcgactaccgcaagaagttgcatgagtataccgtgctccccgaggacatgaagactcagtgggcgaaaaaagcctacggcctgcaatccgagctacagtacaaagctgaccttgcttggatgaagggcgtgggctggctgacagaaggcagcctgaatctcgaacaggctaagaaagcgggtcagctcgttagtgagaaaaattaccgccagcgggttgacgagctgaaatttaccagcgtgacagacagcagtcagatggagcacgctaagaagtctcaggagctgcaaagtggagtcgcatataaggctgggaacgagcagtccgttcatcaatatacaatatcaaaagatgagccattgttcctgcaggcaagagcgaacgcggcaaacctgagcgagaaattatataaatcatcctgggaaaaccagaaagctaagggctttgagctgcgactggattctctgacgtttctcgcagccaaagctaagcgggatcttgcttcagaggtgaaatataaggaagattatgagaggtcgcggggaaagctgatcggcgcgaaggatgtgcagggtgactcacaaatgtcgcactctctacaaatgagcaaactccaaagcgagttggaatacaagaagggcttcgaagacaccaagagccagtgtcatgtgtcactcgacatggttcaccttgtgcacgctagaaaggctcagcatctggccaccgacgttgggtacaaaactgctgagcatcacttcactgcgcttcctaccgatatgaaggttgaatgggcaaagaaggcctacgggcttcagagcgataaccagtaccgggctgacgtgaaatggatgaaaggcatggggtgggtggctaccgggtccctgaacgttgagcaagccaagaaggctggcgagctgatttcagaaaaaaaataccgccagcatcctgatgctctaaagttcacaagtatcaaagacacgcccgaaatggtccaagcacggatctcttacacccaggcggtggatcggttgtatcgtgagcagggcgaaaatattaagcaccactatacaccaaccgccgaccttccggaagtcctgctggctaagctgaacgcaatgaatatatctgagacgcggtacaaggaatcctggagcaagctgagagacggcggatacaaactgcgtctcgatgcgctcccttttcaggccgctaaggcgagcggcgaaatcattagcgattacaaatacaaggaggctttcgagaagatgaagggccaaatgctggggagtcgcagcctggaagacgatatatctcttgctcacagcgtctatgcaacgagtctccagtcggatgttaattataagaagggttttgaacattcaaaggcccagtttcatcttccacttgatatggccgctctggttcatgcgaagaaagctcagaccctggcttccaatcaggattacaaacaccccttgcctcagtacacgtctttggccgaggatttaaggctcagttgcgccaaaaaagcacataagctacagtctgagaatctctaccgaagcgacttaaactttatgcggggagtagcgtgcgtgatcccaggaactttggagatcgaaggtaggaaaaaggcaagcgaactgattagtgagtcaaaataccgccaacatccacattcgtttaaatatacggctgtaaccgatacccctaacttgttgcatgctaagttcagcaaccagattacaaacgaacgcttatataaagcggctggggaggatgcccgtcatgaatataccatgactctcggcctgccggagtttatcagagctaagaccaacgcagccaatctgtcggatgctagatacaaggaatcttggcgcaacctacgggctcaaggctacaaactcaccattgaggcgctgccattccaggcggcccgtgcttccggggatattgcctctgattttctctatcgccacgactttgtcaaggagcgcggaaaactgatcgggccacagtctgtgcgagacgaccccagaatccagcactgtagacgcatgggtcagttgcagtccgaattgcaatatcggcggggcgctacttcatcacaagcacagtttcaccttccaatggacatggtgcatctggtgcacgctaaaaatgcacaggccctggccagcgatcacgattacagaacgcagtatcacaagttcaccgctttgccggaggacctgaaaatggcctgggcaaagaaagctcacgcgctgcagtcagaactcagatacaagagtgatctgattgggatgaagggtatcggatggttggcgctgaggtctccccaaatggaaagcgccaaaaaggcgggagagctcatctctgaaaccaagtataggaagaaacccgatagcatcaaattcacaacagtggtagacagcccagacctggtccatgccaaaaattcctacatgcactgtaacgagcgtatgtatcgcagcggagatgccgagagtttgcatcgttatacactgatcccagatcaccccgattttaccagggctcggttgaacgcactccacctgtccgacaaggtttacaggaatagctgggagcaaactcgtgcaggctcatatgatttccggttggacgctattcccttccaaaccgcccgggcttctcgtgaaatagccagcgatttccgctataaggaagccttcctaagagaccgaggtcttcagatcggatatcggtcggtggacgacgatccccgcatgaaacatttcctcaatgtggggaggctacagagcgacaacgagtataagaaggattttgccaagagcagaagtcagttccattcgtccaccgatcaacccggcctcctgcaggccaagagaagtcagcaattagcctccgacgtgcactatcgacagccacttccacagccgacctgtgacccggagcaactgggattaagacacgcacagaaagctcaccagttgcaatccgacgttaaatataagagcgacttgaatcttaccagaggtgtgggatggaccccaccggggtcgtataaagtggagatggcgaggagagcagccgaactagcaaacgctcggggcctgggcctgcagggagcttaccgtggagccgaggcggttgaggccggagatcaccagagcggcgaggttaatccagatgccaccgagattctgcacgtgaaaaagaaaaaagcgctgctgctctag

SEQ ID NO: 196734 - DNA, 828 bp, Artificial Sequence
  Description of Artificial Sequence: Synthetic coding sequence
atggccaccgagctggagtacgagagcgtgctgtgcgtgaagcccgacgtgagcgtgtacagaattccaccccgtgcctccaatcgaggctacagagcgtcagattggaagctggatcaaccggattggaccgggcggctgcgaattacctccaagggcaaaacagcctacatcaagctcgaggataaggttagtggtgaactgttcgcacaagcccccgtcgagcagtaccccggtatcgctgtcgaaaccgttacagacagctcccgctacttcgtgataaggatccaggatgggactggccgcagcgcattcatcggcatcggcttcactgaccgcggggatgcattcgacttcaatgtgagcttgcaagatcactttaaatgggtgaaacaggaaagcgagatctctaaagaaagtcaggaaatggatgctagaccaaagcttgacctcggatttaaggagggccagacgatcaagctatgtatagggaatattactaacaagaaaggcggcgcatctaagcctaggaccgccaggggtggcggtctgtctcttctcccccctccaccaggtggcaaggtgactatacctcccccatctagctcagttgcaatctcaaatcatgttaccccccctcccatcccaaaatcgaatcacggcggaagcgacgctgacattcttctggacctggactcaccagctccagtaactacaccagctcccaccccagtgtcagtcagtaatgacttgtggggcgatttttcaacagcctcaagctctgtccctaaccaagctccacagccatccaactgggttcagttttag

SEQ ID NO: 196735 - DNA, 402 bp, Artificial Sequence
  Description of Artificial Sequence: Synthetic coding sequence
atggacgcccggcccaagctggacctgggcttcaaggagggccagacgattaaattgtgcataggaaacataacgaataagaaaggcggcgccagtaagccacgtactgcaaggggcggtggattatccctactgccccctccacccggtggtaaggtcacaattccccccccatcttcctccgtggctatcagtaaccacgtgacacctcctcctattcccaagtctaatcacggaggcagcgatgccgacatacttctggacctggactccccagcacccgtgacaaccccagcacctactcctgtcagcgtttccaatgacctttggggagacttctctaccgctagcagctccgtcccaaaccaagccccacagccttctaattgggtccagttctag

SEQ ID NO: 196736 - DNA, 828 bp, Artificial Sequence
  Description of Artificial Sequence: Synthetic coding sequence
atggccaccgagctggagtacgagagcgtgctgtgcgtgaagcccgacgtctctgtgtacaggatacctcctcgggccagcaataggggttacagggcaagcgattggaaacttgatcagccggattggaccgggcgcctacgcataacttcaaagggtaagacagcatatatcaagctggaggataaggtgagtggtgagttattcgctcaggcacccgtggaacaatatcctgggatcgcggttgaaactgtgaccgatagttcccggtactttgtcattcgcatccaagacggtaccgggagatcagcattcataggaatcggttttaccgacaggggtgatgctttcgattttaatgtgtccttgcaagatcatttcaagtgggtgaagcaggagagtgagatatctaaggagtcccaagagatggatgctagacctaagctggaccttggttttaaggaaggacagactataaagttgtgtattggcaacattaccaataaaaagggcggagccagtaaaccccggacagctcgcgggggagggctttccctcctgcctcccccacctgggggcaaggtaaccataccgcccccctcatcttcagtagccataagcaaccacgtgacccctccaccaatcccaaaaagcaaccatggagggtctgatgctgacattttattagatctggatagccccgcccctgtgactacccctgcccccaccccggtatctgtttccaacgacttatggggcgacttttctactgcatcctcttctgtccccaaccaggcgccacagccttcaaactgggtgcagttctag

SEQ ID NO: 196737 - DNA, 558 bp, Artificial Sequence
  Description of Artificial Sequence: Synthetic coding sequence
atggaggagagcggctacgagagcgtgctgtgcgtgaagcccgacgtgcacgtgtacaggataccgccaagggccaccaataggggatacagggccgccgaatggcagctggatcagcctagctggagtgggagactgcggattacagccaaaggtcaaatggcatatatcaagctcgaagacaggacctccggggaactgttcgcgcaggccccagtggaccagtttcccgggaccgctgtcgagagtgttacagactcttcacgctacttcgttatacgaattgaggatggtaacggccgtagggcctttatagggattggattcggtgacaggggcgatgcctttgattttaacgtggctctacaagaccacttcaagtgggtgaaacaacaatgtgaattcgccaagcaggcacaaaaccccgatcagggaccaaaacttgacctgggttttaaagagggccagacaattaagctaaatattgctgtgggcttgggcaatattaacagacgttgctcttgcaccttagccacagcccagtcgtgccattgctag

SEQ ID NO: 196738 - DNA, 792 bp, Artificial Sequence
  Description of Artificial Sequence: Synthetic coding sequence
atggaggagagcggctacgagagcgtgctgtgcgtgaagcccgacgttcacgtctacaggatcccacctcgagccaccaatcgcggctacagagcagcagagtggcagcttgatcagccttcttggtctgggcgattaaggattaccgccaaggggcagatggcatatattaagttggaggaccgcactagcggagaacttttcgcccaagcccccgtggatcagttccccggaaccgctgtcgaaagcgtgacagatagctctcgctatttcgtgatccgaatcgaggacggcaatggtcgccgcgcgtttatcggtatcggttttggtgaccgcggtgacgcctttgatttcaacgtagctctgcaggatcatttcaaatgggtgaagcagcagtgcgagttcgccaagcaggctcagaatcctgaccaaggccccaaactggatctgggttttaaggagggccagacaatcaagttgaatattgcaaacatgaagaagaaagagggagccgcgggcaatcctagagttcggccagcttctacaggcggcctctctcttttgccgcccccaccgggtgggaaaacatccacccttattccaccaccaggcgaacagctggccgtcggcggttccctcgtgcagcctgctgtggctcctagctccgggggggcccctgttccatggccacagccaaatccagccaccgctgacatctggggtgacttcacaaagagcactggcagcacatccagccagacccaacctgggacagggtgggtgcagttttag

SEQ ID NO: 196739 - DNA, 792 bp, Artificial Sequence
  Description of Artificial Sequence: Synthetic coding sequence
atggaggagagcggctacgagagcgtgctgtgcgtgaagcccgacgtgcatgtctacaggatccccccccgggccactaacaggggctaccgcgctgccgaatggcaattagatcagccctcttggagcggcaggctccggattactgccaaagggcagatggcatacataaagttagaggaccgcacgagcggggagctgtttgcacaggcgccggttgaccagtttcctggaactgctgttgaatctgttacggactcctctaggtacttcgttataagaatagaggacggcaatggaaggcgggccttcatcggtatcggctttggcgatcggggggatgcattcgactttaacgtagcgctccaggaccatttcaagtgggtaaaacagcagtgtgagttcgccaaacaagcacagaatccagaccaggggccaaagttggacctcgggtttaaagagggacagaccattaaattgaatattgctaatatgaaaaaaaaggagggcgccgccggaaatccaagagtacggcccgcctccacaggagggttatcactgctgccccctcctcccggaggtaaaacctccacactgataccacccccgggagagcagctggccgtcggagggagcctggtacagcctgctgttgccccctcttccggtggggcccctgtgccttggccacagccaaaccccgccacggccgacatctggggagacttcacaaaaagtacaggcagtacctcctcgcagacccagcccggcaccggctgggtccagttctag

SEQ ID NO: 196740 - DNA, 822 bp, Artificial Sequence
  Description of Artificial Sequence: Synthetic coding sequence
atggaggagagcggctacgagagcgtgctgtgcgtgaagcccgacgtgcatgtttatagaattcctcctagggccactaatcgcggataccgggcagccgaatggcagctcgatcagcccagttggtctggccgattgaggatcaccgccaaagggcaaatggcttatatcaaactcgaggataggacgagtggagagctgtttgcccaagctcccgtcgaccagttccccggcaccgctgtggaatccgtgacagatagttccaggtattttgtgattaggatcgaggacggcaacggccgcagggcattcattggaattgggttcggggaccgaggcgacgccttcgatttcaatgtggccctgcaggaccacttcaagtgggtgaaacagcagtgtgagttcgccaagcaagcgcagaacccagaccaggggccaaagctggatctgggattcaaagaaggtcagactattaaattaaacatcgctaacatgaagaagaaggaaggggcagcaggaaatccccgcgtgagaccagcctctactgggggactgagtctgttacctcccccccccggtggaaagactagcactctcatcccgccccccggtgagcaattagctgtagggggttcccttgtgcaacccgccgtggcaccaagctccgatcagcttccagcgagaccgtcccaggcacaggcggggtctagctcggatttgtctacagtgtttcctcacgtgacatctggaaaagctctaccacacctggggcagagaaaagaggacgaagcactgctcagctggccagtgttcggggcttag

SEQ ID NO: 196741 - DNA, 714 bp, Artificial Sequence
  Description of Artificial Sequence: Synthetic coding sequence
atggaggagagcggcgccgccgagtggcagctggaccagcccagctggtccgggcggctgagaattaccgccaagggacagatggcatatattaagctggaggaccggacttctggcgaactgtttgcccaggcgccggtagaccagttcccagggaccgccgtagagtcagtcaccgatagtagtcggtactttgttatccgcatcgaggacggcaacggccgtagagcttttattggtatcgggtttggcgaccgtggtgacgcattcgatttcaacgtcgccctgcaggatcactttaagtgggtgaaacagcaatgcgaattcgcgaagcaggcccagaaccccgaccagggccccaagttagaccttggatttaaagaggggcagacgatcaagttaaacatcgcaaatatgaagaagaaggagggagccgcggggaaccccagggtgcggcctgcctcaacaggcggactgtcactcttgcctccacccccgggaggtaagacttcgactctgatcccgccacctggggaacagctggccgttggcggaagtctcgtccagcccgccgtggccccatcgtccggaggggctcctgttccctggccccaacctaatcccgcaaccgcagacatctggggggatttcaccaaatcaactggatctacctcttcccagacgcagccaggtacgggctgggtgcagttctag

SEQ ID NO: 196742 - DNA, 792 bp, Artificial Sequence
  Description of Artificial Sequence: Synthetic coding sequence
atggaggagagcggctacgagagcgtgctgtgcgtgaagcccgacgtgcacgtgtacaggatccctccaagagcaactaacagggggtatcgcgccgcagaatggcaattggatcaaccgtcttggagtgggcggctgcgcatcaccgccaaaggccagatggcttatattaaacttgaggatcgaacatcaggagagttgttcgcccaagctcccgtcgaccagttccctggcaccgcagtggagtccgttacagactcttctcggtactttgttatcagaattgaggatggaaacggcagacgcgcctttatcgggattgggttcggggataggggtgacgcctttgatttcaacgtcgccctccaggatcatttcaaatgggtgaagcagcaatgcgaatttgctaagcaggcacaaaaccctgaccagggcccaaaactggatctgggatttaaagagggccagactataaaacttaacatagctaacatgaagaaaaaggaaggagcagcggggaaccccagggtgaggcccgcctccacaggcgggctttcattgttgccaccgccaccgggcggcaaaacctccacgttaattcctcctccaggagagcagcttgctgtggggggatctcttgtacagccagccgtcgccccatcttctggtggggcccctgtcccttggccgcaaccaaaccccgctacagccgacatctggggagactttaccaagtcaactgggagtacgagttctcagacccaacccggtactggctgggtgcagttttag

SEQ ID NO: 196743 - DNA, 966 bp, Artificial Sequence
  Description of Artificial Sequence: Synthetic coding sequence
atgagcgagcagagcaaggacctgagcgaccccaacttcgccgccgaagctcccaacagcgaggtgcactcatcaccaggggtgtctgagggagttcctcccagcgctacactcgccgaacctcagagcccgcccctggggcccacggccgcgccccaagccgctccccctcctcaggctcccaatgacgagggcgatcctaaggcactgcagcaggccgccgaagagggacgggctcatcaggccccctcagccgcgcagccaggtcctgcaccacctgctcccgcccaactggttcagaaagcacatgagctcatgtggtacgtcctcgtgaaagaccagaagaagatgattatttggtttccagacatggtcaaggacgtaattggctcatataagaaatggtgcagatctattctgcggcgcactagcctgattctcgcacgggtgttcgggctgcatctgcgcctaacatctctgcacacaatggaattcgccctggtcaaggccctggagcctgaagaacttgacagggttgctctctccaatcgtatgcccatgacaggacttctgcttatgatcctctcactcatctacgttaaaggccgcggtgctcgtgaaagtgcagtgtggaatgtactgcggatactcggactgcggccttggaagaagcattccacatttggggatgttcgcaaactgattacagaagagtttgtccagatgaactatctcaaataccagcgggtcccctacgtagagccccctgagtatgagttcttctgggggtcaagggcatcccgcgaaatcacaaaaatgcagattatggagtttctggcaagggtgtttaaaaaggacccccaggcctggccttcaaggtatagggaggccctggaagaagcccgagctttgcgcgaggcaaacccaactgcccactatccacgttccagcgtctccgaagattag

SEQ ID NO: 196744 - DNA, 915 bp, Artificial Sequence
  Description of Artificial Sequence: Synthetic coding sequence
atgctgcagaagccccggaaccggggccggagcggcggccaggccgagagggatagagattggagtcactccggcaatcccggtgctagcagggctggcgaggatgcccgggtattgagagacggttttgctgaggaagctccatccacttccaggggccctggtggaagccaggggtctcaggggccgtccccccagggcgcacgaagggcacaggcggcaccagccgtaggacctcgttcccagaaacagctggaactcaaggtctccgaactcgtccagtttctgctgattaaggatcagaagaagatccctataaaaagagccgacatcctgaaacacgtcataggagattacaaggatatcttcccagacctgttcaagcgcgccgccgagaggctgcaatatgtcttcgggtataagctcgtggaactggaacctaagtctaatacatacatcctgattaacacattggagccagttgaagaggatgcagagatgaggggcgatcaaggtactcccacaactggcctgcttatgatcgtgttggggctgatattcatgaagggaaataccatcaaggaaacagaggcatgggactttcttcgtcgtttgggagtgtatcccaccaagaagcacctaatcttcggtgacccaaagaaactcatcactgaggattttgtacgccaacgctatttagaataccgacgcatcccgcacaccgacccggtagattatgaatttcagtggggtccaaggaccaacctagagacctccaagatgaaggtactgaaattcgtggcgaaagtgcacaatcaggatcctaaggactggcctgcccagtattgtgaagcactggctgatgaggaaaatagggctcgacctcagcctagcggtccagccccaagttcttag

SEQ ID NO: 196745 - DNA, 666 bp, Artificial Sequence
  Description of Artificial Sequence: Synthetic coding sequence
atggccctggccctggccgccctggccgccgtggagcccgcctgcggaagccgctaccaacagctgcaaaacgaggaagagtccggggagcccgagcaggcagccggtgatgcaccacctccctacagctctatatccgcggagagcgccgcctattttgattataaggacgaatccggatttccaaagccgccctcatataacgtagccaccaccctgccttcctacgatgaagccgaacggacaaaggccgaggcaaccatccccctggtgcccggaagagacgaggactttgtgggcagagacgactttgatgatgccgatcaactgcggattggtaacgatggaattttcatgttgacattcttcatggccttcctctttaactggatcggttttttcctgtctttttgtctcaccacctctgcagccggaaggtacggcgccatttctggcttcggtctctccctgataaaatggatactaattgtgcgcttctcgacttacttccccgggtacttcgacgggcaatactggctttggtgggtctttctggtgttgggctttctgctttttctgaggggatttatcaactacgccaaggtgaggaaaatgcctgaaacattcagcaacctgcccagaacgcgcgtgttattcatctactag

SEQ ID NO: 196746 - DNA, 462 bp, Artificial Sequence
  Description of Artificial Sequence: Synthetic coding sequence
atggccctggccctggccgccctggccgccgtggagcccgcctgcggctctagatatcagcaactacaaaatgaggaggaaagtggtgaacccgaacaggctgcgggagatgcacctcccccctactcctctattagcgccgagtccgcagcctactttgattacaaagatgaatccggcttccctaaaccaccttcctataatgtggcgaccaccctccctagctgcttttatgacatttcccacttaatcttcttcatattttacctgaggaatatgaagaagaaatacactaagatggttaagctcttacataaatctgccccagctcagtccgacagttgtaaatgcccgtttatttgttgcgtttgcatctcgcgtatttcaataggctccagatctggttaccagtacattatgcacagaagcgtgggatgccttaaagccaaacaggagaactag

SEQ ID NO: 196747 - DNA, 3138 bp, Artificial Sequence
  Description of Artificial Sequence: Synthetic coding sequence
atgcaccagaagacccccgagatctacagcgtggagctgagcggcaccaaggatatcgtgaagactgataaaggtgatgggaaggagaaatatcgcggtcttaagaacaattgtttggagttgaagaaaaaaaatcataaagaagagtttcaaaaagaattacatctggacgatcataaactgtccaatagagagctagaagaaaagtatgggacggatatcatcatgggactctcctccacaagagctgccgaactcctggcccgggacggaccgaattcactcacaccaccgaaacaaacacccgagattgtaaaatttctcaagcagatggtaggggggttttcgattttactgtgggttggggctttcctgtgctggatcgcttatggcattcagtactcctccgacaagagcgccagccttaacaatgtttacctgggttgcgtcctcgggctggtagtcatcctcacggggattttcgcttactaccaggaagctaagagcaccaatattatgagttctttcaacaaaatgattccacagcaggccctagtcatccgcgattcagaaaagaaaactattcctagtgagcagctcgttgtgggcgacattgtcgaagtgaaaggaggggatcaaattcctgctgatattagagtactgtcatcacaggggtgtagagtggacaatagctcccttaccggcgagagcgaacctcagcctagatcttccgaattcacccacgaaaatcctttggaaactaaaaacatctgcttttactccaccacatgcctcgaagcctcgacttccccagtcggaaccgtgacaggcatggtgatcaacaccggcgaccgaacaattattggtcatattgcctctctcgctagcggggtgggcaatgagaaaactccaattgccatcgaaatcgagcatttcgtgcacattgtagctggcgtggcagtgtccattggtattctcttctttattatcgccgtcagcctgaagtaccaggtcttagacagcatcatctttctgataggaattatcgtggccaatgtgcctgagggactgttagccactgtcactgtaactctttctctgactgcgaagcgtatggccaaaaaaaactgcctggtgaagaacttagaggctgttgaaacgctcggctccacctcaattatatgcagcgacaaaacgggcaccctcacacaaaaccggatgacagtggcccacctgtggtttgataatcagatcttcgtggcggatacttctgaggatcacagcaaccaggtgtttgatcagagctcccgaacctgggccagcctgagtaaaataatcaccctgtgtaacagggctgagtttaagccaggccaggagaatgtgcctataatgaaaaaggctgtgatcggagatgcttctgagaccgccctgctcaaattcagcgaggtgatcctgggtgatgtgatggaaattaggaaaagaaacaggaaggttgccgaaattcctttcaattccactaataaattccagctctcaatccatgagatggacgaccctcacggtaaaaggttcctgatggtcatgaagggcgctcctgagaggatactcgaaaagtgcagtacaattatgattaacggagaagaacacccattagacaagagtaccgccaaaacatttcacactgcttacatggagctaggaggcctcggcgagagagtcctgggtttttgccatctgtatcttcccgcagacgagtttcccgagacatattctttcgacatcgacgcgatgaacttccccacatccaacttgtgctttgttggcttgctgagtatgattgatcctcctagaagtacagtaccagacgctgtgacgaaatgcaggagcgcagggattaaggtgattatggttacgggggatcatcccattaccgctaaggctatagctaaatcagtgggcatcatatcagccaatagcgagaccgtggaggacattgcacatcgtctgaacattgccgttgaacaggtgaacaagcgagatgccaaggcggctgttgtaaccgggatggagttgaaagacatgtcctctgagcaactggatgaaattctggcaaattaccaggagatcgtatttgcgcgcacatcacctcagcagaaacttattattgtcgaagggtgccagcggcaggacgccgtggtggcagtgacaggggacggtgtcaacgattcccctgcactaaaaaaggctgacatcggaattgccatgggcatcgcaggatctgacgcggcgaagaacgctgccgatatggtcttactggatgataatttcgcgtcaatcgtgactggcgtggaagagggccgcctgattttcgataatctgaaaaaaaccatagcttacagtctgaccaagaacatcgcggagctgtgtcccttcctcatttatataattgttggactgcccctgcccattgggactatcacaatcttgttcattgatctcgggacggatataatcccctcaatagctctcgcttatgagaaagccgagtctgatatcatgaaccggaagcctaggcacaagaataaggaccgactagttaaccagccgctggccgtctattcatatttgcacataggcctgatgcaagcactgggtgctttccttgtgtattttactgtgtatgcccaggaggggttcctccctcggacccttatcaatctgagggtggagtgggagaaggattacgtaaatgacctgaaggattcctacgggcaggagtggactcggtatcagagggagtacctggaatggactggctacaccgcatttttcgtcggcattctcgttcagcagatagccgatctcattatcaggaagactagacgaaatagcatatttcaacaaggtctttttagaaataaggttatttgggtcgggattacatcacagatcattatcggcttaattctgagttatggccttgggtctgttaccgccctgtcctttacaatgctgcgcgcgcagtactggttcgtagccgttccccacgcgatccttatatgggtgtatgacgaagtacgcaagctgttcatcagactctatccgggtagctggtgggacaaaaacatgtattactag

SEQ ID NO: 196748 - DNA, 1605 bp, Artificial Sequence
  Description of Artificial Sequence: Synthetic coding sequence
atggcccagctgggcaagctgctgaaggagcagaagtacgaccggcagctcagactctggggcgaccacggccaggaagcccttgagtctgcacatgtgtgcctgattaatgccaccgctaccggcaccgagatactcaagaacttggtcttgcccgggatcgggtcgttcaccatcatcgatggtaaccaggtttcaggcgaggacgctggtaacaatttcttcctgcaacggagcagcattgggaaaaacagagcggaggctgctatggagttcttacaggaactcaatagcgacgtgtctggcagcttcgtagaggaaagtcctgaaaatctgctggataacgacccaagttttttctgccgatttactgtggtggtggcaacccagctgcctgaatccacaagcctgcggttagctgacgttctctggaatagtcagatccccttattgatttgccgaacttacggcctcgttgggtacatgcgcatcatcatcaaggagcaccctgtaattgagagtcacccagacaatgcactggaggatcttcgcttagataagccctttcccgagttaagggaacatttccagagctatgacctagaccacatggaaaaaaaggaccactcgcacaccccttggatcgtgataattgccaagtatctcgcccaatggtacagtgagactaatggacgcattccaaaaacatacaaagagaaagaagactttcgcgacctcattcggcagggaatactgaaaaacgaaaatggggctcccgaagatgaagaaaacttcgaggaagcaataaaaaatgtgaatactgcgctcaatacgacacagataccttcttccatcgaggacatcttcaacgatgatcgatgcataaatattacaaagcaaactccaagcttttggatcctcgccagggcgctgaaggagttcgtagccaaggagggtcaaggtaacttacctgttaggggcactattcccgatatgatcgctgacagcggcaagtacattaagctgcagaatgtctatcgtgagaaagcgaaaaaggacgctgcagcagtaggaaatcatgttgccaagctccttcagagtattggtcaggccccagagtccatttctgaaaaggagctgaagttgctgtgctccaattctgcatttctgcgcgtggtgcggtgccgcagtctggccgaggaatatggtctggatactatcaacaaagatgagatcattagctcaatggataacccagataacgaaatagtgctctacctgatgctccgcgcagtagatcgattccacaaacagcaaggaaggtaccccggcgttagcaattaccaggtggaagaagatatagggaagctgaaatcatgtctaaccggcttcctccaggagtacggattatccgtaatggtgaaggatgattacgtacatgagttttgtagatacggggcagccgaacctcacaccatcgctgcttttttgggtggggctgccgctcaagaagtgattaaaatcatcacaaagcaatttgttatctttaacaatacctacatttattcagggatgagtcaaacatcggctacatttcaattatag

SEQ ID NO: 196749 - DNA, 1587 bp, Artificial Sequence
  Description of Artificial Sequence: Synthetic coding sequence
atggacgcccagcagaccaagaccaacgaggcccggctgtggggcgatcacggccaggaggccctcgaatctgcccatgtgtgcctcatcaatgccacagccaccggaaccgaaatcttaaagaatttagtactgcccggcatcggcagcttcactatcattgacgggaatcaggtttcaggcgaagacgccggcaacaacttttttttgcagcgtagtagcatcggcaaaaatcgagcagaagccgccatggagtttctgcaggagttaaattcagacgtctctggatcgttcgtggaggaatcccctgagaatcttcttgataacgatccttcctttttctgcaggtttactgttgttgtggccacacagctccccgagtctacttcccttcgactggcggacgtgctttggaatagtcagattcctctcctgatctgccgcacttacggattagtggggtatatgcggatcatcataaaagagcaccccgtgattgaaagtcatcccgacaatgcgctggaggacttgcgcctggacaagccgttcccagagctgagagaacatttccagagctacgatttggaccacatggaaaaaaaagatcacagccatacaccctggatagtgattatcgctaaatacctggctcaatggtactccgagaccaatggccgcatccccaaaacatacaaggagaaagaggatttccgagatttgatacggcaggggatactgaaaaatgagaatggagctcccgaagacgaagagaactttgaggaggcaatcaagaacgtgaatactgcccttaacacaacgcagatcccgtctagtattgaggacatctttaacgacgataggtgcattaacattacgaaacaaacccctagcttctggattctggcccgagccttgaaggaatttgtcgccaaggaaggacaggggaatcttcccgtgcggggtacgattcctgacatgatcgctgatagtggcaagtacatcaaactccagaacgtgtaccgcgaaaaggcaaagaaagatgctgccgcagtaggcaatcatgtcgcgaagctcctgcagagcattggacaagctcctgaatcgatctccgagaaggaacttaagctcctgtgttcaaattctgcatttctgcgcgtggtcaggtgcagatcactagctgaggaatacggactggataccatcaacaaggacgaaatcatctcaagtatggataatcccgacaacgaaattgtgctgtatctgatgctccgagctgtggaccgattccacaaacagcagggtcgctaccctggagtctccaactaccaggtcgaagaagatatcggaaagctcaagagttgtctgacgggctttctccaggaatacggtttgtcagtcatggtgaaggatgattacgtacacgaattctgtcggtatggggcggccgaacctcacaccattgccgctttcctgggaggcgccgcagcccaggaagttattaagatcatcactaagcagtttgtcattttcaacaatacctatatctacagtggtatgagccagacgagcgcaacattccagctgtag

SEQ ID NO: 196750 - DNA, 1338 bp, Artificial Sequence
  Description of Artificial Sequence: Synthetic coding sequence
atggagttcctgcaggagctgaacagcgacgtgagcggcagcttcgttgaggaaagccccgagaatctcctggacaatgacccttcattcttttgcaggtttaccgttgtcgtggccacacagctgccggagtcaactagtctgcggttagccgatgtcctctggaacagccagattccactcctgatttgtcgaacctatggcctggttggttacatgcggattatcatcaaggagcatcctgtcattgaaagccacccagacaacgccctggaggacctgcggctcgacaaacccttcccagaactgagagaacatttccagtcatatgaccttgaccacatggaaaagaaggatcacagccacacaccctggattgtgattattgctaaatatctggcccagtggtacagcgagacgaacggaagaattccaaaaacctacaaggaaaaggaagactttcgagatctgatccgccaggggattctgaaaaacgaaaacggcgcccccgaagacgaggagaatttcgaggaagccatcaagaatgtgaataccgccctcaacaccacacaaattccctccagcatagaagacatctttaacgatgatagatgcattaatatcactaaacaaacgccctcattttggatcctggctagagcgcttaaggaattcgtggctaaggagggccagggaaacctcccagtgcggggtaccataccagacatgattgccgacagcgggaagtacataaaactccagaacgtgtacagggaaaaagccaagaaggatgctgctgcggttgggaaccatgtcgccaaattgctgcaaagcattggtcaggcgccagagtcgatctccgagaaggagctgaaactcctgtgcagcaactctgcatttttaagagtggttaggtgtcgctcattagctgaagagtacggtctggacaccatcaataaggatgaaataatctcatcaatggataacccagacaatgaaatcgtactgtatcttatgctacgtgctgtggacaggtttcataagcagcagggcaggtatcccggcgttagtaactaccaggtcgaagaagatatcggaaagctcaaatcctgcctcacagggtttctgcaagagtacggcttgtctgtgatggtgaaagacgactacgtgcatgagttttgtcgctatggggcggcagaaccacacaccatagcagctttccttggcggcgcagcagcacaagaggtgattaaaatcatcacgaagcaattcgtgatatttaacaatacttatatttattcgggcatgtctcaaacgagcgcaacattccaactgtag

SEQ ID NO: 196751 - DNA, 2901 bp, Artificial Sequence
  Description of Artificial Sequence: Synthetic coding sequence
atggagccccaggtgaccctgaacgtgaccttcaagaacgagatccagtcctttctcgtgtcagaccctgagaacaccacctgggcagacatagaggcgatggttaaggttagtttcgatctaaatacgatccaaattaagtaccttgatgaggaaaatgaagaggtgagtataaacagccaaggcgagtacgaggaagctctcaaaatggcagtgaagcagggcaaccagcttcaaatgcaggtgcacgaggggcatcacgtcgtggatgaagctccacctccagttgtaggagcgaaaaggttagcagccagagcagggaagaagcccctggcccactactccagcttggtccgcgtcctgggatcagacatgaagaccccagaggaccccgctgtgcagagctttcctctggttccatgtgacacagaccagccccaggataagcctcctgactggttcacatcttacttggaaacattccgcgagcaggttgtgaatgagacagtggaaaagttagaacagaagctgcacgagaagctggtcctccagaacccatctctcggatcttgtcctagtgaagtaagtatgccaacatcagaggagaccctgttccttcccgagaaccagttctcatggcacattgcgtgtaataactgtcaaaggcgcatcgttggagtgaggtatcagtgttcactttgcccgagttataatatatgcgaggactgcgaggctgggccttacggacacgatactaaccatgttctacttaaactgagaaggccggtggttggttcatcagagcccttttgccattccaagtactcaaccccacgtctgccagccgccctggaacaggtccggttacagaaacaggttgacaagaattttctgaaggccgaaaagcagcggctacgcgccgaaaaaaaacagcggaaagcagaggtgaaggagctcaaaaaacagttaaaactccaccgtaaaatccacctttggaattctatccatggcttgcaatcccccaaatctccccttggcaggcccgaaagtcttctccagagcaacactcttatgcttccactgcaaccgtgcacaagcgtgatgccaatgctgtcagccgccttcgtcgacgaaaatcttccagacgggacccacctgcagccgggaaccaaatttatcaaacactggcgaatgaaaaacaccggtaacgttaaatggtccgcagacacgaaacttaagttcatgtgggggaatctgaccttagcgtccactgagaaaaaagacgtgctcgtaccctgtctgaaagccggccacgtcggtgtggtgtccgttgagtttatcgcgccagccctggaagggacatacacaagccactggaggttgtcacacaaaggacaacagttcggtcctcgggtttggtgcagcatcatcgtggatccattcccttcggaggagtcacccgataatatcgagaagggaatgatttcctccagcaagactgacgacttgacctgtcagcaggaggagacgttcctcctggcaaaggaagagagacagctgggggaggtgactgaacagactgaaggcacagcggcatgcattccccaaaaagctaagaatgtagccagtgaaagagagttgtacattccatcagtcgatttactaacagctcaggatctactgtccttcgaactacttgatatcaacattgtccaggagcttgaacgcgtgccccacaatactccagtggacgtgaccccttgtatgtcccccctgccccacgattcacctctcatagaaaaacctgggctgggacagatcgaagaggaaaatgaaggcgccggtttcaaggccttgcctgattctatggtgtccgttaaacgcaaagcggaaaacattgcaagcgttgaagaagccgaggaggacctgagcggaacccagtttgtgtgcgaaaccgtgatccggtcactgacgttagacgcggcccctgatcacaatccaccctgccggcagaagtcccttcaaatgacctttgctctgcctgaagggcctctgggtaacgagaaagaggagatcatccatatcgctgaagaggaggccgtcatggaagaggaggaggacgaagaggacgaggaagaggaggatgaactaaaagatgaggtccagtcccaatccagcgcctcgtccgaagactacatcatcatcctgcccgagtgtttcgatacttctcgccccctcggcgacagcatgtactcttcagctctgtctcagccaggtctcgagagaggcgccgaggggaaacccggagtggaagccggccaggagccagcggaagctggcgaacgcctgcctggcggggagaatcagccccaggaacactctatatccgacatattgactacgtctcagaccctggaaacagtcccactgatcccggaggtggttgagctgcctccctcgctcccaaggtcctccccttgcgtccaccatcacggcagtccaggggtagatctgccagtcaccatcccggaagttagctctgttcccgaccaaattcggggcgaaccgagaggtagctccggtctggtcaattctcgccagaagagctacgaccactctcgccatcatcacggatcttccatcgccgggggcctcgtcaagggggccttgtcagtcgcggcgtcagcgtacaaggcactgttcgccggcccaccagttacagcacaacctatcatttccgaggatcagaccgccgctttgatggcacacttgttcgaaatgggcttttgcgatcgccaacttaatctccgtctgttaaaaaagcataattacaatatcttacaggttgtgactgaacttcttcagctaaataacaatgactggtatagccagcgatattag

SEQ ID NO: 196752 - DNA, 2814 bp, Artificial Sequence
  Description of Artificial Sequence: Synthetic coding sequence
atggagccccaggtgaccctgaacgtgaccttcaagaacgagatccagagtttccttgtgagtgaccccgaaaatacaacttgggccgacatcgaagccatggttaaggtctcatttgatctgaatactattcagatcaaatacctcgacgaggaaaatgaggaggtcaagattgtccttcttggggagtacgaggaagccctgaagatggctgtcaaacaggggaaccagctgcagatgcaagtgcatgaaggacaccatgtcgtcgatgaggcccccccaccggtggtgggggccaagcggcttgccgcgcgcgcggggaagaagccattggcccattattccagccttgtcagggtgctggggagtgacatgaagacaccggaagatcccgcagttcagagctttccactcgtgccttgcgacactgatcaacctcaagacaagccacccgattggtttacatcgtatctggagacatttcgcgaacaggtagtgaatgagacagttgaaaagttggaacagaaattacacgaaaaactggttctgcagaatcccagtctgggttcatgtccgagcgaagtgtccatgccaacctccgaagaaacacttttcctcccggagaaccagttttcatggcacatcgcatgcaacaattgtcagagacgcatcgtgggagtccgttatcagtgttccttgtgtcctagttataatatctgtgaagattgtgaggccggaccttacggacatgatacgaaccacgtgcttttaaagctgagacggcccgttgtcggaagcagtgagcccttctgccattcgaagtacagtacaccaagacttcctgccgccctggagcaggttcggctgcagaagcaagtggacaaaaactttctcaaagctgaaaagcagcggctcagggctgagaaaaagcaacggaaggcagaggtaaaagagctcaagaaacagctcaaactccaccggaagatccacctgtggaatagcattcacgggttgcagtcacctaaatctcctcttggcaggcccgagtcactgctccaaagcaataccctgatgctgccattgcagccgtgcacgtccgtgatgccgatgctgagcgccgcctttgttgatgagaatctcccagacgggacacacctgcaacccgggaccaagttcatcaagcactggagaatgaagaacactgggaatgttaagtggtcagccgatacaaaactcaaatttatgtggggtaaccttaccctggcctcaaccgagaagaaggacgtgctcgtgccgtgtctgaaggcagggcacgtgggagtcgtttccgttgagttcattgcccctgccctggaaggaacatacacgtcccactggaggctgtctcacaaaggccagcagtttggacccagggtctggtgctccatcattgtagatccattcccgagcgaggaatccccagacaatatcgagaagggaatgatctcctctagcaagacagatgatctgacctgtcagcaggaagagacctttttgttggcaaaggaagaaagacagctcggagaggtcactgagcagacggagggtaccgccgcgtgcatccctcagaaggctaagaatgtcgccagcgaaagagagctgtatattcccagtgtggatcttctgactgctcaggatctgctgtcattcgagcttcttgacatcaacattgtccaggaactggaaagagtcccccacaatactcccgtggatgtcacgccctgcatgagccctctgccgcatgattcacctttgatagagaaacctgggctcggtcaaatagaggaggaaaatgagggcgcaggatttaaagccttgccagacagcatggtctccgttaagcgaaaggccgaaaatattgcctctgttgaggaggccgaggaggacttgtccgggacccagtttgtgtgcgagacagtgatcaggtctctcaccttagacgccgcacctgaccataaccccccctgtagacagaaaagcctgcagatgacttttgctctcccagaaggccctttgggaaatgaaaaagaggagatcatccacatagccgaggaagaagcagtcatggaagaggaagaggatgaagaggacgaggaggaggaggacgagttgaaagatgaagtgcagtcccagtcaagtgcttcttccgaagactacatcataatcctgcctgaatgcttcgacacttctcgccccctgggggattcaatgtatagcagtgccttgagccagcccggcctggagaggggggccgagggaaaacccggtgttgaagccgggcaggaaccggcggaggccggagagcgcctgccgggcggagaaaaccagccgcaggagcatagtatctccgatatcttgaccacgagccagactctggaaacagtgcctctgatacccgaggttgtagagctaccaccttccctgccccggtcctcaccatgcgttcaccaccatggctccccaggcgtcgacctgcctgttaccataccagaggtgagctctgtgcccgaccagattaggggtgagccgcgcgggtcatcgggattagtgaactctaggcagaagagttacgaccactcccgacatcaccatggctcctctattgccgggggactggtgaaaggcgccctgtctgtggcagcatcggcctataaggccttatttgctggcccccccgtcaccgcacagggtctgtgggggcttcttagttttctccacctggccaagaaatgcttctttcttaaagcgccgagcgaggccttcagctggttttag

SEQ ID NO: 196753 - DNA, 2901 bp, Artificial Sequence
  Description of Artificial Sequence: Synthetic coding sequence
atggagccccaggtgaccctgaacgtgaccttcaagaacgagatccagagtttcctggtttccgaccctgagaacaccacctgggctgacattgaagcaatggtcaaggtttccttcgacttaaacaccattcaaataaaataccttgacgaagaaaacgaggaagtcaagattgtgcttctgggggagtatgaagaggcattgaagatggctgttaagcagggcaaccagttgcagatgcaggtgcacgagggacaccacgtcgtagacgaggcacctccgcccgtggtcggggccaaacggttggctgctcgggccggcaaaaagcctttggcacactacagctcactggtccgcgtactgggtagtgatatgaaaaccccagaagatcccgccgtgcagagcttccccctggtgccttgcgatactgatcagccccaggacaagcctccagactggttcacttcttacctagagaccttcagggagcaagtagtgaacgagaccgttgagaagctggagcaaaagttgcacgagaagctcgtcctacagaaccccagcttgggctcctgccccagcgaggtgagtatgcctacctcggaggagaccctgttcttgccagagaaccaattctcatggcatattgcctgcaacaattgtcagcggagaatcgtgggcgttaggtatcagtgttccctctgccccagctataacatttgtgaagactgcgaggcaggaccttacggacatgacactaaccatgtgctgctaaagctaaggcgcccggtggtggggtcatccgagcccttttgccattccaaatattcgactcccagactcccagcggctctggaacaagtcagactgcaaaagcaggtagacaagaatttcctcaaagcggagaaacagaggctccgggccgaaaagaaacagcgtaaggccgaggttaaggagttaaaaaagcagttgaagctccacagaaagattcacctgtggaatagcattcacgggttgcaatccccaaagtctccattaggacgtcccgagtcacttctgcagagcaacaccctgatgctccccttacaaccctgcacttccgtgatgccaatgttatcagccgcgtttgtggacgaaaatctgcccgatgggacacatctgcaacctgggaccaaatttatcaagcactggagaatgaagaataccgggaacgtgaaatggagtgctgacacaaaactcaaatttatgtgggggaatctcacactagcctccactgaaaaaaaagatgtactggtgccttgcctaaaagctggacacgtgggagttgtgtccgttgagtttatcgctccagcacttgagggtacatacacctcacactggcggttgtcacacaaggggcagcagttcggacctcgcgtatggtgcagcataattgtagaccccttcccctccgaggagagccctgacaatatcgagaaagggatgatcagctccagtaaaacggacgacttaacctgccagcaggaagaaaccttcctcttggcgaaggaggaacgccagctcggagaggtgacggaacaaacggaaggtaccgcagcttgcatcccccagaaagctaagaatgtggctagcgaaagagagctgtatataccttcggttgaccttctgaccgcccaagacctactttcttttgaattgctcgatattaacatagttcaggagctcgagagagtgccacacaacactcctgtagatgtcacgccttgcatgtctcccctgccacacgacagcccactcattgaaaaaccgggcctcggccagatagaagaagagaacgaaggcgccgggttcaaggctcttcccgactctatggtttccgtcaaacggaaggccgaaaatattgcctccgttgaagaggccgaagaggacctgtctgggacccagttcgtgtgtgaaacagtgatacgaagcctgaccctggacgcagcacccgaccacaacccaccctgtcgccagaagtccttgcagatgacttttgcactgccagaaggacctctgggcaacgagaaagaagaaataatacatattgcggaagaggaggctgtcatggaagaggaagaagacgaagaggatgaggaggaggaagacgagcttaaggatgaggtccagtcccaaagcagcgcgtccagcgaagattatattatcatcctccctgagtgctttgatacttcaagacctctcggcgactcaatgtattcttcagccctgagtcaacccgggttggagagaggtgccgagggaaagcctggcgtcgaagcagggcaagagccagcagaagcaggggagaggttgcctggaggtgagaaccagccccaagaacactcaatcagcgacattttgaccaccagccagacactagagaccgtccccctgatccccgaggtagtggagttaccgccatctctgcctcgaagctctccctgcgtccaccaccatggctcgcccggcgtggatttgcctgtcaccattcctgaggtttcatcggtgcccgatcagattcgaggcgagccgcggggaagcagtggcctagtgaactcaaggcagaaatcctatgaccactcgagacatcatcacgggagctccatcgccggcggcctggtgaaaggggccctatcagtcgccgcttctgcctacaaagctctctttgctggccccccagttaccgcccaacccatcatttctgaggaccaaacagccgcactgatggcccatctgtttgagatggggttctgcgacagacagctgaacctccgcctgctgaagaagcataattacaacatcctgcaggtcgtcaccgagctgctccagctcaataataatgactggtacagccagcgctattag

SEQ ID NO: 196754 - DNA, 2901 bp, Artificial Sequence
  Description of Artificial Sequence: Synthetic coding sequence
atggagccccaggtgaccctgaacgtgaccttcaagaacgagatccagtcattcctggtgagtgaccctgagaacaccacgtgggccgatatagaggctatggtgaaggtctccttcgatctgaataccatccagattaaataccttgatgaggaaaatgaagaagtttcaattaatagccagggtgaatatgaagaagcactcaagatggccgtcaagcagggtaatcaactgcaaatgcaggtccacgagggccatcacgtagtggacgaagccccccctcctgtggtgggcgctaaacggctcgctgcaagggctggcaaaaagccactagcccattattcctctttggtcagggtactggggagcgacatgaagacccccgaagacccagctgtccagagtttccccctggtgccctgtgacaccgatcagccccaggataagccaccagattggttcacctcatacctcgagacctttcgcgagcaggttgtgaatgagaccgtggaaaagctcgagcagaaattgcatgagaagcttgtgctgcagaatccatctctgggcagttgcccctccgaagtcagcatgcctacatcagaggagaccctgttcctgcccgagaaccaattttcttggcacattgcctgcaataattgccagagaagaatcgtgggagtcagatatcagtgcagtctatgcccctcctataatatttgtgaggattgtgaggcgggtccttatggccacgacaccaaccacgtacttctaaaattgcgcagacctgtggtggggtcctctgagcctttctgtcattcaaagtattctactcctagactgcctgcagcactagagcaagttcggcttcagaagcaggtggataaaaacttcctgaaggcggaaaaacagaggctcagagccgagaagaaacagcggaaggccgaggtgaaagaattgaagaagcagttaaaactccataggaagatccacctttggaattcaatacacggacttcagtctcctaaatcgcccttggggaggcctgagtctctgttacagtcaaataccctaatgctcccgcttcagccctgcactagcgtcatgccaatgctgtcagcagcttttgtcgatgaaaacctacccgacggcacgcatttgcagcctggtactaaatttattaagcactggcgtatgaaaaacacgggtaacgtgaaatggagtgccgacaccaaacttaagtttatgtgggggaatctgaccctggcctccacggagaaaaaggatgtcctggtaccgtgcctcaaggcaggccacgtgggcgttgtgtccgtagaattcatagcaccagccctcgaaggaacttacactagccattggcggctcagtcataaaggccagcaatttggaccacgcgtttggtgcagcatcatcgtggatccgttcccgagtgaggaatcccccgataacattgagaaaggaatgatctcctcttctaaaactgacgacttgacctgccagcaggaggaaacatttcttctggccaaagaggaacgccaactgggtgaagttacagagcagactgaaggaacagctgcttgcattccgcagaaagcgaagaatgtagcatccgagcgagaactctacattccctctgttgatctgttaacagcacaggacctattgtcttttgagctgctggacattaatatagtgcaagagttggagagagtcccgcacaacacacctgtcgatgtgactccttgcatgagtccgctgccacacgatagcccactgatcgaaaagcccggacttggccagatcgaggaggaaaacgagggggctggattcaaagctctccccgattctatggtgtctgtgaaacggaaggccgaaaacatagccagtgtggaggaggcggaagaggatctatctggaacacaatttgtctgcgagactgtcattaggtccctgaccctggatgctgctccagaccacaacccaccctgtcggcaaaagagcttgcagatgactttcgctctcccggaagggcctctgggcaatgaaaaggaggagatcatccacatcgctgaggaggaagctgtcatggaagaggaagaagatgaagaagatgaagaggaagaagacgaattgaaggacgaagtccagtctcagagctccgcttcatccgaggactacataatcattctgcctgagtgctttgatacatcgagacctttgggagactcaatgtatagctcagccctttctcagcctggacttgaaagaggagcagaagggaagcctggggtggaagctggacaggaacctgccgaggcaggggagcgcctcccgggcggcgagaaccagccacaggagcattccataagcgacattctgaccacgtcccagactcttgaaactgtgccgctaattcccgaggtggtggagctgcccccctctctgccccgaagttctccatgtgtgcatcaccatggatctccgggtgttgatctgccagtgactatacctgaagtgtccagcgttccagaccaaataagaggagaaccccgcggttcctctggcctggtaaatagccgacagaagagctacgatcacagccgacaccaccacgggtcatcgattgccggaggtctggtgaagggcgccttaagcgtagcagcttctgcttacaaggcattgttcgccggacctccggttacagcccagccaataatctcagaggaccagactgcggccttgatggctcacctttttgagatgggcttttgcgataggcagcttaacctacgtctgctaaagaaacataactacaatattctccaggtggtgactgagttactgcagttgaacaataatgactggtactcacaacgctattag

SEQ ID NO: 196755 - DNA, 654 bp, Artificial Sequence
  Description of Artificial Sequence: Synthetic coding sequence
atgtacagcagcgccctgagccagcccggcctggagcggggcgccgaaggaaaaccgggtgtcgaggcaggtcaggaacccgcagaggctggtgaacgtctgccgggaggtgaaaatcagcctcaggagcattcaatcagcgacatcctcacgacaagtcagaccctagagaccgtgcccctgattcctgaagtggtggagttgccgccgtcgttgcctcgctcttctccttgcgttcaccatcacgggagccctggcgtcgacctacccgtgactataccggaggtgtctagcgtgcctgatcagattcgcggagagccaaggggatcttccggactggtcaatagccgtcaaaaatcttacgatcattcccgacaccaccacggcagttccatcgcaggaggcttggtgaagggtgccttgagtgtcgcagcttccgcatacaaggctttgttcgccggaccccctgtcaccgcccagccaataatcagcgaggaccagacagccgcattaatggcccacctcttcgagatgggcttctgtgaccggcaattaaatctgcgtctactgaaaaagcataactataatatcttgcaagtggttaccgagttgctgcagttaaataacaatgactggtattcacaaaggtactag

SEQ ID NO: 196756 - DNA, 2514 bp, Artificial Sequence
  Description of Artificial Sequence: Synthetic coding sequence
atggagccccaggtgaccctgaacgtgaccttcaagaacgagatccagtcctttctggtgagcgatcccgaaaatacaacgtgggcagatatcgaagcaatggtgagcatcaattctcagggcgaatatgaggaggcactgaagatggccgttaaacagggaaatcagttgcagatgcaggtccacgagggccaccacgttgtcgacgaggcccccccccctgtggtcggtgctaagagactggccgcacgggcggggaagaagcctctcgcacattactcctcactcgtccgggtgctgggctccgatatgaaaacccctgaagatccggcagtgcagagtttccctttggtaccctgcgacacagaccagcctcaggacaaaccccccgactggtttacgagttatttagagacatttcgggagcaggtcgttaacgagacggtcgagaagctggaacagaagctccatgaaaagctggttcttcagaatcctagtttaggcagctgccccagcgaggtgtccatgcctacctcagaggaaactctgtttttgcccgagaaccagttttcatggcacatcgcctgtaacaattgtcagagaagaattgtgggtgtccgttaccagtgcagcctttgccccagttacaatatttgcgaggattgcgaagcaggcccatatggacatgacaccaaccacgtcctccttaagctgaggcgccctgtggtgggcagttctgagcctttttgtcattcaaaatattcaacccctcgcttacccgccgcactcgaacaggtacgtcttcagaaacaggtggacaaaaatttcctgaaggccgagaaacagagactacgggccgagaagaagcaacgaaaagctgaagtaaaggagctgaaaaagcagctgaagctgcatagaaagatacacctttggaactcaatccacggccttcagtccccaaagtcccctttgggaagacccgagagcctcctgcagtccaacactcttatgcttccattgcagccctgcacctcagttatgcccatgctgtccgccgctttcgtggacgagaacctccctgacggtacgcacctgcaacccggaaccaaattcattaaacactggcgtatgaaaaataccgggaatgtgaagtggagcgccgatactaaactcaagtttatgtgggggaatctgaccctggccagcaccgaaaaaaaagacgtgcttgtgccttgtctgaaagccggacacgtgggcgttgtcagcgtggaattcatcgcaccggccctagagggtacatacacgagccattggcggctgtcgcataaaggacagcagttcggccccagggtatggtgtagcattatagtggaccctttccccagcgaggagtccccagataatatcgaaaaggggatgatctcttcatcaaagacagatgacctgacctgccagcaggaggaaaccttcttgctcgccaaggaggagcgccagctgggcgaggtcaccgaacagacagaaggcaccgccgcttgcatcccacaaaaagccaagaacgttgcctcggagagagaactttatatcccatcggtagacctgctaacagctcaggatctgttatcattcgagttattggatatcaacatcgtgcaagagctagaacgggttccccacaatactccggttgacgttacaccttgcatgagccctctaccccacgacagtccactcatcgagaagcctgggttaggccagattgaggaggagaatgaaggcgcaggctttaaagctctgccagatagtatggtgtctgtcaaaagaaaggctgagaatatcgcatctgtggaggaggccgaggaagatctttcagggacccagttcgtatgcgagacagtcattcgctctttaacactcgacgcagccccagaccacaaccccccatgccgacagaaatccttacagatgacattcgccttgccggaggggccattggggaacgagaaggaggaaataatacacatagctgaggaggaggctgtgatggaagaagaagaagatgaggaggatgaagaggaggaggatgaacttaaggacgaggttcaatcgcagtccagtgcctcatctgaagactatattattattctcccggaatgttttgataccagccggccgctgggagacagcatgtattcctcggcgctgagccagcctggcttggaacgtggtgccgagggcaaacccggggttgaggccggccaggagcctgccgaggccggtgagcggctccctggcggggaaaatcagccacaggaacactcaattagcgatatcctcaccacttcgcagactcttgaaacagtgccgctcatcccagaagtcgtagagctcccacctagtttgccacgctctagtccatgcgtacaccaccatgggtcacccggagtggacctccctgtaacaatacctgaggtgagctccgtgcccgaccagatcagaggggctaacaatttctag

SEQ ID NO: 196757 - DNA, 2262 bp, Artificial Sequence
  Description of Artificial Sequence: Synthetic coding sequence
atgcccatggacctgatcctggtggtgtggttctgcgtgtgcaccgcgcgcacagtggttggcttcggcatggacccggatctgcaaatggatatcgtgactgagttggacttagtgaacactaccctgggagtcgcccaggtgtcaggtatgcataacgcatccaaggccttcctgttccaggacatcgagcgggagattcacgctgccccccacgtatcggagaaactgattcaattgtttcggaacaaatccgagttcaccatcctagcaaccgtgcagcaaaagccctcaacctcaggagtgatcctgagtattcgagaactcgaacatagaatttacgagagggtaattgacccacccgataccaatttgccccccggcataaacctgtggctaggtcagcgtaatcagaagcacggcttatttaaggggatcattcaggacggcaagatcatctttatgcctaatgggtatattactcaatgtccaaatctcaatcatacatgtcccacgtgctcagatttcctgagcctggtgcaggggatcatggacctgcaagagctgctcgcaaaaatgaccgccaaactgaactatgcagagaccagactgtctcaactggaaaactgtcactgtgagaagacatgtcaagttagcggccttttataccgtgaccaggattcttgggtggatggcgatcattgtcgcaattgcacatgcaagtctggggcggtggaatgccgccggatgtcgtgtccgccactcaattgctccccagattcactccccgtccacatcgctggacagtgttgtaaggtttgccgcccgaagtgtatatacggcggcaaggttttggccgagggacagcgcattctgactaagagctgtcgagagtgtaggggaggcgtgcttgtcaagataactgagatgtgtccacccctgaactgttcagaaaaggatcacatcctgccagaaaaccagtgctgcagagtgtgcaggggacacaatttttgtgctgagggacctaaatgtggagagaactctgagtgcaagaattggaatacgaaggccacctgcgagtgtaagtccggatacatttcagttcagggggattcggcctactgcgaagacattgatgaatgtgccgctaagatgcattactgtcacgccaacactgtgtgtgtaaatttgcctggtctttaccgttgcgattgcgtgcccggctacatcagggttgatgactttagctgcactgaacatgacgagtgcggaagcggacaacacaattgcgatgagaatgccatttgcacaaatacggtacaggggcacagctgcacatgcaaacccggatacgtaggcaacgggacaatttgcagagccttttgtgaagaaggttgtagatacggtggtacgtgcgtagcaccaaacaagtgtgtctgcccatctgggtttactggctctcactgtgagaaagacattgacgagtgcagcgaaggcattatcgagtgccacaaccatagccgttgtgtgaacctacctggctggtaccattgtgaatgtagatcgggctttcacgatgacggcacttactctctcagcggcgagtcttgcatagatatcgacgagtgtgcactgcggacacacacctgttggaacgactctgcatgcattaatttggccggcggcttcgattgcctgtgtcctagcggcccttcttgtagcggcgactgtccccacgagggcgggctgaagcataacgggcaagtctggacgctcaaggaggaccgttgttctgtgtgcagctgtaaggacggcaagattttttgcagacggacagcctgcgactgccagaatccaagcgccgacctcttctgttgccccgagtgcgatacgagagtcacaagccagtgcttagatcaaaatggacacaaactctaccggagcggggacaactggacacacagctgtcagcagtgccggtgcctagaaggcgaagtagactgttggcccctcacttgtccaaacctaagctgtgagtataccgctatcctggaaggggagtgctgcccccggtgtgtgtctgatccctgtctggccgacaacatcacatatgatattcgcaagacttgcctggattcctacggtgtcagccgccttagcgggtctgtctggaccatggctggtagtccttgtacaacgtgcaagtgtaaaaacgggcgcgtgtgctgctccgtcgacttcgagtgccttcagaacaactag

SEQ ID NO: 196758 - DNA, 2433 bp, Artificial Sequence
  Description of Artificial Sequence: Synthetic coding sequence
atgcccatggacctgatcctggtggtgtggttctgcgtgtgcaccgcaagaaccgtggtgggctttggaatggatccagatctgcagatggacatcgtaacagagctggacctcgtgaacaccactctgggggtcgcccaagtgagtggcatgcacaatgcgagcaaagctttcctatttcaagatatcgagagagagattcatgctgctccgcacgtctcagagaagctaattcaactgtttagaaacaagtctgaattcacaatcctggcaaccgtccagcagaagcccagtaccagtggggtcattttgtcaatacgggaattggagcattcatattttgagcttgaatcctctgggctaagggacgaaattaggtaccattatatccacaatggtaaacccaggactgaggcgctgccatataggatggccgacggccagtggcataaggtggccctgtctgtgtccgccagtcacctgctgcttcatgtggactgcaaccgtatatacgaacgggtcattgacccacctgatactaacctcccccccggaattaacctgtggctcgggcaacggaatcagaagcacgggttgtttaagggaattatccaagatgggaagatcatttttatgccaaatggctacataacccagtgtccgaacctgaatcatacctgtcctacctgctccgacttcctgtctctcgtacaaggtatcatggacctacaggagctgcttgcaaaaatgacagccaaactcaactatgcagagacccgtctgagccaactcgagaattgtcactgcgagaagacatgtcaggtgtccgggcttctgtatcgggaccaagacagttgggtcgatggcgatcactgtcgaaattgtacgtgcaagtccggggctgttgagtgcaggaggatgagttgccccccattgaattgcagcccggactccctgccagttcacatagctgggcagtgttgtaaggtctgtagaccgaagtgtatctacgggggcaaagttttagccgaaggacagaggatccttactaagtcgtgccgagagtgtagaggcggtgtgctcgtgaagatcactgaaatgtgccctcccctgaactgctctgaaaaggaccacattttgcctgaaaaccagtgttgccgcgtgtgtcggggtcataatttctgcgccgaggggccgaagtgcggcgagaattcggagtgtaaaaattggaatactaaagctacgtgcgagtgcaagagtggctacatctctgttcagggcgacagtgcttactgcgaggacatagacgagtgcgcagccaaaatgcactactgccacgccaacacagtatgcgtgaatctccctggcctgtaccgctgtgactgtgtaccagggtatattagggtcgacgatttcagctgcaccgagcatgacgagtgcggctccggtcagcataactgcgatgaaaatgccatatgtaccaatacagttcagggtcactcctgcacatgtaagcctggatacgttggtaatgggacgatctgcagggctttctgcgaggaaggctgtcggtatggggggacatgcgtggcacccaataagtgtgtttgcccatccgggttcactggatctcactgcgagaaggacattgatgaatgcagcgaaggaatcattgagtgccacaaccactcccgctgcgtaaacctaccaggctggtaccactgcgagtgtcgctccggattccacgatgatggaacatatagcctctccggggagagctgcatcgatattgatgaatgtgcactgcgcacacacacctgttggaatgatagcgcatgtatcaacttagctggcgggttcgactgtttgtgtccttccggacctagttgtagtggagactgtccccacgagggtggcctcaaacacaatggccaggtttggactctcaaagaggacagatgcagcgtctgtagttgtaaggacggtaagattttctgcagacgcactgcatgtgattgtcaaaacccctccgccgatttgttttgttgccctgagtgcgatacgcgggtaacatcacaatgcctcgatcaaaatggccacaaattatatagaagtggggacaactggacacattcctgccagcaatgtcgatgcctcgagggagaggtcgactgctggccactgacgtgcccaaatctctcctgtgaatacaccgctatactcgagggtgagtgctgcccccggtgcgtctctgacccatgcctcgccgacaatataacctacgatatccgtaaaacttgtctcgactcgtatggggtgtcacgactctccgggagcgtttggaccatggcaggcagcccatgcacaacctgcaagtgcaagaacggaagagtctgttgcagcgttgactttgagtgcttgcaaaacaattag

SEQ ID NO: 196759 - DNA, 2292 bp, Artificial Sequence
  Description of Artificial Sequence: Synthetic coding sequence
atgcccatggacctgatcctggtggtgtggttctgcgtgtgcaccgcccgaacagtggtgggctttggcatggatccagacttgcaaatggacatcgtgacagagctcgacctggtgaacaccactcttggtgtggcacaggttagcgggatgcataatgcctctaaggcttttctgttccaggatatcgaacgtgagatccacgccgcacctcatgtgagtgagaagttaatccagcttttcaggaataagagcgagtttaccatcctggcaactgtccagcagaaaccatctaccagtggcgtgatcctcagtatacgagagctcgagcattcttactttgagctggagtcctctgggctgcgggatgaaattcgataccactacattcataatggcaaacctcgcactgaggccctgccttatagaatggcagatggccagtggcacaaagtggccctgagcgtctctgcctctcatttgcttctccatgtggactgcaaccgaatttatgaacgggtaatcgatcctcccgatactaatctgcccccaggaatcaacctgtggttaggccagcgcaaccagaagcacggactgttcaaaggcatcattcaggacggtaagatcatcttcatgcctaatgggtacataactcagtgcccaaatttaaatcatacctgtcctacatgctcagactttctgtctcttgtccagggaatcatggacttacaggagctgctggcgaaaatgaccgctaaactgaactacgctgaaacgaggctgagtcagctggaaaactgccactgcgaaaaaacatgccaggtgtcagggctgctatacagagatcaggactcctgggtggacggagaccattgcaggaactgtacatgtaagagcggtgctgtagaatgtagaagaatgtcgtgcccacccctgaattgtagccctgactccctgccagtgcatatcgccggccagtgctgtaaagtttgtaggccgaaatgcatttatgggggtaaggttctggcagaaggccagaggattctgactaagtcatgtcgcgaatgtaggggaggagtcctggtaaagattacggaaatgtgcccaccgctcaattgttctgagaaggaccacatactacctgaaaatcagtgctgtagagtgtgtcgcggtcacaacttttgtgctgaggggcctaagtgtggtgagaattcggagtgtaaaaattggaatacaaaagccacttgtgagtgtaaatctggctacatctccgttcaaggagacagtgcctactgcgaagacatcgatgagtgcgcagccaagatgcactattgtcatgcaaacaccgtctgtgttaacttgccaggactgtatcgctgcgactgcgtgccaggatacattcgggtagacgactttagctgtaccgagcatgatgagtgcggctcaggacagcataattgtgatgaaaacgcgatttgtaccaacactgtgcagggccactcctgcacttgcaaaccgggatacgtgggaaacggaactatttgccgagccttttgcgaagagggctgtagatacggcgggacctgtgtcgcccccaacaagtgcgtgtgtccttctgggtttacaggatcacactgtgaaaaagacatcgatgagtgcgcactgcgaacccatacttgctggaacgattcggcttgcataaatctcgctggaggatttgactgtctgtgcccaagcggcccctcatgtagcggggactgtccacatgaaggagggcttaagcataatgggcaggtttggactctgaaggaagatcgatgctctgtgtgctcatgcaaagatggaaagatcttttgtaggcgaacagcttgcgactgtcagaaccctagcgcagatctgttctgttgccccgagtgtgacaccagggtgacatctcagtgtttggaccagaacggccacaagctatatcggtctggcgacaactggactcatagctgccagcagtgcaggtgtctggagggtgaagtcgattgctggccgctcacctgccctaatctatcatgcgagtacacagcaatcctggaaggggaatgctgcccacggtgcgtaagcgatccttgccttgcggacaatatcacatacgatatccgaaagacatgccttgactcctacggggtatcacgtctctccggcagtgtctggaccatggcaggatccccatgtactacctgcaaatgtaaaaatggccgcgtctgctgtagcgtggattttgagtgcttgcagaacaactag

SEQ ID NO: 196760 - DNA, 2520 bp, Artificial Sequence
  Description of Artificial Sequence: Synthetic coding sequence
atgagcatccggcggctgctgatcctgatcctgaagatcggccggaggtggaccgagcttattagaactatggagtcgcgcgtgcttctgcggactttctgtcttatcttcggccttggcgcagtgtgggggctgggcgtggacccttctctccaaatcgatgtgcttaccgagctggaacttggggagagtacaacaggtgttcgtcaggttccaggcctccataatggcactaaggcttttctctttcaggataccccccggtcgattaaggctagtaccgctactgccgaacagttcttccaaaagttacggaacaagcatgaatttacgattctagtgaccttgaagcagactcatcttaatagcggcgtgattctcagcattcatcacctcgaccataggtacctagaactggaaagctctggccatagaaatgaagtgcggcttcactacagatcaggatctcatagaccccacacagaggtcttcccgtatatactcgctgacgacaagtggcacaagttgagcctcgcaattagtgccagtcatctaatactgcacattgactgcaataaaatctacgaaagagtggttgaaaagccatctacagacctcccactaggcacaaccttttggctgggacagaggaataacgcccatggatatttcaaaggaatcatgcaagacgtacaactgctcgttatgcctcaaggattcatagcccagtgcccagatctgaacagaacctgccctacctgtaatgatttccatggtttagtacagaaaattatggagctccaagacatcctagccaagacatctgcgaagctatcaagggctgaacaacgcatgaaccggcttgaccagtgctattgtgagagaacatgcacaatgaagggcacaacatatcgcgagtttgagagttggattgacggttgcaagaattgtacttgcctcaatggcactatccagtgcgaaacactcatttgtcctaatcctgactgccccctgaaaagcgctctggcctacgtagatggtaagtgctgcaaggaatgtaagtcaatctgccagttccaaggtcgcacctactttgaaggcgagcgcaatacagtgtattcgtcgtcaggcgtctgcgttctatacgagtgcaaggatcagacaatgaaactggttgagtcatctgggtgccctgccctggactgtcccgagtctcatcagatcacactatcccattcctgttgcaaggtttgtaagggctacgacttctgctccgaaagacacaactgcatggaaaattcaatctgtcggaatctgaacgatagagctgtgtgtagctgtagggatggtttccgggccctacgggaagacaacgcgtactgtgaggatattgatgagtgtgccgagggcagacattattgtcgggagaacaccatgtgcgtgaacaccccaggaagttttatgtgcatctgtaagactggctatataagaatagatgactatagttgtactgagcacgacgaatgcatcacaaaccagcataattgcgacgagaatgcgctgtgcttcaataccgtcggtggccataattgtgtgtgcaaacccggctatacaggaaacggaacaacgtgtaaagccttttgtaaggatggttgtcgcaatggcggggcgtgcattgccgcaaacgtctgtgcctgtccacagggctttacaggaccaagttgtgaaacggacatagacgaatgctccgatgggtttgtgcaatgtgactccagggctaactgtatcaacttaccaggttggtatcattgtgaatgtcgcgacggttaccatgacaacggcatgtttagtccctccggcgaaagctgcgaggacatcgatgagtgcggaactggtagacattcctgcgctaatgatacgatctgctttaacctggatggcggctatgattgcagatgtccccacggcaagaactgtacgggtgattgtatacacgatggaaaagtcaaacacaatggacagatttgggtacttgaaaacgatcggtgtagcgtgtgctcctgtcagaacggcttcgtaatgtgtcggcggatggtatgcgactgcgagaatcctactgtcgatcttttttgctgtcccgaatgcgacccacgtctgtcatctcagtgtttgcatcagaatggcgagaccctgtataactcaggcgacacctgggtccagaattgccagcagtgccggtgtctccagggggaagtggactgttggccccttccgtgtcccgacgttgagtgcgaatttagcattctgccagaaaacgaatgctgccctaggtgcgtgacagatccttgccaggctgataccatccggaatgacataacaaagacttgtttggacgagatgaatgtggtccgctttaccggctccagctggattaagcatggcacagaatgtaccttgtgccagtgcaagaatgggcacatctgctgctccgtggatccacaatgcctacaggagctctag

SEQ ID NO: 196761 - DNA, 2448 bp, Artificial Sequence
  Description of Artificial Sequence: Synthetic coding sequence
atggagaccggcctgggcgcccccctgttcaaggcctggctgctgatcagcgtatggggccttggggttgatcctagccttcagatcgatgtgttaacggagttggaactcggggagtccaccacaggagtgagacaggttcccggcttacacaacggaactaaggcctttctcttccaagataccccccgctccattaaggcgagcactgctaccgccgagcagtttttccagaagctcagaaacaagcacgagttcacaatactagtcaccctgaagcagacacatctgaacagtggggtcattctgagtattcaccacctggaccaccgatacctcgagctggagtcaagtgggcacaggaatgaggtcagattgcactatagaagcggatctcataggccccataccgaggtttttccatacatactggccgacgacaagtggcataaactgtctctggccatttctgctagccacctcatactgcatatcgattgcaacaagatctatgagcgtgttgtggaaaaacctagcactgacttaccactcggaaccactttctggctgggtcagcggaataatgctcatggctatttcaagggcatcatgcaggacgtccagctgctcgtgatgccacagggattcatcgcacagtgccccgatcttaacaggacatgcccaacatgtaatgacttccacggcctggtgcagaaaattatggaactgcaggatattctggccaagacatccgccaagctttctcgtgctgagcagaggatgaatcgcctagaccagtgttattgtgagcgtacctgcacaatgaaggggactacctatcgcgagttcgaatcctggatcgatggctgcaaaaactgcacttgccttaacggaacgatccaatgcgagacgctaatatgccccaaccctgactgccccctaaaaagtgcgctggcctacgtcgacggaaaatgttgtaaggaatgtaaatccatctgtcagtttcagggcaggacctacttcgagggagagcggaacacagtctattcttcttccggcgtctgtgtactatacgaatgcaaagatcagaccatgaagctggtcgagtctagcggatgcccggcattggactgtcccgaaagccaccagatcacactttcgcactcctgttgcaaagtgtgtaagggctacgacttctgttccgaacgtcataactgcatggaaaacagtatttgtcgtaatctgaacgatagggcggtgtgcagctgccgagacggatttcgagcattgcgcgaagacaacgcctattgcgaagatatcgatgagtgcgccgaaggcagacactactgtcgcgaaaacacaatgtgcgttaacacacctggctcatttatgtgtatctgcaaaacaggttatatcagaatcgacgactactcctgcaccgagcatgatgagtgtatcacgaatcagcacaattgcgacgagaacgcactctgtttcaatacagtgggaggccacaattgcgtttgcaaaccggggtacactggtaatggaacgacttgtaaggctttttgcaaggatggctgccgcaacggcggcgcctgtatcgctgcaaatgtgtgcgcctgtcctcagggatttacaggaccatcttgcgagactgatattgatgagtgcagcgacgggttcgtgcaatgcgattctcgagccaattgcattaatcttccaggttggtatcactgcgaatgtcgggatggctaccatgacaacggcatgttctccccctcaggggaatcttgcgaggacatcgatgaatgtggcaccggccgccactcgtgcgccaatgacacaatctgcttcaacctagatggtggttatgactgcagatgtccacacggcaagaactgcactggtgattgtatccatgatgggaaggtgaaacataatgggcagatctgggtcctggaaaatgaccgatgttccgtatgctcctgccagaacggattcgttatgtgtcggcggatggtctgcgactgcgagaacccgaccgttgacctcttctgctgcccagaatgcgacccaagattatcctcacagtgcctacaccaaaacggtgaaactttgtataactccggcgatacttgggtgcagaactgtcaacagtgcagatgtctgcaaggggaggtagattgttggccactgccttgccctgatgttgagtgtgagtttagcattttgcccgaaaacgagtgctgtcctcggtgcgttactgacccctgtcaagctgacaccattcgcaatgacattacaaaaacctgcctggacgagatgaacgtggtgagattcaccggaagttcctggattaaacacggaaccgaatgcaccctttgccagtgcaagaacgggcatatttgctgcagcgtagatcctcaatgtctgcaagagttatag

SEQ ID NO: 196762 - DNA, 2451 bp, Artificial Sequence
  Description of Artificial Sequence: Synthetic coding sequence
atggagagccgggtgctgctgcggaccttctgcctgatcttcggcctcggcgcagtgtggggtttaggcgtcgaccctagcctccagatcgacgtccttactgagctcgagctaggagagtccactacaggagtccggcaggtccccggactccataacggcactaaggcctttttgtttcaggatactccgagatctatcaaagcttccacagccactgctgagcaattcttccaaaaattaagaaataagcacgaatttactatactcgtgacacttaaacagacccacttaaactcaggtgttatcttgtccatccaccacctcgatcaccgatatctggaactggagagcagcggccaccggaatgaagtaaggctgcattacagatccggaagccaccggccacatactgaggtcttcccgtacatcctcgccgacgataagtggcacaaactgagcctggcaatctcagccagtcaccttattctacacatcgactgcaacaaaatctacgaaagggtggtggagaaaccgagcaccgacctccctttaggcactacattttggctgggccagaggaacaacgcacatggatactttaaaggaattatgcaggatgtccagctactggtgatgccccaaggcttcatcgcccagtgcccggacttaaatcgtacctgcccaacctgtaacgactttcacggtttggtgcagaaaattatggaacttcaggacatcttggcgaagacttccgctaaactcagccgcgcagagcagcgtatgaatcgtttggaccagtgttactgcgaacgaacatgtactatgaagggcaccacctaccgggagtttgaaagctggatagacgggtgcaagaactgcacatgtctgaatggcaccatccagtgcgagactctaatttgtccaaatccagattgtccactgaaaagcgccttggcatacgttgacgggaagtgttgtaaagaatgcaagtcgatctgccagttccaggggagaacttacttcgaaggagagcgtaacacagtgtattcttcatccggtgtttgcgtcctctacgagtgtaaggaccaaacgatgaagttggtggagagctccggctgcccagctctcgattgtccagagtctcatcagatcacgctaagccattcctgctgcaaggtctgcaagggctacgacttttgttctgaacggcataactgcatggagaattccatctgtcgaaacctaaatgacagagccgtatgtagctgccgagatgggttccgtgcactgcgagaggataatgcgtattgtgaagatattgacgaatgtgccgaggggcgccattactgcagagagaacacaatgtgcgtgaatacccccggctcattcatgtgcatctgcaagacggggtatattcggatagacgactactcatgtaccgagcacgatgagtgcattaccaaccagcataattgtgatgagaatgcactctgtttcaacactgtcggcgggcacaattgcgtttgcaaacccggatacaccggcaacgggacaacatgtaaagcattctgcaaggatggctgccgcaatggcggagcctgtattgccgcaaacgtgtgcgcctgccctcaaggatttactggtcctagctgcgaaacagatatcgatgaatgtagtgatgggtttgtccagtgcgattcccgggcaaattgtattaatctacctggctggtatcactgcgagtgcagagatggatatcatgacaacggcatgttctctccttccggggagtcatgtgaggacatcgacgaatgcggcacggggcggcattcctgcgctaatgatacgatttgttttaatctggacgggggctacgactgtaggtgtccgcacggaaagaactgtacaggcgactgtatccatgacggtaaggtgaagcacaacggccagatctgggtgctggaaaacgatcgctgctcagtatgctcctgccagaacggcttcgttatgtgccgacgtatggtctgtgattgcgagaaccctactgtagacctcttctgctgtcccgaatgtgacccaagactttcctctcagtgtttgcatcagaacggtgaaacactctacaattcaggggatacttgggtgcagaattgccaacagtgcagatgcttacagggcgaggtggactgctggcctctgccatgcccggacgtggagtgtgaattctccattctgcccgagaatgagtgctgccccaggtgtgttacagacccttgccaggccgatacaattcgcaatgacattaccaaaacatgtttagacgaaatgaacgtggttcggtttacgggctcttcttggattaagcacggaaccgaatgtaccctctgtcaatgtaagaacgggcacatttgctgttccgtggacccacagtgtcttcaggagctctag

SEQ ID NO: 196763 - DNA, 2601 bp, Artificial Sequence
  Description of Artificial Sequence: Synthetic coding sequence
atgggcttcccccccctgctgaagggccaggccagcgccacccggtcttcactcgcctcgtgctcatgggtggttttcttcttaagctgcctgagtcgacatgcccctgaaatagagggggggcgccgatggaccgaactgatccgtaccatggaaagtagggtcttgttacgcaccttttgtctaatttttgggctcggtgctgtctggggtttaggcgtggacccaagtctgcaaatagacgtgctcaccgagctggagctcggagagtctacaactggggtgcggcaggttccaggactgcacaatggcacaaaggcatttctctttcaggacactccccgtagtataaaggccagcaccgctacagctgagcaattcttccagaaattgcggaacaagcacgagttcaccatcctggtgaccctgaaacaaacccacctgaactccggggttatattgagcatacatcatctcgaccaccggtatctcgaactggaatccagtgggcatagaaacgaggtgcggttacattaccggtcaggaagtcacaggccccatacagaagtttttccctacattctcgccgatgataaatggcacaagcttagcctggccatctctgctagccatctcattttgcatatcgattgcaataagatatacgagagggtggttgaaaagccctccacggacctgcctctgggcactaccttttggcttggtcagaggaacaatgctcacggctattttaagggaatcatgcaggacgtgcagcttttggttatgccccaggggttcatagctcaatgtcctgatctcaacaggacctgccctacatgtaatgattttcatggactggttcagaaaatcatggagcttcaagacatactggccaagaccagcgccaagctgagccgtgcggagcaacgaatgaataggctcgaccagtgctactgcgagcgaacgtgcactatgaagggcactacttatcgagagtttgagagctggatagacgggtgcaagaattgcacctgtttgaacggtacgattcagtgtgagacattgatctgccccaatcccgactgtcctctgaaatcagcccttgcttatgtcgacgggaaatgttgcaaggaatgcaagtctatatgccagttccaaggccgaacatactttgagggagagcgtaacaccgtctactcatcttctggcgtctgcgtgctttacgagtgtaaggatcaaaccatgaagctcgtcgagtcttcagggtgccctgcccttgattgcccagaatcgcatcagatcaccctctcccacagctgttgtaaagtctgtaagggttatgacttctgctctgaaaggcacaactgtatggaaaattcgatttgccgaaacttaaacgatcgcgccgtttgctcctgtcgagatggcttccgcgccttaagagaggataacgcatattgcgaggacatagatgaatgtgctgagggacgtcattactgccgcgagaacaccatgtgtgtcaataccccggggtcattcatgtgcatctgtaagactggctacattcgaatcgacgactacagctgtaccgagcatgacgagtgtattactaatcagcacaactgtgacgaaaacgcactctgtttcaatacagttggtggacacaactgcgtgtgtaaacctggttatactggcaacggtactacttgcaaagcgttttgtaaggacggctgccggaacggcggtgcgtgtatagccgccaatgtgtgcgcatgtccccaggggttcaccggcccaagctgtgagactgacattgacgaatgctccgatggatttgtacaatgcgattcaagggcaaattgtatcaatttgcccggctggtaccactgtgaatgtcgggatggataccatgataacggtatgttcagccctagtggcgaaagctgtgaggacatcgatgagtgcgggacgggaaggcatagctgcgctaatgacaccatctgtttcaacctggacggcggctacgattgtaggtgcccgcatggaaaaaactgcaccggtgattgtatccatgacggtaaggtgaagcacaatggacagatctgggtcttggaaaacgacagatgctccgtatgttcctgtcagaacggcttcgtcatgtgtaggagaatggtctgcgactgtgaaaaccctaccgtggacttgttttgttgtcctgagtgcgatccgagactctccagccagtgtcttcaccaaaatggagagaccctgtacaatagtggggacacttgggtccaaaattgtcagcagtgcagatgcttacagggcgaagtcgattgttggcctctcccatgccccgatgtagaatgcgaattttctattctccctgaaaacgagtgttgtccccggtgtgttaccgacccgtgccaggctgacaccatacgaaatgacataacaaaaacatgtttggacgagatgaacgtggtgcggtttacgggatccagttggatcaaacatggcacagagtgcacactatgtcaatgcaagaacggacacatctgctgcagcgtcgacccacagtgccttcaagaactctag

SEQ ID NO: 196764 - DNA, 2451 bp, Artificial Sequence
  Description of Artificial Sequence: Synthetic coding sequence
atggagagccgggtgctgctgcggaccttctgcctgatcttcggccttggtgcagtgtgggggctgggggttgatccttctcttcagatcgatgtgctgactgagctagagctcggtgagtctacaaccggggtcaggcaggtacccgggctgcacaatggcacaaaggcttttttgttccaagataccccacggtccattaaggcgagcacagccaccgcagagcaattctttcagaagctgaggaataaacacgaatttacgatactggtcaccctgaaacaaacccaccttaattctggtgtcattctatctattcatcacttagatcatagatatctcgagttggagtccagcggacatcggaatgaggtgcgcctccattatcggagcgggtctcaccgcccacataccgaagttttcccatacatactggctgatgataagtggcacaagctgtctctcgcgatttccgcgagccacctaatcttgcatattgattgtaacaagatctacgaacgggttgttgaaaaaccctcgaccgatttgccccttggaaccacattctggctcgggcaacgcaataacgctcacggctactttaagggtatcatgcaagacgtacagctgctggtcatgcctcaggggtttattgctcagtgtccagatctcaatcgcacatgtcccacctgcaacgatttccacggtttggtacagaagataatggaactgcaggacatcctggctaagacttctgctaaactaagtagagccgagcaacgcatgaacagattggaccagtgttattgcgaaaggacctgtacaatgaaaggtacaacatacagagagttcgagtcatggattgacgggtgtaagaactgtacctgtctgaatggaacgatacagtgtgaaacactcatctgtccaaatcccgactgtccccttaagtccgccctcgcgtatgttgacgggaagtgttgcaaggaatgcaaaagcatctgtcagtttcagggcagaacctatttcgagggcgagcggaacaccgtgtactccagttccggtgtgtgcgtgctctacgagtgcaaggaccaaaccatgaaactggtagagagctctggctgcccagccctcgactgtccagaatctcatcagatcaccctcagccacagctgttgtaaggtgtgcaagggctatgacttctgctctgaaagacataactgtatggagaattctatctgcaggaacctgaacgatcgggctgtgtgttcttgcagagacgggttccgcgcactgagggaggataacgcatattgtgaggacatagatgagtgcgccgaaggccggcattactgtagagaaaatacaatgtgtgtaaacactccaggcagctttatgtgcatttgcaaaacagggtatattaggatcgacgactattcctgcacagagcatgatgagtgtattaccaatcagcacaattgtgacgaaaatgctctttgtttcaacacagttggtggtcacaactgcgtgtgcaagcctgggtatacggggaatggaaccacgtgcaaggcattttgcaaagatggctgtaggaatggtggcgcttgtatcgctgccaacgtatgcgcctgcccccagggcttcacaggtccctcttgtgagacagacattgatgagtgcagcgatgggttcgttcagtgcgacagtagggccaattgtataaatctgcctgggtggtaccactgcgaatgtcgggacgggtatcatgacaatgggatgtttagcccatcaggggaatcctgcgaagacatcgatgagtgcgggacggggaggcactcttgtgctaatgacactatatgctttaacctggacggggggtacgattgtcggtgtccccacggaaagaattgcactggcgattgtatccacgatggcaaagttaaacacaacggtcagatatgggtattagagaacgatcgctgctctgtttgctcttgccaaaacggatttgtgatgtgcagaagaatggtgtgtgactgtgagaatccaacagtggacttattttgttgccctgaatgcgatcccaggctaagctcccagtgcctccatcagaatggggagactttatataacagcggagacacatgggtgcaaaattgccagcagtgccggtgtctccagggcgaggtggattgttggccactgccctgcccggatgtcgagtgcgaattttctattttacctgagaatgagtgctgccccagatgcgtgaccgacccttgtcaagcagataccatacgtaacgacattactaaaacttgtcttgatgagatgaatgtggtgagattcaccggaagcagttggattaaacatggcaccgaatgtacactctgccaatgtaaaaacggccacatatgttgtagcgtcgatccgcagtgtctccaggagctctag

SEQ ID NO: 196765 - DNA, 1734 bp, Artificial Sequence
  Description of Artificial Sequence: Synthetic coding sequence
atggagaccggcctgggcgcccccctgttcaaggcctggctgctgatcagcgtatgggggctgggcgtggatccttcccttcagatcgacgttcttactgagctggagctgggcgagagtacaaccggcgttagacaggtgcctggcctgcataacggcactaaagcatttctgttccaggataccccgagatccatcaaggcatctactgcgaccgccgagcaattcttccagaagttgagaaataaacacgaattcactatcctggtgaccctgaagcagacgcacctgaattctggcgtcattctaagcattcaccatctggaccatagatacttggagctggagtcttcaggacatcgaaacgaagtgcggctgcactataggtctggcagccaccgaccgcacacagaggttttcccctatattctcgctgacgacaagtggcacaagcttagcctcgctatatctgcgtcccacttgatcctccatatcgactgtaacaagatctacgaacgagttgtcgaaaagcctagtacggacctgcccttgggtactactttttggctgggtcagcgaaataacgcgcacggatacttcaaagggatcatgcaagatgtgcagctactggtgatgccccagggctttatcgcacagtgtcctgatctgaatagaacgtgcccgacgtgtaacgattttcacggcctggtgcagaaaatcatggaactgcaggacatccttgccaagactagtgccaaactgagtagagccgaacagcgcatgaatagactcgaccagtgctattgcgaacgaacctgtacaatgaagggaactacatacagggaatttgaatcatggatagacggatgtaagaactgcacctgtcttaatggtacaatacagtgtgaaaccctgatctgcccaaaccctgactgtccacttaaaagtgcgttagcatacgtggacggaaaatgctgtaaagaatgcaagtcgatctgccagttccagggaaggacttacttcgaaggcgagaggaataccgtatactcatcgtcaggagtatgcgtgttgtacgaatgcaaagatcagaccatgaagctggtggaaagctccggttgccctgcactggattgtccagaatctcaccagatcactctgtcacactcttgctgcaaggtgtgcaaaggctacgatttctgttccgaacgccacaactgcatggaaaattcaatctgtcgaaacttaaatgaccgcgctgtttgcagctgccgggacggcttccgcgctctgcgggaggacaatgcatactgtgaggacatagatgaatgtgctgagggccgacactactgcagggaaaataccatgtgcgtaaacacccccggctcatttatgtgcatttgcaagactggttatatcaggatagacgattactcgtgcactgaacacgacgaatgcatcacaaatcagcacaactgtgacgaaaacgcactgtgtttcaacaccgtgggcgggcataactgcgtttgtaagccaggctacaccggcaatggaactacttgtaaggccttttgtaaggacgggtgtagaaatggcggtgcctgtattgccgcaaacgtctgcgcctgcccacaaggatttaccggacccagttgtgaaaccgatatcgacgaatgctcagatggattcgtgcagtgtgactcacgcgctaactgcatatgtctggttcctctctag

SEQ ID NO: 196766 - DNA, 333 bp, Artificial Sequence
  Description of Artificial Sequence: Synthetic coding sequence
atggagaccggcctgggcgcccccctgttcaaggcctggctgctgatctctgtgtggggtcttggggtcgatccctctctgcaaatcgatgtgctcactgagttggaactgggggaatctacaactggggttaggcaagtgcctggcctgcataacggcacgaaagcattcttgttccaagatacgccccgctcgattaaggcttccacagccactgcggagcaattctttcagaagctgcgcaataaacatgaatttaccatactggtgaccctcaagcagacacacctcaactctggagtgatcctctcaatccaccaccttgaccattag

SEQ ID NO: 196767 - DNA, 2448 bp, Artificial Sequence
  Description of Artificial Sequence: Synthetic coding sequence
atggagaccggcctgggcgcccccctgttcaaggcctggctgctgatcagtgtgtggggcctgggtgtggacccgagcttgcagatcgacgtgcttaccgaactggaacttggcgagagcacgactggggtgcgtcaggtgcctggtttgcacaatggcaccaaagcattcttatttcaggacacccccagatcgatcaaggcctctaccgcaacagctgagcaatttttccagaaacttcgtaataagcacgagttcacaattctggttactctgaaacagacccatctgaattccggggtgatcttgtccatccaccacctcgaccacagatacttagagttagaatctagcggacaccgaaacgaggttcggcttcactaccgctctgggagtcaccgccctcataccgaagtttttccatacatacttgctgatgacaagtggcacaaattgagcctggccatcagtgcgagccacctgatactgcacatcgactgtaacaagatttacgaacgcgtggtggaaaaaccgagtacggacctcccactgggaactacattttggctggggcaaagaaacaatgcgcatggctactttaagggcatcatgcaagacgtgcagctgctcgtcatgcctcagggattcattgcacagtgtcccgacctaaatcggacatgccccacttgtaatgattttcacggtctggtgcagaagatcatggaactgcaggatatccttgctaagacaagcgcaaagttatccagagccgagcagcggatgaaccgtttggaccaatgttactgtgaaaggacatgtactatgaaagggaccacttacagagaatttgagtcctggattgacggctgtaagaattgtacatgtctcaacggcacgatccaatgtgagacactcatctgtcccaatcctgactgcccgcttaaaagcgcactggcttacgtggatggcaaatgctgtaaagaatgtaaaagcatatgccagttccagggacgcacctatttcgagggcgagcgaaatacagtctacagttcatccggcgtgtgcgttctgtatgagtgtaaggatcagactatgaaacttgtcgaaagttctggttgtcctgccttggactgccccgaaagccatcagatcactctctcacattcgtgttgtaaggtctgcaaggggtacgatttctgctctgaaaggcataattgcatggaaaacagtatctgccgaaacttgaatgacagggccgtctgcagctgtcgagatggattccgagccttaagagaggacaatgcctattgcgaagatattgacgagtgtgccgaaggccgccactactgtagggagaataccatgtgcgtaaacacccctgggtcctttatgtgcatctgcaaaaccggctacatccggatagatgattacagctgcactgagcatgacgagtgcatcactaaccagcacaactgcgatgaaaacgctctttgtttcaatacagtaggaggccataattgcgtttgtaaaccaggctataccgggaatggtacaacatgcaaggctttctgtaaggacggatgccggaacggcggggcttgtatcgctgccaatgtgtgcgcctgccctcagggatttaccggtccgtcctgcgaaaccgatatcgacgaatgttccgatgggttcgtccagtgtgatagcagagcaaactgtatcaatctgcctggctggtaccactgcgaatgccgagacgggtaccacgataatgggatgttctcgccctcgggtgaatcctgtgaagatatcgacgagtgcggtacgggtcgacacagctgtgcaaacgacaccatttgcttcaacctggatggaggatatgactgtcgatgccctcacggcaagaactgtaccggcgattgtattcatgacgggaaggtgaagcacaacggacagatctgggtactagaaaacgaccggtgctccgtttgtagctgccaaaacggatttgtgatgtgcaggcgtatggtttgcgattgcgagaatcctactgtcgatttgttttgctgtcccgagtgtgatccccgactgtcctcccagtgcctgcaccagaacggagagacgttgtataatagtggagatacctgggtgcaaaattgtcagcagtgtaggtgtctccagggcgaggtggactgctggcctttgccatgccctgatgttgagtgcgaatttagtatacttcctgagaatgaatgctgcccaagatgcgtgaccgatccctgccaggccgacaccatccggaatgatattaccaaaacctgcctggacgaaatgaacgtggtcaggttcactggctcatcttggatcaagcatggaaccgaatgtacgctctgccagtgcaagaatgggcatatatgctgctctgttgatccccaatgtttgcaggagctttag

SEQ ID NO: 196768 - DNA, 69 bp, Artificial Sequence
  Description of Artificial Sequence: Synthetic coding sequence
atggagagccgggtgctgctgcggaccttctgcctgatcttcggcctgggtgctgtgtggggcttatag

SEQ ID NO: 196769 - DNA, 966 bp, Artificial Sequence
  Description of Artificial Sequence: Synthetic coding sequence
atggagagccgggtgctgctgcggaccttctgcctgatcttcggcctgggggctgtgtggggactcggcgtggatccctctctgcagatcgacgtactgacagaactcgaactcggcgagtccacaacgggggtgcggcaagtacccggcctacataatgggacaaaagcatttctatttcaggatacccctcgatctatcaaagccagcacagccacagcagagcagttttttcagaagctgaggaacaagcacgagtttaccatcctggtgaccctcaagcaaacacatctgaatagtggagtaatactgagcattcaccatctcgaccaccggtacttggagcttgagtccagtggccacaggaatgaggtccggctacattaccggtctggttctcatcgcccccatactgaggtgttcccatacatccttgcagatgacaagtggcacaagctgtctctggccatctcggcgagtcacctgattcttcacatcgattgtaataaaatctatgagagagtggtggaaaaaccaagtacagacctacctctggggaccacattttggctggggcagaggaacaacgcccacggttacttcaagggaattatgcaagatgtgcaacttttggtgatgccacaggggttcattgctcagtgtccagacctgaatcggacctgtcccacctgtaatgactttcacggactggtgcagaaaatcatggaactccaggatatcctagctaaaaccagtgcaaagctcagtcgggctgaacagcgtatgaacagactcgatcagtgctattgcgaacgcacatgtacaatgaagggcacaacatatcgcgagttcgaatcatggatcgatggatgcaagaattgcacctgcctgaatggcacaattcaatgtgagactctaatctgtccaaaccctgactgccccttgaagagcgctctggcatactag

SEQ ID NO: 196770 - DNA, 4386 bp, Artificial Sequence
  Description of Artificial Sequence: Synthetic coding sequence
atggccgccgagcggggcgcccggcggctgctgagcacccccagcttctggctgtactgtctcctgctgcttggtcggagagcccccggcgcagccgctgccagatccggtagcgcaccccagagccccggagccagcattagaacattcactccattctacttcctggtggagccagtcgacaccctgtctgtgcggggttcctcggtgattctgaattgttccgcgtactccgagccatctcctaaaattgagtggaaaaaagacggcacctttctaaacctggtgagtgacgataggcgacagctgctgccagacggtagtctgttcatttctaacgtagtacactctaagcacaataagcccgacgaaggctactatcagtgtgttgcaaccgtggagtctctgggcacgatcatcagcaggaccgccaaactgattgtggccggccttcccaggttcacttcccaacccgaaccctccagtgtgtatgcgggcaataatgcaattctaaattgcgaggttaatgcagatttagtccctttcgtccgatgggagcagaacagacagccgctgttgctggacgatcgcgtgattaaactgcccagtgggatgctagtaatttctaacgcgaccgaaggcgatggcggcctgtaccggtgtgtggtggagtctggaggacccccgaagtattctgatgaagtggaattaaaggtgctgcctgatccggaggtgatttccgaccttgtgttcctgaagcaaccatcacctctcgtgagagtgatcgggcaggacgtagtcttaccctgcgtagcatccggtctgccgacccccactattaagtggatgaaaaatgaggaggcactggacacagagagttcggagagactcgtattgctggcaggaggaagcctggagatttcagatgtcactgaggacgacgcgggcacttacttctgcatcgcggataatggcaacgaaacaatcgaggcacaagctgagctcacggtacaagcgcaacctgagttcctgaaacaaccgacaaatatctatgcacatgaatctatggatatagtgttcgagtgtgaggttacaggaaaacctacgccgaccgtcaagtgggtaaagaacggcgatatggtcataccatcggattattttaagattgttaaggagcacaacctgcaagtactgggtctggtcaaatccgatgagggattctaccagtgcatcgctgagaacgacgttggaaacgctcaagccggggcccagctgatcatactggaacacgcccccgccactacggggcctctgccatcagcgccacgcgatgtggtggccagcctcgtgagcaccagatttatcaaactgacgtggcggacccccgcttcagatcctcacggtgacaaccttacttacagcgtgttctacaccaaagaagggattgccagggagagagttgagaacacatcccatccaggagagatgcaggtcacaatccagaatctcatgccagcaaccgtgtatatttttagagtgatggctcagaataaacacgggagcggcgagagttcagccccattgagggttgagacacagcctgaggtgcagcttcccggcccggcccccaatctcagagcctacgctgcctctcccacgagcataacagtgacgtgggagactcctgtttcgggcaacggggaaatacagaattataagctttactacatggagaagggaaccgataaggaacaagacgtggatgttagtagccactcttacacaatcaatgggctgaaaaaatatacagaatacagttttcgagtggtggcatacaataagcatggacccggcgtgagcactcctgatgtggctgtgaggacccttagcgacgttccaagcgctgctcctcagaatttgtccttggaggttaggaatagtaaaagtattatgatccattggcaacctcctgctccagctactcagaatggtcaaattaccggttacaaaatccggtaccgaaaagcgagcagaaaaagtgacgtgacagagaccctcgtttccggaactcaactgtctcagctcatcgagggactggatcggggtaccgaatacaacttccgagtggcagcactcacaatcaatggcacaggtccagcgacagattggttgagcgctgagaccttcgagagcgacctggatgagacccgggtgcccgaggtccctagcagccttcacgtgcggccccttgtgactagtatagtagttagttggacaccgcccgagaaccagaatattgtggtcaggggctacgcaatcggttacggtataggtagcccacatgcacaaaccattaaagtcgattataagcagcggtattacactattgagaacctggacccttcctcccattacgtgatcacgctcaaggctttcaataacgtaggagaaggaattccgctgtacgaatcagccgtgacgagaccccacaccgacactagtgaggtagatctgttcgtgatcaatgctccatacacacctgttccagatcccacccccatgatgccacctgtcggtgtgcaggcctccatcctcagtcatgatacaattcggatcacttgggccgataactcactccctaagcaccagaaaatcacagactcaagatattacaccgtgaggtggaaaactaatataccagccaatacaaaatacaaaaatgccaacgcgaccactttgagctatctcgtaacgggattaaagcccaataccctgtacgagtttagcgtgatggtcaccaagggcaggagaagcagtacctggtccatgaccgcccacggaaccaccttcgaactcgtgcctacgtcaccccctaaagacgttacagtcgtcagcaaggaaggaaagccaaagactattatagtgaactggcagcctcccagcgaggccaatggtaagataactggatatatcatatactactccacagacgttaatgccgaaatacacgactgggtaatcgagccagtggtgggtaaccggttgacccaccagatccaggagctgactttggacaccccttactattttaagattcaagcgcggaattccaaaggaatgggccccatgtccgaagccgtgcagtttagaactccaaaggctgatagcagcgacaagatgccaaatgatcaagcctccgggtctggcggaaaaggaagccgcctgcctgatctcggttccgactacaagccacccatgtctggatccaattcgcctcatggatctcccacctctcctctcgattctaacatgctgcttgtcattattgtatccgtgggggtgattaccatcgtcgtagttgtgatcatcgccgtgttctgcaccagaaggactacttcccaccagaaaaagaaacgggctgcatgtaagtccgtgaatggctcacataaatataaaggcaactcaaaagacgttaaaccaccagatctgtggatccaccacgagcgtttagagctgaaacctattgacaaatcaccggaccccaacccaataatgactgatactccaatccctagaaattctcaggacattacccctgtagacaacagtatggattcgaacatccaccaacgacggaactcctataggggacatgagtcagaagactccatgagcactctcgcagggcggagaggtatgcgaccaaagatgatgatgcctttcgactcccaacctccacagcccgtgattagcgcccatcctattcactctctggataatccacaccaccacttccacagctcctctctcgcatcccctgctcgttctcacctttatcatcccggctcaccgtggccaataggaaccagcatgtctctgtctgatcgcgcaaattctaccgagagcgtgcgcaatactccttcaacggacactatgcccgcatcttcttctcagacttgttgtacagatcatcaggatcccgagggcgctacgagctcaagctatctggcctcctcccaggaagaggatagcgggcaaagtctgccgacggcacacgtcagaccctctcacccccttaaaagctttgccgtccccgccatccctccccctggtccccctacgtacgatcccgctctgccctccacacccctcctatcccagcaggccttaaaccatcatatccatagcgtgaagacggctagcatcggaacactgggacggagcaggcctcccatgcctgtggtggtcccgagcgcccctgaagtgcaggagacaaccagaatgctcgaggactccgagtcatcttacgagccagacgagcttaccaaggagatggctcatctggaaggcctcatgaaagacctgaacgctataactaccgcgtag

SEQ ID NO: 196771 - DNA, 4386 bp, Artificial Sequence
  Description of Artificial Sequence: Synthetic coding sequence
atggccgccgagcggggcgcccggcggctgctgagcacccccagcttttggttgtattgtttgctgctactcggacggagagcgcctggagctgctgccgcacgttcaggaagtgcacctcagtctccaggtgcttccatcagaaccttcactccattttatttcctcgtcgaacccgtggacaccctgtccgtaagaggttctagcgtgatactcaattgtagcgcgtacagcgaaccctctcccaagatcgagtggaaaaaagacggtacctttctcaatctcgtgtctgatgaccgccggcagcttctaccagatggatcgctgttcatttctaacgtagtgcactcaaagcataataagcccgacgagggatactatcagtgcgtagcgacagtcgagagtctggggacaattatttcccggacagctaagctcatagtcgccgggttgcccagatttacgtcccagcccgagcccagctccgtctatgccggcaataatgccattctaaattgcgaggttaacgccgatctggtgccatttgtgcgctgggaacaaaacaggcagccactccttctggacgatcgcgtcattaaacttccatctggcatgctggtgatttccaacgctacagaaggcgatgggggattgtatagatgcgttgtggagagtggaggtccccccaagtacagtgatgaagtggagctcaaagtgctccccgacccagaggttattagtgaccttgtgtttctgaagcagccttcacctctggtgcgggtgatcggccaggacgtggttctgccatgtgtggcttccggtctcccaactccgaccattaaatggatgaagaatgaagaagccctcgataccgaatctagtgagcggctcgtgctgcttgccggaggatctttggagatttcggatgtgactgaggatgacgctggaacctatttttgcatcgccgacaacgggaatgagaccatagaggctcaagcggagctgaccgtgcaggctcagcctgagttcctgaagcagccaacaaatatctatgcccatgagtccatggatatagttttcgagtgcgaggtgactggaaaaccgacaccaaccgtgaaatgggttaaaaacggcgacatggtcatcccttcagactactttaaaatcgttaaagagcacaatcttcaagtgttagggctggtgaagtccgatgaagggttttatcagtgtattgcggaaaacgatgtaggtaacgcccaggctggggcacagcttatcatcctagagcatgcccccgccactactggtccccttccctcggctccaagggatgtggtcgcctcactggtttctacccgatttatcaaactgacctggcgcactccagcttcagacccccatggcgacaatttgacctacagcgtgttctacaccaaggagggaatagcacgtgagcgagtggagaacaccagtcacccgggagagatgcaggtcacgattcagaacctgatgcctgcaaccgtttacatcttccgcgtgatggcgcagaacaagcatggcagtggagagagttctgccccactacgcgttgagacacagccggaggtacagctgcctggcccggccccgaatctacgagcatatgcggccagcccgaccagcattacggtgacctgggaaacaccggtctctggcaacggcgaaattcagaattacaaactgtactacatggagaaaggcacggataaagaacaggacgtcgacgtgtcatcccacagctatactatcaatggcttgaaaaaatacacagagtacagcttcagggtggtggcatacaataaacatggtcctggcgtgagtacacctgacgtggcagtgcggactctgagcgacgtccctagtgcagctcctcagaacctttccctcgaggtgcggaatagtaaatcgatcatgattcactggcaaccacccgccccagcaacacagaacggacagattaccggctacaaaatccggtaccggaaggctagccggaagagcgacgtcactgagacgctggtgagcggcacccaactctcgcagctgatcgagggtttagataggggtacagagtacaactttcgggtagccgcgctgacaatcaacgggactggtccggccacggattggctgtcagctgagacatttgaaagtgatctggacgaaaccagggtacctgaggttcctagttctctgcacgtccgccccctggtgacctcaattgtggtgagctggactcctccggagaaccagaacattgtggtaagaggctacgctatcgggtacggaatcgggtcacctcacgcgcaaaccattaaggttgactataagcagcgctactatacgatagaaaacctggacccctcctcccactatgtcattaccctcaaggcgttcaacaatgtgggtgaaggaattccgctttatgagagcgcagtcaccagaccccatacagatactagcgaggtggacctgtttgttatcaacgctccgtatacacctgttcccgatccgacccccatgatgccccctgtaggagtgcaagcctctatcctgagtcatgatacaatccgcattacatgggccgataattcgttaccaaagcatcagaagataactgattcccgctattacactgtccgatggaagactaacattcccgcaaataccaaatataagaatgccaatgcgaccactttgtcctacttagtgaccggcctaaaaccaaataccctatatgaattctcggtcatggtcactaagggcaggcggtcctctacctggtccatgaccgcacacggaacaaccttcgagttagtgcctacgtctccccctaaagatgtcaccgtggtgagtaaagaaggcaaacccaagacaatcattgtcaattggcagccacccagtgaggctaacgggaaaataacgggatacatcatctattattccacagacgtgaatgccgagatacatgattgggtaatagaacccgtggtgggaaatagactgacacatcagatacaggagctcaccttggacaccccatactactttaaaattcaggcccggaactcaaaggggatggggccaatgtccgaagcagtgcagttccgaacaccaaaagccgactcctctgacaaaatgcccaacgatcaagcatcgggctccgggggcaagggaagccggctgcctgacctgggatctgattacaagccccccatgtcaggctcaaatagccctcatggttcccccacctctcctctggactctaatatgctcctcgtaatcatagtgtctgtgggggttattactatagttgtcgtggtaattattgctgttttttgtactcgcaggaccacctctcatcaaaaaaaaaagcgggcggcgtgcaagtccgtcaacggttcccacaaatataagggcaactcaaaggatgtgaaaccaccggacctctggatacatcacgaacgtctggagctcaaaccaattgacaaaagtccggatccaaaccccatcatgacagatacacccatcccccgaaactctcaggacattacacctgtcgacaattcgatggactcaaatatacatcagcgtaggaacagttacaggggccacgagtctgaggacagcatgtccactctcgcaggcagaagaggaatgcggccaaagatgatgatgccctttgattcccagccgcctcagccagtgatctctgctcatcctattcatagtttagataaccctcatcaccacttccactcaagttccttggccagtcccgcacgctcacacctataccaccccggtagcccctggccaatcggaacatctatgtctctgagtgatagggcgaactccacggagtctgtaagaaataccccaagcactgacaccatgcctgcctcttcatcccagacatgttgtactgaccatcaggacccggagggagccaccagctctagctacctggccagttcacaagaagaggattccgggcagtcactgcctactgcccatgtccgcccaagccaccccttgaaaagctttgcagtgcccgccatccccccacccggccctcccacatacgatcccgcacttcctagtacaccgctactctcacaacaggcgcttaatcaccacatccactccgtaaaaactgcaagcatcggcacgcttggtcggagtcggccgccaatgcctgttgtggtaccaagtgcccctgaggtgcaggagacaactagaatgcttgaggattccgaatcgtcttacgaaccagatgaattgacgaaggagatggctcatctggagggtctgatgaaagacttaaacgccattactaccgcatag

SEQ ID NO: 196772 - DNA, 3519 bp, Artificial Sequence
  Description of Artificial Sequence: Synthetic coding sequence
atgaagaacgaggaggccctggacaccgagagcagcgagcggctggtcctcctggcagggggatccctggaaatcagcgacgtcactgaagatgatgctggcacctacttttgcatcgctgataacggaaacgaaacaatagaggcccaggccgagcttaccgtgcaggcacaacccgagtttctaaaacagcctacaaatatttatgcacacgagtccatggatatcgtctttgaatgcgaagtgaccggcaaacccaccccaacagtcaagtgggtcaagaacggagatatggttatcccctctgactactttaagattgttaaggagcacaacctgcaggtgctgggcttagtcaaatccgatgaaggtttctatcaatgcatagccgaaaatgatgtgggtaacgcccaggcaggggcccagcttatcattctggagcacgacgtcgcgattcctactctacccccaactagcttgacctcagcgacaacagaccacctcgcgcccgccaccacgggccccctcccctcggctcctcgcgatgtcgtggcgtcgctggtctctacacggtttattaaactcacctggcggacaccagctagtgacccccatggcgataaccttacctacagcgtgttttatacgaaagaggggattgctcgagagcgtgtggaaaacaccagccacccaggcgagatgcaagttactatccagaatctgatgcctgcaactgtatacattttccgtgtcatggcccagaacaagcatggttctggtgaaagcagcgcccccctgagagtcgagactcagcctgaagtgcagttaccaggacctgcacctaatctgagggcatacgccgctagccccacctccatcacagtgacatgggaaacacccgtcagtgggaacggggaaatccaaaactataagctttactatatggaaaagggaaccgacaaggagcaggatgtggatgtctcaagtcactcttacaccatcaatggactaaaaaaatacactgaatatagctttcgtgttgtcgcctacaataagcatgggcctggagtctctacccccgacgtcgccgttagaaccttatcagatgtgccttctgccgctccccagaacctgtctttggaggtgcgaaatagcaaaagtatcatgattcattggcagcctcctgcacccgcaacgcaaaatgggcagataaccgggtataaaattaggtaccgaaaagcctcccggaaatccgacgtgactgagaccctagtcagcggaactcagttgtctcagctaattgaaggccttgatagaggcaccgaatataatttccgtgtagcagctttaactatcaatggaactggcccagctaccgattggctaagcgcagagactttcgagagcgatcttgatgagacccgcgtgcccgaagtccccagttctctgcacgttaggccacttgttacctccatcgtcgtttcttggactccccctgagaatcaaaacatcgtggtgcgcggatacgcaataggctatggcattggttcacctcatgcacagaccatcaaggtcgactacaagcaaaggtactataccattgagaatttggatccctcgtctcattacgttatcaccctgaaggccttcaacaacgtcggcgagggaatccccctgtacgaatcagctgtcactcgtccgcatactgtacccgaccccactcctatgatgccaccggtaggagtccaggcctctatcttaagccacgatactatccgcatcacatgggccgacaacagcttgccgaagcaccagaagattaccgattcccgctactatactgtacgctggaagactaatatacccgctaataccaagtacaaaaacgctaacgcaaccactctgtcctacttggtcaccggactgaaaccaaacaccctgtacgagttctctgtgatggtgaccaagggtcgcaggtcatctacctggagcatgacagcccacggaacaacgttcgaactggtccccaccagtccccctaaagatgtcaccgttgtgtcaaaagaaggtaaacccaagaccatcatcgttaactggcagcctccctccgaggcaaatgggaaaatcaccggatacatcatctattatagcacagatgttaatgcggaaatccatgactgggtcattgagcccgtcgtggggaataggttgacccatcagatccaggaactcacactggacactccttattacttcaaaatccaggctaggaacagtaaaggcatggggcccatgagcgaggctgtgcaatttcggaccccaaaggcaagtgggtcagggggcaaggggtctagactgccggatctaggaagtgattataaaccgccaatgagcggatccaacagccctcacggatcccctaccagccccctggactctaatatgctcctcgtgattatcgttagcgtgggggtgatcacgattgtggtagtcgtgatcatcgccgtgttttgcacgcgtcgcacaacatcacatcagaaaaaaaaacgcgcagcttgtaagagcgtcaatgggtcacacaagtataaaggtaacagtaaagacgtaaaacctcccgacctgtggatccatcacgagagactggagcttaaaccaatcgacaaatcccccgatcccaatccaattatgaccgatacaccaataccacgaaattctcaggacattacaccggtggacaattcaatggacagcaacatccaccaacggcggaactcctaccggggacatgaatctgaggattccatgtccacccttgcggggagaaggggcatgagacccaaaatgatgatgcccttcgactcccagcccccacagcctgtgataagcgcacaccccatacacagcttagacaaccctcatcaccattttcacagtagtagccttgcaagccctgcgcgatcccacctttatcacccgggttccccgtggcctattggtaccagtatgtctctgtccgatcgtgcaaacagtaccgagtcagttaggaatactccttctactgacaccatgcccgctagttcgagtcagacttgctgcaccgatcaccaggatcccgagggggctacgtccagctcatacctcgcaagcagccaagaagaagattccggtcagtcactgcctacggctcatgtgcgacctagccaccccttaaagagttttgccgtgcccgcaatcccacctcccggacctcccacatatgaccctgccctgccttctaccccactcctgagccaacaggcactcaaccaccacatacattcggtgaaaaccgcctctattggaactttagggaggtccaggccccctatgcccgtggtggtgcccagcgcgcctgaggttcaggagactactagaatgttagaggattcagagagcagctacgaacccgacgagctgaccaaggagatggctcacctggaaggactgatgaaagatctgaacgcgatcacgaccgcctag

SEQ ID NO: 196773 - DNA, 4353 bp, Artificial Sequence
  Description of Artificial Sequence: Synthetic coding sequence
atggccgccgagcggggcgcccggcggctgctgagcacccccagcttctggttgtattgcctcctcttgctcggcaggcgggcccccggcgcagcagccgctaggtcaggatcggccccccagagccccggggcttccatcaggacattcacccctttctattttctggttgagcccgtggacactctctccgtgaggggctcaagtgtcatcctcaactgctccgcctattcagagccgagcccgaagattgagtggaaaaaggatggaacctttctgaacctggtgagtgacgaccgccgtcagttgcttcctgatggatccctattcatttctaacgtggtgcattccaagcacaacaaaccggatgagggatactaccagtgtgttgccacagttgaaagcttggggaccatcatttcgaggactgcgaagttgatagttgccggcctgcctcggttcaccagccagcccgaacctagcagtgtctacgcgggaaataacgccatccttaattgcgaggttaatgcagacctcgtcccttttgtgcggtgggagcagaaccggcagcctttgctgttggatgaccgggtgatcaagctgccctcgggaatgctggtgatctccaatgccactgagggggatggaggactgtaccgctgtgtcgtggaatctggcgggccgcccaaatattccgatgaggtggagctgaaagtactgcccgaccccgaagtcatctccgatctggtgtttctgaagcagccctcgccattagtgcgggtcatcggtcaggatgtcgtcctcccctgcgtcgcaagcggcttacccaccccaacgataaagtggatgaagaatgaagaagccctggacaccgagtctagcgagcggcttgtgctgctggcaggcgggtctttagagatcagcgacgtaaccgaggatgatgccggcacctatttctgtatagccgacaacggaaatgaaactattgaggcccaagctgaactgactgtccaggctcagcctgaattcctgaaacagccaactaatatttacgctcacgaaagcatggacatcgtgttcgagtgtgaagtaacgggcaagcctaccccaaccgtcaagtgggtcaagaatggggacatggtgatcccatccgattacttcaaaattgtgaaagagcataaccttcaggtcctcggactcgtgaagtcagatgagggtttttatcagtgcatcgcagagaatgacgtgggcaacgcacaagctggggcacaacttatcatcctggaacacgcacctgcgaccaccggccctcttcccagtgctcccagagacgttgtagcaagcctcgtgtctacccgttttattaagctgacgtggcggacccccgcctccgatcctcatggcgacaacctgacatatagtgttttctatacgaaggagggcattgccagggaaagagtagaaaacacctcccaccccggggagatgcaggtcactatccaaaacctgatgcccgcgaccgtctacatctttcgcgtcatggctcaaaataaacatgggagcggagagagttcggcaccactgagagttgaaacccagcccgaagtgcaacttccaggaccggcgcccaaccttagggcttatgccgcaagtcccaccagcataaccgtgacttgggaaacccccgtgtctggaaacggagagattcaaaactataaactctactatatggaaaaggggactgacaaggaacaggacgttgatgtaagttctcacagctataccatcaacggtctgaaaaagtatacagagtacagctttcgggtggttgcctataacaagcatggaccaggagtttctactcccgacgtcgctgtgcggactttgtcagacgtgccatccgccgccccacagaacctatccctcgaagttaggaatagtaagtctatcatgatccattggcaaccacccgcacccgcgacacagaacggacagattacgggctataaaatccgctacagaaaggcatcccgaaagtccgacgtgaccgagacgttggtgtctggcactcagctctctcagctgatcgaaggtctggatcgtggaaccgaatataacttccgggtagcagctctaacaatcaatggtactggtcccgccaccgactggctctccgcagaaacgttcgagtcagatctggatgaaactcgggttccagaggtcccttcatctctgcacgtgcgtcccttggtgacatcaatcgtcgtgtcatggactccacccgagaatcagaatatagttgtgcgtggatacgccattggctatggcatcggctcaccgcatgctcaaaccataaaagttgattataaacaacgttattacacaattgaaaacttagacccctccagccattatgtaatcacattgaaagcttttaataacgtaggagaaggaatcccgctgtatgaaagcgccgttacaaggccccacacagacactagcgaagtggacctcttcgtcatcaatgcaccttacacccccgtccccgaccctacccctatgatgccccccgtgggtgtgcaggcctcaatcctatctcacgacacaatccgaatcacgtgggcagacaatagcctacccaagcatcagaaaatcacagattcccgttactacactgtaagatggaaaacgaacattccagcaaatacaaaatacaaaaatgcaaatgcaaccaccctgagctacctggtaacaggcctcaagccaaatacattgtacgagttttcggtgatggtcactaaaggacggcgctccagcacatggtctatgactgcccatggaactactttcgagctggtgcccaccagccccccgaaggacgtgactgtcgtctctaaagagggcaagcccaagacaattatcgtgaattggcaacctcctagcgaggctaacggtaaaatcacaggatacataatttactactcaaccgatgtgaatgccgaaatccatgactgggtcatcgagcccgttgtaggaaatcgcctgacacaccaaatccaggaacttacgctggacaccccctattattttaaaatccaggccaggaattccaagggcatggggcctatgagcgaagctgtgcagtttaggacacctaaagcttcaggatcaggtggtaagggatccaggttgccagaccttggaagcgattacaaacccccaatgagtggtagcaattcaccccacggctcacccacctcacctttggactcaaatatgctcttggtgataatcgtgtccgtcggggtaatcacgatcgttgtcgtagtgattatagccgtgttttgcaccaggcgaactacctctcatcagaaaaaaaagagggcggcttgcaaaagcgttaatgggtcccataagtataaagggaactcaaaagatgtcaaaccacctgacctttggattcatcatgaaaggctcgagctgaaacccattgacaaatcgcctgatccaaatcccattatgaccgatacccccatccctaggaacagccaggatatcacaccggttgataactccatggacagcaatatccaccagcgcagaaattcctatcgcggccacgaatccgaagactctatgagcaccctggctggcagaagaggcatgcgtccaaagatgatgatgcctttcgactcccagccacctcagcctgtcatctctgcacacccaatccactcgctggacaacccccatcatcactttcactcctcgagccttgcatcacctgcgcggagccatctttaccatccaggttctccgtggccaatcggaactagtatgagccttagcgatcgtgctaactctactgagtctgtacgaaacacaccttccaccgatactatgccagcatcttcttcccagacatgttgcacagatcaccaggatcctgagggcgccaccagcagctcctatcttgcttccagtcaggaagaagattctggtcagagcctcccgactgcacatgtaagaccttctcaccccctcaagtcctttgccgtgcccgccatcccgcctcccggcccacctacgtatgatcccgccctgccatcaactcctctactttctcagcaagcccttaaccaccacatacattcagtgaagacggcctcgattggcacgctcggtcgttcacgacctccaatgccagtggtggtaccctccgcgccggaggtacaggagacaaccaggatgctggaggactcagaaagcagttatgagcccgatgagctgaccaaagaaatggcccacttggagggactgatgaaggatctgaacgcaataacgacggcctag

SEQ ID NO: 196774 - DNA, 4227 bp, Artificial Sequence
  Description of Artificial Sequence: Synthetic coding sequence
atggccgccgagcggggcgcccggcggctgctgagcacccccagcttttggctctattgccttctgctgctgggacgcagagcgcctggcgcggctgctgcacggtcgggttccgctccacaaagtcccggcgccagtattagaactttcacacccttttattttttagtggagcctgttgatacactttcagttcgcgggagcagcgtcatcctgaattgtagcgcctattccgagccgagcccgaagatagaatggaagaaggatggtacctttctcaatctggtaagcgacgatcgccgtcaactgctacctgacgggtcactgttcatctccaatgtggttcactcaaagcacaataagcccgacgagggttactaccagtgcgtcgcgaccgtggaatctcttggcaccataatttcccgcacagctaagttgatcgtggccggccttccgcggtttacgagccaacccgagccttcctcggtttacgcaggcaataacgcaattctgaattgcgaggtgaatgccgacctggtacctttcgtgcgatgggaacagaaccgccagccgcttctgctggatgatcgagtgatcaaactaccctccggaatgctggtcatttccaacgccaccgaaggagacggcggactgtacaggtgcgttgtcgaatctggcgggcctcccaagtactccgacgaggttgaactaaaggtgctccccgaccccgaggtgatatcggatctggtcttcctgaaacagccatctccactcgtacgggttatcggccaagacgtcgttttgccttgtgtcgcatccgggcttcctacacctaccatcaagtggatgaagaatgaagaggccttggacactgagtcctctgaacgtctggtgcttctagcagggggatcgctggagatttctgacgtgacggaggacgacgctggtacatatttctgcatagctgataatggaaacgagaccatagaagcccaggccgagctgaccgtgcaggctcagcctgagttcttgaaacagccaacaaatatctatgcacatgagtcgatggacatcgtattcgaatgcgaagtgaccgggaagccaactcccacagtgaagtgggtgaaaaatggcgatatggtgatcccctctgactattttaaaatcgtaaaggaacacaaccttcaggttcttgggctggtgaaatctgatgagggcttttaccagtgtattgccgaaaatgatgtcggcaacgctcaggcaggagcccagcttatcatcctggagcacgcaccggcaactacagggcccttgccaagtgcaccccgcgatgtggtagcaagcctcgtgagcacacgctttattaaattgacctggcgaacccctgccagcgacccccacggggataatcttacatactcagttttctatacgaaggaagggattgcgagagagagggtcgaaaatacatcccaccccggcgaaatgcaggtcaccatacaaaatctgatgcctgccacagtttatatattcagagtgatggctcagaataagcacggatcaggggaatcaagcgcacccctcagagtcgagactcagcccgaagtgcaactccctggaccagcccccaatttgagggcctacgccgccagcccaacgagtataacggtcacctgggagactccagtctccggcaacggagaaatacagaattacaagctgtactacatggaaaaaggcacagataaggaacaagacgtggatgtgagcagtcactcctacactatcaatggcctgaagaagtacaccgaatattcctttagagtagtagcatataataaacacggccccggagtcagcaccccagatgtcgcagtgagaaccctgagtgacgtgccatctgccgctcctcagaacctgtctctcgaagtgcggaacagcaaaagtattatgattcattggcagccacctgcccccgctactcagaatgggcagataaccgggtacaagatacgctataggaaggcgtctagaaaaagtgacgtgacagaaacattggtgagcggaacccagctcagccaactgatagaggggctcgaccgcggcaccgagtacaatttccgggtcgctgcgctgaccatcaatggaacaggtcctgcaactgactggctgtccgctgagaccttcgagtccgacctcgacgagacgcgcgtacctgaggtgccctcctctcttcacgtcaggcccctcgtcacgagcatcgtggtcagctggacccctcctgagaatcaaaatatcgtagtgagaggctacgctatcgggtacggcattgggtcgccccatgcccaaactattaaagtggattataagcagagatactacaccatcgagaacctggatccctcctcccattacgtgatcacgctgaaggcatttaacaatgtcggggaagggattccattgtacgaatctgctgtgacccggccccatactgatacctccgaagtagacctctttgtcattaacgcgccgtatacccctgtgcccgatccaactccgatgatgccaccggtcggcgtgcaagcctctatcttgtcccatgatacaatccggataacctgggccgacaacagtctccctaagcatcagaaaatcaccgactcccggtattacactgtgcgctggaaaactaatattccggccaatacgaaatataaaaacgccaacgcgacaaccctgagttatctcgtgaccgggctgaagcctaataccctttacgagttttctgttatggttaccaaaggccggcgatccagcacttggtctatgaccgcgcacggaacaacctttgagcttgtgccgacttctccacccaaggatgtgactgttgtttccaaagaaggcaagccaaaaacaatcatcgtcaactggcagcctccttcggaagctaacggcaagatcaccggctacattatctactactccactgacgtgaatgccgagatccacgactgggtgatcgaacccgtagtcggaaatcggctaacgcatcagatccaggaattgaccctagataccccttattacttcaaaatacaggccagaaactctaaaggcatgggccccatgagtgaagccgtgcaatttcgtactcccaaggccgactcatcagacaagatgcccaacgaccaggccagcggatcaggcggcaagggatctaggctccccgacctcggaagcgactataagcctccaatgtcggggtcgaattccccccacggctcaccgactagcccactcgactctaacatgctcctggtcattatcgtgagcgtcggagtgatcaccatagttgttgtcgtgatcatcgctgtgttttgtactaggcggactacctcccaccagaagaagaaaagagccgcctgtaaatccgtgaacggtagtcataaatataaaggaaacagtaaggacgtcaaaccgcccgatctgtggatccaccacgagcggctggaattaaagcccatagacaagtcccctgatccaaacccaatcatgacggatactccaataccgcgcaatagccaagatatcacgcctgtggacaattcaatggactccaatattcaccagcggaggaattcctaccggggccacgaaagcgaagattccatgagcaccttggccgggcgacgcggtatgcggcctaagatgatgatgcctttcgattcccagccccctcagcagtcagtacggaacaccccatcaaccgacacgatgccagctagcagttcacagacctgctgtacagaccatcaggatcccgagggcgccacgtcttcctcatacttagcttcatcccaggaagaagatagcggccagtccctgcctaccgcacacgtgcgtccctcacatcctctgaagtcctttgctgtgcctgccattcctccgccgggccctccgacatatgatcccgctctgcccagtacaccattgttgtcacagcaagcactgaaccaccatattcatagcgtgaagactgcaagtattggcaccctcgggagatctcgcccgccgatgcccgtggtagtaccatcagctcctgaggtccaggagactaccagaatgctagaggactcagagagttcctacgagccagacgagctgactaaggaaatggcccacctcgagggattgatgaaagacctgaatgccataacaacggcttag

SEQ ID NO: 196775 - DNA, 1074 bp, Artificial Sequence
  Description of Artificial Sequence: Synthetic coding sequence
atgcagagcgtgcagagcaccagcttctgcctgcggaagcagtgcctatgtctcacctttctgctgctgcatctgctcggccaggtcgccgccacacagcggtgtcccccgcaatgtccagggcgttgtccagctacacctccaacatgcgcgccaggggttcgcgctgttctcgatggctgctcatgctgcctagtatgcgcccggcagagaggagagagctgcagcgacctggagccttgcgacgagtccagcggcctgtactgcgatcggagtgccgacccctctaatcaaaccggcatctgcacagcagtggagggagataattgcgtgtttgatggcgtgatctatcgttctggcgaaaagtttcagcccagttgtaagtttcaatgtacttgccgcgacggacagatcgggtgcgtgcccaggtgccagctcgatgttttgctgcccgaacctaactgcccggcgccccgcaaggtggaagtgcccggggaatgctgtgagaaatggatttgcggtccagacgaggaagactctttggggggccttactctggctgcctatcgacctgaagccactcttggcgtcgaagtctctgattcctccgttaattgtatcgagcagaccaccgaatggactgcctgttctaaaagctgcggaatgggctttagtactcgagtgaccaacagaaaccgccagtgtgagatgttgaagcagacacgactctgcatggtaaggccgtgtgaacaggaaccagaacagcctacagataagaagggtaagaaatgcctgcgaacgaagaagtcactgaaggcgatacatctgcagtttaaaaactgtacctcattacatacttataaaccgcgcttctgcggcgtgtgttctgatggacggtgttgtactccacacaacactaagactatccaggccgagttccagtgttctcccggccaaatcgtaaagaagcccgtcatggtgatcggaacctgcacgtgtcatactaattgccctaaaaacaatgaggccttcctgcaggaactagagctcaaaacaactcgcggaaagatgtag

SEQ ID NO: 196776 - DNA, 2202 bp, Artificial Sequence
  Description of Artificial Sequence: Synthetic coding sequence
atgctggcccggcggcagcgggaccccctgcaggccctgcggcggagaaaccaagagctgaagcagcaggtggactccctgctgagcgagtctcagctgaaagaagcactggagccgaataaaaggcagcacatctatcaaaggtgtatacagctgaaacaagctatcgacgagaacaagaatgccctgcagaagctgagtaaagccgacgaatccgcacccgtcgcaaactataatcagcggaaggaagaggagcacaccctcctagacaagcttacacagcagctccagggcctcgccgtgacgatctcccgagagaacatcaccgaagttggggcccccacagaggaggaagaggaatccgaatcagaagatagcgaggatagtggtggggaagaagaggacgctgaggaagaagaggaagaaaaggaggagaatgagtctcataagtggtcaactggtgaagagtatattgctgtgggtgacttcacagctcagcaggtgggggatctgaccttcaagaagggagaaatcctgctggttatcgaaaagaaacccgatggctggtggatcgccaaggatgccaaaggcaatgagggtctggtgccacgcacttatctcgagccgtatagcgaagaggaagaaggccaggaaagctccgaagagggcagtgaggaggacgtagaagcagtggatgaaaccgctgacggtgctgaagtaaagcaacgaacagacccacattggtccgccgtacaaaaggctatttctgaggccgggatattctgtctggtcaatcacgttagcttctgctatctaattgtgctgatgcggaataggatggaaactgttgaggatacaaacggtagtgaaactggattccgagcatggaacgtccagagcagaggcaggattttcctcgtatctaaacccgttttgcagcaaattaatactgttgatgttctgaccacaatgggagctattccggcaggcttccgccctagcaccctgtcccaactgctggaggagggaaatcagtttagggctaattattttctgcaacccgagttaatgccttcccagttggccttccgcgacctgatgtgggacgccaccgagggcacaattcgctcgcggccctcccggatatcccttattctgacgctctggtcatgtaagatgattcctctgccggggatgtcaattcaggtactgtcacggcatgtgcggctgtgcctttttgacggcaacaaagtgttgagcaatattcacacagtgagagctacctggcagccgaaaaaacctaagacctggaccttcagccctcaagtgacacgaattctgccctgcctgttggatggggactgctttatccggtctaactcggcaagtccagacctggggatcttgtttgagttggggatcagctacattaggaatagcaccggtgaaagaggcgaactctcatgcggatgggtgtttctcaaattattcgacgcctctggggttcccatccctgccaagacttacgaactcttcctcaatggggggacaccctatgaaaagggcatcgaagtggatccttccattagcaggcgggctcacggcagtgtcttctaccagattatgaccatgcgtaggcagccacagcttttagtgaaattacggtctctgaacagacggtctcgcaacgttctgtctttacttccggaaacattgattggaaacatgtgctcgattcatctgctgattttctatcggcagatcctgggtgatgtgctgctgaaggacagaatgtccttgcagtcgaccgacctgatttcgcaccccatgttagcaacctttcctatgctgctggagcagccggatgtgatggacgccctgcgatcctcatgggctggcaaagagtctactctgaagcggagtgaaaaacgggacaaggagtttctcaaatcgacattcctcctggtgtaccacgattgcgtcctcccgctgctacattctaccagactgcctccctttagatgggctgaggaagagactgagacagcgcgatggaaggtcatcaccgattttctcaaacagaaccaggagaatcagggagctcttcaggcactgctgagcccagacggggtacacgaacctttcgatctctccgagcagacatatgattttctgggagaaatgcggaaaaatgccgtctag

SEQ ID NO: 196777 - DNA, 1845 bp, Artificial Sequence
  Description of Artificial Sequence: Synthetic coding sequence
atgctggcccggcggcagcgggaccccctgcaggccctgcggcggcgtaaccaagagctgaagcagcaggtggactccctgctgtcagagagccagttgaaggaagcacttgaacccaataagcgccaacacatctatcagcgcgtgggcgctccaacggaggaggaagaggagagtgagtctgaggacagcgaggattccgggggcgaggaggaggacgcagaagaggaggaggaagaaaaggaggagaatgagtctcacaaatggagcactggagaggaatatattgctgttggcgattttacagcacagcaggtaggagatctgacctttaaaaagggcgaaatcctccttgtcatcgagaaaaagcctgacggttggtggatcgcaaaggatgctaaaggcaacgaggggctcgtccctagaacgtacctggaaccgtactccgaagaggaggagggtcaagagtcaagtgaagaagggtctgaggaggacgttgaggcagtggacgagacggccgatggggccgaggttaagcagcggacggacccccattggagcgccgtacagaaagcaatatcagaaatcaacacagtcgatgtcctgactacaatgggagcaatccccgccggattcagacccagtactttgtcccagctcctcgaggaaggaaatcaattccgggccaactacttcctacagcctgagctgatgccttcccagctggcatttcgagacctgatgtgggatgcaaccgaaggcaccattcggtcacggccatcacggatttccctgatcttgacactgtggagctgcaaaatgatcccacttcctggcatgtccatccaggtcctgtcacgccatgtgaggttgtgcctatttgacgggaataaagtgctttccaacatccatacagtcagagctacttggcagcctaagaaacctaagacatggacgttctcccctcaggtgacccgtatcctcccttgcctgctagacggtgattgttttatcagaagtaactctgctagtcctgatttgggaatcctgtttgaactcggaatctcatacattagaaactctacaggggagcgaggcgaattgagttgcggctgggtgttcctgaagctcttcgatgcctccggcgtgcctatccctgctaaaacctacgagctgtttttgaatggaggaacaccctacgaaaaaggaatagaggtagatccatctatatctcgtagggctcacggtagcgtcttttatcaaattatgactatgcgcaggcagccacaattactagtgaagttacggagtctcaatagaaggtccaggaacgtactgtcattgctgcccgaaactctgatagggaacatgtgcagtattcaccttctgatattttatcgtcaaattttaggcgacgtgctactgaaagatcggatgagtcttcaatcgactgatctcataagccaccctatgctggccactttccccatgctcttggaacaaccggacgtcatggacgcactgcgatctagttgggccgggaaagaaagtactctgaaaagatcagagaagcgtgataaagagtttctaaagagtacctttctcctagtctaccatgactgtgtcctccccctccttcatagcacaagactcccgcctttccgctgggccgaagaggaaacagagacagctagatggaaagtgattaccgactttctgaagcaaaaccaggaaaatcagggagctctgcaagccctactatcccccgatggcgtgcacgaaccttttgatttgtccgagcagacctatgatttcctcggcgagatgcggaaaaatgccgtgtag

SEQ ID NO: 196778 - DNA, 2199 bp, Artificial Sequence
  Description of Artificial Sequence: Synthetic coding sequence
atgctggcccggcggcagcgggaccccctgcaggccctgcggcggaggaaccaggaacttaaacagcaggtcgacagtctgttgagcgagtctcagctaaaagaggcccttgaaccaaataagcgccagcacatttatcagagatgtattcaattaaagcaggctatagacgagaacaaaaatgctctgcagaaactgtccaaggctgatgaatcagctcctgtcgctaactacaatcaacgcaaggaggaggaacataccctgctcgataaactgactcaacagcttcagggccttgccgtgacaatttctcgcgagaatatcaccgaggttggtgcacctaccgaggaggaggaagagagcgagagtgaggactcagaggacagcggcggggaagaagaggacgcggaagaagaggaggaggagaaagaagagaatgagtcacataaatggtccaccggtgaggagtacatcgccgtgggcgattttaccgcccaacaggttggagatctcacctttaagaaaggcgagatactgttggttatcgaaaagaagcctgatgggtggtggattgcaaaagatgccaaggggaacgaggggctggtccccaggacatacctcgagccttattctgaggaggaggagggccaggaatcgtctgaggagggctctgaagaggacgtggaggcagtggatgagaccgccgatggggcggaagtcaagcagcggacagatccacattggagcgccgtgcagaaagcgatatcagaagccggcattttctgcctcgtgaatcacgtatccttctgctatctgatagtgttaatgagaaatcgaatggagaccgttgaggatactaacggtagcgagaccggctttcgggcctggaacgttcagagtcgcggaaggatatttttagtgagcaagcccgtgctacagataaataccgtggatgtgctcacaacaatgggggcaattcctgctggtttcagaccatcaacattgagccaactgctggaggagggtaatcagtttagagcaaactacttcctacaacctgagctgatgccatctcagctcgcttttcgggatttaatgtgggatgctactgaagggaccatccgatcgcggcctagtcgtatctccttgatccttactctctggtcctgcaagatgatccccctgcccggcatgagcatacaggtgctgagcagacatgtccgattatgtttattcgacggtaataaggtactctccaacatccatacagtgagggctacctggcagcccaagaagcccaagacatggaccttctctccgcaggtgacacgcatactaccgtgtctgctagacggcgactgctttattaggtctaactcagccagcccagacctgggcatcctctttgaactaggcatctcctatatccgaaattcaaccggggagcgcggggagttgtcatgtggctgggtgttcctgaaactctttgatgcaagcggtgttcccatacccgccaagacctatgaactcttcctaaatgggggaactccttatgaaaaagggatagaggtcgatccaagcattagtcgccgcgctcacgggtcagtgttttaccagatcatgaccatgagacgccagcctcaacttctggtgaagctgcgaagcctgaatagaaggtcgaggaatgtcctttctttgttgccggagaccctgatcggaaacatgtgcagcatccatctgctcattttttatagacaaatcttgggcgatgtgctcctgaaggatagaatgagcctccagtcgactgatttgatttcgcatcctatgctcgctacctttcccatgctgctagaacaaccagacgtgatggacgctctgaggagttcttgggccggcaaggagagtacacttaaacggtctgagaagagagataaggaattccttaagtccacttttttgcttgtatatcacgattgtgtgcttccactattacacagtacaaggcttcccccttttcggtgggcagaggaggagaccgaaaccgctaggtggaaagtgatcacagactttctgaagcagaatcaagaaaaccagggcgccctgcaagcgcttctatcccccgacggtgtccacgaaccctttgacctttccgaacaaacctacgattttctcggagaaatgagaaagaacgccgtctag

SEQ ID NO: 196779 - DNA, 2034 bp, Artificial Sequence
  Description of Artificial Sequence: Synthetic coding sequence
atgctggcccggcggcagcgggaccccctgcaggccctgcggcggcggaatcaggagcttaaacagcaggtagacagtcttctgtccgaatcgcagctcaaggaagctcttgaacctaacaagcgccagcacatctaccagaggtgtatccaactgaagcaggccatcgatgaaaataagaacgccctccagaagcttagtaaggcagacgagtccgctccggtggctaactataaccagcgcaaggaagaagagcacaccctgctcgacaagctaacacagcagctccaaggcctggccgttaccatatcacgggagaatataacagaagtgggggcgcctacagaggaggaggaggagtccgagagcgaggattcggaggacagcggtggtgaagaggaagatgcagaggaagaggaagaagaaaaggaagagaacgagtcccacaagtggtcaaccggggaggagtacattgctgtgggtgacttcaccgcccaacaggtaggcgatctgaccttcaagaaaggcgagattctgctggttattgaaaagaaaccagatggatggtggatcgcaaaggatgccaagggtaacgagggcttggttccccggacgtatctggagccttactctgaggaagaggaggggcaggagtcatcggaagagggatccgaagaagacgtggaggccgtggatgaaaccgccgacggagctgaggtgaaacagagaacagatcctcattggtcagctgtccagaaggcaattagcgagcagattaataccgtggacgtgctcacgacgatgggagccattccagctgggtttcgccccagcactctgagccagctccttgaagaagggaaccagtttagagcgaattattttctacaaccagagctaatgccaagtcaattagcatttagggatctgatgtgggatgctacagagggaacaattcgcagtcgaccatctagaatcagcctaattctcaccctgtggtcttgcaagatgattccgctgccaggaatgtccattcaggtgctatcacgtcatgttagactttgcctattcgatggtaataaagtgcttagtaacatccacacagtgagggcaacgtggcagcctaaaaaacccaaaacttggacgtttagccctcaggtaactaggattctcccttgtctgctggatggggattgttttatccggtctaactccgctagcccagacctcgggatactctttgagctgggtatctcctacatcaggaactcaaccggtgaacggggggagcttagctgtggatgggtctttctgaaactattcgacgccagtggagtgcctattccagccaaaacttacgagctttttctgaacgggggtaccccttacgagaaggggattgaggtggaccccagcatttcgcgcagggcccatggttccgtgttttaccaaattatgacaatgaggcgccaaccccaattactggtgaagctccgatccttaaacaggcgatccagaaacgtgctttcactcttgccagagactttgatagggaacatgtgcagtatacaccttctgatattctacagacaaatcctgggcgacgtgcttctgaaggacagaatgtcgctgcagtccactgatcttattagtcaccctatgctcgctacctttccaatgctgcttgagcagccagatgtgatggacgctttgaggagtagttgggccggcaaagaaagcacattaaagagatctgagaagagagacaaagaatttctgaaaagcacatttctgctggtataccatgattgcgttttacccctgttgcatagcacccgtctgccaccgttcagatgggctgaggaggaaaccgagactgcaaggtggaaggtaatcactgactttttgaagcagaatcaggaaaatcagggagcccttcaagccctcctttcgcctgatggcgtccatgagcccttcgatttgtctgaacagacctatgacttcttaggagagatgcgtaagaacgccgtgtag

SEQ ID NO: 196780 - DNA, 2115 bp, Artificial Sequence
  Description of Artificial Sequence: Synthetic coding sequence
atgggcaccgccagcagcctggtgagccccgccggcggcgaggtgattgaggacacttatggtgcaggtggtggagaggcctgcgagatccccgtagaagtgaagcctaaggccaggcttttgagaaattcatttaggcgaggtgccggagccgcggccggggccgggcccggctccctaccccgcggggtcggggcaggcgggttgctcggcgcttcctttaagtcaactggctcctccgttccggagctggagtacgcagcggcagagtacgagaggctccgcaaagagtatgagattttcagggtctccaaaaatcaagaacttttatctatgggaaggagggaagccaaactagacaccgaaaacaagcgtctgagggcggagctgcaagcccttcaaaagacataccagaagattctgcgcgagaaggaatcagccctggaggccaaatatcaggctatggagagggctgcgaccttcgaacatgatagggacaaagtgaagcgacaattcaagatattccgagaaaccaaggagaacgaaatacaggatcttctccgggctaaacgcgaattggagtccaaactccaacgccttcaggcacaggggatacaggtttttgatccgggcgaatccgatagcgacgacaactgcaccgatgtgacagccgccggtacacagtgcgagtactggaccgggggcgcattgggttccgagccctccatcggttccatgatccaacttcaacaaagttttcgggggccagaattcgcgcactcttcgatcgatgtggaaggcccttttgccaacgtgaatcgcgacgattgggatattgcagtggctagccttcttcaggttactcctttatttagccattccctctggagcaataccgtgagatgttacctgatctacacggacgagacgcaacccgaaatggacctttttctcaaagattattcccccaaactgaagcggatgtgcgagacaatgggatacttttttcacgctgtgtacttccccatagatgttgagaaccaatacctgactgtgaggaagtgggagatcgagaaatctagccttgtgatcctgttcatacatctgacattaccttcccttctgctggaagactgcgaggaggcttttctcaagaatccggagggtaaacccagactgattttccacaggttggaggatgggaaagtgtcctctgactctgtgcagcagttgattgatcaggtatccaacctcaacaagacaagcaaggcaaagattatcgatcattccggcgacccggccgagggagtgtacaagacctatatctgcgtagaaaaaatcatcaagcaggacatcctcggattcgaaaatactgaccttgagactaaggacctcggttcagaggatagtatacctgaggaggatgactttggcgacgtgctgtgggatatccatgatgagcaggaacagatggagacttttcagcaggcatcaaacagtgcgcatgagttgggctttgaaaaatactatcagaggctgaatgatcttgttgctgcccctgcacctataccccctcttctggtgtccggcggacccggcagcggaaaaagcctgctgctgtccaagtggatccaattacagcagaagaacagcccgaacactctgatactgtctcattttgtggggcgtcctatgtctaccagctcagagagctcactgattatcaaaagattaaccctgaaactgatgcagcattcatggagcgttagcgccctaactctggatcccgcgaagttactcgaggagtttccacgatggctagagaaactcagcgccaggcaccagggtagtatcatcatagtcatcgattctatcgatcaggttcaacaggtggaaaaacatatgaaatggctgattgatccactccctgtgaacgtccgcgtgatcgtgtctgtgaacgtggagacgtgccctcctgcatggcgactgtggccgactttacatcttgatcccctctcaccgaaagatgccaagtctatcatcatcgccgagtgccattcggtggatatcaaactctccaaagagcagtgctgggaaagtcggcagttccgatag

SEQ ID NO: 196781 - DNA, 3993 bp, Artificial Sequence
  Description of Artificial Sequence: Synthetic coding sequence
atgggcaccgccagcagcctggtgagccccgccggcggcgaggtgatcgaggatacctacggggctgggggcggcgaagcgtgcgaaatacccgtggaagtgaagcccaaggccaggctgctgagaaattcgttcaggcgcggggccggagcagcggcaggggccggacctggcagtcttccgcgtggcgtcggtgccgggggcctgcttggtgccagctttaagagtacggggtccagtgtccctgaactagagtacgcagctgccgaatacgagcggctcagaaaggaatacgaaatttttagagtgagcaaaaatcaagaacttttatccatgggacggagggaggccaagcttgataccgaaaacaaacggctgcgagccgagctgcaggcactgcaaaagacttatcagaaaatacttcgtgagaaagagtccgcactggaggctaaatatcaggcaatggagcgcgccgcgacattcgagcacgaccgggacaaggttaagagacagtttaagatatttcgagagaccaaggagaacgaaatacaggacctgctcagggccaaaagagaactagaatccaagctgcagaggttgcaggcccagggtattcaggtctttgaccccggagaaagcgactcagatgataattgtactgacgtgactgcggctggcacccaatgtgagtattggactggaggggccctcgggtcggagcccagcattggctcgatgattcagctccagcagtcttttagaggacccgagttcgcccactcttccatcgatgtagaggggcccttcgctaacgtaaaccgtgacgactgggatattgctgttgcatctttgctacaggtaaccccactgttctctcattctctgtggtctaataccgtgagatgctacctgatttacacagatgagacacaaccagagatggacctgttcctgaaagattacagtcctaagctcaagagaatgtgcgaaacgatgggctattttttccatgcggtttactttccaatcgacgtggagaatcagtatctcactgtgcgcaaatgggagatcgagaagtctagcttagtaatcctcttcattcacctgaccctgcctagccttctgctggaggattgcgaggaagcgtttctcaaaaatcccgagggtaaaccaagactgattttccaccgcttagaggacgggaaagtgtccagcgatagcgtccagcagcttattgatcaggtgagcaacctgaacaagacctcaaaagccaagatcatcgatcattcaggcgatcccgcggagggtgtgtataagacctacatttgtgtagagaagattatcaaacaggacattctggggtttgagaacacagaccttgagacaaaagacctagggtcggaggacagtattcctgaggaagatgatttcggagatgtgttgtgggatatacacgatgaacaagagcagatggaaacattccagcaagcctctaactctgcacacgaactgggattcgagaaatattaccaacgcctgaacgacctggttgcagcacctgctcccattccacctttgcttgtgagtggtggccccggtagtggaaagtcactgctgctgtccaagtggatccaattgcaacagaagaacagcccaaacactctgattctctcacattttgtgggccggcccatgtcaacttcctctgagtctagcctgattatcaaacgtctcaccctgaaacttatgcaacattcttggtctgtcagcgctctgacccttgaccccgcgaagcttctagaggagttcccacgctggctcgaaaagctgtcagcccgtcaccagggttcgatcattatcgtgatagattctatcgatcaggttcagcaggtcgagaaacacatgaaatggctgatcgatcctcttcccgtcaatgtgagagtgatcgtctctgtaaacgtggagacttgtccccccgcctggcggctgtggcctactctgcacctcgacccgctttctcctaaagatgcaaagtctatcattattgccgaatgtcattcagtggatatcaaactttccaaggagcaagaaaaaaaactagaaagacactgtcgaagcgctacgacttgcaacgccttgtatgtcaccctcttcggcaagatgattgctcgggccggtagagcaggcaacctggataagattctccaccagtgtttccagtgccaggataccctgtcattgtaccggcttgtacttcacagtatacgtgagagcatggccaacgacgtcgacaaagagctgatgaagcagatcctgtgcctcgtcaacgtcagtcataatggagtgtctgagagtgaattgatggagctctatccggaaatgtcctggacatttctcacttcacttatccactctctatataagatgtgtctgctgacctatggatgcgggctgctcaggttccagcaccttcaggcctgggaaaccgtccgcctggagtaccttgagggccccaccgtgacatcatcctatcggcagaagctaattaattacttcactctccagctgagccaggatcgcgtgacatggaggagcgccgacgagttaccttggcttttccaacaacagggaagcaaacagaagctacacgactgtctgttaaatctttttgtatcccagaacttgtataagcgcgggcactttgccgagctactgagctactggcagttcgtaggcaaggataaatccgctatggcaacagagtacttcgattcactcaagcagtacgagaaaaactgcgaaggggaggacaatatgtcttgcttggccgatctgtacgagacgcttgggcgctttctgaaagacctcggtcttctcagccaagctattgtcccactccagcgaagcctggagattcgggagacagccctcgaccccgatcacccacgtgtggctcagtccttacaccagctagccagtgtgtacgtgcagtggaaaaaattcggtaatgccgaacagctctacaagcaggcactggaaatttcggagaacgcctatggtgctgatcatccttacaccgcccgcgaactcgaagccctggcgacgctctaccaaaaacaaaataaatacgaacaggccgaacattttagaaagaagagctttaaaattcatcagaaagcaatcaaaaagaaagggaacctctatgggttcgcattgttgcggcgccgagctctgcagctggaagagctgaccctgggcaaggacacccccgacaacgccagaacactgaatgagctcggtgtcctgtactacctccagaataacctagagaccgccgatcagtttctgaagaggtcattagaaatgagagagcgggtcctgggacccgaccaccccgattgcgcacagagcctgaataacctggcggccctctgcaacgaaaagaagcaatacgacaaggctgaggaactgtatgaaagagctctggatattcgaaggcgagcactggccccagaccacccttccttggcatacacagttaagcatctggccatcctgtacaaaaagatgggtaagcttgataaggccgtgcccctttatgagctggctgtcgaaatcagacagaaaagcttcggacccaagcaccctagcgttgccacagcattggttaacttggccgtattgtactctcaaatgaagaagcacgtagaggctctgcctctgtatgagcgtgcccttaaaatctacgaggatagtctcggccgcatgcaccccagagttggggagacattgaagaacctggcggtcctgagttacgaaggtggagatttcgaaaaggctgcggagttatacaaaagagctatggagataaaggaggcagagaccagcctgctgggaggtaaggcgcctagccggcactcatcaagcggagatacattcagtttaaaaactgctcactcccccaacgtttttttgcagcagggccagcggtag

SEQ ID NO: 196782 - DNA, 720 bp, Artificial Sequence
  Description of Artificial Sequence: Synthetic coding sequence
atgggcaccgccagcagcctggtgagccccgccggcggcgaggtgattgaagacacatatggtgccggcgggggagaggcttgcgagatccctgtggaggtgaagcctaaagctcgtttgctgagaaattcttttcgaaggggagcaggcgccgccgctggcgccgggcccgggagtttgccccgcggggtgggcgccggtggattgctaggcgcatcttttaagagcactgggtccagtgtcccggagctggagtacgccgccgccgagtatgaaaggttgagaaaggagtacgagatctttagggtgtcaaaaaaccaggagctcctttctatggggcgcagagaagccaaattagataccgaaaacaagagactgcgggctgaattgcaggccctacagaaaacttaccaaaagattctgcgtgagaaggagagtgcattggaagccaagtaccaagctatggagcgcgcggctacctttgagcatgaccgggacaaagtgaagaggcagtttaaaatctttcgtgagactaaggagaatgagatccaggatcttctgcgcgcaaagcgagagctggaatcaaagttacaacgcctgcaagcccagggtatacaagtttttgacccaggcgaatcggactctgacgacaattgtaccgatgttacggtgtccctggaatctgaccagcaccctggaatcttcattgctaacttctag

SEQ ID NO: 196783 - DNA, 453 bp, Artificial Sequence
  Description of Artificial Sequence: Synthetic coding sequence
atgggcaccgccagcagcctggtgagccccgccggcggcgaggtgattgaagatacctatggcgctgggggaggtgaagcttgtgaaattccggtggaagtaaagcccaaagcccgtttgctgcgcaattctttccgtagaggggccggcgcagccgctggcgccggtcccgggtcactgcctcggggagttggcgctggcggactcttgggagcttctttcaagagcacgggaagctcagttccagagctggagtacgctgctgccgagtacgagagacttaggaaagaatacgaaatctttcgggtgtctaagaatcaagaattattatctatggggcggcgagaggcgaagctcgataccgaaaataaaaggctcagagctgagttgcaagggctggctgccgtggcccgatcgcgcctgacagcaacatggaacagttgggcacagtag

SEQ ID NO: 196784 - DNA, 1914 bp, Artificial Sequence
  Description of Artificial Sequence: Synthetic coding sequence
atcatcgccaacgccggccgggccggcaacctggacaagatcctgcatcaatgcttccagtgccaggacacactctcgttgtacagattggttctgcactctatcagggaaagcatggcaaacgatgtcgataaggagctgatgaagcaaattctgtgtctagtgaacgtgtcacacaacggagtctcagagagtgaattgatggaattatacccagaaatgtcttggacctttctcacttcccttatacatagcctgtataaaatgtgtctgctaacatacggatgcggtcttctgcgcttccagcatctgcaggcatgggagactgtccgcctcgagtatctggaaggacccactgtgacctcgtcctataggcagaagttaatcaactactttaccctgcagctgtcccaggatagagtgacctggaggtcagctgacgagcttccttggctcttccagcagcagggaagtaagcagaagctgcatgattgcctcctcaacctgtttgtgagccaaaacctgtataaacgcggacatttcgcggagctgctctcttactggcaatttgtgggcaaagataagagcgccatggcaactgagtatttcgattctctgaaacaatatgaaaagaactgtgagggtgaggataatatgtcctgtcttgccgacctgtacgagaccctgggacggtttctgaaggacctgggactgctgtctcaggctatagtcccactgcaaagatccttggagattagagaaaccgcgttagacccagaccatccccgggtggcccaatccttacaccagctcgccagtgtgtatgtgcagtggaaaaagttcggtaatgccgaacaactgtataaacaagcgctggaaatttctgaaaacgcttacggggcggatcacccttataccgcaagagagctggaagctctggcaacattgtaccagaagcagaataaatatgaacaggcggagcatttccgaaagaagtctttcaagatccaccaaaaggcaatcaagaagaaaggtaatctgtatggattcgctttacttaggcgcagagccttgcaactggaagagcttacgctggggaaagacaccccggacaacgcaagaacacttaacgagctgggtgtgctttactacctccagaacaatctggaaactgccgaccagttccttaagagatctctggagatgagggagcgcgtgcttggtcctgatcatcctgactgcgctcagtccctgaataaccttgcagcgctctgtaacgagaaaaaacaatacgataaggctgaggaactgtatgagagagctttagacatccggcgccgggcacttgccccagatcacccttcattagcatatactgtaaaacacttggctatactctacaaaaaaatgggcaagctggacaaggctgtgccattatacgaactggcagtggaaatcagacaaaagtccttcgggcccaagcacccctccgtcgccacagccctggtaaaccttgctgtgctgtactcccaaatgaaaaagcacgtagaggctctccccttgtacgaacgggcgctcaagatctacgaggacagtctgggacggatgcaccccagagttggggaaacactgaaaaacctcgccgttctgagctatgagggaggcgatttcgagaaagcagccgagctctataagcgggccatggagattaaggaagccgagaccagcctgcttgggggaaaagcccccagccggcactcctcatctggagacacgtttagtttgaagacagcccacagccctaacgtattcctccaacaggggcagcggaaggttcagagcaacctgttgtcacctgagggactgtccaacatttgcgcgcaagagaaaaccacgagatttacctcctcctag

SEQ ID NO: 196785 - DNA, 1236 bp, Artificial Sequence
  Description of Artificial Sequence: Synthetic coding sequence
atgagctgcctggccgacctgtacgagaccctgggccggttcctgaaagatctgggtttgctgagccaggctatcgttcctctgcagcggagcctggagatacgcgagactgcccttgatcccgatcatccgcgagtggcccagagtcttcatcagttggcctcagtgtatgtgcagtggaagaagttcggaaatgcagagcagctctacaagcaggctctcgagatttccgagaacgcttatggcgccgaccatccctacacagcacgcgaattggaggccctggccacgttatatcagaagcagaacaagtatgaacaggcggagcactttaggaagaaatcatttaaaatccaccaaaaagcgatcaaaaagaaagggaacctttacggttttgctctcttacggagacgggctctacagctcgaggagctgactctcgggaaggacaccccagataacgcccgaacactgaatgaactaggggttttgtactatctgcagaataatctcgagacggcggatcaattcctgaagagatccttggagatgcgcgagagagtgctggggcctgatcaccccgattgcgcccaatccctgaacaacttagcggccctgtgcaacgaaaagaaacagtacgacaaggccgaagaactgtacgagcgcgccctggacataagacgaagggcactggcaccggatcatcccagtctggcctatacagttaaacacctcgcaatcttgtataaaaaaatgggaaagctggacaaagcggtgccactgtacgaattagctgttgagataagacagaagagttttggccccaaacatcctagcgtggcgactgcacttgttaacctggctgtcttatattcccagatgaagaagcatgtggaggcgttgcccctgtacgagagggcactcaaaatctacgaagactcactggggaggatgcacccccgggtgggagagactctgaagaatctagcagtgttaagttacgaaggaggggattttgagaaggcagcagaactgtataagagggccatggagataaaggaagctgaaacatcactcctgggaggcaaagctccctctagacactcatcctccggcgatactttcagcctaaaaacagcccactctcccaatgtcttcctccaacaaggccaaagggctgggaaatctaaccctacattctacttgcagaaaggtttccagacttacgttctgtag

SEQ ID NO: 196786 - DNA, 4281 bp, Artificial Sequence
  Description of Artificial Sequence: Synthetic coding sequence
atgaacgactggcaccggatcttcacccagaacgtgctggtgcccccccacccacaacgagctaggcagccctggaaagaatcgacagccttccaatgtgtgctgaaatggctggatgggcctgttatccgccaaggggttctggaggtgctttcggaagtcgagtgccatctcagggttagtttctttgacgtcacatacagacacttttttggtcggacttggaagaccacagtgaaacccacaaagcgccccccctcaagaatcgtgtttaacgagccactctattttcatacttctctgaaccaccctcacatcgtcgctgtggttgaagtcgtggccgaagggaagaagcgggacggctccctacagaccctctcctgcgggtttgggatactgcgaatattcagcaatcagccagacagcccaatctcggcttcacaggataaaagattgagattgtatcacggtaccccccgcgccctgctccaccctcttctgcaggaccctgcagaacagaacaggcacatgacacttatagaaaactgctctttgcagtatacattgaagccacaccccgccctggagccggcatttcacctgcttccggaaaacctgttagtgagtgggctacagcagatccctggactattgccagcacatggagagagtggtgatgccctccgcaaacctagactgcagaaaccaataaccgggcatttagatgacctgttctttacattatatccaagcttggaaaagttcgaagaggaactcttggagcttcacgttcaggatcacttccaggaaggctgtggacccctcgatggaggggcactggagatcttggaaaggcgcctgagggtgggggtgcacaacgggctcgggtttgtgcagaggcctcaggtcgtggtgctcgtgcccgaaatggatgtcgcactgacaaggagtgcctccttttcccgaaaggtcgtgagtagctcaaagacctcttccggctctcaggcactggtcctgaggtctcgtctcaggctgcccgagatggtgggacatccggcctttgctgtcatctttcagctcgagtatgttttttccagtccagccggtgttgatgggaatgccgcaagtgtgacatcactgtccaacttggcctgtatgcacatggtgcgttgggccgtctggaatcctttgcttgaagcagatagtgggcgggtcacacttccactgcagggggggatccagcccaacccatctcactgcctcgtctacaaggtcccttccgcctccatgtcttccgaggaggtcaagcaggtggagtcaggcaccctccgcttccagtttagtctcggatctgaggaacatctagacgcaccaactgagcccgtctctggacctaaggtggagagacggccctcaagaaaaccgccaacctctccttcttctccaccagctccagtgccccgcgtactcgctgccccgcagaactcccccgtgggaccagggctgtccatctcccaattagcagcatcaccaagaagcccaacgcagcattgcttagcaagaccgaccagtcaattgcctcatggatctcaggcttctcctgcacaggcacaggagttccccctcgaagctggaattagtcatctggaggcggatctgagccagacctcactcgtactagagacaagcattgcagagcagctgcaggagttaccatttaccccgcttcatgctcccatagtcgtgggaacacagactcgatcctcggccggccagccttcacgcgcctctatggtgttgttacaatcctctggcttcccagaaattctggacgcaaacaaacagcccgcagaggccgtttccgcgacggagccagtgacattcaatcctcagaaggaggaaagtgattgcctgcaaagcaacgaaatggtcctgcagtttctggcttttagtcgggtcgcacaggattgcagaggtacaagttggccaaagacggtatacttcaccttccagttctacaggttccctccggctacaacccccagattgcagctggtgcagctcgacgaagctggtcagccaagctctggcgccctgacacatattctcgtgcccgtgtctcgcgacggcacattcgacgcagggtcaccaggcttccaactgcgttatatggttggtccggggttccttaagccaggggagcgtaggtgctttgccagatacctggccgttcagactcttcaaatcgacgtgtgggatggtgacagcctgcttttgatcggtagtgccgcagtacagatgaaacacctcctgcgtcaaggaagaccggccgtgcaggcttcacatgagctggaggtggtggccacagaatacgagcaggacaacatggtggtcagcggagatatgctgggctttgggcgggtgaagcccattggcgtccacagtgtggttaagggccgtttacacctgaccctggctaacgtggggcatccgtgtgaacagaaggtacgcggctgttcaacattgccaccctctcgaagccgagtgattagtaacgacggggcttcgcgcttttctggagggtctctgctgacaaccggttcttctaggcggaaacatgtcgtgcaggctcagaaactagcagacgtcgattctgaactggctgctatgttgctcacacacgcaagacaggggaagggcccccaggacgtttcacgggagagcgatgccacacgaaggcggaaactggagcgcatgcgttccgttaggttacaagaagcaggcggagacctcggcaggcgtggtacctccgtgctcgcgcagcagtccgtgcgtacacagcatctcagggatctgcaggtgattgctgcctacagagaacgaacgaaggctgaaagcatcgcctccttgctgagcctggctatcacaaccgagcatactctgcacgctaccctgggtgtagccgagttttttgagtttgttctgaaaaaccctcacaatacgcaacatacagtgaccgtcgagattgacaatccggagctatccgtgattgtagatagtcaggaatggcgcgactttaaaggtgcggccggcctgcatacccctgtggaagaggacatgttccatcttcggggttccttggctccgcagctttacctgcgcccacatgaaacagcacacgtacctttcaagtttcagtcatttagtgccgggcaacttgctatggttcaagctagccccggcctgtccaacgagaagggtatggacgcagtttcaccgtggaaatcttcggccgtcccaacgaaacacgccaaagttctgttccgggcatctgggggaaaaccaattgctgttctatgtttaaccgttgaactgcagccccacgtcgtggatcaggtgttcagattctatcaccctgaactgtcatttctaaagaaagccatcagactgcctccatggcatacatttccaggggccccagtgggaatgcttggtgaagatcctcctgtccatgtgcggtgtagcgaccccaatgttatctgtgaaacgcaaaacgtggggcctggtgaaccccgagacatattcctgaaggtcgcctctgggcccagtcctgaaattaaggatttttttgttatcatctattccgacagatggcttgcaacaccaactcagacttggcaggtgtacctacattcactccagagagtagacgtgagctgcgtggctggccagttgactaggctgtccctcgttctaagggggacgcagaccgtgaggaaagtgagggccttcacaagccatccgcaggaactaaagacagatccgaagggcgtgtttgtgctgcctcctcggggcgtgcaggacctgcatgttggcgtgagacccctgcgggccggcagtcgctttgtacacctgaacttggtggatgtcgattgtcatcagctcgtggccagttggctcgtgtgcctgtgctgccggcagccactaatcagcaaagcatttgaaatcatgcttgccgctggcgaaggtaagggtgtgaataagagaattacttacactaatccctatccttcacggcggacgtttcacctgcattcagaccaccctgagctccttagatttcgagaggattcattccaggtcggtggcggagagacatacaccatcggcctgcagttcgcaccatcacagcgcgtaggcgaagaggaaattctcatctacatcaacgatcatgaggataaaaacgaagaagctttctgtgttaaggtgatttatcagtag

SEQ ID NO: 196787 - DNA, 546 bp, Artificial Sequence
  Description of Artificial Sequence: Synthetic coding sequence
atggtgctgctgcagagcagcggcttccccgagatcctggacgccaataaacaacccgccgaggccgtgagtgccacagagccggtgacttttaaccctcagaaggaggagtctgactgtctgcaaagtaatgagatggtcctgcaatttttggccttctccagagtggcacaggattgtcgcggaacctcttggccaaagaccgtgtattttacattccagttctatcgtttcccgccagccaccacacctagactgcaactcgtccaactggacgaggctggccagccatcaagtggggcgttgacccacatcctggttcctgtgtcccgcgacggcactttcgatgcggggagccctggctttcaactgcggtacatggttggcccgggctttttaaagccaggagagcgccgatgttttgcgcgctacttggcagtgcagacgctccagatagatgtgtgggacggagattctcttctgctgatcggttccgcagccgtgcaaatgaaggaaacgtcacacatcttttctgtatcacagtag

SEQ ID NO: 196788 - DNA, 3606 bp, Artificial Sequence
  Description of Artificial Sequence: Synthetic coding sequence
atggccctgggcaccaccctgcgggccagcctgctgctgctgggccttctgacggaaggtcttgctcaattagccattcctgccagtgtcccaagaggcttctgggctctgccggagaacctgactgtcgttgaaggcgcttcagtggaacttcggtgtggcgtttcgacacctggatctgccgtgcaatgggctaaagacgggctgctgctgggcccagaccccaggatcccaggctttccgcggtacagattggagggggatcctgcacggggcgagtttcatttgcacatagaagcctgtgacttgagcgatgatgctgagtacgagtgtcaagttggacgtagcgagatgggacccgagctggtatccccaagggtgatcctcagtattcttgttcccccgaaactgctgctgctgacacctgaggctggcaccatggtaacatgggtggctggacaggagtatgtggtgaactgtgtttcgggcgatgcaaaacccgcccctgacattactattcttctctcaggtcagacaatcagtgatatcagcgccaatgtcaacgaaggtagccagcaaaagttgttcacagtggaggcaacggctagagtgactcccaggtcaagcgacaaccggcagctgttggtatgcgaagccagcagccccgcgctcgaagctcctattaaagcatcctttacagtgaacgtgctgtttcctccagggcctcccgtaatcgagtggcctggactcgacgaggggcacgtaagggcaggccagtctctggaactcccgtgtgttgcacgaggtggaaaccctctcgccacactccagtggttgaagaacggacagcccgtgagcaccgcctgggggacagagcatacccaagcagtggcaagaagcgtcctggtgatgaccgtccgtcccgaggatcacggagcacagctctcctgcgaggctcacaatagcgttagtgcgggaacgcaggaacatggaatcacactgcaggtcaccttccccccatctgctattatcatactgggcagtgccagtcaaacggagaacaagaatgtgactttgtcatgcgtctcgaagtcttctcgcccacgcgtgcttctccgatggtggttgggatggagacagctgctgcctatggaggagaccgtaatggatgggttacacggtggccatatctccatgagcaatctcacctttctagcccggagagaggacaacgggctgaccctgacgtgtgaagcgttttccgaagctttcaccaaggagacctttaagaagagccttattctcaatgtcaaatacccagcccagaagctgtggatcgagggtccaccagaagggcagaaattgagagccggcaccagagtacgacttgtatgcctggccatcggtggcaatccggaaccgagcttgatgtggtacaaagattccaggactgtcactgaatcacgactgcctcaagaaagtcggagggtacacctgggctctgttgaaaagagtggaagtacattcagccgggagctcgttttggtcacaggcccttcagacaaccaggctaagttcacctgtaaggccgggcaactgagtgcaagcactcagctggccgttcagttcccccctacaaacgtcaccatcctcgctaacgcctctgccttgcgacctggagacgccctgaacttgacctgtgtgagtgtttcatccaacccccccgtgaacctgagttgggacaaggagggagagcggctggagggggtggccgcacctccccggcgcgctccttttaaaggctctgcagcagcgagatccgtactgctccaggtgtcctccagagatcatgggcagcgagtcacttgccgggcacacagtgccgaactccgggagaccgtctcttcattttaccgcctgaacgtgctgtaccgaccggagttcctcggggagcaagtccttgtggtgaccgcagtcgaacagggtgaagccctactgcctgtttctgtgtctgctaaccccgcccctgaagcttttaactggacttttcggggatatcgcctgagccctgccgggggcccaaggcatcggatcttgtccagcggagctcttcacctttggaacgttacacgcgccgatgatgggttgtaccagctccactgtcaaaatagtgagggcaccgcggaagcacgcttgcgcctggacgttcattatgcccccaccattcgtgctcttcaggatccaacagaggtcaatgtggggggcagcgtcgatatcgtgtgcacggtggatgctaatccaattttaccaggcatgtttaactgggagcggttaggtgaggatgaggaggaccagtctttagatgacatggagaagatctccagaggtccaacaggacgactccgtattcaccatgcaaaactggctcaggcaggggcgtaccaatgtatagtcgacaacggggtcgccccccctgcccgcagactgctgcgactggttgtacggtttgctccccaggttgaacacccaactccactgactaaggtggctgcagccggcgactctacctcaagcgcgactctgcattgtcgggctaggggcgttccaaatatcgttttcacctggactaaaaacggggtacccctggatttgcaggacccaaggtacacagaacacacctatcaccaaggtggcgtgcactcctctctacttacaatagctaatgtatccgctgcccaggattatgcgttgttcacctgtactgccactaatgctctgggctctgatcagacaaacatccaactagtctccatctcccgccccgacccaccttcagggctgaaagtggtgtcactgacgccacacagtgtgggactagagtggaagcccggctttgatgggggactgcctcagaggttctgtataagatatgaggctctggggacccccggcttccactacgtggacgtcgtccctccccaggccacaacctttaccttgacgggcttacaacctagcacacggtaccgggtatggctactggcctctaacgccttgggtgatagcggcttggctgacaagggcacccagttgcccataacgacccctggcctgcatcagccttcaggagagccagaagatcaacttcctaccgagccaccatcaggtatatcggaaaaaactgaggctgggtccgaagaggatagagttagaaacgagtatgaagaatcgcagtggactggggaacgcgacacccaaagcagcacagtctcaacaaccgaggcggagccttattaccgcagtctgagagatttttctcctcaactccctcccacacaggaggaagtcagttactcaaggggctttacgggcgaggatgaggatatggcctttcccggccacctttacgacgaggttgaacgcacatatccaccgtcgggggcctggggtcccctctatgatgaggtgcagatggggccctgggatctgcattggcctgaagatacctatcaggatccacgagggatttacgatcaagtcgctggggacttagacacacttgagccagattctctgcccttcgagctgagggggcacctggtgtag

SEQ ID NO: 196789 - DNA, 3726 bp, Artificial Sequence
  Description of Artificial Sequence: Synthetic coding sequence
atggccctgggcaccaccctgcgggccagcctgctgctgctgggcctcttgaccgaggggttagcccaacttgcgatccccgcatcggttccaagaggtttttgggctttgccggagaacctgaccgtggttgaaggtgcctccgttgaacttcgctgcggtgtatctacgccaggaagcgccgtgcaatgggccaaggacggacttctccttggccccgaccctagaatccccgggttcccccgctaccggctggaaggagatcctgcccgcggagaatttcacttgcatatcgaggcttgcgacctttctgatgacgccgagtacgagtgccaggtcggccgcagcgagatgggcccagagctggtgagcccccgcgtcatactgagcattcttgtacctcctaagctcttactgttaactccagaagccgggaccatggtaacatgggtagccggccaagagtacgtggttaattgtgtgtcgggcgatgcaaagccagcgcccgacattacaattctgctctcaggtcagaccatttccgatataagcgctaacgtgaacgagggatcacaacaaaaactgttcacggtagaagctaccgctcgggtgacaccgcgctcttctgacaacaggcagcttctcgtgtgtgaggcctcctctcccgctctcgaagctccaatcaaagcctctttcacggttaacgtactgttccccccgggccccccggttattgagtggcccggactggatgagggacatgtgagggccggacaatctctggagctgccctgtgtggcccgaggaggcaatccccttgctaccctccagtggctgaagaacggacaacctgtttctactgcctggggcaccgagcacactcaggccgtggctagaagtgtgctggttatgactgtgagacccgaggaccatggagcccagctgtcctgtgaagcacacaattcagttagcgccggcacacaggaacatggaatcacactccaggtcactttcccaccttccgctatcatcattctggggagcgctagccagactgagaataagaacgtcactctctcttgcgttagcaaatcttctagacctcgcgtccttctccggtggtggttgggctggcgccagttactccccatggaagaaaccgtgatggacgggcttcacggaggacacattagcatgagcaacctcacttttctggcccggcgggaggacaatggcctgactttaacctgcgaagctttttccgaagcgtttacaaaggaaaccttcaagaaaagcctgatactgaatgttaagtatcccgcccagaagctgtggattgaggggccaccagaaggccaaaagctgagggcaggaacaagagtgcgcctggtatgtcttgccatcggaggaaaccccgagccaagcttaatgtggtataaggattcacgaaccgttacagagagcagactgccgcaggagagccggagagtgcaccttgggagcgtggaaaagtctgggtcaacctttagccgcgagctcgtcctggtgactggccctagcgacaatcaggctaaattcacttgcaaagcaggccaactttcagcatcaacgcagctcgctgtgcagttcccccccactaatgtaactatccttgccaacgcatcagcattgagacccggcgacgcattgaatctgacctgcgtgtcagtgagctctaatcctcccgtgaacctcagttgggacaaggagggagaaagactggaaggggtggctgctccacctcggcgcgcgcctttcaaaggctctgcagcagcacggagcgtgttgcttcaggtttcctcccgcgaccacggacagcgagtcacttgcagagctcactcggctgagctgcgagagaccgtctcttctttctaccgcctgaatgtgctgtacagacctgaattccttggggaacaagtcctggtggtgaccgccgttgagcaaggcgaggccctcttaccagtgtcagtgtcagctaaccctgcacctgaagcttttaactggaccttcaggggctaccggttatcaccagccggaggcccgcggcataggattttgtcctccggcgctttacacctctggaatgtgactagggctgatgatggtctgtatcaactgcactgtcagaacagcgaaggcactgccgaggccagactgcgcctggacgtgcactacgcgccaactatccgggccctgcaggatccaactgaggtgaatgtcggcggcagcgtagacatagtgtgcactgtagatgctaaccccattttaccgggcatgttcaactgggagcgtctcggcgaggatgaagaggaccagtctctggacgatatggagaagatttcacggggccccacaggcagactgcgcattcatcacgccaagctggctcaggctggggcataccagtgcattgttgacaatggggttgcgccaccagctcgcagactcctgcgactggtcgtcagattcgccccccaagtggagcaccccacccccctgactaaggtagcagccgcaggagacagcacttcctctgccaccctccactgtagggcccgcggcgtgcctaacatcgtgttcacctggacaaagaatggcgtccccttggaccttcaggaccctaggtatactgagcacacatatcatcagggtggggtgcactccagcctactgaccatagcaaatgtaagtgcagctcaggattatgccctattcacctgcaccgccacgaatgctttgggctcagatcagacaaatattcagctggtgtcgattagcagacccgaccccccttccggcttgaaggtcgtgtcattaactcctcacagcgtcggtctcgagtggaaacctggcttcgatggaggcctgccacagcgcttttgcataaggtacgaagctcttggaacaccaggtttccattatgttgatgttgtccctccacaggcgacaacttttaccctcaccggcctgcagccttcaacccggtacagagtgtggcttttggccagcaacgcattaggtgatagtgggcttgcagataagggcacccagctgcctattacaaccccagggctgcatcagcctagcggagagcccgaggatcaactgccaacagagccaccttccgggccttccgggctcccactgctgcctgttctgtttgccctgggtgggttgctactcttgtcaaacgcctcttgcgtgggcggggtcctatggcagcgacgcctgagacgcctggctgaagggatctcagagaagacggaggctggctccgaggaagatagagtgcgcaacgaatacgaggagagccagtggacaggggaacgcgatacgcaaagtagtaccgtcagcactaccgaggccgaaccttattatcgctcactgagagacttctccccccaattgccccccacgcaggaagaggtcagttattcccggggatttacaggggaggatgaagatatggccttccccggccatttgtacgacgaagtggagcggacctaccccccatcaggtgcttggggcccgctttacgacgaggtccaaatgggaccctgggatctgcattggcctgaagatacttaccaggacccccggggaatctatgaccaagttgctggggaccttgacaccctcgagccagactcactgcctttcgagttgcgggggcacctggtatag

SEQ ID NO: 196790 - DNA, 1152 bp, Artificial Sequence
  Description of Artificial Sequence: Synthetic coding sequence
atggagcggcgggcccggagcagcagccgggagagccggggccggggcgggagaactccccataaggagaataaaagagctaaggctgaacggtcggggggtggccgagggcggcaagaagcaggacccgagcctagcgggagcgggcgggcaggtaccccgggggaaccgcgcgctccggcggctacagtcgttgatgtggatgaagtcagaggatctggcgaggagggcactgaagtcgttgccctactggagtcggaacggcctgaggagggaactaagtccagcggcctgggtgcctgcgaatggcttctggtgctgattagcttactgtttattattatgacatttcccttctccatctggttctgtgtaaaagtggtgcaagaatacgagcgggtgattattttcagacttggtcacctcctgcccggacgagccaagggacctggactcttcttcttcctcccctgtctggatacgtatcacaaagtagatctcagattgcaaaccctggaaatccccttccacgagattgtcaccaaggacatgtttatcatggagatagatgccatctgttactaccggatggaaaacgcctcgctgctgctgtcgtctctggctcacgtatcaaaagctgtccagtttttggtccagaccaccatgaaacgacttcttgcccaccggtcattaactgagattttactcgaacggaagtctattgcacaggacgccaaagtagctctcgattcagttacttgcatctggggaatcaaagtagagaggatcgagattaaagacgtgcgactgccagccggtctgcaacattcactggcagtggaagccgaagcccaacgacaagctaaagttaggatgatagctgcggaggcagagaaggcagcctcagagtccctgcgcatggccgctgagattttatcaggaacgcccgccgccgtgcagctcaggtatctgcacaccctccagagtctctccactgagaaacccagtactgtggtgctgccactgcccttcgacctgctgaattgcctttcctccccgagtaatcgcacacaggggtctttgcctttcccgtccccttctaagcccgtcgagccactgaatccaaagaaaaaggacagcccgatgctctag

SEQ ID NO: 196791 - DNA, 948 bp, Artificial Sequence
  Description of Artificial Sequence: Synthetic coding sequence
atggagcggcgggcccggagcagcagccgggagagccggggccggggcgggagaactcctcacaaggagaataaacgagcaaaggcagaaaggtctggagggggacgcggccggcaggaggccggacccgagccttctggatctggcagagcagggactcccggtgaacctcgtgcgccagccgcaaccgttgtggacgtggatgaggtgcgcggatccggcgaggagggtaccgaggttgtcgcactcctggagagcgaacgccccgaggaaggaaccaaaagcagtgggttgggagcttgcgagtggcttctcgtgctgatcagcctgctcttcattatcatgacttttcctttttcaatctggttttgcgtgaaagtagtccaagagtatgaacgcgtcatcatcttccgcctgggacacctgttgcctggaagagccaagggccctgggttgttcttttttctcccctgtctcgacacgtaccataaagtggacctacggctccagacattagagattccatttcacgaggtagcacttgactccgtgacctgcatttgggggatcaaagttgagaggatcgaaatcaaggacgtgagactgcctgccggcttgcagcattcactcgccgtggaggcggaggcccagcggcaggctaaagtgcgcatgattgcagccgaggccgagaaggctgcaagtgagtccctgcgcatggccgccgaaatcctctcgggaacgcccgcagcagtccagctgcgctacctacataccctgcagtctctcagtaccgaaaagccaagcaccgtcgtactgcctctgccattcgacctcttgaactgcctgagctcaccatccaaccgtacacagggcagtctgcctttcccaagccctagtaaaccagtagagccattgaaccccaagaaaaaggatagtcctatgttgtag

SEQ ID NO: 196792 - DNA, 1284 bp, Artificial Sequence
  Description of Artificial Sequence: Synthetic coding sequence
atgggcgccggcgccaccggccgggccatggacggcccccggctgcttctgctgctcctcctaggagtctcactgggaggcgcaaaagaagcatgccccaccgggctttatacccacagtggggagtgttgcaaagcgtgcaaccttggagagggcgttgcccagccatgcggcgccaaccagacagtctgcgagccatgtctagattctgttacattctccgatgtggtaagtgcaactgagccctgtaagccttgcacggaatgcgtaggccttcagagcatgtcagcgccctgtgtggaggccgacgatgcggtgtgcagatgcgcctacgggtattaccaggacgagactaccggcaggtgtgaagcttgccgcgtctgcgaagctggttctggcttggtattttcatgccaggataagcaaaatacggtttgcgaggagtgcccagacgggacctacagtgacgaagctaatcacgtggatccatgcctgccttgcactgtatgtgaggatacagaaagacagctgcgtgaatgtacacgatgggcggacgcagagtgcgaagaaattcctgggcgttggattacgaggtctacccctcctgagggcagcgacagcacggcaccaagtacccaggaaccagaggcccctcccgagcaagacctaatagcatccacagtagctggcgtcgtgacaaccgtgatgggctcatcacagcccgtggttacacgtggaactactgacaacttaatccccgtgtactgtagcattctggctgctgtggtggttgggctggttgcctacatagcatttaagcgctggaatagttgcaagcagaacaagcagggcgcaaattctcgtcctgtgaaccagaccccgcccccagagggcgaaaaacttcacagcgatagtggcatcagtgttgacagccagagccttcatgatcaacagcctcacactcaaaccgccagtgggcaggctctcaaaggggacggcgggctgtattcgtcactccctcccgccaagcgcgaggaagtcgaaaagctgctgaacggtagtgccggagatacgtggcgccacctggcgggcgagctcgggtatcagcccgagcacatcgactccttcacccacgaggcatgccccgtccgcgccctcttagccagttgggcgactcaggatagtgccactctagatgctctgctggcagccctgcgccgtatacagagggctgatttggtggagagcctgtgttcagagagcacagctacatcaccagtgtag

SEQ ID NO: 196793 - DNA, 1002 bp, Artificial Sequence
  Description of Artificial Sequence: Synthetic coding sequence
atgagcgccccctgcgtggaggccgacgacgccgtgtgccggtgcgcctacgggtattaccaggacgagacgacaggaaggtgcgaagcctgtcgggtatgcgaagctggctccgggctggtatttagttgccaggacaaacaaaatacagtatgcgaggaatgtcccgatggtacatatagcgatgaggcaaatcacgtagatccgtgcctcccctgtacagtgtgcgaggataccgaacgccagttaagagaatgtacccgctgggcagacgcggagtgcgaagagattccagggcgctggatcactcgctctaccccccccgaagggtccgactcgaccgcacccagcacccaggaacctgaggcacctccggaacaggacttgatcgcgagtaccgtggccggcgtggttactaccgtaatggggtcctcacaaccagtggtaacccgtggcaccacagataatctaatcccagtgtactgttcgatcctggcggccgtagtggttgggctcgtcgcatacatcgctttcaaacggtggaattcttgtaaacaaaacaagcaaggagccaattcacgtcccgtcaatcagaccccccctccagagggagaaaaactgcactctgacagcggaattagcgtggattcccagagtttgcacgatcaacagcctcacacacagaccgcctctggccaggccctgaagggggatggcggattatattcatcccttcccccagctaaaagggaggaggtcgaaaaactgctgaatggtagcgcgggagatacctggagacacttggccggggaactcggataccagcccgagcacatcgattcattcactcacgaggcatgtcctgtccgggcccttctggcatcctgggccactcaagacagcgcgacactcgatgcactcctcgctgcactgcggaggatccagagagcagatctggttgaatctctttgctctgagagcactgcgactagcccagtgtag

SEQ ID NO: 196794 - DNA, 336 bp, Artificial Sequence
  Description of Artificial Sequence: Synthetic coding sequence
atggccaacatccaccaggagaacgaggagatggagcagcccatgcagaacggagaggaggacaggccactgggtgggggggaaggtcatcagcctgccgggaacagaagggggcaggccaggcgcctggcccccaatttccgttgggcaatccccaaccgtcagattaacgatgggatgggcggcgacggcgacgatatggaaatcttcatggaagaaatgagagagataaggcgtaaactccgggagctccagttaagaaactgcctccgcatcctaatgggcgaactttcgaatcatcatgatcaccacgatgaattttgcctgatgccctag

SEQ ID NO: 196795 - DNA, 306 bp, Artificial Sequence
  Description of Artificial Sequence: Synthetic coding sequence
atggagcagcccatgcagaacggcgaggaggaccggcccctgggcggcggtgaaggtcaccagccggcggggaatcggcgagggcaagcgagacgactcgcacctaacttccggtgggctatcccaaatcgccagatcaacgatggcatgggtggagacggtgatgatatggaaatctttatggaggagatgcgagaaattagacgtaagctgagggaactgcagctgcgaaactgcctgaggatcttgatgggtgagttatccaatcatcatgatcatcacgacgaattttgcctaatgccctag

SEQ ID NO: 196796 - DNA, 306 bp, Artificial Sequence
  Description of Artificial Sequence: Synthetic coding sequence
atggagcagcccatgcagaacggcgaggaggaccggcccctgggcggaggcgagggacaccagcccgccgggaatcggaggggccaggcacgacggctagcccccaatttccgatgggctatccctaaccggcagatcaatgacggtatgggcggagatggggacgatatggagatctttatggaggaaatgcgagaaattagaagaaaactgcgggagctccaattaaggaactgtttgcgcatcctgatgggcgagctctccaatcaccacgaccaccatgatgaattctgtttaatgccttag

SEQ ID NO: 196797 - DNA, 336 bp, Artificial Sequence
  Description of Artificial Sequence: Synthetic coding sequence
atggccaacatccaccaggagaacgaggagatggagcagcccatgcagaacggcgaggaagatagacccctgggtgggggcgagggacaccagcccgccggcaacaggaggggccaagcccggaggttagcccctaacttcaggtgggctatcccaaatcgccaaattaatgacggaatgggcggcgatggagatgatatggaaatattcatggaagagatgagagagattaggcgcaagttacgcgagcttcagcttcgcaactgccttaggatcttaatgggtgagctcagcaaccaccacgatcatcacgatgaattctgcctgatgccctag

SEQ ID NO: 196798 - DNA, 336 bp, Artificial Sequence
  Description of Artificial Sequence: Synthetic coding sequence
atggccaacatccaccaggagaacgaggagatggagcagcccatgcaaaacggtgaggaagataggcccctgggagggggggaaggccaccagccggccggcaaccggagggggcaggcccggcggcttgcaccgaactttaggtgggcaatccccaaccggcagatcaacgatggaatgggcggagacggggacgatatggaaatttttatggaagagatgcgggagattagaagaaaactgagagaattgcagctgcgcaactgtttgaggatcctcatgggtgagctttctaaccaccacgaccaccatgacgagttctgcctcatgccatag

SEQ ID NO: 196799 - DNA, 402 bp, Artificial Sequence
  Description of Artificial Sequence: Synthetic coding sequence
atgatgctgaacagcgacaccatggagctggacctgccccccacccacagcgagaccgaatcaggcttctctgattgcggagggggcgctggcccagatggcgccggccccggcgggcctggcgggggccaggcacgagggccggagcccggagagccaggacggaaggatctgcagcatctgtcccgggaagagcgaaggagacgacggagggctaccgcaaaatatcggacagcgcatgcaactcgcgaacggatccgagttgaggcattcaacctcgcatttgccgagttgagaaaactgctgccaacgttgcctccagataagaagctctctaagatagagattctcaggctggctatttgctacatttcataccttaatcacgttctggacgtatag

SEQ ID NO: 196800 - DNA, 408 bp, Artificial Sequence
  Description of Artificial Sequence: Synthetic coding sequence
atgatgctgagccccgaccaggccgccgacagcgaccaccccagctctgctcactccgatcctgaatccttaggcggtaccgatacgaaagtgctgggctccgtgtcagacctggaaccagttgaagaggccgagggcgacggaaagggcgggtcccgcgctgctctatacccccaccctcagcagttgagtcgggaagaaaaaaggcgtcggcggagagctacagcaaaatatagaagcgcacacgctacacgggaacgcatccgtgtagaagcattcaatctcgcatttgctgaactgcggaagctgcttccgactttgccgcccgataaaaaactgtcaaaaatcgagattttgagacttgctatatgttatataagctacttaaatcatgtgctcgatgtctag

SEQ ID NO: 196801 - DNA, 408 bp, Artificial Sequence
  Description of Artificial Sequence: Synthetic coding sequence
atgatgctgagccccgaccaggccgccgacagcgaccaccccagctctgcacattcggaccctgagtctctcgggggaaccgatactaaggtgctgggttcagtgtctgaccttgaaccggtagaggaggccgagggcgatgggaaaggtggctctcgggccgccctgtacccacacccacaacagctctccagggaggagaagaggcgccggcgtcgtgcgacagccaaatatcgttcggctcacgcaacacgggagcggataagggtcgaggcctttaatctggccttcgcagagctgagaaagctgctacccacattaccaccagataagaagctgagtaagatcgaaattctcaggttagcgatatgctatatatcctatctgaaccatgtcctcgatgtgtag

SEQ ID NO: 196802 - DNA, 324 bp, Artificial Sequence
  Description of Artificial Sequence: Synthetic coding sequence
atgatgctgagccccgaccaggccgccgacagcgaccaccccagctccgcacacagcgatcctgagagtttaggggggacagacaccaaggtgcttggcagcgtgtctgacctagaaccagtagaggaggccgaaggagacggtaaggggggctccagggcagcgctctatcctcatccacaacagctgtctagagaggaaaagcgacggcggcggagagctaccgcaaagtacagatccgcccatgccacccgtgaacgcataagggtcgaagcttttaacctcgcattcgctgagcttcgaaagctcctgcccactctctag

SEQ ID NO: 196803 - DNA, 1125 bp, Artificial Sequence
  Description of Artificial Sequence: Synthetic coding sequence
atgggcctgccccggggcagcttcttctggctgctgctgctgctgactgccgcatgtagtggcttgctcttcgccttgtatttctccgccgtgcaacgttatcccgggcccgccgcaggagcccgggataccacatctttcgaggcgttcttccaaagtaaagcaagtaactcgtggactggaaaaggtcaggcctgtagacacctactccatctggctatccagcgccacccccactttagggggctcttcaatttgagcatccccgtgttgttatggggtgacctatttactccagcgctctgggacagactctctcagcacaaagcaccatatggctggcgtggcctcagccatcaggtcatcgcttctaccttgagcttgcttaatggctctgagtctgccaagctttttgcccccccaagagatacacctccaaaatgcattcgatgcgctgtggtggggaacggcggtatactgaacggctcacgccagggtcctaatatcgatgctcatgactacgtcttcagacttaatggtgccgtcatcaaaggcttcgaacgcgatgtcgggacaaagacaagcttctacggcttcactgtcaacacaatgaagaattctctggtttcctactggaatttggggtttacctctgtgccacaggggcaagacttacagtatattttcataccctctgacatacgagactacgtcatgctcagatccgccatactgggtgttcccgtgcctgagggcctagacaaaggcgataggcctcacgcatacttcgggccggaggccagcgctagcaagttcaaacttctgcatcccgactttatttcttacttgactgaacggttcctcaagagcaaactgatcaatacacattttggcgatttgtacatgccatctacaggggctttgatgctgttgacagccctgcacacctgcgaccaagtctcagcctatggtttcatcacctctaattactggaagttctcggaccattactttgagaggaaaatgaaaccattgatcttctacgccaatcacgatctgtccctcgaggccgctttatggagggatctccataaggccgggatacttcagctttatcaacgctag

SEQ ID NO: 196804 - DNA, 2235 bp, Artificial Sequence
  Description of Artificial Sequence: Synthetic coding sequence
atggccggccggagcatgcaggccgcccggtgccccaccgacgagctttctctgacaaattgcgcagtggtgaacgagaaggactttcagtcaggccagcacgtcatagtgagaacctccccaaatcatcgctacacctttacacttaaaacccacccatccgtggtgccaggtagcatagcattctctctgcctcagcggaaatgggccggactgtccattggccaagaaatcgaggtaagcctttacacgttcgataaagccaaacagtgtatagggaccatgacaattgagatcgatttcctgcagaagaagtcaatcgactctaacccatacgatacagacaagatggccgctgaattcattcagcagttcaacaaccaggccttctcggtgggccagcagctcgtcttcagctttaacgaaaagctctttgggttactagttaaggacatagaggccatggatcccagcatccttaagggggaacccgctacgggtaaacggcagaaaattgaagtcggactggtggtgggaaacagccaggtagcctttgaaaaggcagagaattcaagcttaaatctgatagggaaggctaagaccaaagaaaatcgacagtccatcataaacccggattggaacttcgaaaaaatgggtattggcggactggataaggagttcagcgacatttttcgcagagcgttcgcgagcagagtattccccccggaaatcgtggagcagatgggctgcaagcacgtgaaggggattctgctgtacggtcctccgggatgcggcaaaaccttactcgctcggcagatcggaaagatgttgaatgcgagggaacctaaagtcgtaaacggtccggaaatcctgaacaaatacgtgggggaaagcgaggccaatatcaggaagttattcgcggatgcggaggaggagcagagaaggttaggggccaactcaggtttacatattatcattttcgatgaaattgatgcgatttgcaaacagagagggtccatggcgggcagcaccggcgtgcatgatacagttgtgaatcagctgctgagcaaaatcgatggcgtggaacagttgaacaatattctcgtgatcggcatgactaatcgccccgaccttatcgacgaggccctcttaaggcctggacggctggaagttaagatggagatcggactgcccgatgaaaagggaaggctacagattctccacattcatacggccaggatgaggggccatcagctgctgtcggctgacgtggacatcaaggaactagcagtggaaactaagaatttttctggagctgagttggagggattggttagagcagcacagagcaccgctatgaatcggcatatcaaagcatctacaaaagttgaggtggacatggaaaaagctgagtctctccaggtaacacgaggagatttccttgcctcgctggagaatgacatcaaacctgcattcggcaccaatcaggaagactacgcgtcctacattatgaatggaatcattaagtggggcgaccccgtcactagggtcttggacgatggggaacttctagttcagcagaccaagaactctgaccgtacccctctcgtgagcgtgttactcgaggggccccctcattctggcaagacagctctggccgctaagatcgccgaagagtctaacttcccttttatcaaaatttgctctcccgataagatgatcggtttctccgaaactgctaaatgccaggccatgaaaaagatctttgatgacgcctacaagtcacaattatcatgcgtggtggtggacgacattgagcgcctgctggattatgtgccaataggacctcggttcagcaatctggtactgcaggccctccttgtgctactgaagaaggccccgccacaggggcgaaagctgctgattattggaacaacgagcagaaaggatgtgctgcaagaaatggaaatgcttaatgccttctcaacgaccatccatgtccctaacatcgccactggcgaacagttgttggaagcactggaactgctgggcaacttcaaagataaggaaagaactacgatagcacaacaggtcaaggggaaaaaagtgtggattgggattaagaaactgttgatgctcattgaaatgtcgctgcaaatggaccctgagtacagggtaaggaaattccttgcgttactgcgggaggaaggagcgtccccactagacttcgattag

SEQ ID NO: 196805 - DNA, 888 bp, Artificial Sequence
  Description of Artificial Sequence: Synthetic coding sequence
atggacaacagcggcaaggaggccgaggccatggccctgctggccgaagccgagcgtaaagttaagaacagtcagtcattctttagcggtctgttcggcggttcaagtaagatagaagaggcctgtgagatctacgccagggctgcgaacatgttcaagatggccaaaaactggtcagctgctggtaacgcattctgtcaagccgcccagctgcacttacaacttcagtccaagcatgatgctgccacttgcttcgttgacgctggtaacgctttcaagaaagccgacccccaagaagcaattaactgcttgatgagagctatcgaaatctacactgacatgggccggtttaccatcgctgctaaacaccacattagcatcgctgaaatctacgaaacagaactcgtcgatatcgagaaagctattgcccattatgaacagtctgctgattactacaagggagaggagtctaattcgtctgccaacaaatgcctccttaaggtcgccgggtacgccgcattgttggagcagtaccagaaagcaatcgatatctacgagcaagttggcaccaatgcgatggactcaccccttttgaaatactctgccaaggactacttctttaaggctgctttgtgccatttttgcatcgacatgctgaatgctaaattagctgtgcagaagtacgaagaattatttccagccttctcagactcccgcgaatgcaaattgatgaagaagcttctggaggcacatgaggagcagaatgttgatagttacaccgaatctgtcaaggaatatgacagtatcagccggctggaccagtggctgacgaccatgctgttgagaattaaaaaaaccatacagggagacgaggaagatctgcgctag

SEQ ID NO: 196806 - DNA, 897 bp, Artificial Sequence
  Description of Artificial Sequence: Synthetic coding sequence
atggacaacgccggcaaggagcgggaggccgtgcagctgatggccgaagctgagaagagagtcaaggctagccattccttcctccgtggtctcttcggcggaaatacacggattgaggaggcgtgcgagatgtatacacgggctgctaacatgtttaaaatggcgaaaaattggagcgccgccggaaacgccttctgccaagccgcgaagctccatatgcaactgcagagtaagcacgattccgccacaagttttgtcgatgcaggaaacgcatataagaaagccgacccacaggaggctattaactgcctaaacgcagccatcgatatatacaccgacatgggcaggttcaccatcgccgcgaagcatcatataaccattgccgagatctacgagacagaacttgtggatatcgaaaaggcgatcgctcactacgagcagtcagccgactactataagggagaggaaagtaactccagcgctaataaatgtctgttaaaggtcgccgcctacgctgcacagctcgagcaataccagaaagccatcgagatttacgaacaagtgggggccaacaccatggacaatccgctgctcaagtactccgccaaagattacttctttaaggccgcattatgccattttatagtggacgaattaaacgctaaattggccctcgaaaaatacgaagaaatgtttccagccttcacggacagcagggaatgtaagcttttgaaaaagctcttggaggctcatgaagaacaaaactctgaggcgtatacggaggcagtgaaggagttcgactctatttccagactggatcaatggctcaccaccatgctcctccgcattaagaagtccatccaaggtgacggagaaggagatggggacttaaagtag

SEQ ID NO: 196807 - DNA, 615 bp, Artificial Sequence
  Description of Artificial Sequence: Synthetic coding sequence
atgaccctgctgcccgccctgtggatgctggagatgctgaccaagaggcagatccccaaaggtcggttcacaatcgctgcaaagcaccatatcaccatagctgagatctatgagacggagttggtggatatcgaaaaagctatcgctcactatgagcagagcgccgactattacaaaggcgaagaatccaacagtagcgcaaataaatgtctgctaaaagtcgcggcttacgccgcgcagttggagcagtaccagaaagctatagaaatctacgagcaggtgggcgctaatactatggacaatccccttctgaagtattcagctaaggactatttctttaaggctgccctgtgccacttcatcgtagacgaacttaacgcaaaattggcgcttgaaaagtacgaggaaatgtttcctgctttcaccgattctcgcgagtgcaaacttctcaaaaagctgcttgaggcccatgaggaacagaatagcgaagcctatacagaagccgtgaaagaattcgactccatctccaggctggatcaatggctcacaaccatgttgctgcgtatcaagaagtcgatacaaggggacggtgaaggggacggtgacttgaagtag

SEQ ID NO: 196808 - DNA, 768 bp, Artificial Sequence
  Description of Artificial Sequence: Synthetic coding sequence
atgtacacccgggccgccaacatgttcaagatggccaagaactggtcagcggctggaaatgccttctgtcaggcagcgaagcttcacatgcagctccagtccaaacatgatagcgccacaagctttgtcgatgccggaaatgcttacaaaaaagcggacccacaagaagctattaactgcctgaacgcagctatcgatatctataccgatatggggcggtttacaatcgctgccaagcaccacataacaattgccgaaatatacgaaacagagcttgtagacattgaaaaagcaatagcccactatgaacaaagcgcggattactacaaaggggaagagagcaacagttcagcaaataaatgtttgctgaaggtagccgcctatgcagcacagctggagcagtatcagaaggccattgagatttacgaacaggttggtgctaatactatggacaaccccttattgaaatattctgccaaagattattttttcaaggctgcgctgtgccactttatcgtggacgagctcaatgcaaagctcgcactagaaaagtacgaagaaatgtttcctgcgtttaccgatagtcgggaatgcaaattgttgaaaaaacttctggaggcccatgaggaacagaattcagaggcatacacagaggctgtgaaagaatttgactctattagtcgcttggaccagtggctgacgacgatgctgctgaggattaagaaatccatccagggagatggggaaggagacggcgacctgaagtag

SEQ ID NO: 196809 - DNA, 780 bp, Artificial Sequence
  Description of Artificial Sequence: Synthetic coding sequence
atggacaacgccggcaaggagcgggaggccgtgcagctgatggccgaggccgagaaaagggtgaaggcatcccattctttcctcaggggactcttcggtggtaacacccgcatcgaggaagcttgtgagatgtatacacgtgcggctaatatgttcaagatggctaagaattggtcagaggccattaactgcctgaacgcggctatcgacatctacacggacatggggcgcttcaccattgctgccaagcaccacatcaccattgccgagatttacgagacagaactggtggatatcgaaaaagctatcgcccactatgaacagagcgcagattactataaaggcgaggagtccaactccagcgcaaacaagtgtctcctgaaagttgccgcttatgcagcccaactggagcagtatcaaaaggctatcgagatatacgagcaagtcggcgctaatacgatggataatccgctgctcaagtactcggccaaagattacttttttaaggccgcattatgccacttcatagtggacgagctaaatgccaaactggctctcgagaagtacgaagaaatgtttcctgcctttactgattccagagagtgtaagcttttgaaaaagctccttgaagctcatgaggagcagaattctgaagcgtacacggaggcagtcaaggagtttgatagcatatcacgcctggaccagtggctgacgacgatgctgctccggattaagaagtctatacaaggtgatggagagggagacggcgacttgaagtag

SEQ ID NO: 196810 - DNA, 1887 bp, Artificial Sequence
  Description of Artificial Sequence: Synthetic coding sequence
atgggcagctgcgcccggctgctgctgctgtggggctgcaccgtggttgctgcaggactcagcggagtggcaggcgttagttctaggtgtgaaaaagcttgtaacccgcgcatggggaaccttgcccttggaaggaaactatgggccgataccacttgcggccagaatgccaccgaactgtactgcttttattctgaaaacactgatctgacgtgccgtcagccaaagtgtgataaatgcaatgcagcctacccccacctggcccatctgcctagcgctatggctgatagctctttccgcttcccaagaacatggtggcagagtgccgaggacgtgcaccgggagaaaattcaactcgacctagaggccgaattctacttcacacacttgattgttatgttcaagagcccgcggcccgccgcgatggtcctggataggagccaggattttggtaagacatggaaaccttataagtacttcgccaccaattgcagcgccacctttggcttagaggatgatgtggtcaaaaagggcgctatctgcaccagtaagtacagctctccattcccatgcaccggcggggaagtgatctttaaggcgctcagccctccatatgatacggaaaatccctattccgcgaaggtgcaagagcagttgaaaataacaaatctccgagttcagctgctcaagaggcaatcgtgtccatgtcaacgcaacgatttaaatgaagaacctcagcattttacccattacgccatctacgacttcatcgtgaaaggatcttgcttctgcaatggccacgccgaccagtgcattcccgtccatgggtttcgcccagtgaaagccccaggcacttttcacatggtccacgggaagtgtatgtgcaagcataataccgcaggctcccactgtcagcactgtgctcctctgtacaacgatagaccatgggaagccgccgatggcaagactggcgcgccaaacgagtgtcggacctgcaaatgcaatggccacgcagatacatgtcactttgatgttaatgtctgggaggcttctggaaatcgatcgggaggggtctgcgatgactgccagcataatactgaagggcaatattgccagaggtgcaagccggggttttatcgggatctgcgcaggcccttttctgccccggatgcttgtaaaccctgttcatgtcaccctgtgggttcagcagtccttcctgctaattccgtaacattttgtgaccccagcaacggcgattgcccttgcaaacccggagtggcgggaaggcggtgtgaccgctgtatggtcgggtattgggggttcggtgattacgggtgcagaccctgcgattgtgccgggtcttgcgacccgattaccggggactgtattagtagtcatacagatatcgactggtatcacgaggtgcctgactttcgcccggtccacaacaaatccgaacccgcttgggagtgggaagacgctcagggtttcagcgcccttctccacagtggtaaatgcgagtgtaaggagcagaccctgggaaatgcaaaggccttttgcgggatgaagtactcttacgttcttaaaattaagatcctgtccgcacacgacaaagggacgcacgtcgaagttaacgtgaaaataaagaaggtgttgaagagtactaaacttaaaattttccgtggcaaacgcacactctatccggagtcctggaccgatcggggctgcacatgccccattttgaatcccggattggaatatctcgtggccgggcatgaggacatccgaaccggaaaactaattgtaaacatgaaaagctttgtacagcactggaagccctccctgggaaggaaggtcatggacattctgaaaagggagtgcaaatag

SEQ ID NO: 196811 - DNA, 1776 bp, Artificial Sequence
  Description of Artificial Sequence: Synthetic coding sequence
atgggcaacctggccctgggccggaagctgtgggccgacaccacctgcggccagaacgcaaccgaactgtattgtttttactctgagaataccgacttgacctgtcgacagccgaaatgcgacaaatgcaatgctgcctatccccatctggctcatctgccatctgctatggccgatagctctttccggtttcctcggacctggtggcagtctgccgaggatgttcatagggagaagattcagctggatctcgaagctgagttttatttcacccatttaattgttatgttcaaatccccacgcccagcagctatggtgctggataggtcccaggacttcggcaagacctggaagccctacaagtacttcgcaactaactgttccgccacattcggcctcgaggatgacgtggttaaaaagggcgctatttgtacaagcaagtattctagtccattcccttgcaccggcggagaggtgatcttcaaggcgctgtcccctccatatgatactgaaaacccctattcagcaaaggtacaagaacagctcaagataaccaacttaagggttcagttgctgaagagacaatcatgtccttgtcagagaaacgacctgaatgaggagccccagcattttacgcattacgcgatttatgactttattgttaaagggagctgtttctgtaatggccacgccgaccagtgcattccagtgcatggctttcgtcccgtgaaagcacctggtactttccacatggtgcacggcaagtgcatgtgcaaacataacactgcaggctctcattgccagcactgcgctcccctctacaatgaccggccgtgggaagccgctgacggcaagacaggcgcccccaacgagtgccgaacatgtaagtgtaacggtcatgctgatacctgccatttcgacgttaacgtctgggaagcttccgggaaccgcagcggcggcgtatgcgacgactgtcagcacaacaccgaggggcagtattgccagaggtgtaagcctggcttttatagggacttgcgtagacctttcagcgcgcccgatgcatgtaaaccttgctcatgccacccagtgggctccgccgtgttgccagcaaattcagtcacattctgcgacccctccaacggtgattgcccctgtaagcctggggtggccggacggcgctgcgacagatgcatggtgggatactggggtttcggggattacggttgcagaccttgcgactgcgctggaagttgcgacccaatcaccggtgactgtatatcatcccacacagacatcgattggtatcacgaggttcctgattttcggcccgtgcacaataaatcagaacccgcatgggagtgggaagatgcacagggattttcagcactcctccactcagggaaatgcgagtgtaaggagcagacgttagggaacgctaaagctttttgcggtatgaaatattcttatgtccttaagatcaaaattctttctgcacacgacaagggcacccacgttgaggttaacgtgaaaataaagaaggtgttgaagagcacgaagcttaagatttttagaggaaaaagaacactgtacccagagtcttggacagatcgtggctgcacatgcccgatactgaatcccggcttggagtatctggtcgcagggcatgaagatatccggaccggcaaacttatcgtaaatatgaaatcgttcgtacagcattggaagcctagcctggggcggaaggtcatggatatactgaaacgagaatgcaaatag

SEQ ID NO: 196812 - DNA, 1818 bp, Artificial Sequence
  Description of Artificial Sequence: Synthetic coding sequence
atgggcagctgcgcccggctgctgctgctgtggggctgcaccgtggtcgccgctggtctatcaggcgttgccggggttagttcacggtgcgaaaaagcctgcaaccctaggatggggaaccttgcactcggccggaagctatgggccgatacgacatgcggtcagaacgctacagaactgtattgcttttattctgagaacacagacctaacctgcagacagcctaagtgcgacaaatgcaatgccgcgtatccccacctggcccatttgccatcggctatggccgactcatccttccgcttcccccgcacctggtggcagagtgcggaagacgttcatagggaaaagatccaattagatctagaagctgaattctactttactcacttgattgtgatgtttaagagtcccagacctgccgccatggtgctagaccggtcacaggactttggcaagacgtggaagccatacaagtatttcgcgacaaactgcagtgccaccttcggcctcgaagacgacgtcgtcaaaaaaggagcaatctgtacctctaaatatagctctcccttcccgtgtaccggcggcgaggtcatctttaaggccctgagtccaccctacgatacagaaaatccctattccgcaaaagttcaggagcagctaaaaatcacaaacctccgcgtgcagctcctgaagcggcaatcttgcccctgtcagcgaaatgacctgaatgaggaaccgcaacatttcactcactacgctatttatgatttcatcgttaaaggatcctgcttctgtaatggccacgcagatcaatgcatccctgtacatggctttcgacctgtaaaagccccaggtacctttcacatggtgcatggtaaatgcatgtgtaagcataacacggctggttctcattgtcagcattgtgctcccctttacaatgataggccctgggaagctgctgacgggaagactggggcgcccaatgaatgcagaacttgcaaatgtaatggtcatgcggacacctgtcacttcgacgtcaatgtgtgggaagctagtggtaaccggtctggtggtgtgtgtgacgactgccaacacaacacagaggggcaatactgtcagcgttgtaaacctggattttaccgagaccttcggcgacctttctccgcccccgacgcttgcaaaccctgttcctgtcacccagttgggagtgctgtgttgcccgccaactccgtcactttctgcgacccctcaaacggtgattgcccttgcaaaccgggggtcgccggacgacggtgtgacaggtgcatggtcgggtattgggggttcggtgattatggatgccggccctgcgactgcgctggatcttgtgaccccattactggcgattgcattagctcccatactgacattgactggtaccacgaagttccagattttcggccggtgcacaataaatctgagcccgcctgggagtgggaagacgcgcaaggattctctgcactgctacactctgtccttaaaatcaagattctgagtgcgcacgacaagggaacgcacgttgaagtcaatgtgaaaatcaaaaaggtgctgaagtcaaccaaattgaagatcttccggggcaaaaggaccctttacccagagtcttggacagataggggctgtacatgcccaattctgaatccaggattagagtatttggttgctggccatgaagatatcagaactggcaaactgattgtcaacatgaaatccttcgtacaacattggaagccctcactcggccgtaaggtgatggatattttgaaacgagaatgcaagtag

SEQ ID NO: 196813 - DNA, 1095 bp, Artificial Sequence
  Description of Artificial Sequence: Synthetic coding sequence
atgtacctgagccggttcctgagcatccacgccctgtgggtgaccgtctcaagtgtgatgcagccttatccccttgtttggggccactacgatctgtgcaaaacacagatatatactgaagagggcaaagtgtgggattacatggcttgtcaacccgaaagcacagacatgacgaaatatcttaaagtaaagctggatcctcccgacattacatgtggcgaccccccagaaacattctgcgctatgggaaatccctatatgtgcaataacgaatgcgatgcgtccacccctgagcttgctcaccctccagaactgatgttcgactttgagggaaggcatcccagtaccttctggcagagtgccacgtggaaggagtaccctaagcctctgcaggtaaacattacattgtcatggagcaaaaccattgaactcacagataacatagttatcacctttgaaagcgggcgaccagatcagatgatcttggagaagagcctcgattatggccgcacttggcagccataccagtactatgccaccgattgcctggacgcgtttcatatggaccccaaaagtgttaaggacctgtctcagcacactgttctggagatcatttgcaccgaggaatattctacagggtacaccacaaactccaaaattatacatttcgagataaaggatcggtttgcattcttcgcaggacccaggctgcgcaacatggcaagcctgtatggacagctcgatacaactaaaaaactcagagattttttcaccgtcactgatttgagaatcagattgctcaggcctgcagtcggcgagatatttgtggatgaactccatctcgcccgttatttctacgccatctccgatatcaaggtgcgaggaagatgcaaatgcaatcttcacgccaccgtctgcgtgtacgataattctaaactcacatgtgaatgcgaacataatactacaggccccgattgtggcaagtgtaagaaaaattaccagggcagaccctggtcacccgggagctatctgcccatcccaaagggcacagctaacacctgtatcccgtccatcagctccattggctccaagtag

SEQ ID NO: 196814 - DNA, 1518 bp, Artificial Sequence
  Description of Artificial Sequence: Synthetic coding sequence
atgtacctgagccggttcctgagcatccacgccctgtgggtgaccgtctccagtgtaatgcagccctatcccctcgtttggggtcactatgatctctgcaagacacagatctacaccgaggagggtaaagtgtgggattatatggcttgtcagcctgaatcgaccgacatgactaaatacctaaaggttaaattggacccaccggatatcacctgcggggatccccccgaaaccttttgtgccatgggaaacccttacatgtgtaataatgagtgtgacgcttcaacccctgaactggctcatccgcctgaattaatgtttgactttgaaggcagacacccttctaccttctggcagtccgccacatggaaggagtatcccaagccactccaagtgaatataaccttaagctggtcaaagacaatcgaactaaccgataatatcgtaattactttcgagtctgggaggcccgatcagatgattctggaaaagagcttggactatggacgaacatggcaaccctaccaatactatgcaaccgactgtctggacgccttccacatggatccaaaaagcgtcaaagatctatctcagcatacagtcctggagataatctgtaccgaggagtactctactggatacaccactaattccaagatcattcatttcgagattaaggatcgtttcgctttttttgcaggcccgagactgcgaaacatggcgtccctgtatggtcaattagatacaacaaaaaagctgcgggattttttcacggtaacggatctcaggatcagacttctacgcccggctgtgggcgaaatttttgtggatgagctccaccttgcccgttacttctatgccataagcgacataaaggtgagagggaggtgcaaatgtaacctccatgccactgtgtgtgtttatgacaactcaaaactgacctgtgagtgcgaacacaatacaactggacctgactgtgggaaatgtaaaaaaaattaccaggggcgcccctggagccccggcagctatctgcctattcccaaaggaaccgccaatacctgcattccaagcatttcaagcatcggaaatcctccaaagttcaatagaatttggccaaacatctcctccttggaagtctcaaatcccaagcaggaatgctactgcaaccctctgggttctatacatgataggtgcaacggctccggcttttgcgagtgcaaaaccggaactacgggcccaaagtgtgatgagtgcttgcccggtaattcttggcattatggctgtcagcccaacgtttgcgacaacgaactcttacactgccagaacggggggacttgtcacaataatgtgaggtgtctgtgtccagcagcttatactgggatcctctgtgagaagctgaggtgtgaggaagccggcagctgtggctctgattctggtcagggagcccccccccatgggtccccagcccttctgcttctgacgaccctactcggcactgctagccctcttgttttctag

SEQ ID NO: 196815 - DNA, 861 bp, Artificial Sequence
  Description of Artificial Sequence: Synthetic coding sequence
atggccagcctgtacggccagctggacaccaccaagaagctgcgggattttttcacagtgactgacctccgaattcgcctgttaagacccgctgtgggagaaattttcgtggacgaactgcacctggcaaggtatttttacgccataagtgacatcaaagtgcgcggccggtgcaaatgtaatcttcatgccacggtctgtgtgtacgataattcgaagctcacctgcgaatgcgagcataataccaccggccctgattgcggcaagtgtaaaaagaactaccaggggagaccctggtctcccgggtcttatctgccaatccctaaaggaaccgccaatacttgtatcccatccatatccagcattggcaatccaccaaaattcaatcggatctggcctaatataagctccctggaggtcagcaatcctaaacaggttgcccccaaacttgcgctttcaaccgtctcatcagtgcaggtggccaatcacaagcgagagtgttattgcaatcctctcggttcgatacatgacaggtgtaatggctctggcttttgtgaatgcaaaacaggcactactggacccaagtgcgatgaatgtctgcctgggaattcttggcactacgggtgccagccaaacgtgtgcgacaacgagctattgcactgccagaatgggggcacctgtcataacaacgtgcggtgcttgtgccctgctgcttatacaggcattctctgcgaaaaactccgttgtgaggaagccggcagctgtgggtccgattccgggcagggagcccccccgcacggcagtcccgctcttctgcttctgaccaccctgcttggaaccgcctcccctttagtgttttag

SEQ ID NO: 196816 - DNA, 1029 bp, Artificial Sequence
  Description of Artificial Sequence: Synthetic coding sequence
atggccagcctgtacggccagctggacaccaccaagaagctgcgggacttctttactgtgactgatctccgcattcgcctactgcgcccagctgtaggagagatctttgttgatgagctgcacttggcccgttatttttacgccatctcagacatcaaggtgagaggcaggtgcaagtgcaaccttcatgcaacagtgtgcgtgtacgataacagtaaacttacatgtgagtgcgaacataacactaccggccccgattgcgggaaatgcaagaaaaactaccagggaaggccttggtcaccagggagttatctccccatacctaaaggaaccgctaatacatgcattccatccatctcctcgataggcaaccccccgaaatttaatagaatctggccaaatataagcagtctggaggtgtcaaaccctaaacaggtggccccaaagctggccctatctactgtttcatctgtacaggtcgcgaaccacaagcgcgattgtgaatgcttcggtcactctaatcgttgctcatatatcgacttactgaatacagtcatctgtgtgagctgtaaacataatacgcgtggccaacactgcgaactctgccggcttgggtactttcgcaacgcgtcagcacagcttgatgacgaaaatgtctgtattgagtgttactgtaaccccttagggtctatccacgacaggtgcaacggcagcggattctgtgaatgtaaaaccgggaccactggaccgaagtgcgacgagtgtttgccaggcaactcatggcactacggatgtcagcctaatgtatgcgacaatgagctcctgcattgccagaacgggggtacctgccataacaatgtacggtgcctttgtcccgctgcctacactgggattctgtgtgaaaaattaaggtgcgaagaggccgggagctgcgggagcgactctgggcagggggctccgcctcatgggagtccagccctcctcctccttactacactgctgggcacggccagtcccctcgtgttttag

SEQ ID NO: 196817 - DNA, 1485 bp, Artificial Sequence
  Description of Artificial Sequence: Synthetic coding sequence
atgtacctgagccggttcctgagcatccacgccctgtgggtgaccgtcagtagtgtgatgcagccttatccactggtctgggggcactacgatttgtgcaagacccagatttatactgaagagggaaaggtgtgggactatatggcttgccagcccgaatctactgacatgactaagtacttgaaggttaagctggaccctcctgacattacctgtggggatcctcctgagactttctgcgccatggggaacccgtatatgtgcaacaacgagtgtgatgcctctacccccgagttagcccacccaccagagctgatgtttgactttgagggaaggcacccgtccacattttggcagtctgctacgtggaaagaatacccaaagccactccaagtgaacattacactgagttggagcaagacgatcgaacttaccgacaacatcgtgatcacctttgaaagcggcaggcccgatcagatgattctggagaaatccctcgactacgggcgtacctggcagccataccagtattacgctacggactgtcttgacgccttccatatggaccccaaatcggtgaaagacttgagccagcacacagtgctcgagattatttgcaccgaagaatattcaaccggttacaccaccaattctaagattatccattttgagattaaggaccgtttcgcgttcttcgctggcccacgtttgagaaatatggctagtttatatggccaactggataccacgaaaaagcttcgggattttttcaccgttactgacctgcggatccggctgcttaggccggccgtcggggaaatttttgtggacgaactccaccttgctaggtatttttacgcgatctccgacatcaaggtcaggggcaggtgtaagtgcaatctacacgcaaccgtgtgtgtgtacgacaacagtaagttgacttgtgagtgcgagcataatactacaggcccggactgtgggaaatgtaaaaaaaattatcagggcaggccctggtcgcccggatcatacttacccatccctaagggcaccgcaaatacatgcatcccctctatctcttcaatcggaaattgcgaatgttttgggcattccaacagatgcagttacatcgacctgcttaacaccgtgatatgcgtgtcatgtaaacacaatacgcgcgggcagcactgcgaattatgcaggcttggatatttccgcaatgcttccgcccagctcgacgacgagaacgtctgtattgctaatgtgtgcgacaacgaactcttgcattgtcagaatggcggtacctgccataataatgtacggtgcctgtgtcctgctgcctacaccggcatcctgtgcgagaagttgcgatgcgaggaggcaggaagttgtggatccgattcaggccagggtgctcccccccatgggtcaccagcgcttctcctcttaaccaccctgctcgggactgccagtcccctggtgttctag

SEQ ID NO: 196818 - DNA, 1443 bp, Artificial Sequence
  Description of Artificial Sequence: Synthetic coding sequence
atgtacctgagccggttcctgagcatccacgccctgtgggtgaccgtgtcatctgtaatgcagccgtatcctctggtgtggggacattatgatctgtgcaagacccagatctacaccgaagaaggcaaagtctgggactatatggcctgccagcctgaatctaccgacatgacgaagtatctgaaggtcaaattggacccacctgacattacatgcggcgaccctcccgagacgttctgtgcgatggggaacccatatatgtgcaataacgagtgcgatgcctccacaccagaacttgcccaccctcccgagctgatgtttgactttgagggtagacatcccagtacattctggcagagcgccacatggaaggagtaccccaagcccttacaggttaacataactctctcctggagtaaaacgatcgagctcacggataatatagtcatcacttttgaatcagggcgccctgaccagatgatcctcgagaagtctctcgattacggaagaacttggcagccctaccagtactatgctaccgactgtctggacgccttccatatggaccccaaatccgtgaaggatctatcccagcataccgtcctcgaaattatttgcactgaggaatactcaaccggctacaccaccaacagcaaaatcattcatttcgagatcaaggataggtttgcgttctttgcaggtcctagactgaggaatatggcctccctttacggacaactagatactactaagaagcttagggatttttttacagtgacagacctgcggatcagactcctgcgccctgctgtgggagaaattttcgttgacgaacttcaccttgcaagatacttttatgcaataagtgacattaaggtgcgaggaagatgtaagtgcaatttgcacgcgaccgtatgtgtttacgataactctaagctcacttgtgaatgcgagcacaatactaccggccctgattgcggcaagtgtaagaaaaactaccaggggaggccgtggtcaccaggctcctatttaccgattcccaaagggacagcgaacacatgcataccatctatctcctcaattggaaacccaccaaagtttaaccgcatatggccaaacatctcatcactggaggtttctaatccaaagcaggttgccccaaaactcgccctgtcaacagtgagctccgttcaagtggccaatcacaagagggctaacgtttgtgataacgagcttctgcactgccagaacggcgggacttgtcacaacaacgtgcggtgcctatgtcctgctgcttacactggtatcctttgtgagaaactgaggtgcgaggaggcaggaagttgtgggtccgattctgggcagggagctccgccgcatgggtcccccgctttgctccttctgactaccctccttggaaccgcaagtcccctggtgttctag

SEQ ID NO: 196819 - DNA, 1383 bp, Artificial Sequence
  Description of Artificial Sequence: Synthetic coding sequence
atgtacctgagccggttcctgagcatccacgccctgtgggtgaccgtgagctctgtgatgcagccttatcccctggtctgggggcattacgatctctgtaaaactcagatctatacagaagaggggaaggtatgggattacatggcctgccaacccgaatccaccgatatgactaagtacctcaaagtgaaactcgacccccccgatataacatgtggtgaccctccagagacattctgtgctatggggaacccttacatgtgcaataatgagtgcgatgcatccacacccgagctggctcaccctcctgagctgatgttcgattttgagggccgtcatccctccaccttttggcagagcgccacctggaaagagtacccgaagcccctccaggttaacatcactctgtcctggtctaagaccattgaacttaccgacaatattgtgattactttcgagtctggcaggccggaccagatgatcctggaaaaatcattggactacggaaggacatggcagccctaccagtattacgccacagattgtctggatgcctttcatatggatcctaaatctgtaaaggacttatcccaacatacagttctcgagataatctgcactgaggagtactcaacaggctacacaacgaactcaaaaatcatccactttgagatcaaagatcgctttgccttcttcgccggcccccggttgcggaatatggcaagtctctacgggcagctggatacaactaagaagcttcgggatttctttactgtcacggatctccggatccggctgttgagaccagccgttggagagatttttgtagacgagctacacctggcccgctatttctatgccatctccgatattaaagtgcgcgggcggtgcaagtgcaatttgcatgccacagtatgtgtctacgacaacagtaagcttacctgcgaatgcgagcacaacacgactggcccggattgcggtaaatgcaaaaagaactatcaaggaaggccttggagtcctggttcatacttacccattcctaaaggcacagccaacacctgtatccctagtatctcatccatcggtaacccccccaaattcaatcgcatctggccaaacataagctcactggaggtgtccaatcctaaacaggcaaacgtatgcgacaacgagctgcttcactgccagaacggcggcacctgtcacaacaacgtgcgctgtctgtgcccagcggcttacacaggcatcctatgtgaaaagctgagatgcgaagaggcagggtcatgcggttctgatagcggccaaggcgcccccccgcatgggtccccggctctcttgctgctgactaccctgttggggactgcaagccctctggttttttag

SEQ ID NO: 196820 - DNA, 1620 bp, Artificial Sequence
  Description of Artificial Sequence: Synthetic coding sequence
atgtacctgagccggttcctgagcatccacgccctgtgggtgaccgtgtcttcggtcatgcagccctatcctttggtctggggccattatgatctgtgcaagacccagatctacaccgaggaggggaaggtttgggactacatggcatgtcagccagaaagcaccgacatgaccaagtatctcaaggtaaagctggacccgccagacattacctgtggcgatccgcccgagacattttgcgctatggggaacccgtatatgtgtaacaacgagtgtgatgcttccacacccgagcttgctcacccccctgaactcatgtttgacttcgagggacgacaccctagcaccttttggcaatccgccacttggaaggagtacccaaaacccttgcaagtaaatatcacactgagctggagcaagacaatcgagctgaccgataatatcgtgataacttttgaaagtggtcgccctgatcaaatgattctggagaaaagccttgactatggtaggacctggcagccctatcagtactatgccacagactgcctggatgcctttcacatggatccaaaaagtgttaaggacctgtcacagcacaccgtgctcgaaatcatatgcacggaagaatactccaccggttatactacaaatagtaagatcattcattttgagatcaaagaccgttttgcttttttcgccggccccagacttcggaacatggctagcctatatgggcagctagacactactaaaaaactgcgggatttcttcaccgtgaccgatctcaggatccgactcctgcgacccgctgttggagagatcttcgtggacgagctacatctggcccgctatttctatgctatttctgacattaaggtgcgtggccgctgtaagtgcaatctacatgctacagtatgcgtttacgacaactccaagttaacctgcgaatgcgagcataacacgactgggccagattgcgggaaatgcaagaaaaactatcaggggcggccatggtctcccgggtcttacttaccaatacctaaagggacagccaatacctgcatcccatctataagctccattggcaattgcgaatgcttcggccactcaaatcggtgtagctacattgatcttctcaacacggtaatctgcgtctcatgtaagcacaacacacgcggccaacactgcgaactgtgcaggctcggatattttcggaatgcctccgcccaactggatgatgagaatgtctgcattgagtgttattgcaatccactggggtcaatccatgaccgctgcaatggctcaggattctgtgaatgtaaaacaggaacaactgggccgaaatgcgacgaatgtttgccagggaattcttggcattacgggtgccagccaaatgtgtgcgacaacgagctgcttcattgccagaatggcggcacttgccacaacaacgtcagatgtttgtgccccgctgcctacacggggattctatgcgagaagctacgatgtgaagaggccggcagctgcggtagtgatagtggccaaggagcgccaccccatggctcccccgctctgctgctattgaccacactgttgggaaccgcttctccattagtgttctag

SEQ ID NO: 196821 - DNA, 1383 bp, Artificial Sequence
  Description of Artificial Sequence: Synthetic coding sequence
atgtacctgagccggttcctgagcatccacgccctgtgggtgaccgtgagtagcgtgatgcagccgtaccctcttgtgtgggggcactacgacctgtgcaagactcaaatttatacagaggaggggaaggtatgggactatatggcctgtcagcctgagtccaccgatatgacaaagtacctcaaggtcaagttggatcctcccgacattacatgtggagatccccctgaaacgttttgcgcaatgggcaacccttatatgtgcaataacgagtgtgacgctagcaccccggagttagcacatcccccagagctaatgtttgactttgagggacgccaccccagcaccttctggcagtctgctacctggaaagagtatcctaaacctcttcaggtgaacattactctttcttggtctaagacaattgaactgacagataatatcgtgattacgtttgagtctggaagacctgaccagatgatccttgaaaagagcctcgattacggtagaacctggcaaccataccaatattacgctactgactgcctggacgccttccatatggaccccaaatccgtgaaagatctttcacagcacacagtgctggaaattatttgtacagaggagtactctactggatacaccaccaattctaaaattatccatttcgaaataaaggatcggttcgcatttttcgccggaccacggctccgaaacatggcatctttatacggacaactggacactacaaaaaagctccgagactttttcaccgtgacggatctccgaattcggctgctacggccggcagtgggagaaattttcgtggacgagctacaccttgctagatatttctatgcaatttcagacatcaaagtgcggggccgctgtaaatgcaatctgcacgcgacagtctgcgtttacgataattccaaacttacttgtgagtgtgagcacaacacgaccggacccgattgcgggaaatgcaaaaaaaactaccagggcagaccctggtcccctgggtcctatctaccgatacctaagggtaccgctaatacttgcgatccctatcttactagctgcggggacccacccaagtttaacaggatttggcctaacatctcctcgctggaagtgtcaaaccctaagcaggccaatgtctgcgacaacgaactgctgcactgccagaatggcggaacttgtcacaataacgttagatgcctgtgtcccgccgcctacaccggaatactgtgcgagaagcttcgttgcgaggaagccggttcttgcggttccgatagcggccagggggccccaccacacggttcacctgccttgctcctgttgactacattgctgggaaccgcctcaccactggtattttag

SEQ ID NO: 196822 - DNA, 1443 bp, Artificial Sequence
  Description of Artificial Sequence: Synthetic coding sequence
atgtacctgagccggttcctgagcatccacgccctgtgggtgaccgtcagcagcgtgatgcagccgtatccgctggtgtgggggcactacgacctgtgtaaaacacagatctatacagaagaggggaaagtatgggattacatggcctgtcagcccgagagtaccgatatgaccaagtacctgaaggttaagctggaccctcctgacatcacctgcggggatcctccggagacattttgcgccatggggaacccatacatgtgcaacaacgagtgcgacgccagcactcctgaactggcgcatcccccggaactcatgtttgattttgaaggtaggcatccaagcaccttttggcagagtgcgacttggaaggagtacccaaaacctctgcaggtcaacattaccctttcatggtctaaaactatagagttaaccgataatattgtcattacttttgagtccggtcgacccgatcagatgatcctggagaaaagtctggattatggtcggacttggcagccctaccagtactacgcaaccgactgcctagacgctttccacatggatcctaagagcgttaaagacttgagccagcataccgtgcttgaaatcatctgtactgaggagtattcaacaggctacacaactaactccaagattatccacttcgagataaaagatcggttcgcattttttgccggaccgcgcctgcgcaacatggcaagtctatatggccaattagacaccacaaaaaagcttagggactttttcacagttacggatctccgcatcaggctgctaaggcccgcagtcggcgaaatattcgtggatgaactgcatttggcacgttacttctatgcgataagtgatatcaaggtacgggggagatgcaagtgtaacctccacgccacagtgtgcgtatatgacaattctaagttgacgtgtgaatgtgaacataacacaactggaccagattgcgggaagtgtaagaagaactaccaaggacgtccctggagcccagggtcatatctaccaatacctaaagggacggctaatacctgtattcccagtatctccagtattggaaacccacctaagtttaaccggatctggcccaacatcagcagtctcgaggtgagcaacccaaagcaggtcgcacctaaattggctttatccaccgtctctagtgtgcaggtagccaatcataaacgtgccaacgtgtgcgataatgaactcctgcattgtcagaacggagggacgtgccacaacaacgtgcgctgtttgtgccccgccgcttacacaggaattctttgcgagaaattgcggtgcgaagaagctggttcttgcgggtctgactcaggccagggagctccccctcacgggtcacccgctttgctgttgcttacaacccttctcggaacggcatccccgctggtgttctag

SEQ ID NO: 196823 - DNA, 1485 bp, Artificial Sequence
  Description of Artificial Sequence: Synthetic coding sequence
atgtacctgagccggttcctgagcatccacgccctgtgggtgaccgtctcttcagtgatgcagccctaccctttggtttggggccactacgacctgtgcaagacacaaatttacacagaggaaggaaaggtctgggactacatggcgtgccaaccggaaagtacggatatgactaagtacctgaaggtgaagctggatccaccagacattacatgtggcgacccaccagaaaccttctgcgccatgggaaatccttatatgtgcaataacgaatgtgacgcctctacccccgagttagcacaccctcctgagttgatgttcgacttcgaagggcgtcacccaagtaccttctggcagagcgcaacatggaaggaataccctaagcccttgcaggtcaacatcacactgagctggtctaaaactattgaactaaccgataacatagtgatcaccttcgaaagcggcagacctgatcagatgattttagagaagtctctggattatggacgcacatggcagccctatcagtactatgctacagattgtctggatgcttttcacatggaccctaaatcagtgaaagatctcagtcagcacacagtgctcgaaatcatctgcactgaggagtactctaccggctatacaactaacagcaaaattatacacttcgagattaaggatcgtttcgcattcttcgccggtccacggctacgaaacatggcttctctttacggccagttagatactaccaagaagctgagagatttctttaccgtgactgaccttagaatacggctgctgcgaccggctgtcggcgagatcttcgtcgatgagctgcatctggcgcggtatttttacgctatctctgacatcaaagttcgcggcagatgtaagtgcaatctccatgctaccgtttgtgtgtacgacaacagcaaactcacgtgcgagtgtgagcataacaccaccggccctgattgtggaaagtgcaagaagaactaccagggccgcccatggtcccctggcagttatctgcccattccaaaggggactgccaacacttgtgatccatatttaacatcctgcggagattgtgagtgcttcggacactccaaccggtgttcctacatcgatctgcttaacaccgttatctgcgtgagttgcaaacataacactcgcggtcagcactgcgaactgtgtcggctgggctactttcgaaacgccagtgcacagctggacgacgagaatgtttgtatcgcaaatgtgtgtgacaacgaactgttgcattgccaaaatggagggacatgtcataataatgtgcggtgtctgtgccccgcggcttatacagggatcctctgcgagaagctccgatgtgaagaggccgggagctgcggaagcgatagcgggcagggggcaccaccccacggtagcccagccctgctgttgctgacaactcttctgggcaccgccagtcccctggtcttctag

SEQ ID NO: 196824 - DNA, 1620 bp, Artificial Sequence
  Description of Artificial Sequence: Synthetic coding sequence
atgtacctgagccggttcctgagcatccacgccctgtgggtgaccgtcagttctgttatgcaaccttatcccctggtatggggccattatgacctgtgtaagacccaaatatacacagaagagggtaaggtgtgggactatatggcctgtcaacccgaatcaacggatatgaccaaatatcttaaggttaaactcgatccacctgatatcacctgtggcgacccccccgaaacattttgtgccatggggaacccatatatgtgtaacaatgaatgtgacgcaagcacacctgagcttgcccatcctcccgagctaatgtttgacttcgagggcaggcaccctagcacgttctggcagtctgcaacttggaaggagtacccgaaaccccttcaagtgaatatcacgttgtcctggtcaaaaactatcgaacttaccgataatatcgttatcactttcgagtctggccgcccggatcagatgatcctggagaaaagtctggactacgggagaacatggcagccttaccagtactacgcaaccgattgcctcgatgccttccatatggacccaaaaagcgtgaaggatctgagccaacacactgttctggagattatttgtacagaggagtactcaacaggatataccaccaatagcaaaatcattcacttcgagataaaagacagatttgcattctttgccgggcctcgccttagaaatatggcttcgctatatggacagcttgacacgaccaagaaacttagggatttttttactgtgaccgacttaaggatcaggctccttcgtcccgcagttggagaaatcttcgtggatgaactgcatctagcccgatacttttacgcaattagtgacatcaaagttcggggccgttgtaaatgcaacctgcacgccactgtctgtgtctacgacaatagtaagctcacttgcgaatgcgaacataatacaactggacctgattgcggaaagtgtaaaaagaactaccagggccggccttggtcccccgggagttatttacccatcccaaagggcaccgctaacacatgtatcccctcaatttcatccattggaaattgtgaatgttttgggcatagcaatcgttgtagttacattgatcttctgaataccgtcatctgtgttagctgtaaacacaataccaggggacaacactgcgagttatgcaggttagggtactttaggaatgcctctgcgcagctcgatgatgagaatgtttgtatagagtgctattgtaatcccctgggaagcattcatgaccgctgcaatggcagcggattttgtgagtgtaaaaccggcactacgggcccaaaatgtgatgaatgtctgccaggaaactcttggcattatgggtgtcaacctaatgtttgtgataacgaacttctgcactgccagaatggaggaacatgtcataacaacgtgcgatgcctctgccctgccgcgtatactggcattctctgcgaaaagctgagatgtgaagaggcaggcagttgcgggtcggacagcggccagggggcccctccccacggtagccccgctttgctgctcttaactaccctgttggggactgcgagtcccctcgttttctag

SEQ ID NO: 196825 - DNA, 1317 bp, Artificial Sequence
  Description of Artificial Sequence: Synthetic coding sequence
atgtacctgagccggttcctgagcatccacgccctgtgggtgaccgtgagttcagttatgcaaccttatcccctggtatggggtcattatgacttgtgtaaaacccaaatatacacagaggagggaaaggtctgggactatatggcatgtcagcctgagtctactgatatgactaagtatcttaaggtcaagctggatccaccagatattacatgcggcgacccgcctgagaccttttgcgccatggggaacccatacatgtgcaacaatgagtgcgatgcatctactccggagctggctcatcctccagaactgatgttcgacttcgaaggtagacacccatcgaccttctggcagtcagccacctggaaagagtacccaaagcctctgcaagtgaacattacgctctcttggagcaagactatagagctgacggataacatcgtcatcactttcgagtccggcagacctgatcaaatgattttggagaaaagcctcgattatggacgaacctggcagccctaccagtattacgccacagactgtttggacgcattccacatggaccccaaaagcgtcaaagacctgagccagcacactgtgctggagattatttgtacagaagaatacagcactggctataccactaattcaaagataatacatttcgaaattaaggaccgattcgcctttttcgccggcccccgacttagaaacatggcctcactgtatggccagctggatacaacgaagaagctcagggatttttttactgtcacagaccttcgtatccggctgctccggccagccgtgggggagattttcgtcgacgaactccatcttgccaggtacttttatgccatttccgacattaaagtccgcggcagatgtaagtgcaaccttcacgccactgtatgcgtgtacgacaactctaagctcacgtgcgagtgcgagcacaatacaaccgggcctgattgtggcaaatgcaaaaaaaactaccaagggcgtccttggtcaccagggtcctacctccccatccctaagggtaccgccaacacctgcatccctagcatttcaagtattggcactaacgtctgcgacaatgaactgttgcactgccagaacggggggacgtgccataacaacgtgcgatgtctgtgcccagctgcttacaccggcatactctgcgaaaagctgaggtgcgaagaagcgggtagctgcggctccgactccgggcaaggagcaccccctcatggctcgcccgctctgctattactcactacactgctgggtacagcatcccccctggtattttag

SEQ ID NO: 196826 - DNA, 1095 bp, Artificial Sequence
  Description of Artificial Sequence: Synthetic coding sequence
atgtacctgagccggttcctgagcatccacgccctgtgggtgaccgtgagcagtgtgatgcagccttaccctcttgtctgggggcactacgacctatgcaaaacccagatctatactgaagagggcaaggtgtgggattatatggcctgccagcctgagtccaccgatatgaccaagtacctgaaggtcaaactcgatcccccagacatcacctgtggtgaccctcctgaaaccttctgcgccatgggaaacccttatatgtgtaacaacgaatgcgacgccagtacacccgaactggcccacccccctgaactgatgtttgactttgagggacgtcaccccagcaccttctggcagtctgctacttggaaggagtatcccaagccactgcaagtcaatatcacacttagttggagcaagacgatcgagttgacggacaatatagttattacattcgagagcggtaggccagaccagatgatcctggagaagagccttgactatggacggacttggcaaccctaccagtattacgcaactgactgtctggacgccttccatatggaccccaaatctgtgaaggacttaagtcagcatacggttttagagattatctgcacagaggagtatagcacaggatacaccactaattccaagatcatccatttcgaaatcaaagataggtttgcattcttcgctggaccacgcctccggaatatggctagcctgtacggccagctggacactacaaagaaattgcgggatttctttaccgtcaccgacctccgcatacgattgttgagaccggctgtgggcgaaatttttgtggacgaacttcatctggcgcgatatttctatgcaatttctgatataaaagttcgcgggcgctgtaaatgcaatctccatgccacagtgtgcgtctatgacaactccaagcttacctgcgagtgtgaacataatactacgggccctgactgcggcaaatgcaagaagaactaccagggcaggccatggtccccaggttcctacttgcccataccaaaagggaccgctaacacctgcataccgagtatttccagcattggctccaaatag

SEQ ID NO: 196827 - DNA, 1317 bp, Artificial Sequence
  Description of Artificial Sequence: Synthetic coding sequence
atgtacctgagccggttcctgagcatccacgccctgtgggtgaccgtgtcatctgtgatgcagccttacccccttgtttggggacattatgacctgtgtaaaacacagatttataccgaagagggaaaagtctgggactacatggcttgtcagcctgaaagcaccgacatgactaaatatcttaaagtgaagctggatccgccagatatcacttgcggtgatcctccagagaccttttgtgccatgggcaatccctacatgtgcaacaacgaatgcgatgcttccacccctgagttggcccatcctccggaactgatgtttgacttcgaggggcgccacccttctacattttggcagtcagctacatggaaggagtaccctaagccattacaggtgaatatcacactgtcctggagtaagacaatcgagctgactgacaatatagtcatcacattcgagtctggccgtccagatcagatgatcctcgagaagagcttggactacggcagaacatggcagccctaccagtactacgcgaccgactgtctcgatgccttccacatggaccctaagagcgtgaaggatctctcacagcacaccgtcctcgaaatcatttgtacggaggaatattccaccgggtacacaacaaatagcaagattatccatttcgagattaaggacagattcgccttttttgctggccccaggttaagaaacatggcctccctgtacggtcagcttgacaccaccaagaaattgagggatttctttactgtgactgacctccgcattagactgctgaggcctgccgtgggtgagatcttcgttgacgagctgcacctcgctcgatacttctacgctatttcggatatcaaagtgcgcggccgctgcaaatgtaacctccacgccaccgtctgcgtatatgacaattccaagctgacctgtgagtgcgaacataacacaacaggtcccgattgtggcaaatgtaagaaaaattatcaaggacggccctggtcaccgggttcctatctgcccattccaaagggaactgccaatacctatctgcctagtatgtatagcgtggcagctaacgtgtgcgataacgaactgttgcattgccagaacggtgggacctgtcacaataatgttagatgtctctgtcctgcggcctataccggaatcctgtgcgaaaaactccggtgtgaggaagcaggttcttgtgggtccgatagcggacagggggcaccccctcatggaagccctgcactgttattactaactacactgctcggtacagcttctccccttgtcttttag

SEQ ID NO: 196828 - DNA, 1620 bp, Artificial Sequence
  Description of Artificial Sequence: Synthetic coding sequence
atgtacctgagccggttcctgagcatccacgccctgtgggtgaccgtgtcctcagtgatgcagccctacccgcttgtgtggggtcactacgacctttgtaagactcagatctataccgaggagggaaaagtgtgggattacatggcatgccagccggaaagcaccgatatgaccaaatacctcaaagtgaagcttgaccctccggacatcacctgcggagacccacctgaaacattctgtgccatgggaaacccatatatgtgcaacaatgaatgtgacgcttctacacccgagctggcccatccccccgagcttatgtttgactttgaaggaaggcacccctctaccttctggcagtctgctacatggaaagagtatcccaaacctctgcaggtgaacatcactctgtcctggtctaagacaatagaactgacagacaacatcgtaataacattcgagagcggccgaccggatcagatgatcctggagaagagtctggattatggcagaacttggcagccataccaatactacgctacggactgtttagatgccttccacatggaccccaaatccgtcaaggatctgtcccaacacaccgttctggagatcatttgcactgaagagtacagcacagggtacactaccaatagcaagataatccactttgaaattaaagatcggtttgccttttttgctgggccgagactccggaacatggccagtctctatgggcagttggataccactaaaaagctaagagacttctttaccgtgaccgacttgcggatacgcctgctgaggccagcggtaggtgaaatctttgttgatgagctgcatctggcccgctacttttatgccatttctgacatcaaggttagagggcgctgcaagtgcaatcttcacgccacagtctgcgtgtacgataactcaaagctgacatgcgagtgtgaacacaatacaacaggaccagattgtggaaagtgtaagaaaaactatcaaggccgcccatggtccccaggctcctacctccccatccctaaggggacagccaacacatgtgatccctatctgaccagctgcggggactgtgaatgcttcgggcattccaaccggtgttcctacattgacctactgaacacagtaatttgtgtttcgtgcaaacacaacacaaggggtcagcattgcgaattgtgccgcctgggatatttcagaaatgcaagtgcacagttggacgatgaaaacgtctgcattgagtgctactgcaaccctctgggcagtattcacgataggtgcaacggcagcggtttttgcgagtgcaagaccggcacaaccgggcctaaatgtgatgaatgtcttcccggtaactcttggcattacggctgccagccaaacgtgtgcgacaacgaactgttacactgccaaaacggtgggacctgccacaacaacgttagatgcctctgtcccgccgcgtatactggcatactttgcgagaagctgcggtgtgaagaagccgggagctgcggaagtgattcgggccaaggggctccgccacacgggagtcccgcgttactgcttctcacaactctgctgggaactgcaagtcctctggttttctag

SEQ ID NO: 196829 - DNA, 519 bp, Artificial Sequence
  Description of Artificial Sequence: Synthetic coding sequence
atggtgggccccgccccccggcggcggctgcggcccctggccgcccttgcactcgtcctggcccttgccccagggctgcccaccgcccgggccggacagacccctcgacccgctgagaggggtcctcctgtgagactttttacagaggaggagctggccagatacggcggcgaagaagaagatcagccgatttacctggccgtcaaaggtgtagtgttcgacgtcaccagtggcaaagagttttatggccgtggagccccctataatgccctgaccggtaaggacagtacgaggggggtggctaagatgtcgttggatccagctgacctcacccatgacacaaccggcctgactgcgaaggagctggaggcgcttgatgaggtctttaccaaagtgtacaaggccaagtacccaatcgtggggtatacggcacggcgaatattaaacgaggacggaagtcccaatctggatttcaagcccgaggatcagccacattttgacatcaaggatgagttctag

SEQ ID NO: 196830 - DNA, 2088 bp, Artificial Sequence
  Description of Artificial Sequence: Synthetic coding sequence
atgagcctgctgctgagcttctacctgctgggcctgctggtgagcagtggccaggatcgatttgcaatgctggccaataacaacctgcagattctcaacatcaacaagagtgatgagggaatctaccgatgtgagggccgcgtcgaggcccgtggagaaatcgattttcgggatatcatcgtaatcgtcaatgtgcctcccgcaattagtatgcctcagaaaagctttaatgcaactgcagagcgtggagaagagatgactttttcctgtagagcttccggaagccctgaacctgccatatcatggtttaggaatgggaagctgatcgaggagaatgagaagtacatcctgaaaggtagcaatacagagctgacagtgcgtaatatcataaattccgatggtggtccttatgtgtgtcgcgctacaaacaaggctggtgaggacgaaaagcaggctttcctccaggtgttcgtgcaacctcacattattcagctaaaaaacgagaccacgtacgaaaatgggcaggtcaccttagtctgtgatgcagagggggagcccattccagaaattacatggaaacgggctgtagacggttttacattcactgaaggcgacaagagcttggacgggaggattgaagtgaaaggccagcacgggagttctagtctccatattaaggacgttaaactgagtgattcaggaaggtatgattgtgaagctgcctctaggatcggaggccaccagaagagcatgtacctggacatcgaatatgcacccaagttcattagcaaccagacaatctactattcctgggaaggcaaccctattaacattagttgcgatgtcaaaagtaacccgcccgcctcaatccattggcgtagggataagctcgtgttgccagcgaagaataccacaaacctaaaaacatattcaaccggcaggaaaatgattctcgagatcgcccccacatccgataatgacttcgggcggtataactgcacagccaccaatcatattggcactaggtttcaggagtacatcctggcgctcgccgacgttccaagctccccgtacggggtgaaaatcatagagctgtcgcagacaacggccaaagttagttttaacaaacctgattctcacggtggggtacccatccaccactaccaggtggatgtcaaagaggtcgcctccgaaatctggaagatcgttcgaagccatggcgtgcagacgatggtcgtattgaataacctcgagccgaataccacttacgagattcgtgtagcggcggtcaacggtaaaggccagggggactacagcaaaattgaaatcttccagaccctgccagtccgcgaaccaagccctccttctattcatggccaacccagttctggcaaatctttcaagctgagcatcacaaagcaagacgatggcggcgctcccatactcgaatacatagtgaagtacagaagtaaagataaggaggatcaatggctggagaagaaggtgcagggtaacaaagatcatatcatacttgagcatctgcaatggactatgggatacgaggtgcagatcacagcagcaaatagattgggatactctgagccgaccgtgtacgaatttagtatgcctcctaaacctaacattatcaaggatactttatttaacggattgggcttgggcgcagtgatcggcctcggagtggctgccctgttactgattcttgtagtcactgacgtaagctgcttctttattcgccaatgcggactgttgatgtgtataacccgcagaatgtgtggaaagaagagcggttcctccggaaagtccaaagagctggaagaaggcaaggctgcatacttaaaggacggatctaaagagccaatcgtagagatgcgcaccgaagatgaacgcgtgacaaatcatgaggatggatcaccggtcaacgaacccaacgagacaacacctctcacagagcccgaaaaactgcctctgaaagaagaggatggcaaggaagcactcaaccctgagactatagaaataaaagtgtctaacgacatcattcagagcaaggaagatgactcaaaggcgtag

SEQ ID NO: 196831 - DNA, 2514 bp, Artificial Sequence
  Description of Artificial Sequence: Synthetic coding sequence
atgagcctgctgctgagcttctacctgctgggcctgctggtgagcagcggccaggccctactgcaggtgacgatttccttgagtaaggtggagttgagtgtcggggagtctaagttctttacgtgtaccgctataggagagccagagagcattgactggtataatccacaaggagagaagattatcagtacccagcgcgtggtcgtccagaaggaaggggtgagaagccggctcacgatctacaatgccaacatcgaagatgcggggatatacaggtgtcaggccaccgacgctaagggtcaaactcaagaagccacagtggttctggagatctaccagaagctgaccttccgcgaggtagtgtcacctcaggagtttaagcaaggggaggacgccgaggtcgtgtgccgggtgagttcttccccagccccagcagtttcttggctttaccataacgaagaagttaccactatcagcgacaatcggttcgcgatgctagccaacaataatctacaaattttgaacatcaacaaatctgatgaaggaatctaccgctgcgagggcagagttgaagcccgaggcgagattgacttcagagatattatcgtgatcgtgaatgtgccgccggccatctctatgccccaaaaatctttcaacgctactgccgagaggggagaagagatgacgtttagttgcagagcttctggtagccctgagcccgcaataagctggtttcgcaatggcaaactgatcgaggagaacgaaaagtacatcctgaagggttctaatacagaacttactgtgcgcaatattattaattctgatggcggcccctatgtctgcagggccacgaataaggccggcgaggatgaaaaacaggcttttctgcaggtattcgtccagcctcatataatccagttgaagaacgagacaacctatgaaaacggacaggtgacactggtctgcgacgccgagggtgagcctataccagaaatcacttggaagcgggctgtggatggttttacattcactgaaggtgataaatccctggatggcaggatcgaagttaagggccaacatgggtcttcatcattgcatatcaaggatgtaaagctgtcagattccggaagatacgattgtgaagccgcctctcgtatcggtggacaccaaaaatcaatgtacctagacattgagtatgcacctaagtttatttctaatcagacaatctactacagctgggaaggcaatcccattaacatctcttgtgacgtcaagagcaatcccccggccagcatccactggagaagagacaagttagttctgccggccaaaaatactaccaacttgaagacctactcaaccggtcggaagatgatacttgagatcgcccctacatctgataacgactttggtcggtacaactgcaccgccaccaatcacatcggtactcggttccaagagtatattctcgctttagctgacgtcccgtcctcaccttacggtgtgaaaatcattgagttaagccaaacaacagccaaggtatcctttaataagccagattcccacggcggcgttcccatccatcactatcaggtggatgtgaaagaagtggcttccgagatatggaagatagtccggagccacggcgtacagaccatggtcgtgctgaacaaccttgagcccaacacaacttacgagatccgcgttgcagcggtcaatgggaaaggacagggcgattacagcaaaatcgagattttccagacactacccgtgagggagcctagccccccgtctatccatggacagccatcatctggaaagagctttaaactgagcatcactaaacaggatgacggaggggctcctatcctcgagtatatagtcaagtatcggtccaaggacaaagaagatcaatggcttgagaagaaggtgcagggaaacaaagatcacataatattagaacacctgcaatggaccatgggctacgaagttcagatcacagcagccaataggctaggctactcagaacctactgtctacgagttctccatgcctccaaagcctaacattatcaaagacacattgtttaatggcctcggactcggggctgtaattggcttaggcgtagccgccttactcctgattcttgtagtgacggacgtctcctgtttttttatacgacagtgtggcttgttaatgtgcattacccggagaatgtgtggaaagaaatctggcagttctggaaagagtaaagaactagaggagggtaaggccgcatatctgaaagatggctcaaaggagcctattgttgaaatgagaactgaggacgagcgcgttaccaatcacgaagatggcagcccggtgaatgaacccaatgaaacgacccctctgaccgagcccgaaaagctgcccttgaaagaagaagacggcaaggaagctctgaacccagaaacgattgagatcaaggtatccaacgatatcatacaaagcaaagaagacgattcaaaagcctag

SEQ ID NO: 196832 - DNA, 1275 bp, Artificial Sequence
  Description of Artificial Sequence: Synthetic coding sequence
atggtgcggagcgacagcggcggccaggtgtacctggactaccacaatagacaaggcttattcgtggattggaagtataatgaagcactgtatcttgaagagggtcagccagagacctactatcgtactgctctgttacaggtgacaatatctctaagtaaggtcgagctgtctgttggagaaagcaagttctttacttgcaccgctataggtgagcccgagtcgatagattggtacaacccccagggggaaaagatcatatcaactcagcgggtggtggtgcagaaggagggggtgcgaagtagactgacaatttataacgccaacattgaggacgccggaatttatagatgtcaagccaccgacgcaaaaggacagacccaggaagctacagtggtgctggaaatctaccagaaacttacgttccgggaagtcgtgtccccacaggagtttaaacagggggaggatgccgaagtcgtatgtcgtgtttcatcatctcctgcgcctgctgtgtcatggctctatcataacgaagaggtgacgactatttcagataatcgtttcgctatgttggccaataataatctgcagatcctgaatatcaataagtcagatgagggaatctaccgttgcgaaggccgcgttgaggctagaggagaaattgacttccgggacattatcgtgatcgtcaacgttccgccagccataagcatgcctcagaagtccttcaacgctaccgccgagcggggcgaagaaatgactttcagttgcagagcctccggctctccagagcctgcgatttcttggtttcggaatggcaaactcatcgaggagaatgagaaatacattctgaagggaagcaacactgaattgactgtcaggaatatcatcaacagtgacggtggcccttatgtgtgccgcgctacaaacaaagccggcgaggacgagaagcaggccttcttgcaagtgtttgttcagccacacatcatacagctaaagaacgagactacatacgagaacgggcaggtcactctggtgtgtgatgctgagggggaacctatccctgagatcacttggaaaagagcggttgacggtttcacattcaccgagggtgataagagtctggatggccgaatagaagttaaaggccaacatggatcatccagtctgcatatcaaagatgttaagctttcagactccgggcgctatgactgcgaggcagcatctcgaatcggcggtcaccaaaagtctatgtatttggatatcgagtcctag

SEQ ID NO: 196833 - DNA, 1983 bp, Artificial Sequence
  Description of Artificial Sequence: Synthetic coding sequence
atgcaggagaacctgcggttcgccagcagcggcgacgacatcaagatctgggatgcgtcttccatgacattggttgacaagttcaaccctcataccagcccccacggcatctcttccatttgctggagttctaacaacaactttcttgtcaccgcttcttcgtctggagataaaatcgtcgtgtcctcttgcaagtgtaagcccgtgccactgctggagctagcagaaggccagaagcagacgtgcgtgaacctgaattctacctcgatgtatctggtgtcaggcggccttaacaatactgtgaatatctgggacctgaaatctaaacgggtacatcgcagcctgaaagatcataaagatcaagtgacatgtgtgacatacaactggaatgattgttacatagcctccgggtctctctctggggagatcattttacactctgtgacaaccaacctgtcttctaccccgttcggccatggtagtaaccagagcgtgcgacatctgaagtactccttgtttaagaagtctctacttgggagcgtgagtgataatgggatcgtcacgctgtgggacgtaaactcccaaagcccctatcacaacttcgattccgtgcacaaagcacctgcgtccggcatttgtttttcacctgtcaacgaactgcttttcgtcacaattggactggacaaacggataattttgtatgatacatcctctaaaaaactagttaaaactctcgtagcggatacacccctgaccgccgtcgacttcatgcccgacggagccaccttggcaattggatcatcacggggtaagatttatcagtatgaccttagaatgttgaaatcgcccgttaaaacaattagcgctcacaaaacgagcgtacaatgtatcgcatttcagtactctactgtgctcaccaagtcatccctcaataaagggtgttctaacaagcctaccacagtgaataagcggagcgtcaatgtcaatgccgcttccggaggcgtccagaacagcggaattgttcgcgaagcccctgctacctcaattgcaactgtgctgcctcagccgatgacctctgccatgggcaagggtaccgtagccgtccaggagaaggcgggactcccaaggtccattaacactgacacactctctaaggaaacagatagcgggaaaaatcaggacttttccagcttcgatgatacaggaaagtcttccctgggagacatgttctcacccattagagacgacgcggtcgtaaacaagggatccgatgaaagcatcggaaagggcgatggattcgacttcttaccacagcttaacagcgtctttcccccccgaaaaaaccctgtgacaagctctacctcagtgctacacagttcccctctcaacgtgttcatgggctcacccggaaaagaagagaacgaaaaccgcgacctcactgccgaatccaagaaaatctatatgggaaagcaggagtctaaagacagtttcaagcagctggccaagttggtgacatctggagcagaaagtggaaacttgaatacctctcctagctctaaccagacaaggaactcagagaaatttgagaaacccgagaacgaaattgaggcccaattaatctgcgaacctcccattaatggatcttctactccaaatcccaagatcgcctcatccgtcacagctggagtagcaagcagcctttcggagaagatcgcagactctatcggaaacaacaggcagaatgcccccctgacttcaatacagataaggtttatacagaatatgatacaagaaactctggatgacttcagggaagcctgccaccgcgacatcgtgaatctccaggtggagatgatcaaacagtttcacatgcagctcaatgagatgcatagcctgcttgaacggtattctgtgaatgagggtctggtcgccgaaatcgagcggctccgagaggaaaacaagagactgagagcccacttctag

SEQ ID NO: 196834 - DNA, 1716 bp, Artificial Sequence
  Description of Artificial Sequence: Synthetic coding sequence
atgtacctggtgagcggcggcctgaacaacaccgtgaacatctgggacctcaaaagcaagcgtgtccataggtctctgaaagaccataaggaccaagtgacttgtgtgacctacaattggaacgattgttatatcgcctcaggctctttgagtggcgaaatcatcttacactccgtgacaacgaacttgtctagtacgccctttggtcacgggtctaaccaatcagtccggcatctgaaatattctctgtttaaaaaatccctacttgggtctgtgagcgacaatggcattgtcacactgtgggatgtgaactcccagagcccttaccacaattttgatagtgtgcacaaggcccccgctagtggtatatgcttttcaccagtgaatgaacttctttttgtgacaatcggtctcgacaagcgaattatcctttatgacacctcaagtaagaaactggttaagaccctcgtggcagacactcctcttacggcggtagacttcatgcccgacggggcaacccttgccatcgggagttctcgcgggaagatatatcaatacgaccttagaatgttgaaatctccagtgaagacaatctctgcacataaaaccagtgttcagtgtatagcgttccagtatagcaccgtcctgacaaaaagctctctgaacaagggctgtagtaacaagcccaccaccgtcaacaagcggagtgtgaacgtgaatgcggctagcggcggcgttcagaatagcggaattgtgagagaggccccagcaacctctatcgccacagtactaccccagcccatgacttcagccatgggtaaagggacagtcgccgtgcaggagaaggctggcctgcctcgtagcataaataccgacacgctttcaaaggagacggactctggaaagaaccaggatttctccagctttgacgataccggaaaaagttctctcggcgacatgttctcccctatccgggacgatgccgtggtgaataaagggtcggatgaatcgattggaaagggtgatggctttgattttctcccccagttaaattcagtgttccctccacgcaaaaatcccgttacctcgtccacctccgtcctgcattcctcaccgctgaatgtctttatggggtctcctgggaaggaagaaaacgagaatagggatttgacagctgagtctaagaagatctatatggggaaacaagagtccaaagactctttcaaacaactggcaaaactggtcacatccggcgccgaatctggtaacctgaataccagtcctagcagcaatcaaaccaggaattccgagaaattcgagaagcccgagaatgaaatagaagcacagctgatttgcgagcctccaattaatggtagcagcacccccaaccccaagattgcatcaagcgtcacggccggcgtcgcatcatcattgagcgaaaagatcgctgactcgattgggaacaaccggcagaacgcccctcttacttccatccagattcggttcatacagaatatgatacaggaaaccctggacgattttcgggaagcttgtcatagggacatcgtcaatctgcaggtggagatgatcaagcagtttcatatgcaactgaatgagatgcactctctgctcgaacgatactctgtgaatgaagggctggtggcagaaatagaacggctgagagaggagaacaaaaggctaagggcccacttctag

SEQ ID NO: 196835 - DNA, 1983 bp, Artificial Sequence
  Description of Artificial Sequence: Synthetic coding sequence
atgcaggagaacctgcggttcgccagcagcggcgacgacatcaagatatgggatgccagctccatgactctcgtagataagttcaacccacatacatctccacatggcattagctctatttgctggtccagcaacaacaacttcttggtcactgcaagtagctctggcgataagatcgtcgtgtcatcatgcaagtgcaaaccagttcccttgctggagttggctgaaggccagaaacagacttgcgtgaatcttaactcgacatctatgtatctggtgtccggcgggttgaacaacacagtgaatatctgggacctaaagtcaaagagggtacaccgatcgctgaaagaccataaagaccaagtcacgtgcgtgacctataactggaacgactgttatatagctagcgggtcactcagtggggaaataattcttcactcagtgaccacgaatctctcttccacgccgtttggccacggctctaaccagtccgtcagacacctgaagtactcactgtttaaaaagagcttgctgggctcagtatctgataacgggatagtgacattgtgggatgttaacagtcagtctccgtaccacaatttcgacagcgtgcataaggctcccgccagcgggatttgcttctccccggtgaacgaactgctgttcgtcacaattggcctcgataaacggataatcctgtatgataccagctccaagaagctggtaaagacactagtggccgacacacctctcaccgccgtcgattttatgcctgatggagcaactctcgcgatagggtctagtagggggaaaatataccagtacgatcttagaatgctgaaaagccctgtgaagacaatctctgctcacaaaacatcagttcagtgtatcgcattccagtacagtacagtgctgacgaaatcgtctctcaacaagggatgctccaacaaacctacaaccgttaataaacgttcagttaacgtgaacgcagccagtggaggggttcaaaattctggaatcgtccgggaagccccagctacttccattgcaaccgtgctacctcagccgatgacttccgctatgggaaagggaaccgtcgccgttcaggaaaaggcaggcctccccaggagcatcaataccgacacgctgtccaaagaaaccgacagcggcaaaaatcaagacttctcctcctttgacgataccggtaagtcctccctgggggatatgttttctcccattagagacgacgccgtcgtgaacaagggcagcgacgaaagcatcggtaagggggacggattcgacttccttccgcaattgaactcagtgtttcctcccaggaagaaccctgtgaccagttccacgtccgtgttgcattctagcccactgaatgtcttcatgggctctcctggaaaggaggagaacgaaaatcgggatctgacagcagaaagcaaaaaaatttatatgggcaaacaggaaagcaaggacagttttaaacagttggccaaattagtcactagcggcgctgaatccggtaacctaaacacatctccttcttctaatcagacgcgcaactcggagaaatttgagaaaccggagaacgaaatcgaagcccaactgatctgcgaaccccctattaacggcagcagcacccccaacccaaaaatcgcctcaagtgtcactgccggcgtggcctcctccctgtccgagaagattgcagatagcatcggaaacaatcgccagaacgcccctctaactagcatccagattagattcattcaaaatatgatccaagaaacactggatgattttagggaagcgtgccatcgcgacattgttaatctgcaggttgagatgatcaaacagttccacatgcagctcaacgagatgcacagtctcttagaacgatactcagtcaacgagggcctggttgccgaaatcgagagactgagagaggagaacaaaaggctaagggcccacttctag

SEQ ID NO: 196836 - DNA, 1716 bp, Artificial Sequence
  Description of Artificial Sequence: Synthetic coding sequence
atgtacctggtgagcggcggcctgaacaacaccgtgaacatctgggatctgaaatctaagcgagtccacaggagtctgaaggatcataaggaccaagtcacctgcgttacctacaattggaacgactgctatatcgccagtggaagcttgtccggcgagatcatactgcacagcgtgacaacaaacctctcctccaccccttttggccacggcagcaatcagtctgtgcgccatctcaaatatagcctttttaaaaagagcttacttggctctgtcagcgacaatgggatagtgacgctgtgggatgttaattcacaatccccttatcacaattttgattccgttcataaggctcccgccagcggcatatgcttcagtccagtgaacgagctgcttttcgtcaccatcgggcttgacaagagaattatactgtatgacaccagttccaagaagctcgttaagactctcgtcgcggacacccccctgactgcagtagacttcatgccagatggggcaacgcttgctattgggtcgtctcgcggcaagatttatcagtacgatctgcgcatgttaaagtcccccgtgaagacaatctctgcccacaagacgtcagtgcaatgtatcgccttccagtactctacagtgctgaccaaaagctcgcttaacaaaggctgttcaaacaaacctacaactgtcaataagcgcagtgtcaacgtgaatgcagcctccggaggcgttcagaacagcggcatcgtcagagaagcccctgcaacctccatagctactgtgttaccacagccgatgacgagcgctatgggcaaggggaccgtggcggtccaggaaaaagcagggctccccagatctattaacactgacacgttatcaaaagagacagattccggcaaaaaccaggacttttcttcattcgacgacaccggaaagtctagcctgggtgacatgttctcaccaatcagagatgatgccgtagtcaataagggctccgatgagtctattggcaaaggcgacggctttgatttcctgccccagttgaactcggtctttcctccacgcaagaaccccgtcacttcctcaaccagtgttctacactccagtcccctgaacgtgttcatgggctcaccgggtaaggaggagaacgaaaaccgggacctcacagctgagtctaagaaaatttatatggggaaacaggagtcgaaggactcctttaagcagctggccaagttggttacctctggggcagaaagcgggaaccttaatacctcaccctcatcaaatcagactcggaactccgagaagtttgagaagccagagaatgagattgaggctcagcttatctgcgagcctcctattaacggaagcagcaccccgaatccgaagatcgcaagttcagtgaccgccggtgtggctagcagcctcagtgaaaagattgctgactccattggcaataaccggcagaacgctccgctgacctcgatccagattaggttcatccagaacatgatccaggagactctggacgactttcgagaagcctgccaccgcgatattgtgaatctccaggttgagatgatcaaacagttccatatgcagctaaacgaaatgcattccctgttggaaaggtacagcgttaacgaggggctcgtggcggaaatcgagcgtttaagggaagaaaataagcgacttagggctcacttttag

SEQ ID NO: 196837 - DNA, 483 bp, Artificial Sequence
  Description of Artificial Sequence: Synthetic coding sequence
atgtacctggtgagcggcggcctgaacaacaccgtgaacatctgggacttgaagtccaagagggtgcaccgcagtcttaaggaccataaggaccaagtgacctgtgttacctacaactggaatgattgttacattgctagcggttccctgtctggcgagattattctccatagcgtgaccactaatctgtcctctaccccatttggacatggctcaaaccaaagcgttcggcacttgaagtactccctgttcaaaaagagcctgctgggatccgtgagtgataacggtatcgtcaccctgtgggatgtgaatagtcagagtccctatcacaattttgactcagtgcacaaggctccagctagcggaatttgcttttcgcccgtcaatgagctcctttttgtcaccattggtcttgacaagagaattatcttatatgacacgagctccaaaaaactcgtgaagacactggtggctgacacatag

SEQ ID NO: 196838 - DNA, 504 bp, Artificial Sequence
  Description of Artificial Sequence: Synthetic coding sequence
atgcacttcaccggcgccgtgatgcaggagaacctgcggttcgcctcaagcggggatgacatcaagatttgggatgcgtctagtatgacgctggtggataaattcaatccacacacaagtccacatggcatctcctccatctgctggtcatccaacaataattttcttgtaacagcttcaagttctggcgataaaatcgtggtcagctcctgcaagtgcaaacctgttccgctcctggagctggcggaagggcaaaaacagacgtgtgtgaatctcaacagcacctctatgtaccttgtgagcggtgggctcaataatactgtcaacatatgggacctgaagtcaaaaagagtgcaccggtccctcaaggatcacaaagaccaggttacatgcgtgacttacaattggaacgactgctacatagccagcgggagcctcagcggagagattatcctccacagtgttaccaccaacttgtccagcaccccatttgggcacggttag

SEQ ID NO: 196839 - DNA, 306 bp, Artificial Sequence
  Description of Artificial Sequence: Synthetic coding sequence
atgcaggagaacctgcggttcgccagcagcggcgacgacatcaagatttgggacgctagcagcatgactctggtcgacaagttcaatcctcatactagtcctcatggaattagcagcatctgctggtcgtctaataacaacttcctagtgacagcttcatctagtggggacaagatcgtcgtgagcagttgtaagtgcaagcctgttcccctgttggaactggcggaagggcagaagcagacttgcgtgaatcttaattccacctccatgtacctcgtcagtggcggcctcaacaataccgtgtag

SEQ ID NO: 196840 - DNA, 498 bp, Artificial Sequence
  Description of Artificial Sequence: Synthetic coding sequence
atgcaggagaacctgcggttcgccagcagcggcgacgacatcaagatctgggatgcctccagcatgaccttagtggataagttcaacccacatacttctcctcacggaattagcagtatttgttggtcttccaacaataatttcctcgtgactgcctcatcatccggcgataagatcgtggtctcttcttgtaaatgcaaacccgttcctcttcttgaactcgccgagggacagaaacagacttgcgtgaacctgaattcaacgagcatgtacctggtttccggggggttgaataataccgtgaatatctgggatcttaagtccaagagagtgcaccggagccttaaagaccataaagaccaggtcacttgtgtcacgtacaactggaatgattgctacatagctagtggcagtctttcgggagaaattatccttcacagtgtgacaaccaatctctcatcaacgccctttggacatggcagtaaccagtctgtctag

SEQ ID NO: 196841 - DNA, 2004 bp, Artificial Sequence
  Description of Artificial Sequence: Synthetic coding sequence
atgcacttcaccggcgccgtgatgcaggagaacctgcggttcgccagttccggcgacgatatcaagatttgggatgcatcttctatgacccttgttgataagtttaaccctcacactagccctcatggaatctccagcatttgctggagcagcaacaataatttcctcgtcaccgcctcatccagcggtgacaaaatcgtggtgtcatcctgcaagtgcaagccagtgccactgctggagctcgcggaagggcagaagcagacttgcgtaaacttgaattctacgtcgatgtacctggtgtcaggcggactgaataataccgtaaacatctgggatctgaagagtaaaagagttcatagatcccttaaagatcacaaagatcaagttacctgcgtgacttacaactggaatgactgctatatagcctctgggagcctcagcggggagattatcctgcactctgtcacaaccaatctgtctagcacaccattcggacacggttccaatcagtccgtgagacacctgaagtattctctctttaaaaagagcctattggggagtgtgagcgacaatggtatcgtcacactgtgggacgtgaatagccagagcccttaccacaactttgattcggtgcacaaagcacccgcgtccggaatttgcttctcccccgttaacgagctcctgtttgttactatcggcttggataaaaggatcatcctgtacgatacctccagtaaaaaactggtcaagacattggtcgctgacaccccactgaccgcagttgactttatgccagacggcgccacactcgccatagggtcctcccggggcaaaatctaccagtacgaccttcgcatgttaaaatcaccggtgaagaccatcagtgcgcacaagacatctgtacagtgtatcgcctttcagtacagcaccgtgttgacgaagtcatccctgaacaagggctgttccaataagcccactacggtgaacaagagatctgtcaacgttaacgccgcttcaggaggtgtgcaaaattctggaatcgtgcgtgaagcgcccgcgacgtccatcgccactgtgcttcctcagcccatgacatccgccatgggaaaggggactgtggcagtgcaggaaaaggccggacttcccagaagcatcaacacagatactctaagcaaggaaacagacagcgggaaaaatcaggacttttctagtttcgatgatacgggcaaaagttctctgggcgacatgttctcacccatcagagacgatgccgtcgtgaacaaggggtccgatgagtcaatcggtaagggcgacggcttcgatttcctcccccagcttaacagcgtctttccaccgaggaagaaccctgtgacttcttccacctcagttctgcacagctccccactcaatgtgttcatgggctcaccggggaaagaggaaaacgaaaatcgggatttgacagcagaaagcaagaaaatctacatggggaagcaggagagcaaggacagctttaagcagcttgccaaactcgtgacctctggagccgaatctggtaaccttaacacaagtcccagctctaatcagacccggaattcggaaaaattcgagaagccggaaaatgaaattgaagcacaactgatctgcgaaccccctatcaatgggagttccacccccaaccctaaaatcgcaagctccgtgacagcaggagtggcctcgtcactgtccgagaagatcgccgattctatagggaacaacaggcagaacgcacccctgacatccatccagataaggttcattcaaaacatgatccaggaaaccttggatgatttcagggaagcctgtcatcgcgacatcgtaaaccttcaggtcgaaatgattaaacagtttcatatgcaactgaatgaaatgcattccctgttggagcgctattctgttaacgagggattggtggcggaaatagaaaggctgcgagaggagaataagaggctcagagcgcacttctag

SEQ ID NO: 196842 - DNA, 3744 bp, Artificial Sequence
  Description of Artificial Sequence: Synthetic coding sequence
atggcccagagcctgcggctgcacttcgccgcccggcggagcaacacttatcccctctctgaaacgagcggggacgatctggatagccacgtgcatatgtgctttaaacgtcccactaggataagcaccagcaacgtggtacaaatgaaactcacaccaaggcagactgccctcgcgccacttatcaaagagaacgtgcagagccaggaaagaagttctgtgccctcttctgagaacgtcaacaagaagagctcctgtttacagatcagcctacagcctaccagatacagtggatacttgcagtcctcgaacgtgctcgctgactccgacgatgccagcttcacatgcattctgaaggatggcatttattcttcggctgtggtagacaacgaactaaatgctgtgaatgacggccacctggtatccagccccgccatttgctctggcagcctttctaacttctctacaagtgataatgggagctattcctctaacggatctgactttggaagctgtgcaagtattactagcggcggatcgtacaccaactcagtcatcagcgactccagttcttatacgttccccccatccgatgataccttcttgggcggaaacctaccctccgactctacatcaaatcggtcagtgcccaatagaaacaccactccgtgcgagatcttttccagatctacttccactgacccattcgtccaggacgacctcgaacacgggttggaaattatgaagctgcccgtttcgcgcaacacaaagatccctctaaagaggtactcatcactcgttatcttccctagaagtccatccaccacacggcctactagtcccacaagtctatgcacgctcctctcaaaaggcagctaccagacctctcaccagtttattatttcaccttctgagatcgcacacaatgaggatgggacttccgcaaaaggattcttaagcacagctgttaacgggctgcgcttatctaaaaccatctgtactccgggagaagtgcgcgacattcgaccccttcacagaaaggggtctttgcagaaaaagatcgtactgagtaataacaccccacgccaaactgtctgtgagaagagcagcgaaggctatagctgcgtgtctgttcacttcactcaaaggaaggcagctactttggattgtgaaacaactaatggcgactgcaaacctgagatgagcgaaatcaaattgaactcggacagcgagtatatcaagctaatgcatcgaacgtctgcctgcctaccgagcagtcagaacgttgactgtcagattaacattaatggggagctggaaagacctcacagtcagatgaacaaaaaccacggaatcctgcgtagatctatctctctgggcggggcttaccccaacattagttgcctgtcttcattgaagcacaattgctcgaaagggggcccatctcagttactcattaagttcgcatctggcaatgagggtaaggtcgacaacctttcgagagactccaatcgagactgcacgaacgagctgtctaactcttgtaagcccgggtgggttgtgctggaccaaccggatgccgcctgccatctccagcagcaacaggagccttctcctttgcctccgggttgggaggagcgacaggacattctcggacggacttactacgtgaatcatgaatcacgcagaactcagtggaagagacctacccctcaggataacttaaccgatgccgaaaacgggaatatccagcttcaggcccagcgggccttcaccactcgacgccagattagcgaggagacagaaagcgtggacaatcgcgaatctagcgagaattgggaaatcatacgcgaagatgaggcaacgatgtacagtaatcaagccttccccagcccaccacccagttctaatctggacgtcccaacacatcttgccgaggaactgaatgctaggttaactatcttcggaaacagcgctgtgtcccagccagccagcagtagcaatcattcttcccgtagggggagtctccaagcttatacctttgaggagcagcctactctgcccgtcctgctccccacatccagcggactcccccccgggtgggaagaaaaacaagatgaaagaggcagaagctactacgtggaccacaattctaggacaaccacatggactaagccgaccgtccaggcgacagtggaaacttcccaattgacttcttctcaaagtagtgccggcccacagagccaggcctctacttctgacagcggccagcaagtgacacagccgagcgagatcgaacagggatttctacctaaaggatgggaagtccgccatgcccccaatggcaggccgttttttattgaccacaacacaaagactacaacatgggaggaccctcggttgaagatccccgcccatctgcgggggaagacttcgctggataccagcaacgatttgggtcctctgccgcctggatgggaggagcggacacatacagacgggaggattttctatattaaccataatattaaaagaacccagtgggaagacccacgcctggagaacgttgccatcaccggccccgccgtgccttatagccgggactacaagagaaagtatgaattcttcaggcggaaattgaagaaacaaaatgacataccaaacaaattcgagatgaaactgcgaagggctacagtgctcgaagattcgtacagaaggataatgggggtgaaaagagccgactttctcaaggctagactgtggatcgagttcgacggcgaaaagggcttagactatggaggggtcgccagggaatggttttttctcatcagcaaggaaatgttcaacccttattatggcctcttcgagtattcagctaccgacaactatacattgcaaatcaatccaaatagtggtctttgcaatgaagaccatctgtcttacttcaagttcatcgggcgggtagctgggatggcagtgtatcacggaaaactgttagacggattctttatcaggccattctataaaatgatgttacataaaccaattaccctgcacgatatggaaagcgtcgactccgagtattacaactctctcagatggatcctggaaaacgatccgaccgagctggatctgcgtttcatcatagatgaagaattgttcggccagacgcaccagcatgagctgaaaaatgggggatctgagatcgtggttactaataaaaataagaaagagtacatttatttagttattcagtggcggttcgtgaatagaatacagaagcagatggccgcattcaaggagggcttttttgaactgatcccacaagacttgatcaagatctttgatgagaacgaactggagctcctgatgtgcggacttggcgatgtggatgttaacgactggagagaacataccaaatataaaaatggatattcggcgaaccaccaggtaattcagtggttttggaaagccgtactgatgatggatagcgagaagagaatccgcctacttcaatttgtgacaggtacaagcagagtccccatgaacggtttcgctgaactatatggttcaaatgggccccagagcttcaccgtcgaacaatgggggacgcctgagaaacttccgcgagcccatacttgttttaacaggctggacctgccgccctacgaaagcttcgaggagctgtgggacaaactgcagatggctatcgagaatacccagggctttgatggagtggactag

SEQ ID NO: 196843 - DNA, 2703 bp, Artificial Sequence
  Description of Artificial Sequence: Synthetic coding sequence
atggccacctgcgccgtggaggtgttcggcctgctggaggacgaggagaactctcgaattgtacgggtgagagtcatagctggcatcggcctggccaagaaggacattcttggtgcttcagatccgtatgtacgggtaactctgtacgacccaatgaacggcgttctgacttccgtgcagactaagactatcaaaaagagtctcaacccaaagtggaatgaggagatcctcttccgcgtgcacccccagcagcatcggctgctctttgaagttttcgacgagaatcgcctaacacgtgacgacttcctgggccaggtcgatgtgccattgtaccctttgccaactgagaatcctcgactcgagcgcccgtacacattcaaggacttcgtcttacacccacggagccacaagagccgggtgaaggggtacctgagactgaagatgacctacctccccaaaactagcggctcagaggacgataatgcagagcaagcagaggagctcgagcctggatgggtggtgttggatcaacccgacgccgcctgccatctgcagcaacaacaggaacccagccctctgccacccggctgggaagaaaggcaggatatcctggggcgaacatactatgttaatcatgagagtcgtagaacacaatggaaaaggcctaccccacaagacaacctaacggacgctgagaacgggaatatccagctgcaggcccaacgtgcttttactactcggagacagataagtgaagagacagagagcgtggataacagggaatctagtgagaattgggaaatcattcgcgaggatgaggccacgatgtactctaaccaggcttttccttcacctcctccatcttccaacctcgatgtaccgacccatttggcggaagagctcaatgctcggctcactatctttggtaacagtgctgtgtcccaaccagcgtcttcctccaaccacagtagtagaaggggaagcttgcaagcctacaccttcgaggagcaaccaaccttacccgtgctgttgcccaccagctcgggcctcccccctggctgggaggagaagcaggacgagcgcggccgcagctattacgtggaccacaacagtcgaactactacctggaccaaacccactgtccaggcgacagtcgaaactagccaactgacaagctcccagagcagtgccggccctcaatcccaggcatctacatccgatagtggacagcaggtgacgcaacccagcgagatcgagcaaggctttctgcctaagggctgggaggtccggcatgcacctaacggtcgccctttttttatcgatcacaacacaaagaccaccacctgggaggatccacgcctgaagatccccgcgcacctgcggggcaagacatcattagacactagtaatgatctagggccacttccccctgggtgggaagagcgtacacacaccgatggaaggatcttttacataaatcataacatcaagcggacgcagtgggaggatccacgactcgaaaatgtggccataactggcccagctgtgccttactcccgagactacaagaggaaatatgagttttttagacggaagctgaaaaagcaaaacgatataccaaacaagttcgagatgaagctgagaagggccacagtgctcgaggactcttatcggagaatcatgggagttaagagagccgacttcctgaaggcacgtctgtggatcgagttcgacggggaaaaagggctggactatgggggtgttgctagagagtggttttttctgatatccaaagagatgttcaacccttattacggactattcgaatacagtgccacagacaattacaccctccagataaaccccaactccggtttatgtaacgaggatcacctgtcttatttcaagttcataggcagagtagccggcatggctgtctaccatggcaagctgcttgatggtttctttatcagacctttttacaagatgatgctgcacaaaccgattactttacacgacatggaatctgttgattccgagtactataacagcttacgatggattctggagaatgatccaaccgaactcgacctcaggtttataattgacgaagagctcttcgggcagactcaccagcacgagcttaaaaacgggggctctgaaatcgtggtgacgaacaagaataaaaaagaatatatttatttggtgattcagtggaggttcgtgaacagaatccagaagcagatggcagcgtttaaagagggcttcttcgagctgattcctcaagatttgatcaagatctttgacgagaacgaattagaacttctcatgtgcggattaggcgatgtcgacgtgaacgactggagagagcacaccaaatataagaatggttacagcgcgaatcatcaggtgatccagtggttttggaaagccgttctcatgatggacagcgagaaacgcatcaggctgctacagttcgtcacagggacttcacgtgtgcctatgaatgggttcgcggagctgtatggaagcaacggcccccagagttttacggtggaacaatggggcacccctgagaagttacctcgcgcacatacctgctttaacaggctagacctccctccctatgagagctttgaagagttgtgggacaaactgcagatggctatcgaaaacacccagggtttcgacggggtcgattag

SEQ ID NO: 196844 - DNA, 3912 bp, Artificial Sequence
  Description of Artificial Sequence: Synthetic coding sequence
atggcccagagcctgcggctgcacttcgccgcccggcggagcaacacctaccccctgtccgaaacgtcgggggatgatctggacagtcatgtgcacatgtgtttcaaacggcctacgcggatctctaccagcaatgtcgtccaaatgaaactgacaccaaggcaaactgctcttgccccccttataaaggagaacgtccaatcacaggaacggtcatctgttccaagctctgagaacgtcaacaaaaagtcttcttgcctgcaaatcagcctgcagcccacccgatatagtggttaccttcagtccagcaatgtcctggctgattccgacgatgctagcttcacctgtatcttgaaggacggaatttatagcagtgccgtggtcgataatgagcttaacgctgtgaacgatggccatctggtgtcttccccggccatctgttctggatccttatccaatttcagtacttctgataatggctcatattcaagcaatggatctgacttcggctcttgtgctagcattacatccggaggcagctatacaaattctgtaatttcagacagctcatcatacacctttcctccctcagacgatacatttctcggcggaaacctgccctcagacagcacttccaacagaagcgttcctaataggaataccaccccttgcgagatcttttcccgttccacaagtacagacccgttcgtccaggacgatctagagcatggcctggaaataatgaagctgcccgtgtctcgcaataccaagatccccctcaaacggtattcttccctcgtaattttcccgcgaagcccctctacaactcgacctacctcgcctacctcactgtgtacgttactgtccaagggctcttatcagacatctcaccagttcatcatcagcccttccgaaattgcgcacaacgaggatggaacttctgcaaaaggatttctctccacagccgtgaacggcttacgcctctctaagactatctgcacccccggggaggtacgggacatcagacccctccaccgtaagggctccctccagaagaagatagtgcttagcaataatacccctagacagacagtctgcgaaaaaagtagtgaggggtacagttgcgtatcagtgcacttcacccagagaaaggcagctaccctggactgtgagacaacaaatggtgactgcaaaccggaaatgtccgaaatcaaactgaattcggatagcgaatacataaaacttatgcacagaaccagtgcctgcctcccttcgagccagaatgtggactgtcagatcaacatcaacggtgagttagaacgcccccactctcaaatgaataagaaccacggcattttgagacgaagcatttccctggggggagcataccccaatatatcctgcctgtcctctctcaaacacaattgctctaagggagggccatcacagctgctgattaagttcgcctcagggaatgaaggtaaggtggacaacctgtcacgggacagcaacagggactgtacgaacgagctctctaacagttgcaagacccgggatgacttcctgggacaggttgacgtgccattgtacccactgcctaccgaaaatcctaggttagagcgaccatacacttttaaggacttcgtactccatccccgatcccacaagtcaagggtcaagggatacctgcgtctcaagatgacttaccttcctaagacgagcgggagcgaagatgacaacgctgaacaggccgaggaactggaacagcagcaggaaccttcccccctgcctcctggatgggaggagcgtcaggacatcttagggagaacctactatgtaaaccacgagtctcgtcggacacagtggaaaaggccgaccccccaagataacctcactgacgccgaaaatggtaatatacagctgcaggctcaaagggcattcacaaccagaagacagatctcagaagagactgagtccgtggacaaccgcgagtcaagcgagaactgggaaattatccgcgaggatgaggccacgatgtatagcaaccaagcattcccctccccaccaccttcctccaacttggatgtccccacacacctggcagaagagttaaatgcaagacttactatttttggaaactcagctgtctcccagcccgcctcaagttccaaccactcctcccgccgtgggagcctgcaggcgtacacctttgaggagcagcccaccttgcccgtgctcttaccgactagctccggcctccctccagggtgggaagagaagcaagatgaacgaggaaggtcttattacgtcgaccataactcccgcaccacaacctggacaaagcctacagtgcaggccacagtggaaaccagccaactgacgagttcccagtcttcagccggaccacagtctcaggcctctacttctgattccggtcagcaagttacacaacccagtgagatcgagcaggggtttttgccgaaaggttgggaagtccggcacgcccccaatgggaggcctttttttattgaccataatacaaagacaactacctgggaggatccccggctcaagatcccggctcacctacgggggaaaactagcctggatacatctaacgatctcgggccgctaccacctgggtgggaagaaaggactcacactgacggtcggatattttacatcaaccataacattaagaggacccagtgggaggatccaaggcttgagaatgtggctataactggccctgctgtgccgtactccagggactacaaacgcaagtacgaatttttcaggaggaagcttaaaaaacagaatgacatcccaaataagtttgaaatgaaactgcgccgagccactgtacttgaggatagctatcgccgcataatgggagtgaaaagggccgacttcctgaaagcccgcttgtggattgagttcgatggggagaaagggttggactatggaggcgttgccagggaatggttcttccttatttcgaaggaaatgtttaacccctactatggcctgtttgagtattcagcgactgacaattacacactccaaatcaatccaaatagcggtctgtgcaacgaagaccatctgagctatttcaagtttattggcagggtagccgggatggcagtttatcacggcaaactcttagatggtttctttatcagacccttctacaaaatgatgcttcacaaacccattaccctgcacgatatggaatctgtcgactcagagtactataacagtctgcgctggatcctggaaaacgatcccaccgagctcgatctgagatttatcatcgacgaggagctctttggtcagacacaccagcatgagttgaagaatgggggctcagaaatcgtggtcacaaacaagaacaaaaaagaatatatctacctagtcatacagtggcggtttgtgaaccgtattcagaagcaaatggctgcttttaaggagggattctttgagctgatcccccaggaccttatcaagattttcgatgaaaacgagctggagcttctgatgtgtggcctgggtgacgtagacgttaatgactggagggaacatacaaagtataagaatgggtacagtgcaaaccatcaggtgatccagtggttctggaaggctgtcctcatgatggactcagaaaaaaggatacggctgttacaatttgtgaccggaacctcaagagttccaatgaacgggttcgccgagctctacggatcaaacgggccccagtcattcacggtggaacaatggggtacacctgagaaactacccagagcccacacttgttttaacaggctggatctgcctccctacgagtctttcgaggaactgtgggataagctccagatggctatagagaatacccaggggtttgatggggtggactag

SEQ ID NO: 196845 - DNA, 3960 bp, Artificial Sequence
  Description of Artificial Sequence: Synthetic coding sequence
atggcccagagcctgcggctgcacttcgccgcccggcggagcaacacctaccccctctccgagacttctggggacgaccttgatagtcatgtgcacatgtgttttaagcgccccactcgcattagcactagcaatgtggtgcagatgaaactcaccccaaggcaaaccgccctcgcccccctcatcaaagagaatgtgcagagtcaagagagaagctcagtcccttcctctgaaaatgtgaataaaaagtcttcttgccttcagatatccctgcagcctacacgctactctggatacctccaatcttccaatgtccttgctgacagcgacgatgcttcttttacctgtatcttgaaggacggcatttactcttcagccgttgttgataacgaactgaacgcggttaacgatggtcacctcgtctctagcccagctatctgctccgggagcctcagtaattttagcacatctgataatggtagctactccagcaacgggtctgactttggctcctgcgctagtatcaccagtggagggtcctatactaacagcgtgatctcggatagcagtagttacacattcccgcccagcgatgatacatttttagggggaaacctccccagcgactcaacctcaaaccgaagtgtacctaaccggaacaccaccccttgcgagatattctctcggtctacctccactgatcctttcgtgcaggatgatctggagcacggcctggaaattatgaaactaccagtctctaggaacacaaagattccgttaaagagatacagcagtctcgttatatttccgcgatctccctcgacaactcggccgacttctccaacatcattgtgtaccctgttaagtaagggctcatatcaaacatcacaccagtttatcatcagcccaagtgaaatcgctcataatgaggatggcacttccgcaaaggggttcttaagtacagccgtgaatggcctgcggcttagcaagacgatatgcacacctggcgaagtcagagacatccgccctctgcatcgcaagggatccctacagaagaagatcgtgctgtcaaataatacccccagacagaccgtgtgtgagaagtcctctgaaggctatagctgcgtgagcgtgcattttactcagcggaaggccgctactctcgactgtgaaactacaaacggcgactgtaaacctgagatgtccgagattaagttgaattccgattctgaatacatcaagcttatgcaccgcactagcgcttgtttgcccagcagccagaacgtggattgccagatcaacatcaacggcgagttagagaggccgcattcacaaatgaacaagaaccacggcatactgaggcgctcaatctctcttggaggcgcctatccaaatataagttgtctcagctccctgaagcacaactgctcaaaaggtggcccctcccagcttttaatcaaatttgccagtgggaatgagggtaaggtggataacctcagtagagattcgaatcgcgactgcaccaatgagctgtcgaacagttgcaagacaagggacgacttccttggacaggtagacgtccccctttacccgctccccaccgaaaatccccgcctggagcgtccttataccttcaaggacttcgtgctgcaccctaggtcccacaagtcgcgcgtcaagggctatcttcgcttgaaaatgacttatctgccgaagacaagtggaagtgaagatgacaacgccgaacaagccgaggagcttgagcccggctgggtggttctcgatcaaccggatgcggcatgtcacttacagcagcaacaagagccttccccactcccacctggatgggaagaacgccaggatattttagggaggacttactatgttaatcatgaatcacggcgcacacagtggaagcgacctaccccacaggacaatctgacagacgccgagaacggtaatatacagttgcaggcccaacgcgctttcaccacacgtaggcagatttcggaggagaccgagagcgtggataatcgggagagtagtgagaattgggagatcatacgcgaggatgaagcaactatgtattcaaaccaggcctttcccagccccccaccttcatctaacctcgatgtcccaacacatctcgccgaggaactcaacgcccgacttaccatttttggcaacagtgctgtgagccagcccgcatcatcaagcaatcacagctcacggagaggtagtttgcaagcatatactttcgaagaacagcctactcttcccgtgctgttacctacaagttccggactgccacccggatgggaggaaaagcaggacgagagggggcgctcatattacgtggatcacaactcacgtaccacgacatggaccaaaccaacagtgcaggccactgtagagacctctcagctgacgagcagccagagtagtgccggaccccagtcccaggcctcaacttctgatagtggccagcaggtaacccagcccagtgaaatcgaacaaggattcttgcctaagggctgggaagtccgccacgcaccaaacggccggccattctttattgatcacaatactaagaccactacttgggaggacccacggcttaaaattcctgcacatttgagaggtaagacgtccctagacacaagcaacgacctgggcccacttccgcctggatgggaggagagaactcacacagacggcagaattttttatattaatcataacatcaagcgcactcagtgggaggatccaaggcttgagaatgtggcaatcacaggtccggctgtgccctattctcgggattacaaaagaaagtatgagtttttcagaaggaaacttaaaaagcaaaacgatatcccaaataaattcgagatgaagctgaggcgcgcaacagtgctcgaggattcttaccgccggattatgggcgtgaagcgggccgactttcttaaggcccgtttgtggattgaatttgatggtgagaagggattggactatggcggagtggcgcgcgagtggttcttcctgatatccaaagagatgtttaatccgtattatgggctctttgaatactcagccacagacaactatactttgcagattaaccctaacagtggcctttgcaatgaagatcacctctcttactttaaatttattgggcgtgtcgccggaatggccgtgtatcatgggaagctgctggacggtttcttcatcaggccattttacaagatgatgctccacaagcctatcacactccatgatatggagtccgtggatagtgagtactataattcactccggtggatcttggaaaatgatccgacggagttggacctccgctttatcatcgatgaagaattatttggccaaacccaccagcacgaactcaagaatggcggctccgaaatcgttgtcaccaataaaaacaagaaggagtacatttacctagtaatacagtggagatttgtcaaccgaatccagaagcagatggcagccttcaaggagggcttcttcgaattgattcctcaggatttgattaagatattcgatgaaaatgagttagaacttctcatgtgcgggctaggcgatgtggacgttaacgactggcgggagcataccaaatacaaaaatggatactctgctaaccaccaggtaattcagtggttttggaaggctgtgctaatgatggactctgagaagaggatcaggttgctgcaattcgtcacaggaactagcagggtgcccatgaatggatttgcagaactgtacggctccaatggtcctcagtcatttaccgttgaacaatgggggactcctgaaaagttgcctcgcgctcacacgtgctttaatagactggatctgcccccctacgagtcattcgaggaactctgggacaagctgcagatggctattgagaacacccaaggcttcgatggagtcgattag

SEQ ID NO: 196846 - DNA, 2616 bp, Artificial Sequence
  Description of Artificial Sequence: Synthetic coding sequence
atggccaccggcctgggcgagcccgtgtacggcctgagcgaggacgaaggtgagtctaggattctcagggtaaaggtggtctctggtatagatctcgccaagaaagatatcttcggcgccagcgacccctacgtgaaattgtctttatacgtggcagacgagaaccgcgagttagctctcgtccagaccaaaacaattaaaaaaaccctgaacccaaagtggaacgaagagttttatttccgagtcaacccgtccaatcacagactactttttgaagtgtttgatgagaataggctaacccgggatgattttttgggtcaggtggatgtgcctttgtcacacctgcccaccgaggatcccactatggaaaggccatatacattcaaagattttttgctccgaccacggagccataagagccgcgtgaaaggatttttacgattgaaaatggcgtacatgcccaagaacggcggccaggatgaggaaaacagcgaccagagggacgacatggaacacgggtgggaagttgtcgactcaaatgatagcgcgtcacaacatcaggaagagcttccaccacccccactgccccctggctgggaggagaaggtcgataatctggggcgaacctattatgtgaaccacaataatcgcaccacccagtggcaccgcccctccctgatggacgtgtcatccgagagtgacaataatattcgccagattaaccaggaggcagctcaccgacgattccgatcacgccgacacattagcgaggatctggagccggagccctcggagggcggcgacgtgcctgagccatgggaaacgatttcagaagaggtcaatatcgcgggtgatagcctgggccttgctctgccacctcctcccgcttcccccggatccaggacctccccccaggagttgtccgaagagctgagccgcaggctccagattacaccagatagtaacggcgagcaattcagctcactaatccagcgagaaccaagctccaggctcagatcatgcagcgtgactgacgccgtggccgagcagggccacctgccgcccggcgctaaggattccccagtccgtagggccgtgaaagataccctgtccaatccccagagtcctcagccatcaccttataatagtcctaaacctcagcataaagtgacacaatcatttttgccacccggatgggagatgaggatcgcaccaaacggccgaccttttttcatagatcacaacacaaagacaaccacatgggaggaccctaggctcaaatttcctgtgcacatgaggagtaaaacaagtttgaatccaaacgacttgggccccctgccacctggctgggaggaacgaattcacctcgatggaagaaccttctatattgaccacaactcaaaaatcacccagtgggaagacccacgactgcagaacccagccattaccgggcccgctgtgccttattcccgcgaattcaagcagaagtacgattacttccggaaaaaacttaaaaaaccagcagacatccctaatcgtttcgaaatgaagctccataggaacaatatctttgaagagtcgtaccgtcggatcatgagcgtgaagcgtcccgacgtgctgaaagcccggctgtggattgaattcgagtccgagaaagggttggattacggcggcgttgcacgcgagtggttttttctcctttcaaaggagatgtttaacccctactacggtctttttgagtatagtgcgacagataactataccctgcagataaacccaaactccggtctgtgcaacgaggaccatctgtcctatttcacgttcatcggacgcgtggctggcctcgcagtcttccatggaaagctgctggatggatttttcatccgccctttctacaagatgatgttaggaaagcaaatcactctgaatgacatggagtcagttgactccgagtactacaactcactgaagtggatccttgaaaacgaccctacagaactcgacctgatgttctgcattgatgaagaaaacttcggtcagacctatcaggtggacctcaagcccaatggctccgagataatggtcaccaatgaaaataagcgggagtacattgacctcgtgatccagtggaggttcgtgaatcgcgtccagaagcagatgaacgccttcttggagggattcaccgagctcttgccaatcgacctcattaagattttcgatgaaaacgagctcgaactgctcatgtgcggtcttggggatgtagatgtaaacgactggcgccagcactccatctataagaatggatactgccccaatcatcctgttattcaatggttttggaaggccgttctcttgatggatgcagaaaagcgcatcaggctcctccagtttgttacgggtacaagtagggtgcccatgaatggcttcgcggagctttacggttccaatggcccgcaattatttactattgagcaatggggcagccctgaaaagctgccccgggcccacacctgcttcaaccgcttggatctgcccccctatgagaccttcgaagacttgcgggagaagctgctgatggccgtggagaacgcccagggctttgagggggtggattag

SEQ ID NO: 196847 - DNA, 2508 bp, Artificial Sequence
  Description of Artificial Sequence: Synthetic coding sequence
atggagcggccctacaccttcaaggacttcctgctgcggccccggtcccacaaatcccgagtcaagggctttctccgtctcaagatggcgtacatgccgaagaacggggggcaagatgaggaaaattctgaccaaagggacgacatggaacacggttgggaggtggttgacagtaatgattcggcatctcagcaccaggaagagctccctccgccccccctgccaccaggatgggaggaaaaggtcgataatctcggcagaacttattatgttaatcataacaaccgaacaacccagtggcacagaccgagtcttatggatgtgtcttctgagagcgacaataacatcagacagattaatcaggaggcggcccatagaaggttccgcagtcgccgacacatttccgaggatctggaaccagaaccctctgaaggcggcgacgtccctgagccgtgggaaactataagcgaagaagtgaacatcgccggcgactccctcggcctggcccttccccctccgccggcgtccccaggatctaggacctctccccaggaacttagcgaggagctctctcgcagactccagataacacccgatagcaacggcgaacaattttcctctctcatacaaagagagccctcctcacgcctgagaagctgttctgtgaccgacgctgtggccgaacagggccacctgccccccccttccgttgcctacgtacataccacacccgggctgcctagcggatgggaggagcgtaaggacgccaagggcaggacctattacgtgaatcataacaacagaaccactacctggactcggccgatcatgcagctagccgaggatggagcctccggtagcgccaccaatagcaataatcacctgattgagccccaaatacggaggccaaggtccttgtcatcgccaactgtcacacttagtgctcctcttgaaggcgcaaaagacagtccagttcgacgggccgtcaaggacacactgagtaatccacagagcccccagcctagtccttacaactcccctaagccacaacacaaagtgacacagtctttcttacctccggggtgggagatgcggatagcgcccaatggtaggcccttctttatcgaccacaacacgaaaaccacgacctgggaagacccgcgtctgaagtttcccgtacacatgagatcaaagaccagtctgaatccaaatgacctgggccccctccccccaggctgggaggagcggatacatttagacgggaggactttctacatcgaccacaacagcaagatcacacaatgggaggaccctcgactgcagaaccctgccatcaccgggccaaaagcagtgccgtacagtagagaattcaagcagaaatatgactactttagaaaaaaactgaagaagcccgctgatatacctaaccgctttgagatgaagctccaccggaacaacatttttgaggagtcctaccgccggattatgtccgtgaaaaggcctgacgtgctgaaggcaaggttatggattgaattcgagagtgagaaggggctggactacggcggcgtggctcgagagtggttctttctactctctaaagagatgtttaatccgtactatggcctgtttgagtattcagcgaccgacaactacacgctgcagataaacccgaactctggcctgtgcaacgaggatcacctttcttattttaccttcatcggacgcgtcgcagggttagccgtttttcacggcaagctgctggacggcttcttcatccggcccttttacaagatgatgcttggcaagcagatcactctcaatgacatggaaagcgtggactcggagtactacaactccctgaagtggatcctggagaacgatccaacagagctggacttgatgttttgtattgacgaggagaattttggtcagacataccaggtggatctgaaacccaacggctccgaaatcatggttacgaacgagaacaagagggagtatatcgatctagtgatccaatggcgctttgtcaacagggtccagaaacagatgaatgcatttctcgaaggcttcaccgagctgctcccaatcgacttgattaaaattttcgacgagaacgaactcgagctgctaatgtgcggcctcggggacgtagatgtaaatgactggcgtcagcactctatatacaagaatggctattgcccaaatcacccagtgatccagtggttctggaaagcagtgttattaatggacgccgagaagaggatacgactgctgcagttcgtcactggtaccagtagggttcctatgaacggttttgccgagctctatggatcaaatgggcctcagttgttcaccatcgagcaatggggttctccggagaagctgccaagggcccacacttgttttaaccgcttggacctcccaccttatgaaacttttgaggacctgcgcgaaaaattgttaatggccgtagaaaatgcgcagggatttgaaggcgtggattag

SEQ ID NO: 196848 - DNA, 2736 bp, Artificial Sequence
  Description of Artificial Sequence: Synthetic coding sequence
atggccaccggcctgggcgagcccgtgtacggcctgagcgaggacgagggtgagtctagaattctgagagttaaggtcgtttcaggtattgatctggcaaaaaaggacatctttggggcctcagatccctatgtgaagctgtctctgtacgtggccgatgaaaaccgagaactggctctggtgcagaccaagactatcaagaagacactgaatcctaaatggaatgaggaattttattttcgcgtgaatccaagcaaccatcgtctgcttttcgaggtattcgacgaaaaccggttgacgagagatgatttcttgggccaggtggacgtgcctctttctcatctgccgaccgaagaccccaccatggagaggccttacacttttaaggacttcctcctgagacctcggtcccataaatcccgggtcaagggctttcttcggttgaaaatggcatacatgccaaagaacggtgggcaggacgaagaaaactccgatcagcgtgatgatatggagcatggttgggaggtggttgactctaatgactccgcatcccagcatcaggaagagctgccgcctccaccactgcccccggggtgggaggagaaagttgataatctgggacggacatattatgtcaatcataacaatcgcaccacacagtggcaccggccgagcctgatggatgtgtcctccgaaagcgacaacaatatacgacagatcaaccaggaagccgcccatcggcggttcaggagtagacggcacatctctgaagacctggagccagaaccctccgagggaggggatgtacccgaaccctgggagactatctctgaagaagtgaacatcgcgggagacagcttgggactcgctttgcccccccctcccgccagccccggcagcagaacatcaccccaggagctgtcagaagaactcagccgtcgactgcaaattactccagacagcaacggggagcagttctctagtctgatccagcgggaaccatccagtcgattgagaagctgttccgtcactgatgcagttgccgaacagggacatctgcctcctcttgccgaggacggggcttccggaagcgcaaccaacagcaacaatcacctcatcgaaccccagattaggagaccgagatcactctcttctccgacggttacactgtccgcacccctagagggagccaaggacagtcccgtccggagggccgttaaggacactctgtccaatccgcaatcgccccagccctctccgtacaatagccctaagccccagcataaagtaacgcagtcatttttgccccctggctgggagatgagaatagccccgaacgggcgccccttttttatcgaccataacaccaagacaacaacatgggaagaccctcgattaaagtttccagtgcacatgcgttcgaagacatctctgaatcccaatgacctaggacccctccctcctgggtgggaggaacgaatccacctggacggacgcacgttctatatcgaccacaactctaagattactcagtgggaagatccgagattgcagaatcctgccataacgggccctgctgtgccctattccagagaatttaagcagaaatatgattatttccgcaagaagctcaaaaaacctgcggacatcccaaaccggtttgagatgaaactgcatcgtaacaatatcttcgaggagtcttacaggcgcatcatgtcagtcaagcgacccgatgttttgaaggcacggctgtggattgagtttgagtctgaaaagggtctggattatggaggtgttgcccgggaatggttttttctactgtccaaagagatgttcaacccatactatggcctgttcgaatacagcgctacagataattacaccttgcagattaaccccaactcaggcctctgcaacgaagaccaccttagctatttcacttttataggcagagtggcaggcctggccgtgttccacggtaaactccttgacggctttttcattagacccttttataaaatgatgctcgggaagcaaattactttaaacgacatggaaagcgtggacagcgagtactataacagcctgaagtggattctcgaaaacgacccgaccgagctggacctaatgttctgcattgacgaagagaatttcggccagacgtaccaagttgacttaaagccgaacggctctgaaatcatggtaaccaatgaaaacaaaagagagtacatcgatctcgtgatccagtggaggttcgtgaacagggtccagaagcagatgaacgcattcttggaaggtttcaccgaactccttccgatcgatctcataaagatctttgacgaaaatgagttggagctcctgatgtgtggattaggggatgtggacgtcaacgactggcggcagcattcaatctataagaacggatactgtccaaatcaccctgtgatccagtggttttggaaggctgtgcttctgatggatgctgagaaacggattagactcctgcaattcgttaccgggacgtctagagtccccatgaatgggttcgccgagctgtacggctcaaatggcccccagttgttcaccatcgaacagtggggttcacccgaaaagttgcctcgcgcacacacttgctttaacagactagacctccccccgtatgagacatttgaagacttacgggagaaactgctcatggccgtcgagaacgctcagggtttcgagggagtggattag

SEQ ID NO: 196849 - DNA, 2904 bp, Artificial Sequence
  Description of Artificial Sequence: Synthetic coding sequence
atgcggcggctggccttcgagcagggcgagagccggatcctgcgggtcaaagtggtgtctggtatcgacctggccaagaaggatattttcggcgcctctgacccttacgtcaaactgtctttgtacgtagccgatgaaaatagagaacttgccttagtgcagacgaagacgataaagaaaaccctgaatcctaaatggaatgaagaattttactttcgcgtgaatccaagcaaccaccgattactgttcgaagttttcgacgagaatcggctgaccagggatgactttctcggccaggtcgatgttccgttgagccacctccccactgaagatccaacaatggagcgcccgtacactttcaaagatttcctcctcagaccacggagtcacaagtctcgtgtgaaaggattcttaaggctgaagatggcctatatgccaaagaacggcggccaagacgaggaaaatagtgaccagagggacgatatggaacatggctgggaagtagtggatagcaacgactccgctagccagcatcaggaagagctcccacctccccccctaccaccaggctgggaagaaaaggtcgataatctcggaaggacttattatgttaaccacaataatcgaaccacccagtggcatcgaccaagtctgatggatgtttcatcagagtctgacaataatataagacagattaatcaggaggcagcccatcgacgtttccgcagccgtcggcatatctcagaggacctggagcctgaaccctctgagggtggtgatgtccctgagccatgggaaactatctctgaggaggtgaatatcgctggtgactcccttggactggccttgccgcctcctccagcatctccggggtctcgaacctccccacaagagctcagcgaagagctttcaaggcgactgcagatcactcctgactccaacggagaacaattcagtagcctaatacagagagagcccagctcccgcctgagaagttgctcagtgaccgatgctgtcgccgaacagggccacctaccgccacctagtgctccagccggacgcgctcgctcctctaccgtcaccggtggcgaagaacccaccccaagcgtcgcctacgtgcataccactcccgggcttcctagcgggtgggaggagcgcaaggacgcaaagggccggacttactacgtaaatcataataatcgcacaactacatggacacgcccaattatgcagctcgctgaggacggggccagtggtagcgccaccaactctaacaaccatctgattgagccacagattagaaggccccgatcactgagctcaccaaccgtgactctgtctgcgcccctggagggagcaaaagattcccccgtccggagggcagtcaaggacacattgtcaaaccctcaaagcccccagccatctccttataatagcccaaagccacagcacaaagtcactcagtcattcctgccccctggctgggagatgcggatcgcccctaacgggcggcctttcttcattgatcacaatacaaagaccactacttgggaagatccacggcttaagttcccagtgcatatgcggtccaagacgtctctcaaccccaatgatctggggcctctcccccccgggtgggaagagcgcatccacctggatggaagaacattttacatcgatcacaatagtaagattacccaatgggaagacccccgcctgcagaaccccgctattacagggcctgcggtgccctacagccgtgaattcaaacaaaaatatgattactttcggaaaaaattgaaaaagccagctgacatccccaatcggtttgagatgaaactgcatcggaacaatattttcgaggagtcttaccggcgcataatgtcggtaaagagaccggacgtcctcaaagccaggctgtggattgagttcgaatccgaaaaaggcctggattatggaggagttgcacgtgagtggttttttttgctctctaaggagatgttcaacccttattatgggttattcgagtacagcgctactgacaattatacactacagatcaaccctaacagcggattgtgcaatgaggatcacctgagttactttacctttatcggtagggtagccggactcgcagtgtttcacgggaaattattggacggattttttattcggcccttctacaaaatgatgctgggtaagcagatcacactgaatgacatggagtccgttgatagtgaatactataattctcttaaatggattctggaaaacgatccgaccgagcttgatttgatgttttgtattgatgaagagaactttggccaaacataccaagtggaccttaaacctaatggctccgagatcatggtgacgaacgagaacaaacgggaatacatagatttggtgatccagtggagattcgtgaaccgcgtgcaaaagcagatgaacgcgttcctggaagggttcaccgagctactgccgatcgacctgataaaaatattcgatgaaaatgaactcgagctactgatgtgtgggttgggcgatgtcgacgtgaacgattggaggcagcatagcatttataaaaatggctactgtccaaatcacccagtaattcagtggttttggaaggcagttctgctgatggacgcggaaaaacgaattaggcttctgcagttcgttaccggtacatcacgcgtgcccatgaatggatttgcagagctctacgggagcaacgggccccagctgtttaccatagaacagtggggctcaccagagaaattaccccgcgcgcacacatgttttaaccgcctggatctgccaccctatgagacgttcgaggatctgagagagaagctcttgatggctgtggagaacgcccagggctttgaaggggtggactag

SEQ ID NO: 196850 - DNA, 2868 bp, Artificial Sequence
  Description of Artificial Sequence: Synthetic coding sequence
atggccaccggcctgggcgagcccgtgtacggcctgagcgaggacgagggagagagccgcatccttagagttaaggtggtaagtgggatcgatttagccaaaaaggacatctttggcgcctccgacccctatgtgaagctctcactgtacgtggccgatgaaaatagggagctcgccctcgtgcaaaccaagacaatcaagaagacgttgaatcctaaatggaacgaggaattctattttagagttaatccaagtaatcatcggctgctctttgaagtcttcgacgaaaatagattgactcgggacgattttctcgggcaggtggatgtgccactatcacacttgccaacagaagaccctactatggaacgaccgtatactttcaaggactttcttcttcgccccagaagccataaatcgagggtgaagggttttctgcgtttgaagatggcctatatgcctaaaaacggcggccaggacgaagaaaacagtgaccagcgggatgacatggagcacggatgggaggtcgtcgattcgaatgacagtgcctcacagcatcaggaagaactccctccccccccactgccacccggatgggaggaaaaggttgacaaccttggaagaacctattacgttaaccacaacaacaggacaacccagtggcatcggccctcactgatggacgtgtcatcagaatctgataacaatatcaggcagattaatcaagaggctgcccaccggaggttcaggtccaggaggcatatttcagaagacttggagccagaaccatccgaaggcggtgacgtccctgagccgtgggaaactatttccgaagaagtgaacattgctggggattctctgggcctcgccttgcctcctcctcctgcctcacctggctctagaacctccccccaggagcttagtgaagagttgagtcggcgcttacagataacccctgatagtaatggagagcagttctcaagtctgatccaaagagagccaagtagccgccttcgaagctgttctgtgacagatgcagtcgccgaacagggacacctccctccaccatccgttgcctacgtgcatactaccccaggtctcccgtctgggtgggaggagcgaaaggacgctaagggccgaacctactacgtgaatcataacaacagaacaactacgtggactcgacctatcatgcagctggcagaagatggagcatccggaagtgctacaaatagtaacaaccacctgattgagccacaaataagaaggcctagaagcctatcaagccctacagttactcttagcgcccccctggagggggctaaggacagcccggtgaggcgcgccgtgaaagacacactgagcaacccgcagtcaccgcagccgtcaccttataattcgcccaaaccccagcataaggtgactcagagtttcctacccccaggctgggaaatgcgcattgctcctaacggcagacccttttttattgatcataacaccaagactacaacatgggaggacccaaggctgaagtttcccgttcatatgcgcagcaagacatccctgaacccaaacgatctcggccccctcccccctggatgggaggaacggatccacctcgacggccgcacgttctacattgaccataacagcaaaattactcagtgggaagatccaagactacagaaccctgcaatcaccggacccgccgtgccgtacagcagggaatttaagcagaagtatgactattttagaaaaaagctcaagaagcctgcggatattcccaaccgtttcgaaatgaaactgcatcggaacaacattttcgaggaatcttaccgccggatcatgtctgtcaagcgtcctgacgtgttgaaggctaggctctggattgagttcgaatccgagaaagggcttgactatggaggagtagcccgcgagtggttcttccttctgagtaaagaaatgtttaacccatactatgggctgtttgagtattcagccaccgacaactacaccttgcaaattaatcccaattccggactctgtaatgaggatcatctttcctatttcaccttcataggcagggtagcaggattagccgtgtttcacgggaagttgctggacgggttttttattaggcccttctataaaatgatgctggggaagcaaatcactctaaacgacatggaaagcgtcgattcggaatattataattccctgaaatggatcctggagaatgatcccaccgagttagacctgatgttttgtatcgacgaagaaaactttgggcagacttatcaggttgaccttaagcctaacggctctgaaatcatggtcaccaatgagaataaacgcgagtatatagatctggttatccaatggcggttcgtgaaccgtgttcagaagcagatgaacgcattcctcgagggttttaccgagctgctgcccattgatctgatcaagatcttcgatgagaacgaacttgagctcctgatgtgcggcctgggtgacgtggatgtgaatgattggcgccagcactcaatttataagaacggatactgcccaaaccatcccgtgatccaatggttctggaaagccgtgttactgatggatgctgaaaagaggatccgattgctccagtttgtcaccgggacatccagagtccccatgaatggcttcgctgagctctatggctcgaacggacctcagctatttacaatcgaacagtggggatcccccgaaaagttaccaagagctcatacgtgcttcaacaggctcgacttacccccttacgagactttcgaggatctgcgtgagaagctgctaatggcggtcgagaacgcacaaggatttgagggcgtcgattag

SEQ ID NO: 196851 - DNA, 2928 bp, Artificial Sequence
  Description of Artificial Sequence: Synthetic coding sequence
atggccaccggcctgggcgagcccgtgtacggcctgagcgaggacgagggcgagagcagaatcctgagagtcaaggtggtctccggcattgacttggcaaagaaagatatctttggggcgagcgatccatacgtgaagctcagcctttatgtggccgacgaaaaccgcgaactggccctagtacagactaaaactattaaaaagaccttgaaccccaaatggaacgaagaattctactttagggtgaacccctctaatcacagattacttttcgaggttttcgacgaaaacaggttgacaagggacgacttcctcggacaagtggatgtcccactgagtcaccttccgaccgaggatccaacgatggagcgcccatatacctttaaggattttcttctccggcctcggtcacacaagtctcgagtcaaggggttcctgagactgaagatggcatacatgcctaaaaatggcggccaggatgaagagaattcagaccaaagggacgatatggaacacgggtgggaggtggtggattccaacgactcagccagtcagcaccaggaggagttacctccacctcccctgcctcctgggtgggaggaaaaggtggataatttaggtaggacctattatgttaatcacaataaccgcacaacccagtggcaccgcccatcactcatggacgtatcaagcgaatctgataacaacattcggcagataaatcaggaggccgctcatcgccggtttaggagcaggagacacatatcggaggatctggaacctgaaccatctgagggaggcgatgttccagaaccttgggagacgatatccgaggaggtgaacatcgcaggcgattccctggggttagccctacctccgcctccagcaagtccagggagcagaacaagcccccaggaactatctgaggagttgtcccgcagacttcaaattactccggatagtaacggcgaacagttcagtagcctgatccaacgcgaaccctcatcaagactgcgcagctgctcggtaacggacgcagtggctgaacaggggcacttgcctccacccagcgcccctgcagggagagcccgaagtagcaccgtgacagggggggaagaacctacccctagcgtggcttatgttcacactacgcccggattacccagcggctgggaggagcgcaaggacgctaaggggaggacgtactatgtgaaccataacaacaggacaacaacttggactcggccaataatgcagctcgccgaggacggcgcttccggaagtgccacgaatagtaacaaccacctgattgaaccacagattagacggccaaggtctctgagttccccgactgtaactctcagcgccccactcgaaggcgctaaagattctccggtgagacgggccgtcaaggacaccctctctaacccccagtctcctcagccctcgccctataactcccctaagccccagcacaaagtgacacagtccttcttaccacccggatgggagatgcggatcgctccaaatggacgccctttttttattgaccataataccaagaccaccacatgggaagaccccaggcttaagtttcctgtgcatatgcgctcgaagactagtctgaacccaaatgacttgggtcctctcccgcccggttgggaggagcgaatccacctcgacggccggacattctatatcgaccataactctaaaattacccagtgggaggaccctaggctgcagaatcctgctataaccggcccagctgtgccatacagcagggaatttaaacagaagtatgattacttccgaaaaaaactcaaaaagcctgcggatatccctaatcgctttgaaatgaagttacaccgtaataatatattcgaggagtcctaccgacggattatgagcgttaagaggccggacgtactgaaggcccggctatggattgaatttgagtctgaaaaaggtctggactatggaggggtcgcgcgagagtggttttttctgctttctaaggagatgtttaacccctactacggtctcttcgagtattcagccacagacaattacactctgcaaatcaaccccaactcgggcctgtgcaatgaggatcatctctcctactttacattcatcggtagagttgctggcttggcagtgtttcatgggaaactgcttgatggattctttatcaggcctttctacaagatgatgcttgggaaacagataacactgaacgacatggagtcagtggactccgaatactacaattctttgaagtggattctcgaaaatgacccaacagagctggacctgatgttctgtatagacgaggaaaactttggacagacatatcaggtggacctgaagcccaacggcagtgagattatggttacaaatgaaaacaagcgtgagtacattgaccttgtgatccaatggcgcttcgtgaaccgcgtgcagaagcagatgaacgctttcctcgaaggattcactgaactcttacccatcgacctgataaaaatattcgacgagaatgagttggagctgttaatgtgcggcctgggagacgtggacgtcaatgattggcggcaacacagcatttataagaacggatattgtccaaaccatccagtgattcaatggttttggaaggctgtgctgctaatggatgcggagaaaaggatccgcctcctacagttcgtgaccggtacttcgcgggtacctatgaatggcttcgccgaactgtatggcagcaacggaccccagctgttcactatagaacagtggggttcccctgaaaaactgcctcgcgcccacacatgtttcaatcggctggatttacccccatacgagacctttgaggatttgagagagaaattgcttatggctgtcgagaatgcccaaggtttcgagggagtggattag

SEQ ID NO: 196852 - DNA, 2565 bp, Artificial Sequence
  Description of Artificial Sequence: Synthetic coding sequence
atggagcggccctacaccttcaaggacttcctgctgcggccccggagccacaagtctcgtgtaaaggggtttcttaggttgaagatggcttatatgccaaaaaatggtggacaagacgaggaaaatagtgatcagcgtgatgatatggaacatggatgggaggttgtcgattccaacgacagtgcatcccagcaccaggaagaattaccacctcctcccctgccaccaggctgggaagagaaggttgataacctgggccgaacttactatgttaaccataataatagaaccacacagtggcaccgcccaagcctgatggatgtctcctcagagtctgacaacaacatccgacaaataaatcaggaggcagcacacaggaggtttcggagccggcgacacatctctgaggacctggaaccagagccttcagagggaggtgatgtgccggaaccttgggaaaccatcagtgaggaggttaatattgccggagactctttaggcctggcgctgccccctccacccgcttcccctggttcccgaacttccccccaggagctgagcgaggagttatctcggcggctgcaaatcacaccagacagtaatggagaacagtttagcagcttgatccagcgcgagccgtctagcagacttagatcctgctctgtgacggacgcagtggctgagcagggacacttgccacctcccagcgcccccgctgggagggcgcgatcttctaccgtgaccggcggggaagaaccaactcccagcgtggcctatgtccacacgactcctggtctgccatccggatgggaggaaagaaaagacgcaaaggggaggacttactacgtgaaccacaacaaccgaaccactacatggacgaggccgataatgcagctcgctgaagacggcgccagcgggagtgccacaaactctaataaccacctgatagagcctcagatcaggcggcctagaagcttatcctccccaaccgtgacccttagcgcaccgttggagggggcgaaggactcccctgtgcgaagagctgttaaagacactctctctaatcctcaatccccacagccctcaccttataactcacctaagcctcagcacaaggtgacccagagttttctcccacccggatgggagatgaggatcgcacccaatgggaggcctttctttattgaccacaacacaaagacgacgacctgggaagatccacgccttaagtttccagtgcacatgcggagcaagacttcgttgaaccccaacgatctggggcccctgccccctggatgggaagaacgaatccaccttgatggacggacattctacattgaccataactccaaaataacccagtgggaagatcccagattacaaaatccagccataacaggcccagccgtcccctattccagagagttcaaacaaaaatatgactattttagaaagaagcttaagaagccggccgacattcctaaccggttcgaaatgaagctccaccgaaacaacatctttgaagagtcctatagacgaatcatgagcgtgaagaggcccgatgttctgaaggcacgcctctggatcgagttcgagagcgagaagggtctggattacggcggagttgcccgagagtggttcttcctcctgtctaaggagatgttcaatccgtactacggtctgttcgaatattctgctaccgacaattacactctgcagattaaccccaattctggtttatgtaatgaagatcatctctcttattttacgttcatagggcgggttgcagggttggcagtgttccacgggaagcttctggacggcttctttatcaggccattttacaagatgatgctcggcaagcagattactctgaacgatatggaatccgtggactccgagtactacaactccttgaaatggatactcgagaatgatccaaccgagctcgatctgatgttttgtattgacgaggagaattttggccagacctatcaggttgatctaaagccaaacggaagtgagatcatggtgacaaacgagaataaacgcgagtatatcgatctggttatacagtggaggttcgtcaacagagtgcagaaacaaatgaacgcgttcctagaaggcttcaccgagctgctgccaattgacctgataaaaatttttgatgagaatgaactggagctcctcatgtgcggactgggcgacgtcgatgtaaacgactggcggcagcacagcatctacaagaacggatactgtcctaatcaccctgtcattcagtggttttggaaagccgtattgctgatggacgccgagaaacggataaggttgttgcagtttgtaacggggacctcgcgggtgccgatgaacggttttgcggagctttacggatctaacggtcctcagctgttcactatagaacaatggggtagtccagagaagctgcctcgggcgcacacgtgcttcaaccggctcgacttgcccccgtacgagacatttgaggacctccgggagaagttgttaatggcagtggagaatgcccagggattcgagggtgtggattag

SEQ ID NO: 196853 - DNA, 2505 bp, Artificial Sequence
  Description of Artificial Sequence: Synthetic coding sequence
atggagcggccctacaccttcaaggacttcctgctgcggccccggtctcacaagtccagggtcaaggggttcctgcggttgaaaatggcgtacatgccgaagaatggtggccaggatgaagaaaactccgaccagagagacgatatggaacacggttgggaggtagtcgacagtaacgatagcgcaagtcagcatcaagaagaactgccaccaccacccctgcccccaggatgggaggaaaaggtagataacttgggccgcacatattacgttaaccacaacaacaggacaactcaatggcaccggccctcgctgatggacgtgtcctccgagtccgataacaatatcaggcagattaatcaggaggccgcccataggagattccggtcccggcgacatattagtgaagatcttgagccagaacctagcgaggggggcgacgttcccgagccctgggagacaatatcggaagaggttaacatcgcgggcgacagcctgggactcgccctgcctcctccccctgccagtcctgggtctaggacttctccacaggagttgtctgaggaactaagcagacggcttcaaataacacctgattcaaacggcgagcagttcagcagcttgatccagcgagagccctcatccaggctgcggtcatgcagtgtgacagacgcagttgcggagcaaggacacttgcccccaccttccgtggcatatgtacatacgacacctggactgcccagcggatgggaagaaagaaaagatgccaaggggagaacctactatgtcaaccacaataatcgtaccactacctggacgagaccgatcatgcagctggcggaagacggcgcctccggcagcgctactaactccaataaccacctgattgagccccagatccgtcgtccaaggtccctgagcagccctaccgtaaccctgagcgctccgttggaaggagccaaggatagccccgtgagacgggctgtgaaggacaccctctcgaatccacagagccctcagccaagcccctacaactctccaaaaccacagcataaggtgacccagtcattcttaccccctggatgggagatgcggatcgccccaaacgggcggcccttctttattgaccacaatacaaaaaccaccacatgggaagacccgcgcctaaagttcccggtccatatgcggtcgaagacttcactgaatcctaacgatctggggcccctcccaccgggttgggaggagaggatccacttagacggcagaaccttttatatcgatcacaactcaaaaatcacacaatgggaggacccccgcctgcagaacccggcaattacaggacccgctgtgccctactcaagagaatttaagcagaagtacgattatttcagaaagaagctcaaaaaacctgctgatatccctaaccggtttgagatgaagcttcatcgaaataatattttcgaagagtcttaccgccgcatcatgtccgtgaagaggcccgatgtgctgaaggctcggctctggatcgaattcgagtcagagaaaggtctcgattacggaggcgttgccagggagtggttttttctgctaagtaaggaaatgttcaacccttattacggcttatttgaatatagcgccactgacaattatactctccaaattaaccctaatagtggtctctgcaatgaggatcacctcagctactttacattcattggacgggttgctggattagctgtgtttcatggcaagctgctggacggtttttttatccgcccattctataaaatgatgcttggcaaacagataactctgaacgacatggaaagcgttgattccgagtattacaatagcttgaaatggatcctggagaatgacccaaccgagctcgatctgatgttctgcatagatgaagaaaactttggacagacatatcaagttgaccttaagcccaacgggtcagaaatcatggtgactaacgagaataaaagagaatatattgatctggtgattcagtggaggtttgttaatcgggttcaaaaacagatgaatgcttttttggagggttttactgagctgttaccaattgacctcatcaagatttttgacgagaatgagctggaattgctgatgtgtggcctcggggacgtcgatgtcaatgattggcgccagcactcaatctacaagaatggctactgccccaatcacccagtgatccagtggttctggaaggccgtgctgctaatggacgccgagaagaggatacgcctgttgcagttcgtgactgggacttcacgcgtgccgatgaacggtttcgccgaactatatggaagcaatggcccacagctttttactattgagcagtgggggagccctgagaagctgccacgggcccacacctgctttaaccggctggacttaccaccatacgagaccttcgaggatctgcgcgaaaaactactcatggcagtcgagaatgcccaggggtttgagggcgtggattag

SEQ ID NO: 196854 - DNA, 2505 bp, Artificial Sequence
  Description of Artificial Sequence: Synthetic coding sequence
atggagcggccctacaccttcaaggacttcctgctgcggccccggagccacaagagccgtgtcaaaggcttcctccgcctaaaaatggcatacatgcccaagaacggtggccaggacgaagaaaattccgaccaacgcgacgacatggagcacgggtgggaggtggtcgatagtaatgattccgcctcacagcatcaggaggaactgccacccccgcctctccctcccggctgggaggagaaagtggataatctgggaagaacctattatgtgaaccacaataaccgcactacacaatggcatcggcctagcctgatggacgttagctccgaatctgacaataatattaggcagatcaatcaggaggccgcccatcgaaggttccgatctcgcaggcatatctctgaagacctcgaaccggaacctagcgagggcggagacgtccctgagccctgggagaccatttctgaggaagtgaatatagccggagattctctgggactggcactcccacctcctccggctagccccggctcaagaaccagcccgcaggaactatcagaagagctcagcagaagactacagatcaccccagattccaatggggagcagttcagctctctcatacagcgggagccctccagccgactgcgcagttgttccgtgacagatgccgtggccgaacagggacatctgccacctcctagcgtagcctacgtacacaccacgccggggttaccttcaggttgggaagagaggaaagacgccaaaggacgtacttattacgtgaatcacaataaccgtactaccacgtggacccgtccaatcatgcaattggccgaggacggagcgtcaggctctgctaccaactcaaataatcatttaatcgagccgcagataaggcggcctcggtctctgtcttcgccaacagtgaccctgtctgccccactggagggggcaaaagactctcctgtccgtcgtgccgtcaaggatactctctcgaatcctcagtcgccccagccctctccatacaattccccaaagcctcaacataaggtgactcagtcctttcttccccctggttgggagatgagaatagcaccaaacggccgcccgttctttatagaccataataccaagacaacaacgtgggaggacccccggcttaaatttccggtgcacatgagatctaagacgagcctgaacccaaacgacctcggcccattacctcccggatgggaagagagaattcatctcgatggacgtaccttctatatcgaccacaacagcaaaattacacagtgggaggatccccgactccagaaccctgcgatcaccggacctgccgtcccgtatagtcgggaattcaagcaaaaatatgactatttcagaaagaagctgaagaagcctgccgatatccccaatcggtttgaaatgaaactgcaccgtaacaacatttttgaagagagttatagacgcatcatgagtgtaaaacgccctgatgtattaaaggccagactctggattgaattcgagtctgagaaaggccttgactacggtggggtggctcgggagtggttttttctcctgtcaaaggaaatgttcaatccatattacggtctgttcgaatactctgccactgataactatactctgcagattaatcctaactccggcctgtgcaatgaagatcacttgagttactttacgttcattggaagggtcgccggactcgcagtctttcacgggaagttgctcgacggatttttcataagaccattctacaaaatgatgctggggaaacagattactcttaatgacatggagagcgttgacagcgagtattacaatagcctcaagtggattctggagaacgatccaaccgagctcgacctcatgttctgtatcgatgaagaaaacttcggtcagacgtaccaggtggatcttaagcccaatggaagcgaaataatggtgacaaacgagaataaacgagagtatattgacttggtgatacagtggcggttcgtgaatcgtgttcagaaacagatgaatgcattcttggaaggattcaccgaactgttaccaattgacttgatcaagatatttgatgagaacgaactggaactgcttatgtgcgggcttggcgatgtagacgtcaacgactggcgccagcactcgatatataaaaatggctactgccctaaccaccccgtcattcagtggttttggaaggcggtcctactgatggacgcagaaaagcgtatccggcttttacaattcgtgacagggacttcccgcgtgcccatgaacgggtttgcagagctctatggatccaacggaccgcagctgttcaccattgaacaatggggctcgcctgagaagctccctcgagcccacacttgtttcaatcggctggacctacctccatacgagacattcgaagatttgcgggagaagctgctgatggcggtggagaacgcccagggcttcgaaggagtggattag

SEQ ID NO: 196855 - DNA, 2565 bp, Artificial Sequence
  Description of Artificial Sequence: Synthetic coding sequence
atggagcggccctacaccttcaaggacttcctgctgcggccccggtcccacaaaagcagagttaaagggtttcttcgtctaaagatggcttatatgcctaagaatggcggtcaggacgaagagaattctgaccagagggacgacatggagcacggatgggaggtcgtggattcgaatgatagcgcaagccagcatcaagaggagttgcccccgcccccactcccgccagggtgggaggagaaggtggataacttaggacgaacctattacgtaaatcacaacaacaggactacacagtggcatcggccgtctctgatggacgtgtcaagtgaatcggacaacaacatccggcaaatcaatcaagaagccgcccacaggcggtttagaagccggagacatatttccgaggatctggaaccagaaccttccgaaggtggggatgtgcccgagccatgggaaaccatctcagaagaagtaaatatagctggtgattccttggggctcgctctccctccaccccccgcatctcctggtagcaggacgagccctcaggagttaagcgaagaattatcccgacgcttgcagattactcccgattcgaacggcgaacagttctcttcgctcattcaaagggagccatcatcacggcttcggtcatgttctgtaaccgatgctgtggccgaacaagggcatctgcctccaccatcagccccagcagggcgcgctaggagcagcactgttacaggcggcgaagagccaactccgtcagtggcctacgtgcatacgaccccaggtctgccttcggggtgggaggaaagaaaggacgcaaaggggagaacctactacgtcaaccacaataatcggaccaccacgtggacgcgccctatcatgcagttggcagaggacggagcctcaggatcagcaacaaattctaacaaccacttgatcgaaccacagataagacgccctcgatctctgtcttccccgacagtgaccctatcagcgcctctggagggcgcgaaggactctcctgtcaggagggccgttaaggacaccctgtcaaatcctcaaagtcctcaaccctcaccttacaattccccaaaaccacagcataaagtcacccagagtttcctacccccggggtgggaaatgaggatagcgccgaacggccggccattcttcattgaccataacacaaaaactacgacgtgggaggaccctcggctcaaatttcccgtgcatatgagaagtaagacctctttgaacccgaatgatcttggacctctccccccaggatgggaggagcggattcacctggatggtcgaaccttttacatcgaccacaactctaaaatcacccagtgggaggatcccaggcttcaaaatcccgctataacaggccctgccgtcccatattctcgtgaatttaagcagaagtacgactatttcagaaagaaactgaagaaaccagccgatattcccaaccgctttgaaatgaagttgcaccgcaataatatcttcgaagagagctatagacggatcatgtcggtgaagagaccagatgttcttaaagccaggctgtggatcgaatttgagtcagaaaagggtctggattacggaggcgtggcacgtgagtggttcttcttactctcaaaggaaatgttcaacccatattacggcctattcgaatatagcgcaacagataactacacactccaaatcaatcctaatagcgggttatgtaatgaggaccacctatcttactttaccttcatcggtagggtggcagggctagccgtattccatgggaagctgctggacggtttctttattcgacccttttacaagatgatgctcgggaagcagattacacttaacgacatggaaagcgtggattccgagtactacaacagtctgaagtggatcctcgaaaacgatcctaccgagctggacttgatgttctgcatcgatgaggagaattttggtcagacttaccaagtggatctaaagccaaacggttccgaaattatggtgacaaacgaaaacaagcgcgaatatattgaccttgttattcagtggcgattcgttaatcgggtccaaaagcaaatgaatgctttcctagaagggttcacagagctgcttcccattgacctcattaagatattcgacgaaaacgaactggaactcttgatgtgcggtctcggcgatgtggacgtgaatgattggcggcagcactctatttataaaaacgggtattgcccgaaccaccccgtgatacaatggttttggaaggctgtgttgttaatggatgccgagaagcgaataagactgctgcaattcgtcacaggaacatcacgcgtgcccatgaatgggtttgcagaactctacggctctaacggcccccagctgtttactatcgagcaatggggaagccctgagaaacttccccgcgcccatacatgctttaaccggttggacttaccgccctatgagacttttgaggatcttagagagaagctgctcatggcggtggagaatgcacaagggttcgaaggtgtcgattag

SEQ ID NO: 196856 - DNA, 525 bp, Artificial Sequence
  Description of Artificial Sequence: Synthetic coding sequence
atgaagtacaagaacctgatggcccgggccctgtacgacaacgtgcctgagtgcgcggaagagctcgccttccggaagggcgatattctgaccgtcatagaacagaataccggtggccttgaggggtggtggctgtgctcacttcacggacggcaaggcatcgtgcctgggaatagagtcaaactgctcatcgggcctatgcaggaaaccgcttccagccacgaacagccagcgtccggcctcatgcaacaaactttcggacaacagaaactctaccaggtccctaaccctcaggccgcaccccgcgacaccatttaccaggtgccaccttcttaccaaaatcagggtatctaccaggttcctaccgggcacggcacacaagagcaagaggtttaccaggttccaccctctgtgcagaggtccatcggaggcacgagcggtccgcatgtgggcaagaaagtatttcagagggacggtcaggtaagttatttccttgtgagggcatcaaaacaaacgtctctatag

SEQ ID NO: 196857 - DNA, 2505 bp, Artificial Sequence
  Description of Artificial Sequence: Synthetic coding sequence
atgaagtacaagaacctgatggcccgggccctgtacgacaacgtgccagaatgtgcagaagagctagcatttcgaaagggggatattctgaccgtgattgagcaaaataccgggggactggaagggtggtggctttgttcccttcacgggcgccaaggcatcgtaccaggaaatagggtcaaactgttgatcggacctatgcaagagaccgcctcaagccacgaacagcctgcctccggtcttatgcagcagacatttggccagcagaagctgtaccaagtccctaacccccaggccgcccctcgcgacactatctatcaggtgccaccctcttaccagaaccagggtatctatcaggtgccaactggtcatggaactcaggagcaggaagtctaccaggtccccccctccgtgcagcggtcaataggtggcacctctggtccgcatgttggtaaaaaggttatcactccagtgagaactgggcatggctatgtctacgagtacccttcccgttaccagaaagatgtatatgacatcccaccttctcatacaacacagggtgtgtacgacatcccgcccagcagcgctaaaggacccgtcttcagcgtgccagttggagaaatcaagcctcaaggggtctatgacatcccccctaccaaaggggtgtatgcaatccctccaagtgcatgccgagacgaggctggcctccgtgagaaggattatgattttccgcctcctatgcgacaggccggacgccctgatctgagacccgaaggagtgtatgacatcccacctacttgcactaagccagcggggaaggatctgcacgtgaagtacaactgcgacattccaggagccgccgagccagtggctcgccgccatcagagcttatcaccaaaccatccccctcctcaactcggccaaagtgtagggtcacagaacgatgcttacgatgttcccaggggtgtccagtttttagagcctccagctgagacctccgaaaaggccaaccctcaggagagagacggcgtttacgatgtgcctctccataaccctccggatgctaagggaagtagagatttggtggatggaataaaccggctgtcctttagctcaactggatccacaagatccaacatgtctacatctagtacatcttcaaaagagtccagcttatcagcgagccccgcccaggacaaacgtctgtttctcgatcccgatacggccatcgagcgcctccaacggctgcagcaggccctagagatgggagtcagcagccttatggcattagttaccacagattggagatgctacggatatatggagcgccacattaatgagatccgaaccgcagtggacaaggtggaactgttcctcaaggagtacctgcactttgtgaagggcgcagttgctaacgccgcctgcctgcccgaattgatcctgcataataagatgaagcgggaacttcaacgggttgaggactcacatcagatcctgagccagacatcacacgacctcaatgagtgttcttggtccctaaatattctcgcgataaacaaaccgcagaacaagtgcgacgacctcgataggttcgtgatggtagccaagacagtccctgacgacgccaaacagctcactaccacaattaataccaacgccgaggctctcttcagaccaggacctgggtcactgcacctgaagaacgggccggagtccattatgaacagcactgaatatccccatggcggctcccaggggcagctgttgcatccaggcgaccataaagcacaagcgcacaacaaagcccttcctcccggtttgagcaaagaacaggcacctgattgcagtagcagtgatgggagcgagcgatcttggatggacgattacgactacgttcacctccaggggaaagaagagtttgagaggcagcaaaaggaactcctggagaaagagaatattatgaaacagaacaagatgcagcttgaacaccaccaactgtcccagttccagctcttggagcaagagatcaccaaaccagttgaaaatgacatctcaaaatggaaaccttctcaatcactgcccaccaccaactccggagtgtcagcgcaggacagacagctcctctgtttttactacgatcaatgcgagacccattttattagcctgctgaatgcaatcgacgcactgttctcttgcgtgagcagcgctcagccccccaggattttcgtcgcacattccaagtttgtcatactcagtgcccataaactagtattcataggggacaccctaacacgacaggtgacagcacaagacatcagaaacaaggtaatgaattccagtaatcagctctgcgaacagctgaagaccatagtcatggcaacaaagatggccgcgctgcattacccttccaccaccgccctccaagagatggtacaccaagtaacagatctctcaagaaacgctcagctgtttaagcgctctttgctggagatggccacattctag

SEQ ID NO: 196858 - DNA, 99 bp, Artificial Sequence
  Description of Artificial Sequence: Synthetic coding sequence
atgtggacccggaacctgatggcccgggccctgtacgacaacgtgcccgagtgtgctgaagaacttgcatttagaaaaggtgatatcctcaccgtgtag

SEQ ID NO: 196859 - DNA, 2505 bp, Artificial Sequence
  Description of Artificial Sequence: Synthetic coding sequence
atgtggacccggaacctgatggcccgggccctgtacgacaacgtgcccgagtgcgctgaggagcttgcatttcgcaagggcgacattctaaccgtcattgagcaaaacacagggggtctggaggggtggtggttgtgctcacttcacggacgccagggcattgtaccaggcaatagagtcaagctcctaatcggacccatgcaggaaacagcctcctcgcacgaacagcctgcctcgggtctgatgcagcagacctttggccagcagaagctctatcaggtgccgaacccacaggccgcccctagggatactatttaccaagtccctccatcttaccaaaatcaaggaatatatcaggttcccactggtcacggaacccaggagcaggaggtataccaagttccccctagtgtgcaacggagcatcggcggaaccagcggtccacacgtgggaaagaaggtgatcacacctgtgaggacaggacatgggtacgtttatgagtacccgagtcgctatcagaaggatgtgtatgacattccccccagtcacactacacagggagtttatgatatccctccatccagcgctaaaggtccagtgttcagtgtgcccgtcggggaaattaaacctcaaggcgtctatgacattcctcccacaaaaggcgtctacgctatacccccaagcgcgtgtcgtgatgaagctggtctgagagaaaaagattatgatttccccccgcctatgcgccaggccggtaggcccgatctgcgcccagaaggcgtatacgatataccaccgacttgtacgaagcccgccggtaaagatctgcacgtgaaatataattgtgacatccccggggccgcagaacctgtggccagacggcaccagagcctctcacccaaccaccccccacctcaactgggccaaagcgtcgggagccagaacgacgcctacgatgtacccagaggagtacaattcctggaacccccagcagagacctccgaaaaagcaaatccccaggaaagagatggggtctatgacgtgcccctacataatcccccggacgcgaaaggcagtagagacctggttgacggtatcaacagactgtctttcagtagcaccggaagcacaaggtctaatatgtccaccagcagtacctcatctaaggagagttctttaagcgcttcacccgcccaggataaaagactgtttctagacccagacactgccattgaacgacttcagaggctgcagcaggccctggaaatgggtgtctccagcctgatggcactggtgacaaccgattggcgatgttacgggtacatggaaaggcacattaatgaaatacggacggcggttgataaggtcgaactgtttcttaaagagtatcttcatttcgtcaagggggcagtggcaaatgcagcctgtctgccagagctcatcttacataataaaatgaagcgcgagttacagcgcgtagaggactctcatcaaattctgtctcagacgagccacgatctcaacgaatgcagttggagcctaaacattctcgcaattaataagcctcagaacaagtgcgatgacctggacagattcgtgatggtggctaaaaccgttcctgacgatgccaagcagcttaccacaacaattaacacaaatgcagaagcgttattccgacccggaccggggagtctgcacctcaaaaacgggcccgaatctattatgaacagtactgaatatccccatggagggagccagggccagctgttgcaccccggtgaccataaggctcaggcacacaataaggccctgccaccgggcttaagcaaggagcaagccccagattgctccagcagtgatggatctgagcggtcatggatggacgattatgattacgtacacctacaaggcaaagaagagttcgaacgccagcaaaaagagttactggaaaaagaaaacattatgaagcagaacaagatgcaactggagcatcaccagctcagccagttccagcttttagaacaggaaatcaccaagcccgtggagaacgatataagcaaatggaaaccttcgcagtccctgccgaccaccaatagcggcgtttccgcccaggaccgtcagctactgtgcttctactacgaccagtgtgagacacatttcattagtctgctgaatgctatagacgcactcttttcctgtgtgtcgagtgcccagccccccaggatctttgtcgcccactccaagttcgtcatcctgtctgcgcacaaactcgtgtttattggcgataccctcaccaggcaggtcacagcccaggacataagaaacaaggtcatgaacagcagtaaccagctgtgcgagcagctgaagactatagtgatggcaaccaaaatggcggcactgcattacccatcgacaaccgccctgcaggagatggtccaccaagtgaccgatctttcaaggaatgcgcaacttttcaagcggagtctcttggaaatggccacattctag

SEQ ID NO: 196860 - DNA, 1212 bp, Artificial Sequence
  Description of Artificial Sequence: Synthetic coding sequence
atgctgcggcccgaggccggcctggtgggcctgcacggccccgcccaagagaactctgccctgcccgggcgaagagacagcgcatccgaactccgcgccctatctggattggaggtagatcccggcgagggttggggtagggtagtgctgatcagcccaagaactgttcgatttcgcgtcttatctccaggtgtccgtgaagagggccatgtacagaacaatggacagaatcaggcccgccccgccaggggtgtgaccggcgctggcggatggggctccgcggccgtttgtcgtggccgggccctcaggggcagggagccggccctgcccagtgccagcttcccagacgtcgccgcttgtcccggatcgctggattgcgctctgaaacgtagagcaaggtgtccacctggcgcccatgcatgtggcccttgcctccaaccttttcaggaagatcagcaggggctgtgcgtcccccgcatgaggaggccacccggcggtggacgccctcagccaagactggaagacgagatagacttcctcgcacaggaactggcccgcaaggaatccggccactctacaccccctttgccgaaagacagacaacggctcccggaaccagcaacgttggggtttagcgcccgaggccagggtctggagctaggcttaccaagcacaccaggaacaccaacacctactccccacaccagcctcggcagtcctgtgtcctccgaccctgtacacatgtccccgctcgagcccagaggagggcaaggcgatggtttggccttggtgctgatcctcgccttttgtgttgctggagcagcagccctgtcagttgctagcctgtgctggtgtcggcttcagcgggaaattcggcttacccagaaagccgattatgccacagctaaagcaccaggatcacctgccgctcctagaatttccccaggtgatcagaggctggcacagagtgcagaaatgtatcactatcagcaccagcgtcagcaaatgctgtgcctggagcgtcacaaggagccaccgaaggaactcgatactgcctcttccgatgaggagaacgaagatggcgattttactgtgtacgaatgtcccggcctagcccccactggagaaatggaggtacggaatcctttattcgaccatgcagccctatctgccccactgcccgccccttcttcccctcctgccctcccatag

SEQ ID NO: 196861 - DNA, 978 bp, Artificial Sequence
  Description of Artificial Sequence: Synthetic coding sequence
atggccacccccctgcccccccccagcccccggcacctgcggctgctgcggctcctgctgtctggtcttgtactgggggccgctctccggggagcggctgcaggacaccctgatgtcgccgcgtgccccggcagcttggactgcgcgttaaaaagacgcgcacggtgtccaccgggggcccacgcctgtggcccatgtctgcaacctttccaggaggatcagcagggcctgtgcgtcccacgcatgaggcgccctccgggaggcggaagaccacagcctcgactcgaagatgagatcgattttcttgctcaggagttagccagaaaggagagcgggcactccactccaccactgcccaaggataggcaaagactgcccgaacctgccacactgggctttagcgcgagaggtcagggcttggaactgggcctgccctctacaccaggaacgcccactcctaccccccatacctccctcgggtcgcccgtgtcatccgatccagtgcatatgtccccactggagcctcggggggggcagggcgacgggttggccctggttcttatcttagctttctgcgtagccggcgccgcagccttgtccgtcgcttcgctctgctggtgcagacttcagcgggagattagattaactcagaaggcagactacgcgactgcaaaggccccgggatccccagccgcaccccggatcagcccaggagaccaacggttggcccagtctgcagaaatgtatcactaccagcaccaacgccagcagatgctgtgtctggagcggcacaaggaaccacctaaagagcttgatacagctagctctgatgaagagaatgaggatggcgacttcacagtttacgaatgccccggcctggcaccgacaggggaaatggaggtgcgtaaccccctcttcgaccacgcagccctgagtgcccctttgcctgcccccagttccccccccgcattaccctag

SEQ ID NO: 196862 - DNA, 297 bp, Artificial Sequence
  Description of Artificial Sequence: Synthetic coding sequence
atgagcgtgcgggagctgaaccggcagctgcggggctgcggccgggacgaagctctgcggctgaagcagagacgacgcactctcaaaaatcgcggctatgcccaagcttgcagatccaagcggctccaacaacgaagaggcctggaggccgaaagggcccggctggcagcacaactggatgcgctcagagctgaagttgcccggttagcaagagaacgggacttgtacaaggcccgctgcgacaggctcactagtagtggcccaggttctggcgacccttctcacctctttctgtag

SEQ ID NO: 196863 - DNA, 714 bp, Artificial Sequence
  Description of Artificial Sequence: Synthetic coding sequence
atggccctgccccccagccccctggccatggagtacgtgaacgactttgacttgatgaaattcgaagtgaaacgagagccctctgagggcaggcccgggccgcccaccgccagcctgggatcaaccccttattctagtgtacctccaagcccaactttttccgaacccggtatggtgggcgcaaccgaggggactagacccggactggaggaactttattggttggcaacactccagcaacaattgggagccggggaagcgctggggttgtcccccgaggaggccatggaactcctgcagggccagggcccagttcctgtcgacggaccccatggttactaccctggtagccccgaagagacaggcgctcagcacgtgcagctagccgaaagattcagcgatgctgccctggtgtcaatgtcagtcagggagctcaatcggcagttgaggggctgtggcagggacgaagccctccgtctgaagcaaaggcgcagaaccctcaaaaaccgcgggtacgcccaggcttgcagatccaaacgcctccaacaaaggagggggctggaggccgagcgggctcggttggccgcacaactggatgctctgcgagcggaggttgcaagactggctcgagaacgggacctttacaaagcaaggtgcgataggttgacctcctcaggaccagggagtggcgacccctcccatctgtttctttag

SEQ ID NO: 196864 - DNA, 714 bp, Artificial Sequence
  Description of Artificial Sequence: Synthetic coding sequence
atggccctgccccccagccccctggccatggagtacgtgaacgactttgacttgatgaaatttgaggtgaagagagagccctctgagggcagacctggtccgcctactgctagcctaggatctactccttactcaagcgtgcccccaagccccaccttctcagagcccggtatggtcggcgcaaccgaaggaacccggcctggcctggaggagctttattggcttgccacgctccagcagcagctgggtgcaggcgaggcactgggactgtcgcctgaagaagccatggagctgctgcaaggacagggacccgtccccgtggatggcccccacgggtactaccccgggtcacctgaagagactggggctcaacacgtgcagctggcagaaaggttctccgacgccgcactagttagcatgtcagtgcgcgagctgaaccggcagctgaggggatgtgggcgggacgaggccctaagactgaagcagagaaggcgaaccttgaagaaccgagggtatgcccaggcatgcaggtcaaagagactccagcagaggcggggactggaggctgagcgagcccgactcgcagcacaactcgatgccctgcgggccgaggtcgcccgtctggccagagagcgggacctgtataaagcgcgatgcgaccggctgacctccagcggccccggttccggggatccatcccacctctttctgtag

SEQ ID NO: 196865 - DNA, 198 bp, Artificial Sequence
  Description of Artificial Sequence: Synthetic coding sequence
atggccctgccccccagccccctggccatggagtacgtgaacgacttcgaccttatgaaatttgaggtgaaacgcgagccaagtgaaggacgaccagggccgcccacagcaagtctcggatcaactccctactctagcgtcccaccaagtccaaccttctctgagcctggcatggtgggtgccaccgaagggacctag

SEQ ID NO: 196866 - DNA, 297 bp, Artificial Sequence
  Description of Artificial Sequence: Synthetic coding sequence
atgagcgtgcgggagctgaaccggcagctgcggggctgcggccgggatgaggcactgagactgaagcagcggagaaggacattgaagaaccggggctacgcgcaggcttgccgtagtaaacgtctgcaacagaggcgaggcctggaagccgagcgggcgagactcgcggcccagttggacgctctgagggctgaagtggctagattggccagggaaagggatctttacaaggcacgctgtgaccggttgacctcctccggcccaggtagcggagacccttcacacctttttctctag

SEQ ID NO: 196867 - DNA, 714 bp, Artificial Sequence
  Description of Artificial Sequence: Synthetic coding sequence
atggccctgccccccagccccctggccatggagtacgtgaacgactttgacttgatgaaattcgaagtaaagcgggagccgtcagaaggcaggcctggcccaccaacagcgagcctgggtagcaccccctactcttcggtccccccaagtcccacattttccgagcccgggatggtaggcgccacggaaggcactcggcctggcctcgaggaactgtattggctggccactctgcaacagcagcttggcgctggcgaagcacttgggttatctcccgaggaagcgatggagcttttacagggccagggacccgtccctgtggacggacctcacggctattatccaggttctcccgaagaaacaggcgctcagcacgttcagctggccgagagattttcggatgccgccctagtaagcatgagcgtacgggagcttaataggcagctgcggggatgtgggcgcgacgaagctttgcggttaaaacaacggcggcgtactcttaaaaacagaggttacgcacaggcctgtcgatccaaacggctccagcagcgtaggggtctggaggctgaaagggcacgtcttgcagctcagcttgatgcgctcagagccgaggtcgcacgacttgcgcgtgaaagagatctgtataaggcacgctgcgatcgccttacaagttctggccccggatccggtgatccctcccacctgtttctctag

SEQ ID NO: 196868 - DNA, 1674 bp, Artificial Sequence
  Description of Artificial Sequence: Synthetic coding sequence
atgggcggccagatcacccggagcaccctgcacgacagcatcggcggccctttccctgtgacatctcaccgatgccatcataaacagaaacactgtcccgcagttcttcccagtgggggactaccagcaactccactactttttcatccacacaccaagggcagccagatcctgatggacttatctcataaggcagtaaagcggcaggccagcttttgcaacgcaattacgttcagcaaccgccctgtgttgatatacgagcaggtgcgcttaaaaattaccaaaaaacagtgttgttggtcaggagccctccgactgggtttcacctccaaagaccctagccgaattcaccctgattctctgccgaagtatgcctgtcctgatttggtctcgcagtccgggttttgggcaaaggctcttcctgaagaatttgccaacgagggcaatataatcgcattctgggtggacaaaaagggtcgcgtattccatagaatcaacgacagcgctgtgatgctcttcttctcaggagtccgcaccgccgaccctctgtgggctctggtggatgtgtacggcttaactagaggcgtacagttgctggactctgaactggtcctgccagactgtctacgccccagaagcttcacagctctacgtagaccatcgctccgccgggaggctgacgatgcaagactgagcgtctccctatgcgacctcaatgtgcccggcgctgatggtgatgaggccgctccagccgcaggctgtccgattccccagaactctttaaattcacagcattccagggcccttcccgcacagttggacggcgacttgcgcttccacgcgctgagggcaggagcccatgtcagaatcctcgacgagcaaaccgttgcgcgcgtggagcacggaagagacgaaagggctctcgtgttcactagtagacccgtgagggtggcagagaccatcttcgtgaaggtgacgcggtcgggtggtgctcggccaggagcactgtctttcggtgtcaccacttgcgatcctggcacattaaggccagctgaccttcccttttcgcccgaagccttagtggaccggaaggagttttgggccgtatgtcgcgtgccagggccgcttcactccggagatatcctgggccttgtagtgaatgccgacggcgagctccacctgtcacataatggcgcagcggccggaatgcagctttgtgtggatgcctcacagcccctgtggatgctctttgggctccacggcactatcactcagattcgcattctgggcagtaccatcctcgctgagcggggtattccatctttaccctgcagtccggcctcgacacccacctctccctccgccctgggaagcaggctaagtgatccacttctttccacatgttcctctgggcctctcggatcaagtgcgggagggacggctcctaattcacctgtgtccctcccagagtctcccgtaactccgggactcggccagtggtctgacgagtgtaccatttgctacgagcacgcggtggataccgtgatctacacctgcgggcatatgtgtctgtgctatgcatgcggcctcaggctgaaaaaggcactgcacgcctgctgtccaatttgccggagacctattaaagacattatcaaaacttacagatcctcctag

SEQ ID NO: 196869 - DNA, 1725 bp, Artificial Sequence
  Description of Artificial Sequence: Synthetic coding sequence
atgggcaacaacttcagcagcatccccagcctgccccggggcaacccatccagggcaccaaggggccacccacagaatctaaaggattctatcggcggaccttttccagttacctcccaccgctgtcatcacaaacagaagcactgccccgcagtgttgccgtccgggggcttacccgcgacccccttactgtttcacccccatacaaagggctcacaaatactgatggatttgagtcataaggctgtcaagaggcaggcctccttctgcaacgcaataaccttctcgaaccgtcccgttctcatatacgagcaggtgcgcttgaaaattactaagaaacagtgctgttggtctggcgcactcaggctgggctttacaagtaaggacccatccagaatccaccctgattcattgccaaagtacgcatgtcctgatctcgtgtcacaatctggcttttgggctaaggccctgcctgaggagttcgcaaacgaaggcaatattatcgctttttgggtcgacaaaaagggtagagtcttccataggattaacgactctgccgtgatgctgttcttctccggtgtaagaactgccgatcccctttgggctctggtagatgtgtatggcctgactcggggcgtccagctgctcgatagcgagctggtcctccctgattgtttgcggcctcggtctttcactgccctccgtaggccatcactccgccgagaggcggacgatgcccgtttatctgtgtccttatgcgatctcaacgtgccaggcgctgatggggatgaagctgcacccgctgccggctgtcctatccctcagaattctctgaactcacaacattctcgagcattacccgctcagctggacggagatctaagattccatgcgctccgggctggggcccacgtgaggatcctggacgagcaaaccgtcgcgcgagttgagcatggaagggacgagcgggcgctggtcttcacaagtaggcccgttcgagtggctgagactattttcgtaaaggtcacaagaagcgggggagcccgacccggggcactaagttttggcgtaacaacgtgtgatcccggcaccctgcgtcccgctgacctccccttcagtccggaagctctggtcgatcgtaaagaattttgggccgtgtgcagagtgccggggcctctgcattctggcgatatcctcggactagtggtcaatgccgacggagagttacatttgagtcataatggggctgcggctggcatgcaactatgcgtggacgcctcccaaccgctttggatgctgttcggtcttcacggaaccataacccagatccgaatcctgggatcgacaattctggcggaaagagggattccttctctaccctgctcacccgcttccaccccaacaagtcctagcgctttgggcagcaggctgagtgaccctctcctgagcacatgcagctccgggcccctgggaagtagcgccgggggcacagctccaaattcgcctgtgagtcttcctgagtcccccgttactccaggactgggacaatggagcgacgagtgcactatctgctatgagcacgctgtggacactgtgatctatacatgtggccacatgtgcctgtgctatgcctgtggactgcgcttgaagaaagctctgcatgcatgttgtcctatctgtcgacgccccataaaagatattatcaagacgtatagaagtagttag

SEQ ID NO: 196870 - DNA, 600 bp, Artificial Sequence
  Description of Artificial Sequence: Synthetic coding sequence
atgggcggccagatcacccggagcaccctgcacgacagcatcggcgggccattccctgtcactagccatcgctgtcaccataagcaaaagcactgtccggctgtgctgcccagcggaggactgcctgctacccctttgttgtttcatcctcacaccaagggttctcagatactaatggatctctctcacaaggctgtgaaacggcaggcatccttttgtaatgctataacattctccaatagacccgtgctgatctatgagcaagtccgcctaaaaatcaccaagaagcaatgctgctggtctggcgccctaaggctaggttttacttccaaggacccatctcgcatccatcccgactctctgcctaagtacgcctgcccagatctggtcagtcaatctggattctgggctaaagccctgcctgaggaatttgctaatgagggtaatattatcgcattttgggtggataaaaagggccgtgtttttcaccgcataaacgattccgctgtcatgttgtttttctccggtgttcgtaccgctgacccactgtgggctctagtcgacgtgtacggtctgacccgcggggtgcaacttctgtag

SEQ ID NO: 196871 - DNA, 327 bp, Artificial Sequence
  Description of Artificial Sequence: Synthetic coding sequence
atggacctgagccacaaggccgtgaagcggcaggccagcttctgcaacgcaattaccttcagcaatcgacctgtgttgatctacgaacaggtgaggctaaagataactaagaagcaatgttgttggtcaggagcattgcgcctgggctttacatctaaagacccctcccggatccaccctgattccctacccaaatatgcatgtcctgacctggtgagccagtccggcttctgggcaaaggcattgcctgaggagttcgctaatgagggcaacattatcgcattctgggtagataaaaaaggaagagtctttcatagaataaactag

SEQ ID NO: 196872 - DNA, 2553 bp, Artificial Sequence
  Description of Artificial Sequence: Synthetic coding sequence
atgcggcaggtgtgctgcagcgccctgccccccccccccctggagaagggtcgttgtagcagctactctgattcctcctcttcaagctccgagcgctcatcctccagttcctcatcatcaagcgagtctggatcctcctctcgatccagctctaacaactcttcaatctcgaggcccgctgcaccacctgagccaaggcctcagcagcagccacagccgcggagcccagcagcgcgcagagctgctgcccgctcccgggccgccgccgccgggggtatgaggagggaccctgccccaggcttctcaatgctgctttttggagtgtcgctagcatgctacagcccttcccttaagagtgtacaggatcaggcctacaaagctcccgtagtcgtcgaaggaaaggtgcagggcctggtcccggccgggggttcgtcttcaaacagcacccgtgagcctcctgcctccggcagagtggctctcgtcaaggtgctggataaatggccgctccggagtggtggtttacagcgggaacaggttataagcgtcggatcttgcgtccctcttgaaagaaaccaaaggtacatttttttcctcgagccaaccgagcagcctttggtgtttaaaacagccttcgctcctttggatacaaacggaaagaatctgaaaaaagaggtcggcaagattctctgcactgattgcgcaacccgcccaaaactcaaaaaaatgaagtctcagaccgggcaggtcggcgagaaacagtcactgaagtgcgaggctgccgcaggtaatcctcaaccctcgtatagatggttcaaagatggcaaagagctgaacagaagtcgggacattagaattaagtatggcaacggccgtaagaactcgagacttcaatttaacaaggttaaagtggaggacgccggagagtatgtgtgtgaggctgagaacatcctgggaaaggacacggtgcgcggcagactgtacgttaacagtgtcagcactacccttagcagctggagcggccatgccagaaaatgtaacgagacggcaaagagttattgcgtgaatggaggggtatgctactatattgaagggattaaccaattgtcttgcaagtgtccaaacggcttcttcggccagcggtgtttggaaaagttaccacttcgtctgtatatgcccgatccaaagcagaaggcagaggaattgtaccagaagcgtgtactcacaatcactggcatctgcgtagccctgcttgtagtcggcattgtttgcgtggtggcatactgcaagacaaagaagcagcgtaagcagatgcacaaccatcttcggcagaacatgtgtccggcacaccaaaacaggtcattggccaacggtcctagtcatccccggctggatcctgaagagattcagatggctgactatatctctaaaaatgtgcccgcgaccgaccacgtcatccggcgtgagacagaaaccacattttccggctcccattcttgctctcctagccaccactgcagtactgctactcccacctcaagccatcgccatgagagccatacatggtccctcgagaggtcagagtcgctgacatccgattctcaaagcggaatcatgctgtcgtcagtaggcactagcaagtgcaattccccagcttgcgtggaggcgcgcgcccgccgagctgcggcctacaaccttgaggaacggcggcgggcaactgcccccccttatcacgacagtgtggactctttgagggactctcctcatagcgagcgatatgtaagcgcgctcactactcccgccaggctgagcccagtggatttccattacagcctggctacccaggttccaacatttgagataacaagtccaaatagcgcccacgctgtgtcattacctcctgccgcaccgatctcgtaccgtctggcggagcaacaacccctccttagacacccggcaccccctggcccaggcccaggccccggcccgggccccgggcccggggctgatatgcagagatcctatgactcctattactaccctgccgctggaccagggccccgacggggaacatgcgccctaggaggctcgttgggaagcttacctgcatcccctttcaggatacctgaggacgacgaatacgagacaacacaggagtgtgccccacctcctcctccacgccctcgagctcgcggggcctcccggagaacgtccgctggccccaggcgatggcgacggtccagattgaatggcctagcagctcagagagcccgtgccgccagagatagcttgagcctgagttcaggctccggcggcggaagcgcttctgcctcagacgatgacgccgacgatgcagacggcgccctggccgctgagtccaccccatttctgggcctccgtggcgcacacgacgcacttcgctcagattcacctcccttatgtcccgctgcggacagccggacctactacagcctagatagtcatagtactcgcgcctcaagtagacacagccggggacctccgcctagggctaaacaggattctgcccccctgtag

SEQ ID NO: 196873 - DNA, 1281 bp, Artificial Sequence
  Description of Artificial Sequence: Synthetic coding sequence
atgcggcaggtgtgctgcagcgccctgccccccccccccctggagaagggccggtgcagcagttactcagatagctcttccagctcctccgaaaggtcgtccagcagctcaagttcatcaagcgagagtgggagcagttcccgttcttcaagcaataatagctcaattagtcgaccagctgctcctcccgagccacgcccccaacagcagcctcaaccacgctctcccgccgcgaggagggcggccgctagaagccgtgctgccgccgccggcggcatgagaagggacccagctccgggtttctctatgctcctcttcggggtgtcccttgcttgctattccccttctctgaaatccgttcaggaccaagcatacaaagctcctgtggttgtcgaaggaaaggtccaaggcctggtgcccgccggcgggtcatcaagtaactccactcgagaacccccagcgtcaggtcgggtcgccctcgtcaaagtcctcgacaaatggcctctgcggtcaggcgggctgcagcgtgagcaggtcatttcggtgggctcatgtgtgccactcgaacgcaaccaacggtacattttttttcttgaacctacggagcaacctctagtcttcaaaactgctttcgccccccttgatacaaacgggaaaaatctcaagaaggaggtgggcaagatcctgtgtacagattgcgcaacccgccccaagctcaaaaaaatgaagagccagacaggccaagtcggggagaagcagagccttaagtgcgaggcggcagcaggcaaccctcagcctagctataggtggttcaaggacggcaaggagctgaacagaagccgtgacataagaatcaaatatggcaatgggaggaagaactctaggctacagttcaacaaagtgaaagttgaagacgcgggtgagtacgtttgcgaagctgagaatatcctcggcaaggataccgttcgcggtcgactctatgtgaattcagtcagcacaacactgtcatcctggtctgggcatgcacgcaagtgcaatgaaaccgcgaaaagctactgtgtcaatggaggagtgtgctattatatcgagggtataaatcagctgtcatgtaagtgcccaaatgggttcttcgggcaaagatgcctggagaaactcccattgcgcctgtatatgcctgatccaaagcagtcggtgttgtgggacacgcctggtactggcgtctcaagttcccagtggagcacatctccgaagccccgatcatgtacaagacgaggctcgtag

SEQ ID NO: 196874 - DNA, 2577 bp, Artificial Sequence
  Description of Artificial Sequence: Synthetic coding sequence
atgcggcaggtgtgctgcagcgccctgccccccccccccctggagaagggaaggtgctcttcttattccgattctagttccagttcatctgaaagaagctcaagttccagcagctcttcatctgaaagcggatcctcttccagaagctcctccaacaactcctccattagtcgccctgcggcccctccggaacctcgaccccagcagcagccccaaccccggtcccctgctgcgaggcgggccgcagctagatcccgggctgctgctgccggtgggatgagacgcgacccggcccctggcttctccatgttgctcttcggggtttctctggcctgttacagcccatctctgaaatccgttcaggatcaggcctacaaagctccagtcgtggttgaaggaaaagtccaggggttggtaccggcaggcggctcatctagcaattccaccagagagcctcccgcctccggcagggtcgccctggtaaaggtgctagataagtggcccctgaggtccggcgggctgcagcgagaacaagtgatctccgtggggagctgcgtgcctctggaacgcaatcaacggtatattttttttcttgagcccactgagcaacctctggtttttaagaccgcattcgcccctctagatactaacggcaaaaacctcaagaaggaagtgggcaaaatcctctgtacggattgcgccacccgccccaaacttaagaaaatgaaatctcaaactggacaagtgggagaaaaacagtcgctgaaatgtgaggctgctgccggcaatccacagccctcctaccgctggttcaaggatggcaaagaattgaaccggtcgcgggacataagaataaagtatgggaatggaaggaaaaacagcaggctgcagtttaacaaggtaaaagtcgaagacgctggtgagtacgtatgtgaggccgaaaacattctgggcaaagatacagtgcgcggcagactttatgtgaactccgtatctaccaccctgtcttcctggagcgggcatgctcgaaagtgcaatgaaacagctaagtcatattgcgtgaacggaggcgtgtgctactatattgaaggcatcaaccagctgagctgcaaatgccccaatggcttctttggtcagagatgcctcgagaagctcccattgcgcctttatatgcctgatcccaagcagtcttttctgtcattcgagctgtccaaggcagaggagctctatcagaagagagtgctgactattacggggatttgcgtggccctgctggttgtgggcatcgtgtgtgttgtcgcttactgcaagacaaaaaagcaaaggaagcagatgcacaaccacctcagacagaatatgtgccccgcccatcagaatcgtagcttggcgaacgggccctcccatccgaggctcgaccctgaggagatacagatggcggattacatatctaagaacgttccagccactgaccacgtgattcggagggaaaccgagacgaccttttcagggtcccatagttgtagtccctctcaccattgctccactgctacaccaactagctcccaccggcacgaatctcatacatggagcctcgagcggtccgaatctctgaccagtgactcacagtccggtattatgctctcaagcgtgggcacatctaagtgcaacagccccgcctgtgtcgaggcgagggctcgacgagccgccgcttataatctcgaggaacgccggcgggcaactgccccaccgtatcacgattctgtggacagcttacgggatagccctcattctgaaagatatgtgtctgctctgactacgcctgcccggttgtcccccgtggacttccattattccctggccacccaagttccaacgtttgagataacaagcccaaattctgctcatgcagtctccttacccccagccgcaccgatcagctaccggctggccgagcaacagcctttgcttagacaccctgctccccccggtcccggaccaggtccggggcctgggccaggtccaggagcagatatgcagcgctcttacgactcatattactaccccgcagcgggccctgggcccaggagagggacatgtgctctcggaggcagtctgggtagcctgccagccagcccgttccggatcccagaagatgatgagtatgaaaccacccaggagtgtgcacccccccctccgccacgacctcgagcccgtggggcctcccggcgaacttccgccggaccacggcgatggcgcaggagtcgactaaatgggctggccgctcagcgggcaagggccgcccgcgattctttaagtctcagctccggatcaggcggaggcagcgcatctgctagcgacgacgatgctgacgatgccgacggcgccctagccgcagaatccacacccttcttgggcttgcgaggtgctcacgatgccttgcggtcagactcccctcctttatgtccagctgcagattcaaggacttattactcactcgacagtcactctactcgggcatcgagtaggcacagtaggggtcctcccccccgagccaaacaggactccgctcccctgtag

SEQ ID NO: 196875 - DNA, 2355 bp, Artificial Sequence
  Description of Artificial Sequence: Synthetic coding sequence
atgcggcaggtgtgctgcagcgccctgccccccccccccctggagaaggggcgctgctcatcctatagcgactccagcagctcctcctcagagcgcagttcttcctcttcttccagctcctccgaatctggatcatcatccaggtcctccagcaacaactcttcaattagccgacccgctgcccccccagaacctcggcctcagcaacagccacaacccaggtccccagccgcccgccgggcagccgcacgcagcagggccgccgcagccggcggtatgcgcagggaccccgcccctgggttctccatgttactgttcggcgtatctctagcctgctactcccccagtttgaagagtgtgcaggaccaggcctataaggccccggtggtcgtcgaaggcaaggtgcagggcctggtgcctgcgggaggctcctcttctaacagtacacgagaacccccagcgtcagggcgagttgctcttgttaaggtcctggataagtggcccctgcgctccggagggcttcaacgcgagcaagtgatatccgttggttcatgtgtcccgctggagcgcaatcagcgatacatattctttctggagcccaccgagcagccactggtgtttaaaacagcctttgccccactcgatactaacggcaaaaacctgaaaaaggaggtgggcaaaatcctgtgtacagattgcgcaactaggccaaaactgaaaaaaatgaagagccagaccggccaagtgggcgagaagcaatcgctgaagtgcgaggctgcagccggtaaccctcagccatcttataggtggtttaaagatgggaaagagctaaaccgaagccgggatatccggatcaaatacgggaatggacgtaagaactcaaggctccaatttaataaagttaaggttgaggacgctggcgaatacgtctgtgaagcagaaaatattctggggaaggacaccgtgaggggccgtctttacgtgaactcggaagcagaggagctgtaccaaaaacgggtcctcacaatcactggaatttgcgtcgctttgttagtcgtgggcatcgtgtgtgtggttgcttattgtaagaccaagaaacaacgtaaacagatgcacaatcatctgagacagaatatgtgcccagctcaccaaaatagatctctagccaacggaccttcccatcctcgcctggatccagaagagatccaaatggccgattatatttctaaaaacgtgccagccacggatcacgtgatccgacgcgaaactgagaccactttctctggctcacacagctgttcaccaagccatcattgttctaccgcgacgccaacgtccagccaccgccacgagagccatacgtggtccctggagaggtccgagtcccttacctccgattcacagagcggtattatgctttcgtctgtggggaccagcaagtgtaactctcctgcctgcgtggaggctcgggcccgtagagccgccgcctacaacctcgaggaaagacggagggccaccgcacctccttatcatgacagcgtggactctctgcgagattctcctcatagcgagcgctacgtcagcgcgctgactaccccagcccgtctatcaccagtagacttccactattcgctggcaactcaggttcccacctttgagataacaagtcccaacagcgctcatgccgttagtctcccacccgcagcccctatcagttataggctggccgagcagcagccgctgctccggcacccggcgcctccaggtccaggacctgggcctgggccaggccctggtcccggagctgacatgcagagaagctacgactcctattattatccggccgcgggacctggcccacgtcgtggcacgtgcgcattgggaggctccctgggatcactgcctgccagcccattccggatacctgaggacgacgagtatgagacaacacaggagtgcgccccacctccgcccccaagacccagagcaagaggtgcatctcgcaggacctccgccggaccgcgccgctggcggcggtccaggctcaacggcttggctgcacagcgagccagggcagcgcgagattctctctctctgagctccggcagtggaggcgggtcagccagcgctagcgacgacgacgctgacgatgctgatggcgccctggccgctgagagcactcccttcctcggcctacgcggagctcacgatgctctccgctccgacagccctcccctgtgtcccgctgcagattctaggacctattactctctggattcacatagcacgcgagcctcaagccgacacagccgtggcccaccgccaagggcaaaacaagattccgcacctttgtag

SEQ ID NO: 196876 - DNA, 993 bp, Artificial Sequence
  Description of Artificial Sequence: Synthetic coding sequence
atgcggcgggaccccgcccccggcttcagcatgctgctgttcggcgtgtcgctggcgtgttactcacccagcttaaagagtgttcaggatcaggcctacaaagctcccgtggtggtcgagggtaaggttcagggattggtgccggccgggggaagcagcagtaatagtacaagggagccgcctgcttctggtagggtggccttagtgaaggttctggataagtggcccttacgttcagggggcttacagcgggagcaggtaatcagcgtggggtcatgcgtgccgctggagaggaaccagagatatattttctttcttgaaccgacagaacaaccattggtattcaagactgctttcgccccccttgacacaaatggtaaaaatttaaagaaagaggtggggaaaatactttgtactgactgcgcaacaaggcccaagctgaaaaagatgaagagccagaccggtcaggtgggagagaaacagagcttaaagtgcgaggcggccgccggcaacccgcagcctagttatcgctggtttaaggatgggaaggaacttaatcgctcacgggacatccggatcaaatacggtaacggtcgcaagaacagcaggctccagttcaataaagtgaaagtggaagatgccggggaatatgtttgcgaggcagaaaacatccttggcaaggacaccgttagagggagactctatgtaaatagcgtgtccacaacattatcctcctggtcaggccacgctcgaaagtgtaacgaaactgccaaatcatactgcgtgaatggtggcgtgtgctattatattgagggaattaaccagttatcctgcaagtgtccaaacgggttttttggtcagcggtgtcttgagaaactgcctctgaggctgtacatgcctgaccccaagcaatccgtgctgtgggacacccctggcactggggttagttcatctcagtggagtactagcccttcgactcttgatctcaactag

SEQ ID NO: 196877 - DNA, 2559 bp, Artificial Sequence
  Description of Artificial Sequence: Synthetic coding sequence
atgcggcaggtgtgctgcagcgccctgccccccccccccctggagaaaggaaggtgcagctcctactcagattccagttccagcagctccgagcggagttctagttcgtcttcatcatcttcagaatccggatcctccagcagatccagtagcaataactcaagcatttccaggccggcggctcctcctgaaccaaggccgcagcagcagccacagccacgcagtccggcagctcgtcgcgctgcagcaaggtctagagccgcagccgccggcggaatgaggcgagatcctgctcctgggttcagtatgctgctatttggtgtctccctagcctgctactcaccaagcttgaagtctgtgcaagatcaggcgtacaaggccccagtcgtggtcgagggaaaggttcagggccttgtgcccgctggggggtcctcctccaactccacccgcgaaccaccggcatcgggaagagtggctctggtcaaagtcctggacaaatggcccctgaggagcggtgggctccagagagaacaggttataagcgttggaagttgtgtgccactcgagcggaaccaacgctatatcttcttcctggaacctaccgagcagcctctcgtctttaaaaccgcattcgcccctctggatacgaacggtaagaacctgaagaaggaagttggcaaaatcctgtgtacagactgcgctactcggccgaaactcaaaaaaatgaaaagccagactggtcaggtaggagagaagcaaagcttaaagtgtgaggctgccgccggcaacccacagccatcatatcgctggttcaaggatggcaaagagttgaaccggagtcgtgacatcagaattaagtatgggaacgggagaaagaattctaggcttcagtttaataaagttaaggtggaggatgccggagaatacgtgtgcgaggcagaaaatatcctgggcaaagacaccgtcagaggccggctgtacgttaacagtgtctctactacactcagcagctggagcggacatgcaaggaagtgtaacgaaacagccaagagctactgcgtaaacggcggcgtttgttattatatcgaggggatcaatcaactatcgtgcaaatgccccgtcgggtacaccggcgaccggtgccaacagtttgccatggttaatttcagcacacgattggggggagacgttgaggaggcagaggagctgtatcaaaagagagtactgaccatcaccggcatttgtgtggcgctcctggtggttggcatcgtctgtgtggttgcctattgtaagacgaagaagcagagaaagcagatgcacaaccacctccggcagaacatgtgtccagcccaccaaaacaggagccttgccaacggacccagtcacccccgtttagatccggaagagatccagatggccgactacatttcgaaaaacgtacccgccaccgaccacgtcatccgaagggagacagagaccacgttttccggtagtcattcttgtagcccatcccaccactgctctaccgcgacccctacctccagccataggcacgaaagccacacctggagtttggaaaggtccgaatccttaaccagcgattctcaatcaggcattatgcttagttcagtgggcacttccaagtgtaattctccggcatgtgtcgaggctcgggctaggagagccgcagcctataacctcgaagagcggcggagggcaacggcacccccatatcatgattccgttgactcacttagagacagtcctcatagcgaacgttacgtctccgccctgacaactcccgcgcggttaagcccagtcgattttcactacagccttgcaacccaagtaccaacattcgaaattactagccctaactccgctcatgctgtaagcctccccccagctgcccctatctcctacaggttagcggagcaacagcctctgctcagacatccagctcctcccggtccaggccccggccccgggcccgggcccggtcctggagcggacatgcagcgcagctacgactcctattactacccggccgccgggccgggtcctcgccggggcacctgtgctctggggggctcactcgggagccttccagcaagcccgttcaggattcccgaggacgacgaatatgagaccacacaagagtgcgcccctcccccacccccgagacctcgcgctcggggagcctccagacgtacttccgctggaccacggaggtggagaagatcacgccttaatggactggctgcccagcgcgctagagcagcccgcgactcactgagcctgtccagtgggtccggaggtggatctgccagtgctagcgatgacgatgctgacgatgctgacggcgcgcttgctgccgagtctactcccttcctgggtctgaggggggctcatgatgccctcaggtcagattctcctcccctatgccctgctgccgactccaggacatactatagccttgattcccactctacaagggcttctagccggcattccagagggccccccccccgagctaagcaggacagtgcaccgctctag

SEQ ID NO: 196878 - DNA, 2535 bp, Artificial Sequence
  Description of Artificial Sequence: Synthetic coding sequence
atgcggcaggtgtgctgcagcgccctgccccccccccccctggagaagggccgctgctccagctacagtgatagttcgagtagctccagtgagcgctcgtcgtcctcaagcagttcttcaagcgagtctggcagtagcagccggtcttctagcaacaatagcagcattagtcggccagctgccccccccgagccccggccccagcagcagccccagccccggagccctgctgcccgccgggccgccgcacgttccagagccgccgcggctggcggcatgaggagggatcctgcccctggctttagcatgctactctttggcgtttctctagcctgttattctccgtccctgaaatccgtacaggatcaagcctataaagcgcccgtagtagtcgagggcaaggtgcagggcctagtccctgcaggtggctcaagctctaacagtacgagggaaccgcccgcatctggccgcgtggccctggttaaagttctggacaagtggcctctgcggagcggtggcctccagcgtgaacaagtcatctccgtaggctcctgtgtgccactggaacgcaaccaacgctacatctttttcctggagcctaccgaacaaccattggtcttcaaaacagcattcgctcccctcgacacaaatggcaaaaacctcaagaaagaggtgggaaaaatcttatgtaccgactgcgccacacgaccaaaactgaaaaagatgaagtctcaaaccggacaggttggcgagaaacagtccctcaaatgcgaggccgccgctgggaatcctcagccctcctaccgctggtttaaagatgggaaggagctgaaccgctcccgggacatccggattaaatatgggaacggtcggaaaaacagtcgcctacagttcaacaaagtcaaagtggaggatgccggggaatacgtgtgtgaagccgagaacatcctgggcaaagacacagtgagggggaggctgtacgtgaactccgtgtctacaacattatcatcctggagtggccacgctcgaaaatgcaacgaaaccgcaaaaagctattgcgtcaatggtggggtgtgttactatatcgaaggaattaaccagctgtcatgcaaatgccccgtaggctatacaggagacaggtgtcagcagttcgctatggttaacttctctaaggccgaggaattgtaccaaaagcgagtactgacaatcactggtatttgcgtcgcgctgctagttgtgggcattgtgtgtgtagtggcgtattgcaaaactaagaaacaacgtaaacagatgcacaatcacttgaggcaaaacatgtgtcccgcgcatcagaacagatccttggctaacggaccttcacaccctagactggaccccgaggagatacaaatggctgactacatttcaaaaaatgtgcccgcaactgaccacgtcatccgcagagaaactgagaccacgtttagcggttcccactcatgctctccgtctcaccattgctctacagctactccgacaagctcccaccgtcatgagagccatacttggtctttggaaaggtccgagagcctaacctccgactctcaatccggaattatgttgagctccgtgggaactagtaagtgcaattcaccagcctgcgtggaagccagggcgaggcgagcagccgcctataacttagaggaaagacgccgggcaaccgctcctccttaccacgacagcgtggatagcctccgtgacagtccccactccgaacggtacgtttccgcactcaccactcctgccaggctctcgcccgtagactttcactactctctggccacacaggtccctacattcgagatcacttcacccaacagtgcgcatgccgtgtcgctacccccggcagctcccatttcatacaggcttgctgaacagcagcccttgctcaggcatccggcccctcccggccccggacccggaccagggcccggacctggccctggcgccgatatgcagcggtcctatgattcttattattatccagcagccggccctggtccccgaagggggacctgtgccctgggcggttccctggggagcctccccgcgtcaccatttagaattcctgaagacgatgagtatgagacaacccaggaatgtgccccaccaccaccccctcgtccgcgagcaaggggtgcatccagacgtacatcagccggacctagaagatggcgtcggagtagactgaacggactcgcagcacagcgagcacgtgccgctcgggatagcctgtctctgagtagcggttcagggggagggtccgcctctgcaagtgatgacgacgccgacgatgctgatggagcgcttgcggccgagagcacaccatttttgggactgcgaggcgcacacgacgccttgcggtcagactctcccccactgtgtcccgccgcagatagtcggacctactattctctcgactcccacagcactcgagcatcctcccgacacagccggggtcctcctccacgggctaagcaggacagtgcccctttgtag

SEQ ID NO: 196879 - DNA, 2577 bp, Artificial Sequence
  Description of Artificial Sequence: Synthetic coding sequence
atgcggcaggtgtgctgcagcgccctgccccccccccccctggagaaggggcgatgtagttcatactctgacagttcttctagctcatcagagcgctcttcgtcatcctcatccagctctagcgaatctggtagctcaagtcgctccagcagtaacaactcctccatttcgcggccagccgccccgccagagcccaggccccaacaacagcctcagccccggagtccagcagctcgacgagcagctgccaggagccgggccgcggctgccggcgggatgcggcgggacccggcccccggcttcagcatgctgttgttcggagtgtcacttgcctgttatagtccctccctgaaaagcgtccaagatcaggcctacaaggccccggtggtggtggaggggaaggtgcagggactcgttccggctggcggctcgagtagcaactctacgagagagcctcccgcctccggccgggtagcattggtgaaagtgctggataagtggcccctgcggagcggaggtctgcagagggaacaggtgatatcagtgggtagttgcgtcccgttggagaggaaccagagatacatattttttcttgagcccacagagcagcctctggtgttcaaaacagccttcgcacctttagacacaaacgggaaaaacctgaaaaaggaagtgggcaaaatactgtgcaccgattgtgccacaagaccaaagctgaaaaagatgaaatctcagacgggacaggtaggagaaaagcagtcccttaagtgtgaggcagcagctggaaatcctcagccatcttacagatggttcaaagacggaaaagagctgaacaggtccagggatatccgaattaagtatggcaacgggaggaagaatagccggctgcagtttaataaggtcaaagtcgaagatgctggcgaatacgtgtgcgaagcagaaaacattctgggtaaggataccgttcgagggcggctatacgtgaattccgtcagcacaaccctgtctagctggtcgggacatgcgcggaagtgcaacgagactgctaagagctattgtgtgaatggtggagtctgctattacatcgaaggaataaatcagctttcgtgcaagtgtcccaacggatttttcgggcagcgatgcctagagaaactgcccctgcgcctgtacatgccagatcccaagcaaaagcatctcggttttgaattaaaagaggcagaggagctctatcagaaaagggttcttacgattactggaatttgtgtggccttactggtagtgggtattgtgtgtgttgtagcctattgtaagactaagaagcagagaaaacaaatgcataatcacctacgccagaacatgtgtcctgcccaccagaataggtccttagcaaatggtcctagccatccccgcctggatccagaggaaattcagatggcagactatatcagtaaaaacgtacctgcgaccgaccatgtgatccgcagagaaacggaaacaacattttctggatctcacagttgttcaccgagccaccactgttccaccgcaacccctacctcttcccacagacatgaatctcatacctggtctctcgaaagaagcgagtccctcacctctgattcccagtctggaattatgctctcgtccgtggggaccagcaagtgtaattcgcccgcatgcgtcgaggctcgggcccgaagggcagctgcctataatctggaggagcggagaagggccacagctccaccctaccatgatagcgttgatagtctgagagactctcctcatagtgaacggtatgtctcagccctgaccaccccagcccgcttaagtccagtcgatttccactactccctggccacacaggttcccacctttgagatcaccagccccaatagtgctcatgcagttagtctgcctcccgccgcgccgatctcctaccgattggctgaacagcagcctctcctgagacacccggcacctcccggcccaggtcctgggcctggacctggacctggtcctggcgctgacatgcaaaggtcctacgacagctactattatcccgcagcaggtcctggcccaaggaggggaacttgcgccctcggagggtcactgggctccctgccagcttccccttttcgcatccccgaggacgacgaatatgagacaacccaggaatgcgcacctccaccacctcccaggccaagagcacggggggcgtctcggagaacatctgccggacccagacgctggagacgttcccgcctgaatggcctggcggcgcagagagcaagagccgcccgggatagcctgagcctttcatccggttcaggaggcgggtctgctagcgcgtccgacgacgatgcggacgatgccgacggagccctggctgccgaatcaactcctttcctcggcctacgaggcgcccatgatgctcttaggtctgacagtccgcctctatgcccggccgcagatagcagaacgtactattcgttggacagtcactccacaagggcttcttcacggcattcacgaggtccaccgccgagagcaaagcaggactccgctcccctgtag

SEQ ID NO: 196880 - DNA, 2091 bp, Artificial Sequence
  Description of Artificial Sequence: Synthetic coding sequence
atgagcgagggcgccgccgccgccagcccccccggcgccgccagcgcggctgccgcttccgccgaggaaggcaccgctgcagccgcagcagccgccgccgcaggcggaggacctgatggcggaggcgagggcgccgctgaacccccgcgcgagctaagatgttcggactgtattgtatggaatagacagcagacttggctgtgcgtggtaccactgtttatcggtttcattgggctcgggctgtcactcatgctattaaagtggatcgtagttggcagtgtgaaagagtacgtacctactgacttggtggactctaagggcatgggacaggaccctttctttctctcaaagcccagtagcttccccaaagccatggaaacgaccaccaccaccacttccacaacaagtccagccaccccctccgcagggggggcagcctcatcccggacccccaatcggatcagtacacggcttaccactattaccagggcccctactcggtttcccggacaccgggtccctattagagctagccctcggagtacaacagctcgtaatacagccgctccagccacagtgccctccactacggcaccattttttagctcttcaaccctggggtccagaccccccgtccctggaacccccagtacccaggctatgccttcatggcctactgcagcatacgccactagcagctatcttcacgactcaaccccgagctggactcttagccccttccaggatgctgctagtagcagctcttcatccagcagctctgcaactacgactacacctgagacctcgacgagccccaagttccacacaacaacatactcaaccgagcggagcgagcacttcaagccttgtagagacaaagacttagcctattgtttaaatgacggagaatgcttcgtcattgagaccttgactggaagccataaacattgccgttgcaaagagggctaccagggcgtcaggtgtgatcagtttctgccaaagactgactctattctgtctgatccaacagaccatctcgggatagaattcatggagtccgaggaggtctaccagagacaggtgctgagcatcagctgtattatctttgggatagtgatagtgggcatgttctgcgctgcattctattttaaatctaaaaaacaggcgaagcagatccaggaacaattgaaagtcccgcagaatgggaaatcttattctctgaaggcctcttctaccatggccaagagtgaaaatctggtgaagtctcacgttcagctgcagaattacagcaaggttgagaggcacccggtcaccgcccttgagaagatgatggaatcatctttcgtgggccctcagtcttttcccgaagttccatccccagaccgcggctcacaaagcgttaagcaccacaggtccctgtcatcatgctgcagccccggccaaagaagtggaatgctccaccggaacgcatttagacggaccccccccagccctcgctcaagactggggggtatcgtgggtcccgcttatcagcagctggaggagagtcggatccctgaccaagatacaattccgtgtcagggctactcctcaagcggtctgaagacccagaggaatactagcatcaacatgcagctcccatcccgcgagacgaacccttacttcaactctctggagcagaaggatctggtgggctacagtagtacccgagcctcctcagtcccaattataccctcagtaggcctggaggagacatgcctgcagatgccaggcatttctgaagtgaaatctattaagtggtgcaagaattcctacagtgcagacgtggtgaacgtgtccattcctgtatctgattgccttatagccgaacaacaagaagtcaagattctgctggaaaccgtgcaggagcagattcggattctgacagatgcacgaaggtctgaagactacgagcttgccagcgtcgagacagaggactccgcgtccgagaacactgcttttctgcccttgtccccaaccgcaaagagcgaaagggaggcgcagttcgtgctcagaaatgaaatacagagagacagcgccctaacgaagtag

SEQ ID NO: 196881 - DNA, 1500 bp, Artificial Sequence
  Description of Artificial Sequence: Synthetic coding sequence
atggagtgcggcatcccccccaccctggtgtgcgtgggccggggcggaggactccacacgatcaatatcattatttggtactacttcccaagcgcctggcggacttgtttcaatatttccagctccgtcgggctcctgctcactaatagttacaagttctacacgaccacatactctaccgagcgttccgagcactttaagccttgcagagataaggacctcgcatactgtttgaacgacggcgaatgttttgtgatcgagaccctcacgggcagccataaacactgcagatgcaaggaaggatatcagggggtccgttgcgatcagttcctgccaaagacggattccattctgagcgaccccacagaccacctgggcatagaatttatggaaagtgaggaagtgtaccagaggcaggtgctgagtattagttgtattatattcgggattgttatcgtcggaatgttttgcgcagccttctattttaagtcaaaaaagcaggcaaagcagattcaggagcaattgaaagtcccccagaacggcaagagttattccctgaaggcttcctccacaatggctaaaagcgaaaacttggtgaaaagccacgttcagctccagaactactctaaggttgaacgacatcccgtgacagccttggagaaaatgatggaaagttcctttgttggaccccagagtttcccagaagttcctagccctgaccgcggaagccagtctgttaagcaccatcgctcactctcaagctgctgtagccccggacagagaagtgggatgctacacaggaacgctttccgacgcacaccgccttcaccaaggagcagactgggagggatcgtgggcccagcctatcagcaactggaggaaagcaggatccccgaccaggacactatcccatgtcaaggcatcgaggtgcggaagaccatcagccatctgcccatacagctctggtgtgtcgagaggcctctggacctgaaatactcctctagtggattgaagacccagcgtaacaccagtatcaatatgcagttgccctctagggaaaccaatccctattttaactcgctcgagcagaaggatctggtagggtatagctctactcgggcctccagcgttcccattatcccgtccgtcggtctcgaggagacctgcctccagatgcctgggatcagcgaggtgaagagcattaagtggtgcaagaactcatacagcgcagacgtggttaatgtttcgattcctgtgtccgattgcttgatcgccgagcagcaagaagtaaaaatacttctggaaactgtgcaggagcagatccgaattctgacagacgctaggaggagcgaagactacgagctagcatctgtagagacagaggattcagcatctgaaaacacggcctttttacccttgagtccaacagcaaagagtgagcgggaagctcagtttgtgctgcggaacgagatacaaagagactccgcgttgaccaaatag

SEQ ID NO: 196882 - DNA, 2163 bp, Artificial Sequence
  Description of Artificial Sequence: Synthetic coding sequence
atgagcgagggcgccgccgccgccagcccccccggcgccgccagcgctgccgcagccagcgccgaagaggggacagctgctgccgccgcagccgccgccgctgggggaggtcccgatggcggcggagagggcgctgcagagccaccacgggaactccggtgctccgactgcatcgtgtggaatcggcaacaaacttggctgtgtgttgtccccctctttatcgggttcattggactcggcctgagcctgatgctcctaaagtggattgttgttggttccgtgaaggaatatgtcccaacagacttagttgattcgaaagggatgggccaggatcccttctttctcagcaagccaagctcattcccaaaagccatggagacaacgaccaccacaaccagtaccacatcgcccgctactccttccgcaggcggagccgccagcagcaggacccccaataggatttctactcgcctgaccacaatcactcgagcgcccactcgatttcctgggcacagggtgcccattcgcgctagtccacggtctactaccgctcggaatacagctgcgccagccaccgttccttccacgaccgccccatttttttcttcctccacgcttggtagtagacctcccgtgccaggcaccccatctactcaagctatgccgtcctggcctacagcagcatatgctacgtcctcttacttgcacgactccactccaagctggacattatccccattccaagacgccgccagtagctcaagtagctcatcctctagcgcaacaactacaaccccagagacctcaacatcacccaagtttcacacaactacctactccacagaacgatccgagcactttaaaccttgtagagataaggacctcgcatattgtctgaacgatggggagtgctttgtgatcgaaacactgacaggtagccacaaacactgccgatgtaaagagggctaccagggggttaggtgcgatcagttcttacctaaaactgacagtatcttgagcgatcccactgaccatttaggcatcgagtttatggagtcggaagaggtttatcaacggcaggtcctgagcatttcctgcattatctttggaatcgttattgtcggcatgttttgcgcggccttctactttaaaagtaagaagcaggcaaagcagatccaagaacagctcaaagtcccccagaatggcaaatcatatagcctgaaggcaagcagtaccatggcgaaatcagagaacctggtgaaatctcacgtccagctgcagaactacagcaaagtcgaaagacaccctgttaccgccctggagaagatgatggagtccagcttcgtgggacctcagagctttcctgaggtacccagtcctgaccgggggtcacaaagcgtgaaacaccaccgcagcctgtcttcatgttgctcccccggacaacgttccggaatgctgcataggaatgcattcaggaggacccccccctccccgagaagcaggctcggagggatagttggccccgcttaccagcagctggaggagagtcggattccagatcaagatactatcccatgccagggtatcgaagtgcgaaagactatcagtcacctccccattcagctgtggtgtgtcgagcggcccctggacctgaagtactcttcttctggactgaagacccagcgaaataccagcatcaatatgcaactgccatctcgggagacgaacccctatttcaattctttagagcagaaggacctggtggggtactcttctacccgggcttcatcagtacccatcatccccagcgtggggctggaggagacatgtttacaaatgccggggatctccgaagttaagtccattaaatggtgtaaaaattcatacagcgctgatgtcgtgaatgtgagcattccagtgagcgactgtcttattgcagaacaacaggaggtaaagatcctgctggagaccgtccaggagcagattagaatcctgaccgatgcccggcgttcggaagactacgagcttgccagcgtggagaccgaggatagtgccagcgaaaataccgcgtttttgcccttgtcaccaacggccaaaagcgagagagaggcccaattcgttttgcggaacgagattcagcgggactctgcgctgactaaatag

SEQ ID NO: 196883 - DNA, 2088 bp, Artificial Sequence
  Description of Artificial Sequence: Synthetic coding sequence
atgagcgagggcgccgccgccgccagcccccccggcgccgccagcgccgctgcggcttccgccgaagagggcacagccgctgcagcagctgccgccgcagctgggggcggacctgatggaggcggcgagggggctgccgagcctccccgcgagctgagatgctctgactgtatagtatggaataggcaacagacatggctgtgcgtcgtccctcttttcattggttttattggactgggcttatctttgatgttgctgaagtggatcgtggtgggctccgtgaaagaatacgttcccactgacctcgtggatagcaaagggatgggtcaagaccctttctttctgtccaagccatccagctttcccaaggctatggagaccacgaccacaactacaagcacgacctcccctgctacacctagcgccggcggcgctgcttcaagtaggacgcccaatcgaatttctactagactgacaaccataactagagcccccacaaggtttccagggcaccgcgtcccaatccgggctagcccccgatcaaccacggctcgaaatacagccgccccggcgaccgtgccttccaccaccgcccctttctttagctcttctaccctaggctcacgacctcctgtgccaggaaccccaagcacccaggcaatgcccagctggccgacagcagcctacgctacatcaagttacctccacgacagcacgccgtcttggacactgtcccctttccaggacgccgcttctagttcatctagcagctctagcagcgctacgactactactccagaaacgagcacctcccccaaatttcatacgaccacttattctacggagcgctccgaacattttaaaccctgtagggacaaggatctggcttattgcctgaatgatggggagtgtttcgtgatagagacactgacagggtctcacaagcactgtcgatgcaaggaaggataccagggagtgagatgtgatcagtttctgcccaaaaccgacagtattctctccgacccgactcatatcgggatcatttttacggagagtgaggaggtataccagaggcaggtccttagtatcagttgtataatttttggcattgtgatcgtggggatgttctgtgcagcattttacttcaagagcaagaaacaggctaaacagattcaggaacagctaaaggttccccagaatgggaagtcttactcacttaaagcctcttctacaatggctaagtcggagaatctggtgaaatcccacgtccagctgcagaactattctaaagtagagcgacaccccgtgaccgcactggagaagatgatggagagctctttcgtaggcccacaatcgttccctgaagtcccctcacctgatcggggctctcagagcgtcaaacatcacaggtcgttgagcagttgctgctctcctggtcaaagaagcggcatgttgcatcgtaacgcatttagaagaactccacctagtcctcggagccgcctgggcggaatcgtaggccctgcctaccagcagctcgaagaatccaggatccccgatcaggatacaatcccatgccaggggtattcatcatctggactgaagacccaacggaacactagcattaatatgcagcttcccagtcgggagaccaatccctattttaactctctggaacaaaaagatctcgtgggctacagtagcacaagagccagctcggtgcctatcatcccgtcagtcggcctggaggagacctgtctgcagatgccaggcatcagtgaagtcaaaagcatcaagtggtgtaaaaattcctactctgcagatgtggtcaacgtttctatccctgtgtctgattgtcttatcgctgaacagcaagaggtgaaaattctcctggagacagttcaggagcagattcggatcttgaccgatgcaaggagatccgaagattatgagctggcctctgtggagacagaggactcagccagcgagaataccgccttcttgcctctttcccccacagccaaaagcgaacgggaagctcagttcgtgctgagaaacgaaatccaaagagactcagctttgaccaagtag

SEQ ID NO: 196884 - DNA, 1041 bp, Artificial Sequence
  Description of Artificial Sequence: Synthetic coding sequence
atggagagcgaggaggtgtaccagcggcaggtgctgagcatcagctgtatcatctttggaatcgtcattgtgggcatgttttgtgccgctttctattttaagagtaaaaaacaggccaagcagatacaggaacaactgaaggttccacagaacgggaagtcctattccctgaaagcttcaagcacaatggcaaagtcagagaaccttgttaaatcccatgtccagctgcagaactacagtaaagttgagcgtcatccggtaacggctctcgagaaaatgatggagtcctcttttgtgggtccgcagtcgttcccagaagttcctagtcccgaccggggtagccagagtgtgaaacaccacaggagcctaagcagctgctgtagcccaggtcagagaagtggaatgcttcataggaatgccttccggagaacaccccctagtcccaggtccagattgggcgggatcgtggggccagcttaccaacagctggaagaatcccgcatcccagaccaggacactattccttgtcaagggtatagctcctctggtttgaaaactcagagaaacacttccatcaacatgcaactgccttctcgcgagacgaatccttacttcaacagcctggaacagaaagacctggtgggatactcctctactcgggcgagctctgtaccaataatcccaagcgtgggtctcgaggagacgtgtctgcagatgcccggcatctcggaggtcaaatcaataaaatggtgtaaaaattcttacagcgccgacgtcgtgaatgtgtcaattcccgtcagcgactgccttatcgcagagcaacaggaggtgaagattctactcgagacggttcaagagcaaatccgcattctgaccgacgcgcggcgttccgaggattacgaactagcttctgttgagaccgaggactccgccagcgagaacacggcattcctgcctctgagtcccaccgccaagtccgaaagagaggctcaatttgtcttgagaaacgagatccaacgagacagtgcacttaccaagtag

SEQ ID NO: 196885 - DNA, 1041 bp, Artificial Sequence
  Description of Artificial Sequence: Synthetic coding sequence
atggagagcgaggaggtgtaccagcggcaggtgctgagcatcagctgtatcatattcggtattgtgatcgtcggtatgttttgtgcagctttttacttcaagtctaagaagcaggcaaagcagattcaggagcaacttaaagttccccaaaacggtaaatcgtactcacttaaggcgagctccaccatggccaaatctgagaacctcgtcaagtcccatgtgcagctgcagaactactctaaggttgagcgtcacccagtgacggccctcgaaaaaatgatggaaagctcgttcgtcggaccacaatccttccccgaagtgccgtcccctgaccggggctcccagtctgtaaaacaccacagatccctttcatcttgctgcagccctggtcaaagatccggcatgttgcatcgtaatgctttccggaggacccccccttcaccccgcagcaggctggggggcatcgtgggccctgcgtatcaacagctcgaggagtcacggatacctgatcaggatacaatcccgtgccaaggttactcttcctcaggcttgaagacgcagaggaataccagcattaatatgcagctgcccagcagagagaccaatccatatttcaactctctggagcagaaggatcttgtcggctactcctctactagagctagttcagtccctataataccgagcgtaggtttggaagaaacttgtttacagatgcccggtatctccgaagtcaagagcataaagtggtgtaagaacagctattcagccgatgtcgtcaacgtaagcatcccagtctcagattgtctcatagccgaacagcaagaagtcaagatcttgctggaaactgtacaggagcagattcggatcttaaccgatgcacgccggagcgaggactacgagctggctagtgtggaaaccgaggacagcgccagtgaaaatactgcctttctccctctttcccccacggccaagtcggaacgggaggcccagtttgtcttgcggaatgagatccagagggactctgccctcacaaagtag

SEQ ID NO: 196886 - DNA, 171 bp, Artificial Sequence
  Description of Artificial Sequence: Synthetic coding sequence
atgcccaccgaccacgaggagccctgcggccccagccacaagagcttttgtctgaatgggggactgtgttacgtgataccaacgataccctcgcctttttgctcactgcacgagaatgaaaacgacaataatgaggacctttacgatgatctattgcccctcaatgaatag

SEQ ID NO: 196887 - DNA, 348 bp, Artificial Sequence
  Description of Artificial Sequence: Synthetic coding sequence
atgcccaccgaccacgaggagccctgcggccccagccacaagagcttctgcttgaacgggggactgtgttacgtaatccccactattccttcgcccttttgccgatgcgtcgaaaactacacaggagctcgatgcgaggaggtgttcttgcctgggagtagcatccagaccaaatccaacctcttcgaggcttttgttgcccttgctgtgttagtcactttgattattggcgccttctactttctgtgccggaagggacacttccagagagctagcagtgtgcagtacgacataaatcttgtcgagacaagcagcacctcagcacaccactctcacgaacaacactag

SEQ ID NO: 196888 - DNA, 273 bp, Artificial Sequence
  Description of Artificial Sequence: Synthetic coding sequence
atgcccaccgaccacgaggagccctgcggccccagccacaagagcttctgtctgaacggggggttgtgttacgtgatacccaccattcccagccccttttgtagatgcgtggagaattacacaggcgcgagatgcgaggaggtgtttctgcccgggtcatcaatccagaccaagagtaatcttttcgaggccttcgtcgctctggctgtgttggtaacattgataatcggcgccttctatttcctgtgccgctgcggcaacacctgcatgtag

SEQ ID NO: 196889 - DNA, 615 bp, Artificial Sequence
  Description of Artificial Sequence: Synthetic coding sequence
atgatgcccagctgcaaccggagctgcagctgcagccggggcccctctgtggaggacggaaaatggtacggcgtgcgcagttatctgcacctgttttacgaggattgcgcgggcactgcactcagcgatgacccggagggacctccagttctgtgtcctcgccggccgtggccaagcctctgttggaagatttctctgagttccggtactcttctgcttctcttaggcgtcgccgcgctcactactggttacgcagttcccccaaaactggagggaatcggagagggggagtttctggttcttgaccagcgtgccgccgactataaccaagccctggggacctgtcgtctagctggcactgccctttgtgttgccgcaggtgtcctccttgccatttgcttgttttgggcgatgatcggctggctctcacaggataccaaggcagagcctctcgacccagaggctgatagccatgtggaggtgtttggcgatgagcctgaacagcagctttcaccaatcttcaggaatgcatccggacaatcttggttttcaccacctgcttcacctttcggccaaagttctgtccagactattcaacccaaaagagactcatag

SEQ ID NO: 196890 - DNA, 615 bp, Artificial Sequence
  Description of Artificial Sequence: Synthetic coding sequence
atgatgcccagctgcaaccggagctgcagctgcagccggggccccagtgtagaggacgggaagtggtacggagtgaggtcctatttacacctgttctatgaggactgtgcaggcaccgcgttatccgacgacccagagggcccaccagttctctgccccagaagaccctggcccagcctgtgctggaaaatcagcttgtcaagcggcacccttcttctgctgctaggggtggccgctctgactacaggttacgctgtgcctccaaagctggaagggattggagagggggagttcctcgtgctggaccagagggccgccgattacaaccaggccctcggaacttgtaggctggccggcacagcactgtgtgtggctgccggagttcttcttgctatatgcctgttctgggcgatgattgggtggctcagtcaggataccaaggctgagcctctggatcctgaggctgactctcatgtggaagtgtttggcgatgagcccgagcagcagttaagccctattttccgcaatgcctctggccagtcttggtttagtccaccggcctccccttttggtcagtcttccgttcagaccattcaaccaaagagagacagctag

SEQ ID NO: 196891 - DNA, 1329 bp, Artificial Sequence
  Description of Artificial Sequence: Synthetic coding sequence
atgtaccagcggatgctgcggtgcggcgccgagctgggcagccccggcggaggagggggtgggggaggaggaggtggggcaggcgggcgcctagccctcttgtggatcgtgcctcttaccttgagcggactgctcggggtggcctggggagcaagcagcttaggggcacaccacattcaccacttccacggatcctcaaaacatcactccgtaccgattgccatttataggagcccagccagtctccgcggcggccacgctggaaccacttacatttttagcaagggcggaggccaaatcacctataaatggccacccaacgaccgcccctccacacgagcagacaggctcgcaataggtttttctactgtacaaaaagaggccgtcctagtgcgggtggactcctcttccgggctcggcgactacctagagctgcacatccatcagggaaaaattggtgtcaaattcaacgtgggaacagatgatatcgccatcgaggaatccaacgctatcatcaatgacgggaaataccacgtggtccgttttacccgttccggtgggaacgctaccttgcaggttgactcatggccggttatcgaacggtacccagccggaagacagctaacaatcttcaatagccaggcaaccattatcattggcgggaaagaacagggccagccatttcaaggtcagttaagtggcctttactacaatggactgaaagtcttaaatatggcagctgagaacgacgccaacatagccatcgtagggaatgtgagactggtgggagaggtgccttcctctatgaccaccgagagcaccgctactgctatgcagagtgagatgtcgacctcaattatggagaccactacaaccctcgccaccagcaccgcacgccgcggtaagcctcctaccaaagagccaatttcccagacaaccgacgacattcttgtggcaagtgccgagtgcccaagtgatgacgaggatatcgacccctgtgagccgagctccggtgggctggcgaatcccactcgagccggcgggagagagccttaccctggttctgcagaggtcattagagagtcgagctcgactaccggaatggtcgtgggaattgtggcagcagctgctctgtgtatcctgatactattatacgctatgtataaatatcgaaacagagacgagggtagttatcacgtcgacgagagcagaaactacatctccaacagtgctcagagcaacggcgcggtggtgaaagaaaagcagccttccagtgccaagtcatctaataagaataagaagaataaggacaaagagtattacgtgtag

SEQ ID NO: 196892 - DNA, 4524 bp, Artificial Sequence
  Description of Artificial Sequence: Synthetic coding sequence
atgggcaccgccctgctgcagcggggcggctgcttcctgctgtgcctcagcctgctgctcctcggctgctgggctgagctgggatctgggttggaattccctggagctgagggccagtggactcgctttccgaaatggaacgcatgctgtgaaagcgagatgtcatttcaactgaaaacccgcagcgcccggggactcgtgctatactttgatgatgaaggattttgcgattttctggagctgattctaaccaggggaggtagacttcagctgtccttcagcatcttctgtgcagagccagccactctcctggccgatacccctgttaatgatggggcctggcactccgttcgaatccggcggcagttcaggaatactactctcttcatcgatcaggtagaagccaaatgggtcgaggtaaaaagcaaacgcagggacatgaccgtgttcagtggactgtttgtgggtggcctgccacctgagctgagggccgcagccctcaaactgacgctggccagtgtgcgcgagagagagcctttcaaaggatggatccgggacgtcagagtgaatagcagccaggtccttccagttgactctggggaggtgaaactggatgacgagccacctaactccggcggaggcagcccgtgcgaggcaggagaggagggcgaagggggcgtgtgtctgaatggaggcgtgtgcagcgtggtcgacgaccaggccgtgtgtgactgcagccggacggggttccgcgggaaggattgctcacaggaggataacaatgttgagggactggcccacttgatgatgggggaccaaggcaaatcaaagggaaaagaggagtatattgcaacattcaaaggatcagagtacttttgctacgatctaagccaaaatccaattcagtcctctagtgatgagattactctgtcattcaagacactgcaaagaaatggactgatgttgcacactggaaagtctgccgactacgtgaatttagctctaaagaatggagcggtctctctggtgatcaatcttggctccggcgcttttgaggcattggtagaacccgtcaatggcaagtttaacgacaacgcctggcatgatgtgaaggtgacccggaacctgcggcagcacagtggcatcggtcacgcaatggtcacaatttccgtggacggaatactgactacgacgggatatactcaggaagactatactatgctagggagcgatgactttttctacgttggtggatccccctcgaccgcagacctgccaggcagtcccgtctctaacaacttcatgggttgcctgaaagaagttgtgtacaaaaataacgacgtcaggctggaactttcacgcctggccaaacagggagacccaaaaatgaagatccatggcgtcgtggcctttaaatgcgaaaacgtagccaccctggatcccattactttcgagacacccgagtctttcatctctcttcccaaatggaacgccaaaaagactggcagcatttctttcgattttaggactactgaacccaatggcctcatcctgttcagtcacggaaaaccccgccatcaaaaggatgcaaaacaccctcagatgattaaagtggactttttcgcaatagagatgctcgatgggcacctgtaccttctgctggacatggggagtggcaccatcaagattaaggcactgctgaaaaaggttaacgatggggaatggtaccacgttgacttccagcgtgacgggagatccgggactatttctgtgaataccttacgaactccatatactgccccgggggagagcgagatcctagatttagacgacgagttgtacttagggggccttccggaaaataaggctgggctagtgttccctactgaagtgtggaccgcgcttctcaattatggctatgtggggtgcatccgggatctctttattgacggacagtcaaaggatattcggcagatggctgaagtgcagagtaccgccggcgtcaaaccttcttgctctaaggaaactgccaaaccctgtctatccaacccatgcaaaaacaacggcatgtgccgggacgggtggaatcgatatgtctgtgactgctctgggacgggctacctgggtagaagttgcgaacgagaggccacagttctatcgtacgatggatctatgttcatgaagatccagcttcccgttgtgatgcatactgaagctgaggatgtgagtctgaggttccgcagccagcgagcctatggcatcctgatggctaccacatcccgcgatagcgcagacacattgcggctggaactggacgccgggagggtgaaattaacagtcaatttagattgtatccggatcaattgcaatagctcgaaggggcccgagacgctatttgccggatataacttgaacgacaatgagtggcataccgtgagagtggtgcgcaggggaaagtcacttaagctgaccgttgatgaccagcaagctatgaccggacagatggcaggggaccacaccagattggaatttcataacatcgagacaggcataatcaccgagcggcgatatttgagtagcgtgccaagtaatttcattggtcatctccaaagtctcacatttaatggaatggcctacattgatctgtgtaaaaatggcgacatcgactactgcgagctgaacgcccgcttcggcttccgcaatatcattgctgatcctgtgaccttcaaaacgaagtcgagttacgtagcgctggcaactcttcaagcctatacaagcatgcacttattttttcagttcaaaacaacatcattagatggcctgatactgtacaactccggggacggtaacgattttatagtggttgagctcgttaaaggctacctccattacgtattcgatcttggaaatggcgccaacttgattaaaggcagttctaacaaaccactaaatgacaaccagtggcataacgtcatgatttctagggatacctccaacctgcacaccgtaaagatagataccaagataactacccagattacggctggcgccaggaacctcgacctgaaaagcgacctgtatattggcggagtggctaaggaaacctataagtcgctgcccaagctggttcatgcaaaggaagggtttcagggctgtctggccagtgtggaccttaacgggaggctcccagacttgatctctgatgctctgttttgcaatggccagatagagcgcggctgcgagggccccagcaccacgtgtcaagaagactcctgtagcaaccagggggtgtgtctccaacagtgggatggttttagctgtgactgcagcatgacatcttttagcggaccgctttgtaacgatccaggcaccacgtacattttcagtaaaggcggcggtcaaattacatacaagtggcctcctaacgatcgcccatcaaccagagctgaccggttggctatcggttttagcacagtccagaaggaggcggtgctggtgcgcgtggattcaagtagcggccttggtgactatctggagttgcatatccaccaaggcaagattggcgtgaaattcaacgtaggcaccgacgacatcgccatcgaagagagcaacgccattataaatgacgggaaataccacgttgtccgttttacccggagcgggggtaacgcgactctgcaggtggacagttggcctgtgattgaaagatatcccgccggaaataacgacaacgaacggctggccattgcacggcaaagaatcccttacaggcttgggagggtggttgacgaatggctgctagacaagggtcggcagctcaccatctttaacagccaggccactataatcattgggggaaaggaacagggtcagcctttccagggccaattgtccggactttactacaatgggctgaaagtgctgaatatggctgcagaaaatgatgctaacatagccatcgtgggcaatgtcagactcgtgggagaggtaccatcctctatgacgaccgaaagtacggccacagcgatgcagagcgagatgtcaacctccatcatggaaacaacaacaacactcgccacttccacggctagaagagggaaaccccctaccaaggaacctatctctcagaccacagatgatatattggttgctagcgccgaatgtccaagcgacgatgaggacatagacccctgcgaaccctcttcaggaggcctggccaatcccaccagagccgggggcagagagccctaccccggctcggctgaggtaatccgagaaagctccagcaccacgggcatggtcgtgggtatcgtcgccgctgcagcgctgtgcattctcatcctgctgtacgcaatgtataaatatcggaaccgggacgaaggatcctatcatgttgatgagagccggaactatattagcaacagcgctcagtccaacggagccgtagtcaaagaaaagcaaccttcaagcgccaagagtagcaacaagaataagaaaaataaggataaagaatactacgtgtag

SEQ ID NO: 196893 - DNA, 1488 bp, Artificial Sequence
  Description of Artificial Sequence: Synthetic coding sequence
atgatcagccgggacaccagcaacctgcacaccgtgaagatcgacaccaaaatcaccacacagattaccgccggtgcaaggaacctcgatttgaagtccgacttgtatatcggcggagtggctaaggagacctataagtccctccctaaactggttcatgcaaaagagggattccagggttgtctggcgtccgtagatctgaatggacgacttcccgacctgatctctgacgccctcttttgcaacggacagattgaacgcggttgcgaagttgctcttatgaaagctgacctgcagggcccgtctaccacttgtcaggaggattcatgttccaaccagggagtgtgcctgcagcagtgggacgggtttagctgtgattgctctatgacatctttttctggccccctctgcaacgacccagggaccacttacattttctccaaaggcgggggccaaatcacctacaagtggccaccgaatgacaggccctctactagggccgatcgtcttgccatagggttttctacagtgcaaaaggaggcagtgctggtgcgtgttgactctagcagcggcctgggggactacctggaacttcatattcaccagggcaagatcggcgtgaagtttaacgtcggcaccgacgacatcgccattgaggagtctaacgccataatcaacgatggcaaatatcacgtcgtgaggttcacacgatccggggggaacgctaccctgcaagtggactcatggcccgtgatcgagcgatacccggctggtcgtcaactgactatcttcaattcacaggccacaattatcattgggggaaaggagcagggccagccctttcaggggcagctgagtggtctgtattataatgggctgaaggtcctgaacatggccgccgagaatgatgcgaatattgcgatcgtcggaaacgtgagactggtgggcgaggtgccctccagcatgacaaccgagagtaccgccaccgctatgcagagtgaaatgagcacatccattatggagacaaccaccacgcttgctacttctacggctaggcgcggtaagccccccactaaggaacctatctcacagacgacggatgacatactggtcgcatctgccgagtgtccttcggacgacgaggatattgatccatgtgaaccctcttctggcggtttagcgaatcctactagagccgggggaagagaaccctacccaggctccgccgaagttatccgggagtcctccagcaccaccggcatggttgtggggatcgttgccgctgcagctctctgtatcctgatcctcctttacgctatgtacaaatataggaaccgagatgagggatcttaccatgtggatgagagcaggaactacataagtaattcagcacagtctaatggcgcagttgttaaggagaagcagccttcgtctgccaaatccagcaataagaataaaaaaaataaggacaaggagtattacgtctag

SEQ ID NO: 196894 - DNA, 4500 bp, Artificial Sequence
  Description of Artificial Sequence: Synthetic coding sequence
atgggcaccgccctgctgcagcggggcggctgcttcctgctgtgcctgtctttgttattacttggatgttgggcggaactgggcagcgggttagagtttcctggagcagaagggcaatggaccagatttccaaaatggaatgcttgctgtgagtcagaaatgtcctttcaactgaaaactcggtctgccaggggtttggtcctttacttcgacgacgaggggttttgcgatttcctcgagctgatcttgacaaggggtgggaggcttcaactgtcttttagcattttctgtgctgagcctgcgacactgttggctgacacccctgtcaacgacggggcgtggcacagcgttcggatccgccgacagtttcggaacaccactctgtttattgaccaagtagaggcaaaatgggtcgaagttaagtccaaaagaagagacatgactgtattttccggcttgtttgtaggtggactaccgccggagttgcgagcggccgcactgaaactcacacttgctagcgtgagagagcgggagcccttcaaagggtggatccgagatgttcgtgtgaactccagccaagtgcttcctgtggattccggcgaggtgaaattagacgacgagccacccaattccgggggagggagcccctgcgaggccggagaggaaggggaagggggcgtgtgcctgaatggcggggtgtgcagtgtagttgatgaccaggccgtgtgcgattgttcacggacaggttttaggggaaaggattgtagccaggccgacactaacctggagggcctggcccatttgatgatgggggatcaggccaaaagcaagcggaaggaggagtatatcgcaacttttaagggcagcgagtacttttgctacgatctgtcccagaacccgatccagtcctcaagcgacgaaatcaccttgagcttcaagacgttgcagcgcaacggcctgatgctgcacaccggcaagtctgcggactatgtaaacttggccctgaagaacggcgccgtgtcacttgtgataaacctaggaagcggggcgttcgaagctctggtcgagcccgtcaacggtaagttcaacgacaatgcctggcacgatgtcaaggtcacacgcaacctgaggcaggtgactatctcagtggatggaatcttgacaactacgggatacacacaggaggactatacaatgttgggtagcgacgattttttctacgttggtgggtcaccatcgaccgctgacctgcctggctctcctgtgtcgaataactttatggggtgtctgaaggaggtagtttacaagaacaacgacgtcagactggaactgagcagactcgcgaaacaaggcgatcctaagatgaaaatccatggggtggttgcctttaagtgcgaaaacgttgccacactcgaccctatcaccttcgaaaccccagagagttttatcagcctcccgaaatggaacgctaagaagacagggtccataagctttgacttcaggacaacggagccaaacggcctaatcctattttcacatggcaagccccggcatcaaaaagatgcaaaacaccctcaaatgattaaagtcgatttttttgctatagagatgctggatggacatctgtatctgctccttgatatgggaagcgggaccataaaaatcaaggctctactgaaaaaagtcaacgacggagagtggtatcatgttgatttccagcgagacggtagaagcggaacgattagtgtgaacaccctgcggacaccatataccgctccgggggagagtgagatcctcgatctggacgatgaactgtacctgggtggactgcctgaaaataaagccggtttggttttccctacagaagtgtggactgcactgttgaactatggctatgtgggttgcattagagacttatttatagatgggcagtccaaagacatccgccagatggccgaagtccagagcaccgctggcgtcaaaccttcttgctctaaggagaccgctaagccgtgccttagcaatccttgcaaaaacaacggcatgtgtcgggatggctggaatcgatatgtgtgcgactgtagcggtacaggttatctcggacgatcatgcgaaagagaagctaccgttttatcatacgatggttctatgttcatgaagatacagctgcctgtcgtcatgcacaccgaggctgaagatgtgtctctgcgatttcgctcccaacgtgcttacggtatcctaatggccaccaccagcagggactccgccgacacattacggctggagctggacgccggcagggtcaagctgaccgtaaacctggactgtattaggatcaactgtaattccagtaaggggcctgagacattattcgctgggtacaacctcaacgacaatgaatggcacactgtgcgggtcgtgagaagaggaaagtccctgaaactcactgtggacgaccaacaggccatgactgggcagatggcaggggatcacactcgcctagaatttcataacatagaaacaggtataattaccgagagacggtacttatcctccgtgccgtctaactttattggccacctgcagtcactgacgttcaatggcatggcatatatcgacctctgcaaaaacggcgatatcgactactgcgagctcaacgcgcgctttgggtttcggaacataattgcggatccggtaacgtttaaaaccaagtcgtcctatgttgcactggctaccctgcaagcgtatacatctatgcatctgttttttcagtttaagaccacatcactggatgggctgatcctttataattcaggcgatgggaacgacttcattgtagttgaattggtgaagggatacctccactacgtcttcgatctcggcaatggcgcaaatctcatcaaggggtcaagcaataaaccattgaacgataaccagtggcacaatgtgatgatctcaagagacactagcaacctccacacagttaagatcgataccaagattacaactcaaattaccgccggcgctaggaatctggacttgaagagcgacctctacatcggtggcgtcgctaaagaaacctacaaatcacttcctaaactggtgcatgcaaaagaaggattccagggctgcctggcatcagttgacctcaatggccggctgcccgaccttatttctgatgcccttttttgcaacggccagattgagcgcggctgcgagggtccctcgactacctgccaagaagattcttgctccaatcagggagtgtgcctgcaacaatgggacggatttagttgtgactgttcaatgacatccttctctggtcccctgtgcaacgatcccggcacaacctatatcttcagcaaagggggcggacagatcacgtacaaatggcctcctaacgatcggcccagcacgagagccgatagactggcaataggcttcagcactgtacagaaagaagccgtgctggtccgcgtggattccagctccggtctcggggactacctcgagctgcatatccaccagggtaagatcggagttaagttcaacgtgggtacagatgatatcgcgatcgaagaatcaaacgctattattaatgatgggaagtaccacgtagttcgcttcactcgaagcggaggtaatgcaacacttcaggtcgatagctggcccgttatcgagcggtatccagctgggaacaacgacaacgaaaggttggcaattgctaggcagcggatcccttatagattgggtcgcgtggtcgacgagtggctgctggataaaggcaggcagttgacaattttcaactcacaggcaactatcatcattggaggcaaagagcagggtcagccattccagggccaattgagtgggctgtactacaatggactaaaggtactgaatatggctgccgagaacgacgctaacatcgccattgtgggcaatgtccgcctcgtcggtgaggtgccgtcctctatgacaactgagtcaactgccacggcgatgcagagcgagatgtcaacttctatcatggagaccactaccacgcttgctactagcaccgcccgaagaggcaagccccccacaaaggagccaataagccagacaactgacgatatcctcgtcgccagtgccgagtgtccttctgacgatgaagacatagacccctgcgagccgagcagtggggggctggcaaatcctacaagggcaggaggcagggagccctatccgggctccgccgaggtgatccgggagagcagttcaaccaccggaatggtggttggcatcgtcgctgctgcggctttgtgcattttgattctgctgtatgcaatgtataagtaccggaatcgggatgaggggagctatcatgttgatgagtccagaaactacattagtaattccgctcagagcaacggtgcagtcgtgaaggagaagcaaccatcctcagctaagtcttctaacaagaacaaaaagaataaagacaaggaatactacgtgtag

SEQ ID NO: 196895 - DNA, 4644 bp, Artificial Sequence
  Description of Artificial Sequence: Synthetic coding sequence
atgggcaccgccctgctgcagcggggcggctgcttcctgctgtgcctctccctgctgctcctgggatgttgggcagaattaggtagcggactcgaatttccgggtgctgaaggccagtggaccaggttcccaaaatggaacgcttgctgcgagtccgaaatgagtttccagctgaagactcggtcagcacgaggcttagtgctgtattttgatgacgaaggcttttgcgactttcttgagctgatcctgacacggggcggccgattgcagctgtctttctcaattttttgtgccgagccagccacgctgctcgccgatacccctgttaacgatggagcttggcattctgtccgaatcaggagacagtttagaaacacaaccctttttatcgatcaggttgaagctaaatgggtggaggtgaagagcaagcggcgcgacatgacggtattcagcggcctgtttgttggcggactcccaccagaactccgagctgctgctctgaaattaactctcgcatcggtacgtgagcgcgagccattcaagggatggattagggatgtccgtgtaaacagcagccaggttctgcctgtcgactccggggaagtaaaactggatgacgagccacctaactccggaggcggaagcccttgtgaggcaggcgaagagggagagggcggagtatgcttaaatggcggcgtttgttccgttgtggacgaccaagccgtgtgcgactgttcacgcacaggcttccgtggaaaggattgctcccaggagattaaattcgggctgcaatgcgtcctgcctgtgctgctccacgacaacgatcaaggaaagtactgttgcatcaacacagcaaagccactcactgagaaggacaacaacgttgaggggctcgcacatcttatgatgggcgatcagggtaaaagtaagggcaaagaggagtacattgccaccttcaaaggcagcgaatatttttgctatgatctatcccagaatcctatacagtccagttcggacgagattactttgtcgttcaagaccttacagcgcaacggcctgatgctccataccggcaaaagcgctgattacgtcaacctcgctctcaagaacggcgccgttagcctcgtgattaatctaggctcaggcgcattcgaagcactagtcgaacccgttaacggtaaatttaatgataacgcctggcatgacgttaaggtgactaggaatctgcgccagcattcagggattggacatgccatggttaataagttgcactgctctgtgacaatctcagtggacggcattctcactacaacaggttatacgcaggaggattatactatgctggggtcagacgactttttctacgtgggcggctccccaagcacagccgacttgcccggatcccccgtgtcgaacaattttatgggatgtctgaaagaagttgtctacaagaacaatgatgttcgcctggagctcagccggcttgccaaacaaggtgatcccaaaatgaagatccatggtgtggtcgctttcaaatgtgaaaatgtcgcaactcttgaccctatcacctttgagactcctgagagcttcattagtctgcctaaatggaacgccaaaaaaaccggctcaatcagttttgacttcagaactaccgagcctaacggacttatacttttctctcacggaaaaccccgccaccagaaggatgccaagcacccccagatgatcaaagttgacttcttcgctatcgagatgctcgatggtcatctgtatctgttactggacatgggatccggtaccatcaaaatcaaagctctgctcaaaaaagtcaatgatggagagtggtaccacgtggactttcagcgcgatggcagatccggtaccatctctgttaacacattgcgcaccccttacacagcccctggggagagcgagatcttagacttagacgatgagctgtatctcggagggcttcctgagaacaaagctggcctggtgttcccgacagaagtgtggaccgctctcctgaattatggatacgtcggttgcatcagggatctcttcattgatgggcaatcaaaagatattcggcagatggccgaggtgcagtcaacggccggcgtgaagcctagttgcagcaaggagacggccaagccttgcctatcgaacccgtgtaaaaacaatggtatgtgtagggatgggtggaacagatatgtatgcgattgcagtggcactgggtatctgggaaggtcatgcgagagagaggccacagtcctttcttacgatggctccatgttcatgaagattcagctgcccgtggtcatgcacacagaggctgaagatgtgagccttcgctttagaagccagcgcgcctatggaatcttaatggccacaactagccgggacagtgcggatacgcttcggctagagctggatgcgggccgcgttaagctaacagtcaacctggactgcatccggattaattgcaacagtagcaaaggccccgagacattgtttgcaggttacaatctgaatgataatgagtggcacaccgtccgggtggtccgacggggcaaaagtttaaaacttacagtggacgaccagcaagccatgacgggacagatggcaggcgaccacactcggctggaatttcacaacattgaaaccggcataattaccgagcggagatatctctccagcgtgccctccaatttcatcgggcacctgcagtcattgacatttaatgggatggcgtacatcgatctctgcaagaacggggacatagactactgcgaacttaacgcaagattcggatttcggaatattattgccgaccctgttactttcaagacaaaatcgagttatgtagcactggcgacactccaagcttatacttcaatgcacctgtttttccaatttaaaacgaccagtctggatggccttatcctctacaacagtggagacggcaacgattttattgtggtcgagttagtcaagggctatttgcactacgtatttgacctcggcaatggggccaatctgattaagggaagctctaataaaccactgaatgacaatcagtggcataacgtcatgatttcaagggacacttctaacttacacaccgtcaaaatcgacaccaagatcactacccagataacggccggggctaggaacttggacctcaaaagtgacttatatatcggcggagttgcaaaagagacgtacaagtccttgcctaaactggtgcatgctaaagaggggttccaagggtgtctggcctccgtcgacctgaacggtcggttgcctgatttgatcagcgatgccctgttttgcaacggacagatcgaaaggggatgcgagggcccttccaccacttgccaggaggactcttgttccaaccagggggtgtgtctacagcaatgggacggttttagctgcgactgttcaatgaccagcttcagcggcccattgtgtaatgatcctggtacaacttatatcttctcaaagggaggaggccagataacttacaagtggccaccgaacgaccggcctagtaccagggcagacaggctagccatcggtttcagcaccgtccaaaaagaggctgtcctagtccgtgtagatagctcttcggggctcggcgattaccttgaactccatatacaccaaggcaaaattggggttaaatttaacgttggcacggatgacatcgccatagaggagtccaacgctattattaatgacggcaagtaccacgtggtgcgctttactcgctcagggggaaatgcaaccctgcaggtcgacagctggccagtaattgagcggtaccctgcaggaaacaacgacaatgagcgcctcgcgatcgccagacaaagaattccctatcgtctggggagggtcgtggacgagtggctgcttgataaggggcgacagttaaccatatttaatagccaagctacaatcattataggcgggaaagagcaaggccagcccttccagggacaactcagcgggctttattacaacggacttaaggtacttaacatggctgctgaaaatgacgctaatattgctatagtgggtaatgtgaggctggtaggagaggtgccttcatcgatgactacggaatctacggccacagccatgcagtccgagatgagtactagtataatggaaacaaccaccaccctagcaacatccacagccagaaggggcaaaccacctactaaggagccaattagtcagacaaccgacgatatcctggtcgccagcgccgagtgtccatccgatgacgaggacattgatccatgtgagccaagctctggaggactcgcaaatcctaccagggcgggcggccgagagccttacccaggaagtgccgaagtgattcgcgaaagctctagcactaccggtatggtggtgggcatcgtggccgcagccgctttatgtattttgatcctgctgtacgccatgtataaatacagaaaccgcgacgagggatcgtaccatgtcgacgagtcgcgaaattacatttctaatagcgcacagtctaacggggccgtcgtgaaagagaagcagccgtccagcgccaagtcgagcaacaagaacaagaaaaacaaggacaaagaatattatgtttag

SEQ ID NO: 196896 - DNA, 4434 bp, Artificial Sequence
  Description of Artificial Sequence: Synthetic coding sequence
atgggcaccgccctgctgcagcggggcggctgcttcctgctgtgcttgagccttctgctcctcggctgctgggcggaactgggtagcggtctggagtttcccggagccgagggacagtggaccaggttccctaagtggaacgcctgctgtgagagcgaaatgagcttccaattgaagactcgctctgcgaggggccttgtgctgtacttcgacgacgaaggcttctgtgacttcctggagctgatcttgacgcgcggcggcaggctccagttgtccttcagtatcttttgtgccgagcccgccacgctgctggccgatacccccgttaacgacggtgcttggcacagcgtgcggatcagacgccagtttcgtaacactactctgttcatagaccaagtggaggcgaagtgggtggaagtgaagagcaagagacgcgatatgactgttttcagcggactgtttgtcgggggactgccccctgagctgagagcagcggctctgaaactcaccctggcttccgtgcgggaacgagagccattcaagggctggatacgagacgtgcgcgtgaactcttctcaggttctccctgtggattccggtgaagttaagctggacgacgagcctcctaattccggaggtggctccccctgcgaggccggagaggagggcgaaggaggggtttgcctcaacggtggcgtctgttctgtagtggacgaccaggctgtctgtgattgttcaaggactggctttcgtggaaaggactgctctcaggaagacaataatgtcgaagggctcgcccacctgatgatgggggatcaaggcaaatctaagggtaaggaagagtacattgcaaccttcaagggtagtgaatacttttgctatgacttgagccagaacccaatccaatcatcaagcgatgagattacgttatccttcaagacactccaaaggaacggactaatgctgcacactggcaaatccgccgattacgtgaatctggcgttaaagaatggagcagtgagcttggtcatcaatctgggctcaggggccttcgaggcactcgtagagccagtgaacgggaaattcaacgacaatgcctggcacgatgttaaggtcacgagaaacttaaggcaacacagtgggatcggtcacgctatggtgaccatttcagtggatggaatactgacaaccaccgggtatacacaggaggactacaccatgctgggatccgacgatttcttctacgtgggcggatcaccatcaacagccgatctgccgggatcacccgtatccaacaatttcatggggtgtctgaaggaggtggtttacaagaataacgacgtccgcctcgaactcagtcggctcgctaagcagggggacccgaaaatgaagattcacggggtggtagcattcaaatgtgaaaacgtggcaaccctggaccctattacctttgagacacccgagagcttcatttcgctacccaagtggaacgcaaagaagaccgggtcaatcagcttcgactttaggactacagaacccaacggactcatcctatttagccacggcaaaccaagacatcagaaggacgcgaaacacccacagatgatcaaggtggacttcttcgcaattgagatgctggatggccacttgtacttactgctcgacatgggttccggtaccatcaagatcaaggcgctgcttaagaaagtcaacgatggggaatggtaccatgttgattttcaacgggatgggagatccggcaccatctccgtaaacaccctccgtactccatataccgctcctggggaatctgagatcctggacctcgatgacgaactgtatctggggggtcttccggaaaataaagcgggactggtgtttcccactgaagtttggaccgctctcctgaactacggttatgtgggatgcatcagggatctctttatcgacggacagtccaaggacatacgacagatggccgaagtgcagagcaccgctggcgtcaaacccagctgtagtaaggagacagcaaaaccctgtctgtcaaatccatgcaaaaataacggaatgtgccgagatggatggaatcgctatgtatgcgattgcagcgggacaggctatctggggcggagctgtgaacgtgaggccactgtgctcagctacgacgggtcaatgttcatgaagattcaattaccagtcgtgatgcacacagaagcagaggatgtgagtttacgatttaggtctcagcgggcctacggcatactcatggccacaacctcgcgggattctgcagacacgctgaggctggaattggatgcaggtagagtcaagctcacggttaacttggactgcattagaattaattgtaactcaagcaaaggccccgaaacactcttcgctggttataacttgaatgacaacgagtggcataccgtgagggttgtgcgccgtggtaaaagtctgaagctgacagtggacgaccagcaggcgatgacaggccagatggccggtgatcatacgcgtttggagttccataacatcgagacagggatcattaccgagcgcaggtacctatcgagtgtgccatctaacttcattgggcacttgcagtcgttgacatttaatggaatggcatacattgatctgtgcaaaaatggagacatagattactgtgagttgaacgcgcgattcggttttcgtaacataatagccgatccagttacatttaagaccaagtctagctacgtggccctagccaccctacaggcctatacatcgatgcacttgttcttccagtttaagaccacgagcctggatggtctcatcctgtacaacagtggagatggaaacgactttattgtagtcgaactagtgaaaggatatctacactacgtgttcgatctgggtaatggcgcaaatcttattaaagggagctcgaacaagcctctgaacgacaatcagtggcacaatgtgatgatctcaagagatacgtcgaacctgcacactgtcaaaattgatacaaaaataactacacagatcaccgccggagcccgcaaccttgacttaaaatcagacctatacattggtggagtcgctaaagagacttacaaatcactaccgaagttggtccatgccaaagaggggtttcaaggatgtcttgctagtgtggacctgaatggccgccttccagacctgatttctgatgcgcttttctgtaacggacagatagagcgggggtgtgaggggcctagcactacatgtcaggaagattcctgctccaatcagggggtctgcttacaacagtgggatgggtttagctgcgactgctctatgacctctttctcaggaccactttgcaacgacccagggacaacctacatcttctcaaaaggcgggggccaaatcacctataaatggccaccaaatgacagaccctccacaagagcagataggctggccatcggattctccacagtccagaaggaggcagtattggtacgcgttgactcatcttcgggtctcggagattacctggagctccacatccaccagggcaagatcggtgtcaagtttaacgttggcacagacgacatcgccatcgaagagtccaatgctatcattaacgacgggaaatatcatgtcgtgagatttactcgcagtggcggcaacgcgacactgcaagttgatagctggccagtgattgagaggtacccagccgggcgccagctgacgattttcaacagccaggcaaccatcataattggcgggaaggagcagggccaaccattccagggccaactaagcgggctttactacaacgggctcaaagtgctcaacatggccgccgaaaacgatgccaacatcgccatagtgggtaatgtgagattagttggagaggtcccttcctcaatgactacagagtccaccgctacggccatgcagtccgagatgagcacatccattatggagactactactacgctggcgacttccaccgcccgcagaggaaaaccacccactaaggaacccatttcacaaaccaccgatgacattctggtggcgagcgctgagtgtcctagtgatgacgaagatatcgacccttgcgaaccttctagcgggggcttggccaaccccaccagggccgggggcagggaaccatatcctggctccgcagaagtcatcagagagtcctcatccaccactggaatggtggtcgggatcgtggcagccgcagccttatgtatcctgatcttgctgtatgccatgtacaagtacagaaatagagacgagggtagttatcatgtcgatgagagtcgcaattacatcagcaatagcgcacagagcaacggtgccgtggtgaaggaaaagcaaccaagcagcgcgaaaagttcgaacaaaaataagaagaacaaggacaaggagtattacgtatag

SEQ ID NO: 196897 - DNA, 4434 bp, Artificial Sequence
  Description of Artificial Sequence: Synthetic coding sequence
atgggcaccgccctgctgcagcggggcggctgcttcctgctgtgcctgtccctcctccttctgggctgttgggctgagctgggttccggcctggaatttcccggtgcagagggccagtggactcgctttcccaagtggaacgcttgctgcgaatctgaaatgtcgttccagttgaagacacggagcgcccgcggcttagtcctatactttgacgacgaggggttttgcgattttttagagcttattctgactaggggaggcagactgcaactatcattctcaatcttttgtgccgagccagccacactgctggcagacacacccgtcaatgatggtgcgtggcacagcgtgcgaatccgtcgtcaatttaggaataccacgctcttcatagaccaagtagaagctaaatgggtggaagtgaagtcaaagaggcgtgatatgacggtgttctctggattgttcgttggtggtctgccccctgagttgcgggccgccgcacttaagttaactctggcttcggtacgcgagagagagcccttcaaagggtggatacgcgatgtccgggtaaactcaagccaagtcctcccagtggacagtggggaggtcaaattggacgatgagccccccaattccggcggcggatcaccttgtgaggccggggaggaaggggaaggaggagtatgtcttaatggcggcgtgtgttccgtagttgacgatcaggcggtgtgcgactgcagtcggacgggatttcgtggaaaagattgtagtcaggctgacactaacctagaagggctggcgcatttaatgatgggggatcaggcaaagtcaaagcgaaaagaagagtacattgctacgtttaaagggtctgagtacttctgttacgacctctcccagaatcccattcaaagctctagcgatgagatcaccttgtcgttcaagaccttacaaagaaatggactcatgcttcacactgggaaatccgccgattacgtgaacctagcactaaagaatggcgccgtatccttggtgataaacctcggctctggtgcgttcgaggcactggttgaacctgttaatggaaaattcaacgacaatgcgtggcacgacgtgaaagtgaccaggaatttaagacaacattctggaataggacacgcaatggtgacgatttccgtggatggaatcctgactacgacagggtacacccaagaagattatacaatgctcggcagtgatgattttttctatgtgggcggctcccctagcaccgctgatcttcctggtagccctgtgagtaataacttcatgggatgtttgaaagaggtggtctataaaaataacgacgtaagactcgaactttctcggttagccaagcagggcgaccccaagatgaaaatccacggagtggtagctttcaaatgtgagaacgtggctacccttgacccgatcacttttgagactcctgagagttttatatctctgcccaagtggaacgccaagaaaacgggctcaatttcctttgattttcggaccaccgagcctaatggcttaatcctgttctcccatggaaaaccaagacaccagaaggacgccaaacacccccagatgatcaaggtcgacttctttgctatcgagatgctggatgggcatctttacctcttgttggatatgggctcaggaactattaaaatcaaagcactgttaaaaaaggtcaatgacggcgagtggtaccatgtagactttcaacgcgacgggcgttcggggacaattagcgtgaacacactcaggacaccctatactgcccccggtgagagtgaaatcctggacttggatgatgagctctacctaggaggcctgcccgagaacaaagcagggctcgtcttccccacagaggtgtggactgcgctgctgaactacgggtatgtgggctgcatccgcgatctgtttattgatggccagtccaaggatatacggcagatggccgaggttcagtctactgccggcgtgaagccaagctgcagcaaggagacagccaagccatgcctctcaaatccgtgcaagaataatggcatgtgtcgggatgggtggaaccgctatgtctgtgattgctccgggaccgggtatcttggccggagctgcgaacgcgaggccaccgtgctgagctatgatgggagcatgtttatgaaaatccaactgcccgtagtgatgcatactgaggccgaggacgtgagcctccggtttagatctcagagggcttacggtatcttgatggccaccacaagccgtgattccgccgatacacttcgtctggagttggatgccgggcgtgtaaaattaaccgtgaatctggactgcatcaggatcaattgtaactcttcaaaaggccctgaaactcttttcgcggggtacaatctcaatgacaacgagtggcatacggtcagggtggtccgccgcggaaagtctctgaaactgacggtcgacgaccagcaagccatgacaggccaaatggccggcgatcacactcgcctggaatttcacaatattgaaaccggcattatcaccgagcgcaggtacctgagctcggttcccagcaacttcataggccacctccagtctctcacgttcaacgggatggcatacatcgacctctgcaaaaacggtgatattgactactgcgagcttaacgcaagattcggcttcaggaatatcattgcagatcctgtcacgtttaaaaccaagagctcgtatgtcgccctggccactctccaggcttacacttctatgcacctgtttttccagttcaaaaccacttccctggacgggctcatcttgtacaatagcggggacgggaatgatttcattgttgtggagctggtcaagggataccttcactacgtattcgatctgggaaacggcgcgaatctaattaaaggctcgtctaataaacccctgaacgacaatcagtggcataatgtcatgatctcacgcgatacttcgaacctgcatacagtgaagatagatactaagatcaccactcagatcacagccggcgcaagaaacctagacctcaaatccgacctttacataggcggcgtggcaaaggaaacatataaaagtcttcctaaattagtgcacgctaaggagggattccaaggctgtctcgccagcgttgatctcaacggccgcctacctgatttgattagcgacgcgctgttttgtaacggtcagatagagcggggatgtgaagggccatccactacctgtcaggaagatagttgctcaaatcagggagtgtgcctgcaacaatgggacggtttctcctgcgactgtagcatgacaagtttctctggacccctctgcaatgaccccggaacgacatacatattcagcaagggaggcggtcaaatcacctacaaatggcctcccaacgacagaccatcaacccgggccgaccggctggcgatcggattttctaccgtgcagaaagaagcagtacttgtgagagtagatagctcttcaggactgggcgattacctggagttgcatatccaccaagggaagattggagtaaagtttaatgtgggtaccgatgatatagcaatcgaggagagcaacgccatcataaacgatggtaagtatcacgtggtccgctttacgaggtcaggcgggaacgcgactctgcaagtcgactcttggcccgtgatcgagaggtatccagcagggagacagctgaccatcttcaactcccaagccacaattatcattggaggaaaggaacagggtcagcctttccaaggacagctcagtggactctattacaatggcctaaaagtgctcaatatggcagcagaaaacgacgccaatattgccatcgtggggaacgttaggctggttggagaagtgccatctagcatgacaacggagtcaacggccacagccatgcagagcgaaatgagtacttctattatggagacaactaccactctggcaacctcaactgcacgccgaggaaaaccccccacaaaggaaccaataagtcagacaaccgacgatattctggtggcctctgccgaatgtccatcagacgacgaggacattgacccttgcgagccaagttcgggcggccttgccaacccgacccgggccggcggacgcgaaccttacccaggctctgcggaagtcatccgggagagctcatccacaacgggcatggtggtcgggattgtggctgccgctgccctatgtattctgattcttctgtacgccatgtataaatatcgaaacagagatgagggctcttaccatgtcgacgagagccgaaattacatatctaattctgctcagtctaatggggccgtcgtcaaggagaaacaaccaagctccgccaaatcaagtaataagaacaaaaagaacaaggacaaggagtactacgtgtag

SEQ ID NO: 196898 - DNA, 4647 bp, Artificial Sequence
  Description of Artificial Sequence: Synthetic coding sequence
atgggcaccgccctgctgcagcggggcggctgcttcctgctgtgcctcagcttactcctgttggggtgttgggctgaactcggtagcggactggaatttccaggtgcggaaggacagtggacccggtttccaaaatggaacgcctgttgtgagagtgagatgtccttccagctgaagacccgcagcgcccgcggcctagttctttattttgatgacgagggcttctgtgactttctcgagctaatactgaccaggggaggtcgactacagctatcctttagcattttctgtgctgaacccgcaacactccttgcagacacaccggtgaacgacggcgcctggcattcagtccgcattcgccggcagttccggaacactactctgtttattgatcaggtggaggccaaatgggtggaagtaaagtccaagagaagagatatgacagtgttttccggcctctttgtaggaggactcccgccggaactgagagctgcagccctcaagctgacactcgcctctgtgagggagcgcgaacctttcaaaggttggatacgggatgtgagggtcaattcaagccaggtgctgcccgtcgattccggggaggtcaaactggacgatgaaccacctaactccggcggaggttccccatgcgaggccggcgaggagggggaagggggcgtgtgtttaaatgggggtgtctgctcagttgtggatgatcaggcagtgtgcgattgtagcaggaccggcttcagaggaaaagactgcagtcaggaaatcaagttcggcctccagtgcgttctgcctgtgctgttacacgacaatgaccagggaaagtactgttgtatcaacactgctaagccgctgacagaaaaaaaggataatgattttgaaggcctcgcgcacttgatgatgggcgatcaagccaaaagcaaaaggaaagaggaatacatcgctacctttaaggggagtgaatacttctgctacgacctgagccagaatccgattcaatcatcttctgacgaaattaccctttccttcaaaactctacagcgtaatggtctgatgctgcacaccgggaaaagtgcagattatgtgaatctcgctcttaaaaacggtgccgtgagtttggtgatcaacctgggctctggcgcctttgaggcactcgtggaacccgtgaacggtaagtttaacgacaacgcatggcacgacgtaaaggtgacccgtaacctcagacagcacagcgggatcgggcatgcgatggtcaacaaattacattgctccgtcactatatccgtcgatggcatactgaccacaacaggctacacccaagaggactacaccatgctgggatccgacgacttcttctacgtcggcggctcaccatctaccgcagacctacctggaagtcctgttagcaacaacttcatgggatgtcttaaggaggtagtgtacaaaaacaatgatgttcgcctggagctcagtcggctggccaagcagggcgacccaaagatgaagatacacggagtggtagcattcaagtgtgaaaatgtcgccacactggacccaatcacttttgaaacccctgaaagtttcatttctctgcctaagtggaatgccaagaaaactgggtcgatttctttcgacttccgcactacagagcccaacgggttaatcctgttctcgcacgggaaacccaggcaccagaaagatgccaaacatccgcagatgatcaaagtagacttcttcgctattgagatgcttgacggacacctctatctccttctcgatatgggtagtggaactatcaagataaaagccctactgaaaaaagttaacgatggagaatggtaccacgtggattttcagagagatggaaggagtggtaccattagtgtgaacacccttagaactccatatacagctcccggtgaatcggagattctcgacctggacgatgagctctatttgggtggcctgcctgaaaataaggcgggactggtgttcccgaccgaagtgtggactgcactgctgaactacggatatgtcggctgcatacgtgatctctttatcgacgggcagtcaaaggacatcagacagatggcagaggtgcaatccaccgcaggggtaaagccatcttgcagtaaagaaaccgcaaagccatgtctaagcaacccttgcaagaacaatgggatgtgtagagatgggtggaatcgatacgtttgcgattgttccggaacggggtatttaggccgctcctgcgagagggaagctaccgtgttgagctacgacggaagcatgtttatgaagattcaactccccgtcgtcatgcacacggaggctgaagacgttagcctccgattccgaagccagagagcctacggtattctgatggcaactacttcaagggactccgctgacacactgagactggaactggatgcaggcagggtcaagctcaccgtaaatctggattgtattcgcatcaattgcaacagctcaaaaggacccgagacgctgttcgctggttataacctgaatgacaatgaatggcacaccgtccgcgtcgtgaggaggggaaagtctctaaagctgaccgtggatgatcaacaagccatgacaggccagatggctggtgaccatacacgactcgagtttcacaacattgagacagggattatcacggagcgccgctatttatcctctgtgccatctaactttattggccatctgcagagcctgacctttaatggaatggcttacattgacctctgcaaaaatggggacatagactattgtgagctgaatgcacgcttcggtttcaggaacatcatcgcagatcctgtgacctttaagaccaagtcttcctacgtggccctggccaccctgcaggcctatactagcatgcacctgttctttcaattcaaaaccaccagtctcgacggactgattctctacaacagtggagacggtaatgactttatagtggtggagcttgtcaagggctacctccactatgtgttcgatcttgggaatggggccaatctgatcaagggctcatctaataaacctctcaatgataatcaatggcataatgttatgatctccagagacacttctaatttgcataccgtgaaaatcgacacgaagattactacacaaattacagctggagcaagaaatctggacttaaaatcagacctgtatattgggggggttgccaaggaaacctataagagtctgccaaagcttgtgcacgccaaggagggatttcagggctgccttgcctccgtcgacctcaacgggagattgccagacttgatatccgatgctttgttctgcaacgggcagattgagcgggggtgcgagggcccatccaccacatgtcaagaggatagctgtagcaaccaaggagtctgcttacagcagtgggacggattttcttgcgattgtagcatgacgagcttcagcggccctctttgtaatgatcctggtaccacctacatattctcaaaagggggtggtcagattacatataaatggcccccgaacgatagaccaagtacacgcgccgacagactcgcaattggattctcaacagtgcagaaagaggcagtcctggtccgcgtggactccagtagcggcctgggtgactacctggagttgcacatccaccagggaaaaatcggcgtcaagtttaatgtgggtactgacgacatcgcgattgaggagtctaatgctatcatcaatgacggtaaatatcacgtggtccggttcacccgctcaggtgggaacgctaccttgcaggtcgacagctggcccgtcatagagcgatatcccgctggaaataatgacaatgaacgactcgccatcgctcgtcaacgaatcccataccgcctcggccgcgtggtggacgaatggctcctggacaaaggtaggcagttaaccatttttaattcccaggcaaccattatcattgggggcaaggaacaaggccagccatttcagggccagctttccggcctctactataatggactcaaggtgttgaacatggctgctgagaatgatgctaacattgctatcgtaggcaatgtgagactcgtgggcgaggtccctagttccatgacgaccgagagcaccgccaccgccatgcagtcagagatgtcgacatccatcatggaaaccaccacgactctggcgacatcgactgctagaagaggtaagcctcccactaaggagcctatttcacagacgaccgacgatatcctggtggctagcgccgaatgtccgtcagacgacgaagacatagacccctgtgaaccttcctctggcgggctagccaacccaacacgcgcgggaggccgggagccctatcctggctcagcagaggtaattcgagaatcttctagcaccaccggtatggtggtcgggattgtggcagctgctgccttgtgtatcctgattctgctgtatgctatgtataaatatcgaaatagggacgaaggcagctatcacgtagatgagagcaggaactatatatccaactccgcacagtctaacggggcagtggtaaaagagaagcagcctagttctgccaagtccagcaacaagaataagaagaataaagacaaggagtactacgtttag

SEQ ID NO: 196899 - DNA, 1191 bp, Artificial Sequence
  Description of Artificial Sequence: Synthetic coding sequence
gccctggagatctgggagcagccccccgccccccggctgctgttccctggtctcccatttagaaccagtccgtcccctgccgccttctataggagtccagcaagcctgcggggaggccacgcaggcactacatatattttctcaaagggcgggggacaaattacttacaagtggcctcccaatgacagacctagtacaagggcggaccgcctggccattggctttagcacggtccagaaggaggccgtgctggtgagggtcgattcttcttccggcttgggagattacttggagcttcacattcatcaagggaaaattggcgtgaaatttaatgtggggaccgatgacattgctatcgaagagagtaacgcaatcatcaacgacggcaagtatcatgtggtcagatttacgcgaagtggcggaaatgccactctgcaggtagacagctggcccgtaatcgagcgataccccgctgggcgccaactaaccatcttcaattctcaggccacaattattattggcggaaaggaacagggtcaaccattccaggggcagctgtctggtctgtactataatggacttaaggttctgaatatggctgctgagaatgacgctaatattgcaattgtcgggaatgtaagactggtgggggaagttccatcgtcgatgaccaccgaaagcactgctacagcaatgcaatctgagatgtcaaccagtatcatggagaccactacaactttggcgactagcaccgccagacggggaaaaccccctacaaaagagccgatctcgcagacaactgatgatatcttagtggccagtgcggaatgcccttccgacgacgaagacatcgacccttgcgagccctcctcgggcggtctcgctaacccgaccagggccggaggaagggagccctaccctggctccgccgaagtcatccgagaaagtagctcgacaacaggcatggttgtgggaatcgttgccgctgcggcgctttgcatcttgattctgctatacgcgatgtataaataccgcaaccgggatgaaggctcctaccatgtggatgagtcccggaattatatcagcaactccgctcagtccaacggcgccgtggtaaaagaaaagcagccctcctctgctaagtcctcaaataagaataagaaaaataaagataaggaatattacgtgtag

SEQ ID NO: 196900 - DNA, 5139 bp, Artificial Sequence
  Description of Artificial Sequence: Synthetic coding sequence
atggccagcggcagccggtggcggcccacccccccccccctgctgcttcttcttctgcttgctctggccgctagagcagatggcctggagttcgggggcggtcccgggcagtgggcccgatatgctcggtgggccggcgccgccagcagtggagaattgagtttctctttaagaactaacgcaacaagggctctcctattatatctggacgatggcggcgattgtgatttcctggagcttctactagtggacgggagactcagactcaggttcaccttatcttgtgctgagccagcaactctgcagctcgacactcccgtggctgatgataggtggcatatggtactgctgactagggatgcaagacgcacggcactcgccgtagatggcgaagcccgagccgccgaggttagaagtaaacggcgcgaaatgcaggtggccagcgacctctttgtgggggggatcccccctgacgtgaggctatctgcgctgaccctgagtaccgtgaagtacgagcctcctttcaggggcctgcttgcgaatctgaaacttggagagcgaccaccggcactgctaggctcacaaggactgagaggcgcaacggccgaccctttgtgcgcccctgcacggaatccctgtgctaacggtggcctgtgtacggtcctcgctcctggtgaagtcggctgtgactgtagtcataccggattcggcggtaagttctgctccgaagaggagcatcccatggagggcccagctcatctgacactgaactctgaggttgggtccctgctcttcagtgaaggtggtgctggacggggaggagcgggcgacgtgcaccagccgacaaaagggaaagaagagttcgttgcaacatttaaggggaacgaatttttctgttacgatctgagtcacaatccgattcaaagcagcactgatgaaattaccctcgcatttcgtaccctccagcgcaatggcctaatgttgcacaccggaaagtctgcggattatgtaaatctcagcctgaaaagcggggcggtgtggctggtcatcaacctaggctccggcgcattcgaagccctggttgagccagtaaacggcaaatttaatgacaacgcatggcatgacgtgcgtgtgactagaaatcttaggcagcacgcaggaatcggtcacgctatggtaaacaagctgcattacctagtgaccatctctgttgacggcatcctgacaaccactgggtatacgcaagaagactataccatgctagggagcgacgattttttctatattgggggtagccctaacaccgcggaccttcccggcagccctgtgagtaataattttatgggttgcttgaaggatgtcgtctacaagaataatgatttcaaactggagctctcacggttagccaaagagggcgatccaaaaatgaagctgcaaggtgatctgagttttagatgtgaggacgtggccgcactggacccggtcacctttgagtcaccagaggccttcgttgcactaccccgctggtctgcaaagcgcaccgggtctatttcgctggactttcggacaactgaacccaatgggctgctgctgttctcgcaggggcgcagggccggggggggggccgggtcccattcctccgcgcagcgcgccgactattttgctatggaactgcttgacggccatttgtaccttctactggatatgggcagcggcggcattaagctgcgcgcttccagtagaaaggtgaatgatggagaatggtgtcacgttgatttccaacgtgatggacggaaagggtccatcagcgtgaatagtagatccacaccattcctggctaccggggactctgagatcctagacctggagtccgaactataccttgggggacttccagagggcggccgagtggacctaccgcttccaccagaggtgtggaccgcagcactgcgcgctgggtacgtcggatgtgtgcgcgatctgttcattgatgggcggtcacgcgatcttagagggcttgcggaggcacagggtgcggtcggagtggcaccattctgttcaagggaaacccttaaacagtgtgcgtcagctccgtgccgcaatggaggagtttgccgggaaggctggaaccgctttatttgtgactgcatcggaacaggtttcttgggaagggtgtgcgagcgggaggctactgttctctcctatgatgggagcatgtacatgaagattatgctgcctaatgccatgcacacagaggccgaagacgttagtctcaggtttatgtcccagcgggcctacgggctgatgatggctactacatctcgtgagagcgccgacacacttagattggaattggacggagggcaaatgaagttgaccgtcaacctggactgcctccgcgtgggatgcgccccttctaaggggcccgagaccctcttcgctggacacaagctgaacgacaacgagtggcataccgttcgagtagtccggaggggcaagtcactccagctgagtgttgataacgtcactgtggaagggcagatggccggcgcacatatgcgtctggaatttcacaatattgagaccggaatcatgaccgagagacgttttatttctgtagtgccaagtaacttcatcggacacctgagtgggctagtgttcaatggccagccatatatggaccaatgtaaagacggtgatattacatactgcgagctgaatgctcgctttggactgcgagctatagtggccgacccagtaacctttaaatctaggagcagctaccttgcccttgctacactgcaggcgtacgccagtatgcacctgttctttcagtttaaaacgactgcccccgacgggctgctactcttcaactctggaaatggcaatgactttatcgtgatcgagctcgtgaaaggctacattcactacgtctttgacctcggcaatgggccaagcctgatgaaaggaaacagcgacaagcccgtcaatgacaaccagtggcacaacgtagtggtgtcaagagaccctggcaacgtgcacacacttaagatcgacagtcgcactgtgacgcagcactccaacggagcgcgcaatctggacttaaaaggcgaattatacatcggtgggctgtccaagaatatgttttctaaccttcctaagctagtggcaagtcgagatggcttccaaggctgtctcgcctctgttgatctgaatggccgtctacccgatctgatcgctgacgcacttcaccgaattggtcaggtagaacgcggatgtgatggccccagcacaacttgcactgaagaaagttgcgcaaaccagggtgtgtgtctccagcagtgggatggattcacgtgcgattgcactatgacttcgtacgggggacccgtgtgtaatgacccaggcactacttacatcttcggcaagggtggagctttaatcacttatacatggcctcctaacgaccggcctagcacaagaatggataggttagccgtcggttttagtacccatcagcgcagcgctgtgctggtgcgggtagactccgcttccggattgggagactacctgcagctgcacatcgaccagggcaccgtgggggtgatcttcaacgtcggcaccgacgatataacgattgatgaacctaacgcgattgtgtccgatggcaagtatcacgtggttcgattcaccaggtccggaggtaatgctacgctgcaggtggattcttggcccgtcaacgaacggtaccccgctggtaattttgacaatgagcggctggcaatcgcccgacaaagaatcccatacaggctcgggagggtggtagatgagtggctgctggacaagggccggcagctgaccatattcaactcacaggccgcaatcaaaatcggaggaagagatcagggccgcccctttcaggggcaggtgtcaggactctattacaacggcctgaaggttctggcactcgcggccgagtctgacccaaatgttagaacggaaggccatctgagacttgtgggtgaaggtccgtccgtgctgctgagtgctgagaccaccgccactactctcctggccgacatggctaccacgatcatggaaaccacaaccactatggccacaaccactacacgccgggggcgttcaccaaccctacgtgactctacaactcagaataccgacgatctcctcgtcgcctcagcagaatgcccctccgacgacgaagatctcgaggaatgcgagccgagcacaggcggcgagctgatactgcccataattacagaggacagcttagatccaccaccagtggctactcgatctcccttcgtgccccctcctcctactttctatcctttcctgactggagtgggggccacccaggacaccctccctccacccgccgctcggaggcctccctctgggggcccctgtcaggctgagcgcgatgattccgattgtgaggagccgatcgaggcctcaggatttgcgagtggggaggttttcgactcatcacttccccccacagatgacgaagatttctataccaccttccctctcgttacagacaggactactctgctttctcccagaaagcctgcacctagacctaacttgagaacagatggcgctaccggtgcccctggtgtcctttttgccccgagtgcccccgctccgaatttgcccgcaggaaaaatgaatcatagagatccacttcaaccccttctggagaacccccctctcggtcccggcgcgcctacgagcttcgaaccccggagaccccctcccctacgccctggggtcacgagcgccccagggttcccacaccttcccactgccaaccccacgggtcccggcgaaagaggaccaccgggagcagttgaggtgattagagaatcttcttcaaccaccggcatggtcgtgggcatcgtagctgccgctgccctgtgcatcctcatcctactttatgccatgtacaaatatcgcaatagagacgaaggatcatatcaggttgatcaatctcgtaactatatttccaatagcgcacagagtaacggagctgtagtgaaagaaaaggcccccgctgctcctaaaacaccttccaaagccaagaaaaataaagataaagaatactatgtgtag

SEQ ID NO: 196901 - DNA, 4929 bp, Artificial Sequence
  Description of Artificial Sequence: Synthetic coding sequence
atggccagcggcagccggtggcggcccacccccccccccctgctgcttcttttgctgttagccctcgcagctagagccgacggacttgagttcggcggaggtcctggccagtgggccagatacgcacggtgggcaggagctgccagcagtggggagctgagcttctctctgcggactaacgcaactcgtgcactgctgttgtatctggacgacggtggcgactgcgattttctggagctacttctggttgacggacgactgaggctgcgtttcacccttagttgtgccgaaccagctaccctgcagcttgacactccagtggcagacgatcggtggcacatggtgctgctcacgcgggacgcgcgacgcacagccctggctgtggatggggaggcacgagcggccgaggttcgttcaaagagacgggagatgcaggtggcttcggatctcttcgtgggaggcattcctccagatgtccgcctgagtgctctgactctgtctactgtaaagtacgaacccccatttcgaggactgctggcaaacctgaagttgggggagcgacctcccgctctgcttggaagccaagggttaagaggtgctacagccgatccactttgcgcacccgcgcggaatccatgtgctaacggaggcctgtgtacagtgctcgctccaggtgaggtgggttgcgactgctcccataccggattcggcggcaagttttgctctgaagccccctcccccttccagggccctgcccatctgaccctcaatagtgaagggaaggaggagttcgtggccaccttcaaaggcaatgagtttttttgctacgacttgtcccataatccaatccagagcagtacagatgagatcacactggccttccgcaccctgcagcgtaatgggctcatgctccacaccgggaagtccgcggattatgtaaatcttagcctgaagtcaggggctgtgtggttagtgattaacttgggttctggcgcctttgaagcgttggttgagcccgtcaatggaaagttcaacgacaacgcctggcacgatgttagagttaccaggaacctgagacagcatgcaggcatcggccacgcgatggtgacgatcagcgttgacggaatcctcactacaacgggttatacccaagaagactatacaatgctgggttctgatgacttcttctatatcggaggctccccgaataccgctgacttgcccgggtcccctgtttctaacaattttatgggctgtcttaaagacgtggtttacaaaaacaacgatttcaagctcgaattgagtagactggcaaaggagggcgatcctaagatgaagctgcagggggacctgtctttccgttgtgaagacgtggcagctttagaccctgtcacatttgaaagccccgaagcttttgtggctctcccaaggtggagcgcaaagcggacgggcagtatttctcttgatttccggactacagagcccaatgggctgctcctgttcagtcagggcaggcgagctgggggcggagcagggagccactcctccgctcagcgggccgattacttcgccatggaactgttggacggccacctctacctcctgctcgacatgggatccggaggtatcaagctgagggcaagctctcggaaggtgaatgatggggagtggtgccacgtggactttcagagagacggacgaaagggctccatctcagtcaacagtcgttctacgcctttcctggctacgggggactccgagattttggatcttgaaagtgaactctacctgggagggctgcctgaaggtggccgggtggacctgcccttgcctcccgaagtttggacagcggccttgcgcgcaggttacgtcggctgtgtccgggacctctttatcgacggacggtccagggatttgagagggttggctgaggcccagggagccgtgggagtggccccattttgctcaagggaaaccctaaagcagtgcgctagcgcaccttgccgaaacggtggagtgtgcagagagggttggaatcggttcatctgtgactgcattggtaccggctttctcgggagggtgtgcgagcgggaagccactgtgctgtcatacgacgggagtatgtatatgaagataatgttgcctaacgctatgcatacagaggccgaagatgtcagtctcagattcatgagtcagagggcatacggcctcatgatggccacgacctccagggaaagtgccgataccctgaggctggaactggatggaggacaaatgaaattaacagtcaatctagggaagggcccggaaaccctgttcgctggtcacaagctgaacgacaatgaatggcatactgttagggtggttcgtcgcggcaagtcactgcagctaagcgttgacaatgtcaccgtcgaaggccagatggccggggcgcacatgagactcgaatttcacaatatcgagaccggcattatgaccgaacgcaggtttatatccgtggtgccgtccaatttcattggccaccttagtggtctggtgtttaacggacagccctacatggaccagtgcaaggacggtgacatcacttattgcgagcttaatgccaggttcggtctacgtgctattgtggccgaccccgttacattcaagtcccgtagcagctatctcgccctggcaacactgcaggcatacgcttctatgcatctgtttttccaattcaaaacgaccgcacccgatggactcttgctcttcaattctgggaatgggaacgatttcatagtcatcgaacttgtgaagggctacatccactacgtgttcgatctcggaaatggcccctccttaatgaagggtaatagtgacaagcccgttaatgataatcagtggcacaacgtcgtcgtatctagggatcctggcaacgtacacacactgaagatcgattcccggaccgttacgcaacacagcaacggcgcgcggaacttagatcttaagggggaactttatatcggaggactgagcaagaacatgttctccaacttgccgaaactcgtggcatcacgagatggatttcagggctgccttgcctcggtggacctcaacgggcgcctgcctgacctcattgctgatgcgcttcacagaatcggccaggtcgagcgaggatgcgacggaccatccaccacatgcactgaggagagttgtgcaaatcagggtgtgtgcctacagcagtgggacggatttacctgcgattgtaccatgaccagttacggaggaccagtgtgtaacgaccctggcaccacctacatctttggtaaagggggtgctctcatcacctatacctggccccccaacgacaggcccagcacccgaatggaccggctcgccgtgggtttctcgacccaccaacgttcagctgttttagttcgcgtcgactcagcgagtggactgggcgactatctgcaactccacatagaccagggaacagtgggcgtgatatttaacgtagggactgatgatattaccatcgacgaacctaatgctattgtgtccgacgggaagtaccacgtggtcagattcacccggagcggcggcaacgctacactacaggtggatagttggcccgtgaatgagcgctatcctgccggaagacagttgactattttcaacagccaagctgccataaagattggggggagagatcaaggaaggcccttccaagggcaagtatcgggtctgtactataatggcctcaaagtgttggccctagccgccgagagcgatcccaacgtacgaacagaaggccacctgagactcgtcggcgaggggccatcggtccttctgagcgcagagaccacagcaacaacactgctcgcggacatggcaactaccataatggaaactaccacaacaatggcaaccaccacaacgcgccggggacgtagtcccacactgcgcgactccaccacacaaaatactgatgacctgctggtcgcttctgccgagtgccccagcgacgacgaagaccttgaggagtgcgaaccaagtacaggaggggaactgatactacccataatcacagaagattctttggaccccccccctgtagcaacacgctcaccgttcgtgcctcccccccccacgttttacccgttcttgactggcgtcggcgccacgcaagatacactgcctccacccgccgccaggcggccgcctagcggaggaccgtgccaggcagagagagatgactctgattgcgaagagccgatagaagcatctggcttcgcttcaggcgaagtgttcgacagctcgctgcctcccaccgacgatgaagatttctacaccacattcccgctcgtgacggacaggacaaccctcctcagcccccggaagcctgcccctagacctaacctccgaacagacggtgcaactggcgctcctggagtgttatttgctccatctgctcccgcacccaacctgcctgccggcaaaatgaatcacagagaccctctacagcctttgctggaaaacccacccctgggacccggcgcccccacctctttcgaaccccggagaccaccacctctgagaccaggggtcacttctgcccctggcttcccacacctgcctaccgccaaccccacaggacctggagagagaggcccccctggggcagtggaagtaataagggagtccagcagcacaactggaatggtggtggggattgtggcagcagctgcactctgcatcctgattctgctgtacgctatgtataagtacaggaatagagacgaaggatcatatcaggtggaccagtccaggaactatatctccaactcagctcagagcaatggggcagtggtgaaggaaaaggctcctgcagcccccaagacacccagcaaagccaaaaagaataaggacaaggagtactatgtatag

SEQ ID NO: 196902 - DNA, 5139 bp, Artificial Sequence
  Description of Artificial Sequence: Synthetic coding sequence
atggccagcggcagccggtggcggcccacccccccccccctgctgctgcttctcctcctggccctcgctgccagggctgatggtttggaattcggaggtggcccggggcagtgggcccgttacgctaggtgggccggagccgcgagttccggcgagctgtcctttagcctgcggacaaatgcgactagggccttattattataccttgacgacgggggggactgcgattttctcgaactgctgctagtcgacggccgcctgaggcttcgttttaccctgtcgtgcgccgaaccagccacgttacagctggacacgccagtggcagatgatcggtggcatatggttctattaacacgggacgcccggagaactgcacttgccgttgatggagaggcacgggccgcagaagtgaggtccaaacggcgggagatgcaggtcgcttctgatctgttcgttggcggaataccacccgatgtccgactttcagcccttacgctcagcaccgtgaagtatgagcctcccttccgaggcctcctcgcaaacttaaaactgggagagcgcccgccggcattgctgggttctcaaggccttcggggggcaaccgctgatccgctatgcgcacctgcaaggaacccttgtgccaatggtggtctctgcactgtgctggccccgggggaagtgggctgcgattgctctcacaccggtttcggcggcaaattctgttctgaggaagagcaccctatggagggaccagcacatctaacactgaatagcgaagtgggttcgctgctgttcagtgaagggggcgctggccggggcggggcaggcgatgtccatcagcctactaaaggcaaagaggagtttgtcgccacattcaaaggcaacgaatttttctgctacgacctgtcccacaaccccatccagtcatctactgacgaaataaccttggccttccgcaccttacagcgcaacggactcatgcttcacacaggcaagagcgctgactacgtaaatctgtctctaaagagcggggccgtgtggcttgttataaacttaggtagcggtgctttcgaggccctcgttgaaccagtgaacggcaaattcaatgataatgcctggcacgatgttagagttacacggaacctgcggcagcacgctggcatcggccacgcaatggtcaataaactccactatctggtcaccatttctgtagatggtattctgaccactactggatacacacaggaagactacacaatgctcggttctgacgatttcttttacattggggggagtcccaacaccgcagatctgccaggatcacccgtcagtaacaacttcatggggtgtctgaaagatgttgtctacaagaacaatgactttaagttagaactttcccgcctcgccaaagagggagatccgaagatgaagctccaaggagacctgtccttccgttgcgaggatgtggctgcacttgacccagtgacatttgaatcccccgaggcttttgtggcactgccccgatggtcagcaaaacgtacagggtctatatccctggattttaggaccaccgagcctaacggtctgctccttttctcccagggcagaagagccggcgggggggctggctcccatagcagcgcccaaagggctgactatttcgccatggagctcttagatggacatctttacctgttactcgacatgggatcggggggcattaaactgagagcctccagccgcaaagtcaatgacggggagtggtgtcacgtcgatttccagcgtgatggccgcaaggggagcatctccgtcaactccagatcaacccctttcctggcaactggagatagcgagatccttgacctagagtcagaattgtacctcggcgggttgccagagggcggcagggttgatctgcctctgccccctgaagtttggacagcagcactgcgcgctggttacgtgggatgtgtgcgcgacctcttcatcgacggtaggtccagggacctgcgaggcctcgccgaagcccaaggggcggtcggcgtggcaccattttgctcccgcgagaccttgaagcagtgtgcaagtgcaccttgtagaaacggcggcgtgtgtcgcgagggctggaacagattcatttgtgattgcattggcacgggcttcctgggcagagtatgtgagagggaggccacagtgttgtcctacgacggcagtatgtatatgaagattatgctgccaaatgccatgcataccgaggccgaggatgtgtccttgagattcatgtctcagagggcctacgggctgatgatggcaaccacctcacgggaaagtgccgatactcttcgactggagctggacgggggccagatgaaactgaccgtcaacctcgattgcctgcgtgtaggttgtgcaccttccaagggacccgagacgctcttcgcaggccacaaactgaatgacaatgagtggcatactgttcgggttgtgcggcggggaaaatctctgcagctctccgtcgataatgtgaccgtcgaggggcagatggcgggagcacacatgcggttggagtttcacaatattgaaacaggcattatgactgaacgtcgcttcataagtgtagtgccttccaactttattggccacctgagcgggctcgtgtttaacggccagccctacatggaccagtgtaaggacggcgatataacatactgtgagctgaatgctaggttcggactcagggccatagtggccgatccagttacctttaagagccgcagcagctatttagctttagccacattgcaggcctatgcttctatgcatttgttcttccagttcaaaaccaccgcccctgacggactgttattgttcaactccggaaacggtaatgatttcatcgtaatagaacttgtaaagggatatatccattatgtgttcgatcttggcaatggtccctcactgatgaaaggtaactcggataaaccagtgaatgataatcagtggcacaatgtggtggtctcccgggacccaggtaacgtccataccctgaagatcgatagtcggacagtgacacaacatagcaatggcgcccggaaccttgatttgaaaggggagctctacattgggggcctatccaaaaacatgttcagcaatttacctaagttggttgcctcacgcgacggctttcaggggtgcttagcctctgttgatttaaatgggagacttccagatctaatcgctgacgccttacacagaattggccaggtagaacgcggttgtgatggtccgtctaccacgtgtacggaggagtcttgcgccaaccaaggcgtgtgcttgcagcagtgggacggctttacctgtgactgtactatgacgagctatggcggtcccgtctgtaacgatcccggtactacctacatttttgggaagggcggcgccctgattacctacacttggccaccaaatgaccgaccgagtactaggatggacagactagctgtagggttctccactcaccagagatctgccgtgctggtgagagtcgactcggccagcggacttggtgattacctgcagctgcatattgatcaggggaccgtcggggtgatctttaacgtggggacggacgatatcacaatcgacgaacctaatgcaatagttagtgatggcaagtaccatgtggtgcgtttcacaagatccggcgggaacgccactcttcaggtagacagttggccggtgaatgagaggtacccagctggaaactttgacaatgagcggcttgccattgcccgtcaacgaatcccctatcgcctaggacgagtggtcgacgagtggctgctggacaaaggacgccagctgactattttcaactcccaggctgccattaaaatcggggggagagatcaggggagaccttttcagggacaagtgagtggattgtattacaacggattaaaggtgctcgctttggcagccgagagcgatcctaatgtccgaacagagggccacctgcgacttgtcggcgaggggcccagtgtactgctttccgccgaaacgacagccactacactcctcgccgatatggcaaccacgataatggagacaacgacaaccatggcaaccacaaccaccagacgtggaagatcaccaaccctgcgggattcaaccacccaaaacacagacgatctcctggtagcaagtgctgaatgtccaagcgacgacgaggacctggaggagtgcgaaccctccaccggaggtgaactgatattgcccatcattactgaggatagcctagacccacctccggtggcgacaaggagcccattcgtccctcctccacccaccttttaccccttcctcacaggcgttggcgcgacacaggatactcttccgccacctgcagctaggcgacccccgagtggtggcccttgccaggccgagcgcgacgatagtgactgtgaagaacctattgaggcctctggattcgcctccggtgaagttttcgattccagcctcccacccacggacgatgaagacttctacactacctttcctctagtcacagacagaacgacactcctgtcaccacgcaaacccgctccccggcctaatcttcgtacagatggcgcaacaggtgcccccggtgtgctcttcgcgccctcagcccctgctcccaacctgcctgccggaaagatgaatcatcgtgaccctttgcaaccgctcctcgagaacccgcccctgggccctggagcaccaacgtcatttgagcctagacgtccccctcctttgaggcccggcgtgacctccgcaccgggcttcccccatttgcccacagctaatcctaccggccctggggagaggggccccccaggcgcagtggaagttatacgtgaaagctcaagcaccacaggtatggtagttggaattgtcgcagccgccgccttgtgtattcttatactgttatatgctatgtacaaataccggaacagagacgagggatcctatcaggtggaccagtcacggaattatatcagtaactctgcacagagtaatggagctgtggtgaaggaaaaggctcctgccgcaccaaaaactccctctaaggcaaagaaaaataaggacaaggagtattatgtgtag

SEQ ID NO: 196903 - DNA, 4929 bp, Artificial Sequence
  Description of Artificial Sequence: Synthetic coding sequence
atggccagcggcagccggtggcggcccacccccccccccctgctgctactactgttactggcacttgctgccagagccgacggcctggagttcggcggcggtccaggccagtgggcccgctacgcccgttgggctggcgccgcgtcctctggtgaactgagcttctcgctgcggacaaacgccacaagagccctgctgctttatctggatgacggaggcgactgtgattttctcgaactactgttggtcgatggtaggctccggctgcgcttcactttgtcctgcgcagaacctgctaccctgcagctggatacacccgttgccgacgacagatggcacatggtgctgttgacaagggacgcgagacgcaccgcacttgccgttgacggcgaagcccgcgcggctgaagtcaggtcaaaaaggagagagatgcaggtcgctagtgacctgttcgtaggcggcattcctcccgatgtaaggctcagcgcgctgaccctgtctactgtcaaatatgagcccccattccgaggcctgctggccaaccttaagctcggcgagaggccaccggccctgcttggatctcaaggcctgcggggggcgactgcagatccgctgtgcgcccctgcccgtaacccttgtgccaacgggggcctctgtaccgtgttggctccaggtgaggtgggatgtgattgctcccatacgggatttggcggcaagttttgtagtgaagaagagcacccaatggagggaccggcgcacctgaccttgaattccgagggcaaggaggagtttgtcgccacatttaagggaaacgagtttttctgttacgatctgtcccacaacccaatacagtcctctaccgacgaaattacacttgccttccggactctccagcgtaatggacttatgcttcacactggcaagtcggctgattatgtcaatctatcacttaagtctggggccgtgtggctagtcatcaacctgggttctggcgctttcgaagcactggttgagcctgttaatgggaagtttaacgacaacgcctggcatgatgttagagtcaccagaaacctgcgccagcatgctgggatcggacatgccatggttacaatctccgtggatgggattttaaccactacaggatacactcaggaggattacaccatgctgggttccgatgacttcttctacataggggggtcaccaaacaccgccgatttgccaggcagtccggtttccaacaactttatgggttgtttaaaggacgtggtgtacaaaaataacgatttcaagcttgagctctcacggctagccaaggaaggcgatcccaaaatgaaattacagggtgatctaagttttcgttgtgaggacgtcgcagccctggacccagtcaccttcgagtcacctgaagcttttgttgcccttccgcggtggtccgcgaagcgcacgggctccatatcgctggattttaggaccacagagcccaacggcctcctgctattttcccaaggaaggcgggcagggggcggcgccgggagccattcttccgcccagcgagcagattactttgcgatggaattactcgacggacatttgtaccttctcttggacatgggtagcggaggtataaagctgcgcgcgagttccagaaaggtgaacgatggcgagtggtgccacgtggatttccagagggacggacgaaagggatcaatttcggttaattcaaggagtaccccattcctggcaacaggcgactccgagattcttgatttggagagcgagctctatctgggtgggttaccagagggagggcgggtcgaccttccacttcctccagaagtgtggactgcagctctccgggcaggatatgtgggctgtgtaagagatctttttattgacggccgatcaagggacttacgaggactcgcagaggcccagggcgcagtaggagtagccccattttgctcgcgcgagactcttaaacaatgcgcctctgcaccatgtagaaatggtggggtttgcagagagggttggaataggttcatctgcgattgcatcggaaccggctttctaggccgtgtgtgtgagcgggaggccaccgtactgtcttacgatgggtctatgtacatgaagatcatgctacctaacgcaatgcatacagaagccgaggacgtgagcttgcgctttatgagtcagcgtgcttacgggcttatgatggcgacaacaagtagagagtcggccgatacactgagactcgagctagatggtggacaaatgaagctcacagtgaacctgggaaagggacccgagacactctttgccgggcataagctcaatgataacgagtggcataccgtacgggtggttagacgcggtaagtctctccagctcagcgtcgataatgtgactgttgaaggtcagatggccggagcccatatgcgcttggagtttcacaacatcgaaacaggcattatgacagaaagacgatttatttcagtagtaccgtcaaatttcatcggccacctgagcggcctggtgtttaacggccagccctacatggaccagtgcaaagacggggacattacctattgtgagctgaatgcccgctttggcctgcgtgccatagtggctgacccggtgacattcaagtccaggagctcctatctcgctctggcaactttacaggcttacgcgtccatgcacctgttctttcagttcaagaccaccgcaccggacggcttgcttcttttcaactctgggaacgggaatgattttatcgtgatcgaattagtcaaaggctatatacactatgttttcgacctcggtaacggacccagcctgatgaaaggaaattctgataagcccgtaaacgacaatcagtggcacaacgtggtagtgtcgcgggaccccgggaatgttcatactttgaaaattgactcacgaacggtgacacagcacagcaatggggcaaggaatctagatctgaagggagagctctatatcggaggactgtccaaaaacatgttcagcaatctgcccaagctggtcgcatcccgggatgggtttcagggctgcctggcatccgtcgacctgaacggacgcctccctgacttgatcgcggacgcactccatcggatcggacaggtggaaaggggatgtgacggaccctccaccacttgtacggaggagagctgtgcaaaccaaggggtctgtctccagcagtgggatggcttcacctgcgactgcacaatgactagttacggaggccctgtctgcaacgacccagggaccacatatatttttggcaagggaggtgctttgatcacctacacttggcctcccaatgaccgcccatctaccaggatggaccgtctagccgtcggcttctcaactcatcaaagatcagcagtcctggtcagggttgatagtgccagcgggctgggcgactatcttcagctacacatagaccaggggacggtgggtgtgatctttaatgtagggaccgacgatataacaattgacgagcctaacgccattgtaagtgacggcaaataccacgtggttcgcttcacaagatctggcgggaatgctaccctccaagtggacagctggcctgtgaacgagcggtaccccgccggcaggcaacttacgattttcaactctcaagccgcaatcaagataggcggtcgcgatcaagggagaccctttcaaggacaggtgagcggtctatactataatggtctgaaagtcctggctctggcagctgaatcagatcccaatgttagaaccgagggacacctgcgactagtcggggaaggaccctccgtgctgctctctgccgagactaccgccaccactttgttggcagacatggcaaccacaatcatggaaacgactacgacaatggccaccaccaccactcggagggggcgatcccccactctgagggactccacaacacaaaatactgatgacctgctcgtggcctccgctgaatgtccctctgatgatgaggacttagaagagtgcgaacctagcacaggcggggaactgatcttgccaataataaccgaggattctctggacccaccgcctgtggcgaccagatcaccttttgtccctccccctcctacattctatccctttctcaccggagtgggggccacccaggacaccctgcccccacccgcagcgaggaggcctccttcgggaggaccctgccaagccgagagggacgattccgactgcgaagaaccaatcgaggctagcggattcgcatccggggaagtattcgacagctcactgcctcccacagatgacgaggacttctacacaactttccctcttgtcacagatcgtaccactctcttatccccccgaaagccagctcctagacctaacctgcggactgatggggccaccggtgcccccggagtgctcttcgcaccgagcgctcctgcccctaacttgccagcaggtaagatgaatcatagggatccactgcagccactccttgagaaccctcccctgggccccggcgcccctacctctttcgagccaagaagacctccacccctgcgtccgggcgtcactagcgccccaggattcccccatctacccacagcgaatcccacagggcctggagagcgtggaccccctggcgccgtggaggttattagggaaagtagtagtacaacgggtatggtcgtcggtatagtcgcagctgcggcgctgtgcatactgatcctcctctatgctatgtacaagtaccgtaaccgcgacgaaggcagctaccaggtggatcagtccagaaactatatatctaacagtgctcagtccaatggcgctgtggttaaggagaaagcccctgccgctcctaagactcccagtaaggctaagaaaaataaagacaaggagtactacgtttag

SEQ ID NO: 196904 - DNA, 5118 bp, Artificial Sequence
  Description of Artificial Sequence: Synthetic coding sequence
atggccagcggcagccggtggcggcccacccccccccccctgctgctgttgctcttgttggctcttgcagctagggccgacggcctggagtttggaggtggccccggacagtgggctcgctacgcaagatgggcgggagcagcatcctcaggggaactgagcttctcattgaggaccaacgcgacaagggccctgttactatacctcgacgacggcggcgactgtgattttcttgaactcctcctggttgatggaagattgaggctgagattcaccctcagctgtgccgaacccgctacgctgcaacttgatacacccgtggcagacgatcgttggcatatggttctattgaccagggatgcgaggaggaccgctctggcagtggacggcgaggctagggccgctgaggtgcggtccaagcggagggagatgcaggtggcaagcgacctgtttgtgggtgggattccacccgatgtccgactgagcgcattaacattgagtaccgtcaagtacgagcccccattcagaggactcctcgctaacctgaagctcggggagcgccctcccgctcttctcggatcgcagggtctgagaggagccaccgcggatcctctgtgtgctcccgctcgaaacccatgcgccaacggaggcctatgtacagttttagctcccggagaagtcggctgtgactgtagtcacacaggttttgggggtaaattttgttctgaggaggaacacccaatggaggggcccgctcacctgaccctgaatagtgaggtcggatccctactattcagtgagggtggtgccggacgtggcggagccggtgatgttcaccagccaaccaagggtaaggaggaatttgtagccacctttaagggtaatgagttcttctgttacgatctttcccataatcctattcagtcttccactgacgagattacattggcttttagaacacttcagaggaacggtctgatgctgcacaccggcaaatccgccgactatgtaaacctctccctgaaatcaggggccgtctggctagtgataaatttaggcagcggggcttttgaggccctagtcgaacccgttaacggtaagttcaacgataatgcctggcatgacgtccgggtcacaagaaacttacgccaacacgcaggcattggacatgccatggttacaatatcagtggacggaatcctgacgactactgggtacacgcaggaagattacacgatgcttggaagcgacgattttttttacataggcggttcaccaaacacagcggatcttccagggagcccagtgagcaacaatttcatgggttgcttgaaggatgtcgtttataaaaacaatgatttcaagctggagctctctagactggctaaggagggggacccaaagatgaagcttcagggagacttgtcctttcgctgtgaagacgttgcagcgttagacccagtcacctttgagagccccgaggcctttgtcgctctgcctcggtggagcgctaagagaacgggcagcatttcattggatttcaggaccaccgagcccaatggactgcttttgttttctcaggggcgcagggccggaggtggtgccggatctcacagttcagcacaaagagccgactattttgccatggagctgctggacggacatttatacttgctcttggacatgggctccggaggcattaaactgagggcgtccagcaggaaagttaatgacggcgaatggtgtcatgttgattttcagagggacggacgaaagggctctatttcggtgaatagccgttcaaccccatttctggctactggagactctgagattttagatttggagtcagaactctatctgggaggattgccggagggaggccgcgtggacttgcctcttccccccgaagtctggaccgcggctctgcgggccggttacgttgggtgcgtgcgcgacctgttcatagatgggaggagcagagacctacgggggctggctgaagcgcaaggggccgtgggggtggcaccattttgcagtagagagactcttaagcagtgtgcatcagcaccatgccgaaacggtggcgtttgccgcgagggatggaataggtttatctgtgattgcatcggcaccggctttctggggcgtgtgtgcgagagagaggcgaccgtgttgtcttatgatggatctatgtatatgaagatcatgttacccaacgctatgcatactgaagccgaggacgtgagtcttaggttcatgagccaaagggcttacggcctgatgatggcaactacaagccgcgagtccgctgacactttacgtcttgagctggatggcggacagatgaaacttaccgttaatctagattgcctccgagtgggttgcgcgcctagcaagggacccgaaacactgtttgcaggacataagctcaatgataacgagtggcacactgtgcgtgtggtccggcgtgggaaatctctgcaactgagcgtagataatgtaaccgtggaaggtcagatggcaggcgcacacatgcgacttgagtttcataatatcgagacagggattatgactgaacggcggttcatctccgtggtcccatctaacttcattggccacctttcaggcctggtctttaatgggcagccgtatatggaccagtgcaaggatggggacattacctactgtgagctaaacgccaggtttggactgcgggccatcgtcgccgaccccgtgacctttaagagtcggtctagttacttggctctggcgacccttcaagcatacgcaagtatgcacctgtttttccagtttaaaaccactgcaccggacggcctgcttctttttaatagtgggaatgggaatgactttatcgtcatcgagttggttaagggttatatccattacgtgtttgatctcggcaacgggccctccctcatgaagggcaattccgacaaacccgtgaatgataaccagtggcataacgtggtggtctcccgcgacccgggcaacgtgcacacactgaaaattgatagccgaactgtgactcaacacagtaatggagctcggaatcttgacctcaagggagaactctatatcggaggtttgagcaaaaatatgttctctaatctgcccaaattggtagctagcagggacggcttccagggatgtctcgcctctgtggaccttaatggccggcttcccgacctgatcgcagatgctctccataggattgggcaggtcgagagaggctgcgatggcccatccacgacctgcactgaggagagctgtgcaaatcagggagtatgtctccagcagtgggacggttttacgtgcgactgtacgatgaccagctacgggggtcccgtgtgtaacgaccctgggacaacttatatcttcggcaaggggggagctctcattacgtacacttggccacccaacgacagacctagcacccgtatggacaggctggcagtaggatttagcacccaccagcggtctgccgtgctggtgcgggtggattcagcgagtggcctgggagattatctacaacttcacattgaccagggtacggtgggcgtgatcttcaacgtagggaccgacgacataaccatcgatgaacccaatgctatcgttagtgacggaaagtaccacgtagtgcgctttaccagatcagggggtaatgcaactctccaggtcgatagctggccagtaaatgaacggtatccagccggcaatttcgataatgagagacttgccatcgcacgccaacggatcccttatcgactgggaagagtggtggacgaatggctgctggacaagggaaggcagttgaccatttttaattcccaggctgcaatcaagatcggaggccgtgaccaggggcggccatttcagggccaagtaagcggactctattataatgggctcaaggtcctagcgcttgcagctgagtccgacccgaacgtcaggacagagggccacctgcgcctagtcggagaggggccgagcgtgttgttgtctgctgaaacaactgctacaactctgttggcagatatggcaaccacaattatggagacaacaaccacgatggcaacaacaacgaccaggcggggaagatctccaaccctccgcgattctacaactcagaacacagacgatctgctggttgcctctgctgaatgcccttcagacgacgaggacctagaggagtgcgaaccaagtacagggggtgagctaatactaccgatcattacagaagactcgctggatccgcctccagttgctacgaggagccctttcgttcctccacctccaaccttctaccctttcctcaccggcgttggggccacccaggacacccttccaccccccgccgcgaggcgaccccccagtggcgggccatgccaggccgaacgtgatgatagcgattgtgaggaaccaatcgaagctagtgggttcgcctccggcgaggtgttcgactccagtttacctcccactgatgatgaagacttttacaccacatttccgctggttactgacaggacaacactactttcccctaggaaaccagcccctaggcccaatcttcgaactgatggcgccacaggtgccccaggcgttttgtttgccccaagtgccccggcacctaatctgcccgccggcaaaatgaatcacagggacccattgcagcctctcctggaaaaccccccccttggacctggcgctcctacctccttcgagccccggaggcctccccctctgcggccaggggtgacttccgccccaggtttccctcacctcccaaccgctaaccccacaggacccggcgagaggggtccaccaggagctgtggaagtgattcgcgagtcgagttcaactaccgggatggtggtcggcattgtggccgccgccgctctgtgcatcttgatcttactgtatgccatgtataagtaccggaacagagatgaaggatcttatcaggtggatcagtcccgcaattacatctcgaattccgcacagtcaaacggtgccgtggtgaaggaaaaggccccagccgccccgaaaacaccctccaaggcgaaaaagaacaaggataaggaatattatgtatag

SEQ ID NO: 196905 - DNA, 2001 bp, Artificial Sequence
  Description of Artificial Sequence: Synthetic coding sequence
atgccccccggcggcagcggccccggcggctgcccccggcggccccctgcactcgcaggaccgttgccgcctcctccacctccgcctcctccccccctgttgccactgctcccccttctgctattgttgcttctgggggccgctgagggcgccagagtgagttcctcactgtccactacacaccacgtgcaccattttcattccaagcatggcactgtacccattgctattaacagaatgcccttcctcactcgcggaggccacgccgggacgacttatattttcggaaagggaggcgctctgataacatatacatggcctccaaacgacaggccatctaccagaatggacaggttggccgttgggttttcaacccaccagcgatctgctgtcctcgttcgtgtggattccgctagtgggctcggcgattatttacagcttcacatcgatcaggggactgtaggtgtcatattcaacgttgggacagatgacataacgattgacgagcctaacgccattgtaagcgacggaaagtaccatgtggtccgatttacaagatctgggggaaatgccacactacaggttgattcttggccagttaatgaaagataccccgccggaaacttcgacaatgagcggctggctattgcccgacagcgcattccctaccgactgggaagagtggtggacgagtggctcctggataaagggcgacagctgaccattttcaactcacaggcggccatcaaaatcggagggagagatcagggccgtccctttcagggacaagtttcaggcctctactataatggcttaaaagtgttggccctcgccgccgaatctgaccctaatgtccggacagaggggcatctgcgcctcgtaggcgaaggcccttctgtgttattgagcgcagagacaactgcgaccactctattggccgacatggccaccaccatcatggaaaccactacgaccatggctaccacaacgactaggcgtgggcggtctcctaccttacgcgattccaccacccaaaacacggatgacctgctggtagccagcgcagaatgtcccagcgatgatgaagacttagaggagtgtgaaccatcaaccggcggggagctgattctcccaatcattaccgaagactctttggatcctccccccgtggccacacggagtccgttcgtacctccaccgccaactttttacccattcctgaccggagtgggggctactcaggacacgctgccgccacctgctgctaggcggcctccctccggcggcccatgtcaggctgaaagagacgactcagactgcgaggagcccatcgaagcttccggattcgcaagcggggaggtcttcgactcgagcttaccaccaaccgacgacgaggatttctatacgactttccccctcgtgaccgaccggactaccctcctttctccacggaagccagcgcctaggcctaatttgaggacagacggagccacaggcgctccaggggtgctgtttgctccctcagctcctgcgccaaatctgcccgcaggcaaaatgaaccatcgggatcctctccagcctctactcgaaaatcctccactgggccctggcgcacccacaagcttcgagccccggcgaccgcctccattgagacctggcgtgactagcgcacctggattcccacatttgccaactgccaacccaacaggccccggggagcgaggaccccccggcgctgtggaagtaatccgtgagtcctcttcaactaccggaatggtcgtaggtattgtagcagccgcagcactctgtattctgatcttgctgtacgcaatgtacaaatatcggaatagggatgaaggctcctatcaggtggaccagtcacgcaattacatttccaattcagctcagtcaaatggagcggttgtcaaggagaaagcccctgccgcgccaaagaccccctccaaagcaaaaaagaataaagacaaagaatattacgtatag

SEQ ID NO: 196906 - DNA, 1299 bp, Artificial Sequence
  Description of Artificial Sequence: Synthetic coding sequence
atgcacctgcggatccacgcccggcggagccccccccggcggcccgcctggacattggggatctggtttctgttttggggatgtatcgtgtccagcgtttggagttcatcaaacgtggccagctcaagcagcaccagtagttccccaggtagtcactctcagcacgaacaccacttccacgggtctaaacatcacagtgtgccaatctctatctacaggagccctgtctcgctgagaggcggtcatgccggcgccacgtatattttcggcaaatcaggaggattgatcctctacacatggccagcgaacgacagacccagtacacgaagcgatagactggctgtggggtttagcaccaccgttaaagatgggatcctcgtgcgcatagattcagcccctggactgggagacttcttgcagctgcatatcgagcaggggaagatcggagtggtcttcaacataggcaccgtggatatatcgattaaagaggaacgtacacctgtgaacgacggtaagtatcacgtggttaggtttacgaggaacggaggcaacgccaccttgcaggtagacaactggcctgtgaacgaacattatccaacgggtcggcaactgaccatcttcaatacacaggcccagatcgccattggcggcaaagacaaaggtcgcctatttcaaggacagctgtccggcttgtactacgatggtctgaaagtcctgaatatggcggcggaaaacaacccgaatataaaaataaatgggtcggtgcgtctggtcggtgaagtcccaagtatactgggcacaactcaaacaacgtccatgccccctgagatgagcactacggtaatggagaccactactacaatggctactacgacaacgagaaaaaaccgatctactgcatctatacagccaacctcagacgatctcgtgtcctccgccgaatgcagttcggacgacgaggattttgtagagtgtgagccttccactggacgcagtgccaaccccacggaaccagggatccggcgggtacccggcgcctcagaagtcatccgcgaaagtagcagtacaacgggcatggtggtggggattgttgccgccgccgctctgtgtattctgattctcttgtacgctatgtataagtacaggaatagggatgaaggctcataccaagttgacgaaacacgtaactacatttccaattccgcccagagcaacggtacgctgatgaaggagaagcagcagtccagcaagagtggccacaagaagcagaaaaataaggaccgcgaatattacgtgtag

SEQ ID NO: 196907 - DNA, 4932 bp, Artificial Sequence
  Description of Artificial Sequence: Synthetic coding sequence
atgagcagcaccctgcacagcgtgttcttcaccctgaaggtgagcatactgctcggctccctactgggcttgtgcctaggcctggaatttatgggactccctaatcaatgggcgaggtatctccggtgggatgcatccaccagaagtgatctttcctttcagtttaagaccaatgtcagcactggccttttactctacctcgacgatggtggcgtctgcgatttcttgtgcctgagtcttgtagatgggcgagtgcagctgagatttagcatggactgtgctgaaaccgccgtgctgtctaataagcaggtaaatgactcgtcttggcatttcctcatggtctcaagagacagactgaggactgtgcttatgctggacggagaaggccagagcggtgagctgcaacctcaacggccatacatggatgtggtcagtgatctgttccttggaggtgtcccgaccgacattcgacccagcgcgctgacccttgacggcgtacaggccatgcccggtttcaagggactgatactagatctgaaatacgggaattccgagcccagacttctgggttccagaggggtgcagatggacgccgaaggcccatgcggagagcggccttgtgagaacgggggcatatgctttctgctcgacgggcatccgacttgtgactgcagcacgactgggtatggcggcaaactgtgtagcgaaggtagcagcggggacccttgcctgtcccatctgatgatgagtgagcaggcaagagaggaaaacgtggccacgtttcgaggttctgagtatctgtgttatgatctgtcccaaaaccccatccagagttcctcagatgagattacactgtcctttaagacctggcagaggaacggactcatactgcacactggtaaatccgctgactacgtgaatctagcccttaaagacggtgctgtgtctcttgtgattaatctcggtagcggagcattcgaggcgattgtggagcccgtgaatggcaaatttaacgacaatgcttggcatgatgtcaaggtgacccggaatctgaggcaggtcactatctccgtcgatgggatcctaaccactaccggatacacccaggaagactacactatgttaggttcggacgacttcttttacgtgggtggatcaccatcgacagccgatctgcccggttctcctgtaagcaacaactttatgggttgcctgaaggaggtggtttacaaaaataatgatatccgtcttgaattgagtcgcctcgcgcggatcgctgatacaaaaatgaaaatttatggggaggtggtgtttaaatgcgaaaatgtcgcaactctcgatcccatcaactttgaaacccccgaagcctacatctcgctgccgaaatggaacaccaagagaatgggaagtatctccttcgactttcgaactaccgagcctaacggcctgatcctgttcacacacgggaaacctcaggagcgaaaagatgctaggagccaaaaaaacactaaggtcgacttcttcgccgtggaactgctggatggcaatctctacctgttgttagacatgggcagcggtactattaaagtaaaggccactcagaagaaggccaacgacggggagtggtatcacgtagacatccaaagagacggtaggtctggtacaatctctgttaattcccgtcggacccctttcacagctagtggagagtccgaaatcctcgatctggagggggatatgtaccttggaggcttgcctgagaatcgggccggactcatcctgcctactgagttatggaccgccatgctgaactacggatatgtggggtgtataagggatttgtttattgacggacgttccaagaacattagacagttagcagagatgcagaatgccgccggagtcaagtcttcttgttctcggatgtcagccaagcaatgcgatagctacccttgcaagaacaatgccgtgtgtaaggacggctggaacagatttatctgtgactgcacaggtaccggctattggggaaggacctgcgagagggaagcttctatcctctcttatgacggttccatgtatatgaagataatcatgcccatggtgatgcatactgaagccgaggatgtgagttttagattcatgagccagcgagcttatggcctcctagtggccactacctcccgagactcagctgatactctccgactggaattggacggaggccgcgtaaagctaatggtcaacctggactgtatcaggatcaattgtaactcctctaaaggacccgaaaccttgtacgccggacagaaacttaatgataacgagtggcatacagtccgcgtcgtgagaagagggaagagcttgaaactgactgtcgatgacgatgtcgcagaaggaactatggtgggcgatcacacgaggctcgagtttcataatatcgagacagggatcatgacagagaagcgctatatctccgtcgtgccctctagctttataggccaccttcagagtctcatgtttaacggactgttgtatatagacctctgcaaaaatggcgatattgattattgtgaactgaaggcccgatttggcctgcggaacatcatcgcagatccggtcacgttcaagactaagtccagctatctctccctcgccactctgcaagcctatacatcaatgcaccttttttttcagtttaaaacgactagccccgacggattcatattgttcaatagcggcgacggaaacgattttatagccgtggaacttgtcaagggatatatccactatgtcttcgacttaggcaatgggcctaacgtgattaaggggaactccgaccggccgctcaatgataaccagtggcataatgtggtcatcacgcgggacaattccaatacgcattcacttaaagtagatacaaaggtggtcacccaggtaatcaatggagccaagaatctggatctgaagggtgatctgtacatggccggcctggcgcagggcatgtactcaaacctcccaaaactggtggccagccgagatggattccagggctgcctagcttcagtcgatttaaacgggagactgcccgatctcattaacgacgctctgcacagaagcgggcagattgagcgcggctgtgagggcccttctaccacatgtcaggaggactcctgtgcgaatcagggggtctgtatgcaacagtgggaaggcttcacctgcgactgcagtatgacctcttattcagggaaccaatgtaacgatccaggagctacttatattttcggcaaatccggtggcctgatactgtacacctggcccgccaacgacagaccatccacacgatctgataggctcgccgtcggcttctcaacaactgtgaaagatgggatcctagtcaggattgactcagctccgggacttggtgatttcctgcagctgcacattgagcagggcaaaatcggtgtggtgtttaatattggaaccgtggacatatctattaaagaggagaggacaccagtaaacgacggtaaataccatgtggtcaggttcacacggaatggcggtaacgccacacttcaagtcgacaactggcctgtcaatgagcactatcctactgggagacagctgacaattttcaacacacaagctcagattgctatcggtggcaaggataaggggcggctctttcaggggcagctcagcggactgtactacgacggcctgaaggtgctgaatatggccgctgaaaacaaccccaacattaagattaatggttccgtcagactggtgggagaagtgccaagcattttggggacaacccagacaaccagcatgccccctgagatgtccacgaccgtcatggagaccaccaccactatggccactaccacaaccagaaaaaataggagcactgctagcatccagcccacgagtgatgacttagttagttcagctgagtgctcttccgatgacgaggacttcgttgaatgtgaaccttctactgcaagaggagagctagtgatcccactgttagtggaggacccattggcaacacccccaattgccacccgggcgccatccatcacgctgcccccaacttttcggcctctgctcactatcattgaaactaccaaagattctttaagtatgacatcagaggcgggactgccctgcctgtccgatcagggctccgacggatgtgacgatgatggcctcgtgatatccggatacggctccggcgagacattcgattcaaatttacctccgaccgatgatgaagatttctacaccacgttttccctggtgactgataagtccctctccacttctatttttgagggaggatataaagcccacgccccgaagtgggagagcaaagattttagacctaataaagtgtctgagacctctaggacaactacgacctctctctcacctgaactcataaggtttaccgcatccagcagctcaggtatggtacccaagctgccggctggaaagatgaataacagggatctcaagccccagcccgacatcgtgttgcttcctcttccaactgcctacgagcttgacagcaccaagctgaaatcccccctcattacttctcctatgttccgaaacgtccccactgcaaacccaactgaacctgggatccgccgggtgccgggcgcttcagaggtgattcgtgagagctcctccacaacaggaatggtggtcggaatcgtggcagccgcggccctctgcatactgatccttctgtacgcgatgtataagtataggaacagggacgaagggtcctaccaagtggacgagaccaggaactatatctcaaactccgcccaatctaacggcaccctaatgaaagaaaaacagcagtccagcaagtcagggcataaaaaacagaagaacaaggatagagagtactatgtgtag

SEQ ID NO: 196908 - DNA, 4179 bp, Artificial Sequence
  Description of Artificial Sequence: Synthetic coding sequence
atgagcagcaccctgcacagcgtgttcttcaccctgaaggtgagcatcctactcgggtcccttcttggcctctgcctcgggctggaattcatgggcctccccaaccagtgggcccgctatctccgatgggacgcctcgacccgctccgatctctcattccagttcaaaaccaacgtgagtactggcttgctgttgtaccttgatgacgggggggtgtgtgattttctgtgtctgagcctggtggacgggcgcgttcaactccgattttccatggattgtgccgagaccgcagtgctgagtaacaagcaggtgaatgatagcagctggcatttcttgatggtgagtcgagaccgcctgaggacggtattaatgcttgacggcgaaggccagtccggcgaactgcagccccagcggccttatatggacgtagtttcagacctgttcctcggcggcgtccctaccgatatccggccttctgccctgactctggacggggtgcaggcaatgccaggattcaaaggcctaattctggacctgaagtacggaaacagcgagccccggttactgggtagccggggcgtgcaaatggacgccgaaggcccctgcggtgagaggccttgtgagaatgggggcatctgtttccttcttgatggacatcccacgtgtgattgcagcacaactggatatggtggtaaattgtgcagtgaaggtcttagtcatttaatgatgtccgagcagggccgctggaaggcgagagaagagaacgtggccacttttcgcggtagtgaatacctttgttacgatcttagccaaaatcccatccagtcctcttcagatgagatcaccctctcgtttaaaacttggcagagaaatggccttattctccataccggaaagagcgctgattacgtaaacttagcactgaaagacggcgccgtctccttggttataaacctcggctccggggcttttgaagctatcgtggagccggttaacggaaagtttaatgacaacgcgtggcacgacgtcaaggtgaccaggaacctgcggcaggtaacaatctccgtggacggaattctgacaaccaccgggtatacccaggaagattataccatgctagggtctgacgattttttctacgtcggaggcagcccctctacggccgatttgccaggctctcctgtttccaataattttatgggttgcctgaaggaggttgtgtataagaataacgatatccgcctggagctgagccgactggctagaatcgccgacacgaaaatgaagatctacggagaggtggtcttcaaatgtgagaacgttgccacgcttgacccgattaacttcgaaactcctgaggcgtatatatcactccctaagtggaataccaaacgcatgggcagcatctccttcgacttccgtacaactgagcctaatgggctcatcctctttacccatggcaagccgcaggagcgaaaggacgcacgtagccagaagaacacgaaagttgacttctttgctgttgagttgttggatggaaatctttatctgttactagacatgggctctggtacgatcaaagtgaaggctacccaaaaaaaggctaatgatggagaatggtaccacgtggacatccagcgggatggcagatctggcactattagtgtaaactctagaaggactccttttactgccagtggggaatcggagattctggacctggagggtgacatgtatctagggggactacccgagaatcgggcaggcttgatactgcccaccgaactgtggacagctatgctgaattatgggtacgtcggatgcatccgagatctattcatcgacgggcgcagcaagaacataaggcagcttgctgagatgcagaacgcagccggtgtaaaaagcagctgcagtaggatgtccgctaaacagtgtgactcttacccctgtaagaacaacgctgtctgcaaagatggctggaaccgatttatctgtgattgcacgggtactggctattgggggagaacctgtgagcgcgaggcctccatactatcttacgacgggtccatgtatatgaaaatcatcatgccaatggtgatgcatacagaagccgaggacgtatcattcaggttcatgagccagcgcgcatacggtcttttggtcgcaactacctctcgcgacagtgccgacactctgagactggaactggacggaggcagagtcaaactgatggtaaacctgggcaagggccctgagaccctgtatgctggtcagaagttaaacgataatgaatggcataccgttagggttgttaggagaggcaaatccctgaaacttaccgtggacgacgatgtggctgagggcactatggtcggagatcacaccaggttggaatttcacaacattgagaccgggattatgactgaaaagagatatatttcggtggtaccaagcagctttatcggccatctgcagtctctgatgttcaatggactgctatacattgacttgtgtaaaaatggagacatagattactgtgagctgaaggctcgctttggcctgaggaatatcattgcagatcccgtgactttcaaaacaaagtcgtcctacctttccctcgcaacattgcaggcctacaccagcatgcaccttttttttcaattcaagacaacctcacctgatgggtttatcctgtttaattctggggatgggaatgactttattgccgtcgagctcgtgaaggggtacattcattacgtgtttgatttaggcaatggacctaatgttattaagggaaacagcgatcgacctttaaacgacaaccaatggcacaatgtggtaatcacgcgtgataacagtaacacacatagcttgaaagtggatacgaaagtagtgacccaagtgatcaatggagccaaaaacctggacttgaagggggatctgtatatggcaggattggcccagggaatgtactcaaatttacccaaacttgtggcatcccgcgatgggtttcaggggtgcctggcaagcgtggacttgaatggaagactgcccgatctcataaacgacgcccttcatcggtccggtcaaatagaacgaggttgcgagggcccctcaacaacttgtcaggaagactcctgtgctaatcagggtgtttgcatgcagcagtgggaggggtttacttgcgattgctctatgactagctattcaggcaaccagtgcaatgatcccggcgccacatacatttttgggaaatctggaggtctcatcttgtatacgtggcccgcgaacgatcgaccctccactcgatctgaccgcttggccgttggcttttccaccacagtcaaagacggaattcttgtaaggattgacagcgccccaggcctgggcgatttccttcagttgcacatagagcagggaaaaatcggcgtggtattcaatattgggactgtggacatctctatcaaagaagagaggactcccgtcaatgatggcaagtatcatgtagtaaggtttactcgcaacgggggcaatgccaccctgcaggtggacaattggccagttaatgagcattaccccactgggaataccgacaacgagagatttcagatggtcaaacagaagatcccattcaagtataaccggcccgtcgaagagtggcttcaggagaaaggccgacagttgacaatcttcaatactcaagcacaaatagctatcggtggaaaggacaaaggacgattattccaagggcaactgtccggactctactatgatggcctcaaagtccttaacatggccgcggaaaacaacccgaacatcaaaatcaatggctctgtgcgcctagtgggggaggttccttctatattgggaacaacacagaccaccagtatgcctccagagatgagcactacagtgatggagacgacgacaaccatggccaccactacgacccgaaaaaaccggtctaccgcaagcatccagcccacctcagacgacctagtttcttccgcggagtgttcctctgatgacgaggactttgtcgaatgtgagccatctacgggtcgatccgcccgttccagcaatgccgccagatccttgcgagccgctctaacctggacatggcggctcacgtacactttcactccaattatcttcatctcctgtgtggtgcactcttag

SEQ ID NO: 196909 - DNA, 3186 bp, Artificial Sequence
  Description of Artificial Sequence: Synthetic coding sequence
atgctgggcagcgacgacttcttctacgtgggcggcagccccagcacggctgacctcccaggctctccagtgagtaacaacttcatgggctgcctgaaggaggtagtttacaaaaacaacgacatccgcctggaactctccaggctggcacgaatcgcagacaccaaaatgaaaatctacggggaggttgtgtttaagtgcgaaaacgtcgcgaccctggacccaatcaattttgagacgccagaagcatatatttcgcttcctaagtggaacaccaagcgcatgggcagcatttcatttgatttccggactaccgaacccaatggattaatactattcactcacgggaaaccccaggaaaggaaagacgcccgttcacagaaaaatacgaaggttgattttttcgctgtcgagctgctggatgggaatctatacctgttgctcgatatgggcagcggaactatcaaggtcaaggccactcagaagaaagcgaacgatggcgaatggtaccatgtggatatacagagggacgggcggtcagggacaatctccgtaaactccaggcgcactcccttcacagcctccggtgaatcggagatacttgacttagagggagatatgtacttaggaggtttacctgaaaaccgcgccggacttattcttcctactgagttgtggacagctatgctgaactacgggtatgtgggctgtattagagaccttttcatcgacggcaggagcaagaacattagacagctggccgagatgcagaacgctgccggggtgaagagcagttgttcacgtatgagcgccaaacagtgcgattcttatccatgcaagaacaatgccgtgtgtaaagatgggtggaaccgatttatatgcgattgcaccggtaccggatactggggaagaacttgtgagcgcgaggcaagcatcctgtcttacgatggctccatgtatatgaagatcatcatgcccatggtgatgcatacggaggccgaagatgtgtcgttccgtttcatgagtcaaagagcatatggcttgctcgtcgccacaacctctcgggattccgcagacaccctgcgcctggaactggacggcgggcgggtgaaactgatggtgaacctagactgtatccgaatcaactgtaacagttccaaaggtccggaaactttgtatgcaggccagaagcttaacgataacgaatggcacaccgtgagagttgtgcggcgtggcaagtcccttaaacttacggttgacgatgatgttgcggaaggaaccatggtgggtgaccacaccagacttgagttccataatatagagactggtattatgacagagaagagatatatatcagtggttcctagttccttcatcggtcacttacagtctctcatgtttaatggtctcctgtatattgacctctgtaagaacggcgacattgactactgtgaacttaaagcaaggtttggactgcgaaacatcatcgctgaccctgtgacgttcaagacaaagagcagctatctgagtttggccacattacaggcgtatacctctatgcacctcttcttccagttcaagactacttctcccgatggttttattctttttaattcaggggacgggaatgactttatcgcggtcgagttggttaagggatacatccactatgtgtttgacctcggtaatgggcctaatgtgattaaaggaaatagcgacaggcccctgaatgacaaccaatggcataatgtcgtgattaccagagacaactctaatacccactcgctgaaggttgacacaaaagtggtcacccaggtcataaatggagccaagaatcttgacctgaaaggcgacctatacatggcgggactggcacaaggcatgtactccaatctgccaaaactagttgctagtagggacggcttccaggggtgcctagcctctgtcgatcttaatggacggctgcccgacttaataaacgatgccctccatcgctctgggcagatcgagcgggggtgcgagggcccttccaccacttgccaggaagatagctgtgcaaatcagggcgtgtgtatgcagcagtgggagggcttcacatgtgactgcagcatgacttcatatagtgggaatcaatgtaatgatcccggggctacctacattttcgggaagagtggaggcctgatactctacacttggcccgccaatgatcgaccaagtaccaggtccgacaggctggctgtaggattctccacaacggtgaaagatggtattcttgtcaggatagatagtgcacccggtctgggcgatttcctccagctccacatcgagcagggtaaaattggagtcgtctttaatattggaacggttgacatctctattaaggaagagcggactcctgtgaacgatggaaaatatcacgtggtgagattcacacgcaatggaggcaatgccactcttcaggttgacaactggccagtcaatgagcactaccctaccgggcggcaactgacaatatttaatacacaggcccaaatagctatcggcggaaaagataagggcagactgttccagggccaactgagcgggctatattacgacggcctgaaggtactcaacatggcggctgagaacaatcccaatatcaagatcaacggctccgtacggctggtcggagaagtacccagcattctgggtaccacccagactacgagcatgccacctgagatgtctaccactgtgatggagactactaccacaatggctacaactactaccaggaagaaccggagcacagcctcaatccagcccactagcgacgacctcgtgagtagcgctgagtgttcttccgacgatgaggacttcgtcgagtgtgagccctcgactgcaaaccccaccgagccaggcataaggagggtgcccggggcaagcgaagtgattcgagagtcgtcttcaaccacaggcatggtcgtcggcatcgtcgcagccgctgccctgtgtatcctcatcctgctctatgccatgtacaaatataggaatcgggacgagggctcctatcaggtcgacgaaacccgtaattatatctccaattccgcacaaagcaatggcacactgatgaaagagaaacagcagtcctccaagtcgggccacaagaagcagaaaaataaggacagagaatactacgtctag

SEQ ID NO: 196910 - DNA, 1380 bp, Artificial Sequence
  Description of Artificial Sequence: Synthetic coding sequence
atgcacctgcggatccacgcccggcggagccccccccggcggcccgcttggactctaggcatatggttcctgttctggggctgcatcgtgagctctgtctggtcaagctccaacgtggctagcagtagctctacgagctcatcacctggtagccacagccagcacgaacaccactttcacgggagcaagcatcactcggtccccatttccatttaccgatcccctgtctccctgcgaggggggcacgcgggggcgacttatatattcggtaagtccggagggttaatcctctatacttggccagctaatgaccgaccttctaccaggtcggatagactggcagtcggttttagcaccacagtcaaggatggaattcttgtgcggattgattctgcccccgggcttggcgactttctgcagctccacatcgagcagggcaagattggggttgtatttaacattgggacagtggacatcagtattaaggaggaaagaactcctgttaatgacggcaagtaccacgtcgtacgatttactcggaacggaggaaacgctaccttgcaagtcgacaattggccagttaatgaacactacccgacagggaacaccgacaacgaacggttccagatggttaagcagaagataccttttaagtacaaccggcccgttgaagagtggctgcaggaaaaagggcggcagcttacaatcttcaatacgcaggctcagatagcaataggtggtaaggacaaaggccgtctatttcagggccaacttagtggcctatactatgacggtctgaaggtattgaacatggcagccgagaataatcccaacatcaaaatcaacgggagcgtcaggctagtcggcgaggttcctagtatcctgggcacaacacagaccacatccatgcccccggaaatgtcaacaaccgtgatggagaccaccacgaccatggcaactactaccactcggaagaaccgcagcacagccagcatccagccgacctccgatgacctggtgagtagcgccgagtgctcctcggatgatgaggacttcgtcgaatgtgagccatccacagcaaacccgacagagcccgggattcggcgcgtgcctggtgctagcgaggtcattcgggaatccagcagcacaaccgggatggtggtgggcatcgttgctgcggctgctctgtgcatcctgattctgctatacgcaatgtacaagtaccggaacagggatgagggctcatatcaagttgacgaaacacgaaattatatcagcaattcagctcagtccaacggtaccctgatgaaggaaaaacagcaatccagcaagtctggacataagaagcaaaagaacaaagatcgcgaatactacgtttag

SEQ ID NO: 196911 - DNA, 3186 bp, Artificial Sequence
  Description of Artificial Sequence: Synthetic coding sequence
atgctgggcagcgacgacttcttctacgtgggcggcagccccagcaccgctgatctcccggggtcaccagtgtcaaataattttatgggctgtctcaaggaggtcgtgtacaagaataacgacattcgcttagagttatcaagattggcgaggatcgctgataccaaaatgaagatatatggagaagttgtgtttaaatgtgagaatgtggctacccttgatcccattaatttcgaaacaccagaggcgtatattagtttgccaaaatggaacaccaagcgtatgggtagtattagcttcgatttccgcacgactgaacccaacggtctgatcctctttacacacggaaaaccccaggaacgtaaagatgctaggtctcaaaagaatacaaaggtggacttttttgccgtggagctcctggacggaaacctctatctgctgcttgatatgggctctggtaccattaaggtgaaggctacgcagaagaaggccaacgatggtgagtggtaccatgtggacatacagagggatgggcggtctggcactatcagtgttaacagccgacggacccccttcacagcctccggtgaatccgagatcctcgacctggagggggacatgtacctggggggcctgcccgagaacagagcgggtctgatccttcccaccgaactttggacggccatgctgaattacggatatgtgggctgtattagggatctattcatagacggaagatctaagaatatccgccagctggctgaaatgcagaacgctgcgggggtgaagagttcctgtagtcggatgagcgccaaacagtgtgattcttatccttgtaaaaataatgctgtttgtaaggacggctggaatcgattcatatgtgattgtaccggtacaggatactggggaaggacctgtgagcgcgaggcaagcatcctatcatacgatggttccatgtatatgaagatcataatgcccatggtaatgcacactgaagccgaggacgtgagctttagattcatgtcacagagagcatacgggctgctggtcgcgacaacttctagagacagcgcagacacattgcggcttgaacttgatggcggaagagtgaaacttatggtgaatctggactgtatccggataaactgcaatagttccaagggtccggagaccctatacgccggccagaagctcaatgacaatgagtggcacacagtcagggtggtcaggcgcggaaagtctcttaaacttaccgtggatgatgacgtggccgagggcacaatggtcggcgaccatacccggctcgaattccacaatatagagaccgggatcatgaccgaaaaaagatacatatccgtggtcccctcgtcatttatcggccatctccagagcctgatgttcaatgggctgttatacattgacctttgtaagaacggcgatatagactactgtgaacttaaagctagattcggcctgagaaacatcattgctgatcccgttactttcaaaaccaagtcctcatacctttccctggctacccttcaggcttatacttcaatgcacctcttttttcagttcaaaaccacctctcccgacgggtttattctcttcaattccggcgacggaaacgatttcattgccgtagagctggtgaaaggatacattcattacgtctttgatcttgggaacggcccgaacgtgatcaaggggaacagtgatcgtccactgaatgacaaccagtggcacaacgttgtgatcacccgcgacaacagcaacactcattcactgaaggtcgacacgaaggtcgtgacccaggtgataaatggcgcaaagaatctggatctgaaaggcgacctgtatatggctggcctcgcccagggaatgtattcaaatttacctaaactggtcgctagtcgggatggtttccagggatgcctggccagcgtcgatctcaatggacgtcttcctgacctcataaacgacgccttgcaccgatccgggcagatcgaacggggatgtgagggccctagcactacctgccaggaagacagctgtgcgaatcagggagtgtgtatgcagcagtgggagggatttacctgcgattgctccatgacatcatacagcgggaatcagtgtaacgaccctggtgcaacctatatattcggaaagagcggcgggctaattctttacacgtggccggcaaacgaccggcctagcacgcggagtgacagattggccgtcgggtttagtacgaccgttaaagacggaatcttggtgcgcatcgatagcgctcccggtctaggggactttctccagcttcatattgagcaaggaaagatcggagtggtattcaatatcgggaccgtggatatttccataaaagaagagaggacccccgtgaatgatggcaagtatcacgtggtgcggttcactcgaaacggaggcaacgccacactgcaggtggacaattggcccgttaatgaacattatcccacagggcgccagcttactattttcaatacacaggcccagattgctatcggcggcaaggataagggaagactgtttcagggccagctatcaggcctgtactacgatgggctgaaagtgctgaatatggcggctgagaataaccccaacattaaaatcaacggttcagtcaggctagttggcgaggtcccgtcaatcctgggtacaacacagaccacctcgatgccgcccgaaatgtctactaccgtgatggaaaccacgacaaccatggccaccaccaccacacggaagaataggtccactgctagtatccagccaacctccgatgatcttgtgtctagcgcagaatgttcctcggacgacgaagacttcgtggagtgtgaaccaagcacagcaaaccccaccgaacccgggattaggagagtcccaggcgcttctgaagttatcagagagtcatcctccacgactggtatggtggtcggaatcgtggccgcagccgcactctgtatcttgattctgctttatgccatgtataaataccgtaacagggatgagggatcttatcaggtggatgagacacgtaattatataagcaactcagctcagagtaatggcacgttgatgaaggaaaaacagcagtcgtcaaagtccggacataagaaacagaagaacaaagatcgggagtactatgtgtag

SEQ ID NO: 196912 - DNA, 1914 bp, Artificial Sequence
  Description of Artificial Sequence: Synthetic coding sequence
atgcacctgcggatccacgcccggcggagccccccccggcggcccgcgtggacgctcggcatctggttccttttctggggctgcatagtaagttctgtttggagtagcagtaatgtggcgtcatcaagcagcacatcatctagtcctgggtctcactcccagcatgagcatcactttcacggctccaagcatcacagcgtacctatctcaatttacaggtcacccgtctcactacggggagggcatgctggcgcaacatatatcttcgggaaaagcggaggtttgatcttgtacacttggccagcaaatgatcgccctagtacccgcagcgataggctagccgtgggattctccacgactgtgaaggatggtatcttggtaagaatagacagtgcccccgggctgggcgattttttgcagctccacatcgaacagggcaaaataggcgtggtatttaacatcggcacagtcgatatcagcatcaaagaagaacggacacccgtgaatgatggaaagtaccacgttgtgcggtttactcgtaacggggggaacgccacattacaggttgacaattggcccgttaacgaacactacccaacgggtaggcagcttaccatcttcaacacacaggcccaaatagctatcggcggaaaagacaaaggaaggctcttccaaggacagctgtccggtctctactacgacggactcaaagtattgaacatggcagccgagaacaatccaaatatcaagatcaacggctctgtgcggctggtgggagaggtcccctccattctaggtaccacccagactacatccatgccacctgaaatgtcgacaacggtgatggagacaactaccacaatggctacaacgacaacacgcaaaaaccggtccaccgcatctatccagcctactagcgatgatctggtgagctctgctgaatgcagttctgacgacgaagactttgtcgagtgcgaaccttccactggaggcgaattggttattcccttgctggtcgaagatccgctggcaaccccaccaatcgcaactagagccccttcaatcactctgcccccaactttcaggcccctcctcactataatagagaccacaaaagacagcctcagcatgacatccgaggctgggctgccatgcctaagtgaccaaggtagcgatggctgtgatgacgacgggcttgttatctctgggtatgggagcggggagacctttgactcaaatttaccacctacagatgacgaggacttctacacgacattcagcttggtgacggataaatcactgtcaactagcatttttgaggggggctataaagcccatgcaccaaagtgggagagcaaggactttcgtcccaacaaagtgtccgagacaagcagaactacaaccacaagcctatcacccgagctgatccgcttcacagcctcctctagctcagggatggtcccaaaactacctgcaggtaaaatgaataatcgtgatctcaagcctcaacccgacatagttctgttgcccctgccaacagcctacgagctggattccacaaaactcaaaagcccgctgattaccagtcctatgttccggaacgtccctactgcgaaccctaccgagcctgggatccggagagtcccaggtgcctcggaggtgataagagagagcagctccaccactggaatggtggttggcattgtggccgctgcagctctgtgtatacttatactcctgtacgccatgtacaagtaccgcaaccgtgatgaaggctcttaccaggtagacgagacccgcaactatattagtaactcagctcagagcaatggtaccctgatgaaagagaaacagcagagctcaaaaagcggacataaaaaacagaaaaataaagaccgagaatattatgtgtag

SEQ ID NO: 196913 - DNA, 429 bp, Artificial Sequence
  Description of Artificial Sequence: Synthetic coding sequence
atgggcctgaagctgaacggccggtacatcagcctgatcctggccgtacagatagcttacctcgtgcaggcggtgcgagctgcaggcaagtgtgatgctgtgtttaaggggttttccgactgcctcctgaaactgggagacagtatggccaactatcctcaagggctggatgacaaaactaacattaagacagtatgcacgtactgggaagattttcactcctgcaccgtcacagcccttaccgattgccaggagggcgcaaaagacatgtgggataagctgcggaaggaaagcaaaaatttgaacatccaaggcagcctgttcgagctctgcggcagcggcaacggagcggcgggatcactccttccagctttcccagtcctcctggtaagtctttccgccgcgctcgcaacgtggctgtccttctag

SEQ ID NO: 196914 - DNA, 8841 bp, Artificial Sequence
  Description of Artificial Sequence: Synthetic coding sequence
atggccagcgagaagcccggccccggccccggcctggagccccagcccgtaggcctaatcgcagtgggagcggccgggggcggaggggggggttccgggggcggcggcacaggaggctccggtatgggagagctccgcggggccagtggatctggatcagtgatgttgccagccgggatgattaacccctcggtgccaatacgtaatatccgaatgaaatttgccgttttaattgggcttattcaggttggggaggtgtcaaatcgggatatcgtggaaactgttttaaatttgctggtgggaggtgagtttgatctggagatgaacttcatcattcaggacgctgaaagcattacttgcatgaccgaactgttagaacactgcgacgtcacatgccaggcagagatctggtcaatgtttaccgccatcctccggaaaagcgtacgcaatctgcagactagcacagaggttgggttgatcgagcaggtcctgctgaagatgtctgcagtggacgatatgattgccgacctgctggttgatatgcttggagttcttgcatcctactccatcacagtgaaggagctcaagctcctattttccatgctgcgcggagaatcgggaatatggcctcgtcatgcagtcaagctgctatctgtcctcaaccagatgccccagagacacggcccagacactttcttcaactttcccggttgtagtgccgcggctattgccctccctcccattgctaaatggccctaccagaacggttttaccctgaatacatggtttcggatggacccgttaaacaacattaacgttgacaaggacaaaccctatctgtattgttttaggaccagtaaaggtgtggggtacagcgcccactttgtagggaactgtctgatcgttacctcacttaaatccaagggcaaaggctttcaacactgcgtgaagtacgattttcagcccagaaaatggtacatgatttccatcgtgcatatttataaccggtggcggaattcagagattaggtgctacgtcaacggtcagcttgtgagttatggtgatatggcctggcatgtgaacacaaatgatagttacgacaaatgttttctggggagcagtgagacggccgatgccaatcgagtgttttgcggtcagctgggcgcagtttacgttttttcggaggcgctgaatcccgctcagatttttgccatccatcagctggggcctggatataagtccacgttcaaattcaagtcagaatccgacattcatcttgcggagcaccataagcaggtgttatatgacggaaaattggcttcctctattgcattcacatacaacgccaaggctacggacgctcagctgtgtctggagagcagccctaaagaaaacgcctcaatctttgtgcactccccccatgccttgatgctgcaggacgttaaggccatcgtaacccattccatccacagtgctatccattccattggcgggatacaggtactttttcctctgttcgctcagctggacaatcgccaactgaatgacagccaagtagaaactaccgtctgtgccaccctactggcctttttagtcgagttgctgaaatcttccgtggctatgcaagaacagatgttaggcggcaaaggttttctggtgattgggtacctactagagaagtcctctagagtccacataacgagagctgtgttggagcaattcctttcattcgccaaatatctggacgggctgagccacggggcacccttactaaaacagctatgcgaccacatcttatttaatccagcaatctggattcacacacctgccaaggtgcaattatcgctatacacctacttgagcgcggaatttatcgggacggccactatctacaccactatacgtcgggtcggtaccgtactgcaactgatgcacactttgaaatattattactgggtaatcaacccagcggatagcagtggcattactcctaaaggattggacggccctaggccatctcagaaggaaatcatctctctgcgcgcttttatgttgctgtttctcaaacagcttatactgaaggacaggggcgtgaaagaagacgaattgcagtccatcctgaactacctgttaacaatgcacgaagacgaaaacatacacgatgttctccagctcctggttgctttgatgtctgaacatcctgcatctatgattccggcattcgaccagcgaaacggcataagagttatctataaactgctcgcgagtaaatctgagtccatttgggtccaagcactgaaggtacttgggtactttttaaagcatttgggccataagcgcaaagtggaaattatgcatacacactcccttttcacactcttgggtgagcgcctgatgctgcatacaaacactgtgactgtgacaacctacaatactctctacgagatattaacagaacaggtatgcacccaggtggtgcacaaacctcatcccgaacccgacagcaccgtcaagattcaaaacccaatgatcctgaaagtggtcgccaccctgctaaaaaattcaacgcccagcgcggagctcatggaggtcagaagattattcttgtccgacatgatcaaattattcagcaactcacgcgaaaaccgaagatgcctgcttcagtgcagtgtgtggcaggactggatgttttcactggggtacattaaccctaagaactctgaagaacaaaaaatcacagaaatggtgtataatatctttcggattctcctctaccacgctatcaagtacgaatggggagggtggagagtttgggtcgacacattgtcaatcgcacactcaaaggtcacgtacgaggcgcataaagagtatctggccaagatgtatgaggagtaccagcggcaagaggaggagaacattaaaaagggcaagaaagggaacgtttccacaataagcggcctgtctagtcagacaactggagcgaaggggggaatggagataagggaaatagaagatctcagtcagtcacagtctcccgagtctgagacagattatcccgtgtccacagataccagggacttactgatgtctaccaaggttagcgacgatattctgggcaatagtgacaggccaggaagcggcgtccatgtagaagtgcacgaccttctggttgacatcaaagcagagaaggtagaagcaacagaggtgaagctcgacgacatggacctgtctcctgagacactagttggcggtgagaatggcgcactcgtcgaggtggagagcttgctggataacgtctatagcgccgccgttgaaaagctccagaacaatgtacacggctccgttgggatcattaaaaagaacgaagagaaggacaacgggcccctcatcactctggcagatgaaaaggaagatttacccaattcgtccaccagctttctgttcgataaaattcccaaacaggaggagaagctcctccctgagctaagctccaatcacatcattcccaatatccaagatacccaggttcatctgggcgtgtccgatgatctgggactgctggcccatatgactggctcggttgacctgacctgcacctcaagcattatcgaagaaaaggaattcaaaattcacaccacgagtgacggaatgagcagcatctcagagagagacctggcatcctccacgaagggactagaatacgcagagatgaccgccacaaccctagagaccgaatcctcaagctccaagattgtcccaaacatcgatgctgggagcatcatttcggacactgaacgctccgacgacggtaaggagtccggaaaagaaatccgaaaaatccagaccaccacaactacgcaggcagtccaaggaaggtccattacccagcaggacagagacctccgggttgatcttggatttagagggatgccgatgaccgaagagcagcgacgacagttctcgcccggcccacggacgacgatgtttagaatccccgaattcaaatggtcccccatgcaccaacgtctgctcacggatctgcttttcgcactggagacagacgtgcacgtttggcgtagtcacagcaccaagtccgtgatggatttcgttaactctaacgagaacatcatattcgtgcataacactatccacctcatctcccagatggttgacaatataatcatcgcctgcggcggcatcctcccccttctttcagctgcaaccagtcctaccgtctcgaagaccgagttggaaaacattgaggtgacccagggtatgtctgctgagaccgccgttacctttctgtcccgactcatggccatggtggatgtgctggtgtttgctagttcgttgaatttctcggagatcgaggccgagaaaaacatgtcttccggtggcttaatgcggcaatgtctgcgacttgtgtgctgtgtggctgtaaggaattgtctggagtgccggcagaggcaacgcgaccgaggcaataaaagctcacacggcagcagcaaaccacaggaagtgcctcagtccgtgaccgcaaccgctgccagcaaaacaccactggagaatgtgcccggaaatctgagtccaattaaggaccctgaccggctacttcaggacgtagatattaaccgtctgagggcggtggtgttccgagatgtcgacgactcgaaacaggcccagtttctggcccttgcagtggtctattttatcagtgttctgatggtatccaagtaccgggatattttagaaccgcaaagggagaccactaggactggttctcagcctgggaggaacatcaggcaggaaattaatagccccacgagtactgttgtggtcattccctctattcctcatccgtcgcttaaccatgggtttctggcaaagctaattccagagcagagcttcgggcactctttctacaaagagacaccagctgctttccctgatactattaaagagaaggagactccgacgccgggagaagatatccaggtggaatccagtatcccacacacagactcaggaattggtgaagaacaagtagcctctatcctgaacggtgcagaattggagacaagcaccgggcctgatgccatgagcgaactactgtctactctgagcagtgaggtgaagaaaagccaggaaagtctgacggagaatccttcagagacgcttaaacctgctaccagcatcagttccatcagccagaccaaaggcatcaacgttaaggagatcttaaaatcgcttgtagctgcgcccgtagagatcgctgaatgtgggccggagccaataccctatccagaccccgccctgaagcgtgaaacacaagccatcctccccatgcagttccattcttttgatcggtctgttgtggtccctgtgaaaaagccccctccgggctccctggcagtgacaactgtgggggcgaccactgcaggatcaggattgcccaccggtagcacatctaacatcttcgcagctacgggggccaccccgaagtccatgattaacaccacaggagccgtggatagtggatcctcctcttcctcctcctccagtagctttgtcaatggagctacatcaaagaatttaccagcggtgcagacggtcgcgcccatgccagaggactctgctgaaaacatgtccattacagctaaactggagcgagctctcgaaaaggttgcacctttgttaagagagattttcgtcgatttcgcccctttcttgtcccggacactgctgggctctcacggccaagagctcctgatcgaaggcctcgtttgcatgaaaagttccaccagcgttgtggagttagtaatgttactgtgcagtcaagagtggcaaaactcaattcagaagaatgcggggctggcgtttatcgagttgataaatgaaggacggctcctctgtcacgccatgaaggaccatatcgttcgggtcgcgaatgaggccgaattcatcctaaatcggcagcgggccgaggacgtgcataagcatgccgaattcgaatctcagtgtgcgcagtatgccgccgataggagggaagaagagaagatgtgcgatcatctgatttcagcggctaaacaccgcgaccatgtcacagcgaatcaattaaaacaaaaaatcctcaatattctcacaaacaaacacggagcatggggcgctgtcagtcacagccagctccacgatttctggcgtttggattattgggaggacgatctcagaaggcgacggaggtttgtgcggaatgcatttggaagtacacatgcagaagccctgttgaaagctgctattgagtatggtaccgaggaagacgttgtcaaatctaaaaaaacgttccggtcacaggccattgtgaaccagaatgccgagacagaattaatgctagagggcgatgatgacgcagtgagtctgctacaggagaaggaaatcgataacctggccggaccagtcgtgctgtccactccggcacagctcatagctcccgtggtagtcgccaaaggaacactgagcattaccacaaccgagatttatttcgaggtggacgaggacgacagcgccttcaagaaaattgataccaaagtgttagcctataccgaaggactacacggaaaatggatgttcagtgagattcgagccgtttttagccggcgctatctgcttcagaatacggcactcgaggtctttatggctaaccgcacatctgtgatgttcaattttcctgatcaggccaccgtgaaaaaagtcgtttattcgttgcctcgcgtgggggtgggcactagctacgggttaccccaggccagacggatctctctagccacacctaggcaactttataagtcctctaacatgacacagcggtggcaaagacgggagatctcaaacttcgaatacctgatgtttctgaatactatcgctggccggacctacaatgacctgaaccaataccctgtgttcccatgggtgctgaccaattacgaatcagaggagctggatcttactctgccagggaacttccgcgacctctctaagcctatcggtgcactaaatccaaagagggccgtcttctacgctgaacgatacgaaacctgggaagatgatcagtcccccccatatcactacaacacccattacagtactgctacttcaaccctttcctggttagttcgcatcgagcctttcactacattttttttgaacgcaaatgacggaaaatttgaccatccagataggacattctctagtgtggccagatcttggcgcacatcccagcgggacacgagcgatgtaaaggaattgattccggaattttattatcttcccgaaatgttcgtcaactcaaatggctacaatttgggcgtgcgggaggacgaggtcgtggttaatgacgtggacctgcccccatgggcaaagaagccagaggattttgttagaatcaataggatggccctggaatctgagtttgtgtcctgtcagttgcatcaatggattgacctcatcttcgggtacaagcagagaggccccgaagctgtgcgagcgctgaatgtcttccactatctgacctatgagggcagcgttaacctggattctatcaccgatcccgtgctgcgagaggccatggaggctcagatccaaaattttgggcaaacgcccagtcagcttttgatcgaaccgcacccacctagatcctcggcaatgcacctgtgctttcttcctcagtctcccctcatgttcaaggaccagatgcagcaggatgttattatggttcttaagttcccctccaactctcccgtaacacacgtggcagccaatacgttaccacatctcacaattccagctgtagtgactgtgacttgttctagactgtttgcagtgaataggtggcacaacacggtggggctcagaggagctcctggttacagtctcgatcaggcccaccatttgccgatagaaatggaccccttaatcgccaacaatagcggtgtgaacaagcggcagattaccgaccttgtcgaccaaagtatccaaatcaatgcccactgcttcgtggtgacagccgacaatcgatatatcttgatctgcggtttttgggataaatccttccgggtgtacagtacagagaccggtaaactaacccagattgtgttcggccattgggacgtggtaacctgcctcgctcgatccgaatcgtacattggcggagactgttacatcgtgtctggcagccgggatgccactctccttctgtggtattggagcgggaggcaccacatcattggagataatcctaatagttccgactacccagcgccaagggccgttcttacgggacatgaccatgaggtagtgtgtgtgtctgtatgtgctgagctgggcctcgtgatttccggggccaaagagggaccgtgtttggtgcatacgattaccggagatctgctgagggccctcgaggggcctgagaattgtcttttcccccgtctcatttcagtgtcttcggaggggcactgtattatctattacgagagggggcggttctcaaatttttcgattaacggcaagctgctggcacagatggagatcaacgatagcacccgcgcaattctgcttagctccgacggacagaaccttgtgactgggggggataacggagttgtcgaggtgtggcaagcgtgcgattttaaacagctttacatctaccctggatgcgacgccggtattagagcgatggacctcagccacgatcaaagaactttgattaccggaatggcttccggctcaattgtggctttcaacatagacttcaaccggtggcactacgaacaccaaaaccgctattag

SEQ ID NO: 196915 - DNA, 1575 bp, Artificial Sequence
  Description of Artificial Sequence: Synthetic coding sequence
atgttcgtgaacagcaacggctacaacctgggcgtgcgggaggacgaggtcgtggtcaacgacgtggacctgcctccctgggcaaagaagccagaggactttgtgaggattaaccgaatggcactagagtccgagtttgtgagctgtcagctgcatcagtggatcgatctgattttcgggtataagcagcgcggccctgaggccgtccgtgccctgaacgtcttccactatctgacgtacgaaggtagtgtcaatctggacagcattacagatcccgtcctccgggagatccccgaagcttacttcatccgagatccccatacatttttgctcacaaaggatttcataaaggccatggaagcacagatacagaacttcgggcagactccaagccaacttctaatcgaaccacaccccccaagaagttcagcaatgcatttgtgtttcttgcctcagagtcctttaatgttcaaggaccaaatgcagcaggacgtcatcatggtacttaaattccccagtaattccccagttacacacgtggctgccaataccctgccccatctgacaattcccgctgtggtaaccgtaacatgttcaaggctctttgcagtaaatagatggcacaataccgtgggactgcgcggagctcctggatattccctcgatcaagcgcaccatcttcctatcgaaatggatcccctgattgcaaataattccggtgtcaacaagcgccagatcacggatctcgtggaccagtccattcagatcaatgcccattgcttcgtggtgaccgccgacaaccgctacattctcatctgcgggttctgggacaagtcctttcgcgtgtactctaccgaaacaggcaaactcacgcagattgtatttggccactgggatgtggtgacatgcctggccaggtctgagtcgtacatagggggcgattgttatattgtgagcggaagccgagatgccaccctgctcctctggtactggtcaggccggcaccacattatcggagataaccccaattcatcagactatcctgcgccacgcgccgtgctgactggacacgaccacgaggtcgtgtgcgtttcagtctgcgccgagctgggcctggtcatctcaggcgcgaaggagggtccgtgtctggtccacacaattaccggggacctgcttcgggcactcgagggtcctgaaaactgcctgttccctcgtctgatttctgtgtcgtccgaagggcattgtatcatttactatgaacggggacgcttctcaaatttctctataaatggcaaactgttagcacagatggaaatcaacgacagcacacgcgcaattttgctgtcatcagatggacagaacctcgtcaccggcggcgacaatggagtggtcgaggtgtggcaagcgtgcgacttcaagcagctttacatatatcccgggtgcgacgccggaattcgggcgatggacctctctcacgatcagcgcacgttaataaccgggatggccagcgggtcaattgtcgccttcaatatcgactttaaccgatggcattacgaacaccagaaccgatattag

SEQ ID NO: 196916 - DNA, 8832 bp, Artificial Sequence
  Description of Artificial Sequence: Synthetic coding sequence
atggccagcgagaagcccggccccggccccggcctggagccccagcccgttggacttattgctgtaggggctgccggaggcgggggcggcggaagtggtgggggcggcaccggcggctccggcatgggggaactccgcggagcgtcaggatccgggagtgttatgctgcccgcaggtatgattaacccctctgtgccgatcaggaacataaggatgaagtttgctgtccttataggattgatccaggtcggcgaggtgagcaatagggacatcgttgaaactgtgctaaacctgctggtaggcggagaattcgacttagaaatgaattttatcatccaagacgccgaaagcatcacctgcatgacggagttacttgagcactgcgatgtcacttgtcaagcggaaatttggagtatgttcacagccattctgaggaagtccgttagaaatttgcagacctctactgaagtggggttaattgagcaggtgctgcttaagatgtctgctgtggatgatatgatcgcagacctcctcgtggatatgttgggggttcttgcaagctatagtatcactgtgaaagagctcaagctcctcttcagtatgcttcggggcgagagcggtatctggccaaggcatgctgtaaagttactttccgtcctgaatcaaatgccacaacggcatggcccagacacattttttaacttcccaggctgcagtgcggccgctattgccctgcctccaatcgcaaagtggccttatcagaacggattcactctgaatacatggttcaggatggacccactgaataatattaacgtggacaaggataaaccatacctctattgctttaggacaagtaagggtgtcggttacagtgcacatttcgtcggtaactgtctgattgtgactagccttaagagcaagggcaaggggttccaacactgtgtgaagtacgactttcagcctagaaagtggtacatgatctcaatagtccatatttataaccgatggagaaactcggagattcggtgttacgttaatgggcagctggtctcttacggagatatggcctggcacgttaacactaacgactcctatgataagtgctttctgggttcatccgagacagctgatgcaaaccgggtcttctgcgggcaacttggggccgtctatgttttttctgaagccctgaatccagcacagatcttcgcaatacaccagctcggaccgggatataaaagcacctttaaattcaagagcgaaagtgatatccatctggctgaacatcataaacaggtgctgtatgacggaaaactcgcttccagcatagccttcacatacaacgctaaagccaccgatgcccaactatgtctggaaagctcgcctaaggaaaacgcttctattttcgtgcatagtccgcacgccctgatgctccaagacgttaaagccattgtgactcatagcattcattccgccatccacagcatcggcggaatccaagttcttttccctttattcgcccagttggataatcggcaactgaacgatagtcaggttgaaaccacagtttgtgccaccctattggcattcttggtggagctcctcaagagcagcgtcgcaatgcaggaacagatgctgggcggaaaaggattcctggtgatagggtatctcttggaaaagagctccagagtccatattactagagcggtgctggaacagttcctttctttcgctaaatacctcgacggtctgtctcatggggcacctttactgaaacagttgtgcgatcacattctgttcaaccctgctatttggatccacacaccagctaaagtccagctgtcattatacacgtacctgtcagccgagtttattggcacagctaccatatataccaccatcagacgtgtgggaacagtactccaactgatgcacacactgaagtactactattgggtcattaatccagctgattcaagtgggattacccccaaaggactggatggtccacggcccagtcagaaagagatcatcagtctcagagcattcatgcttcttttcctgaaacagctgattctcaaagacagaggcgttaaggaagatgagctgcagagcatcttgaactatttgctgactatgcatgaggacgagaacatccacgacgttctgcagctactcgtggcactgatgtcagaacatccagctagtatgattcctgcattcgatcagcgcaatggcattagggttatctataagcttctggccagcaaatccgagtcgatctgggtccaggcgctgaaggtcctgggatatttccttaaacacctggggcacaagcgtaaagtcgagattatgcacacacactcactgttcactctcctgggtgagcggctgatgctgcacaccaacactgtcacagtcaccacatataatactctgtacgaaatcctgactgagcaggtgtgtacccaggtcgtccataagccccaccccgagcctgattcaacagtgaaaatccagaacccaatgattttgaaagtggtcgctaccctactaaagaattccacaccctcggccgaactgatggaggttagaaggttgttcctgagtgatatgatcaaacttttttctaatagcagggaaaaccgaagatgtctgctgcagtgttccgtgtggcaggattggatgttctccctgggctacattaatccaaaaaatagtgaagaacagaaaattaccgaaatggtgtacaacatctttcggatccttctgtaccatgcaatcaagtatgaatggggagggtggcgcgtttgggtcgataccctttccatcgctcattctaaggttacttatgaagcccataaagaatacttggctaagatgtacgaagaataccagaggcaggaagaggagaacataaaaaaggggaagaaagggaacgtgagtacaatctctggcctgagttctcaaacaaccggggcgaagggtggtatggaaattagggagatcgaagacctctctcagagccagtcacccgagagcgagacggactacccagtgtctaccgacactagggatctcctgatgagcacgaaggtctcggacgacattctgggaaactcggatcgtcccggctctggcgttcatgtagaggttcatgacttgctagtcgacattaaggcggagaaggtagaagccactgaagtaaaactagatgacatggacctgtctccagaaaccctggtgggaggggaaaatggcgccttggtagaagtcgaatcgctcctggacaacgtttacagcgctgcggtcgaaaagctgcagaacaacgtacatggcagtgtaggcatcatcaagaagaatgaggagaaagacaatgggccgttaattaccttagctgacgagaaggaggatctgccaaactcgtccacatccttcctgttcgacaagatccccaagcaggaagagaagttgctgccagagcttagttctaaccacatcattcctaatatacaagatacccaggttcacctgggagtgtctgacgaccttggcctgttagctcatatgactggcagtgttgatctgacctgtacttcgagcatcattgaagagaaagagttcaaaatacacacaaccagcgacggtatgagctctatttcagaacgggaccttgcctcctccacaaaaggtctggagtacgcagagatgactgcaaccaccctcgaaacagagagctcatcaagcaaaattgtccccaacatcgatgctggatcgatcatctccgacaccgaacgttcagacgatggaaaggaatccggcaaggagattagaaagattcagacaactactacaacccaggccgtgcaaggaaggagtatcacccaacaggacagggatcttcgagtggaccttggcttcagggggatgcctatgacagaggaacaaagaaggcaattttctccaggtccgcggactaccatgtttcgaatcccagagtttaagtggtcgcccatgcatcagaggttgcttactgatctactgtttgccctggaaactgacgtgcacgtatggaggagccattcgactaaatcagtgatggatttcgtcaattctaacgagaatattatcttcgtgcacaataccatacacttgattagtcaaatggttgataatataattatcgcctgcggaggtatcctgcctctcctgtccgcagcaaccagcccgactacagagcttgagaatattgaggtgacccagggcatgtctgcagaaactgcagtcacgttcctttccaggctgatggctatggtcgatgtgctggtatttgcatcttccctgaatttttccgaaatcgaggccgagaaaaatatgtcttccggggggttgatgagacagtgtctacgcctcgtgtgttgtgttgccgtaaggaattgtttggaatgtcgccagcgacagagagaccggggcaataaaagctcccatggcagctccaagccacaggaggtgcctcaatcagtgacagcaacggcagcctcaaagacacccctggagaatgtacctggaaatctttcccctattaaggaccccgatagactattgcaggatgttgacatcaatagactgcgcgctgtcgtgtttagggatgttgacgatagtaaacaggcacagttcctagccttggctgtggtctatttcatttcagtactcatggtctcgaaatacagggatattcttgagccacagagggagacgacgaggacagggtcccagcctggccgtaatattcgccaggaaattaactccccaacctcgacggttgtggtgatcccctctatcccacatccaagtctgaatcacggcttcctagcaaagctcattcctgaacagtcctttgggcacagcttttacaaagagacacccgctgcgtttccagacacaattaaagagaaagagacacccacacctggagaagatattcaagtcgaatcttcaattcctcacactgattctgggattggggaggaacaggtcgcttccatcttgaacggagcggagcttgagacttctacggggcccgatgccatgtctgagttgctgtccacattgtcctctgaagtcaaaaaaagtcaggagagcctcaccgagaacccctccgagacgctcaagccagcgacttctatctcctcaattagccagaccaaaggcatcaacgtgaaagagattctgaagagtctcgtggcagccccagtggagatcgccgaatgtggaccggagcctatcccttatccggaccctgctctcaagagggagacccaggcaattctgcctatgcagtttcatagcttcgaccggagcgtggtcgtgccagtcaagaagccaccgcccgggagcctggcagtgaccaccgtgggcgcaacaacggcgggttcagggttgccaaccggctccacttccaatatcttcgctgctactggtgcaactcccaagagtatgatcaatacgacaggagcagttgactcaggcagcagcagctcctcttcttcgtctagctttgtaaacggtgcaacttctaagaacctacccgcggtgcaaacggtggcaccaatgcctgaggacagtgcagagaatatgagcattactgcaaagctcgagcgtgcgctggaaaaagttgcccctcttctccgcgaaatcttcgtggactttgccccattcctctcaagaacacttctagggagtcacgggcaggagctcctgattgaagggcttgtatgtatgaagtcctctacttcagtggtagagctggttatgcttttgtgttctcaagagtggcagaattctattcaaaaaaacgctgggcttgcatttatagagctcatcaatgaaggtcggctgctgtgtcacgccatgaaagatcacattgtgcgcgtggccaatgaggctgagttcatccttaatcggcagagggccgaagacgtgcacaagcatgccgagtttgaaagtcagtgcgcgcagtacgcggcagatcgtagggaggaggagaagatgtgtgaccatttgattagcgctgccaaacaccgggatcacgtgacagccaaccagctcaagcagaagattctcaatatcttgacaaataagcacggagcatggggggccgtgtcccactcccagttgcacgatttttggaggctcgattactgggaggacgatctcaggcgaagaagacgcttcgtccggaacgcatttggttccacccacgccgaggcacttcttaaggccgcaattgaatatgggactgaggaggacgtggttaaatccaagaaaacatttcggtcccaggctatagtgaaccagaacgctgaaacagaactgatgctggagggagatgatgatgccgtcagcctcctgcaggagaaggaaatagataatctcgctggtccagtggtgttaagcacacccgcgcaattgatcgcccccgtagtcgtagcaaagggaactttgtcaattaccaccactgagatctacttcgaggttgacgaggacgattcagcttttaaaaaaattgacacgaaggttctcgcctacaccgagggactgcacgggaagtggatgttttctgagatcagagcagttttttctagacgatatttgctgcagaataccgcccttgaggtcttcatggctaatcggaccagtgtgatgttcaatttcccagaccaagcaaccgtaaagaaggtagtgtacagcttgccaagggtcggagtgggaacatcttacggcctgccccaggctagaaggatctctcttgcaaccccgaggcaactctacaaaagctccaatatgacccagcggtggcagcgaagggaaatctccaattttgagtatttgatgttcctgaatacaatcgccggtaggacatataatgacttaaaccaatatcctgtcttcccatgggtcctcaccaattacgagagcgaggagctggatctgactcttccaggaaacttccgagacctgtcgaaacctattggggctctcaaccctaaacgagcagtgttctatgccgaaagatatgagacctgggaagatgaccagtcacccccatatcactataatactcactattcaacagcaacctccaccctgtcgtggctcgtacgaatcgaaccttttacaaccttctttctgaatgcaaatgatggaaagttcgaccacccagaccggacttttagctcagttgctagatcttggcgcacatcccagagagacacatccgacgtcaaggagctgatccccgagttttattaccttccagagatgttcgtgaactccaacggctataatctgggagttagggaggacgaggttgtagttaacgacgtagacctgcctccttgggccaagaaaccagaagatttcgtgagaattaaccggatggccctggagtccgagtttgttagctgtcagctgcatcagtggatcgaccttattttcggctacaagcagaggggacccgaggctgtgcgagcactcaatgtcttccattatctgacatacgagggtagtgtcaatctggacagtatcacagatcccgtcctgcgcgaggccatggaggctcagatacagaactttggacagactccctctcagctgctgatcgagcctcatccaccacgctcctcagccatgcacctatgtttccttccccaaagcccactgatgttcaaggaccagatgcaacaagacgtaatcatggttctcaaattcccctcaaattcaccagtgacgcacgtggcggccaacacacttccacacctcaccatacctgccgtcgtgaccgtgacttgtagcaggttatttgctgttaaccgttggcacaatacagtgggtctcagaggcgctcctgggtactctctcgatcaggcacaccacctgcctatagaaatggaccccctaatcgcaaataattctggagttaacaaacggcagatcacggatttggtggatcagtccatccagattaacgcacactgcttcgtggtaactgctgacaaccgctatatactgatttgtggattctgggataagtcatttagagtatactccactgaaacaggcaaattaacccagatcgtgttcggacattgggacgttgtgacttgcttggctcggagcgagagctacatcggaggcgactgttacattgttagcggaagccgagacgccacacttctcctttggtactggtcagggaggcaccatattattggggacaaccccaactccagtgattacccagcaccccgagcagtgctgaccgggcatgaccacgaggtggtttgcgtgtctgtgtgcgcagagctcggtctggtgatcagcggcgctaaagaaggcccctgcctggtgcacactattacaggggacctcctaagggccctggaagggccagagaattgcctgtttccacggttaatctccgtgagttccgagggccactgcattatttactacgagcgtgggcgattttcaaactttagtattaatggcaagttgcttgcgcagatggaaatcaatgattcaactagggccatccttctgtcctctgacggccagaacctggtgaccgggggggataacggcgtggttgaggtgtggcaggcttgtgattttaagcagctttacatttaccccgggtgtgacgccggcattagagcaatggacctgtcccacgatcagcgtaccctgatcacaggcatggcaagcggatccattgttgctttcaatatcgacttcaatcggtggcattatgagcatcagaaccgctactag

SEQ ID NO: 196917 - DNA, 8841 bp, Artificial Sequence
  Description of Artificial Sequence: Synthetic coding sequence
atggccagcgagaagcccggccccggccccggcctggagccccagccggtgggccttatcgctgtaggggcggcaggaggtggcggaggggggagcggaggtggtgggaccggggggagtggcatgggcgagctgagaggagcgagcgggtcaggtagtgtgatgctccccgctggcatgatcaaccccagcgtccctatccgcaatattcgcatgaagttcgcagtgctcatcggtttaattcaagtcggagaggtgtcaaaccgcgacatcgtcgagactgtgctgaacctactggttggcggcgaatttgacctggaaatgaatttcattatccaagacgctgagtctatcacttgtatgacagaactgcttgagcactgtgacgtcacttgccaggcggagatttggagcatgttcacggccatcctgcgtaaatctgtccgcaacttgcagaccagcactgaggtggggttgatagaacaggtgctgcttaagatgtctgcagtggatgatatgatcgcagacttgctggtcgatatgctgggtgtgttggcctcctactcgatcacagttaaggagctgaagctactcttctctatgctgcggggcgagagtggaatttggcctcggcacgccgtgaagcttctgtcagttctcaaccagatgcctcagaggcacgggcccgatacctttttcaattttcctgggtgcagcgctgccgccatagctcttccacccattgctaagtggccataccaaaatggctttacactgaacacatggtttagaatggacccgctgaataatatcaatgtggacaaagataaaccctacctgtactgtttccggacatccaagggtgtgggctatagcgcccactttgtcggtaactgtctaatcgtcacaagtcttaagagcaaagggaagggttttcagcattgtgtgaaatacgattttcagccccgaaagtggtacatgatttccatcgtgcatatctataatcgatggcggaactcagagatccgttgctacgtcaacgggcagcttgtgtcttatggggatatggcctggcatgttaacaccaatgactcatatgataagtgtttcctgggatctagcgaaaccgccgatgccaaccgggtcttctgcggacagctgggtgctgtctacgtcttttccgaagctcttaatccagcccaaatttttgcaatccatcagctgggtccagggtacaaatcaaccttcaagttcaagagtgagagcgatatccaccttgcggagcaccataagcaggtgctttatgacggcaaactcgctagttctatcgccttcacatataatgccaaggctactgacgcacaattatgccttgagtccagccccaaagagaacgcctccatattcgtgcatagcccgcacgctctcatgctgcaggacgtcaaggcaatcgtcacacactccatacactctgccatccactcaattggagggattcaagtgcttttcccactattcgctcagctggacaaccgacagctcaacgacagtcaggttgagacaaccgtatgcgctacgcttctggcattcttggtcgagctcctaaagtcttctgtcgccatgcaagaacagatgttgggcggaaagggcttcctggtgatcggatatctactggaaaaaagctctagagtgcacatcaccagagctgtcttggagcagtttctttcttttgcgaaatacctggatggcctatcacatggggcaccactgctgaaacagttatgcgaccatattctgttcaacccggcaatttggatccacacacccgccaaagtccagctgtccctgtatacatacctttctgccgaattcatagggacggccacaatttacaccacaatcagaagagtgggcactgtgttacagcttatgcataccttaaagtactattactgggttattaaccccgccgattcttctgggatcacccctaagggactggacggacccagacctagccagaaagagatcattagtcttagagcattcatgctactgttcctgaagcagttaattctcaaggatcgtggggtgaaagaggacgagctgcagtccatcctaaactacctcctaactatgcatgaagacgagaacatccatgacgttctccagcttctagtggctctcatgtctgaacatcctgccagtatgatccctgcatttgaccagcgtaatggaattcgggtgatatacaagcttctcgcctcaaagtcagagagcatctgggtgcaggcactgaaggtgctgggctacttcttaaaacacctaggacataaacgcaaagtagaaattatgcatactcatagtctgttcactctgcttggcgaacgcctaatgttacacacaaatactgtaactgtgacaacatacaatacgctgtacgagattctcacagaacaggtctgtacccaggtagttcacaaacctcacccagagcccgactcaacagttaagattcagaacccaatgatacttaaagtggtggccactctgctcaagaattcaaccccctccgcggagttgatggaagtacgcaggttatttctgtccgacatgatcaagttgttttctaattccagagagaaccggcggtgtctacttcaatgctctgtgtggcaggattggatgtttagcctgggctatatcaaccctaaaaactccgaggaacagaagatcaccgagatggtttacaatatttttaggatcctgctataccatgcaatcaagtatgagtggggcggttggagagtgtgggtggacactttatctattgcccattcaaaggtcacgtatgaagctcataaggaatatctcgccaaaatgtacgaggaataccagcggcaggaagaggaaaatatcaagaaaggcaagaaaggcaatgtgtcgaccatcagcggtctgtcaagccagaccaccggagctaagggcggtatggagatccgtgagatcgaagatctaagccagtcacagagcccagaaagcgaaacagactacccagtctcaaccgatacacgcgaccttcttatgagcacgaaggtctccgacgacatcctggggaactcagacaggccaggcagtggggtgcacgtggaagtgcatgacctgttagtggatattaaggcagagaaggtggaggccactgaagtgaagctcgacgatatggacctgtcaccagagactctggtaggcggagagaacggggctcttgtggaagtcgaatctctcctagacaacgtttatagtgcagccgtcgagaagctgcagaataatgtccacggctctgttggcatcatcaagaagaatgaggagaaggacaacggtccacttattaccttggctgacgagaaagaggatctgcctaatagtagtacctcctttcttttcgataaaatccctaagcaggaggagaagcttctccccgagctgtccagtaaccacatcattcccaacatccaggacacacaggtgcacctgggcgtcagcgatgatcttggtctcctcgcacacatgacgggcagcgtggacctcacttgcacctccagcattatcgaagaaaaagaattcaaaatccataccacgagtgatggaatgagctccatcagcgaaagggatctcgcatccagcactaagggcctggaatatgccgagatgactgccaccacactcgagaccgagtcatcttcatctaaaattgtcccaaacatcgacgcaggctctataatttcggatacggaacggtcagacgatggaaaggaaagtggaaaggagatacggaaaatccagactacgacaacgactcaagcagttcagggaaggtcaatcactcagcaggatagagacttgcgtgtggatctcggctttcggggcatgcccatgactgaggaacagcgcaggcagttctcccctggtccacggaccactatgttcagaatacccgaattcaagtggtcaccaatgcaccagagactgctgaccgatttactgttcgcattggaaaccgacgtccatgtctggcggagtcactcaaccaaaagcgtcatggatttcgtgaatagcaacgaaaacattatattcgtacacaacactatacacttaatctcacagatggttgacaacattattatagcgtgcggcgggattctgcccttgttatctgccgcaacgagccccactggatctaagaccgagctagagaatattgaggtgacccaaggcatgtccgccgaaaccgctgttaccttcctttctaggctgatggccatggtggacgtcctcgtctttgcatcctctctcaactttagcgagattgaagctgaaaaaaacatgagctcggggggcctgatgaggcagtgtcttcgactcgtgtgctgcgtagctgtgcgcaattgcttggagtgccgacagagacagcgcgatcgcggcaacaaatccagtcacggctcgtccaaacctcaggaggtcccccagagtgtaaccgccaccgccgcctccaaaacacctctcgaaaacgttccaggcaatctgagcccaatcaaggatccagatcgtctgttgcaggacgtagatatcaataggcttcgtgctgtcgtcttcagagatgtcgacgactccaagcaggcccagttccttgcattggccgtagtgtattttatctccgtcttaatggtatcgaagtatcgcgacatccttgaaccacagagagagaccactcgcacgggttcccagccgggaaggaacattcggcaagagatcaattctcctaccagtaccgttgtggtgatacccagtattccccatcccagcctcaaccatggctttttggccaagctcatccctgagcagtctttcggacacagtttctacaaagagaccccagccgcgttcccagacactattaaggagaaggaaacaccaaccccaggggaagacatccaggtcgagagttcaattcctcataccgactctggcataggagaagaacaagtcgcctcaattttaaatggggccgaattggagacctccaccggtccagatgctatgtccgaactgctttctacgcttagtagtgaagtgaagaagtctcaggaatcactgactgagaacccttccgaaacactcaagcccgccacttccatttcctccatatctcagaccaagggaatcaacgtcaaggaaatactgaagtcactcgtggcggccccagtggagatcgctgagtgtggcccagagcccataccttatccagatcccgcgctgaaaagggaaactcaagccattctgccgatgcaatttcattcctttgatcggtctgttgtcgtgccggtgaagaagcccccccccggttcgttagccgttaccactgtaggtgccacgaccgcggggtctggcctgcctaccggatccacttctaatattttcgcagccaccggtgccacacctaagtctatgattaacaccactggcgccgtcgacagtggctcatcatctagcagcagttcttcgtcctttgtaaacggggccactagcaagaatcttcccgccgtccagactgtggccccaatgccagaggattctgccgaaaacatgtcaattacagccaagctcgagcgggcattagaaaaagtagcgcctttactgagagaaatctttgtggactttgccccattcctctcacgaaccctgctcggctctcacggccaggagttactcatcgaaggcctggtctgcatgaaaagcagcactagcgtcgttgagcttgtcatgctgttgtgcagccaggagtggcaaaattcaatccagaagaacgctggtcttgctttcattgagctcattaatgagggacgactgctgtgccacgctatgaaggatcacatagtgcgtgttgctaatgaagctgagttcattctaaatcgccagagagcagaggacgtgcacaaacatgctgaattcgagagtcagtgtgctcagtatgccgcggacagaagagaagaggagaagatgtgcgaccacctaatcagtgcggcgaaacaccgagatcacgtaactgccaatcagcttaagcagaaaatactgaacattttaacgaataaacatggcgcgtggggcgccgtttcacattctcaactgcatgatttttggcggctggactattgggaggatgatctcaggaggagaaggcggttcgttcgtaatgcctttgggagcacacatgctgaggcactgctcaaggctgctattgagtatggaacggaggaagacgtcgtcaaaagtaagaaaacgtttagatctcaagcgattgtaaatcaaaatgctgagaccgaacttatgctggaaggtgatgatgatgcggtgagcttactacaggagaaggagattgacaatcttgcgggacccgttgtgctgagcacacccgctcagctaattgcccccgtcgttgtggcgaaagggactctaagcatcacaaccacagaaatttactttgaggtcgatgaagacgacagcgcctttaagaagatagacacaaaagtgttggcctatacggagggtctgcatggtaagtggatgttctccgaaatccgcgccgtgttcagtcgtagatatctcctacagaacacggcgcttgaggtattcatggccaaccgcacatccgtcatgtttaatttccctgaccaggctactgttaaaaaggtcgtatattctctgccacgggtgggcgtgggcacctcctatggactgcctcaagccaggcggatctccttggcgactccacgacaattgtacaaatcatccaatatgacccaacggtggcagcgccgcgaaatctcaaactttgaatacctgatgttcctgaacactattgccgggcgcacatataacgacctcaaccagtatccagtgttcccttgggttctcactaactatgagtcagaagagttggaccttacgctgccagggaacttcagagatctaagcaagccaattggcgcactgaatcccaagcgcgctgtgttttatgctgaaagatacgagacatgggaggacgaccagtcccctccatatcattacaacacccattatagcacagccacgtcgaccctgagctggctcgtcaggatcgagccatttactacattctttctgaacgccaacgatgggaaatttgatcaccccgataggacgtttagctccgtggcccggtcctggcgtacctctcagagggatacttctgatgtaaaggaactgattcctgaattctactatcttccggagatgttcgttaattctaacggctataatttgggggtgcgggaagacgaggtggttgtcaacgatgtggatcttccgccctgggctaaaaagcccgaggacttcgtgagaataaataggatggccctcgaatctgaatttgtgtcatgtcagttacatcaatggattgatctgatcttcggatataagcagagaggaccggaagccgttcgggctctcaatgtttttcattatctgacatatgagggcagtgtgaatctcgattccatcacagacccagtcctccgtgaggctatggaggctcagatccagaactttggacaaaccccctctcagttattaatagagcctcatccccctaggtcttccgcaatgcatctctgctttctgccacagagccccttaatgttcaaggatcagatgcaacaagacgtgatcatggttttgaagttcccatccaacagtcctgtgacccacgtggccgcgaataccctgcctcacctgacgattccagccgttgtcaccgtgacatgttcccgactgttcgcggtgaataggtggcacaacaccgtggggttaagaggagcaccgggctacagcttggatcaggcccaccacctccccatcgagatggaccccttaatcgcgaacaattcaggcgtgaacaagaggcaaatcacagatcttgttgatcagagtatccagatcaatgcccactgctttgtggttacagccgacaacagatacatcctgatctgcggattttgggacaagtcgttccgagtttacagtactgaaaccgggaaactaactcagatcgtatttggtcactgggatgtcgtgacctgcttagcccggtctgaatcctacataggcggcgattgctacattgtttccgggagcagagatgcaacccttcttttgtggtactggtctggccggcaccacatcatcggtgacaatccaaactccagcgactatccagcaccgcgcgctgtgctcacggggcatgaccatgaggtggtatgtgtatctgtgtgtgctgaactcggactggttatctccggtgctaaagaggggccatgcctagtgcacaccatcacgggagacttgctacgcgctctagaaggtccagagaattgtctgttcccaaggctgataagtgtgtcatccgagggacattgtataatatattatgaaagaggccgcttcagtaacttcagcattaatggtaagctcttagctcagatggaaatcaacgacagtacccgtgccatcctcctgagttcagatggtcagaacctcgtcacaggcggcgataatggagtggttgaggtgtggcaagcatgtgactttaagcagctttatatctatccaggctgtgacgcaggcatcagggccatggatctttctcacgatcagcgcaccctgatcactggtatggcaagtggctcaatagtggcttttaatatcgacttcaatcggtggcactacgaacatcagaaccgctactag

SEQ ID NO: 196918 - DNA, 1575 bp, Artificial Sequence
  Description of Artificial Sequence: Synthetic coding sequence
atgttcgtgaacagcaacggctacaacctgggcgtgcgggaggacgaggtggttgtaaacgatgtggacttacctccatgggcgaaaaagcctgaggattttgtccgaatcaatcggatggcactggagagcgagtttgtatcctgtcagctccaccagtggatcgatctgatcttcggctataagcagcggggacccgaagcagtgagggcactgaatgtctttcattacctgacttatgagggcagtgtgaatctggacagcatcacggaccccgtgctgagagagattcccgaagcctacttcataagggatcctcatacgttccttctaactaaagattttatcaaggccatggaggcacaaattcagaatttcggacagaccccatcacagctcttgatcgaaccccaccccccgcggtcctccgctatgcacctgtgctttctcccacaaagccccttgatgttcaaggaccagatgcagcaggacgtgattatggtccttaaatttccatcaaattctcccgtcacccacgtcgctgccaataccctgccccatctcaccatcccggccgttgttaccgtgacatgttcgcgattgtttgcagttaatagatggcataacactgtcggtctacgaggggctcctggctattcactcgaccaagctcaccacctgcctattgaaatggaccccctcattgcaaataactcaggcgtgaataagagacagattactgatctggtcgatcaatccatccaaatcaacgcccattgctttgtagtcactgccgataacagatacatcttgatctgtggtttctgggacaagtccttcagggtgtattctactgagacaggcaagctcacccagatcgtgtttggtcattgggatgtggtgacatgtttagcacggtccgaaagctacattggcggagactgctatattgtttccggatcccgagatgcaaccctcctgctgtggtactggtcagggagacaccacatcatcggagataaccctaattcctcggattatcctgccccccgcgcggttctaaccggccacgaccatgaggtcgtatgtgtttctgtgtgtgctgagttaggccttgtgatcagcggagcaaaggagggaccctgtctcgtccatactataacaggggatctgttgagggctctcgaaggacctgaaaattgcctgtttccacgcctgatcagcgtatccagtgagggtcactgcatcatttactatgagcggggacgcttttctaacttttcaataaacggaaaattgctggcgcagatggagatcaatgactccaccagggccatcctcctctcctcagatgggcaaaatttagtcaccggtggtgacaacggtgtggtggaggtttggcaggcatgcgatttcaagcagctatacatctaccccggatgtgacgccggtattagagccatggatctctcccacgaccagcggactctgataactgggatggcctccgggtcaatcgtcgcctttaatattgacttcaatcggtggcactacgagcaccagaaccgatactag

SEQ ID NO: 196919 - DNA, 4728 bp, Artificial Sequence
  Description of Artificial Sequence: Synthetic coding sequence
atgcaccagcggctgctgaccgacctgctgttcgccctggagaccgatgtgcatgtgtggaggtcccactctaccaaaagtgtgatggactttgtgaactctaacgaaaatatcatattcgtgcacaatacaattcatctaatttcacaaatggtggataacataatcattgcctgcggcggcatcctgccactgctgagcgcggccacgagtccaacaacggaattggagaacatcgaggtaacccagggaatgtccgcggagactgcagtgactttcctcagtaggcttatggcaatggtagatgtccttgtcttcgcttctagtttgaattttagcgagattgaggccgaaaagaatatgtcctctggcgggctaatgaggcaatgcctgagactggtgtgttgtgttgccgtcagaaactgtctggaatgtagacagcggcagagggaccggggcaacaagagcagccacgggagctctaagccccaggaggtaccccagagcgtgactgctaccgccgctagcaaaacaccgctggagaacgtcccagggaacctgtccccaatcaaagatcccgatcgattactacaggatgttgacattaataggttacgcgcggttgtgtttcgagatgtggatgactctaagcaagctcagtttttagcactagccgttgtgtacttcatttccgtgttgatggtgtccaagtacagggacatcctggagccccagcgtgagactacaaggaccggctctcaaccgggacggaatattcgccaggagattaacagtcccacttccacagagactcctgctgcttttccggacacgatcaaggagaaagagacccctacacctggagaagacatccaggtggagtcaagcattccacataccgatagtggcataggcgaggaacaggtggcatctatcttgaacggcgcagaattagagacatctaccggtcctgacgccatgtctgaactgcttagcaccctcagttctgaggttaagaagtcccaggaatcgcttacagagaatccgtctgaaacactcaagcccgccacgagtataagctctatcagccaaaccaaaggcattaacgttaaagagattttaaaatccctggtggcagcccctgtggaaatcgccgaatgcggcccagagcctattccctacccagaccctgctctgaaacgagaaacgcaggccatccttcctatgcagttccatagcttcgaccgtagtgtggtggtgcctgtgaaaaagcctccaccgggatctcttgccgtgaccactgtcggcgctaccactgccggaagcgggctcccgacaggaagtacgtcaaacatcttcgcggctaccggcgctacacctaaatctatgatcaacactactggggccgtcgattccggttcgagtagcagctcatcatcatcctcttttgttaatggcgcgacttccaagaacttgcctgcagtgcagaccgtcgcccccatgcccgaagactccgccgaaaacatgagcataacagcaaagttggagcgagcccttgagaaggtggcaccactcctgcgagaaattttcgtggacttcgctccgttcctttccagaaccctgcttggctcccatgggcaggagctgttgatagagggcctcgtgtgtatgaagtctagcacttccgtggtggaacttgtaatgcttctgtgctcacaggaatggcagaattctatccagaagaacgcaggcctcgccttcatcgagctgataaacgaaggacgcctgctatgtcatgcgatgaaggatcacatcgtccgggtggctaacgaggccgagttcatccttaacaggcagcgggcagaagacgtccacaagcacgccgagtttgaatcccaatgtgcccaatacgctgcggatcgtagagaggaggagaaaatgtgcgaccacctcatcagcgcagcaaagcatcgcgatcacgtgaccgccaaccaacttaagcagaaaatcctaaacattctgacaaacaagcacggcgcctggggtgctgtatcgcactctcagttacacgacttttggcggttagactattgggaggatgacctgagaaggcgacgccggttcgtcagaaacgcctttggatcgacccatgctgaggccttgctgaaggcggctattgagtatggcaccgaagaagacgtcgtaaaaagtaagaaaaccttcaggtctcaggcgattgttaatcagaatgcagagactgaattgatgctggagggggatgatgacgcggtatcgctcctgcaggagaaagagatcgataatctggccggacctgtggtgctgagcacccccgcccaactgattgcacccgtcgtggtcgccaagggaactctgtctattacaacaacagagatttatttcgaagtagacgaggatgattcagcttttaaaaagatcgacaccaaagtgctcgcttacacagagggtctgcatggcaagtggatgttttcggagattcgggcggtgttcagtaggcgctatctgctgcagaataccgcgttggaagtattcatggctaaccgaaccagtgtcatgttcaatttcccggaccaggccacggtgaagaaggtagtttattcgctgccacgagttggcgtgggtaccagctacgggcttccccaggcacgccggatttctttggcgaccccacgccagctttacaagtcctcgaacatgacacagcgatggcagcggagagagatcagcaatttcgaatacttaatgttcctgaacaccattgccgggaggacatataatgacctgaaccagtacccagttttcccctgggtactgaccaactacgaaagcgaggaacttgacttgactctgcccggaaattttcgggacctgtcaaagcctatcggcgcgttaaatcctaagagggcagtgttctatgccgaacgatacgagacctgggaagacgatcagtcaccaccctaccactacaacactcattatagcactgctacctctaccctgtcctggcttgtgcggatcgaaccctttactacattcttcctaaacgcgaatgatggtaaattcgaccatcctgatagaacattttcctccgtcgccaggtcttggaggacaagtcagagagatacctctgacgttaaggagcttatccccgaattctattatctgcccgagatgttcgtgaactccaacggatacaacctcggagtgcgggaggacgaggttgtcgtgaatgatgtagatctgcccccttgggcaaagaaacctgaagattttgtgcgaattaacaggatggccttggagtctgagtttgtgtcttgtcagcttcatcagtggatcgatctcatctttggctataagcagagagggcccgaggccgttcgggctctgaacgtctttcattacctgacctacgagggctccgtgaatctggactccattacagaccccgtcttaagggaagctatggaagctcaaattcagaactttggacagaccccatcccagctgctgattgaaccccatccccctaggagcagcgcgatgcacttgtgttttctgccacagtcaccactgatgttcaaagaccagatgcagcaggatgtaataatggttctgaaattcccctctaacagcccagtcacccatgtggcagcgaacaccttgcctcacctgacaatccccgcggtggtcaccgttacctgctctcgcctgttcgccgtgaacagatggcataacacagtcggccttcggggagccccaggatactcactagatcaggcccatcacctgcctatcgagatggaccccctgatcgcaaacaattctggagtgaacaaaaggcagatcacagatctggtcgaccagtctatccaaattaacgcccattgtttcgtagttaccgcagataatagatatatcctgatctgtggattttgggacaagagctttagggtgtactctacggagacaggaaagctgacccagatagtattcggccattgggacgtagtgacttgcctcgccaggtcagagtcctacatcggcggcgattgctacattgtgtcaggatccagggatgccaccctcctgctctggtactggtccggaaggcaccacataatcggcgataaccctaacagtagtgaatgcgactatcctgcaccacgggctgtcctgacaggccacgatcatgaggtggtgtgtgtgagtgtttgtgccgagcttggcctggttatctcaggtgcaaaggagggaccttgtttggtccataccataacaggtgatctgctgagggccctagaggggcctgagaactgtctgtttcctaggttaatttctgtgagttccgagggtcattgtatcatatactacgagcgcggacgtttttcaaacttcagcattaacggcaaattgctggctcagatggaaattaacgattccaccagggccatactcctgtcctctgacggccagaacctggtgacaggaggagacaacggagtcgtggaagtatggcaggcttgtgattttaagcaactttatatatacccaggctgtgacgctggcattagggccatggacctgtcccacgatcaaaggactctgatcactggcatggcaagtgggtctattgtggcatttaacattgatttcaaccgctggcactatgagcaccaaaatagatactag

SEQ ID NO: 196920 - DNA, 2220 bp, Artificial Sequence
  Description of Artificial Sequence: Synthetic coding sequence
atgttcagcgagatccgggccgtgttcagccggcggtacctgctgcagaatacagccctggaggtgtttatggctaataggactagcgtgatgttcaactttcccgatcaggccaccgtgaagaaggttgtttactcccttccacgcgtgggagttgggacatcatatggactcccacaggcacgccgaatcagtctggccacaccacgtcagctgtacaaatcgagtaacatgacccagaggtggcagcggcgagagatctccaattttgaatacctcatgtttttgaacactatcgctggccggacgtataacgacctgaaccagtaccccgtctttccatgggtcctcactaactacgagtcagaagagctggacctcactctgcctggcaattttagagacctgagcaaacccatcggggctctcaaccccaagcgggcagtgttctatgctgagcgttatgagacctgggaggacgatcagagtccaccttatcactataatacgcactacagtaccgcgacatctacactcagctggttggtcagaattgaacccttcacaacatttttcctgaatgccaatgacggtaaatttgatcatccggatcgcactttctcgtcagtggccagaagttggcggacatctcagcgcgatacttccgatgttaaggagttaatccccgaattctactatctgcccgagatgttcgtcaatagcaatggctataaccttggcgttagggaggacgaggtggtggtgaatgatgtggatctcccaccatgggcaaagaagccagaggattttgttaggattaataggatggcgctggagtctgaattcgtctcctgccagctgcaccaatggatagaccttatcttcggatacaaacagagaggccctgaggcagtaagggctcttaatgtgttccactatctcacctacgagggctctgtcaatctagactcaataaccgatcctgttctcagagaggctatggaggcccaaattcagaattttgggcaaactccctcccagttactgatcgagccccatccaccccggagctccgcgatgcatttgtgtttcctgcctcagagcccactcatgtttaaggaccagatgcagcaggatgtaatcatggtcctcaagtttccatcaaattcgcctgtgacccatgtggcagccaacacactgccgcacctgactattcccgctgtcgtaactgtgacctgctcccggctattcgctgttaatcgatggcataacacggtgggcttgagaggcgcgcctggctattccctcgaccaggcccaccacctcccgatcgagatggatcccctcatcgcaaataactccggcgtgaataagcggcagattacggatttggttgatcagagtatccaaattaacgcccattgttttgtggtgacagcggataacaggtatatcttgatctgtggattttgggataagagtttccgtgtgtatagcactgaaacaggtaagctaacccaaattgtcttcggccattgggatgtggtcacttgtcttgctcgctcggaaagctatattgggggagactgttatatcgtcagcggcagtcgcgacgcaacactgctgctttggtactggtcagggcgacaccacattattggcgacaacccaaactcatctgattaccctgctcctcgggccgtgcttaccggccatgaccacgaagtggtgtgtgtctcggtgtgcgctgaactgggattggttatttccggtgccaaggagggtccttgccttgttcacaccattaccggggaccttctaagagccctcgaaggaccagagaattgcctgtttccccgtctaatctcggtcagctcagaagggcactgtatcatctactatgagaggggccgattttctaacttcagcatcaatggtaaactattggcccagatggagataaacgatagtacacgggctatactgttatcctcagacggtcagaacctggtcaccgggggagataacggagtcgtggaggtgtggcaagcttgtgatttcaaacagctgtacatctaccccggctgtgatgcgggcattagggccatggacttaagccatgaccagagaactctcataaccggtatggctagcggcagtatcgttgccttcaacatcgattttaaccgatggcattatgagcatcaaaacagatactag

SEQ ID NO: 196921 - DNA, 8841 bp, Artificial Sequence
  Description of Artificial Sequence: Synthetic coding sequence
atggccagcgagaagcccggccccggccccggcctggagccccagcccgtgggcctcattgccgtgggcgctgccggcggcggtggagggggttcaggaggagggggtacaggaggatcaggaatgggcgaactgcggggagcaagcgggagtggcagtgttatgcttcctgctggaatgatcaaccccagcgtgcccatccgcaatatcagaatgaagttcgctgttctcatcggcctcatccaggtgggagaggtgagtaacagagatattgtggagacagtgctgaatttgctcgtcggcggcgaattcgatcttgagatgaactttatcatccaggacgctgaatctatcacttgcatgaccgaactactggagcattgcgatgtgacctgccaggccgagatctggtccatgtttacagctattctcagaaagtccgtcaggaatctgcagacctccaccgaagttggcctgattgagcaagtcctgctgaagatgtccgccgtagacgatatgattgcggacctgctggtggatatgctgggggtccttgcctcctattctatcactgtcaaggaactaaaattgctgttctccatgctcagaggagaaagtggaatttggccacgccacgcagtgaagcttctgagcgtgctgaaccagatgccccagcggcatgggccggataccttctttaactttccaggatgttctgctgcggccatcgcgttgcctcctatagcaaaatggccgtatcagaacgggttcacactgaatacctggtttcggatggatccgctaaataacattaatgtggacaaggataaaccatacctgtactgctttcgaacgagtaagggcgttggatactccgctcactttgtcggtaactgtctgatcgtgacttctctaaaatctaaaggaaaaggctttcagcattgcgtcaaatatgactttcagcctcggaagtggtacatgatttctatcgtgcatatttacaacagatggaggaatagcgagataaggtgctatgtgaacgggcagctggtgtcctacggtgacatggcctggcacgtaaataccaatgactcttacgacaagtgtttcctgggtagcagtgaaacggctgacgccaatcgcgtgttttgcggacagttgggcgccgtatatgtgtttagcgaagctttaaatcctgctcaaattttcgcgatccatcagctgggccccggttacaagagcactttcaagtttaagagtgagagcgacatccacctcgcagaacaccacaagcaagttctgtatgacggtaagctagcttccagcattgcatttacgtacaatgccaaagccacagacgcacagctctgtctggaatcatctcccaaagagaacgcctccatctttgtgcacagcccacacgccttaatgttgcaggacgtcaaagctatcgttacacattctattcactctgctatccacagtatcggggggattcaggtgctgtttcccttattcgctcagctggataacagacagctcaacgacagtcaggtggaaactacagtttgcgccacactgcttgcctttctggtcgagctgctcaaaagctccgtggccatgcaagaacagatgctcggtgggaagggttttctagttatcggatacttactggagaagagctcacgggttcacattacaagagccgttctcgaacagtttctcagctttgccaagtacctagacggactcagccatggagctccgctgcttaaacagctgtgtgaccacatcctcttcaatcccgcaatttggatacatacaccagcaaaagtccagctaagcctgtacacctatctgtcagcggagttcatcggcaccgcgaccatctacacgactatcagaagggtaggaactgtgcttcagcttatgcacaccttgaaatattattattgggtgattaatcccgcagattcttcaggcatcaccccgaaggggctggacggaccacggccttctcagaaggagatcatttcactgcgtgcttttatgctgttatttctcaaacagctgatcctgaaagatagaggcgtgaaagaagacgagttgcagagcattctgaattacctcttaaccatgcacgaagatgaaaatatccacgacgttctccagctgttggtggccttgatgagcgagcacccagcgtcaatgattcccgctttcgaccagcgcaatggaattagagtaatttacaaattactggcttcaaagagcgagtccatttgggtgcaggccctcaaggtactcggttactttctcaaacaccttggacacaagcggaaggtcgagatcatgcatacccactctctattcactctgctgggtgagcgcctgatgctgcatacaaacactgtgactgtcactacttacaatactctgtacgagatactgactgaacaggtgtgtacgcaggtggttcacaagccccaccccgagccggactccacagtgaaaatccagaacccgatgatcctgaaagttgtggccaccttgctcaagaactccacaccgtccgccgagttaatggaggtgcgacggctgttcctaagtgacatgatcaaactcttctctaactcacgcgaaaaccggcggtgtcttctgcagtgctctgtgtggcaagactggatgttctccttaggatatattaacccgaagaacagtgaagagcagaaaattacagagatggtctacaatatctttagaattcttctttatcatgcaatcaagtatgagtggggaggctggcgggtctgggtcgataccctatctatcgcccactctaaagtcacctacgaagctcacaaggaatatctagcaaaaatgtacgaggagtatcagcggcaggaggaagaaaacattaaaaaggggaagaagggcaatgtttccaccatttctggactttcttctcagacgacaggggccaaaggcgggatggagattcgagagatagaggatctgtcccagagccagagtcccgagagtgaaaccgattatccggtgagcaccgacacaagggacctgctgatgagtaccaaagttagcgacgacatcctgggaaatagtgaccgcccgggaagcggagtgcatgtggaagtgcacgacttactagttgacatcaaagcagaaaaggtggaagcgacagaggtcaagctggatgacatggatctgagccctgagactcttgttggcggcgagaacggtgccctggtggaggtggagtcactgctggataatgtgtatagtgccgctgtggagaaactgcagaataatgtgcacgggtccgtcgggatcatcaagaagaacgaggagaaagacaatggaccactgatcaccttagcagatgagaaagaagatttacctaattcttctaccagtttcctcttcgataagattccaaagcaggaagaaaagctgcttcccgagcttagtagcaatcacataatccctaatattcaggacacgcaagtacacctgggagtaagcgacgacctcggcctgctcgctcacatgacagggagtgtggacctgacatgtacaagcagcattatcgaggagaaagaattcaagatacatacaacttcagacggcatgtcttcaatttccgaacgtgacttggccagctccacgaagggtttagagtacgccgaaatgacagcaaccacgctggagactgaatctagcagcagcaagatagtgcctaacattgacgccggaagtataatttcagatacagagaggagtgatgatgggaaggaaagtggaaaagaaatcagaaagattcagactaccactactacccaggcggtacaaggaaggtccataacccaacaagacagagatcttcgggtggatctgggatttaggggaatgccaatgaccgaggagcaaagaaggcagttttctccagggccacgcacaacaatgttcaggatccccgaattcaagtggagtcctatgcaccagcgacttttgactgatctgctgtttgccttagagacagatgtgcacgtgtggaggagccattctacgaaatctgttatggacttcgttaactccaacgagaatataatctttgtgcataatactatccacctgatctcccagatggtagacaatattatcatcgcctgtggggggattctccccttgttgtctgcagctaccagtcccaccgtcagcaagacggagctcgaaaatattgaagtgacacagggcatgagtgcagagacagctgtgacctttctgagcagactgatggcaatggtggacgttctggtgttcgcatcatcactcaattttagcgagatagaagccgagaaaaatatgagcagtggcggcctgatgcggcagtgtcttagactggtctgttgtgtggctgtaagaaactgcctggagtgtcgtcagcggcagcgggatcgaggaaataagtcctcacacggttcgagcaagccccaagaggtgccccagtctgtaacggcgacagcggccagtaaaacacccctggaaaacgtacctggaaacctctcacctattaaggatcccgacagactgttgcaggacgtggatatcaatcgtctgagggccgttgtattccgagatgtggacgactcaaagcaggcccagttcctggctctcgctgttgtatacttcatttccgtgttgatggtgagtaagtatcgcgatatcctggagccccagcgcgaaactacgagaacagggtcacagcccggaaggaatatccggcaggagattaatagccctacttccaccgtagtggtgatcccttcaattccacacccatccctcaaccacggcttcctggctaaactaattcctgagcaatctttcggacactcattttataaagaaacacccgccgccttcccggatacaattaaagagaaagagacaccaacgcctggtgaagacattcaagtggagtcatccattccacacaccgacagcgggatcggcgaggagcaggtcgcaagcatcctgaatggcgctgagcttgagactagcaccgggccagacgctatgtccgagctgctgtccacactgtcttctgaagtgaaaaaatctcaggagtcactcacggagaatccatcggaaactctgaagccggcaacctctatctccagcatctcacaaaccaaagggattaacgttaaggaaatcctgaagagcctcgtggctgccccagtggagattgcagagtgtggtccagagccgatcccttaccccgatcccgccttaaagcgggaaacgcaagcgattctacccatgcaatttcatagcttcgaccggtctgtagtagtccctgtgaagaaaccgccacctggtagtctagccgtcactacggtgggcgctaccacagctgggagcgggctgccaaccgggtcgaccagcaacattttcgctgcgactggggcaaccccaaagtccatgatcaacacaacgggggccgttgatagcggatcgagctcctccagttcaagctcctccttcgtgaacggcgccacctcaaagaatttgccagccgtgcagactgtcgcccctatgcccgaagactctgccgagaatatgagcatcacagcaaaactggagagagccctggaaaaggtggccccactgttgagagaaatattcgtggattttgcccctttcctctctaggactcttttaggaagccacggacaagagctcctgatcgaaggtttggtctgcatgaaatcttcaacctcagtcgttgaattagtcatgcttttgtgttcccaggagtggcagaattccatccagaaaaacgccgggcttgccttcatagaactgatcaacgagggacgcctgctgtgccacgcgatgaaagatcacatagttcgggtcgcaaatgaggccgagttcatacttaacaggcagagagctgaagacgtgcataagcatgcagaattcgagagccagtgtgcccagtatgctgcagaccgccgcgaggaggagaaaatgtgtgaccaccttattagcgcggcgaaacaccgggaccatgtaaccgcaaaccagttgaaacaaaaaatattaaatatccttaccaacaagcacggcgcatggggcgcagtgagccactcacagcttcacgacttctggaggctggattattgggaagatgacttacgacgccgccggcgattcgtacgcaatgccttcggatcaacacacgcagaagccctgcttaaagccgcaatcgagtacggaacagaagaggatgtcgtgaagagcaagaaaacattccggtctcaagcaatcgtaaatcagaacgctgagaccgaactcatgctcgagggggacgacgacgcggtgagtctgctgcaggagaaagaaattgataaccttgccggcccagtggttctgtccaccccagcgcagctaattgcgcctgtcgtggtcgccaaaggtaccctcagcattactactacagaaatctactttgaggtggacgaggacgacagcgctttcaagaagatagacactaaggtgctcgcatatactgagggccttcacggaaagtggatgttttccgaaattcgagccgtcttttctcgccggtatttactacagaacaccgcactagaagttttcatggccaaccggacttcagttatgttcaatttcccagaccaggctaccgttaagaaagtggtgtatagcttacctcgagtcggtgtggggaccagctatgggttgccacaagcaaggcggatttcactggctaccccacgtcagctgtataaatcttccaatatgacgcagcgctggcagcgaagggagatttcaaacttcgagtatttgatgtttctgaacaccattgcgggtagaacctataacgacctcaatcagtaccctgtattcccatgggtgctgacaaattacgagtccgaagagctggatctcaccttacccggaaacttcagagacctgtcaaaacccatcggcgcccttaacccaaagagggctgtcttttacgcagagcgatacgagacatgggaggatgatcagagtccaccataccactacaacacgcattattcgacagccacctcgaccctgagctggctagtaaggatcgagccatttacaacctttttcttgaatgccaacgatgggaagttcgaccaccccgatcgaacattttcctccgtggcgaggtcctggcgcacaagccaacgagatacctctgatgtgaaggaactcattccagagttttactatcttccggaaatgttcgtgaactcaaacgggtacaacctgggagtgcgggaagatgaagtggtcgtgaacgatgtagatctgcctccatgggctaaaaaacccgaagacttcgtccggattaataggatggcgttagaaagcgaattcgtgtcatgccaactacatcaatggatagatctgatttttggctataaacaacgtggcccggaagcagtacgcgctttgaacgtgttccactatctgacctacgaagggtcagtcaacttggactcaataactgaccccgtcctgagagaagctatggaagcacagatccaaaatttcggtcagactccatcacaactcctcattgaacctcacccaccacgtagttctgccatgcatttatgcttcttaccacagagtcccctcatgtttaaggaccagatgcaacaagacgttattatggtgcttaagtttccatccaattctccagtgacacacgtggcagcaaacaccctgccccatctgactatccccgctgtcgtcacagtcacatgcagccggttgttcgccgtgaataggtggcacaacacagtaggactccggggggcccctggttattcgctagatcaggctcatcaccttcccatcgagatggatcctcttattgccaacaatagtggagtgaataaaaggcagattactgacctggtggatcaaagcatccagattaatgcccattgctttgtcgtgaccgccgacaatcgctacattctaatctgcggattttgggacaagtcctttcgtgtgtatagtacagagacaggcaagctgacacagatcgtctttggacattgggacgttgtgacgtgcctggctcggagcgagagctacatcggcggggattgttacattgtgagcggcagccgcgatgcaacacttctgctgtggtactggagcgggagacatcacatcattggggacaatccgaattccagcgattacccggcaccccgtgctgttcttactggacacgaccatgaagtagtgtgcgtgagcgtttgcgctgaattgggactagtgatcagcggagccaaagagggtccttgtcttgtgcataccataacaggagacctgctgcgggccctggaggggcctgaaaattgcctctttcctcgcctcatttccgtgagctcagaaggacactgcatcatttattacgaaaggggtagattctccaacttttccatcaatgggaagttgttggctcagatggaaatcaatgactccacacgagctattctactgagctcagatggacagaatctcgtgacaggcggggataacggtgttgtagaggtgtggcaggcatgcgatttcaagcaactttatatctatcccggatgcgacgccggcattagagccatggacctaagccatgatcaaaggactctgatcacaggcatggcgagcggtagcatcgttgcatttaacatcgactttaatagatggcattacgagcatcaaaacaggtattag

SEQ ID NO: 196922 - DNA, 834 bp, Artificial Sequence
  Description of Artificial Sequence: Synthetic coding sequence
atgttcagcgagatccgggccgtgttcagccggcggtacctgctgcagaatacggctttggaagttttcatggcaaataggacatccgtcatgtttaacttccctgaccaggctaccgtaaaaaaagttgtttattctctgcctcgggttggagtgggcaccagctacggccttcctcaggctcggaggataagtctggcgactccccgacagctctacaagtcctctaatatgacacagaggtggcagagacgggagatctccaatttcgagtaccttatgtttctaaacacaatcgcaggaaggacatataatgacctcaatcaatacccagttttcccttgggtgctgactaattatgaaagcgaagagctggatctaacactaccaggtaattttagagacttaagcaagccgatcggagccctcaatcccaagcgggctgttttctatgccgagagatacgagacttgggaggacgaccaaagcccaccataccactataacacccactactctacagccacaagcactctaagctggctggtgaggatcgagccctttactacatttttcctaaatgcaaacgacggaaaatttgaccaccccgatagaactttctccagtgtggccagatcatggcgaacctctcaacgagataccagcgatgtcaaagagttgattccagaattttattacctgccagagatgttcgtgaactcaaatggttataacctgggcgtacgtgaggacgaggtggtcgttaatgatgtcgatctgccaccgtgggccaagaatctcaagaccctttgcgggtctactgggtggccctag

SEQ ID NO: 196923 - DNA, 7815 bp, Artificial Sequence
  Description of Artificial Sequence: Synthetic coding sequence
atggccagccgggagcggctgttcgagctgtggatgctgtactgcactaaaaaggatccggactatctgaagctgtggctcgacactttcgtttccagctacgaacagtttctggacgtggacttcgagaaacttccaacacgcgtcgacgacatgccacccgggatcagcctcctgcccgacaatatactccaggttctgcgaatccagcttcttcagtgcgtgcagaaaatggccgacggccttgaggaacaacaacaggctttgtcaattttattggtcaagttttttattatactctgtaggaacctgtcaaacgtggaggagataggcacctgctcttacatcaattacgtgatcactatgactaccctttatatccagcagctaaagagcaagaagaaggagaaggagatggcagaccagacttgtatcgaggaatttgtcatccatgccctggccttctgcgaatccttgtacgatccctatcgcaattggaggcaccggatctcggggcgaatcctgagcaccgtcgagaagtcccgacagaaatacaaaccggcaagcctgaccgtagagttcgtgccattcttctaccaatgcttccaggagagcgaacatctgaaggagtcactgaaatgctgtctgttgcacctgtttggggcgatcgtggccggaggacagcgaaacgcgctgcaggccattagccctgccaccatggaagtcctgatgagggttttagcagattgcgattcttgggaggatggggaccccgaggaggtgggacgtaaggctgagcttactttgaaatgcctgacggaagtggtacacattctgctgtccagtaactcagaccagagacaggtggaaacatcaaccatactggaaaactactttaagctattaaatagcgaccatagcgccctccctaatcaacgcagaagcaggcagtgggaaaacagattcatcgccctgcagattaagatgctgaacactatcacggccatgctggattgcactgatcgcccagtccttcaggcaatcttcttaaactccaattgcttcgaacacctgatcaggctactacaaaactgtaaggtgttccagggccaactcgattgcctggccatttcaactattcaagctttgaccgccgtgatgaacaagtctccggccgcaaaagaggtctttaaggaacgtatcggttatactcacatgttggaggttctgaaatctttgggccagccccccctggagctgctgaaggaactgatgaacatggctgtcgagggggatcacacctctgtgggaattctcggcatttcgaacgtccaacctctgctgctactaattcagtggctccctgaattgcagtcacatgacctgcaaattttcatttcagattggctgaaacgcatctgttgcattaacagacagtcccgaaccacctgcgttaatgcaaatatgggaattaggattatcgagaccttggatctccacagctcactccaccaaacctgtgcagagaaccttattgctatccacgggtccctaggaagccaatctgtgtcttcagaggaaattcggcggctgctgcgtctcttgcgggtcgatgagtccgagagtgtccatccctacgtgaccccagtgacccgagctatcctcacaatggctcgcaagttgtcactggagtcagctctgcagtactttaacctgagccattctatggccggcatttccgtgccacccatccagaaatggccggggagtgcattcagcttctctgcatggttttgccttgatcaggatcagctgaccctcggaatcgccaataagggaggaaaaagaaagcagttatactcgttcttcaccggatcgggaatgggattcgaagcatttattacacactctgggatgctcgttgtcgccgtgtgtacaaaacgcgagtacgcgacagtcatgttgcctgatcatagcttctgcgactcactttggcacaacatcacagtggtccacatgcccggtaagagaccctttgggcagtcattcgtgtacatttacgataacggacagcagaaagtcagcgcccctctccggtttccagccatgaacgaaccttttacctcttgctgtatcggatcggcgggccaacgaacgactacccctcctccatctcagatcccagaccccccattctccagccctattactccacaccgcacaagcttcggtgggatcctgtctagtgcttcctggggggggacaatcgaaaagagcaagctgattacgaaactaataagcgccggaactcaggactccgaatgggggtgtccgacaagtttagagggccaactggggagcgttattatattctacgagcccttgcagcctcctcaggtaaaggccctttatctggcaggacccaactgtcttagtccatggaagtgccaagagtcagacatggcggacctgccaggaaatatcctcctctattatacagctaaagcctgcaagaattctatctgtttagacctctccaccaactgcctgcacgggagattgacggggaataaagttgtcaattgggatataaaggatattataaactgcataggtgggctaaacgtgctgtttccgcttctggagcagatctcgcatttttcagaaggccagatacctgaggagaagaacgaatccacagttcctgaatcagtgacacctgtcgaaggcgactggttagtttggacttcaactaaggcaagcgagtcccggctggagcggaatctggtcgcaacgttcatccttatcgtgaagcacttcatccaacgacaccccatcaatcagggcaacttgattcactcgcacggcgtggcaaccctcggagcactcctacagaaagtgccttcaacactcatggatgtaaatgtactcatggcagtacagctactcatcgaacaggtgtctctggaaaaaaatatgcaactactacaacagatgtaccagtacttgctttttgacttccggatctggaaccggggggacttcccattcaggatcggacatattcaatacctatccacaataatcaaagactcaagacgagtctttaggaaaaaatacggagtgcaatttctgctagacacactcagaatctactatggtaacggctgcaaatataacgaactttcattggacgacattcgcacaattcgcacaagcctctacggcctgatcaagtacttcctctgcaaaggtgggagccatgaggaaatacagtccattatgggatatattgcagccaccaatgaagaggagcaactgttcggcatcttagacgtgctgttctcacttctgaggaccagcccaacgaggggccaactgtttctcctgctctttgagcccggcaacgcagatattctttatgctttgctgctaaatcagaagtatagcgataggttgcgcgagattatcttcaagattatggagcaaatgctgaagtgcacgaatgtgtacgagcggagcaaacagcatatcaggctgagggaggtgggttatagcgggctgggactcttactgaatgaagctctggtgaacaccagtctgattaagaacctgactcatcaaataattaacactgaccccgtgataaactttaaagaccttctctctgttgtatacatctcacaccgcgcgcatatcaatgtccgagttgccatttgtcgcaaggtgctgcaaattctccagttccagcctgacgctgcccaccagatttctcagcaggtgggctggcaggacacacttgttcgacttttcttgaaagccaagttcgagaatgggaataccctccacaaacacagcagggccgtgctcatgaaagacaatgacaaaaacatgtccacagaagacaccaaaaaaaattcggatgagaaaactgacgaggaaaaaattacttcctttgctagcgccaatgtgagctccgaccagtggtcactcgaagacaggcatagtctcgattctaacacccccttgtttccagaagactcttctgttggggagcttagcttcaaaagcgagaatcaggaagagttttggcactccaacccctcccatctgtccctagacctctctggaattgactcatgcgaaatgtccgattccgggagccaggtgcctgatagtctaccgtcgaccccctctcccgtagagagcactaaaagcttttccgtccattcagacagggagtcaagtataaccaatgacatgggtttttctgatgatttttcacttctcgaaagccaggagcgctgcgaggaggagcttctacaactcctgacccacatcttgaactatgtcatgtgcaaggggttagagaaatctgatgatgacacctggattgagagaggacaggtttttagcgcactgtcgaagcccggcatcagctctgagctgctgcggccaagcgacgagatcaaactaacactgctacaaaagatgctggagtgggcaattagcgagaatagagaagcaaagacaaacccggtcaccgcagagaacgccttcaggctcgtgctcattatacaggacttccttcagtctgagggattggtcaactcaaacatgtggacagagaaactgctagaggatatgatgttgctttttgattgcctttctgtgtgttactctgaatctccagtgtgggttaaactttcccagattcagatccagcttctgctgggattcatcggacgcggaaacctgcaggtctgcgccatggcatccgctaaactgaatacactactgcagaccaaggtgattgagaatcaagatgaggcgtgctacatcttgggaaagctggagcacgtgctgtctcaatcaatcaaagaacaaactgaaatatattcttttctaatccctttggtaagaacactggtctcaaaaatatacgagctgctatttatgaatctgcacctgccgtccctaccatttaccaacggaagttcttctttctttgaggatttccaggaatactgcaactctaatgaatggcaggtatacattgagaagtatattgtgccgtatatgaaacaatacgaggcccacacattctacgatggtcacgaaaatatggcgttgtattggaaggactgctacgaggccctgatggtgaacatgcataaacgcgacagagaggggggtgagagtaaactgaaattccaggaactctttgtggaacccttcaatcgcaaagcaagacaagagaatcttcgctacaataatatgcttaaacaactgtccagccagcaactagcgaccctgcgaaggtggaaggcaatccaactgtatctgacctgcgaacggggaccttgggccaagagaaagcagaacccaattcactggaagctcgcaaatgtggagaactactcacgtatgcggctgaaacttgtccccaattataactttaagactcatgaggaggcgtccgcactaagagacaatctagggatccagcactcccagccatcaagcgacaccctattactggaggttgtgaagcaggttaaggtatccgacatggtggaggataagctggatctgcccgaggaggacattaccgcgagggtcaacgtggacgagaaagaagaacaggaccagaaggaaaagttggtactgatggaggattgtgagctgatcaccatcatagacgtcatcccaggcagactggagataactacacaacacatatatttttatgacggttctatcgagaaggaggatggagtgggtttcgacttcaagtggccccacagccagattagagagatccatttgcgaaggtacaatcttcggcggagtgccctcgaaatcttccacgttgatcagagtaattactttctgaatttcaagaaggaagtaagaaacaagatatatagtcggttgctgagcctacacagtccgaacagctactacggaagccgctctccacaggagctctttaaggcctcaggactgacacagaagtgggtgaatcgtgagatttccaactttgattacctgatccaaattaatacaatggccgggagaacgtataatgacttagctcagtaccctgttttcccctggattctgcaggactatacctccgaggagcttgatcttaataaccctgccgtctttagggacctgtccaaacccataggtgtggtcaacgagaaaaatgcaaaggccatgagagaaaagtacgagaatttcgaggacccgatggggacgatagacaagtttcactacgggacccattacagtaactctgccggcgtcatgcactatttgatccgggtggagcccttcactacattgcatattcagttgcagagtgggcggttcgactgcgccgatcgacaattccatagtatccccgccacttggcaggccctaatggacaacccctatgacgtgaaggagctgatccccgagttcttttacttcccagagtttctagagaatcagaatcaattcaatcttggtagactgcagattagtaaggagctggtaaatgacgtgatcctccccaagtgggcaaaaagcgccgaagacttcatttacaagcatcgcaaagcccttgagtcagaatacgtctcagcgcatctgcatgagtggatcgacctgattttcggttacaagcagcgaggtccagccgctgtggaagccctgaacgttttctactactgttcatacgagggcgccgtggacctagacgccctcacggatgagaaggaaagaaaggccctggagggaatgataaacaacttcggccagaccccttgccagctcctcaagatcaccatatccatgaattacgtcatcggaacgcatgggtggctgccatatgatcggaacatctctaactacttcacctttatcaaggaccagacagtgacaaacccaaagacgcaaaggtcaatcaatgggagttttgctcccggcctggagattacctctaagttgttcgtcgtgagccacgacgctaagttactgttctctgccgggtactgggacaattccattcaggtgatgtccctgaccaagggaaagatcatctcccatatcataagacacatggatatcgtgacttgcctagctacagattactgtgggattcatctaatcagcgggtctagagacaccacatgtatgatctggcaaattacacaacaggggggagttcccgtcgggctcgcttccaagcctttccagatcctgtacgggcacaccaatgaggtgctctccgtagggatttctaccgagctggatatggctgtctcaggctctcgggatggcactgtaatcatccacaccatcccaaacctcgccatttcatgggagggacatatagtggtctattcatctaccgaggagaagaccacgctgaaggataaaaacgccttgcacctgttctcgattaatggcaaatacctgggttctcagattttaaaggagcaggtctcagatatttgtatcatcggagaacatattgtgaccgggagcatacaggggttcttatctatccgtgatctgcattcacttaatttgtccatcaacccactagctatgaggctgcccatccactgtgtctgcgtcacaaaggagtattcccacatcctcgtcggcttggaagatgggaaattaatcgtggtgggggtgggcaagccggccgagatgcgaagcggccagctctcgcgaaaattttggggcagctctaaacgcctctcgcagatatccgcaggggagaccgagtacaacacccaagattcaaaatag

SEQ ID NO: 196924 - DNA, 8085 bp, Artificial Sequence
  Description of Artificial Sequence: Synthetic coding sequence
atggccagccgggagcggctgttcgagctgtggatgctgtactgcacaaagaaggaccccgattatttgaagctgtggcttgacactttcgtgtccagctacgagcagttcctggacgtggatttcgaaaaactgcctacaagagtggacgacatgcctcccggtatcagcttgttgccggataacattctgcaggtattaaggattcagctgctccagtgtgtccagaagatggcagatgggctggaagagcagcagcaggctctatccattctactggtaaaattttttattatcctctgtcggaatttgtccaatgtggaggagattgggacctgttcttacattaactatgtgatcacaatgaccacattatatatccagcagttaaaatcaaagaagaaggaaaaagaaatggcagaccagacttgcattgaggaattcgttatacatgcgcttgcgttttgtgaaagcctgtatgatccctacaggaactggcgccaccgaataagcgggcgcattctgagtacagtagaaaagagcagacagaagtataaaccagcttcacttacggttgagttcgttccgttcttttatcagtgttttcaggagtccgagcacctgaaggaatctcttaagtgctgtctgcttcacttgttcggagcaatcgtagcaggcggccagaggaatgctcttcaagccattagtcccgccacaatggaagttctcatgagggtcctggcggactgtgattcatgggaggatggtgatccggaggaggtgggtcgtaaggctgagctgacacttaagtgccttaccgaggtggttcacatactcttatcttccaattccgatcaacgacaggtggaaacgagcacaatcctagagaactacttcaagctccttaacagcgaccattctgccctccccaatcagcgaaggtcccggcagtgggaaaaccggttcatagcgttgcagattaagatgctgaatactatcaccgccatgttggattgcaccgacaggcccgtcctgcaggccatcttcctgaattcaaactgcttcgagcacctgatcagactgttacagaattgcaaggtgttccaggggcagctcgactgcctagcaatttccaccatccaggctctgacagcagtgatgaacaagtcaccggcggccaaagaagtgttcaaggaaaggatcggctacacgcacatgctggaagttctgaagagtctaggccagcctcctctcgagttactgaaggaactcatgaacatggcagtggaaggcgatcatacaagcgtcgggattctcgggatttcgaacgtacaaccgctgctgctgctgatacagtggctccctgagctccaatcccatgatctccagatcttcatctccgattggctgaagaggatctgttgtatcaaccgccagtccaggaccacatgcgtgaacgcaaatatgggtataaggattatcgagacattggatctgcacagtagcctccatcagacatgtgccgaaaatcttattgccattcacggctctttgggctcccaaagcgttagctccgaagagatccgacgcctcttaagactcctcagggtcgacgagtcagaatcagttcacccatatgtgaccccggtgactcgggcgatcctgactatggcccgcaagctcagcctagagtctgcactccagtactttaatctgagccactccatggcgggcatttccgtccccccaatccagaagtggcctggctccgccttctctttcagcgcatggttttgcctcgatcaggatcagctcaccttaggcatagctaacaagggtggtaagcgcaaacagctgtactccttctttacaggatcaggcatgggctttgaggccttcattactcattcaggaatgctggtcgtggccgtgtgtacaaagagggaatatgccacagtgatgctacctgatcatagcttctgtgactctctttggcataacatcacagtcgtgcacatgcccggcaagcgcccattcggtcaaagctttgtttatatttacgacaatggtcagcagaaagtctccgctcctctgcgctttcccgccatgaatgagccttttacttcctgctgtattggatcagcgggccagcggacaaccacacctcccccatcacagatcccagacccgccgttctcttctcctatcaccccacatcggacgagcttcggggggattctgtctagtgcgtcttggggagggacaatagaaaagtccaagttgattaccaaactcatctcggccggaactcaggattccgagtggggctgcccaacctcgctcgaaggacagctgggatcggtgattattttttatgagcctctgcagcctccccaggtgaaggctctctatttggccggacccaattgccttagcccctggaaatgccaggaatccgatatggcagacctgcctggcaacatccttctgtactacacagccaaagcctgtaagaactctatctgtctggatctgtcgactaactgcttgcacggccggctcacaggaaacaaggtcgtgaactgggatataaaagacatcatcaattgcatcggaggcctgaacgtcctgtttccactgcttgagcaaatatcccacttctctgagggccagattccagaggagaagaatgagagcactgttccggagtccgtgactcccgttgagggcgattggctggtatggacatcaacgaaggccagcgagtcaaggctcgaacggaacttggtcgccacatttattttgatcgtaaaacactttattcaacgccatcccataaatcagggcaacctaatccattctcatggggtggcaactttgggggcgctgcttcagaaagtgccatccacactgatggatgtgaacgtgctaatggccgtgcaattattgatcgaacaggtgtcccttgaaaagaacatgcagctgttacagcagatgtaccagtatctgcttttcgatttccgcatttggaaccgcggcgatttcccattcagaataggccatatccagtacctctccacgatcatcaaagactcaaggcgggtgttccgcaaaaagtacggcgtacagttcttgctggataccctcaggatctactatggaaatggatgtaagtataacgagctcagtttggacgacatacgtacgatccgaacgtcgttgtacggactcattaagtacttcttatgtaaaggtggttcccacgaagagattcagagcattatgggatacattgctgccaccaatgaggaggagcaacttttcgggatcctggatgtcctgttctccctcctacgtacttcaccaacgagaggccagcttttcctgctgctttttgagccaggcaatgcagacattctctacgcattattgttaaaccagaaatactccgacagattgcgcgagatcatcttcaagatcatggaacaaatgttaaagtgtacgaacgtgtacgagcgcagtaaacaacacatccgcctaagggaggtaggctattctggcctgggccttctgttaaatgaggctctcgtaaatacgtctctgattaagaatttgacccaccagattattaataccgaccccgtgattaattttaaggacctgttaagtgtcgtttacatatctcaccgggcccacatcaacgtccgtgtggccatttgcagaaaggtgctacagatcctgcagtttcagcctgacgccgctcatcagatctcccagcaggtcggctggcaggatacactggtgaggctgttccttaaagcaaagttcgaaaacggaaacacactccacaaacattccagggccgtcttgatgaaagacaatgacaagaacatgagcacggaggatacaaagaagaactctgatgagaaaaccgacgaagaaaaaatcacctcatttgcctcagcaaatgtttcttctgaccaatggtccctggaggaccgtcacagtctggactccaatactcccttgttccctgaggatagcagcgtcggcgaactgtcatttaagagtgagaatcaagaggaattttggcattctaatccatcacaccttagtctagacctgagcggtattgatagttgtgaaatgtcagactcaggatctcaagtgcctgacagcctgccaagtaccccaagccctgttgagagtacaaaaagcttctccgtgcattctgatcgggagtccagcattactaatgacatgggattttctgatgacttctctctgcttgagtcgcaggaacgctgcgaagaagagcttctacagttgttgacccatatcttgaactacgtaatgtgcaagggtcttgagaagtccgacgatgatacatggattgagcgcgggcaggtgtttagtgcactctctaaacccggaatctctagcgagctgttacgcccgagcgacgaaattaagcttaccttgctgcagaagatgttggagtgggcgatttcagaaaacagggaggctaagacaaacccggtaaccgcggaaaacgcctttcgtctagtcctgattattcaggatttcctgcagagtgaggggttagtgaactccaatatgtggacggaaaaactgctcgaagacatgatgcttctatttgattgtttaagcgtttgctattcagaaagtcctgtgtgggtgaaactgtctcagattcagattcagctgctcctggggttcatcggccgcggaaatttacaggtttgcgcaatggcatccgccaagctgaatacgcttctgcagaccaaggtcatagagaaccaggacgaggcttgttacatcctgggtaagctggaacatgtattatcacaaagtatcaaggaacagaccgaaatctattcgttcttgatacctctagtacggaccctagtcagtaaaatatacgaactgctatttatgaatctccacctcccgtccctgccgtttactaatggctcatcatctttctttgaggacttccaagagtactgcaattcaaatgaatggcaagtgtatattgaaaagtacattgtgccttacatgaagcaatacgaagctcacaccttctatgacggccacgagaatatggcgctttactggaaggactgctatgaagccctcatggtgaacatgcataagcgcgacagggaggggggcgaatctaaattgaagtttcaggagttgtttgtggagcccttcaaccgcaaggcgcgtcaggagaacctgagatataacaacatgcttaagcagttgtcatcccaacagctggctaccttgcgaaggtggaaagcaatccagctgtacctgacatgcgagcgtgggccatgggctaaacgcaagcaaaatccaatccattggaagctcgcgaatgtggaaaactatagccgcatgcggctaaagttggtgcctaattacaactttaagactcatgaagaggccagtgcactccgggacaatctgggcattcaacacagtcaaccatcctctgacaccttacttctggaagtggtgaaacaagtgaaggtatctgacatggtggaggataaactcgatctacccgaagaagatatcacagcccgggtcaacgtagacgaaaaggaagaacaggatcagaaggagaagttggtgctgatggaggactgtgaactgattactattattgatgtcatcccaggtcggctggagattacaacgcagcatatttatttctacgacggaagcatcgaaaaggaggacggtgtgggttttgactttaagtggccacactcgcagatcagagagatccacctgcgccgctataacttgcggaggagtgctctcgaaatatttcacgtggaccagtcgaattattttttgaattttaagaaggaagtccgcaacaaaatctactctcggctcctgtccctacattcccccaattcctactatggctccaggtccccccaggagttatttaaggcctctggcctgacccaaaagtgggttaatcgtgagatttccaatttcgattaccttattcagatcaacaccatggccggcaggacgtataatgatttggcccagtatcccgtttttccttggattctccaagattatacgagcgaggagttggatcttaataaccccgccgtgttccgtgatctttctaaacccatcggcgtggttaacgagaagaatgccaaagctatgagagagaagtacgagaacttcgaggatcctatgggcaccatagataaattccattacgggacccattactcgaattcagctggcgtgatgcactatcttattagggtcgaacccttcaccacactgcacatccagctgcagagtggtcgtttcgattgcgccgatcggcagtttcactctattcctgccacatggcaagccctgatggataatccttacgacgttaaagagctgatccctgagttcttctatttccctgagtttttggaaaaccagaatcagtttaacctcgggcgtttacagatctctaaggaactggtgaacgacgtgatactgcctaagtgggccaagagcgcagaggactttatctacaagcatcgaaaagcacttgagtccgagtacgtttccgctcacctgcatgagtggattgacttgatcttcggctataaacaacgggggccagcagcagttgaagcactcaacgtgttctactattgctcgtatgagggtgcagtggatctggacgcattgactgatgagaaggagaggaaggccctcgaaggcatgattaataactttgggcaaacgccatgccagctgctcaaggagcctcaccccccgcggctcagcgcggaggaagctgtgcaaaagcctaccaaaattgacacgtctactctgaacctctttcagcacttgcctgagctgaaatcgttctttattgaaggtatatcagacggaattcccctcctgaaagcaactattcccaagaatcagtataggagtttcatgagccagggttcgcctgagctgctcatcactatttccatgaactatgtcataggtacccacggatggctgccttacgaccggaatatatccaattactttacttttatcaaggaccagaccgtgaccaatccaaaaacccaaaggtctatcaatggctcctttgcccctggactcgagataacatccaagcttttcgtcgtgtcccacgatgcaaagctcctcttctccgcaggttactgggacaatagcattcaggtcatgagtctgaccaaaggcaagataatctcccatattatccggcatatggatatcgtgacctgcttggcaactgactactgcgggatacatctgatttctgggtctagagacactacctgtatgatatggcagatcacccaacagggaggagtccctgtcgggcttgccagtaaacccttccaaattctttacggacatactaacgaggtgctgtcagtaggcatatccacagagctggatatggcagtgtctgggagtagagacggtacggtgattatccatacgattcagaagggacagtacatgcggacactgcgccctccctgtgaatcatccctgttcctgacaatccctaatctggccatcagctgggaaggacacattgtggtctactcctcgaccgaagagaaaactaccctcaaggataagaatgcgcttcatctgttcagcatcaatggaaagtatctggggagccagattctaaaggaacaggtgtcagacatttgcatcattggtgagcacatcgtcaccgggagcattcaaggctttctgagcatccgcgatctgcactcactcaacttgtctattaaccccctcgctatgaggcttcctatccattgcgtttgtgtgactaaggagtatagtcatatcctggtgggcctggaagacggcaaattaatcgtggtgggagttgggaaaccggctgagatgaggagcggccagctgtccaggaagttttggggaagttctaagcgcttgagccagatctccgccggagaaacggagtataacactcaggacagcaagtag

SEQ ID NO: 196925 - DNA, 7713 bp, Artificial Sequence
  Description of Artificial Sequence: Synthetic coding sequence
atggccgccagcgagcggctgtacgagctgtggctgctgtactacgctcagaaggaccttggatatctgcagcagtggctgaaggccttcgtgggcgcattcaagaaaagtatctccctcagctccttggaaccaagaagaccagaggaggccggggctgaagtgccactgcttccccttgatgaactgcatgtgctagccgaacaactgcatcaggcagatttggagcaggcattgctgctcctcaagctctttatcatactttgtaggaaccttgaaaacatcgaggccggcagggggcaggtcctggttccacgggttctggcccttctgactaaacttgtggcagaacttaagggatgtcccccaccccaggggagaggaacccagctcgagaatgtggccttacacgcactgttgctttgcgagggtctgttcgacccttatcaaacttggcgccgccaacgctctggggaggtgattagcagcaaggaaaaatctaaatacaagttccctcccgcagccttgcctcaagaattctctgccttcttccaagagtccttgcagaacgcagatcatctgccccccatcctgttactcagactgatacatctgttctgcgctgtactggctggggggaaagaaaacggtcagatggctgtgagtgatggttcagtgaagggcctcctttccgtcgtgagaggttggtcaagaggccccgcccctgacccatgcctggtgccccttgctcttgaagctctggtgggcgctgtgcacgtcctgcacgcttccagggccccacctcggggccccgaactgagggctcttctggaaagctattttcatgtactcaacgcagactggccggcggggctcagttcggggcctgaggaggccctggtaactcttcgtgtgtccatgcttgatgctatccctatgatgctggcttgtgaggatagacccgtgctccaggctacttttctcagcaataattgtttcgaacacctcacccgcttaatccagaattcgaagctgtacctgcagtcccgggccccacctgagggtgactccgacctggccacaaggttgcttacagagcctgatgtgcagaaggtgttagaccaggatacggacgcaattgccgttcacgttgtgagggtccttacctgcattatgtccgacagcccatccgccaaagaggtattcaaagaacgcatcggctacccacatctccaggaagtcctgcaatctcacggccccccaacccacaggctgctgcaggagctcttaaacatggctgtggagggtgaccatagtatgtgtcctcctcctcctatcagaaacgaacagccggtcctggtgctcgctcaatggcttccctccctgcctacagccgaacttagactgtttctcgcgcagcggttacgatggctgtgtgatagttgccctgccagccgggccacctgcgttcaagctggtctggtgggatgcctgttagagaccctcagcacaggtctggcccttgaggcgcggtgccaggaacaattgctggccctccttcaggcccttggcagggtgtcaattagaccgatggagcttcggcatctcctacgccctcgccctggcctggacagtgaacctggaggggcagaggctgggaaggcacgacatgcgggagccgttatcaggactttgtctgggatggctaggcatcagggccccgccagagcgctcaggtatttcgacctcaccccttctatggccggcataatggtgccgccagtgcagagatggcccggtcctggctttaccttccacgcctggctttgtctgcatcctatggatacagcacctacgccagccccgacaagacctctccagaggaagcaactgtatagcttcttcaccagttccggaagcgggttcgaggcctttttcacagcagccgggacactggtcgttgcggtctgtacccggaaggaatatttgacaatgtctctgccagaagtgagcttcgccgatagtgcttggcattgtgtcgctatcgtgcatgttccaggacggcgtccattttctcagaacctagtccatgtgtacaaagacggccacttggtcaaaaccgccccattgcgatgcccctctctgtcagaaccatttagcagttgttgcatcggtagcgcaggctatcgaacgacaactaccacgacagggcttcccaccccgcccgtgcctgctacactagcgtacacccaccccgccctcacaaggtcacagtccgtaccagcctctactggtctaggttggggatcaggtctggttgctccattgcaggaggggtccatagattcaacactggccggaacccaggatacgcggtggggatctcccaccagtctggagggggagcttggggctgtggcaattttccacgaagctctgcaggcaactgctctgagaaccctctgtaccctcggcccaaatgagactgcacccttcaagcctgagggcgaattacatgaactgagcactcgtcttttgctccactattctccacaggcgtgtaaaaataacatctgccttgatctgtccccaagccatggattggacggcagactgaccggccaccgagttgagacctgggacgtgaaagatgtggttaattgcgtgggaggcatgggcgccttattaccacttttagaaagagtggccgctcaacccaaagaagcggaggcaggtccagcagagactcacgatctcgttggcccagaactgacgagtggccacaacactcaaggcctagtgctacctttggggaaaagctccgaggagcggatggaaagaaatgctgtggccgcgttcctgctgatgctgcgaaactttctccagggccatatggtgaatcaggagagcctagtgcaatgtcaggggcctgccattatcggcgcactgcttaggaaggtcccatcctgggctatggatatgaacgtgcttatgtccgctcagctcctgatggagcaggtcgccgcagagggaagcggtcccctgctctatttactgtaccaacacttattattcaatttccacttgtggaccctttctgactttgcagtgcggttgggacatatacagtacatgagctctattgtgagggagcataggcaaaagctaaggaagaagtatggggtccaattcatcctcgacgcactgcgaacgcattactctccccagcgcgaaagacccttagccgctgacgatcttcgcacagtgcaaactagcttacttggtctcgccagggaattcctcgtgcgcagcctgagcgccgacgatgtgcaggtgactcaaaccatgctttcatttttggcagccacaggggacgacggccagatcttgcgtcgtctccaacagaatgaacgactacctgagcgcagccgacagcggttgagactgagagagtgcgggctccaggggctcgtcgcttgcctacctgaggggacagtgtccccccagttgtgccaaggcttatacaaactgtttctaggggctgggtctggaaataccgcaggtggaggcggcagctctgggacactgacccctgcaagtcagcccggaactccgtcccccctggacggccctcggcccttccccgccgctcccgggaggcacagttccagtctgagcaacgttttagaagacggtagcctgcctgaacccacaatctcaggtgacgacaccagcaatacaagcaacccccagcagacttccgaggaagagctgtgcaaccttttaaccaacgtcctattcagcgtcacatggagaggtgttgaaggaagcgacgaggcagcatggagggagcgcggacaggtgtttagcgtgctaactcagctcggagcgtctgcaaccctggtccgaccgcctgactgtatcaagaggtctttgcttgaaatgatgctggaatccgcattgactgacattaaggaggcccctgttggggtgctggcatccctgactcagcaagccctatggctcctgcgtttgctgcaggatttcctttgtgctgaggggcacggcaaccaggaactctggagtgaaaagctatttgagggcgtgtgctccttgctggataggctcggggcgtggccgcacctggccaacggcactgctgaccttcgggaaatggcacagatcggattgaggctggttctgggatatattctgttggaagacccacaattgcacgctcaggcatatgtgcggctccacatgctactgcagacagccgtgcctgctcgtagggaagaggcatgctatgtgctctcaaaactggaggccgccttgggcagagtgctcaacacaagttcacttgaatcagccactgacgaagcaggtagccccttggccgcggcagccgccgccgccgcagcagagagatgtagctggctggtgcccttagtgagaacgctcctggatagggcatatgagcccctgggtcttcagtggggactgccttccctcccaccaaccaacggaagccctaccttttttgaagatttccaggctttctgtgcgactcccgagtggcgtcatttcatcgataagcaggttcaaccaacaatgtcacagtttgagatggatacttacgcaaagtcccatgacctcatgtcagggttctggaacgcatgttacgatatgctgatgtcttccgggcagcgcaggcaatgggaaagggcacagagcagacgggccttccaggaactcgttctggaacccgcacagcgccgtgctcggctggaaggtctgcggtacacagcggtcctaaaacagcaggcgacacagcattctatggcattgttgcactggggcgccctgtggaggcagttggcctctccgtgcggggcatgggcactcagggacaccccaattccgaggtggaaactgtcttcagcagagacctactctcggatgcgactgaaactggtgcccaaccaccattttgacccacatctcgaggccagcgctcttagggacaacctgggcgaagtgccactaacccctactgaagaggcttcactccccctcgcagttaccaaagaggctaaagtgtcaaccccgccagaactcttgcaggaggaccaactgggcgaggacgagctggccgagctggagactcctatggaggcagctgaattagacgagcagcgggagaagctggtactctcagcagagtgccaattggtaaccgtggttgctgttgtccctggcttactggaagtgacaacgcagaacgtctatttttatgatggctctaccgaacgtgtggagaccgaggagggtatcgggtacgacttccggcgccccctcgcccaacttcgcgaggttcacctccgccggttcaacctacgtcgctccgccctagagctattctttatcgatcaagcgaactacttcctgaacttcccatgcaaggtggggactacccctgtctcttcaccctcgcagaccccaaggcctcaaccaggccctatcccacctcacacccaggtgcgaaatcaggtctacagctggcttctaagactgagaccccccagccagggctacctgtcttctcgtagcccccaggaaatgctgcgcgcctccgggctcacccagaaatgggtgcaacgggaaattagcaatttcgagtatctgatgcagctcaatacgatagccggcaggacatacaacgacctctcacagtatccagtcttcccttgggtacttcaggattatgtgtcaccaactttagatttgtctaatcccgcagtgttcagggatctttccaaacccataggcgtggtcaacccgaagcatgctcagctggtccgcgagaagtacgagtcttttgaggacccagcaggaactatagacaaatttcactacggtacccactatagcaacgctgctggagtcatgcactacttgatcagggtcgaaccttttacttctctgcacgttcagctgcaatccgggcgctttgactgctccgacagacaattccactctgtggcagccgcatggcaggcccgcctggaatcacctgccgatgtgaaagaactcattcccgagtttttctatttccctgactttctagagaatcagaacgggttcgatttgggttgtctccagctgaccaatgaaaaggtcggcgatgtggtgcttcccccatgggcatcttccccagaagacttcattcagcagcaccgccaggccctcgagtctgagtacgtgtcggcacatctgcacgagtggatcgatctgatcttcggatacaagcagcgcggacctgccgccgaggaagcattgaatgttttctactattgcacctacgagggtgcagtggacctggaccacgttacagacgagcgtgaacggaaggctctggagggcatcatatcgaactttggacagactccttgtcagctgctcaaagagccacaccctactagactaagcgctgaagaggccgctcacagactcgccaggctcgatacgaatagcccgagcatctttcagcacctggacgaactgaaggctttcttcgccgaagtggtctctgatggtgtcccacttgtgttggccctagtgcctcaccggcagccacacagctttattactcaaggaagtcccgatcttctagtcacagtgagcgcttcaggcctgcttggaacccactcctggttgccttatgatcgtaatatttccaattacttcagctttagcaaagaccccactatgggttcacacaaaacgcaacgcctcctcagcggtccgtgggtcccgggctcgggggtgtctgggcaagcgttggctgtcgcgccagacggaaaattgctcttctccggtggccattgggacggaagtcttcgcgttactgctctgccccgaggcaaactgctgagccagttgtcatgccatctggacgtggtgacttgcctggctctggatacgtgtggaatttacctaatcagcggcagtcgcgacacaacgtgcatggtctggaggctactccaccagggagggttgtccgtcggcctcgctcccaaacccgttcaagtactgtacgggcatggcgccgccgtcagttgtgtagccatttctaccgagctggacatggctgtgtctggctctgaggatgggacagtgattatccacacagtccggcgcggccagttcgtcgcagcgttacgacctctgggagccacattccccggccctatattccatctggccctaggttcagaagggcaaatagtggtgcagtcatccgcctgggagagacctggagcacaggttacatactctctgcatctctacagtgtcaatgggaagctgcgggcatcacttccattggccgagcaacctaccgctctgactgttaccgaggacttcgtactgcttgggactgcacagtgcgctctgcacatcctgcagctgaatacgttacttcccgccgccccaccactgccaatgaaagtggcgattagatcggtcgctgtgacaaaggagcggtcccatgtgctggtgggattggaagacggtaaactgatcgtggtggttgctggtcagccctccgaggtgagatcctctcaattcgccagaaagctttggcgttcgtcaaggaggatcagccaggtgagctccggtgagactgagtataaccccactgaggcccggtag

SEQ ID NO: 196926 - DNA, 1848 bp, Artificial Sequence
  Description of Artificial Sequence: Synthetic coding sequence
atggagcccgccctgggccccggcgtgcagaaggacctgggctacctccagcagtggttaaaggcttttgtgggggcctttaaaaaatcaatctctctctcctctctagagccgcgcaggccagaagaagccggcgcagaagtgcccttgttgcccctagatgaactccacgtgctggcagaacagttgcaccaggccgacttagaacaagccctattgctgctcaaactttttatcattctttgcagaaatttggaaaacatagaagcagggagaggccaggtgctggtgccacgggtcctggccctgcttactaaacttgttgccgagttgaaagggtgcccgccgccacaaggtcgaggcacccagctcgaaaatgtggctcttcacgctctgcttttgtgtgaaggattatttgatccgtaccagacctggcggaggcagaggtccggggaggtcatcagctcaaaggagaaatccaagtacaagtttccaccagctgctcttcctcaggaattttccgccttctttcaggagtccctgcagaacgctgaccatttgccaccaatcctgctcctgagattgattcacctgttttgtgccgtcctagctgggggtaaggaaaatggtcagatggccgttagtgacgggtccgtcaaaggcctgctgagcgtggtgagagggtggtcacgagggccagcgcccgacccgtgcttggtccccctcgccttggaagctcttgtgggcgccgtccatgtgctgcacgcatctcgcgctcctcctcgaggccctgaactacgcgcgctccttgagagctacttccatgttttgaatgccgattggccagcaggcctctctagcgggcccgaagaggcccttgtgaccctgcgtgtcagcatgcttgacgcaattcctatgatgctcgcctgtgaggaccgccccgtgctgcaggccacctttttatccaacaactgtttcgaacacctgacaagattgattcaaaactcaaaggtactcgaccaggacacagacgcaatcgccgttcatgtggtgagagtattgacgtgtatcatgtccgattctccttctgctaaagaggtgttcaaagagcgcattggttatccccacttgcaggaggtgttgcagtcccacggacctcccacccacagactgttacaggaacttctgaacatggctgtggagggtgaccatagtatgtgtcctccgccacccattcgcaacgagcagcccgtactcgtcttggcccagtggctgcctagcttgccaaccgccgagctgcgcctgttcttagcgcagcgcctccgctggctttgcgattcttgcccagcctccagggctacctgcgtgcaggcaggacttgtgggctgtctgctggagacactgagtacaggactggcactggaggcacgctgtcaggagcagctgctggccctgctccaggctctgggcagggtgtctatcaggcccatggagcttcggcatctgctgagacccagacccggcctggactccgagcccgggggggccgaggctggcaaagcgagacacgcaggcgcagtcatccgaactctttccgggatggctcgccaccaagggccggcaagggcactgaggtatttcgatctgactcccagcatggctggaattatggtccccccagtgcagagatggcctggacctggcttcactttccacgcctggctgtgtttacatcccatggacaccgcccccacacctgctcccccaaccctgccctcaagtgggatcgggggacggtgctaccctctcagggactggagagccgaggtgccccctttagccggttag

SEQ ID NO: 196927 - DNA, 3012 bp, Artificial Sequence
  Description of Artificial Sequence: Synthetic coding sequence
atgagccagttcgagatggacacctacgccaagagccacgacctgatgtccggtttctggaacgcttgttatgacatgctgatgtctagtggccagcggcggcaatgggagcgggcgcagtcccgccgggcttttcaggagttggtcctcgaaccagcacaaagaagggcccggctggaaggcctccgctacaccgcagtgttgaagcagcaggccacccaacacagcatggccttactccattggggtgctctttggagacagctggcaagtccttgtggcgcttgggctctacgggatacccccatccccagatggaaactctcaagtgccgagacatacagcagaatgcgactgaagctcgttccaaaccatcacttcgacccacaccttgaagcctccgccctgcgcgacaacttaggtgaggtgcccttgaccccaactgaggaggccagtcttcctctggccgtgaccaaggaggccaaggtctctacgcccccagagctacttcaagaggaccagctgggcgaggatgagctggccgagcttgaaaccccgatggaggcagcggaactggacgaacaacgcgaaaagttggtgttgagcgcagagtgccaactggtcacggttgtggccgtggtccctgggctcttagaagtgacaacccaaaatgtttatttttacgatggctctaccgaacgtgtggagactgaggaggggattggatacgatttccgccggccacttgctcagctgcgggaggttcacttacgaaggtttaacctcagaaggtctgccttggagcttttttttatcgatcaggccaactacttccttaatttcccttgtaaagttggcaccaccccagtgagcagccccagccagactcccaggcctcagccggggcccattcccccccacacacaggtcagaaaccaggtctacagctggctgcttcgattaaggccgccctcacaagggtatctgtccagtaggagccctcaagagatgcttagggcttccgggttaactcagaagtgggtgcaacgggagatcagcaactttgagtatctcatgcagttaaataccatagctggcaggacttacaatgacttaagtcagtaccctgtatttccctgggtcttgcaggattacgttagcccgacattggacctgagtaacccggcagtgtttcgcgacctttctaagccgatcggagtcgtgaacccgaaacatgcacaactcgtaagagagaagtacgagtcgttcgaggaccctgcaggaactatcgataaatttcattacgggacacattattccaacgcggcaggcgtgatgcattatctaatacgggtggaaccttttacttctctgcatgtgcagcttcagagcgggcgctttgactgtagcgaccgacagtttcacagcgtggctgccgcatggcaggcgaggctggagtctcctgccgacgtcaaggaattgatacctgagtttttctacttccctgactttctagagaaccagaatggctttgacctggggtgccttcagttgaccaacgagaaagtcggtgacgtggtgctccctccatgggcttcatcccccgaagattttattcagcaacatcggcaggccctcgagagtgaatacgtttcggctcatctgcacgagtggatcgacttgatcttcggctacaaacaacgagggcccgccgctgaggaggccttaaatgtcttctattattgcacctatgagggagctgtggatctggatcacgtaactgacgaaagagaacgtaaagcactggaggggattatcagcaattttgggcagaccccgtgtcagctgctcaaggagccacaccccacgcggctcagtgctgaggaggcagcccatcgtctggctcgcctggacaccaacagccctagcatcttccaacatctggacgagttgaaggcatttttcgccgaagttaccgtgtccgcctctggactcctcggaacccacagctggcttccatatgatcgcaatatctcgaactacttctcctttagcaaggatccaactatgggtagccacaaaacacaacgtttattatccgggccctgggtgccaggatcaggggtttctgggcaggctctcgcagtcgcaccggacggtaagctgctctttagtggcggccactgggacggttcacttagagttaccgccttgcctcgaggcaagctattaagccaactttcttgtcacctcgatgtggtgacctgcttggccctcgacacatgcggaatctacctcatctccgggtcaagggatactacatgcatggtttggcgcttgcttcatcagggcgggctgtccgtgggcctggctcctaaaccagtgcaggtgctatatggccatggcgcggctgtttcctgtgtggcgatctccactgagcttgatatggcggtgtccggaagtgaagatggcacggtgatcatacataccgtgagacgcggacagtttgttgcagctcttcgccccctgggcgccacctttcccgggccaatatttcacctggctcttggctccgaagggcagatcgtggttcagtcatctgcttgggagagacccggtgcccaggtgacctacagcctgcatctgtatagcgttaatggaaaactgcgggctagcctccctcttgccgaacagccaaccgctctcaccgtgactgaggacttcgtcctcctgggtactgctcagtgcgccttacacatacttcagctaaatacactacttcctgcagccccgcccctgcctatgaaagtcgctattaggagcgttgcagtcactaaggaaaggagccacgtcctagtcggactcgaggacgggaagttaattgtggttgtggcagggcagccatctgaggtgcgctcttcacagttcgctcgcaaactctggcgttccagtcggcggatcagtcaagtatcctctggggagaccgaatataatccgaccgaggctaggtag

SEQ ID NO: 196928 - DNA, 2094 bp, Artificial Sequence
  Description of Artificial Sequence: Synthetic coding sequence
atgctgcgggccagcggcctgacccagaagtgggtgcagcgggagatctcgaacttcgagtacttgatgcagttgaataccattgctggacggacttacaatgacctgtcacagtatcctgtcttcccttgggtgctccaggactatgtttctcccaccctggatctgagcaacccggctgtctttcgggacctgagcaaaccaattggtgtcgtgaatcccaagcatgcccagttggtgcgcgagaagtacgaatcttttgaagatcccgcaggcacaattgataagttccattacggaacccactacagcaatgcagctggggtgatgcattacctcatcagagttgagccgtttacaagtctgcacgtgcagctgcagtctggccgctttgactgctcagatcgccagttccatagcgtggcagctgcctggcaggcccggctggagtctcccgctgacgtgaaggaactcataccagagttcttttacttcccggatttcctggagaatcagaatggctttgatctcggctgtctccagttgaccaatgaaaaggtcggagacgtcgtgttgcccccatgggcctcttccccagaagacttcatccagcaacaccgtcaagcactggaaagcgagtacgtcagcgcacacctccacgagtggatcgatctcatcttcggatataaacagaggggcccagccgccgaagaagccttgaatgtattttattactgtacctacgaaggcgcagtagacctcgatcacgtgaccgatgagcgggaacgtaaggctctggagggaattatctctaattttggtcagacgccgtgtcagctgttgaaggagccacacccaaccagattatccgccgaggaggctgctcacagactggcccgcctcgatactaacagccccagtatctttcaacacttggatgagctcaaagccttttttgcagaggtggtgagtgacggcgtgccactagtgctggctctggtgcctcaccgtcaacctcactcgttcatcacccagggctcgcccgatctgttggtcactgtgtcagctagtggtctcctgggcactcattcttggctgccatatgacaggaacatctcaaactactttagcttttctaaggatcctaccatgggttcgcacaaaactcagagactgctgagtggcccttgggtacctggctccggagtgtccggtcaggcactggcagtggctccggacggcaagctgttgttctctggcggccattgggatggctccctgagagtgaccgcgcttccacgcggcaagttactgtcccagcttagctgccatctagatgtcgttacatgtttggctctggacacctgtgggatttaccttatcagcggctcacgtgataccacttgcatggtctggaggctgctccatcagggcggattatcagttggactagctcctaagcccgtccaggtgctctacgggcacggagcagccgtgtcatgcgtcgccatctcaacggaactggacatggccgtctctggctcggaggatggtacagtgatcattcatacagtgcggcgcggacagtttgtggccgctttgaggccactgggggccacatttcccggtccaattttccatctggcgctggggtcagagggtcaaattgtcgttcagtcttccgcatgggagcgacccggggctcaggtcacctacagcctgcatctttactccgttaacggcaagttacgggcctcgttgcccctggctgaacagcccactgcactgaccgtcaccgaggactttgtgttattaggcaccgcccagtgcgcactgcatatcctacagttaaatactctgctcccggccgctccaccactgcccatgaaggtggccatccgctctgtagctgtgactaaagaacgctcacacgtgctcgtcggactggaagacggaaaactcatcgtggtagtggccgggcaaccaagcgaggtgagatcctctcagtttgcccgcaagctctggaggagctccagacggatatcccaggtgtccagtggcgaaacagaatataacccgaccgaagcacgctag

SEQ ID NO: 196929 - DNA, 8265 bp, Artificial Sequence
  Description of Artificial Sequence: Synthetic coding sequence
atggccgccagcgagcggctgtacgagctgtggctgctgtactacgcacagaaagacttggggtacctccagcaatggctcaaagcctttgtaggagccttcaagaaaagtatttctttatcaagcctcgagccccgacgacctgaggaggctggggcagaggtcccgctgcttcctctagatgaactccacgtcctcgcggaacagctgcaccaagccgacttagagcaggctctgctcttactgaagctcttcattatcctgtgtcgtaatttagaaaatatcgaagcaggaaggggtcaagtcctggtgccacgagtcctcgccctcctgactaaactcgtcgctgagcttaagggctgcccgcccccacagggtagggggacccaattggaaaacgtggctttgcacgcgctcctactgtgtgaaggcctctttgatccataccagacctggcggaggcagcgatcaggggaagttatctctagcaaggaaaagagtaagtacaagttccctccagcggcacttccgcaagagttttcggccttctttcaggaatcactgcaaaacgcagaccacctcccccctatactcctgctgagacttatccatttgttttgtgccgtattggccgggggaaaggagaatgggcagatggctgtatcagatgggagcgtgaaaggactcctgtccgttgtgcggggatggagccgtggccctgcgcccgatccttgcctcgtccctctagccttagaggcactagtgggtgcggtgcatgtcctgcatgcctcccgggcgcctcccaggggaccagaactgagggctcttctcgagtcctacttccacgtgttgaatgccgattggcctgccggcctgtctagtggccctgaagaggcactggtaacactgcgtgtgagcatgctggacgctattccaatgatgctagcatgtgaagatcggcctgttctccaggcaaccttcctctctaacaattgtttcgaacatttgacgcgcctaatccaaaattcaaagctgtatcttcaatctcgagcacctccagaaggggacagtgatctggctacccgcctcctcaccgagcctgatgttcaaaaggttctagatcaagataccgatgctattgccgtgcacgtggttcgcgtgttgacctgcatcatgagcgacagccccagcgccaaagaagtcttcaaagaaagaattggctatccccacttgcaggaggtattacagtcgcatggcccacccacccaccggctgctgcaggagctgcttaatatggcagttgagggggaccacagtatgtgtccacctcctcccatacgaaatgaacagcctgtcttagtacttgcacagtggctgcccagcctgccgacagcagagctccgtctgttcctagcacagcggctccgctggctttgcgactcatgtccagcctctagagcgacttgcgtacaggctgggcttgtagggtgtttgctggagacattgtcaactgggctagctctggaagctcggtgccaggagcagctgctagccctccttcaggcactgggcagagtttctatcagaccgatggaactgcggcacttgttgcggccaagacctggattggatagtgagccaggcggtgctgaagccggaaaggccaggcatgccggagcagtcattcgtacgctgtctggaatggcacgtcatcaggggccggcccgcgctctgcgatacttcgaccttacaccttccatggctgggatcatggtgcctcctgtacagcggtggcccgggccaggattcaccttccatgcctggctgtgtttacacccaatggatactgcgcccacccctgcaccaactagacccctccagcggaagcagctgtacagctttttcacatctagtggatctggttttgaggccttcttcactgcagccggcactctggtggttgccgtctgtacacgcaaggagtacctcacaatgtccctccccgaagtaagcttcgccgattccgcctggcactgtgtggcaattgtccacgtccctggaagaagacccttttcccagaacctcgttcacgtgtacaaagacggccatctggtgaaaaccgcccccctccggtgtccttctctgtccgagcccttcagttcctgctgcataggtagtgctggctatcgtactaccaccacgaccacaggacttcccaccccacccgtgcccgccactcttgcttatacccatcctgccctgacccgctctcagagtgtgccagcatcgaccggactcggttggggtagcggactcgtggctcccctgcaggaaggttctattgatagcaccttagctggaacgcaggacacacgctggggctcccctacctcactggagggggagctcggagcagttgccatcttccacgaggcgctgcaagcaacggcccttcgtaccctgtgcaccttggggccgaacgagaccgcccctttcaagccagaaggcgagctgcatgagctctccacccgtctgctcctacattatagtccacaggcgtgtaagaacaacatttgtttggacttaagcccttctcacggccttgacgggcggttgaccgggcaccgggtggaaacctgggacgtgaaagacgttgtcaattgcgtcggaggaatgggcgccctgcttcccctgctcgagcgagtggcagctcaacctaaagaagccgaggctgggcctgctgaaactcacgacctggttggtcccgaactgacctcaggacataatacccaggggctcgtcctccctttgggcaagtccagcgaagaacgcatggagcgtaatgcggttgccgcttttctgctgatgctcagaaattttctccagggccatatggtgaatcaagagtccctggtacagtgccaggggcctgccattataggcgcgctgctgagaaaggtgcctagttgggctatggatatgaacgtcctgatgagcgcacaattgctgatggaacaggtcgccgcggagggctccggccccctcctgtaccttctttaccagcacctgctgttcaacttccatctctggacactgtcagacttcgccgtgcggctcgggcacatccaatacatgtcatcaatcgtgcgggaacaccgccagaagttgaggaaaaagtatggggtgcagttcattcttgatgctctgagaacacactacagtcctcaaagagagagaccactagcagccgatgatctgcgcacagttcagaccagtcttcttgggctagcccgtgaatttctcgtccggtccctgagtgcagatgatgtgcaggtgacccagaccatgctcagcttccttgccgcgacaggggatgatggccaggcagtgggtgccttagatctgctactcgctctgctccacggtagcctcgtacaggagtccctcgccgtgtttctcttggagccagggaatttggaagtcctcctagcactgctggtgcggccaggttccctccccctgctgcctgatcgggtttgcaagatcctgcgtcggctgcaacagaatgagcgcctccccgagcgcagtcggcagaggttacgcctccgggaatgcggtttgcaggggcttgtcgcttgtctgcccgaaggaactgtcagtccccagttgtgtcaggggctctacaagctttttctcggagccgattgcctgaacctctcggatcttctggccgtcgttcagctttccctgcaggcagatctcagtgtgagattggacatctgcaggcagttatttcacctgatctatggccagcccgacgtggtgcgcttactggcaagacaggctgggtggcaagacgtccttacaaggctgtacgtgttagaagctgccaccgccggcagccccccaccgagttctccagagtctccaacatcacctaagccagctccacccaagcctcccacagagtcgccagctgaacctagcgatgtgttcctaccatcggaggctccatgtcccgatcccgacgggttctatcacgcactgtcgccattttgcacgcccttcgatctgggcctggagcggtccagtgtgggaagcggaaacaccgccgggggcggcgggtcctcaggcactctgactccagctagccagcccggtacaccctcacccctcgatggtcccaggccattccccgcagctcccggccgccactcatcgtctctcagtaacgtgctcgaagatgggtccttgccagagcccaccatctccggcgatgacacaagcaatacgtccaaccctcaacagacatccgaggaggagctgtgtaatcttttgactaatgtgcttttctctgtgacctggagaggggttgagggctccgacgaggcagcctggcgcgaaagaggccaggttttctccgtacttacccaactgggggcctccgccactttagtcagaccaccagattgcatcaagaggtccctgctggaaatgatgctggaaagcgctctcacggacattaaggaggcacccgtcggcgtgctggcctcgctcactcagcaggccctgtggttactccgcctgcttcaggattttctctgcgccgaagggcacggtaaccaggaactttggtctgagaagctgttcgaaggggtgtgtagtctgttggatcggctgggagcctggccccatctggccaacggaacagcagacttgcgggagatggcgcagatcggccttcggctcgtgctggggtatattctcctggaagatcctcagctccacgctcaggcttatgtacgactccacatgttgctccagacagctgtgcctgctagaagagaggaagcttgttatgtgcttagtaagctggaagcggcactcggacgagtgttaaataccagcagcttagagtcagccactgacgaagctgggagccctctcgcggcggcagctgcagccgccgcagcagagcgatgcagttggttagtgccattagttcgtacactgctggatagggcgtacgagcccctcgggctccagtgggggcttccttccctgcctcctacgaacgggagtccgactttcttcgaagactttcaggccttttgtgccacacctgaatggagacacttcattgacaagcaggtccaacccaccatgtcgcagtttgaaatggacacttatgccaagtcgcatgatctcatgtccggcttttggaacgcctgctatgacatgctgatgtcaagcggccagcgacggcaatgggagagggcacagtcccggcgcgcgtttcaggagctggtgctagaaccggcccagagaagagctaggctggagggcctgagatacacggccgtactaaaacagcaggccacccagcactcaatggcccttctccactggggtgccctgtggagacagctggcctctccttgtggcgcttgggccctgcgtgacacccctataccccgctggaagctgtctagcgcagagacttactcccgtatgcgcctcaagttagttccaaaccatcatttcgaccctcaccttgaagcttcggcacttcgcgacaacctgggggaagttcctctgacacctactgaggaggcctcccttccgctggccgtcaccaaggaggctaaagtgagcactccccctgagctgcttcaggaagatcaacttggggaagacgagctcgctgagctggaaaccccaatggaggccgccgagctggacgaacagcgggagaagctggtgctgagtgccgagtgtcagctggtgaccgtggtagctgtggtacccggattgctggaggtgactactcaaaatgtttacttctatgacggctccaccgagcgcgtcgaaaccgaagagggtatcggctatgattttcggcggccactggctcagctcagggaggtccaccttcggcgatttaatctgcggcgaagtgcactcgagctcttttttatcgaccaggccaactacttcctgaatttcccctgcaaggtgggcacaaccccggtgagctctccaagccagaccccacggccgcaaccaggcccaatcccccctcacacacaagtgcgcaatcaagtgtactcttggttgcttcggctcagaccaccctcacaaggatacttatcttccagatcccctcaagagatgctgcgggcctccggacttacacagaaatgggttcagcgggagatttccaatttcgaatacttaatgcagctgaacaccatcgctgggcgaacatataacgatctaagccagtaccccgtttttccttgggtgctgcaagattatgtctccccaaccctcgatctgagcaatcccgccgtgttcagagatctgtccaaaccaatcggcgttgtaaacccaaagcatgcacaactagtcagggaaaaatacgagagttttgaggaccccgcgggcacaatcgataagttccactatggcactcattacagtaatgcggcaggcgtgatgcattacctgattcgggtggagccgttcaccagtctacatgttcagttgcagagcggccggtttgactgctcagatcgtcagttccactccgtcgcggcagcgtggcaggctagactcgagtctcccgccgacgtgaaggagctcatacctgaatttttttatttcccagattttctagagaaccaaaacgggttcgacctcggatgcctgcaactaacgaatgaaaaagtgggcgatgtcgtgctgccaccctgggcctccagccctgaagactttattcagcagcacagacaagccttagagagtgagtacgtgtctgctcatcttcacgagtggattgacctgatctttgggtataaacagagaggccctgccgcggaagaagctctgaacgtgttctactactgtacgtacgagggcgcggtggacctggaccacgtcaccgacgaacgtgagaggaaagctctggagggcatcatatcaaatttcggccagaccccatgtcaacttctgaaggagccccaccccactcgcttgtctgctgaagaagcagcccatcgtctcgcaagattggacaccaacagtccgtccatttttcagcacctggacgagctgaaggcattctttgctgaggttgtatccgatggagtgcctctcgtgcttgcgctggtacctcaccgccaaccacattctttcatcactcagggttcccccgatctcctcgttacagtgtccgcatccggactgctgggaactcattcctggctcccctatgaccggaatatatcaaactatttcagcttctctaaagatcctaccatgggatcgcacaagacgcagcgactcctgagcggtccttgggtgccgggctctggcgtgagcgggcaagcgctggcggtagcgcctgacgggaaactgctgtttagcggaggccactgggatggctcccttcgcgtaaccgccctgcctaggggaaaactgctttctcaactttcctgccacttggacgtagtgacctgcttagcccttgatacttgcgggatatacttgatcagcggctctagagacaccacttgcatggtgtggagactcttacaccaaggaggcctttccgtgggtctggcacccaaaccggtgcaggtgttgtatggccacggggcggcagtgtcatgtgtggccatcagcactgaacttgatatggctgtgtccggatcggaggatgggacggtgattatacacacagttagacgggggcaatttgtggctgccctcaggcccttgggcgccacttttcctggaccaatctttcatctcgcgctcgggagcgaggggcagatcgttgttcaatccagtgcatgggagcggcccggggcccaagtgacctattcactccacctttacagcgtgaatgggaaattgcgggcaagcctgcccctcgctgagcagccgaccgctcttaccgtcaccgaggactttgttctcctggggactgctcagtgcgctctgcacatcttgcagttgaacacactgctgcccgctgcaccgccacttcctatgaaggttgctatccggtccgtagccgtcactaaggaacgttctcatgtgctggtcgggttggaagacggtaagctcatcgtggtggtggcgggtcagccaagcgaggtccgctccagccagttcgcgcggaaattatggaggtcctccaggcgaataagtcaggtgtccagtggcgaaacagaatacaaccctaccgaggctcgctag

SEQ ID NO: 196930 - DNA, 7116 bp, Artificial Sequence
  Description of Artificial Sequence: Synthetic coding sequence
atggccgcccccgagagcggccccgccctgagccccggcaccgccgagggggaagaagagacgattctgtatgacctcctggtgaatacagagtggccacctgagaccgaagtgcagccgcgtgggaatcagaagcatggagcgtctttcataatcacaaaagcgatcagagaccgcttactgtttctgagacagtatatctggtatagccctgcccccttcttactgcctgatggactggtgcggttggtaaacaagcagattaattggcacttggtcttggccagcaacggaaaacttttggctgccgtgcaggatcagtgcgtcgagattcgctctgctaaggacgactttactagcatcatcggtaaatgccaggtgcctaaggaccccaaaccacaatggaggcgcgtggcctggtcctatgactgcacactcctggcttacgccgaatcaacgggaactgtgcgggtgtttgacctgatggggtctgaactgtttgtgattagccctgctagtagttttatcggagacctttcatacgccatagccggcttgatattcctggagtacaaagcaagcgctcaatggtccgcagagctgctggtgataaactaccgcggcgagctcagaagttacctggtgtccgtggggactaaccagtcttaccaggagagccactgtttttctttttcttctcattatccccatggaataaacaccgccatttatcatcccggccatcgtctgctcctggtcggcggatgtgagaccgcagaagtgggaatgagcaaggcttccagctgcggactgagtgcctggcgcgttctttccggtagcccttactataagcaagtgactaatgggggcgacggcgtcaccgccgttccaaaaactctcgggctgttgcgcatgctgtcagtgaagttctattctcggcagggccaggaacaagacggcatttttaagatgagcctgagccccgatggaatgctgctggccgccattcacttctctggaaaacttagtatctgggcaattccatccctgaagcaacaaggggagtggggacagaatgaacagcctggatacgatgacctcaatcctgactggcgcttatctaccgaaaagcgtaagaagattaaggacaaagaaagtttctatccattgattgacgtaaattggtgggccgacagcgctgtgaccttggcaaggtgcagcggtgccctaaccgtgtcaagtgtgaagacgctgaagaatctcctaggaaaatcatgtgagtggttcgaacccagcccacaggtcactgccacccatgatggagggtttctgtcacttgagtgtgaaattaagctggctcctaagagatcaagacttgagacaagagctggggaggaagacgagggggaggaagattccgattccgattacgagatttctgcaaaagctcggtatttcggatatattaagcaggggctgtatctcgtcacagagatggagagattcgcccctccgcggaagcgacctcgcactattacaaagaactatagattagtctccctgcgttcgactaccccagaagagctatatcagcgtaaaatcgagtctgaggaatatgaggaggcgctctctctcgcgcacacatacggactggatacagaccttgtgtaccagagacagtggaggaaaagcgcagtcaatgtggctagcatacaaaattacttgtcaaagattaagaaaagatcctgggtccttcacgaatgtctagagcgggtcccagaaaacgtggacgccgccaaagagctgctccagtacggcttgaaaggcaccgatcttgaggcactgctggctattgggaagggagctgatgatggtcggtttaccctgcccggggagatcgatatcgattctatctcctacgaggagctgagcccaccagatgaagagcccgctaaaaacaagaaggagaaagagttaaaaaagaggcaggaactgcttaaactggtcaatttcagcaaactgacactggagcaaaaggagctatgccggtgtcggcgcaagctcctgacttacctcgatcggctagcaacttacgaagagatattaggagtaccacacgccagcgagcagaggtacgatgccgagttttttaagaaattcagaaaccagaacattgtcctaagtgctcgcacatatgcccaggagagtaatgtgcaagccttggaaattctttttacttaccatggttctgatctgctgccacaccgtctggcaattctctccaacttcccagaaaccacctctcctcatgagtacagcgtgcttctccccgaagcttgcttcaatggagatagccttatgatcatcccttggcacgagcataagcatcgggccaaggactggtgtgaggaactggcatgcagaatggtggtagagcctaacctccaggacgagagtgaattcctctacgctgctcaaccggaattattgcggtttaggatgacccagcttacagtcgaaaaggtgatggattggtatcaaacaagagcagaagaaatagagcactatgcccgacaggtggattgcgcactctcactcataagactggggatggaacggaacatacctggcttgctggtcctgtgtgataatctggtcacactcgaaactctggtgtacgaagccaggtgtgacgttacacttacattaaaggagctgcagcagatgaaagatattgaaaagctgcggctgcttatgaattcctgttccgaggataagtatgtgacatctgcatatcaatggatggtgccatttttgcacaggtgtgagaagcagtctcccggcgtcgccaacgaattgctcaaggaatatcttgtcactctagcgaagggcgatttgaagtttccccttaagattttccagcattctaagcctgacctgcaacagaaaatcattccagaccaggaccagttaatggccatagcattggagtgtatctatacctgtgagcgaaatgaccagctgtgtctgtgctacgaccttctcgagtgcctgccagaaaggggctatggcgacaagaccgaagccactaccaagctacacgatatggtggaccagctggagcagattctgagcgtttcagagttgctcgaaaaacatggattggagaaaccaataagcttcgtgaagaacacacagtcatcaagcgaagaggcaaggaaactgatggtccgcctgacgcggcacactggacggaagcagccccccgtgtccgagagccattggcggaccctcctccaggatatgttgactatgcagcagaacgtctacacctgtctagattccgacgcatgttacgagatctttacggaatccctgttatgttcttcacgtctcgagaacatacacctcgccggccagatgatgcattgttccgcttgctctgaaaaccctccggcggggatagcacacaagggaaaaccgcactatcgcgttagctatgaaaagagcattgatctggtccttgccgcctcacgggaatatttcaattcgtcaactaacctgaccgattcatgtatggatctggcccggtgctgcctgcaactgatcaccgatcggccccccgctatacaggaggagctcgacctgattcaggcggtgggctgcttggaggagttcggggtgaaaatactaccacttcaggtaagactctgtccagatcgaatctccctaatcaaagaatgtatatcgcagagtcccacatgttacaagcaaagcactaaacttctaggcctagccgaactgctgcgcgtcgcaggggagaatcctgaggagcgcagaggacaagtgcttatcttgctcgtggagcaggccctgcgcttccatgactacaaggctgcgtctatgcactgccaggagctgatggcaaccggatatcctaaatcatgggacgtgtgtagccagttaggccaatcggagggctatcaggatctcgcgacgaggcaggagttgatggcgtttgctctgactcactgtccaccatcatcaatcgagctcctgctcgctgcgtccagctctcttcagaccgaaattctgtatcagcgggtgaactttcagatccaccacgaaggaggcgagaatataagcgcaagtccactcacatccaaggccgtccaggaggacgaggtgggcgtgcctgggagcaattctgcagacctgctgcgttggaccacggccaccactatgaaggtgctgtcaaatacgactactaccactaaggccgtactgcaggctgtctctgatggccagtggtggaagaaatcattaacttatctccggccccttcagggacagaaatgcggaggggcataccagatcgggaccaccgccaacgaagaccttgagaaacagggttgccacccattttacgagtcagtaatatcaaatccctttgttgcggaaagcgaaggcacttatgatacgtaccaacatgtgccagtcgaatcctttgccgaagtcctgctcagaaccgggaaacttgctgaagcgaagaataaaggcgaagtcttcccaacaacagaagtactcctccagctggcaagcgaggctctccccaatgacatgaccctggccttggcatatttgcttgctttgccacaagtattggacgcaaaccggtgtttcgagaagcagtccccttctgctctctctctccagctggccgcctattattactctctccaaatatacgctcggctggcaccatgctttcgggataagtgccatcccctctatcgggcggaccccaaagaattgattaagatggtgacccgtcacgtgactcgccacgaacacgaggcttggcctgaagacctgatcagcttgacaaagcagctgcattgttacaacgagcgccttctggacttcacgcaggctcagatcttgcagggccttagaaagggagttgatgttcagcgctttaccgccgatgatcagtacaagagagaaaccattctggggttagcagaaaccctggaagagagtgtgtattctatagccatctcccttgctcagcgatattcggtcagcagatgggaagtcttcatgacccacctcgagtttttgtttaccgattctgggttgtctaccctcgagattgaaaatcgggcccaggatttgcacctgttcgaaaccttaaaaaccgatccggaggccttccaccagcatatggttaagtacatttatcccactatcggaggatttgatcatgagagactgcaatactattttacactccttgaaaactgcggatgcgcagacctgggtaactgtgccataaagcccgaaactcacatccgtctcctgaaaaaatttaaggtggtggctagcggtttgaactacaagaagctgactgacgagaacatgtcacccctggaggctttggagcctgtgttatcatcccaaaatattctgtccatttctaagctcgtgccaaagattcccgaaaaggatggccagatgctttcgccctcatcactgtacaccatttggctgcagaaactgttctggaccggtgatccccacctgatcaaacaggtgccagggtcgtcccccgagtggctacacgcttacgatgtatgcatgaagtatttcgaccgactgcaccccggcgacctgatcaccgttgtcgatgccgtcacattttccccaaaagcagtgacgaaactttccgtcgaagcccggaaggagatgacaaggaaagccatcaagactgtcaagcacttcatcgaaaagcctcgcaagcggaatagcgaggacgaggctcaggaggcaaaggattcaaaggtgacctacgcggacaccctcaatcaccttgagaaatcactagcccacttagagacactctctcacagttttatcctgagtctgaagaactcggagcaggaaaccctacagaagtatagtcatctctatgatctatcaagatctgagaaagagaagctgcacgatgaagccgtggccatctgcttggacggccagccccttgcgatgatacagcagctccttgaagttgccgtaggtccgctggatatttcccctaaggacatcgtccagtcagctatcatgaaaatcattagcgcactgtctggtggctccgctgatttgggagggcctcgggaccctctcaaggttctggaaggagtagtcgctgccgtccatgcaagcgtggataaaggggaagaactcgtgagcccagaggacctgctggaatggttgcggcccttctgcgcagatgatgcctggcccgtgcggcctagaatacacgtcctccaaatcttaggccagagtttccatctcaccgaggaggactctaagctgctagtcttctttagaaccgaggcgatcctcaaggcatcctggccccagaggcaggttgacatcgcagacatcgaaaatgaggagaaccggtactgcttgtttatggaattgttagaaagctcccaccacgaggccgagttccagcacctcgtgctgctgctccaggcctggccacctatgaaaagtgaatatgtgatcacgaataacccctgggtcaggcttgctacagtgatgctgacgagatgcaccatggagaacaaggagggtttggggaatgaggttctcaagatgtgcaggtccctatataacactaaacagatgctgcccgccgagggggttaaagaactgtgtctcttactgttaaatcagagtctgcttctgccctctctcaaactgctccttgaatccagggacgaacaccttcacgagatggctctggaacagataaccgcggtgaccactgtaaatgactctaactgcgaccaggagctgctcagcctccttctggacgccaagctcctggtcaaatgtgtgagcaccccattttacccaaggatcgttgatcacctgctggctagtctccagcaggggcggtgggatgccgaagaactgggcaggcacttacgggaggctggccacgaagccgaggctggctccttgcttctcgcagtcaggggcacccatcaggcgtttcgaaccttctccaccgccctgagagccgcccagcactgggtatag

SEQ ID NO: 196931 - DNA, 6756 bp, Artificial Sequence
  Description of Artificial Sequence: Synthetic coding sequence
atggccgcccccgagagcggccccgccctgagccccggcaccgccgagggtgaggaagagactatcctgtacgacctccttgtgaatacagagtggccccccgagaccgaggtgcagcctagaggaaaccagaagcatggcgcatcttttatcattacaaaagctatcagggataggttgctgtttctgcggcaatacatctggtactctcccgcaccttttcttttacccgatgggttagtaagattagtaaacaagcaaattaactggcacttagtgctggccagcaatgggaagctactggccgctgtgcaggaccagtgtgtggaaatcaggagtgcaaaggacgatttcactagcattattggaaagtgccaggtcccgaaggaccctaagcctcagtggcgaagagtggcttggagctacgactgcacgctgttagcgtacgcagaatcgacgggcaccgtgcgagtgtttgacttaatgggaagcgaattgtttgtgatcagtccggcctcttcttttattggcgatctcagctacgccatagccggcctgatttttctggaatacaaagctagcgctcagtggagcgcagagctgctggtaataaactatcgtggcgagctcagatcctatctggtttcagtggggaccaaccagtcctaccaagaatcgcactgcttcagcttttcttcccactaccctcacggaattaacacggccatctatcacccaggccataggcttctgctagtggggggctgtgagaccgctgaggttgggatgtccaaggcttcctcttgtgggctgtcagcttggcgcgttctctccggatctccctattataagcaggtcaccaacggcggagacggcgtaaccgcggtgccaaagacactgggattgctgagaatgctctcagtgaaattctattcacgccaggggcaggagcaggatggcatatttaagatgtccttgtctcccgatgggatgcttcttgctgcgatacacttctctggcaagctgagtatttgggcaatcccatccctgaagcagcaaggagaatggggacagaacgagcagcccggctatgatgacctcaaccctgattggaggcttagcacagagaaaaggaaaaagattaaagacaaggagtccttctacccgctgattgatgtgaattggtgggcggactccgccgtgaccctggctcgctgttccggagctctgactgtgagttctgtcaagacacttaagaaccttctcgggaagtcctgcgaatggttcgaaccaagcccacaggtcaccgccactcacgacggaggatttctcagccttgagtgcgaaatcaaactcgctccaaagcgatccagactggaaacacgcgccggtgaggaggatgaaggtgaggaggactcagattccgactatgaaatttccgccaaagccagatacttcggatatatcaaacagggactatacctggtgaccgaaatggagcggttcgctccaccacgcaaaagaccaaggacgattactaagaattaccgcctagttagcttgcgaagcacaacacctgaggagctttatcagaggaaaatagagtccgaagaatacgaagaggcactctcactagctcacacctacggactggatacagaccttgtttatcagaggcagtggaggaaatccgccgtgaacgtggcctccatccaaaattacctctcaaaaatcaaaaagaggagctgggttttgcacgagtgtctggaacgggttcctgagaacgtcgatgctgctaaggagctcctacagtatggcctaaaaggcaccgatttggaggcgctgctggccattggcaagggggccgatgatggacgcttcaccctgccaggggagatcgatatcgatagtataagttacgaagaattgagtcctcctgatgaggaaccggcaaagaataaaaaggaaaaagaacttaagaaacgacaggagctgctcaaactcgtgaatttctctaagttgacactggaacagaaggagctttgccgatgtagaaggaagctgctcacttacctggatcgccttgcaacatacgaggaaatcttgggcgttccccacgcatccgaacagcgctatgatgctgaattcttcaagaaattcaggaaccagaacatcgtgttgagcgcccgaacgtatgcccaggagtctaacgttcaggccctcgagatcctgtttacctatcatgggtcagatttgcttccccaccggttagccatccttagcaacttcccagagacaacctcccctcacgagtactctgttctgctgcctgaggcatgttttaacggggactcactgatgatcattccttggcacgaacacaaacaccgtgccaaggactggtgcgaagaactggcatgccgaatggtagtggagcccaatttgcaggatgagtctgagtttctgtatgctgctcagcccgaactgctccgctttcgtatgacacagctaacagttgagaaggtcatggactggtaccagaccagagccgaggagatcgagcattacgcccggcagctccagcagaagataattccagaccaggatcagctcatggctatcgcactggagtgcatttacacttgtgagaggaacgaccagctttgcctgtgctatgatctccttgagtgcctgcctgagcgtgggtatggcgacaagacagaggccacaacaaaactccacgatatggtcgatcagcttgagcagatcctgtctgtgagcgaactcctggagaagcacgggttggagaagcccatttctttcgtgaaaaacactcagtcctctagtgaggaggctcgcaaactcatggtacggctcacccggcacactggccggaagcagcctcccgtaagtgaatcacactggcggaccctccttcaggacatgttgaccatgcaacagaacgtttacacgtgtctcgactcagacgcatgttacgagatctttacagagagcctcctgtgtagcagcagacttgagaacatccatttagccggtcagatgatgcattgttcagcctgtagtgaaaatccaccagcaggtattgcccacaagggtaaaccacattaccgagtgtcatatgaaaagagtatcgatcttgtcctcgccgcatctcgggaatatttcaactcctctaccaatctgaccgatagctgtatggatctggcacggtgctgtttgcaactgatcacagatcgaccacccgctatccaggaagaacttgatctgattcaggccgtagggtgtcttgaggagttcggcgtgaagattttaccgctgcaagttaggctgtgcccagaccggatttctctgatcaaggaatgcattagccagagccccacctgctacaaacagagtactaagttattggggctcgccgagctcttgcgagtcgcgggtgagaatccagaagagcgacggggccaggtgttgatcttactggtggaacaggccctgcggtttcacgactataaggccgcttcaatgcactgtcaggagttaatggccacaggataccctaaaagctgggacgtgtgttctcagctgggccagagcgagggataccaggacctggccactcggcaggagctcatggccttcgccctcacgcattgtccaccttcctctattgaactgttactggccgcctcaagctccctgcagacagagatattgtatcagcgcgtgaactttcagatccatcatgaggggggcgaaaacatctcagcctcgccgttgaccagcaaagcggttcaagaagacgaggtgggtgtaccaggatcaaattccgcggatttgcttaggtggaccactgccaccacaatgaaggtgctaagcaacacgaccaccaccaccaaagccgtgctgcaggccgtgagcgacggtcagtggtggaaaaaatctctcacatatcttcgtcctctccagggccagaagtgtggcggagcctaccagattgggaccaccgctaatgaggatctcgaaaaacagggatgccatccattctacgaatctgtaattagcaacccattcgtcgcagaatcagagggtacatacgacacctatcagcacgttccggtggagtcatttgccgaggtactcctccgcacggggaagttggctgaggcaaagaacaagggggaggtgtttccaacgacagaggtgctgctccagctggcttcagaagcgctgccaaatgatatgaccttggccctcgcttatctgcttgctctacctcaggtcttggacgcgaacagatgtttcgagaagcaaagcccatcagccctgtccttgcaactggctgcctattattattccctgcagatttatgctcggttggcaccttgcttcagagacaaatgtcatccactttacagagccgacccaaaggagttgatcaagatggtgacgcgccacgtgacacgacatgagcatgaggcttggcccgaagatttgatatcactgaccaagcaattgcactgttataacgagcgcctgttggattttacacaggcacagattctgcaggggctgcggaagggtgtcgacgtccagcgcttcacggcagatgatcagtataagcgcgaaacgatcctcgggctcgctgaaaccctggaggaatccgtttactcaatcgccatttcattggcgcaacgttattcagtctcgagatgggaggtcttcatgacacacctggagttcctctttacagattcagggttaagcaccttggaaatagagaatcgggctcaagatcttcatttgttcgaaacgcttaaaactgacccggaggctttccaccagcacatggtgaaatatatataccccacaattggcggattcgaccacgagaggctccaatattattttaccctgctcgagaactgtggctgtgcagatctgggcaactgcgctattaaacccgagacacacattcgactccttaaaaagtttaaagttgttgccagtgggctgaactataagaagcttaccgatgagaacatgtcacccctggaagccctcgagcccgtgctgagctcccaaaatattctttccatttcaaagttagtacctaagatccccgaaaaggatggccaaatgcttagcccttccagcctgtatacgatctggctccagaaattgttttggacgggtgaccctcatttaatcaagcaggtaccaggaagttcacccgagtggctccacgcatacgatgtctgtatgaaatattttgacagattgcatcccggagacctaatcaccgtcgtcgacgccgttactttcagtcccaaagcagttaccaagctctctgtagaggcacggaaggaaatgacaagaaaggccataaagaccgtaaaacatttcatagagaagcctcgcaagaggaatagcgaagatgaggcgcaggaggccaaagacagtaaggtgacatacgccgacactttgaaccatcttgagaaatccttggcccaccttgagaccctgtcccactcattcattctctctctaaagaactctgagcaggaaacccttcagaagtattcacatctgtacgatctgtctcgctcggagaaagagaagctgcacgacgaggcggttgccatctgtctggacggtcagccattagccatgatccaacagttgttggaggtggccgttgggcctctggacatcagtcctaaagatattgtgcagagcgctatcatgaagataatttcagctctgagcggcggatctgctgatctgggcggaccacgagaccccctgaaggttcttgaaggagtggtcgcagccgtgcatgccagcgtggacaaaggagaggagcttgtgtccccagaggatctgctcgagtggctgcgccccttctgcgctgacgacgcatggcctgtccggccgcgtatccacgttcttcagattctggggcagagcttccatttgactgaagaagatagcaaactactggtgtttttcagaaccgaggccatcctgaaagccagttggcctcagcggcaggtcgacattgcagacattgagaatgaagagaatagatattgtctgttcatggagctgctggagtcatcccatcatgaagctgagttccagcatctagtgctgctgctccaggcgtggccacccatgaaaagcgaatacgtgatcacaaacaatccctgggtgagattggctacagtaatgctaactcggtgtacaatggagaataaggagggactgggcaacgaggtcttgaagatgtgtaggagcctgtataacacaaagcaaatgctgcccgcagagggcgttaaagaactctgcctgctgctgttgaatcagtctctcttgttacctagtctgaagctcctgctcgagtctcgggacgagcacctccatgagatggctctcgagcagatcacagcagtgacgacagtgaatgactccaattgcgatcaagaattactgtccttgctgcttgacgctaaactcctggtaaaatgtgttagcacaccgttttacccaaggatcgtggaccacctgctagcctcgctgcagcagggtcggtgggatgcagaagaactgggcaggcatctccgggaggccgggcacgaggctgaggcgggaagccttttgctggccgtgaggggtactcatcaggcgtttaggacatttagtaccgccctgagggcagctcagcactgggtttag

SEQ ID NO: 196932 - DNA, 10662 bp, Artificial Sequence
  Description of Artificial Sequence: Synthetic coding sequence
atggtggtgagcgccggcccctggagcagcgagaaggccgagatgaatatcctcgagataaatgaaactcttaggccacagttggccgagaagaaacagcagtttagaaatctgaaggaaaagtgcttcctaacccagctagccgggttcttagcaaacagacagaaaaaatataagtatgaagaatgtaaggatcttatcaagttcatgctccggaacgagcgacaattcaaagaggagaagttagccgagcagctgaagcaggcagaggagctccggcagtacaaggtgctcgttcacagccaggagagggagctgacccagcttagagaaaaactacgcgagggacgcgatgcatcccggtcgttgtacgagcatctacaggccctgctgacacccgacgagcctgacaagtctcagggacaggacctgcaggaacagctggcagaggggtgtcgattggcccagcaccttgtccagaagctctccccagaaaatgacgaggacgaagatgaggacgtgcaggtggaggaagctgaaaaagtgttggagagctctgcaccacgagaggttcagaaagccgaggaatctaaggtgcccgaagacagcttggaggagtgtgctatcacctgtagcaatagccacggaccctgtgactccaaccagccccacaaaaacatcaagattacattcgaggaggacgaagtaaattctactctggtggtcgacagggagtcaagccatgacgagtgccaggatgcattaaacatacttccggtccctggacctactagcagtgcaaccaatgtgtcgatggtggtgagtgccggccctttatcctccgagaaggcagagatgaacatcctcgagatcaacgagaagctccggccacagcttgctgagaaaaaacagcagttccgaaacctgaaggaaaaatgcttcttaacacagctgtctggattcttggccaatcagcagaagaaatacaagtacgaggagtgtaaggatctgatcaagttcatgcttaggaatgaaagacagttcaaggaagaaaagcttgcggagcaacttaagcaggctgaggagctgcggcagtacaaagttctcgtgcacgcacaggagagagaactgactcagctgaaggagaagctgagggagggacgggacgcctcacgatctttgaatgaacatctgcaggctcttttaacgccctacgagccggacaagtcacagggccaagacctgcaagagcagctcgccgaaggctgccgactggcccagcacttagttcagaagctgagccccgaaaacgacaacgatgacgacgaagacgtgcaggtcgaggtagccgagaaggtccagaaaagttccgcgccaagggagatgcagaaggccgaggagaaggaggtccccgaagactcgctggaggagtgcgccatcacctactccaactctcatggcagctacgacagtaatcagcctcaccgaaagacgaagattacgtttgaggaagacaaagtggattctactctgatcgggtcctcatcccacgtcgaatgggaggacgccgtgcacatcattcccgagaacgaatctgatgatgaggaggaagaggagaagggcccagtcagcccgagaaacctccaggaatcggaggaagaggaggtgccccaggagtcatgggatgagggatacagcactttaagcatacccccagagatgctggcttcctaccagagctattcttcgactttccactctctcgaggagcaacaggtctgtatggctgtggacatcggtaggcatagatgggaccaagtgaagaaagaggaccaggaagcaacagggccacgactctctcgggaactgctcgacgagaaggagccagaggtcttacaggactctctggatcgctgctacagtactcccagcgggtatcttgaactccccgatctcgggcagccctactcctccgctgtttattctcttgaggaacaatacctgggtcttgctctggacgtagaccgtataaagaaggaccaggaggaggaagaggatcagggcccgccatgtcctcgactctctagagaactgctggaggtggtggaaccagaagtgctgcaggactctctggatcggtgttattcaactcctagctcttgtctggagcagccagactcgtgccagccatatgggtcctcattctatgccttagaggagaagcacgttgggttctccctcgacgtgggcgaaattgagaagaagggtaaaggcaagaagagacgggggaggcgatcgaagaaagagaggcggcgcggacgcaaggagggcgaagaggatcagaacccaccctgcccgagacttagccgcgagctcctcgatgaaaaggggccggaggtcctgcaagactccctggaccgatgttatagcaccccgtccgggtgtctggagctcaccgattcttgtcagccataccgctccgccttttatgtgctggagcagcaacgagtggggttcgccgtcgacatggacgagatcgaaaagtaccaggaggtggaggaggaccaggatccgagttgcccccgactgtctcgggaactcctcgatgagaaagaaccagaagttctgcaggatagcctggacagatgctacagcaccccctctgggtacctggaactgccagacctgggacagccttactcatctgccgtttattcactagaggagcagtacttagggcttgccctggacgtcgatcggatcaaaaaggatcaggaggaggaggaggaccagggacctccttgtcctcgattgtccagagagctgctggaggttgtggaaccggaagtgctccaggactcacttgataggtgttattctacaccctcatcttgtctcgaacagccagactcctgccagccctacggatcctctttttacgcgctggaagaaaaacacgtgggattcagtctcgacgtgggcgagatagaaaaaaagggaaaaggcaagaagcgccggggtcggagatctaagaaggaaagacgtaggggacgtaaagagggggaagaagaccagaacccgccttgccccaggctgtctagggagctgttagatgagaaggggccagaggtcttgcaggactctttagaccgttgttattccaccccgagcgggtgcctggagcttacagactcgtgccagccgtatcgcagcgcgttttacgtactggaacagcagcgggtggggttcgcggtcgacatggatgaaatcgagaagtatcaggaagtggaagaagaccaagatccaagttgtcccaggctgtcgcgggagttgctcgacgagaaagagcccgaggtgttacaggattctctggatcggtgctattcaacaccctccggatacctggagctaccagacctgggccagccgtactccagcgcagtgtatagtttagaagagcagtaccttggactcgcccttgacgttgatagaattaagaaggacgaagaagaggaggaggaccaggacccaccttgcccgagattgtcgcgtgagcttttagaagtcgtcgcccctgaggtcctgcaggacagcttggaccgatgttattctacaccttcaagctgcctggaacagccagattcttgccagccttatggaagctccttttacgcccttgaagaaaagcatgtgggattcagtttggatgtcggagaaatagaaaaaaaaggaaagggtaagaaaaggaggggccggaggtctaaaaaagaacggagaagagggagaaaagaaggggaggaagaccagaacccgccatgtccacgactgagtagggaacttctggatgagaagggtccagaagtcctgcaggactcccttgatcggtgctactcaacacctagcggatgtttagaactcaccgacagttgtcagccatatcgtagtgcattttatgtgctcgaacagcagcgcgtgggaatggctgtcgatatggacgaaatcgagaagtatcaagaggtggaggaggaccaggatccatcctgtcctcgcctgtccagggaactcctggatgaaaaagagccggaagtgctgcaagacagtctgaacaggtgctactcgactccatccgggtacttagaactgccagacttaggacagccatatagctccgccgtgtattcactggaagagcagtatttgggactcgcactcgacgtggatcgcatcaaaaaggaccaggaggaggaggaggacgaggaccaggatcctccttgcccgaggctctcccgcgagcttttggaggtcgtggagcccgaggttctgcaggattctctcgacaggtgctattccactcctagtagttgtttggaacagccggactcatgccagccatacggaagctccttttacgccctggaggagaatcatgttgggtttagcttggatgtcggtgagattgagaagaaaggaaaaggtaagaagcggcgagggaggcgcagcaagaaagagaggcggaggggacggaaagagggcgaggaggaccagaaccccccctgtccccggctatcccgcgaactgcttgatgaaaaaggccccgaggtcctgcaggactccctggatagatgttattcaacaccctctggctgccttgaacttaccgattcctgccagccttacaggtcggccttttacgtcctggaacagcaacacgtcggccttgccgtcgacatggacgaaatcgagaagtatcaggaggtggaggaggaccaagacccaagctgtccgaggctgtcccgggaactgttggacgaaaaagaaccagaagtgctgcaggattcgctagataggtgttatagtacaccttccggttatctggagttacctgatctggggcagccatatagcagtgcagtgtattccctggaagagcagtacctgggactcgcgttggacgtggatcgaatcaagaaagaccaggaagaagaggaggaccaagggcccccttgtccaagactgagcagagaactgctggaagtggtagagcctgaggtgctgcaagacagcttggatagatgctattccaccccctctagttgcctggaacaaccagattcatgccagccttatggaagctctttttacgcccttgaagagaaccacgtgggcttctcactggatgttggtgaaattgaaaagaaaggaaaggggaaaaagaggcgtggcaggagatccaagaaagagagaagaaggggtcggaaagagggggaagaggaccagaaccctccctgcccccgcctttctagagagctgctggacgaaaagggaccggaggtgttacaggattctctggataggtgttactccaccccttctggctgtctggaactgacagattcttgtcagccttacaggtctgccttttatgtgctagaacagcagcatgtgggcctcgctgtggacatggacgagatagaaaagtatcaagaagtcgaagaggatcaggatccctcatgccctaggttaagccgcgaacttcttgatgagaaagaacccgaggtgctgcaggattccctcgatcggtgctattctacacctagtgggtatctggagctcccagatcttggacagccatactcctctgccgtgtattctttggaggagcagtacttgggactcgcactcgacgtagataggataaaaaaagatcaagaggaagaagaggatcaggggcccccatgcccccgtctaagcagggaactcttggaagtcgtggagccagaagtgcttcaggattccttggacagatgctacagtaccccatcgagctgtctcgagcaacccgatagctgtcaaccttacggtagttccttctatgctctggaggagaaccatgttggattttctctggatgtgggggagatcgaaaaaaagggcaaaggcaaaaaacgaaggggcaggcgctccaaaaaggagcgccgacggggccgcaaagaaggggaagaagaccagaacccaccttgcccacgactgtctagagagcttctcgacgagaagggccctgaagtgcttcaagattcactggaccggtgctatagtaccccctctggctgcttggaactgactgacagctgccagccataccgctctgcattttacgtgctcgagcagcaacacgtggggctagctgtggatatggatgagatcgagaagtaccaggaggtagaggaggatcaggacccctcatgtccccggctgagtagagagctgttggatgagaaagagccagaggttctccaagacagcctggataggtgttatagcacaccttccggatatttggagctgcccgaccttggacagccttatagtagtgccgtgtatagcctggaggagcagtacctgggtctggccctggatgtggaccgcatcaagaaggatcaggaagaggaggaggaccagggcccaccttgcccgagactctctcgcgagctgctcgaagtggtggagcctgaagtgctgcaggattcacttgataggtgttacagtacgccctcttcttgtctggagcagcctgactcctgccagccctatggaagcagtttctacgctctggaagaaaatcacgtgggattttcactagatgtgggcgaaatcgagaagaagggaaaaggcaagaagcggcgtggcagaagaagcaaaaaggagcggcgtaggggtcgcaaggagggggaggaagaccagaatcccccatgtccacgtctgtctcgagaactgctcgacgagaagggcccagaggtgctccaggactcgctcgataggtgttactccactccatcaggctgcctggagctcaccgactcgtgccaaccgtaccggtcggctttctacgtgttggaacagcaacacgtcggtcttgctgttgacatggatgaaatcgaaaagtaccaggaggtcgaggaggaccaagacccgtcatgtcctcgcttgtccagggagctcttggacgagaaagagcccgaggttctccaggatagtctggaccgatgttactcaacaccctccggctatctcgagctacccgacttggggcagccttacagctcagcagtgtacagcctcgaggagcagtacctgggactggccctggacgtggaccgaatcaagaaagatcaagaggaggaggaagaccagggtccaccctgccctagactgtcccgggaacttttggaggtagtagagccagaggtgctgcaggatagtcttgataggtgttacagcactccctccagttgcctggagcagcccgacagttgccagccctacgggtctagtttttatgccttggaggagaatcacgtgggcttctctttggacgtcggggaaatcgaaaagaagggcaaaggcaagaaaaggaggggaaggagaagtaaaaaagaacgacgtcgaggacgaaaagagggagaggaagatcaaaatcccccatgtccaagactgtcacgggagctgctagatgagaagggtcctgaggttctccaagatagtctagacagatgttattcaacacctagcggctgcttagagttgacagacagctgccagccctaccggagcgctttttacgtacttgaacagcagcacgtagggctggcagttgacatggacgaaatcgagaagtaccaagaagtggaggaggatcaagacccctcttgccctagattgtcgagagagttacttgatgaaaaagagccagaagtgcttcaggattccctcgacagatgttattcaacacccagcggctacctggagttaccggacttgggacagccgtacagctctgcagtgtattctctggaagagcagtacctgggcctggccttggatgtcgaccggattaagaaggatcaagaagaggaagaagatcaaggaccgccatgtccccgcttgtcgcgcgagttactggaggtcgttgaacccgaggtgctgcaggactcattggacaggtgctattctacacctagctcctgcttggaacagccagactcttgccagccttacggaagctcgttctacgctctggaggaaaaacacgtcggattcagcctagatgtgggcgaaatcgaaaagaaagggaaaggaaagaagcgccggggacgtaggtccaaaaaggaacgacgcagaggcaggaaggagggggaggaggatcagaaccctccatgcccacggctgtctcgagaactgcttgatgagaagggtccggaagtgctgcaggacagcttggacagatgttattccacaccttccggatgtcttgagctcaccgacagttgtcaaccatatcgcagcgcgttttacgttctcgaacagcagcatgtcggtctggccgtggacatggacgagatcgagaagtaccaggaggtggaggaggatcaggacccatcgtgccccagattatctagggagctgctagacgaaaaggaaccagaagtactccaggattctctcgacagatgttactctaccccttcaggctacctggagctgcccgacctagggcagccatactcttcagccgtctactccctcgaggaacagtacttgggcctcgccctcgatgtggaccggattaagaaagatcaagaagaggaagaagaccaggggccaccgtgccctcgcctgtctagagagttgttggaggtggttgagccagaagttctccaagattcattagaccggtgttattccactccaagctcctgtcttgaacagcccgactcttgccagccgtacggctctagtttctacgctctggaggaaaagcacgtgggcttttccctcgatgttggcgaaatcgagaaaaaagggaaaggaaaaaagcggagaggacggcgtagtaaaaaagagcggcggcgcgggcggaaagaaggcgaagaggaccaaaatcctccatgtcctcgcttgtcacgtgagctcctcgacgaaaagggacccaaggtgctccaggactcattggacaggtgctactctacaccttccggatgcctggagctctgcgactcgtgtcaaccttatcgatctgcattctacgtgctcgaacagcagcgggttgggctggccgtggatatggacgagatagagaaataccaggaggtggaggaggatcaggacccatcttgcccaaggctgagtcgcgagctgctggacgaaaagggtcccgaagtcttacaagacagcttggatcggtgctatagtaccccttctgggtgtctggaactgtgtgactcctgtcaaccatatcgaagtgcgttctacatcctggagcagcagcgcgttggattagcggttgacatggacgagattgaaaagtaccaagaagttgaagaggaccaggatcccagctgtcctcgtctgagcagggagctcctggatgaaaaagaacctgaggtgctgcaggacagcctggacagatgctattcgacgccaagcgggtatctggagctccccgacttagggcagccctattcgtctgcggtttattccctggaagagcagtatcttggactggctctggatgtggaccgtatcaagaaagaccaggaggaggaggaggaccagggtcccccttgcccccggctttccagagagctcctcgaggtggtcgaaccggaggtgttacaggattccttggatagatgctattctacccccagctcatgcctcgagcagcccgactcgtgccaaccatatggaagcagtttctacgccctcgaggaaaagcacgtggggttctctctggacgtcggtgagatcgagaaaaaaggcaagggcaagaagaggaggggacgcagatcaaagaaggaaagaagacggggacgcaaggagggcgaggaggaccagaatccaccgtgccctagacttagtcgcgagctgttggacgagaaggggccagaggtcctgcaagatagcctcgatcgatgctactcaaccccttcagggtgtctggagctatgtgacagttgccagccttataggtcagccttttacgttctcgagcagcaacacgtgggtcttgccgtcgacatggacgaaatagaaaagtaccaggaagtggaagaggaccaggatccttcttgcccacgcctcagtcgcgagctcctggatgagaaggagccagaggttctccaggattccctggataggtgctatagtaccccttctggatatctggaacttcccgatctcggacagccgtattcgtcagccgtgtattcacttgaggagcagtatctcggcctcgcgctcgacgtggataagattgaaaagaaagggaaggggaagaagaggcgcgggcgccgatcgaagaaagaacgccgacggggtaggaaggagggagaggaggatcagaatcctccatgcccgcggctgaatggcgtgctaatggaggtggaggaaagggaagtgctacaggatagtctagacagatgctacagcacccccagcatgtatttcgagctgcctgacagtttccaacactatcgatcagtgttttatagcttcgaggagcagcacatttccttcgctctctacgttgacaatcgatttttcacactgaccgtcacctctctccacctggtattccagatgggtgtgattttccctcaatag

SEQ ID NO: 196933 - DNA, 900 bp, Artificial Sequence
  Description of Artificial Sequence: Synthetic coding sequence
atggtggtgagcgccggccccctgagcagcgagaaggccgagatgaatattctggagattaacgagaagcttcggcctcagctggcagaaaagaaacaacagtttcggaacctaaaagaaaagtgctttctgacacagttatctgggtttctggccaatcagcagaaaaagtacaaatacgaagaatgtaaagatctgatcaagttcatgttacgcaacgagcgccagtttaaggaggagaagctggccgaacaattaaaacaggctgaagagttacgccaatataaagtgttggtgcatgctcaggaacgcgaacttactcagctgaaagagaaacttcgggaaggccgtgacgcgtcccgatcccttaatgagcacttgcaggctctccttacaccttatgaacccgataagtcccaaggccaagacctgcaggaacagctagccgaggggtgcagactggctcagcacctggtgcaaaaactgtcccccgaaaatgacaacgacgacgacgaagatgtccaggtggaggtggctgagaaagtgcaaaaaagctcagccccaagggagatgcagaaagcagaagaaaaggaggtgcccgaagactccctcgaggaatgcgccataacttacagcaattcccacggatcatatgattccaaccagccacatcggaaaaccaagatcacctttgaggaggacaaagtcgactcgaccctgattggcagctcatcgcatgtggaatgggaggacgctgttcacattatcccagaaaacgagtcagatgacgaagaagaagaggaaaaaggccccgtctcgccacgaacatccgtagggagctcagaaaaagggggcccacgcggaaatcggagtcaagctcaacaaggcgctgctggctag

SEQ ID NO: 196934 - DNA, 2010 bp, Artificial Sequence
  Description of Artificial Sequence: Synthetic coding sequence
atggtggtgagcgccggccccctgagcagcgagaaggccgagatgaatattcttgaaattaatgaaaagctgagaccccagcttgctgaaaagaagcagcagttccgcaatctgaaagagaagtgctttcttacgcaattgtccggtttcctcgccaatcagcagaagaaatataagtatgaggaatgcaaggatttgatcaaatttatgctgcgtaacgaacgacaattcaaggaggaaaaactggccgaacagctaaagcaagcagaggaactgcgacaatataaagtcctggtgcatgcccaagagcgagagttaacgcaactcaaggagaaactgcgcgaaggacgagatgcgtcacggtctttaaatgagcatctgcaggcactacttaccccatatgagccggataagagtcagggtcaagatctgcaggaacagctcgccgagggctgtcggctggcacaacacttggtccagaagttaagtccggagaacgataacgatgacgacgaagatgtacaggtggaggtggccgagaaggtccagaaatccagcgcaccccgggagatgcagaaggccgaggaaaaagaggtccctgaggattcactggaagaatgcgccattacctattcaaatagccatggctcctacgacagtaaccaaccccaccgtaaaaccaaaatcacgtttgaggaggataaagtcgatagcaccctgataggcagttctagtcacgttgagtgggaagacgctgttcacatcattcccgaaaatgagtccgatgatgaggaagaagaggagaaagggccagtgagtccccgtaatctccaagaatccgaggaggaagaagtcccccaggaatcttgggacgaaggatacagtactctgtctattccacccgaaatgcttgccagctaccagagctactcttctaccttccactcactggaagaacagcaagtatgcatggccgttgatatcgggcgacatagatgggatcaggtgaagaaggaggaccaggaggcgaccggcccctctcgcgaactgctggatgaaaaaggccctgaggtgtttcaagactcccaggatagatgctattccacacccagcggctgcctggaattgacagatagttgtcagccatatagatccgccttctacattctagaacagcagagggtggggttagcaatagatatggacgaaatagagaaatatcaggaagtcgaagaggaccaagatccgagttgtccaaggctctcgagagagttgctggatgaaaaggaaccagaggtgttgcaggattccctggaccgctgctacagcacccccagtggctacctggaacttcctgatctgggccagccttatagctcagcagtttactccctggaggagcaatatctaggccttgctctcgacgttgatcgaatcaaaaaggatcaggaggaagaagaggaccaagggccgccttgcccccgcttgtctcgggagttgcttgacgagaagggccctgaagtcctgcaggactcgctggaccggtgctacagtacaccatcagggtgtctggaactgaccgattcctgtcagccttaccgtagcgcattctacgtcctggagcagcagcacgtggggctggctgtcgacatggacgaaatcgagaagaagggaaaaggcaagaagaggagaggaaggagaagtaaaaaggaaaggagacgcgggagaaaggaaggtgaagaagaccagaatccaccatgcccaagactgaacggcgtgttgatggaagtagaagaacgggaggtactgcaggacagcctggaccggtgttactcaacgccatctatgtatttcgagttgcctgactcattccagcattaccggtccgtcttttattcctttgaggaacagcacatctctttcgccctgtacgtagacaatagattttttacgctgaccgtgacgtcactccaccttgtcttccaaatgggagtgatatttccccagtag

SEQ ID NO: 196935 - DNA, 2022 bp, Artificial Sequence
  Description of Artificial Sequence: Synthetic coding sequence
atggtggtgagcgccggcccctggagcagcgagaaggccgagatgaacattctggagatcaacgagaccctgagaccacagctggcagaaaagaagcagcagtttaggaatctgaaggagaagtgcttcttaacgcagctggctggttttttagctaatagacagaagaagtacaaatacgaagaatgtaaagacctgatcaaattcatgctgcggaatgagagacagttcaaggaggaaaagctggcagagcagctcaagcaggcggaggagctgaggcagtataaggtgttagtccactcacaggaaagagagctgactcagcttcgtgaaaaactgagagaggggcgggacgcatcccggtccctctatgagcacctacaggctcttttgacccccgacgaaccggacaaatcccagggccaagatttacaggagcaactggccgaaggctgtagacttgcccagcacttggttcagaaactcagccctgagaacgatgaggatgaggacgaagatgtgcaggtggaagaagcagaaaaggtcctggaaagtagcgcccctcgggaggtgcagaaggcagaggagagtaaggttcccgaggacagcctggaagaatgcgccataacctgctcaaactcccatggaccttgtgattctaaccagccacataagaacatcaagatcaccttcgaagaggacgaagtgaattcgacgctcgtcgtggacagggagagttcacacgatgaatgccaggatgctttaaacattctgcccgagaacgagtctgacgatgaagaggaggaagagaaggggccagtttccccaagaaacctgcaagaatcggaggaggaagaagtgcctcaggagtcctgggatgaagggtacagtactttgagtattccaccggagatgctggccagctatcagagctacagtagcacatttcactcactggaggaacaacaggtctgtatggctgtggacatcggacgccatcgctgggaccaagtgaagaaggaggaccaggaggccaccgggccacgcttgtctagagagctcctggatgagaagggcccagaggttctgcaggactcgttggatcgatgttatagcactccatctggatgtttggaactaaccgactcctgccagccctacaggtccgctttttacgtgctcgaacaacagcgagtcggattcgcagtcgatatggacgagattgagaagtaccaggaagtggaggaagatcaagacccaagctgcccacggctcagccgggagctcttggacgagaaggagccggaggttctccaagattcattagaccggtgctacagcaccccctctggctacttagagctgcctgatttgggccagccctacagctcagcagtatattctctcgaagaacagtacctaggccttgcattggacgtagaccgtataaagaaagatcaggaggaagaggaagatcaagggccgccatgcccaaggctctcacgggaacttctcgaagtggtcgagcctgaggtcctccaggatagtctggaccgctgctatagtacgccttcgagttgtctggagcagccagacagctgtcagccttacggctcatcattttacgctctggaggaaaagcatgtaggattcagtctcgatgtcggtgagatcgaaaaaaaggggaaaggcaaaaagcgccggggtcgccgctcaaagaaggagagacgccggggaagaaaggagggagaagaagatcaaaacccgccttgcccacggttgaacggggtccttatggaagtagaagagcgggaggtcttgcaggatagcctggaccggtgttattcaacaccctcgatgtattttgagttacctgacagctttcaacattatcgcagcgtcttctattcgtttgaggagcagcatatatcttttgccctgtatgtggacaacaggtttttcaccttgactgtcacaagcctccaccttgtgtttcagatgggggtgatcttcccgcagtag

SEQ ID NO: 196936 - DNA, 519 bp, Artificial Sequence
  Description of Artificial Sequence: Synthetic coding sequence
atggccgtggacatcggccggcaccggtgggaccaggtgaagaaggaagaccaggaagcaacgggcccttccagagagcttctggatgagaagggtcccgaggtctttcaggattcccaggaccgctgttactccacccctagcgggtgcctggagttgaccgactcctgccagccatatagatccgccttctatatattagagcagcagcgagtcggactcgctattgacatggatgaaattgagaagtaccaggaagtggaggaagaccaggatcccagctgccctcgtctgtctcgcgaattactggacgagaaagaacccgaggtgctccaagactcactagatcgatgctattctacaccctcggggtacctggaactgcccgatctggggcaaccctactcctctgccgtttactccctggaggaacagtacttaggcttggctttggatgtagacaggatcaagaaggatcaggaggaagaggaagaccaaggcccaccatgtccgagatag

SEQ ID NO: 196937 - DNA, 2295 bp, Artificial Sequence
  Description of Artificial Sequence: Synthetic coding sequence
atgttcagcaacagcaccggccggctgcccggccagcccaccgaggaaatccaacagtacaaagtacttgtccactcacaggaaagagagctcactcagctgcgtgagaaattgagagaggggcgcgacgcgtctaggagtttgtacgaacatttacaggctttactgacacctgacgaaccagacaaatctcagggccaggacctgcaggagcagctcgccgaggggtgcaggctggcacagcatctagtgcagaaactctctcccgagaacgatgaggacgaagatgaggacgtgcaggtagaagaagcggagaaggtcctggagagcagtgccccacgcgaagtgcagaaggcggaagagtcaaaggtgccagaggactccctcgaagagtgtgcaataacatgcagcaattcccacggcccgtgcgattctaatcagccgcacaaaaacatcaaaatcactttcgaggaagatgaagttaactcaaccttggtcgtagaccgcgagtcctcgcacgatgagtgccaggacgcactgaacatcttacccgtgcctggtccaacatcatctgccactaatgtttcaatggtcgtgagtgccggacctctgagctcggagaaggcggagatgaatatcttggagataaacgagaaactgcggccacaactcgccgaaaaaaagcaacaattcagaaacctaaaggaaaagtgcttcttgactcagctatcaggattcttggccaaccagcagaagaagtacaaatatgaggagtgtaaggacttgatcaagtttatgctcaggaatgaacggcagtttaaagaggagaagctggccgagcagttgaagcaggctgaggagctgcgccaatacaaggtgctcgtccatgctcaggagagggagctgacccagctgaaggagaaactaagggaggggagagacgccagccgaagcctgaacgagcatcttcaagcactgttgacaccttacgagccagataaatctcagggacaggatcttcaagagcagttggccgaggggtgcagactggcccagcatctggtgcagaaactgtccccagagaatgacaacgacgacgatgaggacgtgcaggtagaggttgcagagaaagtgcagaagtcctctgccccacgggagatgcaaaaggccgaggaaaaagaggttcctgaagactccctcgaggaatgtgctataacttattctaattcccacggaagctacgactctaaccagccccatcggaagactaaaataaccttcgaagaggacaaagtggactcaaccctgattggatcctctagccatgtggagtgggaggacgccgtgcatattattcccgaaaacgagtcagacgacgaagaagaggaggaaaaaggacccgtgtccccacgcaacctgcaggagagcgaagaggaagaagttccccaggagtcttgggacgaagggtatagcactctcagtatacctcccgagatgttagcctcttaccagagctactcttctacttttcactccttagaggagcagcaagtatgtatggccgtcgatatcggtcgccaccgctgggatcaagtaaaaaaggaagaccaggaggctacagggcctcgcctgagtagggaactcctggacgaaaaagggccagaagttttgcaggacagcttggaccgttgctacagtaccccctctggttgtttggagttgactgatagctgtcaaccctacaggagtgccttctacgtgctggagcagcagcacgtgggcctcgccgtggacatggatgagattgaaaagtaccaggaggtggaggaagatcaggatccaagctgcccccggttatcacgggaactgttggatgagaaggagccagaggttctgcaggattctctagacagatgttactcaacaccaagtggctatctggaattgcctgatctgggacagccttattcttcggccgtgtactcactagaggaacagtacctggggctagcacttgacgtggataggatcaagaaggatcaagaggaagaggaagaccagggaccaccgtgccccagactcagccgcgagcttctggaagtggtggaacccgaggtgcttcaggatagcctggacagatgctactcaactccaagtagttgcctagagcagccagactcctgccagccctacggaagctctttttacgcattagaggagaaacatgtaggcttttccctagatgtcggcgaaatcgagaaaaaagggaagggaaagaagcggcgcggtcgatag

SEQ ID NO: 196938 - DNA, 105 bp, Artificial Sequence
  Description of Artificial Sequence: Synthetic coding sequence
atcggcagcagcagccacgtggagtgggaggacgccgtgcacatcatccccgagaacgagtctgatgacgaagaagaggaagagaagggccctgtgtcaccttag

SEQ ID NO: 196939 - DNA, 2517 bp, Artificial Sequence
  Description of Artificial Sequence: Synthetic coding sequence
atggtggtgagcgccggcccctggagcagcgagaaggccgagatgaacatactcgagattaatgagaaacttaggccacaactggcagaaaataaacaacagttccggaatctcaaggagcgttgctttctcacccaactggcagggtttctagctaaccgtcaaaagaagtacaaatacgaggagtgtaaggacctcatcaagttcatgctgcgtaatgaacgccagtttaaagaggagaagctggccgagcagcttaaacaggccgaggagttaagacagtataaggttctcgtgcattcacaagagagagaactgacacagctccgcgaaaagcttcgggaaggcagagatgccagtcgttcgttaaatgagcacctgcaggcactgttaacccccgacgagcccgataagtcccagggacaggatctccaagagcagttggcagagggatgtcggctggcccaacacctagtgcagaaactgagccctgagaatgacgaggatgaagatgaagatgtgcaggtggaggaggacgaaaaagtgctcgagagcagtgctccacgcgaggtgcaaaaagctgaagagagcaaggtacctgaagactctctcgaagaatgtgctattacatgttctaatagtcatggcccctgcgatagcattcagcctcacaaaaatatcaaaattaccttcgaggaggacaaggttaacagctctttggtagtggaccgcgagagcagccacgacgggtgccaggacgcgctaaacattcttcctgttccaggacctaccagcagcgctacgaatgtctctatggtagtcagcgctggcccgctcagtagcgagaaggcggagatgaatatcctggaaatcaatgagaaactgtgcccccagctggctgagaagaagcaacagttccggagcctcaaggagaaatgctttgtgacacaagtagcctgctttctcgccaaacaacaaaataaatataaatatgaagagtgtaaagatctaattaaatcgatgctccgcaacgagagacaatttaaagaggaaaagctcgctgaacagcttaagcaagccgaggagctgaggcagtacaaggtgcttgtgcattcccaggaacgcgagctcacgcaactccgggaaaaattacgagaaggcagggacgctagccgctcactgaatgagcatctgcaggcactgttgacccccgacgagcccgacaagagccaagggcaggacctgcaggaacagttggccgaaggatgtcggctcgcacagcatctggttcagaaactttcccccgagaatgacaacgacgacgatgaggatgtgcaggtggaggtggctgagaaggttcagaagtcaagctcacctagggagatgcagaaggcggaggagaaagaggtgcccgaagattctcttgaggaatgcgcgatcacatgttcaaattcccacgggccgtacgactctaaccagccgcaccgcaagcctaagtcgcaccttagaaagaccaagagcacccagctgtcgcttgcacatcccctcatgctcaacggccgcatgctgtacactctgtcccagaaaatgaaagtgatgatgcggaaaagaaaaaagaagggtcagtgtctgccgggaatttgcaggagcctgaagagaaggaaatctccacgctctcccggaatgaaagtaatcagactgtcccaatttctgttgaagggacatcggtgggatcaggtcaagaaggaggaccaggaagccaccgggcctaggctgtccagggagttgctagacgagaaagaacccgaagtgctgcaagattccttagatagatgctactccaccccatccgtatatctgggtcttacagactcttgccaaccctatagatcagccttctacgtgctcgagcagcagcggatcggcttggcagtagacatggacgagatcgagaaataccaagaggtggaagaggatcaggatccttcatgcccaaggctgtctcgagagctgctggcagaaaaggagccggaggttttgcaggactcgctagatcggtgttattctactccttcaggctatctggagctgcccgatctgggtcagccgtaccgcagcgcagtatactctttagaggagcagtacctgggactggcgttggacgtagaccggatcaagaaggatcaggaagaagaagaggatcagggtcccccctgtccacgactctctcgagagctgctggaggtcgtggagcccgaggtcttgcaggactctcttgacgtgatacaactcttgcccgtcgtgctgaatagccttactcccgcatctccaaccgaggttcctttcatgcactggcgtaagaatatgctggcctttctcctgacatgggagaagctgaagcgcagggggcgtggaagaaaggagggcgaggaggaccagcgcagaaaagaggagggggaagagaaaaagggcaaaaagatcaaaactcatcatgcgcccggatctgccgcctgttag

SEQ ID NO: 196940 - DNA, 2373 bp, Artificial Sequence
  Description of Artificial Sequence: Synthetic coding sequence
atgttcagcaacagcaccggccggctgcccggccagcccaccgaggaaatacagcagtataaggtgctggtccactctcaggagcgtgagttaacccaacttagagaaaaactgagagagggtcgggatgccagtaggagcctgaatgagcacttgcaggctttactgacaccagatgagcccgacaagtcccagggccaggatctgcaagagcaactggccgagggatgtcgcctggcccaacatctcgtccagaagctgtccccggaaaacgacgaagatgaagacgaggacgtgcaggtggaggaagatgaaaaggtgctggaaagctctgcacctagagaggtgcagaaggccgaggagtctaaggtccccgaggactccctcgaggaatgcgccatcacctgttcaaattcacacgggccctgtgactccatccagccacacaagaatattaagattacgtttgaagaggataaagttaattccagtcttgtggtcgacagggagagctctcatgacggttgccaagacgctcttaatatcctgcctgttcctggccccactagttcagctactaatgtgtccatggtggtctcggccggcccactttcaagcgaaaaagcggagatgaatatcttggagattaatgagaagttgtgtcctcaactcgcggagaagaaacagcagtttcgaagcctgaaggagaaatgttttgtgacccaggtggcttgctttctggccaagcagcaaaataaatacaagtacgaggaatgtaaggatctgattaaatccatgttgcgaaacgagaggcagtttaaggaggagaaactggctgagcaacttaaacaagcagaagagctgaggcagtacaaggtactggtccacagccaggaacgtgagctgacacagctaagagaaaaactgcgcgaaggccgagatgcttccaggagtttaaacgagcacctccaggccctactgaccccagatgaaccagataaatctcaaggccaggacctgcaggagcagctcgcagaagggtgtagattggcacagcaccttgtgcagaaactcagcccagagaatgacaacgatgacgatgaggatgtccaggtcgaagtcgccgagaaagtgcagaagtcctctagcccaagagaaatgcagaaggctgaggagaaagaagtgccggaggattccctcgaggagtgcgctatcacatgttctaattcacacggaccttatgactcaaatcagcctcatcggaagacgaagattacatttgaagaggacaaggtggattctacactaataggaagtagctcacacgtcgagtgggaagacgctgttcacataattcccgaaaacgagtcagacgacgaggaggaagaagaaaaagggcctgtaagcccacgtaatttacaggaatcagaggaagaagaggtgccacaggagtcatgggacgagggatactctacccttagtattcctccagagcgactcgcaagctaccagtcctattctagcacattccactccctggaggagcaacaagtgtgcatggctgttgacatcggtcgccacaggtgggaccaggtgaaaaaggaagatcaggaagccaccggaccaagacttagccgcgaactgcttgacgagaaagagccagaagtgctgcaggattccctggacagatgctatagcactccatcggtttatctgggtctcactgattcctgtcaaccttaccggagtgccttttacgtgctcgaacaacagcgaattgggctcgctgtggacatggatgaaatcgagaagtatcaggaagtcgaggaggatcaggacccctcttgccccaggctgagtagagagctgttagcagagaaagagcccgaggtcctgcaagattctttggacaggtgttacagtacaccctctggctatctggagctgcccgacttggggcagccctaccggagcgccgtatattccttggaagaacagtacctgggactggcactcgacgtggatcggatcaaaaaagaccaggaagaagaagaggatcaggggcccccctgtccacgtctgtctagagagttacttgaggtcgttgaacctgaggtactccaggacagcttagacgtcatacaattactgcccgtcgtgctgaactctctgacacctgcctcaccaaccgaagtgccctttatgcactggagaaagaacatgttggcctttcttctaacttgggagaagctgaaacgccgcggccgcggaagaaaagaaggagaagaggatcagcgccgcaaagaggaaggtgaggaaaagaagggcaagaaaattaagacccatcacgcgccagggtctgctgcgtgctag

SEQ ID NO: 196941 - DNA, 258 bp, Artificial Sequence
  Description of Artificial Sequence: Synthetic coding sequence
gagatgcagaaggccgaggagaaggaggtgcccgaggacagcctggaggagtgcgcaattacctgcagtaactcacacggcccctacgactccaatcagccacacagaaagaccaagataacctttgaagaagacaaggtggactcaacgctgatcgggtccagttcccacgtggagtgggaagacgcagtacatattattccagaaaacgaatccgatgatgaggaagaagaggagaaaggccccgtttcaccctag

SEQ ID NO: 196942 - DNA, 1101 bp, Artificial Sequence
  Description of Artificial Sequence: Synthetic coding sequence
ctggccagctaccagagctacagcagcaccttccacagcctggaggagcagcaggtttgcatggctgtggacattggccgacaccgttgggatcaggtcaagaaagaagaccaagaggcaactgggccccgattgagcagagagctcttggacgagaaagaaccagaggtcctccaagactctctggaccgatgctatagtaccccctctgtttatttggggctcacagactcatgtcagccttaccggtccgccttttatgtcctagagcaacaacggatagggctagcagtggacatggacgaaattgaaaagtatcaagaagtggaagaggaccaagatccatcttgtccccgcctttcacgggagcttctggcggagaaggaacctgaagtgttacaagattcgctggacagatgctacagcactccgagcggatatctggagctgcccgacctcgggcaaccttacaggagcgccgtctactcactagaggagcagtatctggggttggctttggacgtggacagaatcaaaaaggaccaggaggaggaagaagatcaaggccccccctgtcccaggctgtcccgggaacttctggaggtcgtggagcccgaggtcctgcaggatagtttgtgttattccacgcctagcagttgtctggagcagcccgattcctgtcagccttacggctcgtctttctatgccttggaggaaaagcatgtggggttttccctagatgtcggtgagattgagaaaaagggtaaaggcaaaaaacgtcgaggccggcgcagcaagaagaaaagacggcgtggtagaaaagagggcgaggaagaccaaaatcctccatgccctcggctgtcctctgtgctgatggaggtggaggtgcccgaggtgttgcaggactcccttgatcgttattactcaactccatccatgtacttcgaattgcccgacagcttccagcattatagatctgtgttttactcttttgaggagcagcacatcagctttgctctcgacatggacaaccgttttttcaccctgactgtcaggagtctccacctcgtctttcagatgggagtaatttttccacagtag

SEQ ID NO: 196943 - DNA, 2598 bp, Artificial Sequence
  Description of Artificial Sequence: Synthetic coding sequence
atggtggtgagcgccggcccctggagcagcgagaaggccgagatgaacatcctcgagataaacgaaaagctgagaccacagctggcggagaacaaacaacagtttcgcaacctgaaggaacggtgcttcctgactcaactcgctggttttctggcaaaccgccagaagaagtataaatacgaagagtgtaaggatttaattaaattcatgttgcggaatgagcgtcagtttaaagaagagaagctcgctgagcagctcaaacaggccgaggagctccgccaatacaaggtcttagtccattcacaggaacgcgaattaacacagctgcgtgaaaagctgcgagagggaagagatgcatctagatctctgaacgagcatcttcaggcgctgctcacacccgatgagcctgacaagagccagggtcaagacctgcaggagcaactggctgagggatgtcgattagctcagcaccttgtgcaaaaattgagccctgagaacgacgaggacgaagacgaggacgttcaagtcgaggaagacgaaaaagtgctggaatcctccgcaccacgcgaagtgcagaaagccgaggaaagcaaggtccccgaagatagccttgaggagtgtgccatcacgtgttcaaactcccacggaccttgcgacagcattcagccacacaagaatatcaagattaccttcgaggaggataaggttaacagctcgctggtggtggatagagagtctagtcacgacggctgccaagatgctcttaacattctccctgtccccggcccaacatcgtcagccacaaatgtgtctatggtcgtgtccgccggtccccttagcagcgagaaagcagaaatgaatattttggaaataaacgaaaagctttgcccccagttggcggaaaagaagcaacagttccgtagccttaaggagaagtgttttgtcacccaagtagcctgttttctggccaagcagcagaacaagtacaagtatgaggagtgtaaggatctcatcaaaagcatgctccggaatgagcggcaattcaaagaagaaaaactggcagaacagctaaagcaagctgaggagctgagacagtacaaagtgcttgtgcattctcaagagcgggaactgacacagctaagagagaagttgcgtgaaggccgcgatgctagccgctcactgaatgaacacctacaagctctgctgacccctgacgagcccgacaaatctcagggccaagatcttcaggagcaactggctgagggctgcaggctggctcagcacttagtgcagaagttgagccccgagaacgataatgacgatgacgaggatgtacaagttgaagttgctgagaaggttcaaaaaagttcaagccctagagaaatgcaaaaagcggaggagaaagaggtcccagaagattctctcgaagaatgcgcaattacctgctccaattcgcacggcccttacgactcaaaccagcctcatcgtaagacaaagatcacctttgaagaagataaggtggactctacactgataggatcaagttcccatgtagaatgggaggacgcagtacacatcatacccgagaacgaatctgacgacgaagaggaagaggagaaagggcccgtgagtcctcggaatctgcaggaaagtgaagaagaagaagtcccgcaggaatcatgggacgagggctactcaaccctctccatccctcccgaacgactggcatcatatcagtcatattcaagcactttccacagtctggaagagcagcaagtttgcatggcggtagacatcggccgccatcgatgggaccaggtgaagaaggaggatcaggaggctactggaccgcgtctgtcgcgggagttgctggatgagaaggaacctgaagtcctgcaggactctctggataggtgttactccacaccgtcggtgtatttggggttaactgacagctgccagccataccgaagtgcgttttacgtacttgagcagcagcggataggcctcgctgttgatatggatgagattgagaagtaccaggaggtggaggaggaccaggacccctcctgtcccaggctctcacgagagctgctggcggaaaaggaaccagaagttcttcaggatagtttggacaggtgctatagtactccgagtggttacctggagctccctgatctcggacaaccttaccgctccgccgtgtactctctcgaagagcagtacctcggactggccctggacgtcgatcggatcaagaaggatcaagaagaggaggaggaccagggacccccatgccctagactttcccgggagctgcttgaggttgtggagcctgaggtgctccaagatagtctggatgtcatccagcttctacctgttgttttaaacagtttaactcctgcaagcccaaccgaggttccttttatgcactggcgcaagaacatgcttgcattcctcttgacatgggaaaagctgaaacgccgcggcagggggcgaaaagagggcgaagaggaccagcggcgaaaggaggagggcgaggagaagaaaggcaagaaaatcaaaacacaccatgcgcctggctccgcggcttgttag

SEQ ID NO: 196944 - DNA, 2373 bp, Artificial Sequence
  Description of Artificial Sequence: Synthetic coding sequence
atgttcagcaacagcaccggccggctgcccggccagcccaccgaggaaattcagcaatacaaagtgctggtccactctcaggaaagagagctgacacagctcagagagaagctgcgcgagggccgggatgcatcccgctcactgaatgaacacctgcaggctttattgaccccggacgagccggacaagtctcagggccaagacctgcaggaacagctagctgagggctgtcggctggcgcaacagcttgtccagaagctctcccccgagaacgacgaagacgaagatgaggatgtgcaggtggaggaggacgagaaggtcctcgaatcctccgctcctcgggaagtgcagaaagctgaagagtcgaaagttcccgaggacagtctggaagagtgtgctattacctgctccaattcccatgggccttgtgattcgaaccaaccgcacaagaatattaaaataacctttgaagaggacaaagtcaactcgtcactcgttgtcgatcgggagtattcacatgatgaatgccaagatgcccttaacattctgcccgtccccggaccaacgtcttccgccacaaacgtgtccatggtcgtgtccgctggccccctatcttccgagaaggctgaaatgaatatattggaaatcaatgagaagctccgtccgcagctggccgaaaagaaacagcagttcagaagccttaaagagaaatgttttgtgacgcaggtcgcctgctttctggccaaacagcagaacaaatataagtatgaagaatgtaaagatctgatcaagtcaatgctacgcaacgagttacaattcaaagaagaaaaactggccgaacaactgaagcaagcagaagagttgcgtcaatacaaagtactggttcattctcaggagcgagagctcacgcagcttagagagaagttgcgcgaaggacgcgacgcttcccgttcccttaacgagcacctgcaggccctcctgacgcccgacgagccagataagagccagggccaggaccttcaggagcagctggctgagggttgccgcctggctcagcacctggtgcaaaaactctccccggaaaacgataacgatgacgacgaggacgtgcaggtcgaggtggcagagaaggtccagaagagttccagccctcgtgaaatgcagaaagcagaggaaaaggaagtcccagaagactccctggaagagtgcgccattacctgtagcaattcccacggcccctacgattccaaccagccacaccggaaaacgaagatcactttcgaggaggataaggttgactctactttgattggtagctcgagccatgtggagtgggaagatgccgttcacatcattccagaaaacgagagtgacgacgaggaagaggaggagaaaggccctgtttccccccgcaacctgcaagaatcagaggaagaagaggtgccccaggaatcctgggacgagggatatagcacactttctattccacctgagagacttgcctcctaccagagttactcctcaactttccacagcctggaggaacagcaggtttgcatggctgtggatataggtaggcatagatgggatcaggtaaaaaaagaggaccaagaggccactggccccaggttaagcagagaactcctcgccgagaaggaacccgaggtgttgcaagactctctggaccggtgttactcgactccgtctgtttatttggggctcactgactcctgtcagccttatcgatcagctttctatgtgctggagcagcaacgcgtgggactcgctgttgacatggatgaaattgagaagtaccaagaggtggaggaagaccaggatccctcctgtccacggctttcacgagagctgctggctgagaaggaaccggaggtccttcaagatagcctggaccgctgctattcaacgccttccggctatctggagctcccggaccttggacaaccttatcgatcagccgtgtacagtctcgaggaacaatatctgggcctagctctcgatgttgatagaattaagaaagatcaagaagaggaggaggaccagggtcctccatgccccaggctgtctagggagctgttggaggtggtcgagcccgaagtactgcaggactccctggacgtgattcagttgttacctgtggtgctcaactcacttacacccgccagtccaacggaggtccccttcatgcattggaggaagaacatgctcgctttcttacttacttgggagaagcttaagcggagaggtcgaggaaggaaggaaggagaggaggaccagcgtagaaaggaagagggagaagagaagaaagggaaaaagatcaaaactcatcatgcaccagggtctaccgcatgctag

SEQ ID NO: 196945 - DNA, 234 bp, Artificial Sequence
  Description of Artificial Sequence: Synthetic coding sequence
atggacgagatcgagaagtaccaggaggtggaggaggaccaggacccctcgtgcccccgtctgagtcgcgaactgctggctgaaaaggagcctgaagtgctccaagattctctggaccgatgctactccacccctagcggctatttagagctaccagatcttggccagccctataggagcgccgtgtatagcttggaagagcagtatctgggtctggcactcgatgtggattag

SEQ ID NO: 196946 - DNA, 234 bp, Artificial Sequence
  Description of Artificial Sequence: Synthetic coding sequence
atggacgagatcgagaagtaccaggaggtggaggaggaccaggacccttcctgccctcgactgtccagggagttgctagcggagaaagaaccagaggtgcttcaagattcgctggatagatggtatagcacgccatccggctacctggaactcccggatctcggccagccataccgtagtgctgtgtatagcctagaggagcagtatctcggacttgccttagacgttgactag

SEQ ID NO: 196947 - DNA, 234 bp, Artificial Sequence
  Description of Artificial Sequence: Synthetic coding sequence
atggacgagatcgagaagtaccaggaggtggaggaggaccaggacccatcgtgtcctcgtctgagtcgagaactgctcgctgaaaaagaacccgaggtgcttcaggactcgttggaccgttgttatagtactcctagcggttatcttgagctgccggatctaggccagccttatagatcagctgtgtacagcctggaggaacaatatttagggctagcattagacgtcgactag

SEQ ID NO: 196948 - DNA, 207 bp, Artificial Sequence
  Description of Artificial Sequence: Synthetic coding sequence
gagatgcagaaggccgaggagaaggaggtgcccgaggacagcctggaagaatgtgccatcacgtgttcgaattcacatggtccctacgatagcaaccagccgcaccgcaagaccaaaatcacatttgaggaggacaaggtcgattcgaccctgattggctcctcatcacatgtggagtgggaagatgccgttcatataataccgtag

SEQ ID NO: 196949 - DNA, 9996 bp, Artificial Sequence
  Description of Artificial Sequence: Synthetic coding sequence
atggtggtgagcgccggcccctggagcagcgagaaggccgagatgaatattctggaaattaacgagaaattgaggccacagctggccgagaataaacagcagtttagaaacttgaaggaacggtgctttctcacacagttggccggctttcttgcgaaccgacagaagaagtataaatatgaggaatgcaaggatctcattaaattcatgctccgaaacgaacgtcaattcaaggaagaaaagctggcagagcaactgaaacaggcagaagaactacgccagtataaagtgctggtgcactctcaggagcgtgaactgacacaactcagggagaaactgagggagggtcgcgacgcctcacgttccctgaacgagcatctccaagccctgctgactcccgatgaaccagataagtcacagggccaggacttacaggagcagttggcggagggatgccgactggcccagcaactggttcagaagctaagtcctgagaacgatgaggatgaagatgaagatgtccaggtcgaggaggatgagaaagtgctcgagagttcggctccaagagaggtgcagaaagccgaggaatccaaagtccctgaggattcacttgaggagtgcgccatcacctgttcgaattcgcacggaccttgtgattcaaaccagcctcacaaaaacatcaagattaccttcgaagaagataaggtaaactcgactgtcgtggtcgatcggaagtcctctcacgacgaatgccaggatgccctgaacatcctgcctgttccaggtcctacctcctctgccaccaacgtgtccatggtggtgtccgcaggaccactgtctagtgagaaagcagagatgaacatcctggagattaacgagaaactgcgtcctcagttggccgagaaaaaacagcagttccgctcgcttaaagagaagtgcttcgttacccagttagccggcttcttggccaagcagcagaataagtataagtacgaagagtgcaaagacctgatcaaatcaatgcttagaaatgaactgcagttcaaggaagagaaactagccgagcagctcaaacaggctgaagagttacgccaatacaaggttctggttcactcccaggagcgtgagttaactcaactcagagagaaacttcgggaagggagagatgcttctcggtccctgaacgaacacttgcaggcactgttgaccccggacgaaccggataaaagccaaggccaggatctccaggaacagttagctgagggctgccggttggctcagcacctggtgcagaagctgtcgcctgagaacgacgaggacgaagacgaagacgtacaagtggaagaggatgagaaggtgctggagtctagctcccccagggaaatgcaaaaagctgaggaatctaaggtgcctgaagactctctggaagagtgtgccatcacctgttcaaactcccacgggccatgtgattcgaaccagccccacaaaaacataaaaattacctttgaggaggacaaggtgaattcttctctggtcgtggaccgcgagtatagtcacgacgagtgtcaagacgctttgaacatactccccgtcccaggaccaacttcctctgctacaaacgtttcgatggtggtgtctgcaggccccctttcttctgagaaggccgagatgaacatcctggaaataaatgagaaattaagaccacagctggccgagaagaaacagcagtttcggagtctgaaggagaagtgctttgtgactcaggtcgcatgctttctggccaaacagcagaacaaatataagtacgaggagtgcaaagatctgattaagagtatgctgagaaatgagctacagttcaaagaggagaaattagccgagcagctgaagcaagctgaagagcttagacagtataaagtcttggtccactcgcaggaaagggagctgactcagcttcgggaaaagctccgcgagggccgggacgccagccgatcactgaatgaacatctccaggcgttattgacgcccgacgaaccagacaagagtcagggacaagatctgcaagagcagctggctgagggttgcaggctagcacaacatctggtccagaagctgtcgcctgaaaatgacaacgatgacgacgaagatgtgcaggtagaggttgcagagaaagtacagaaatcctcttccccccgcgagatgcagaaagccgaggagaaggaagtgcccgaagactcattagaagagtgcgcaattacctgctccaacagtcatggtccctatgatagtaatcagccccataggaagaccaagattactttcgaagaagacaaggtagactcgaccctgatcgggagctcctctcatgtcgagtgggaggatgcagtgcatattattcccgagaacgaatcggacgatgaagaggaggaggagaagggcccggtctccccacgaaacctccaggaatcggaggaggaagaggtgccacaagagagctgggacgaaggatacagcactttgtccattccgccagaacggctcgcgagctatcaaagttactcctctaccttccactcccttgaggagcagcaggtttgcatggctgttgatattgggagtgaatacagcatcgttaaggtgatcaagctgcagttcatggcccagagtcaagctatgccggtcccaacgtggacagactgtcacgatatcgaactgaaggccggccataggtgggaccaggttaagaaggaggaccaggaagcaacggggcctcggttatcaagagagctccttgcagaaaaggagcccgaagtgctgcaggacagcctcgaccgatgttactctaccccaagcgtgtatctcgggctcaccgacagttgtcagccttatcgctccgcgttctatgtgctcgaacagcagcgcgttgggctggccgtggatatggacgaaatagagaagtaccaggaggtcgaagaggatcaagatccctcgtgtccacggctgtcccgggagcttttggcagaaaaggagcccgaagtcctccaggatagtctggatcgttggtatagcacccccagcggatacctggagttgcctgatctggggcaaccttaccggtccgcagtgtactcactcgaggagcagtacctcggcctggctctggacgtggacaggatcaaaaaagatcaagaggaggaggaggatcagggccccccgtgtcctaggctctcaagagagctactcgaagtcgttgaaccagaagtccttcaagatagcttagatcggtgttatagcacaccatcgagttgccttgagcaaccggactcttgtcagccataccggtcctctttctacgctcttgaggagaagcatgtggggttctctttggacgtgggggaaattgagaagaaggggaagggcaagaaaaggagaggaaggcgctccaaaaaaaaacgtcgacgaggccgaaaagagggcgaagaggatcaaaatcctccttgcccgcgtctgagccgtgaactgctcgcggagaaagaacctgaggtcctgcaggactccttggacagatggtactcgacaccttccgtctacttgggactgactgacccatgccagccatatcggagcgccttttatgtcctagagcagcagcgcgtcggattggccgtcgacatggacgagatcgaaaaataccaggaggtcgaggaggatcaggacccttcatgccctagattgtcccgcgagctgctggctgaaaaggaacccgaggtgctccaggatagtttggatcgctggtatagcactccttcaggatacttagagcttccagacctgggccaaccgtaccggtccgctgtttacagcttagaagaacagtacctgggactggccctggacgttgacaggattaaaaaagaccaggaggaagaggaggatcagggccccccatgcccacgactgtcccgagaactgctggaagtggtggagcctgaagttcttcaggatagtctagatcgttgttactctaccccatcctcgtgtttggagcaacccgacagctgccagccctatagatcctccttttatgctctagaggaaaagcacgtaggattcagtctggacgttggagagattgagaagaagggtaaagggaaaaagagaagagggaggcggagtaaaaagaaacggagacgggggcggaaagagggggaggaggaccagaatccaccatgcccaaggctgtcacgagaactgttggcagagaaagagcccgaagtgctgcaggactctcttgacagatggtacagtaccccctctgtgtacttaggtctaaccgatccgtgccaaccttatagatctgcattctacgtgttggagcagcaaagggtgggcctggcagtcgatatggacgaaatcgagaagtaccaggaagttgaggaggaccaggacccctcttgtccgcgcctgtcccgcgaactcctagctgaaaaggagcccgaagtgctccaggacagcctcgaccgctggtattcaactccgagcggttatctcgaactgcccgacctcgggcagccatacagaagcgcggtctatagtctcgaagagcagtacctgggcctagccctggacgtggacaggatcaagaaagatcaggaggaggaggaagatcaaggccctccttgccctcgtttgagtcgggagctgctggaggtcgtcgagcccgaagtcttacaggactcgctggaccggtgttattctacgccaagcagctgcttggagcagccagactcctgccagccatatagatcgtctttttacgccttagaggagaagcacgtagggttttcgctggatgtaggcgaaatcgaaaagaaagggaaaggcaagaaaaggcgcgggaggcgatccaaaaaaaaacgaagaagaggccgaaaagaaggggaagaagaccagaatccaccatgcccacgcttgagtcgggaactgttggccgagaaagagccagaagtgctgcaggatagtctggatcgttggtactccacgccctccgtctacttgggcctgactgacccttgtcaaccataccgctccgcattttacgtgctcgagcagcaacgcgtggggctagcagtggatatggacgagatagagaagtaccaggaggtggaggaagatcaggaccctagctgtcccagactatcaagagaattgttggcggaaaaagagcccgaggtccttcaggattctctggaccgatggtacagcacacctagtggctatttagagcttccggatttgggccagccctacagatcagccgtctatagtctggaagagcagtatctcggactagccctagacgtagatcgcataaagaaggatcaggaggaagaagaagaccagggacctccctgtcctaggctttctcgcgagctgctagaagtggtggaaccggaggtgttacaggactctttggacagatgctactcaacaccaagtagctgtctggagcagccagacagctgccagccctacaggtcatccttttatgctcttgaagagaaacatgtgggcttcagtctggatgtgggggagattgagaagaagggtaagggaaagaagcgccgaggacgtcgaagcaaaaaaaagcggcgaagaggaagaaaagagggtgaagaagatcagaatcccccttgtccccggctctccagggaactcctggcagaaaaggagccggaagtgcttcaagattccttggatcggtggtatagcaccccatccgtttacctcggccttaccgatccctgccagccttataggtctgcgttttacgtgctggagcaacagcgcgtcgggctcgccgtggatatggacgaaattgaaaagtaccaggaagtcgaggaagatcaagatccctcctgccctcggttgagccgggaactgctggccgagaaggagcctgaggtcctgcaggactctttggatagatggtactccaccccgtccggctacctcgagttgcctgatcttgggcagccctatcgcagtgccgtgtatagtttggaggaacagtaccttggacttgcattggatgtggacaagattgagaaataccaagaagtggaggaggaccaggacccttcttgcccgcgcctgtctcgcgaactactcgccgaaaaagaacccgaagtgctccaggatagtctggacaggtggtactccacaccatccgtgtacctcggcctgactgatccctgtcagccttaccggtcggctttctatgttctagagcaacagcgggtggggttagccgtggacatggacgagattgaaaagtaccaagaggttgaggaagaccaggacccaagttgcccgcgccttagcagggaactgctcgccgagaaggaacccgaggtgctccaggactcgctggaccgatgttattcaacccctagcggctacttagaactcccggatcttggccaaccatatcgtagtgctgtatactcactcgaggaacagtaccttgggttggctcttgatgtggataggatcaagaaggatcaagaggaagaagaggaccaaggcccgccatgtccccgactgtctcgagagctcctcgaagttgtcgagccggaagtgttacaagactccctcgaccgctgctattctaccccctcctcatgtttggagcagcctgactcctgccagccatatcgctcatcattctatgctctggaggaaaaacacgtagggttctcactcgacgtgggtgagatcgaaaagtaccaggaagtggaggaagaccaggatccttcatgtcctcggctttctcgggaacttctcgcggaaaaagaacctgaggtgttacaagattcattagatcggtggtactccacaccgtccgtgtacttgggcctgacagacccctgtcagccttaccggagtgcattttatgtcctagaacagcagagggtcggcctcgcggttgatatggacgagatcgaaaaataccaggaagtcgaagaggatcaggatccaagctgtccccgccttagccgggagctgcttgccgaaaaggagcctgaggtgctgcaagatagcctggatagatgttatagcacgccttctgggtatctggaactccccgacctcggacagccctataggtccgccgtgtactcgctggaagagcagtacctcgggctggcgctggatgtcgatcggatcaagaaggaccaggaggaggaggaggaccaaggacctccatgccccaggctaagcagggagctgctggaagtcgtcgagcccgaggttctgcaggactccctggacaggtgctattcaactccgtcttcatgcctggagcagcccgacagttgccagccttacaggagttccttttacgcgttggaggagaagcatgttggcttctccctggacgtgggcgagatcgaaaaaaaaggcaaaggcaagaaacggcggggtcggcggtccaagaagaagaggcggaggggccgaaaggagggcgaggaagaccaaaatcctccttgccccaggctctcacgggagcttctggctgaaaaagaacccgaggtattacaagattctctcgatcgctggtattctacgcctagcgtctatttgggactgacagacccttgccagccctatcgatccgctttttatgtgcttgaacagcagagggtgggcttagcagttgacatggacgagatcgagaaatatcaagaagtggaagaggaccaggatccctcctgtccgcgactctctagggagctgttggcggagaaggaaccagaagtcctgcaggactcactggacaggtggtactctacacctagtggatatctggagctccccgacctggggcagccgtataggtcagccgtgtattctctggaggagcagtatttgggcctagccctagacgtggaccggatcaaaaaagaccaagaggaggaagaagatcagggacctccatgccctcgcctttccagagagctacttgaggtcgtcgaacccgaagtgctgcaggacagcctcgaccggtgttactcgaccccgagcagttgcctcgaacaacccgattcctgtcagccctaccgctcctctttctatgccctggaagagaagcacgtcggtttctccctggatgtgggagagatcgagaagaaggggaaggggaaaaagagacggggtagaagatctaagaaaaagcgtcgccgtggtcgaaaggagggagaagaagatcaaaatcccccctgcccccggctgagcagagaattattagcagaaaaggaaccagaagtgctccaggacagcctagatcggtggtattctaccccctctgtctatttggggttgacagacccctgtcaaccctatcgctctgcattctatgtgttagagcaacaaagagtgggcctggcagtggatatggacgagattgaaaagtaccaggaagtggaagaagaccaggacccgagctgccccagactcagccgggagctgctggctgagaaggaacctgaagttctgcaggatagcctcgatcgctgttatagcacgcccagtggttatctcgaactgcccgatctgggccaaccataccggtccgccgtttacagcctcgaagaacagtacttgggcctggctctagacgtcgaccgcatcaagaaagatcaagaagaggaggaggaccaaggtcctccttgtcctcgattgagccgcgaactgctcgaagttgtggaacctgaagttttacaagacagcttagaccggtgttactcaaccccgtcttcatgtctggaacaacctgattcatgccagccttatcggtccagtttctacgctcttgaggagaagcacgtagggttctcgttagatgtgggtgaaattgaaaaaaagggcaagggtaagaagaggagagggcggaggtctaaaaaaaaaagaagaaggggcagaaaggagggggaggaagaccagaaccccccatgcccccggctgtcccgcgagcttcttgctgaaaaagaacctgaggtactgcaagattccctcgatcgttggtactccacaccaagcgtgtacctggggctcacagacccatgccagccatgtaggtccgccttttacgtattggagcaacaaagggtcgggcttgcagtggatatggacgagatagagaagtatcaagaagtcgaagaggaccaggatccctcctgtccaaggctcagtagagaactgctcgccgagaaggaacccgaggtcttgcaggactccctggatcgctgttacagtacccccagtggatacttggagcttccggacctcggacagccttaccggtcagcagtgtactctctcgaagagcagtatctgggactggcccttgatgttgacaggatcaaaaaggaccaggaggaagaggaagaccaggggccaccctgtccacggctgtctagggaactgctggaagtggtggagccagaagtactgcaagattccctcgaccgctgctactcgactccttcatcatgcctggagcagccggacagctgtcaaccatacaggagttcattttacgcactggaagagaagcatgtagggtttagcctggacgtaggggagatagaaaagaaaggcaaaggtaagaaaagaaggggaagacgcagcaaaaaaaaacggcgccgggggcgaaaagagggcgaagaggatcagaaccctccctgccctcgattgaactctgtgctgatggaagtcgaagagcccgaggtcctccaggacagtctggatcgctgctactccacaccttctatgtactttgagctgcctgattctttccagcattatcgctcggtgttttactcttttgaagaacaacatatcacatttgcactggacatggacaattctttcttcacactgaccgtcacgtctctgcacttggtatttcagatgggcgttatcttccctcagtag

SEQ ID NO: 196950 - DNA, 234 bp, Artificial Sequence
  Description of Artificial Sequence: Synthetic coding sequence
atggacgagatcgagaagtaccaggaggtggaggaggaccaggacccaagttgcccaagactatccagggaattgcttgccgaaaaagagcccgaggttctgcaggattctttggaccgctgctactcaacgccatcaggctacctggaactgcccgacctggggcagccttaccggtccgctgtctactcacttgaggagcagtacctgggcctcgctctggacgtggattag

SEQ ID NO: 196951 - DNA, 2517 bp, Artificial Sequence
  Description of Artificial Sequence: Synthetic coding sequence
atggtggtgagcgccggcccctggagcagcgagaaggccgagatgaatatcctggagataaacgagaaactaaggccccagctggcggaaaataaacagcagtttaggaacctaaaggaaaggtgtttcttgacacagctagctggatttctggctaacaggcagaagaagtataagtacgaggagtgtaaggacttgataaagtttatgctgcggaacgaacggcagttcaaggaagagaaattggccgaacagctgaaacaggctgaggaacttagacaatataaagtgcttgtgcattctcaagagcgggagctgactcagttgagggagaagctgcgagaaggccgggatgctagcagaagccttaatgagcatctacaagccttgctgacaccagacgagccagacaagtctcagggtcaagacctccaggagcaactggcggaaggatgtcgcctggcgcagcaactggtacaaaagttgagcccagaaaatgacgaggacgaggacgaggatgttcaagtagaggaggatgaaaaggttctggagagctcagcacctagagaggtccagaaagccgaagagagtaaggtgcccgaggacagcttggaggaatgtgccatcacttgttccaactcccacggcccatgcgactctaaccaaccccacaagaacatcaagatcactttcgaagaggacaaagtgaacagtagcctggtggttgacagagaatattctcatgatgaatgtcaggacgctttgaatattttgcccgtgcctggcccaacctcttcagccacgaacgtaagcatggttgtgagtgccgggcctctgtcctctgagaaggccgagatgaatatcttggaaatcaatgagaaactcaggccacagctggcagaaaaaaaacagcagtttcggtcgctcaaggaaaagtgtttcgtgacccaggtggcatgctttctggccaaacagcagaacaagtacaaatatgaggaatgcaaggacctgattaaaagtatgctgcggaacgaactccaattcaaggaggaaaagttggctgagcagctgaaacaggctgaagagctacgacagtataaagtgctggtgcatagtcaagagcgagaactgacccaactaagagaaaaactcagagagggtcgggacgcatcgcgcagcctgaatgagcacttgcaggcacttttgacccccgatgaacccgataaaagtcagggccaagacttgcaagaacaactggctgaggggtgtcgcctggcacagcacctggtgcagaagctttctccagagaacgacaatgacgatgatgaggacgttcaggtggaggtagcggagaaagttcagaaaagctcttcccctagagagatgcaaaaagctgaagagaaggaggtgcctgaggacagcttggaggaatgcgctatcacatgctccaatagccatgggccatacgactccaaccagccccaccgcaagccaaaatctcacctgcgcaaaaccaagagcacccagctgagcttggcccaccctctgatgttgaacgggcgcatgctatacactctgtcacagaaaatgaaggtcatgatgagaaagcgaaagaagaaagggcagtgcctcccaggcatttgtcggtcactgaagcggcgaaagtctcctcgctctccggggatgaaagtgattcgcctgtctcagttcctcttgaagggccatcggtgggatcaggtgaaaaaagaagatcaggaagccaccggcccccgcctgtccagagaactgttagctgagaaggaacccgaggtgctgcaggatagccttgacagatgctatagtacaccgtctgtttaccttgggcttacggactcgtgccagccctacaggagcgctttttacgtgttggaacagcagagggtcggcttggcagtggacatggacgagatagagaaataccaagaggtggaggaggaccaggatccctcctgtcccaggttgtcccgagaactgctggcagaaaaagagccggaggtgctccaagactcccttgacagatgctattcaacaccgtccggctaccttgagctgcctgacctgggccagccatatcgatcagccgtttacagtttggaggagcagtacttaggtcttgcgttggatgtggacagaatcaaaaaggaccaagaggaggaagaagatcaaggaccaccgtgccctcggctgagccgtgaacttctggaagtggtggaacctgaggtgctccaagatagcttggacgtaatacagcttctgccagttgtgctgaatagccttaccccagcttcgcctaccgaggtgcccttcatgcattggagaaaaaacatgctggcattcctcctcacatgggagaagctgaaacgaagaggaaggggcaggaaagaaggcgaggaagatcaacgccggaaggaggagggcgaggaaaaaaaaggtaaaaagatcaaaactcatcatgcccctgggtccactgcttgttag

SEQ ID NO: 196952 - DNA, 288 bp, Artificial Sequence
  Description of Artificial Sequence: Synthetic coding sequence
atcgccgagatcgagaagtaccaggaggtggaggaggaccaggaccctagctgtccaagactgtcccgcgagctcttagcggagaaggaacctgaagtgttacaggactcactggaccgctggtattccaccccctctgggtatttggaattgcccgacctcgggcagccctaccggagcgcagtttactccctggaggaacagtatctgggcttagctcttgatgtggacaaaattgaaaagtatcaagaagtcgaagaggaccaggatcctagctgccctaggtag

SEQ ID NO: 196953 - DNA, 234 bp, Artificial Sequence
  Description of Artificial Sequence: Synthetic coding sequence
atggacgagatcgagaagtaccaggaggtggaggaggaccaggacccaagctgtccaagactgtcgcgggagctcctggctgagaaggaaccagaggtattacaggactctttggatcggtgctactctaccccttccggctacttggaactccccgatttaggtcagccttatagaagcgccgtatattcacttgaggaacagtacctgggattggctctggatgtggattag

SEQ ID NO: 196954 - DNA, 2784 bp, Artificial Sequence
  Description of Artificial Sequence: Synthetic coding sequence
tgagacctgatcaagagcatgctgcggaacgagcggcagttcaaggaggaaaagctcgcggagcagttgaaacaagcagaggagctacggcagtataaggttctcgtgcacgcccaggagcgcgaactcacacagctcagagagaaattacgcgagggtcgcgacgccagccggtctttgaatgagcacttacaagccctcctgacacccgacgagcctgataaatcccaaggtcaggatctgcaagagcagctggccgaaggctgtcggttggcccaacatttggtgcagaagttgtctcccgaaaatgacaacgatgacgatgaggatgtgcaggtcgaggtggctgagaaagttcaaaaatcatcggcaccgagggaaatgcagaaggccgaggagaaagaggtgcccgaggattcacttgaagagtgtgcaatcacctgtagcaattcccacggcccttatgactcaaatcaaccacacaggaagacaaagattactttcgaggaagataaggtggactccacactcataggttcctccagtcatgtcgagtgggaggacgctgtgcatattatcccagagaatgagtcagacgatgaggaggaagaggagaaggggcctgtgagcccccgtaacctgcaggagtcagaagaggaagaagttccacaggaatcttgggatgaaggctactcaaccctgtctatccctccagagatgttagcgtcatacaaaagttactcatccacattccactcactggaggaacaacaggtgtgtatggcggtggacataggccgccatcgctgggaccaggtcaagaaggaggatcacgaagcaacaggacccaggctgagtagagagctgctcgacgagaagggaccggaggtgcttcaggattctttggaccggtgctactccacaccgtcgggatgcctggagctcactgatagctgccagccataccggtccgcattttatgttttagaacagcagagagtgggccttgcagttaatatggatgagatcgagaaataccaggaggtagaggaagaccaggatcctagctgccctaggctatcacgcgaactgctggacgagaaggagccagaagtattgcaagactcgctcggtaggtgctactctacaccgagtgggtatctggaactgcctgaccttggacagccatactctagcgctgtatactccctggaggaacaatacctgggattggcactggatgtcgaccgaataaagaaggaccaagaagaggaggaggaccaagggcccccatgtccacgattgagtcgggagcttttagaagttgtcgaacctgaggtgttgcaggattccctggacaggtgctacagcactccatccagttgtctcgagcagccggactcctgccagccatacggctcctccttttacgcactggaagaaaagcacgtcggcttctctcttgatgtaggagaaatcgagaagaaagggaaagggaaaaagaggcggggacggcgctctaaaaaagagcgccggaggggtcggaaggagggtgaagaagaccaaaaccctccctgcccccggctgtctcgcgagctcctggatgagaaggggcccgaagtgctacaagacagcctggatcgctgctattcaactccctctggatgcctggaattgacagattcatgccagccttatcgcagcgccttttatattctggagcaacagcgggtaggcctggcagtggacatggatgagatagagaaatatcaggaggttgaagaagatcaggaccccagttgcccaagattatcaggcgagctgctggacgagaaggaaccagaagtactgcaggaatcccttgataggtgttactctaccccctcaggctgccttgagctaacagacagctgccagccctacagatcagccttttacatactggaacaacaaagagtagggttagctgtcgacatggacgagatcgagaagtatcaagaggttgaggaggaccaggacccaagctgtcccaggctcagccgtgagcttctggacgagaaagaaccagaggtacttcaggactccctcggccgttgttacagcacgccctctggatatctagagttacctgacctgggccagccttactccagcgcagtctattcattggaagagcaatacctcggcctggctctagatgtggacaggatcaaaaaggatcaagaggaagaagaagaccaaggtccaccttgcccccgcctgagccgggagctgttggaggtggtcgaacctgaggtgctgcaagactccttagacagatgttactctaccccatcatcctgtctggagcagcccgacagttgccaaccgtacgggtcctctttttatgctctagaggagaagcatgtgggattttctctcgacgtgggggaaatcgaaaaaaagggtaaaggcaagaagaggcgcggccgtagaagcaagaaggagagaagacgcggtagaaaggaaggcgaggaggatcaaaacccaccatgtccacgccttaactctatgctcatggaggtggaggaacctgaggtcttacaggattctctcgatatttgttatagcacaccctctatgtattttgagctgcccgacagctttcagcactataggtccgtgttctatagtttcgaagaggaacacatatcctttgccctttacgtggataaccgcttctttactctcaccgtgacttctctccaccttgtgttccagatgggcgttatattccctcaatag

SEQ ID NO: 196955 - DNA, 2766 bp, Artificial Sequence
  Description of Artificial Sequence: Synthetic coding sequence
atgctgcggaacgagcggcagttcaaggaggagaagctggccgagcagttaaaacaggccgaggaattgcgccaatacaaggttcttgtccatgcccaggaacgagagctgacccagctgcgtgaaaagctgcgggagggccgcgatgcctcccgaagcctgaatgagcacttgcaagctctcttaactcccgacgagcctgacaaatctcaaggacaggaccttcaggagcaacttgctgagggttgtcgattagcccagcatttggtgcagaagctctcccccgagaacgacaatgatgatgatgaggacgttcaagttgaagtggctgaaaaggtgcagaaaagtagcgcacctcgggaaatgcagaaggccgaagagaaagaagttcctgaggatagcctggaggaatgcgctataacttgctctaactctcacgggccttatgattccaaccagccacaccggaagacaaaaatcacctttgaggaagataaggtggactcaacgcttatagggagcagtagtcatgtcgagtgggaggacgctgttcatatcattccagaaaacgagagtgacgatgaggaagaggaggaaaagggacctgtctctccaaggaacttgcaagagtctgaggaagaagaggtcccccaagaatcatgggacgagggctacagtactttatcaattccccccgaaatgctggcctcctacaaatcctacagcagcacatttcacagcttggaggaacagcaggtgtgcatggccgtcgatatagggagacatcggtgggatcaggttaagaaggaagatcatgaggccacaggaccccgactgtctagagaactactggacgaaaagggccctgaggttctgcaggatagtctggacagatgttattccactccatcggggtgcctggaactaaccgacagctgccaaccatatagatctgctttttacgtgttagaacagcaaagagttggactggccgttaatatggatgaaattgaaaagtaccaggaagtggaggaagaccaagatccgtcatgtccccgactgtcaagagaactgctggacgagaaagaacccgaggtcctgcaggattcgctcggccgctgttactcaactcccagcggttacctcgaactgcccgacttgggccaaccttattcaagcgccgtttactcccttgaggaacaatacctgggtctcgctctggacgtcgacagaattaaaaaggaccaagaagaggaagaggatcagggccctccctgtccacggctgagccgggagctgttggaagtagtggagcctgaagtactgcaagattcgctcgaccgttgttactcaactccatcctcatgcttggagcaacccgactcctgtcagccttatggatctagtttttatgcactcgaagaaaaacatgttggctttagcctagatgttggcgaaattgagaaaaagggcaagggcaagaagagacgggggcgacgctccaagaaggagcgaaggcgaggccgcaaagagggtgaagaagaccagaatcctccttgtccaaggctctctcgagaactccttgacgagaagggccccgaggtgctgcaggattccctggatcgctgttactccacaccgtctgggtgcctggaactgaccgactcttgtcaaccttaccgttctgccttctacatcctagaacaacagagggtgggcctggcagtggatatggatgaaatcgagaaataccaagaagtggaggaagaccaagaccccagctgtcctcggctctctggcgaactcttggacgaaaaagaaccggaggtgctgcaagagagtctggatcgctgctactcgacaccatcgggatgcctggaattaactgattcctgccaaccatacagatcagctttttacatcttggaacaacagagggtggggctcgccgtggatatggatgagatagagaagtaccaagaggtggaggaagatcaggacccctcctgtccccgtctcagcagggagctgctcgatgagaaagaacctgaggtgttgcaagattccctggggaggtgttacagcaccccaagtggttacctcgagcttcccgacctaggacagccatactcttccgcagtttatagtctagaagagcagtacctgggcctcgcactagacgtagacagaataaaaaaggaccaggaggaagaggaagaccagggccctccatgtccgcggttgtcccgcgagcttctggaagttgtcgaacccgaagtgctccaggattctctcgaccggtgttacagtactccttcctcttgcctggagcaacccgattcttgccaaccctatggctcctccttctatgcccttgaagagaaacacgtgggattcagcctagacgttggggaaattgaaaaaaaaggtaagggaaagaaaaggcgcggccggcgcagcaagaaggagcgccgcagaggtcggaaggagggagaggaagaccagaacccaccctgccccaggctgaatagcatgctgatggaagtggaagagccagaggtgctccaggatagcctcgatatctgctacagcacaccctcaatgtacttcgagctgccggattccttccagcactacaggagcgtcttctattcctttgaagaggagcatatttcgttcgccttgtatgtagacaacaggttctttaccctcacagtcacatccctccatctggtgttccagatgggagttatcttcccccagtag

SEQ ID NO: 196956 - DNA, 810 bp, Artificial Sequence
  Description of Artificial Sequence: Synthetic coding sequence
atggacgagatcgagaagtaccaggaggtggaggaggaccaggacccatcctgccctcgtctgtcgagggaactgcttgacgagaaggaacccgaagtgttacaggactctctgggtcgctgctacagcactccaagtgggtatctcgaactaccagatctgggacagccctattctagtgccgtgtattcactggaggagcagtatctgggcctagccctagacgtcgaccgtataaaaaaggaccaggaggaggaggaggaccagggcccaccatgtccccggctgtctcgcgagctccttgaggtcgttgagcctgaagtgttacaggacagccttgaccgttgctattcaaccccgagttcatgccttgagcagccagattcctgccaaccatacgggagctccttttacgcactggaggagaaacacgtaggattctcgctcgatgttggggagatcgagaagaagggaaagggcaagaagagacgaggcagacgttctaagaaagagcgccggcgaggacgcaaggagggggaagaagaccaaaatccaccctgtcccaggctgaattcaatgctgatggaagtcgaagagcccgaagtgctacaggatagcctagatatctgttattctaccccgtctatgtactttgagctcccagattcatttcaacattataggtccgttttctatagttttgaggaggaacatatatcatttgctctatacgtggacaacagattcttcactttaactgttaccagcctccacctggtctttcagatgggagtcatttttcctcagtag

SEQ ID NO: 196957 - DNA, 1539 bp, Artificial Sequence
  Description of Artificial Sequence: Synthetic coding sequence
tgatacgaggagtgcaaggacctgatcaagagcatgctgcggaacgagcgccaattcaaagaagaaaagctcgcagaacaactgaagcaagccgaggagctgcgccagtataaggtcttggtacacgcccaggaacgcgagttaacacagctccgggaaaaactgagggaggggcgggacgcctctcgaagcctcaatgaacaccttcaggccctcctgacgccagatgaaccagataagtcccaggggcaggacttacaggagcagcttgccgaggggtgtcggttagcccagcacctggtgcagaaactgagtcccgaaaatgataatgatgacgacgaggatgtacaagttgaagtggctgaaaaggttcagaagtcctcggccccacgcgaaatgcagaaagccgaagagaaggaagtgcccgaggattcactcgaggagtgcgcaattacctgctccaacagccacggaccttatgattctaaccagcctcacaggaagacaaaaatcaccttcgaggaagacaaggtcgattctacactgattggatcatcctctcacgtcgagtgggaagatgcggtgcatatcatcccggagaacgaatcggacgatgaggaagaagaggagaagggacccgtgagcccgagaaacctccaggagagcgaggaggaagaagtgccgcaggagtcctgggacgagggctactccactctgtctatccctcccgagatgctggcctcgtacaaaagctatagtagcactttccactctctagaggagcagcaagtatgtatggcggtcgacatcggccggcacagatgggatcaagtgaagaaagaggatcacgaggctaccggtccgagactgagccgcgagctcttggacgagaaaggcccggaggtcctacaggactcacttgaccgatgctatagcactccaagcggctgcttggaactgacagatagttgccagccatacagatccgccttctacgtcctagagcagcagcgggtgggcctcgccgtgaacatggatgaaatcgaaaagtaccaggaggtagaggaagatcaggacccctcttgtccgcggctgtcccgcgaacttctcgacgagaaagaacctgaagtgcttcaggatagtctgggacgatgctactccacaccctccgggtatctggagttacccgacctaggtcagccctattctagcgccgtgtacagtctagaagagcagtatttgggactcgcacttgatgtggatagaattaagaaggatcaggaagaggaggaggaccagggccccccttgccctagactctctcgggaactgctggaagtcgtggaacccgaggtcttacaggattcccttgatagatgttatagcacccccagttcatgcttggagcagcccgacagctgtcagccatatggcagctcattctacgcccttgaggagaagcatgtaggattttcactggacgtaggtgagattgaaaaaaaaggcaaaggcaaaaaacggcgcggccgacggtcttag

SEQ ID NO: 196958 - DNA, 567 bp, Artificial Sequence
  Description of Artificial Sequence: Synthetic coding sequence
atggacgagatcgagaagtaccaggaggtggaggaggaccaggacccgagttgccccagactaagccgcgaactgctcgatgaaaaggagccggaggtcctccaagactcactcggacggtgttattcgactccctcaggttatctcgaactccctgatcttgggcagccatacagctcggcggtctattctctggaagagcagtacctcgggctcgccctggacgtggatcggattaaaaaagatcaggaagaagaggaagaccaggggccaccctgtcctcggctgagtcgcgaactcttagaagtggtggagcccgaagtgctgcaagattctctggataggtgctattctaccccttcaagctgtctcgagcagccggactcgtgccagccctacgggagcagtttctatgctctggaggaaaaacatgtaggcttttcactggatgtgggcgagatcgagaagaagggaaagggcaagaagcggagaggaaggagatccaagaaagagcgcaggcgtgggaggaaggagggagaagaggatcaaaatcccccttgtccttag

SEQ ID NO: 196959 - DNA, 1539 bp, Artificial Sequence
  Description of Artificial Sequence: Synthetic coding sequence
tgatacgaggagtgcaaggacctgatcaagagcatgctgcggaacgagcgacaattcaaagaagaaaagcttgcagagcaactcaagcaggctgaggagctcagacagtacaaggtcttggtgcacgcacaagagcgtgaactcacacaactccgagaaaagctccgggagggcagagacgctagtcgttccctgaatgagcacctgcaggccctgctcactcctgacgagccagacaagtcgcaaggccaggatctccaggagcaactcgcagaaggttgcagactggctcagcacctcgttcaaaagctctcacccgaaaatgacaacgatgatgacgaagatgtgcaggtggaagtggccgagaaggttcagaagtcttctgcaccacgtgaaatgcaaaaagccgaggagaaggaggtgccggaagattccttggaggaatgcgccatcacctgcagcaactcccatgggccatacgattccaatcaaccacatcgcaagaccaaaattacgtttgaagaagataaagtggatagcaccctcattggctcatcctcccatgtggagtgggaggacgccgtccacattattcccgagaatgagagtgacgacgaagaggaagaagagaagggacctgtctcacccaggaatttgcaagaatcggaggaggaggaagtgccacaagagtcctgggatgagggctactccaccctttccattccccccgagatgctggcaagttataagagttactcatctacattccattcccttgaggaacagcaggtttgtatggcagtcgatatcggtcgccataggtgggatcaggtaaagaaagaagatcacgaggcaaccgggccacgcctttcccgggagctgctcgatgaaaaaggtccggaggttctgcaggattcacttgaccgatgttacagtacaccatcagggtgtctggaactcactgactcctgccagccctatcggtcagccttttatgtgctggaacaacaaagggtaggactagccgttaatatggatgagatcgagaaatatcaggaggtggaggaggatcaagacccatcgtgtccccgcttaagcagagagctcttggacgaaaaagagcctgaggtcctgcaggactctttagggcgatgctacagtacccccagcggttatcttgagttgccagatctgggtcaaccttattcgtctgctgtgtactccttagaggaacagtatctgggcctggcgttagatgtggacaggattaaaaaggaccaagaagaagaggaggaccagggaccaccatgtccacggttatcccgagaactcctggaagtggtggaacctgaggtgttgcaggattctctggatcgatgctactccactcctagcagctgtcttgaacaaccagattcttgccaaccatacggttccagcttctacgctctggaagagaagcacgtaggatttagtctggatgtcggtgagattgaaaagaaaggcaagggcaaaaagcgccggggcagaaggtcttag

SEQ ID NO: 196960 - DNA, 1539 bp, Artificial Sequence
  Description of Artificial Sequence: Synthetic coding sequence
tgatacgaggagtgcaaggacctgatcaagagcatgctgcggaacgaacgtcaattcaaagaggaaaaattggcagaacagcttaaacaagctgaggagctcaggcagtacaaggtgctggttcacgctcaggaacgcgaactcacacagctgcgggaaaagctaagggaaggccgagatgccagccggtctctgaacgaacacttgcaggccctgctcacccccgacgagcccgataagtctcagggccaagacctgcaggagcagctggccgaagggtgccgcctcgctcaacaccttgttcagaaattgagcccggagaatgacaacgatgatgacgaagatgttcaagtggaggtcgctgagaaggttcaaaaaagctcggctccccgtgaaatgcagaaggcagaggagaaggaggtgccagaagacagcctggaagagtgcgctattacctgcagcaacagccatggaccctacgattccaaccagcctcaccgcaaaaccaagatcacttttgaagaggacaaggttgacagcacgcttatcggctcctcaagtcacgtggaatgggaggatgcagtgcacattatacctgagaacgagagcgatgacgaagaggaagaagagaagggaccagtgtccccaagaaacctgcaggaatcagaggaagaagaggtgccccaagagagctgggatgaggggtacagcacattgtcgattccacctgagatgcttgccagttacaaaagctactcatctacctttcattctttagaggaacaacaggtctgtatggctgttgacatcggtagacaccgctgggatcaggttaaaaaggaggaccacgaggctacaggcccccgactgagccgggagttattagatgaaaaaggacccgaggtcctgcaggacagtctggatcgctgctactcaactccctcaggatgccttgagttgacagatagttgtcagccttacaggtctgctttctatgtcctcgagcagcaacgggtagggttggctgtgaatatggatgagattgaaaagtatcaggaggtggaagaagaccaggatccctcgtgtccaaggctgtctcgcgagctcctggatgagaaggagccagaggtgctccaagacagcctgggacggtgctactccacacctagcgggtatttggagttgcctgaccttggacagccatattccagtgccgtatatagcctggaggagcagtacctgggcctggctctggacgtggacagaatcaaaaaggaccaggaggaagaggaagaccagggcccaccctgccctaggctttcacgagaattactggaagtggtggagcccgaagtactccaagacagcttggatcgctgctacagcaccccttcaagctgcttggaacagcctgacagctgccagccgtacgggtcttcgttttacgccctggaggaaaagcacgtgggattttctctggacgtgggggagatcgagaagaagggcaagggcaagaaacggcggggccgccggtcttag

SEQ ID NO: 196961 - DNA, 753 bp, Artificial Sequence
  Description of Artificial Sequence: Synthetic coding sequence
gagatcgagaagtaccaggaggtggaggaggaccaggaccccagctgcccccgactgtctcgcgaactgttagacgagaaggagcccgaagtccttcaggatagtttgggtaggtgttattccacaccaagtggctatttagaattgccagatctcggccagccatattctagtgccgtttactccctggaagaacaataccttggccttgccttagacgtggataggattaaaaaagaccaggaggaagaggaggaccaaggcccaccgtgccctagacttagtcgcgaattgctggaggtcgttgaacctgaagtgctccaagatagcttggaccgctgctattcaactcctagctcctgtctggaacagcctgacagttgtcagccatacggtagcagtttttatgcactggaggagaagcacgtcggtttctctttggatgttggggagattgaaaagaagggaaaaggaaaaaagagacggggccgccgcagcaaaaaggaaaggaggcgaggcaggaaggagggcgaagaggatcaaaatcctccctgccccagattgagcggtgagctcctggacgagaaagagcccgaggtgcttcaagagtcgctggaccgctgctatagcaccccaagcggctgcctagagctaacagactcttgtcaaccctaccgctcagctttctacattctggagcagcaaagggtgggcttggctgtggatatggacggggagtatcttagcatgtag

SEQ ID NO: 196962 - DNA, 1539 bp, Artificial Sequence
  Description of Artificial Sequence: Synthetic coding sequence
tgatacgaggagtgcaaggacctgatcaagagcatgctgcggaacgaaaggcaattcaaggaggaaaagctcgccgaacaactcaaacaggctgaggagctgcgtcagtacaaagttttggtgcacgcccaggaacgcgaattgacccaactgcgtgaaaagcttagagaggggcgcgacgcctcccggagtctgaatgaacaccttcaggccctgctcacaccagacgagccagataaaagtcagggccaagacctgcaggagcagctggccgagggatgccgtctggcccagcatctggtccagaagttatcgcccgaaaatgataatgatgatgacgaggatgtccaagtggaagtggctgagaaagtgcagaaatccagcgctccacgagaaatgcagaaggccgaggaaaaagaagtgcctgaggattctcttgaagaatgcgccattacgtgtagtaattcgcatggcccatatgatagtaatcagcctcaccgaaagaccaagatcacatttgaggaagacaaagttgacagcacactcatcggctcttcctctcacgtggagtgggaggacgctgtgcatattattcccgaaaacgaaagcgacgatgaagaggaagaggaaaaggggccagtgagtcccaggaatctgcaggagagcgaagaagaagaggtccctcaggagtcatgggatgaagggtactccactctttccatcccccctgagatgttagctagctataagtcctatagcagtaccttccactcactggaagaacagcaggtctgtatggccgtggatatcgggcgccatcgctgggatcaggtgaaaaaagaggatcatgaagctaccggacccagactgagccgggaacttctggacgagaaaggtccggaggtactgcaggactccctagataggtgttatagtacaccctcaggatgtctagagctgaccgactcctgccagccttataggtccgccttctatgtactggaacaacagcgcgtaggcctcgcagttaatatggatgagattgaaaaatatcaggaggtggaggaggaccaggaccctagctgccctcgcttgtcccgggagttgctggatgaaaaggagcccgaagtgttgcaagattcccttggccgctgctactccactcccagtggatatctggagctgcccgacctggggcaaccttactcaagcgcagtctacagtcttgaggagcagtatctcggcctggccctggacgtggatcgcatcaagaaggaccaggaagaggaggaggatcaaggaccaccttgcccgcgcctctctcgggagctgttggaagtggtggagcctgaggtgcttcaggacagtctggaccgctgctatagtaccccttccagctgcttggagcaacctgacagctgccagccctatgggtcgagtttctatgccttggaggaaaagcacgttggtttctccctggacgtcggggaaatagagaaaaagggtaaaggtaagaagcgaagaggacggcgatcctag

SEQ ID NO: 196963 - DNA, 1539 bp, Artificial Sequence
  Description of Artificial Sequence: Synthetic coding sequence
tgatacgaggagtgcaaggacctgatcaagagcatgctgcggaacgaaagacaattcaaggaagagaagctagcagaacaattgaaacaagccgaggagctaagacagtataaagtgcttgtgcacgctcaggaacgcgagctcacccagctgagagaaaaactgcgcgaggggagagacgcatctcggagcctcaacgagcatctgcaggctttactgactccagacgaacctgataagtctcaagggcaggatctgcaggagcagctcgccgagggttgtcgcctcgcgcaacacctggtgcagaaactgtccccagagaacgataatgatgacgatgaagatgtgcaggtggaagtcgcagagaaggtgcagaagtcctctgccccccgggagatgcagaaagcagaagagaaagaagtgcctgaagatagcctcgaggagtgtgccatcacctgttctaactcccacgggccctatgattcaaaccagccccacagaaaaacgaagataacctttgaggaggataaggtggattccacactgattgggagcagctcacacgtggagtgggaagatgctgtgcacatcataccggaaaatgagagcgacgacgaagaggaggaggagaaggggcccgtctcaccgcgcaatctgcaggagagcgaagaagaggaagtccctcaggaatcctgggatgaaggttatagcaccctctctattccaccggagatgctggcatcctataaatcctattcttccacttttcactcactggaagagcagcaggtctgtatggccgtagacatcggccgacacaggtgggatcaagttaagaaggaagatcacgaagcaacgggccccagactgtctagagagctgctagacgaaaaaggcccagaggtgctgcaggactctctggacaggtgctactctaccccctctgggtgcctggagttgacggattcttgtcagccatacagatccgccttctacgttctcgagcagcagcgtgtgggcctcgcagtcaacatggacgaaattgaaaagtaccaggaggtggaggaagaccaggacccatcatgtcctcggctgtcccgagagctcttagacgagaaagagccagaggtcctgcaagattccttagggaggtgctactccaccccctctggctacttggagctgccagaccttggccagccatacagttctgctgtatatagcttggaagaacagtatttaggccttgcactggacgtcgacagaatcaagaaggatcaggaggaagaagaagatcaggggcccccttgccctaggctgtcccgagaactcctggaggtggtggagccagaggtgctgcaagactcattagacaggtgttatagcactcccagctcttgccttgaacagcccgacagctgtcagccatatggctcttctttctacgccctcgaagagaagcacgtaggtttttccctggatgttggggaaatagaaaagaaaggtaaaggtaaaaaacgccgtggccgccggtcctag

SEQ ID NO: 196964 - DNA, 1539 bp, Artificial Sequence
  Description of Artificial Sequence: Synthetic coding sequence
tgatacgaggagtgcaaggacctgatcaagagcatgctgcggaacgagagacaatttaaagaggaaaagttagctgaacagctgaaacaggcagaagagctgagacagtacaaggtgctggttcacgcccaggaacgcgagctgacacaattgcgggagaagctgcgggaggggcgggatgcctctcggagcctcaatgaacacctgcaggctctgttgacaccagatgaacccgataaatcacaaggtcaggatctgcaggaacagttagcagagggctgtcggctggctcagcacctggttcagaagttatctcccgagaatgataatgacgatgatgaagatgtgcaagtggaggtcgcggagaaagttcagaagtcctctgccccacgggaaatgcagaaagcagaagaaaaagaagtccccgaggatagtctcgaggagtgtgccattacatgtagcaactcgcacgggccctatgattcaaaccagccacatcgcaagacgaagattaccttcgaggaagacaaagtcgatagtactctgataggaagcagctcacacgtcgaatgggaggatgcagttcacatcattcccgaaaatgagtccgacgatgaagaagaggaggagaagggcccggtgtccccacgaaatctgcaggagtctgaagaggaggaagtgccccaggaaagttgggatgaggggtacagtacgctgagcatcccacccgaaatgctagccagctataagtcatactcgtctacattccacagtctggaggagcaacaggtttgtatggcggtggatattgggcggcacagatgggaccaggtgaaaaaagaagaccacgaagcaaccgggccaaggctgtctcgtgagctgctcgatgagaaagggcctgaggtgctccaggactcacttgatcgctgctatagtacccccagtggctgtttagaactgactgattcctgtcagccatacagatcagcattttacgtgctcgagcagcagcgagtgggcctggccgttaatatggatgaaatcgaaaagtatcaggaagtggaagaggaccaagatcccagctgcccccggctctccagagagctgctggatgagaaggagcccgaggttctccaggactccctgggtagatgctactcaactcccagtgggtatctggagctccccgacttgggtcagccctatagctccgcggtctacagtctcgaagagcagtacctgggtctggctctggatgtggacagaataaaaaaagatcaggaagaagaagaggaccaggggccgccatgcccacgtctctctcgggagctgctggaagtcgtggagcctgaggtacttcaggactcgctggaccgctgttatagtaccccttcttcttgcctcgaacagccagatagctgccagccatacggttcaagtttctacgcgctggaagaaaaacacgtgggcttttctctggatgtgggcgagattgagaagaaagggaaaggaaaaaaacgccggggacggcggagctag

SEQ ID NO: 196965 - DNA, 1539 bp, Artificial Sequence
  Description of Artificial Sequence: Synthetic coding sequence
tgatacgaggagtgcaaggacctgatcaagagcatgctgcggaacgagcggcagttcaaagaggagaagcttgcggagcagttgaaacaggccgaggagctccggcagtataaggtgttggtgcacgcacaggagcgggagctgactcagctgagggaaaagctccgtgaaggccgagacgcctccagatcactaaacgaacacctacaggctctactcactccagacgaacccgacaaatcccagggccaggatctccaggagcagttggctgaggggtgccggctagcacagcacctggtgcagaaactgagcccagagaacgacaacgacgacgacgaggatgtgcaggtcgaagtggccgagaaggtgcaaaagtcttcggcaccccgcgagatgcagaaggccgaggagaaagaagtccccgaggactccttggaggagtgtgccataacatgttccaattcccacggaccgtatgacagtaatcaacctcacagaaagacgaagatcacctttgaagaggataaggtggacagcactctgatcggttcctcaagccatgtcgagtgggaagacgccgtccatataattcctgaaaatgaaagcgacgacgaggaggaagaggaaaaaggccccgtgtcccctcgcaatcttcaggaatctgaggaggaggaagtaccccaggagtcctgggatgaagggtatagcacacttagtatccctccagaaatgttggctagctataaatcctacagctccactttccacagcctggaggaacaacaggtgtgtatggccgtggacattggacgtcacagatgggaccaggtgaagaaggaagaccatgaagctactgggccgagattgtccagagaactgcttgatgaaaaagggccagaagtgctacaggactccctggaccggtgctacagcacacccagcggctgtctggagctgaccgatagttgccagccctatcgctcagcattttacgtcctcgagcagcagagggttgggctggccgtgaacatggacgaaatcgaaaaatatcaggaagtagaggaagaccaggatccctcatgtccacggctgtccagggagctcctggatgaaaaggaaccggaagttctgcaagatagtttgggcagatgttactcgactcccagtggatatctagagttgcccgacttgggccaaccgtactcgtcagctgtatatagtctggaagagcagtaccttggtctggcgctggacgtagatcgtatcaaaaaggaccaagaggaagaagaagatcaaggacccccttgtccacgtttatccagagaactcttggaggtggtggaacctgaggttctgcaagattcgctggaccgttgttactcaacacctagtagctgcctagaacagcccgactcttgccagccatatggttcgagcttctatgctctcgaggaaaaacatgtaggcttctctctggacgtgggggaaatcgagaagaaaggcaagggcaaaaagagacggggcaggagaagttag

SEQ ID NO: 196966 - DNA, 2013 bp, Artificial Sequence
  Description of Artificial Sequence: Synthetic coding sequence
atggtggtgagcgccggccccctgagcagcgagaaggccgagatgaacatcctggagatcaatgagaaacttcgacctcagttggctgagaagaagcaacagttccggaatctgaaggagaaatgctttttgacacaattagccggttttctagccaaccgccagaagaagtacaaatacgaagaatgcaaggatctgatcaagttcatgctgagaaacgaacgtcagttcaaggaagaaaagctggccgaacagctcaaacaggccgaggagctccggcagtacaaggtgttagtgcatgcccaggagcgagagctgacccagctccgtgagaaattaagggagggccgggacgcttctcgcagtctgaacgaacacttgcaagccctcctgacacctgatgagcccgataagtctcagggacaggatttgcaagagcagctggcagaggggtgtcgcctaacccaacacttagtgcaaaagctgtcacccgagaatgacaacgatgacgacgaggatgttcaagtggaggtggcagagaaagttcagaaatcctcagctcctagggaaatgcagaaagccgaggaaaaagaagtccccgaggatagcttggaagaatgtgctattacttgttcaaatagtcacggcccctacgactccaatcaacctcataaaaagacgaagattacgtttgaggaggataaggtggactccaccttgatcgggagcagcagccatgtcgagtgggaggacgccgtccacattattccagaaaatgagagcgacgatgaggaggaagaagagaagggcccagtatcgccccgcaacctccaggagtctgaggaagaggaggtcccgcaagaatcttgggatgagggctattccacgctgtccattccccccgagatgctcgccagctaccagagctattcttctactttccactccctggaagaacagcaggtgtgcatggccgtagacatcgggaggcatagatgggatcaggtgaaaaaagaagaccaggaggctacaggtccccggttgtctagggagctgctggacgagaaggagccagaagtcctgcaagactcgcttgatagatgttattctaccccttctggttgcttagagctcaccgactcctgtcaaccatataggagcgctttctacgtgctcgaacagcagcgagtcgggctcgcgatcgacatggatgaaattgagaaatatcaagaagtagaggaagaccaggatccaagttgcccgaggctgagtagggagctgcttgacgagaaggaacctgaagtgctgcaggattcattggatcggtgttactctactccaagcgattacctggaacttcccgacctgggtcagccttattcaagtgccgtgtactcattggaagagcagtatcttggcctggctttggacgtcgacagaattaagaaagaccaggaagaagaggaggatcaggggccaccttgtcctcggctatctcgagaactcctggaggtagttgagccagaagtgttgcaggacagcctggatcgctgttatagcaccccgtcttcatgcctggagcagcccgacagctgccagccatatggatcctcattttacgcactcgaggaaaaacacgttgggttcagcctggatgttggcgaaatcgaaaagaaagggaaaggcaagaagcgccgcgggagacgttcgaaaaagaagaggagaagaggtcgcaaggagggtgaagacgataatcccccctgcccaagactgtacggggttctcatggaggtggaggagcccgaggtgctgcaggattccctggatcgctgctactccaccccttctatgtatttcgagcaaccagattctttccagcattacagatccgttttttactcattcgaggaggagcatatttccttcgctctctacgtagacaatagattttttacactgaccgtaacatccctgcacctcgtcttccagatgggcgtgatattccctcaatag

SEQ ID NO: 196967 - DNA, 2013 bp, Artificial Sequence
  Description of Artificial Sequence: Synthetic coding sequence
atggtggtgagcgccggccccctgagcagcgagaaggccgagatgaatattctggagattaatgaaaagctgcgtccccagctcgcagagaaaaagcagcagttcaggaaccttaaggaaaagtgttttcttacccagcttgctgggttcctggcgaataggcagaagaaatataagtatgaagaatgtaaagacctgatcaagtttatgctgaggaacgagcgccagttcaaggaggaaaagctggctgaacaactgaaacaggcggaggagctccggcaatacaaggtgctggtccacgcccaggagagggagttgacacagctccgggagaagttgcgggaaggacgggatgcgtcacgtagcctgaacgaacatctgcaggctctgctcacccccgatgaacccgataaaagtcaggggcaggatttacaagaacaacttgctgagggatgccgcctcacccaacatctcgtgcagaaactttcgccagagaatgacaatgacgatgacgaggacgtccaggtggaagttgctgaaaaggtacagaagtcgagtgctcctcgagaaatgcagaaagccgaagagaaggaggtgccagaagattctctggaggagtgtgcaataacctgctcaaattcacatggaccatacgatagcaatcagccacataaaaaaactaagatcacgtttgaggaggacaaagtcgatagcaccctgattggctcaagcagtcatgttgagtgggaggatgctgtccacattattccagagaatgaaagcgacgacgaggaggaggaagagaagggcccagtcagccccagaaacctgcaggagagtgaagaggaggaggtaccacaggagtcatgggatgagggctatagcactctgagcatccccccagaaatgctggcatcttaccagagttactcatctacatttcattcgctcgaggaacagcaagtttgcatggctgtagacattggtaggcacagatgggatcaggtcaagaaggaggaccaggaggctacaggaccacgtctgtcacgcgaactcctggacgagaaagaacctgaggtcctgcaggattcactggatcgctgctactcaactccatcaggctgcctggaactgacagactcttgtcagccatatagaagcgcattttatgttctggagcagcagagagtcggtctggccattgatatggatgaaattgagaaataccaggaagtcgaggaggatcaggacccgtcatgcccaaggcttagccgggaactcctcgatgaaaaggagccagaggtcctccaggatagtctcgacaggtgctactcaactccgtctgactacctggaactcccggatctcggccaaccctacagctccgcagtctactctctggaagagcagtacttgggcctggcactggacgtcgacaggataaagaaggatcaggaggaggaggaggatcagggacctccttgtccccgactcagtagagagctgcttgaggtggtagaacccgaagtgcttcaggacagtctcgacaggtgttactccacaccttcatcctgccttgagcaacctgactcctgccagccctatggaagcagtttttatgcgctggaagaaaagcacgtggggttttcattggatgtgggtgagattgagaaaaaaggaaagggcaagaagagacggggcagacggtcaaaaaaaaagcgccgtcggggccgaaaggagggggaagacgacaatccaccatgcccacggctgtatggggttctgatggaagtcgaagaacccgaggtcctgcaggactctctagacagatgctattctacccccagcatgtacttcgagcaaccggacagttttcaacactaccggagtgtattctattcctttgaggaggagcatatttccttcgcattgtatgtggataacagatttttcacccttaccgtcaccagtctacacctggtattccagatgggcgtcatattcccccagtag

SEQ ID NO: 196968 - DNA, 2013 bp, Artificial Sequence
  Description of Artificial Sequence: Synthetic coding sequence
atggtggtgagcgccggccccctgagcagcgagaaggccgagatgaacatactcgagatcaacgaaaaattgagacctcagcttgctgagaagaagcagcagttcaggaatctgaaggaaaaatgttttctgacgcagctcgccggatttctagcaaacaggcagaagaaatataagtacgaagaatgtaaggatctgatcaaatttatgctcagaaacgagaggcagtttaaggaggagaagcttgccgagcagctgaaacaagcggaggaactgcgacaatataaggtgctggttcatgcccaggagcgtgagctcacacagttgagagaaaagctgagagaaggtcgggatgcctcgcggagccttaacgaacatttgcaagcactgctaaccccagatgagcctgacaagtcccagggccaggatttgcaagagcagttggcggagggatgtcggctcacacagcacctcgtgcagaaactgtccccagaaaatgataatgacgatgatgaggacgtgcaggtagaggtggccgagaaagtgcaaaaaagcagcgcccctcgagagatgcagaaagctgaggagaaagaggtccctgaagattctctggaggaatgcgctatcacctgctccaactcccatgggccttatgactctaatcagcctcacaaaaagactaagataacattcgaggaagacaaggttgatagcacactcatcggcagtagctcccacgtggagtgggaagatgcggtgcatatcattcctgaaaatgagagcgacgacgaagaggaggaagaaaagggtcctgtgtcccctaggaatctgcaggagtccgaggaagaagaagtccctcaggagtcctgggacgagggttactccacactgtctattccgcccgagatgctggcctcctaccagtcatacagctcgaccttccactctttggaggagcaacaagtttgtatggctgttgacatagggcggcataggtgggatcaggtgaaaaaggaagatcaagaagcgacaggcccccggctgagccgtgagctgttagatgaaaaagagcccgaggtcctgcaggactctctggaccggtgctattctacgccttcgggatgcttggagctaacagattcttgccaaccatataggagcgccttctacgtactggagcagcaacgggtcgggttagccatcgatatggacgaaattgaaaagtaccaagaggttgaagaagaccaggacccctcatgtccccgtctaagtcgtgagctgcttgatgagaaggaacccgaggtactgcaggacagcctggataggtgctattcgactcctagtgactatctggaactgccggatctgggacagccatattcttctgccgtttactccctcgaagagcagtatctgggtttggccctggacgtggacaggatcaagaaagaccaggaagaggaagaagatcagggcccgccgtgtccacgattgtcccgagaattacttgaggtggtagaacctgaagtgttgcaggattcactagatcggtactacagtactcctagttcgtgcctggaacagcccgatagttgtcaaccgtatggaagttcattctacgctctcgaggaaaaacatgtgggattctcattagacgtgggagagattgagaagaaagggaaaggcaagaagagacgtggccgtcgatctaaaaaaaagaggagaaggggcagaaaggaaggagaggacgacaatcccccgtgccccaggctgaacggggtgctgatggaagtggaggagccagaggtgctccaggactctctagatcggtgctactctacccagagcatgtatttcgagctacccgacagctttcagcattatagatctgtcttttacagtttcgaagaggagcacatcagctttgcactgtatgtcgacaataggtttttcaccttgaccgtcacgagtctgcacctggtcttccagatgggcgtgatcttcccacagtag

SEQ ID NO: 196969 - DNA, 2013 bp, Artificial Sequence
  Description of Artificial Sequence: Synthetic coding sequence
atggtggtgagcgccggccccctgagcagcgagaaggccgagatgaacatccttgagattaatgagaaattaaggccgcagttagccgaaaagaagcagcagtttagaaatctaaaggagaagtgtttcctgactcagctggccggatttctcgctaaccggcagaagaagtataaatatgaagagtgtaaagatctgataaagtttatgctgcgcaatgaaaggcagtttaaggaggaaaagttggccgagcagctgaagcaggccgaagagttacgtcaatacaaagtgctggttcacgctcaggagagagaactgactcagctgagggagaaattgagggaaggccgggatgcctctcgctccctgaatgaacatctacaggccctgttgacgcccgatgaaccagacaagtctcagggtcaagatttgcaggaacagctcgctgaggggtgccgcctgacccagcacttggtccaaaagttgtcacccgaaaatgacaatgacgatgacgaagacgtacaggtggaggtggcagagaaagtgcaaaagtcaagcgcacctcgcgagatgcagaaagccgaggaaaaggaagtgcctgaggattccttggaggagtgcgccatcacctgctccaactcgcacggtccttatgactctaaccagcctcacaaaaagacaaagatcacattcgaagaggataaggtggactctactctcatcgggagctcttctcatgtggagtgggaggatgccgtgcacattatcccagagaatgagtccgacgatgaggaggaggaggagaagggccctgtgagtccccgcaacttacaggagagcgaagaggaggaggtcccccaggagagttgggacgagggctattccacactcagtatccccccggaaatgctcgccagctaccagtcctattcatctacgttccacagcctcgaggagcagcaggtatgcatggccgttgacatcggtcgacaccggtgggaccaggtgaagaaagaggatcaagaagccactggcccacgcctgtcacgggagttactcgacgagaaagagcccgaggtgttgcaggatagtcttgataggtgttactcaacgccctccgggtgtctggagttgacggactcttgccaaccatacaggagcgcattttacgttctagagcagcagagggtggggctggctattgatatggacgagatcgaaaagtatcaagaggtggaggaggatcaggatccttcatgccccagactcagtagagagctactagatgaaaaggagcctgaagtcttgcaggactcactggaccgctgctacagtacgcctagcgattatctcgagctgccggacttagggcagccttactccagtgccgtgtacagtctggaggagcaatatctcggcctggctctagatgtcgacagaatcaaaaaggatcaagaagaagaagaggaccagggtccgccatgcccgcggttaagcagagaactgctggaggtagtcgaacccgaggtattgcaagactctctggaccgttactattcaaccccatcctcctgccttgaacagccagactcatgccagccttacggttctagtttttacgctctggaggagaaacacgtgggattcagccttgatgtgggggagatcgagaagaaaggcaaagggaaaaagaggagggggcggaggagtaaaaagaagagaagacgcggcaggaaagaaggcgaggacgacaatccaccttgccctcgcctcaacggcgttctgatggaggtggaggagcctgaggttctccaagacagcttagacaggtgttactctacccagtccatgtattttgaattgccggattcgttccagcactataggtctgtgttctatagcttcgaggaagagcacatctccttcgccctctatgtggataatcggttcttcacgctaaccgtgacgtccctgcacttggttttccagatgggagttatcttccctcaatag

SEQ ID NO: 196970 - DNA, 2526 bp, Artificial Sequence
  Description of Artificial Sequence: Synthetic coding sequence
atggtggtgagcgccggcccctggagcagcgagaaggccgagatgaacatcctggaaattaacgaaaaactgagacctcaactcgccgaaaacaaacagcaatttggtaacctcaaagaacggtgctttgttacccagctggctggattcctcgccaatcagcaaaagaagtataactatgaggagtgtaaagacctgatcaaatttatgctacgaaatgagcgacagttcaaagaggaaaaactcgccgaacagctgaaacaggccgaggaactgcgacagtacaaagtgttagtgcattctcaggaaagagagctgactcagctgagggagaagctcagggaaggcagagacgcctccaggtctctgaacgagcacttgcaagcgcttcttactctggatgaacccgacaagtcccaaggtcaggatttgcaggaacagttggccgaaggatgccgacttgcccagcacttggtccaaaagctgtcccccgagaatgacgaagatgaggatgaagacgtacaggtcgaagaagcagagaaggttcaaaagtcatccgcacccagggaggtccagaagacggaagaatccaaagttcccgaggacagcctggaagagtgtgctattacctgctctaacagtcacggcccttgtgattccaaccagccacataagaacataaagattacatttgaggaagacgaagtaaatagcacgctcgtggttgaccgtgaatcttcccatgacgaatgccaggatgcccttaacatccttccggttccaggacctacaagctccgcaaccaatgtatccatggtagttagtgcaggccctctctcatccgagaaggccgagatgaacattctggaaatcaacgagaagctccacccgcagctcgccgaaaaaaaacagcagttccgcaatctcaaggagaggtgctttgtcacacagctggctggcttcttggctaaccagcagaagaaatataagtacgaagagtgtaaagatctgattaagtcaatgctgagaaatgaacgacagtttaaggaggagaaactggccgagcaactgaagcaagccgaagaactccgacagtataaagttctggttcatgcccaggaaagggagctcacacagctgagggagaaactgcgcgagggcagggacgcttcccggtcactgaacgaacatctgcaggccctcctcactcccgacgaaccggataaatcccaggggcaggaccttcaggaacaactagctgagggctgtaggctggcccagcatttagtccagaagctgagtcccgaaaatgacaacgacgacgatgaggatgttcaggtcgagttagcagaaaaagtccagaagtccagcgccccgagagaaatgcagaaggccgaggagaaggaggtgcccgaggactcgcaagaggagtgtgcaatcacgtactccaatagccatggtccttatgattcaaaccaaccgcaccgcaaaacaaaaattacgtttgaggaagacaaagtggactctacattaattgggtccagtagccacgtcgaatgggaagatgctgtccatataattcctgaaaacgagagcgatgatgaggaggaagaggagaagggacctgttagtcctaggaatttacaagaatctgaagaggaggaagtcccacaagaaagttgggatgagggatattctacactgtccatcccaccggagatgttggcctcgtaccagagttactcatctacctttcattccctggaagaacagcaggtgtgcatggcagtggatattgggcgccaccgttgggatcaagttaagaaagaagatcaagaggccactgggccacgactgtctcgggagcttctggatgagaaaggaccagaagtgctgcaggattcattggatagatgctattccacaccatctggatgcctggaattgaccgattcatgccagccttacagatctgcattctacgtgttggagcagcagagggtcggactagcggtcgacatggatgaaattgagaagtaccaggaggtagaagaagaccaggacccttcctgtcctaggctttcaagagagttacttgatgaaaaggaacctgaggttctgcaggactctctagacagatgttactccacccctagtgggtacctggagttaccggacctgggacagccttacagctccgccgtctactcattggaggagcagtatttggggcttgctctcgacgtggataggacaaagaaggaccaagaggaggaggaagatcaaggtccgccatgtcctagactgtctcgcgagctcttagaggtggtggaaccagaagtgttgcaagatagcctcgataggtgttacagcacaccttcttcttgtttggaacagccagattcttgtcagccatacggaagcagtttttacgctctggaggaaaagcatgttggttttagcctggatgtcggggagatcgaaaaaaaagggaagggcaagaaaagaagggggagaagaagctag

SEQ ID NO: 196971 - DNA, 13866 bp, Artificial Sequence
  Description of Artificial Sequence: Synthetic coding sequence
atggtggtgagcgccggcccctggagcagcgagaaggccgagatgaacattctagaaattaacgaaaagctgcggcctcagctggccgagaataaacaacaattcggtaaccttaaagaaagatgctttgtgactcagctcgctggctttcttgcgaatcagcagaaaaagtacaactatgaggagtgtaaagaccttatcaagttcatgttgaggaacgaacggcagttcaaggaggagaaactggctgaacagctgaagcaggctgaagagcttagacagtataaggtccttgtgcactctcaggaaagggaactaacacaactcagggagaagctacgggagggtagagacgcgagccgctccttgaacgagcatctgcaggccctactgacactcgatgaacctgataagtcccaaggacaagacctgcaagaacagctggcagaaggatgtagactggcacagcatcttgtacagaaattatctcccgaaaatgatgaggacgaggacgaagatgttcaggtggaggaggccgaaaaggtgcagaagtcttcggcacctagggaagttcagaagaccgaggagagcaaggtccccgaggattccttggaggaatgcgccatcacctgcagtaactcccacggcccttgtgactcgaaccaacctcacaagaacatcaaaattacattcgaagaggatgaagttaacagtactttagtggtcgaccgcgaatcctcacacgacgagtgtcaggatgctctaaacatccttccagtgcccggccctacctcatctgctacaaacgtctccatggtggtttccgccggccccctgagctcagagaaggctgaaatgaacattctggaaatcaatgagaagttgcatccacagttggctgagaaaaagcaacagttccgtaacctgaaggagcggtgttttgtaacacagctcgcaggcttcctggccaatcaacaaaagaagtataagtacgaggagtgtaaagatctgattaaaagcatgctgcgaaatgaacggcaatttaaagaagagaagctggccgaacagctcaaacaggctgaggaacttagacagtataaggtcctggtccatgctcaagaaagagagttgacgcagctccgggagaaactccgagaagggagggacgcatcccggtcactgaacgagcatctgcaggcccttctcacgccagacgagccggacaaatcccaagggcaagatctgcaggagcaacttgctgagggatgtcgccttgcccagcatctagtccagaaactgtctcccgaaaacgataacgatgatgacgaagacgtccaggttgagctggctgagaaagtgcagaaatcttcagcgcccagagagatgcagaaggctgaagagaaggaggtgcctgaagacagccaggaagaatgtgccataacctatagtaatagccatggcccctatgacagtaatcagccgcatagaaagaccaagatcactttcgaggaggacaaagtagactccacactgatcggcagctcaagccacgttgaatgggaggatgccgtgcacattatccccgaaaacgagtcggacgacgaggaggaagaggagaaggggccagtgtccccccggaacctgcaagagtccgaggaagaggaagtgccccaggagtcttgggacgaagggtattccacactgtctattccacctgaaatgctagcgagttaccaatcatacagctccacattccactctctggaggagcaacaggtttgcatggcggtggacatcggccgtcatcggtgggaccaggtgaagaaggaagatcaggaggctacaggaccccggctctctcgtgagctgctggatgaaaagggccctgaggttttgcaagattctctcgatcgctgttattcgacaccttctgggtgtctggaacttaccgacagttgtcaaccgtatcgctcagcattttacgtcctagaacagcaacgcatcgggctggccgtggacatggatgagatagaaaagtaccaggaggtcgaggaggaccaggatccaagctgtccaagactcagccgagagctgctcgatgagaaagagcctgaagttctgcaggattccctcgacaggtgttattccactccgtcagggtacctcgagctgcctgacttaggtcaaccctactcctcagccgtttactcattagaagaacaatacctgggactcgccctcgatgtagatcgcactaaaaaagaccaggaggaggaagaggatcaggggcctccatgccccagactgtccagagagcttctggaggtggtggagcccgaggtactccaagactccctggaccggtgctattccactcccagctcctgtctcgagcagcccgatagttgtcaaccgtatggatctagcttttatgccttggaagaaaagcatgtggggttctcattagacgtgggggagatcgagaagaagggaaaggggaaaaaaaggcgggggagacggagtaagaaggagcgtaggagaggtaggaaagaaggggaagaggaccagaatcccccatgccctcgcctgtcacgtgaactgctagatgagaaaggccccgaggtcctgcaggattctcttgatcgcagctactctactccctccggctgtctcgaattgactgactcatgccagccttaccgctccgctttttacgttctggagcagcagagagtagggttggctgttgacatggacgagattgaaaaataccaggaagtggaggaagaccaagaccccagttgccctcgcctatctcgagagctcttggacgagaaggaaccagaggtccttcaggattccctggaccggtgttactccaccccgtccggctatcttgagttgcccgaccttgggcagccatatagctccgctgtctacagcctggaggaacaatatctggggctcgctctggatgttgaccggacaaagaaggaccaggaagaagaggaagatcagggtccaccttgtcctagactgtccagagaactcctcgaagtcgtagagcccgaggttctacaagacagcttggaccggtgctacagcacaccgagctcttgcctcgagcaacccgatagctgtcagccctacggctcctctttctacgcacttgaagagaagcacgtcggcttttccttggatgtcggcgagatcgagaagaaagggaaggggaaaaaaaggaggggacgacgctctaaaaaagaacggaggaggggaagaaaagagggcgaagaagaccagaaccccccctgtcctagactgtcccgggaacttctagacgaaaaaggaccggaagtgctccaggactcgctcgatagatgctatagtactccctccgggtgcttagagctgactgacagttgccaaccctaccggtctgccttttacgtccttgaacagcagcgtgtcggactggccgtggatatggatgagatcgaaaaataccaagaggtggaggaggaccaggacccttcttgcccccgcttgtcccgggaactcctagacgagaaagaacctgaagtgctgcaggacagcctcgaccggtgctactccacccctagcggctaccttgagctgccagacttaggacagccttactcctctgctgtgtactcactcgaggagcagtatttgggtctggccctggatgtggacaggactaagaaggatcaggaagaggaggaggaccagggtcccccctgcccccgactgagtagagaacttctcgaagtcgtggaaccggaagttctgcaggactcattagaccgttgctatagtacaccgagttcctgtctggaacaacccgacagctgtcagccttatggctcaagtttttacgctctagaagagaaacacgtgggttttagcctggacgtgggggagatagagaaaaaaggaaaaggcaagaagcgccgagggcgccgatccaagaaagagagacggcgcggacgtaaggaaggagaagaggatcaaaatcctccgtgccctaggttgtcaagggagctgcttgacgagaagggaccggaggttttacaggattccctggaccgctcatactctacaccctccgggtgccttgagctgaccgatagctgccagccttatcgcagtgccttctatgtcctggagcagcaacgggtggggctcgccgtggacatggacgaaattgaaaaataccaggaggtggaggaagaccaggatccaagctgtcccaggctctcacgggaactgcttgatgaaaaagagccagaggtgttacaggattcgctggatcgatgctacagtacccctagcggatacttagaactgcccgatctgggccagccgtatagtagcgccgtctacagccttgaagaacagtacctggggctagctctggatgtggatagaactaagaaagaccaagaagaggaggaagatcaaggaccaccatgcccccgtttgtcacgggagttgttggaagtcgtggagccagaggtattacaagattcccttgatcggtgctatagtaccccctctagttgtctggagcagcctgactcctgccagccctatggctcttctttttatgcattagaggagaaacacgttggattctccttggacgtcggggaaatcgaaaaaaagggcaaaggaaagaaacggcgcggccgccgatctaagaaggaaagaaggagaggaaggaaagaaggggaagaggatcagaatcctccctgccctagactgtctagggaactgctagacgaaaaaggtcctgaggtgctgcaggacagcctagataggtgctatagcactccctccggctgccttgagctgactgactcatgtcagccataccgcagcgcattctatgtacttgagcagcaacgcgtcggcctcgctgtggacatggacgagatcgaaaagtatcaggaagtggaggaagaccaggaccctagttgtcccagactgagtcgagagcttctcgatgagaaagagccagaggttcttcaggactctctcgaccggtgctactccaccccttccggctatctcgagttaccggacctaggccagccatactcttccgccgtctatagcttagaggagcagtacctcggactggcccttgatgttgatagaacgaagaaggaccaggaggaggaagaggatcaaggccctccatgcccaaggctctctagagagctgttggaagtcgtggagcccgaagtcctccaagatagcttggaccgctgttactccaccccttcaagctgtctcgagcagcccgattcttgccagccttatggatccagtttctacgctctcgaggaaaaacacgtgggctttagtctcgatgtcggtgaaatcgagaaaaagggaaagggcaagaagcgacgcggccgacgttcgaagaaagaaaggcgccggggcaggaaggagggggaggaggaccagaatccgccatgtccacgtttgtcacgggaattgttagacgaaaagggcccagaagttcttcaggacagtctggaccggtcttacagcacaccaagcggctgcttggagctgacggattcatgtcagccatataggagcgccttttatgtgttggaacagcagagggtcggcttggctgtcgatatggacgagattgaaaaataccaggaagtcgaagaggatcaggatccaagctgcccccgcttatctcgcgagctgctggacgagaaagagccagaggtgctacaagacagtctagataggtgctactcaaccccatcaggttatctggagctgccagacttgggccaaccctacagcagtgctgtgtactccctcgaagaacaatatctcggactcgccctcgatgtggacaggactaaaaaggatcaggaagaggaggaggaccagggtcccccttgtccacggctttcgcgggaactcctcgaggtggtcgagccagaggtattgcaggatagtcttgacaggtgttattccaccccctcatcttgcctcgagcagccagactcctgtcaaccctatggctcatctttttacgcactggaggagaaacatgtaggattcagcctggacgttggtgagattgagaaaaagggaaaggggaaaaagcgtcggggcaggcggagtaaaaaggaaaggcggcggggccgaaaagagggagaggaggaccagaatcctccatgtccacgactgagtagggaacttctcgacgagaaagggccagaagtccttcaggacagtctggaccggtcttattccacacccagcggctgccttgagctcaccgattcttgtcagccttacagaagtgctttctatgtcctggaacaacagagggtgggcttagctgttgacatggatgagatcgagaaataccaggaggttgaagaggaccaagatccgagctgccctcgactgagccgcgaactattagacgagaaagaaccagaagtactccaggactcattggaccgctgctacagtaccccatccgggtatcttgagctccccgatctgggacaaccttatagcagcgccgtatattctctggaggaacagtatctgggactggccctagacgtagataggacaaaaaaggaccaggaggaagaggaagatcagggacccccctgcccacggctgtcaagggaattgctggaggtagtggagcccgaagtacttcaggatagcctggacagatgctattcaacgccatcgagttgcctggagcagcctgactcttgccaaccttacggctcctccttctatgcattggaggagaagcacgttggcttctctctggacgtcggggaaattgagaaaaaaggaaaaggaaagaagaggagaggccgacggtctaagaaagagagacgcaggggccgcaaggagggagaagaggatcaaaacccaccatgccctcgacttagtagagagttgctcgatgaaaaggggcccgaggtcctgcaggattctttagatcgtagctacagcacgccttccgggtgcttagaactcaccgactcatgtcagccgtatcgctctgccttctacgtgctggaacagcagagggtgggactagcagtggacatggacgaaattgagaagtatcaagaggtcgaagaggaccaagatcccagctgtccaaggctctccagagaactgctagatgaaaaagaacccgaggtgctacaggactccctggacagatgctattcaacaccctccgggtacttggagttgcctgacctgggtcagccgtactcgagcgccgtgtactccctagaggagcagtacctggggctcgcactcgacgtagaccgtacgaaaaaagaccaggaggaggaggaggatcagggcccaccatgtccaaggctgtccagggagctgcttgaagtggtggagccggaggtgctgcaagactctctcgaccgctgctattcaacaccatcttcttgcctggagcagccagactcttgccaaccctacggatcttcattctacgcactggaggaaaaacacgtaggtttctcactggacgtgggcgaaattgagaaaaaaggtaaagggaaaaaaagaaggggacgccgctcaaaaaaagaaaggaggagagggcgcaaagagggcgaggaagatcaaaacccaccgtgcccacggctgagcagagagttactggacgaaaaggggcctgaggtgctgcaagactcactggatcgatcctacagcactccatctgggtgtctcgaactgaccgatagttgccagccttaccgcagcgccttttacgtgttggaacagcaacgagttgggctggccgtggatatggacgaaattgaaaagtatcaagaagtcgaggaagaccaggatccatcctgcccccggctgtctcgtgaacttctggacgagaaggagcccgaggttttacaggacagtctagatagatgttactccaccccttcaggctatcttgaactgcctgacctaggacaaccatatagctccgccgtctattccctggaggagcaatatttgggcttggccctagacgtggaccgaactaagaaggaccaggaggaagaagaggaccaagggccgccatgccctaggctgtcccgagaacttttggaagtcgtcgaaccagaggtgttacaagacagtctagataggtgttattctaccccatccagctgtctagaacagccggattcctgtcaaccctacggatcctccttttatgctcttgaggagaaacacgtgggattttctcttgatgttggtgagattgagaagaagggcaagggcaaaaaacgaaggggacgccgctcaaagaaggaacgcaggcgaggtcggaaggaaggggaagaggaccagaatcccccttgccctcgcctgagcagggagctcctggacgagaaagagccagaggtgttgcaagactcactagaccgttgctacagtacccctagtggctacttggagctccctgatctggggcagccttacagttcagctgtctactcacttgaagagcaatacttaggcctggcattggatgttgatagaacgaaaaaggaccaggaggaggaggaagaccagggccccccatgccctagattgagcagagaactgctggaggtggtggagcccgaggtattgcaggattctttagacagatgttatagtacaccatcctcttgtctcgaacagccagatagctgccagccttatggttcaagcttttacgccctggaagaaaaacatgtcggattttcactggacgtgggcgagattgagaagaaaggaaaggggaaaaagaggcggggccggaggtctaagaaagaacggcgacggggtagaaaagaaggtgaggaagatcagaaccccccttgtccacgattgtcccgggaactgcttgacgagaaggaaccagaagttttacaagacagcctggaccgttgttacagcaccccatcaggctacctggagctgccggacctgggccagccttatagctctgcagtttattccttggaagagcagtatcttggcctcgccctggacgtggatcgcacgaagaaagaccaagaggaggaagaggaccaggggcccccatgcccccgactgtcccgagagctcctggaagtggtggagcctgaagtccttcaggactcccttgatagatgttattcaactccctcctcttgcctagaacagcctgatagctgccagccttacggtagtagtttctatgccttggaggaaaagcacgtcggcttttcgctggatgtgggcgagattgagaaaaaggggaaggggaagaaaagacgcggccgccgaagcaagaaagaaagaagacggggcaggaaggagggcgaggaggaccaaaatcccccctgtccgcgcttgtcacgggaactcttagacgaaaaagagccagaagtgctgcaggatagccttgatagatgttactcaaccccctctggctacctcgaacttcccgacctcggacagccatacagctctgccgtttattctctcgaagagcagtacctggggttggctttggacgtggatcgaaccaaaaaagatcaagaagaggaggaggatcaggggcccccctgtccccggctgagccgcgaactcctggaggttgtcgaacctgaggtgctgcaagatagccttgaccggtgctactctacgccctcgagctgcctagagcaacccgactcctgccagccctacggatcctctttctacgccctggaggagaagcatgtcgggtttagtttggatgtaggcgagatagaaaaaaagggaaaagggaagaaacgacgcggtagacgtagcaagaaggagaggaggcgagggaggaaagagggcgaggaggatcagaatcccccctgtcctagactcagccgcgaactgcttgacgagaaaggcccagaggtgctgcaggatagcttggatcgctgttacagcaccccttctgggtgcctcgagctgacagactcgtgtcagccgtatcgaagcgcgttttatgtattggagcagcagcgagttgggctggccgtggacatggatgagatcgaaaagtaccaagaggttgaggaggatcaggatccttcatgcccgcgcctgagtagagaattgttagacgagaaggagccagaagtgcttcaggacagcctcgatagatgctacagcactccttctggttacctagagctgcctgacctggggcagccatatagctctgccgtctatagcctggaggagcagtacctggggctggcgctggacgtggatcgtacaaagaaggatcaggaggaggaggaggaccaggggcctccgtgtccacggctcagccgagagctcttagaagtcgtggaaccagaggtcctgcaggatagccttgaccggtgttacagtactccctctagttgtctggagcagccagacagctgccagccttatgggtcatctttctatgccctcgaggaaaagcacgtgggattttcactcgacgtcggcgagatcgagaaaaaggggaaaggaaaaaagcgcagagggcgccggtctaaaaaagaacgccgaagggggcgaaaagaaggagaggaggatcagaatcccccctgcccgagactgagtcgggaactgctggacgaaaaaggcccggaggttttacaggatagtctggataggtgctactctactcccagtggatgccttgaattgacagactcttgccaaccttatagatcagctttctacgtccttgaacagcagagggtcggactagctgttgatatggatgagatagagaaatatcaagaggttgaagaggaccaggatccctcctgtcctcggctgtcacgggaactgctcgatgaaaaagaaccagaagtgctgcaggacagcttggataggtgctactcaaccccaagcggctatctggagctgccggatctaggacagccatactcatcggcggtgtacagcttggaagaacaatatcttggcttggcactggatgtagacaggacaaagaaggatcaggaggaagaggaagatcagggccctccatgtccacgcctttcaagggagctgctcgaggtggtggagcctgaggtcctgcaggacagtcttgatcggtgttattccacaccctcgtcctgtctggagcagcccgacagttgccagccatatggctcatccttttacgctctcgaggaaaagcatgtgggtttctccttagatgtgggggaaatcgaaaaaaagggcaaaggcaagaagcgacgaggccggcgttccaagaaggagcgacgtcgcgggaggaaagagggtgaagaggatcagaatcccccttgcccccgtctctcgagagagctgctcgatgagaaaggtcctgaagtgctccaggattccctcgaccggtgttatagtacaccaagcggatgcttggaactaaccgattcctgccagccctaccgcagtgccttctatgtccttgaacaacagagagtgggcctggctgtcgacatggatgaaatagaaaaatatcaggaggtcgaggaggatcaggacccctcttgccctcggctctcacgggaattactggatgaaaaagaacctgaggtcttgcaagactctctcgacagatgttatagcaccccatctgggtacctggagctcccggacctaggccagccatacagtagcgccgtctattcactcgaggaacaataccttgggctggctctcgacgtcgaccgcactaagaaggatcaggaagaggaggaggaccagggcccgccttgccctaggctgtcccgagagctgctggaagtcgtcgaacctgaggtgctccaggacagtttggacaggtgctactccactccctctagctgcctggagcagccggattcttgccagccatatggatcctctttctatgccttggaggaaaagcacgtcggcttttcccttgatgtgggagagatagaaaagaaaggtaaggggaaaaaacgccgaggccgcagatccaaaaaagagcgccggcgtggacgcaaggaaggtgaggaagatcagaccccaccctgtcctcggttatctcgggaactgctcgatgagaaaggccctgaagtccttcaagacagcctggatcgatgttactctacaccatccggctgcctagaactgacggatagctgtcagccataccggtctgcgttttacgtgctggaacagcagcgtgtgggcctggcagtggacatggacgagattgagaagtatcaggaagtggaggaagatcaggatccaagttgccctcgactcagccgggaactcttggacgaaaaggaacctgaggtgctgcaggattctctggacaggtgctactctaccccaagcgggtacttggaattgccagatctgggtcagccgtactcctcagccgtttattccctcgaggaacagtatctcggcttagctcttgatgtcgataggaccaagaaagaccaggaagaggaagaagatcagggccccccctgtcccaggctgagccgcgagttactcgaggtagtcgaacccgaagtcctacaggacagcttagaccggtgctatagtacaccaagttcctgccttgagcaacccgactcatgccagccatatggttcctcattctatgcactcgaagagaagcacgtggggttcagcctggacgtgggggagatcgaaaagaaaggtaagggaaaaaagcgtcgcggccgtaggtccaagaaagagcgtcgccgagggcggaaggaaggggaggaggaccagaaccccccatgtcccaggctttcacgcgaactactagatgaaaaaggccccgaagtgttgcaggactctttagacaggtgttactctacccccagcggatgcctggagctgaccgactcctgccaaccttacaggagcgccttctacgtgctggagcagcagagggtggggctggcagtcgacatggatgaaatcgagaagtaccaggaggtcgaagaggaccaggatccctcctgccctcgcttatccagagagttgctcgatgaaaaggaacctgaggttctgcaggattcactcgatcgatgttactcaacgccgagcggttacctcgagctgcccgacttaggacaaccttactctagcgccgtctattcgctcgaggagcagtacctggggttagctcttgacgtggacagaacaaagaaagaccaggaggaggaagaggaccagggtccaccgtgtccccgattatcgagagaactgctggaggtcgtagagcccgaggtcttgcaggatagtctcgatcggtgttactctacaccgtcatcttgccttgagcaaccagatagttgtcaaccatatggcagttcattctatgctctcgaagagaaacacgtgggattcagcctggatgtgggcgaaatagagaaaaaggggaagggaaaaaagcgtcgcggacggaggtccaaaaagaagaggaggcggggaaggaaggagggggaggaggaccaaaatcccccttgtcccaggctaaacggagtgttaatggaggtcgaggaacccgaagtgctgcaagatagccttgatggctgttactccactccctcgatgtactttgagttaccggattctttccaacactacagatccgtgttttactcatttgaggaacagcatatctcatttgcgttgtacgtagataaccgcttcttcactctgacagtgacttctctccacctcgtctttcagatgggcgtcatcttcccacagtag

SEQ ID NO: 196972 - DNA, 780 bp, Artificial Sequence
  Description of Artificial Sequence: Synthetic coding sequence
atggtggtgagcgccggcccctggagcagcgagaaggccgagatgaatatcctcgagatcaatgagaagttgcgtccccagcttgcagagaacaaacagcagtttggaaatctgaaagagcggtgcttcgtgactcaactggccggctttctcgccaatcagcagaagaagtataactacgaagaatgtaaagatctgatcaaatttatgttacgcaacgagaggcagttcaaggaggagaaactggccgagcagttgaaacaggccgaggagctgcggcagtataaggtgctggtacatagtcaggaacgcgagctcacccagctcagagagaagcttcgcgaagggcgcgacgcttccagatcactgaacgagcacttgcaagccttgctaacattggatgaacctgacaaatcacaaggtcaggacctgcaggaacagttggccgaaggttgtagactcgcccaacacctggtccagaagttatcgccggaaaatgatgaagacgaagacgaggacgtgcaggtagaagaggcagagaaggtgcagaagagttctgcccctcgtgaagttcagaaaacagaggaaagcaaagtacctgaggactcattggaggagtgcgcaatcacctgtagtaacagccacggaccttgcgatagtaaccaaccacacaagaatatcaagataacgttcgaggaggatgaggttaactccaccctggttgtggatagagagtcatcacacgacgagtgccaagacgccttgaacatccttccttag

SEQ ID NO: 196973 - DNA, 456 bp, Artificial Sequence
  Description of Artificial Sequence: Synthetic coding sequence
ctgagccgggagctgctggaggtggtggagcccgaggtgctgcaggattctctcgacaggtgctatagcaccccctcaagctgcctggaacaacccgattcatgccaaccctacggctcttcgttttacgctcttgaggagaagcacgtgggttttagtctggatgttggcgaaattgagaaaaaggggaagggcaaaaagaggcgaggacggcgtagcaagaaagagcgaaggcgcggccgaaaggaaggagaagaagaccagacgcccccctgcccccgtctgtcaagagagctcctagacgaaaagggccctgaagtactccaagactcgctggatagatgctactcaactcccagtgggtgcttggaactcacggattcctgtcagccttaccgtagtgctttctatgtgttagagcagcagagggtcggcttggccgtcgacatggattag

SEQ ID NO: 196974 - DNA, 456 bp, Artificial Sequence
  Description of Artificial Sequence: Synthetic coding sequence
ctgagccgggagctgctggaggtggtggagcccgaggtgctgcaggactctctagacaggtgctactcaacaccaagcagctgcctggaacagcccgactcttgtcagccctatggttcctcattctatgcccttgaggagaagcatgttggattctctctagacgtgggcgaaattgaaaagaagggaaaaggcaagaagcgtagaggccgcaggtccaagaaagaacggagaagaggcaggaaggagggcgaagaggaccagaatcccccatgcccaaggctgagtcgggaactgctcgatgaaaaagggcccgaggtgttgcaggattcactagatcggtgctattccaccccatcgggatgcttagaactgaccgattcctgccagccctatcgttccgcattttatgtattagaacaacagcgagtcggtctcgctgtcgacatggattag

SEQ ID NO: 196975 - DNA, 456 bp, Artificial Sequence
  Description of Artificial Sequence: Synthetic coding sequence
ctgagccgggagctgctggaggtggtggagcccgaggtgctgcaggacagcctggatagatgttattcaaccccctcgtcctgtctcgagcagccagacagctgccaaccatacggctctagcttctatgctctggaggaaaaacacgttggcttctcacttgacgtgggggaaattgaaaaaaaaggcaaagggaagaaaagaagaggtcggcgctccaagaaagagcggcgacgaggaaggaaagaaggggaggaagatcagaaccccccgtgccctcggctgtccagggagcttttagatgaaaagggtcccgaggtgctccaagatagcttagacaggagctatagcaccccctccgggtgcctggaactgacagatagttgtcaaccataccgaagcgctttttacgtgttagaacagcaaagggtgggactggccgtggatatggactag

SEQ ID NO: 196976 - DNA, 456 bp, Artificial Sequence
  Description of Artificial Sequence: Synthetic coding sequence
ctgagccgggagctgctggaggtggtggagcccgaggtgctgcaggatagcctggaccgctgttattccactccatcgagctgtctggagcaacctgactcttgccaaccttatggcagttctttctatgcgctggaagagaagcatgtcgggtttagtctggacgtgggtgagattgaaaagaaggggaagggaaagaaaagacggggacgccgatcaaagaaggaaagacggcgaggcaggaaggaaggggaggaggatcaaaatccgccatgccccagactgtcccgcgaactgctggatgaaaaggggccagaagtgttgcaggattctctcgatcgctgttactccacgcctagcgggtgcctggaactgaccgattcatgccagccatacaggtccgccttctacgtactggagcagcagagagtcggcctggctgtggatatggattag

SEQ ID NO: 196977 - DNA, 2016 bp, Artificial Sequence
  Description of Artificial Sequence: Synthetic coding sequence
atggtggtgagcgccggccccctgagcagcgagaaggccgagatgaacatactggagatcaacgagaaacttcaccctcaactggctgagaagaagcagcagtttaggaacctaaaagagcggtgctttgttacccagctagccggttttctggccaatcagcagaagaagtacaagtatgaggaatgcaaggacctgatcaagagcatgttaaggaatgagcgacagttcaaagaagagaaactggcggagcagctgaagcaggcggaggagctgcgtcagtacaaggtcctggtccatgcccaggaacgggaactgacacagctgcgagagaaactgagagagggaagagatgcttcccggagcctcaacgagcaccttcaggccctgctgacgccggatgaaccagacaaaagtcagggccaggacctgcaggagcagctggccgagggatgcaggctcgcacaacacctggtacagaaattaagtcctgagaacgataatgacgatgacgaggacgtgcaggtggaactggccgagaaggtgcagaaaagttcagcacccagagaaatgcagaaggcagaggagaaggaagtacctgaagactctcaagaggaatgcgccattacctactcgaattcacacggcccatacgatagtaaccaaccccaccgtaaaaccaaaatcacgtttgaggaggacaaggtggattccacactgatcggaagcagttcgcacgtggaatgggaggatgctgtgcatataatacctgagaatgagtcagacgacgaagaagaggaagagaaaggcccagtttccccacgtaatctacaagagagcgaggaagaggaggtgccacaagaatcatgggatgagggatatagcacactgtcaatccctcccgaaatgctggcctcataccagagttatagcagcactttccacagccttgaggagcagcaggtgtgcatggccgtagatatcggccgacaccgttgggaccaggttaagaaagaagaccaggaggcgactggacccaggctcagcagagagcttctggatgagaaaggacctgaagtgctgcaggactcgctggaccggtgctattcaacaccatctgggtgcttggagctgacagatagttgccagccttacagaagcgctttttatgttctcgaacaacagagggtagggctagccgtcgatatggacgagattgagaagtatcaggaggttgaagaggatcaggatcccagttgtccaagactgtccagagaactgctcgatgaaaaagaaccagaggtgcttcaagactcactcgaccgttgttactctaccccaagcgggtatctggagctgccagatttaggccagccatacagcagtgccgtgtactctttagaagagcagtacctgggcctggctttggatgtggatcggaccaagaaggaccaggaggaagaagaggaccagggccccccgtgccctagactgagcagagaactcttggaagtcgtcgaaccagaggtactacaggattcactggaccgttgctactccacacccagctcttgtctggagcagcctgactcatgccaaccctatggctcatccttttacgccctcgaggagaagcacgtcgggtttagcctagatgtgggagagatagaaaaaaaggggaaaggcaagaaaaggcggggccgacggtcgaaaaagaagaggcggagaggtagaaaggaaggggaggaggatcagaacccaccgtgccctagattaaacggcgtactgatggaagtggaggagcccgaagttctccaggactcactggatggctgttactccactccatccatgtacttcgagctccctgactcattccagcattatagaagcgtcttttattcctttgaagagcagcacatttcttttgctctgtacgttgacaaccgcttcttcaccctgacagtgaccagcctccacttggtcttccagatgggcgtgatattcccccagtag

SEQ ID NO: 196978 - DNA, 474 bp, Artificial Sequence
  Description of Artificial Sequence: Synthetic coding sequence
ctgagccgggagctgctggaggtggtggagcccgaggtgctgcaggattctctcgacagatgctactcaacaccgtccagctgtctggaacaaccggattcttgtcaaccttatggaagctctttttatgctctggaggagaagcacgtcgggttcagcttggacgtaggagagatcgaaaagaaggggaagggcaagaaaaggaggggccggaggtcaaagaaagaaagaaggcgcggacgcaaggagggagaggaagaccaaaacccaccatgccctcggctaagcagagagctattagacgaaaaaggcccagaagtcctacaggattctctggatcgctgttattcaacaccaagcggctgtcttgagctcactgattcatgtcagccctaccggtccgccttttatgtgctcgagcagcaacgggttggtctggctgttgatatggatggcgagtatctgtcgatgtag

SEQ ID NO: 196979 - DNA, 681 bp, Artificial Sequence
  Description of Artificial Sequence: Synthetic coding sequence
ctgagccgggagctgctggaggtggtggagcccgaggtgctgcaggattctttggacagatgttacagcacgccatcaagctgtctcgagcagcccgactcgtgccaaccgtacggcagctcattctacgctctcgaggagaaacacgtgggattctcactggacgtgggggaaatcgagaaaaagggcaaaggaaagaagcggagagggcgccgtagtaagaaagagcggcgaaggggcaggaaggaaggggaagaggatcagaatcccccctgccctcggctgagcagagagttactcgacgagaagggcccagaagtgctgcaggatagtttggatcggtgttatagcactccctctggatgcctggagctgaccgattcgtgtcagccttaccgtagcgctttctacgtactggagcagcagagggtcggactggctgtggacatggacgagatagagaagtatcaagaggttgaggaagaccaagatccttcatgccccaggctgtcgagggaactgctggacgaaaaggagcccgaggtcctccaggactcactggaccggtgttattcaacaccgtctggttacctggaactccccgatcttggccaaccatatagcagtgctgtgtattctctggaagagcaatacctggggctggccttggacgttgattag

SEQ ID NO: 196980 - DNA, 810 bp, Artificial Sequence
  Description of Artificial Sequence: Synthetic coding sequence
atggacgagatcgagaagtaccaggaggtggaggaggaccaggacccctcctgtccacggctttctagagaactccttgatgagaaggagcctgaagtgcttcaggactctctggatagatgttactctactccttctgggtacttggagttgccagaccttggacagccatactcctccgcagtatattcattagaggagcagtatctgggactcgctctcgatgtagaccgcaccaagaaagaccaggaagaggaggaagatcagggaccgccatgtccacggttgtcacgggagttgctggaggtggtggagcccgaggtgcttcaggacagcctggaccgatgctacagcactccttcttcgtgcttggagcagcccgactcgtgccaaccatacgggtctagcttttacgcactggaggaaaagcatgtcggtttctcactggacgtcggggagattgaaaagaagggaaagggaaagaagcggaggggccggcgatctaaaaagaaaagacggaggggccgcaaagagggggaggaggaccaaaacccaccttgtcccaggcttaacggagtcctgatggaagtggaggagccagaggttttgcaggactcactcgatggctgttattctaccccatccatgtactttgaattgccggattccttccagcactaccgcagcgtgttttacagctttgaggagcagcacatctccttcgccctgtacgtagacaaccgtttcttcactttgacggtcacgtccctgcacctcgtcttccaaatgggggtgatatttccccaatag

SEQ ID NO: 196981 - DNA, 474 bp, Artificial Sequence
  Description of Artificial Sequence: Synthetic coding sequence
ctgagccgggagctgctggaggtggtggagcccgaggtgctgcaggattccttggaccggtgctatagtaccccctcatcttgtctggagcagccagacagctgccagccctatgggtcctcattctatgcccttgaagaaaagcacgtcggtttcagccttgatgtcggtgaaatcgaaaaaaaaggcaaagggaagaagcgcaggggacggcgcagcaaaaaggagaggcgccgaggcaggaaagagggcgaggaggatcagaatcccccctgcccacgactctcacgcgagctgctagatgagaaaggccctgaagtgctacaggattctctggatcgctgctattcgactccttcagggtgtctggagttaactgattcctgccagccttaccggtcagcgttctacgtgctggaacagcagcgcgtcggactggctgtggatatggacggggaatacctgtctatgtag

SEQ ID NO: 196982 - DNA, 525 bp, Artificial Sequence
  Description of Artificial Sequence: Synthetic coding sequence
ctgagccgggagctgctggaggtggtggagcccgaggtgctgcaggacagcctcgacagatgttatagtacaccatcatcctgtctggagcaacctgacagttgccaaccttacggatcaagtttctatgcactcgaggagaagcatgtgggattttctctggacgtaggagagattgagaagaaggggaaggggaaaaagcgtcgtggaaggaggtccaaaaaaaagcgccgaaggggtcgcaaggagggtgaggaagatcagaatcctccctgtccgcggttgaacggggttttgatggaagtggaagagccagaggtgcttcaggactccctggatgggtgctactccactccatcgatgtacttcgagctccccgactcattccagcattatcgctccgtattctatagctttgaggagcaacacatctcatttgcgttatatgtcgataatcgattcttcactttgacggtgacgtcacttcatttagtatttcagatgggtgtgatctttcctcaatag

SEQ ID NO: 196983 - DNA, 456 bp, Artificial Sequence
  Description of Artificial Sequence: Synthetic coding sequence
ctgagccgggagctgctggaggtggtggagcccgaggtgctgcaggactccttggaccggtgttactctactccttcttcttgtcttgagcaacctgattcatgccagccatatggatcgtccttttatgcacttgaggagaagcatgttggattcagcctcgacgtgggcgagattgagaagaaggggaagggaaagaagagacgtggaagacgcagtaaaaaagaaagacgaagggggagaaaggagggcgaagaggatcagaaccctccgtgtccccgtttgagtagagagctgctcgatgagaaaggccccgaggtgcttcaggattccctggaccgtagctactcaaccccctcaggttgtctggaattgactgatagttgtcagccctatagaagtgcattctacgtcttagagcagcaaagggtaggtctcgccgtggacatggattag

SEQ ID NO: 196984 - DNA, 759 bp, Artificial Sequence
  Description of Artificial Sequence: Synthetic coding sequence
atggacgagatcgagaagtaccaggaggtggaggaggaccaggacccctcctgccctagactatcaagagagctcttggacgagaaagaaccagaagtcctgcaagactctctggaccgatgttacagtacgccaagcgggtatctcgagctccctgacctcggccagccatattcatctgcggtgtacagtctcgaagagcaatatcttgggttggcgctggatgtggataggaccaagaaggatcaggaggaggaggaggatcagggacctccatgtcctcgactgagtcgggaactgctggaggtcgtagagccagaagtgcttcaggattcactggaccggtgctactcaacccctagctcttgtctcgaacagccagactcttgccagccatatggcagctctttttacgctttggaagagaaacacgtgggcttctcccttgatgtgggtgaaattgagaagaaaggaaaggggaaaaaacggaggggcagaaggagcaagaaggagcggagaagggggaggaaagaaggggaggaagatcagaaccctccgtgcccccgcctgtctcgggagctgctggacgaaaagggacccgaagtgctccaggattccttggataggtgctactctaccccttcaggatgcctggaactcactgatagctgtcaaccatacagatcggctttttatgtgctagaacagcaaagggtcggcctggccgtcgatatggatggcgaatacctgagtatgtag

SEQ ID NO: 196985 - DNA, 1734 bp, Artificial Sequence
  Description of Artificial Sequence: Synthetic coding sequence
atggtggtgagcgccggcccctggagcggcgagaaggccgagatgaatattctcgaaatcaacaaaaagagtcgccctcagctggccgagaacaagcagcaattccggaacctcaaacaaaagtgtctggtcacccaggtcgcctacttcttagctaatcgtcagaataactacgactacgaagattgtaaggacctgatcaagagtatgctgcgcgatgagaggctgcttacagaagagaaactcgccgaagaactcgggcaagctgaggagctcagacagtataaagtcctggtacactcacaggaaagagagctgacgcagctcagagaaaagctacaggagggcagggatgcatcacgaagcctgaatcaacacttgcaggcactgctcacccccgacgagccagataatagtcagggaagggacttaagggaacagcttgccgagggatgccgcctggctcaacatctagtgcagaagctgagccctgaaaatgatgatgatgaggacgaagatgtaaaggttgaggaggcggaaaaagtgcaggagctatacgctccacgtgaggttcagaaagcagaggagaaagaggtgcctgaagactcactggaagagtgcgccatcacttgttccaactcacatcatccttgtgaatcaaaccagccatacggtaatacaaggattacgtttgaggaggaccaggtcgattccactctcatagacagtagcagccatgacgagtggctggacgccgtgtgcatcattccagagaacgagtccgaccacgagcaggaggaagagaagggacccgtgtctccccggaatttgcaggaatcagaagaagaggaagcacctcaagaaagttgggatgagggtgactggaccctgtcaattcctccagatatgtcagctagttatcagagcgaccggtccacattccactctgtggaggaacagcaagtcgggctcgcactggacatagggcgccactggtgcgaccaagtcaaaaaggaggaccaagaggctaccagcccaaggctctcccgggaactgctggacgagaaagagccagaggtcctccaggatagcttggaccgcttctactctaccccgtttgaatacttagaactgcccgatttgtgccagccctatcggagcgacttttactcccttcaagaacagcacctgggccttgccctggacctcgacagaatgaagaaggaccaggaggaagaagaggaccaaggaccgccctgccctcgattatctcgagagctccccgaggtggtggaacccgaagacttacaggattctttagacaggtggtactccactccgttctcctaccccgagctccctgactcatgccagccctacggctcatgtttctactcactcgaggaggagcatgtgggcttctctttagatgtggacgaaatcgaaaaataccaggaaggtgaggaggaccagaaacccccctgcccgcgtctcaacgaggtactgatggaggccgaggaaccagaagtactgcaggactcactggatcgttgctacagtacgacctcaacatatttccagctgcacgcctcattccagcagtacagatcagcattctattctttcgaggagcaggacgtgtcgctggccttggacgtcgacaacaggttcttcacccttaccgtgatccgccaccatctagcttttcagatgggtgtgatctttccccactag

SEQ ID NO: 196986 - DNA, 1902 bp, Artificial Sequence
  Description of Artificial Sequence: Synthetic coding sequence
atgcccctgacccccaccgtgcagggcttccagtggaccctgcggggtccggatgttgaaacctcacctttcggcgctccccgggccgcaagccacggtgtggggaggcaccaagagttacgagatcccacagtcccaggacccacaagtagcgccacaaatgtgagcatggttgtgtctgctggcccttggagcggggaaaaagctgagatgaacattctggagattaacaaaaagtcaaggccccaactcgccgagaacaaacagcagtttagaaatctgaagcaaaaatgtctggtgacacaggtcgcctattttttagccaaccgccaaaataattacgactacgaggactgtaaggatctgattaaaagcatgctgcgagacgaacgcctgctgaccgaagagaagcttgcagaggagttaggacaggccgaagagctgagacaatacaaggtcctggtgcactctcaagaaagagagctcacgcagttgagggagaagctgcaggagggccgggatgctagtcgcagcctcaaccagcatctgcaggcgttgctgacccctgacgagcctgataattcgcaaggccgtgatctgcgggagcaactggccgaggggtgcaggctcgctcaacacctggtccagaagctgagccctgagaacgacgacgacgaagacgaagatgtgaaggttgaggaagcggagaaggtgcaagagctgtacgcgcctcgagaggtgcaaaaggctgaagaaaaggaagtcccagaagactcgctggaagagtgtgccattacatgttccaacagccaccatccctgcgagtctaaccagccttatggcaacacccggataacattcgaagaggatcaggttgatagcaccctcatcgattcatcctcacacgacgagtggctcgatgccgtctgtatcattccggaaaatgagtctgatcatgagcaggaagaggagaagggacctgtctccccccggaatctgcaggaatcggaggaagaagaggcaccccaggagagctgggacgaaggcgattggaccctgtccatccctccggatatgtcagcctcatatcagtctgaccgatcaacatttcatagtgtggaagaacagcaggtggggcttgctctggacataggccgccattggtgtgatcaagtcaagaaggaagaccaggaggccacatctccaaggttgtcacgtgagctcctcgacgagaaggagcccgaggtgctgcaagattctttggatagattttactctactccttttgagtacttggaactgcccgatctgtgccagccctatagatccgacttctattctttacaggagcagcacctgggtctcgcactggaccttgatcggatgaagaaggaccaggaggaggaggaagaccaaggccccccctgtcctcggctatctcgcgaactgccagaggtggtggagcccgaagacttgcaggactccctcgatcggtggtactccactcctttctcttaccctgagcttcccgatagctgccaaccgtacgggagttgtttctatagccttgaggaagagcatgtcggcttttctctcgacgtggatgagatcgaaaagtaccaggagggcgaggaagatcaaaaacctccatgcccacgcctcaatgaggtgctcatggaagccgaggagcctgaggtgctccaggattctttagacagatgttattcaaccaccagcacatacttccaactccacgcctccttccaacagtacagatctgcattttattcctttgaggaacaggatgtatcactggctctggatgtagacaaccgcttcttcaccttgaccgtgatacgccatcatcttgcctttcaaatgggggtcatcttccctcactag

SEQ ID NO: 196987 - DNA, 1866 bp, Artificial Sequence
  Description of Artificial Sequence: Synthetic coding sequence
atgcccctgacccccaccgtgcagggcttccagtggaccctgcggggtcccgatgtcgagacttccccgttcggggcaccacgtgcggcctcgcacggagtgggcaggcatcaggaacttcgcgatcccacagtgccaggtccaacttcctccgctacaaatgtgagcatggtggtttccgctggcccttggagcggcgaaaaggccgagatgaacattcttgaaatcaacaagaagagccgaccccaattagcagagaacaagcagcaattccgaaacctcaaacagaaatgcctggtcacccaggtggcatatttcttagcaaacagacagaacaattacgactatgaagactgtaaggacttgattaagtcgatgttacgggatgagcgccttttgacagaggagaagcttgccgaagagttaggacaagccgaagaactgagacagtacaaggttctggtacacagtcaggagcgagagctgacacagctgcgggagaagctccaagaggggcgagatgctagcagaagtctcaaccagcacctgcaggctttgctcaccccagatgagcctgacaattcccaaggacgtgatctgcgagagcagttagccgagggctgcagacttgcccagcacctcgtccagaagctgagcccagaaaacgacgacgatgaagatgaggatgtgaaggttgaagaggcagaaaaggtccaagagctgtatgccccccgcgaagtccagaaagcagaggagaaagaggttcccgaagattcactggaagagtgcgcgatcacttgttcgaattctcatcacccttgtgagtctaaccagccgtacgggaacactaggatcacattcgaggaggatcaagtggattctacactgatcgacagcagctcccatgacgagtggttggatgcagtgtgcataatcccagagaatgagagcgaccacgagcaggaggaggaaaaagggcctgtgtcaccaaggtcttcgggcagattctgttgcctgatctcagtcggttatatattctgtcacccttgtcccgcatggctgatccggaacctccaggagtccgaggaggaagaggcgcctcaggagagctgggatgaggggcactggtgcgaccaggtaaagaaggaagatcaggaggcgacaagtccacgccttagccgagagctactcgacgagaaggagcccgaagtgctccaagacagcttggataggttttacagcacaccatttgaataccttgagctccccgacctgtgtcagccatacagaagcgacttctattctctgcaggaacagcacctgggacttgcgctggacttggatagaatgaagaaggaccaggaggaggaagaggaccagggacctccctgtcctcgcctgagccgcgagttacctgaagtggtcgagccagaggacctgcaggattcccttgaccgatggtacagcaccccctttagttacccggaactacccgatagctgccagccctatgggagctgcttttatagtctagaggaagagcacgttgggttctccctggacgttgacgaaatcgaaaagtaccaggagggggaagaagaccagaaacccccttgccccaggctcaatgaggtgttgatggaggccgaagaacctgaagtgctgcaagactcactcgaccgctgttactccaccacctcaacctatttccagttgcacgcatccttccagcagtatcgttctgcattctactcatttgaggagcaagatgtgtctctcgcactcgacgttgacaacagattttttacactcaccgtgatccgccatcaccttgcgtttcagatgggggtgatcttccctcactag

SEQ ID NO: 196988 - DNA, 1062 bp, Artificial Sequence
  Description of Artificial Sequence: Synthetic coding sequence
atggtggtgagcgccggcccctggagcggcgagaaggccgagatgaatattttagagattaacaagaaaagcagaccgcagcttgccgagaataagcagcagttcaggaatctcaagcagaagtgtctcgtaacccaggtagcttatttccttgccaacagacagaataattatgactatgaggactgcaaagatctgatcaaaagcatgctccgggacgagcgacttctgaccgaagagaaattagccgaagagctagggcaggctgaagagcttagacagtacaaggtgctagttcacagccaggaaagagagctgactcagctgagagaaaagctccaagagggcagggatgctagtcggagtctcaaccaacatctgcaggcacttctgaccccggatgagcctgataattctcaaggtcgcgacctgagggagcaactggcagagggctgcagattagctcagcatctggtccagaagctgtccccagaaaatgacgatgatgaagacgaagatgtcaaggtggaggaggcggagaaagtgcaagagctgtacgcgccccgggaggtgcaaaaggcagaagagaaggaagtccctgaggatagcctcgaagaatgtgccattacatgttcaaactctcatcatccatgtgagtccaaccagccttacggaaatacacggattacgttcgaggaagaccaggtcgactcaaccttaattgatagttcctcccatgatgagtggttagatgcagtatgcatcattccagagaacgaatccgaccacgagcaggaggaggagaagggccctgtcagccctcggaatctgcaagagagcgaagaggaagaggcacctcaagagagctgggatgagggcgattggaccctgagtatccccccagacatgtcggcatcttatcagtccgatagaagtaccttccattctgtcgaagaacagcaagtcggactggctctggacataggtcgacattggtgcgaccaggaaaaaggcggccctcggggccataaatcccaagcccaacaaggggctgctggctag

SEQ ID NO: 196989 - DNA, 1668 bp, Artificial Sequence
  Description of Artificial Sequence: Synthetic coding sequence
atggtggtgagcgccggcccctggagcggcgagaaggccgagatgaatattctggagatcaacaaaaagtctcgtccacaactggccgaaaataagcagcagttccgcaacctgaagcagaaatgcctggttactcaggtggcttactttttggctaataggcagaacaattatgactatgaggactgcaaggatctgataaaaagtatgttaagggacgaaagactgttgacagaagaaaaactggctgaggagcttggccaggcagaggagcttcgtcagtataaggtgctggttcattcccaagagcgggagctgacccagctccgcgagaagctgcaggaaggcagagacgcgtcacgttcactgaaccagcatctacaagctttgcttacccctgacgaacctgacaacagtcagggcagagacctcagggaacagttggccgaggggtgtaggcttgcccagcacctcgtgcagaaattaagtcccgagaatgatgatgacgaggacgaggatgttaaagttgaggaagctgaaaaagtacaggagctctacgccccccgagaggtccaaaaggcagaagaaaaagaggttccggaagactccctggaagagtgtgcgatcacctgctccaatagccatcatccctgtgaaagtaaccagccttacggaaacacgcggattacttttgaggaagatcaggtagactccaccctcatcgactcctcctctcatgatgaatggctcgacgccgtgtgtattatacccgagaacgaatctgatcatgaacaagaagaggagaaaggccctgtgtcgccacgaaacctgcaggaaagtgaagaggaggaagcaccccaggaatcttgggatgaaggagactggacgctgagcatcccgcccgatatgtcggcttcttaccaatccgaccggtccaccttccattctgttgaggagcagcaagttggcctggcactcgatattgggcgccactggtgtgaccaggtgaaaaaagaggatcaggaagccacatcccctaggctatctcgagagctcctggacgaaaaggagccagaggtgctccaggattcgttggacagattctacagcacaccatttgaatacctggaactccctgatctgtgccagccctaccgatccgacttctattcactgcaggaacaacatctggggctcgcacttgacctggatcgtatgaaaaaggaccaggaggaggaggaagaccaagggcctccatgcccccgtttgtctagagaacttccagaggtggtcgagcctgaggacctgcaggatagtctggatcgttggtattccacaccattcagttaccccgaactacctgatagctgccagccctatggatcgtgtttctactccttggaagaagaacacgtcgggttctcgttagatgtggatgaaattgaaaagtaccaagagggggaggaagaccaaaagcctccctgtccacgcctgaacgaggttctgatggaggcggaagaaccagaagtgctccaggattccctcgacaggtgttacagtactacatcaacctactttcagctacatgctagctttcaacagtaccggtcagcattctattccttcgaggaacaggatgtatcactggctctggacgtggataactag

SEQ ID NO: 196990 - DNA, 1692 bp, Artificial Sequence
  Description of Artificial Sequence: Synthetic coding sequence
atgcccctgacccccaccgtgcagggcttccagtggaccctgcggggacccgatgtagaaacatctccttttggggctccccgagcagcgtcccacggtgtgggccgacaccaggaactgagggacccgaccgattacgaggactgtaaagatctcatcaagtccatgttgcgggatgagcgcctcctgaccgaagagaaactagcggaggagctgggacaggccgaggaactgcggcaatacaaagtactggtgcattcccaggagagggaactgacacagttgcgtgagaaactgcaagagggcagggacgcaagtaggtccttgaaccagcatttacaggccttgttaacgcctgatgaaccggacaacagccagggccgcgatttgcgtgaacagttggccgaagggtgccggctggcccagcacttggtccagaagttgtccccagaaaacgatgatgacgaggacgaagacgtcaaagtcgaggaagcagagaaggtacaagaattgtacgcccctcgcgaggtgcagaaagcggaggagaaggaggtacccgaggactctctggaagagtgtgcgataacctgtagcaactcccatcatccgtgcgaaagtaatcagccttacggtaataccagaattaccttcgaggaggatcaggtggacagcacgctcatcgacagtagttcccacgatgagtggctcgacgctgtgtgcattatccctgagaatgagtctgatcatgaacaggaggaagaaaaagggcctgtctccccacgcaacttgcaagaaagtgaggaggaagaagctccgcaggagtcttgggacgagggggactggactctgagtataccacctgatatgagcgcctcatatcagtccgatcgatctacgtttcactccgtggaggagcagcaggtggggctggctctggacatcgggagacattggtgcgaccaagttaagaaagaagatcaggaggctacgtctccccgcctctctagggagctcctggacgagaaagagcctgaagtgctccaggactctctggacagattttactccactcccttcgaatatctcgagttacctgacttgtgccagccttaccggtccgacttctatagcctgcaggagcaacacctggggctggctttagatctggatcggatgaaaaaggatcaggaggaagaggaagaccaggggcccccttgccctcggctgtctagagaactccctgaggtggtcgagcctgaagacctccaggattccctggatcgttggtacagtaccccgttttcctacccagagctccccgacagttgccaaccctatggctcctgcttctatagcctggaggaggagcacgttgggttttctctggatgtcgatgagattgagaagtaccaagagggggaggaagaccagaagccaccttgccctagactcaacgaagtgctcatggaagcagaggaacccgaagtccttcaggatagtttggacagatgttactccaccacttcaacttatttccaacttcacgcgagtttccaacagtaccgctccgcattctactcattcgaggaacaggatgtcagtctggcactagatgtcgacaatcgttttttcacactcacggtgatccgacaccacctcgcctttcagatgggagttatatttcctcattag

SEQ ID NO: 196991 - DNA, 1917 bp, Artificial Sequence
  Description of Artificial Sequence: Synthetic coding sequence
atggtggtgagcgccgaccccctgagcagcgagcgggccgagatgaacatactggagatcaatcaggagctacgatcgcaacttgccgaatccaatcagcagttcagagatctgaaagagaagtttctgataactcaagcgaccgcttactctcttgccaatcaactcaagaagtataaatgcgaggaatacaaggacattatcgactccgtacttagagacgagttacagtctatggaaaagctggccgaaaaattgcgccaggccgaggaacttcggcagtacaaagccctcgtccactcccaggctaaagagttgactcagcttcgggagaagctaagggaaggtagagacgcttctcggtggctcaacaagcaccttaagaccctgctgacccctgatgatccagacaaatcgcaaggacaagatctgcgggagcaattggctgagggccatcggctcgctgaacacctcgttcataaactctctcccgagaatgatgaagatgaggacgaggacgaggatgataaggacgaagaggttgaaaaagtgcaggagtcaccagccccgcgggaagttcagaagacagaagaaaaggaagtgccccaggactcattagaggagtgtgctgtgacgtgctccaattctcacaatccgtctaacagtaatcagccccatcgcagtaccaaaattacatttaaagagcacgaggtagactccgctctcgtcgtcgaaagcgagcacccacacgatgaggaggaggaggccttgaacatccctccggaaaaccagaacgaccacgaagaggaggaaggcaaggcccctgtccctcctcgacatcatgacaagagcaattcatatagacacagggaggtgagctttctagctctcgatgaacaaaaggtgtgctcagctcaagacgttgcccgggactacagcaatccgaagtgggatgagacgtctttaggctttcttgaaaaacagtctgatctcgaggaggttaagggacaggagactgttgcccccagactgtctcgggggcctctccgggtggacaagcatgaaatccctcaggagtctctagacggatgctgcctcacccctagtatccttccagatctgactccatcctatcacccatattggagcaccctctattcctttgaagataagcaagtctcccttgcccttgtcgataaaatcaagaaggatcaggaggaaatcgaggaccagagccctccctgtccgcgactttcacaagaacttccagaggttaaggaacaggaggtgcctgaggacagcgtcaacgaagtgtatctcaccccctccgtccaccacgatgtgtctgactgtcatcagccttactcctctaccttgagttcccttgaggaccagctggcatgctcagcccttgacgtggcaagtccaaccgaagctgcttgtccacagggcacttggagcggcgacctgtctcatcaccagtccgaggtgcaagtgtcacaggcccaactggaacccagcacactcgtccccagttgcctaagactgcaactggaccagggcttccactgcgggaacggactggcacaacgaggcctgtccagcacaacatgtagcttctcggcaaatgctgattccggaaaccaatggcctttccaggaactcgtattagaaccgtcattgggaatgaagaacccacctcagttagaggatgatgccctcgaaggctccgcgtccaacacacagggccggcaggtgacaggtcgaattcgcgccagcctagtgctgatactcaagacaattcgtaggcgcttacctttttccaagtggaggttggcattcagattcgccggaccacacgctgagtctgccgagattcctaatactgcgggccggacccagagaatggcaggctag

SEQ ID NO: 196992 - DNA, 1917 bp, Artificial Sequence
  Description of Artificial Sequence: Synthetic coding sequence
atggtggtgagcgccgaccccctgagcagcgagcgggccgagatgaacatccttgagattaatcaggagcttagatctcagctggccgaatcgaatcagcaattccgtgacctaaaagaaaagttcctgattacacaggctaccgcgtacagcctagcgaaccagctgaagaagtataaatgtgaggagtataaagacatcattgattctgttttgagggatgaactccagagcatggagaagctggcagagaaactccgacaggcggaggaactccggcaatataaggctttagtccatagtcaggccaaagagcttacccagctgcgcgaaaaactgcgggaagggagagatgccagccgctggctcaataagcacttgaaaacactgcttaccccagacgacccagataaaagccagggacaggacctgcgcgagcaacttgcagagggacatagactggcagaacacctggtccacaagctcagtcccgagaacgatgaggacgaggacgaagacgaggacgataaagacgaagaagtcgaaaaggtgcaggagtctcccgcaccgcgggaagtacaaaaaactgaggagaaggaggtgccccaggacagcctggaagagtgtgctgtgacatgctccaatagccataaccctagtaatagtaatcaaccacaccgttcgaccaagatcacatttaaagagcatgaagtggacagcgccctggtggtggagagcgagcacccacacgatgaggaagaggaagccctgaacattccgccagagaatcaaaatgaccatgaagaagaggagggcaaggcccctgttccccctagacatcacgataaaagtaacagttatagacacagggaggtctcttttctcgcgctggacgagcagaaggtgtgttccgcccaggatgttgcccgcgactactctaatccaaagtgggatgaaaccagtctgggatttctcgaaaaacaatccgatctcgaagaagtcaagggccaggaaaccgttgcgccacgactgtccagagggcctctgcgagttgataagcatgagattccccaggagagtttagatggctgttgtctgacgccatcaatcctgccagaccttacgccaagttaccacccatattggtcgaccttatactccttcgaagacaagcaggtgtccttggccttggtggacaagattaagaaagatcaggaggagatcgaggaccagtcacctccttgcccccgcctatcacaggaattacccgaggttaaagaacaagaggtgccggaagatagcgttaacgaggtttatttaaccccaagcgtgcaccatgatgttagtgattgtcatcagccctattctagcaccctatcgtctttggaggaccagcttgcatgctctgccctggacgtagcctcacccactgaagccgcctgcccccagggcacatggagcggagatctgagtcatcaccagtccgaggtgcaagtttcacaggctcagcttgaaccaagcaccttagtaccttcttgcctgcggcttcaactcgaccagggcttccactgtggaaatggactggcacagaggggcctctcatcaacaacatgctcattctctgctaacgccgattccggcaatcaatggccgttccaggagctggtgctggagcctagcctgggtatgaagaatccgccccagctggaagatgatgccctggaagggtccgcatcaaacacccaggggcgccaagtgaccgggaggatccgtgcgtctctcgtgctgatcctcaagacgattaggcggaggttaccattttctaaatggaggctcgcattccggttcgctggaccccatgctgagtccgccgagatcccgaacacagcagggcgcacccagcgcatggcgggctag

SEQ ID NO: 196993 - DNA, 1722 bp, Artificial Sequence
  Description of Artificial Sequence: Synthetic coding sequence
atggtggtgagcgccgaccccctgagcagcgagcgggccgagatgaacatcctggaaatcaaccaggaattgcgcagccagctcgccgagagcaaccagcaattcagagatctcaaggaaaagttcctgataactcaggccactgcttatagccttgctaaccagctgaagaaatacaagtgtgaggagtataaagacatcatcgattccgtgcttagggacgaactccagagtatggagaagcttgccgaaaagttgaggcaggccgaggagctccgacagtataaagccctcgttcactcccaggccaaggagctaacacagctccgtgaaaagctgcgtgaagggagagacgcttccaggtggctaaacaagcacctgaagactctgctcacacccgatgatcccgacaagtcccagggccaggatctgcgagagcagctggctgagggtcacagactggcagagcacctcgtgcacaagctatctccagaaaatgatgaggacgaggacgaggacgaggatgataaggacgaagaggtcgagaaggtgcaggagagtccagcccctagggaagttcagaaaactgaagaaaaggaggtcccccaggattccctggaggagtgtgcagtgacttgttcaaattcccacaacccttctaactctaaccagccacaccgcagcactaaaataacattcaaagagcatgaggtcgacagtgctctggttgtggagagcgagcacccgcacgacgaagaggaggaagctttaaatatacctcccgaaaatcagaacgaccacgaggaagaagagggaaaggctcctgttccccccagaaatcgtcagtctctggagccaggtgagctcactaatctgcgtgattttctgattagcccggtcgtgtcccatgttgccaaccccggccaccacgacaaaagtaatagttatcggcacagggaggtctcttttctcgccttagatgagcagaaggtctgtagcgcccaggatgtggctcgcgattatagcaatcccaagtgggatgagacgtcgctgggcttcctcgagaaacagtcagaccttgaggaagtaaagggccaggagaccgttgcgcctagactgtcgcgcggacctcttagggtagataagcacgagatcccccaggagtctcttgatgggtgctgtctcaccccctctatcctccccgatcttacaccttcctaccacccctattggtcaactctttattcattcgaggacaagcaagtgagtctcgctttggttgacaaaatcaagaaggatcaggaggagatcgaagaccagtcacccccttgcccgcgcctgtcacaagagctgcccgaggtgaaggaacaagaagtgccagaggactccgtgaacgaggtctacctgactcctagcgtgcaccatgacgtttctgattgtcatcaaccgtactcttcgacgctgagtagtttagaggatcagctggcctgtagtgcacttgacgttgcgagtccgacggaagccgcgtgtccccagggtacctggtccggggacctgagtcaccaccagagtgaagtccaggtcagccaggctcagctagagccatccacacttgtgccctcttgcttgcgcctccagctagatcaaggctttcactgcggaaatgggctggctcagcggggtctgtctagtactacatgttctttcagcgctaatgcctag

SEQ ID NO: 196994 - DNA, 372 bp, Artificial Sequence
  Description of Artificial Sequence: Synthetic coding sequence
atggtggtgagcgccgaccccctgagcagcgagcgggccgagatgaatatcctggaaataaaccaggagctgcggtcgcagctcgccgagtcaaatcagcagttccgggacttgaaagaaaagtttctcattacccaggccaccgcttactctctcgccaatcaactgaaaaaatattcatgcttgaaatacaggaatcacctgccccccgaaaggtgccggaggctgaaaaaaagaaagtcactgcggacccactggcgaaacgtcctgagtcttgtccagatcgtcacaacgctgctgactccaaccagcttgacaggcgcgcccaagagccatctgagaaatactaagtccacacttttgtggctgtag

SEQ ID NO: 196995 - DNA, 2004 bp, Artificial Sequence
  Description of Artificial Sequence: Synthetic coding sequence
atggtggtgagcgccgaccccctgagcagcgagcgggccgagatgaatattctcgagataaatcaggaactgcggtcccagctggcggagagcaaccagcagtttagagacctgaaagaaaagtttctgatcacacaggccacagcatacagtctggcaaatcagctcaaaaaatacaaatgcgaggagtataaagacatcattgacagcgttctcagagatgagctgcaaagcatggagaaactcgcagagaagcttaggcaggcagaagagctgcgtcagtataaggccttagtacatagtcaggccaaagaattaacccagttacgagagaaactcagggagggacgagacgcctcacgatggctaaacaaacacttgaagaccctgctgacccccgacgacccagataagagtcaagggcaggatctgagggaacagctcgcagaggggcaccgactggcggagcacctagtgcacaaactgagtccggaaaacgatgaggacgaggacgaggacgaggacgacaaggacgaggaagtcgagaaggtccaagagtcccccgccccacgtgaggtccaaaaaaccgaagagaaagaggtgcctcaggatagtttagaagaatgcgccgtgacctgtagcaattcgcacaacccatctaattccaatcagccccaccgaagcacaaaaattacatttaaggagcacgaggtcgactccgccctagttgtggaaagcgagcacccccacgatgaagaggaggaggccctgaacatcccccctgagaatcagaacgaccacgaggaagaagagggaaaggcccccgtgccccctcggaataggcagtccctggagcccggagagctgaccaatctccgcgatttccttatttcacccgttgtgtcccatgtggcaaaccccggccatcacgataagagcaactcatatcggcacagagaggtgagcttcctggccctagacgaacagaaggtctgctctgcacaagatgtggcccgggactactcgaaccctaagtgggatgagacaagcctggggtttttggagaagcagtctgatttagaggaggtcaaaggacaagagaccgtggctcccagacttagccgggggccattgcgggtcgataagcacgaaatcccacaggagagtttggatgggtgctgcctaacaccaagcatcctgcctgatttgacccccagctatcacccttactggagtacactgtattcctttgaagacaagcaggtgagcttggccctcgtggacaagattaagaaagatcaggaggaaatcgaggatcagagtccaccttgccccagattgtcccaggagctgcccgaagtgaaggaacaggaagttcctgaagacagcgtcaatgaggtctaccttactccttctgtccatcacgatgtgtcagattgtcatcagccatactcttcgactctgtctagcctcgaggatcagttggcctgtagcgcactggacgtggctagccctaccgaagccgcgtgcccacagggcacctggtctggagacctatcacatcatcggagtgaggtgcagatctcgcaagcacagttagagccttcaactctggtcccaagctgcctgagactccagctggatcagggttttcattgcggaaacgggttggctcagcgcggcctctcttcaacgacttgctcattcagtgcaaacgcagactccgggaatcagtggccgtttcaggagcttgttcttgaaccttctctgggtatgaagaatccccctcagctcgaggatgacgcactggagggaagtgcgtcaaacacccagggacgacaggtgacaggacgtatccgcgcttccttggtgctgatcctcaaaactattcgacggcggctcccattctccaaatggcgtctcgcgttccgatttgcgggcccacacgctgagtctgcagaaattccaaataccgctgaacgcatgcagagaatgattggatag

SEQ ID NO: 196996 - DNA, 1722 bp, Artificial Sequence
  Description of Artificial Sequence: Synthetic coding sequence
atggtggtgagcgccgaccccctgagcagcgagcgggccgagatgaatatcctggaaattaaccaggagctcaggtcccaacttgccgaatccaaccagcagtttcgagacctgaaggagaaatttttgatcacccaggccaccgcgtactccctggccaaccagctgaagaaatacaagtgtgaggaatacaaggatatcattgatagtgtgctgagggacgagttgcaatctatggagaagctggctgagaagctgcgccaggcagaggaattacgacaatacaaggctctggtgcactcccaagctaaggaactcactcaactccgtgagaaactgcgcgaaggacgcgatgcatcccggtggctgaataaacacctaaagaccctcttaacccccgacgacccagacaagtcccagggacaggatcttcgggaacagctggcggaggggcacaggctagctgagcatctagtccacaagctgtctcccgagaacgatgaggacgaagatgaagacgaagatgataaggacgaagaggtcgagaaggtacaagaatcacctgcaccccgcgaagtccaaaagacagaggaaaaggaagtccctcaagactccctggaggagtgtgcagtcacctgctctaattcccataatcctagtaactccaatcagcctcacaggagcacaaaaataacctttaaagagcacgaagtcgacagcgctctggtggttgaatctgaacatcctcacgatgaagaggaggaggctctgaatattccccccgaaaaccagaacgaccacgaggaggaagagggcaaagctcccgtgccaccccgaaaccggcaaagcctggagcccggcgagttgactaatcttagagacttcctcattagccctgtcgtcagtcacgtggcaaacccgggtcaccatgacaagtcaaattcctatagacacagggaggtgtcattcctggctttggacgagcaaaaggtgtgcagcgctcaggacgtggcccgggattactccaacccaaagtgggatgagactagtctgggtttcttagagaagcaatctgaccttgaagaagttaagggacaagagaccgtggctcctcgcctgtccagggggccactccgagtggataaacacgagattccgcaagagtccctggatggatgttgtttaacgccctcaatactgcccgaccttacaccatcttaccacccatattggtccacactctatagctttgaagataaacaggtttccctggcactcgtggataagatcaaaaaggaccaagaagaaattgaagatcaatctccaccatgcccccgattgtcccaggagctcccagaggtgaaggaacaggaagttcccgaggattccgtgaacgaagtgtacctgactccttctgttcaccacgacgtatctgactgccatcagccctacagcagcaccctcagttcattagaggaccagctggcatgctctgcactagatgttgcgagtccgactgaggctgcatgtccccaagggacctggagcggagatctatcccatcacagaagcgaagtgcaaatctcgcaagcccagctggagccaagtactttggtcccttcttgcctgcggctgcagctggaccagggattccattgcggcaacggtctggcccagagagggctaagctctaccacttgtagtttctccgctaacgcttag

SEQ ID NO: 196997 - DNA, 1917 bp, Artificial Sequence
  Description of Artificial Sequence: Synthetic coding sequence
atggtggtgagcgccgaccccctgagcagcgagcgggccgagatgaatattttagagattaaccaagagttgcgcagccagttagctgagtccaatcaacaatttcgggatctcaaagagaagtttcttattacccaagccacggcttattcactggctaaccagctgaagaaatataagtgcgaagaatacaaggatattatagactcggtgctgcgggacgaactccagagtatggagaagttggcggagaagctacgtcaggctgaagaattgcggcaatacaaggccttggtacatagtcaggccaaggaactcactcaacttcgggagaagttacgcgaggggagagatgcttcaagatggttgaacaagcacctgaaaaccctactgactcctgacgatcctgacaagagccaggggcaagaccttcgggagcagctcgctgaaggacataggcttgctgaacacttagtgcacaagctgagtcccgaaaacgacgaagatgaggatgaggatgaggatgacaaggacgaggaggtggaaaaagtgcaggagtcaccagcgccccgcgaggttcagaaaactgaggagaaagaggtccctcaagattccttggaggaatgcgctgttacatgcagcaatagtcacaacccctctaacagcaaccagcctcaccgaagtaccaaaatcaccttcaaggaacatgaagtggacagcgctctggtggttgaatccgaacacccgcatgatgaggaagaagaggccctgaacatcccccccgagaatcagaacgatcatgaagaagaggagggaaaggccccagtgccaccccgtcatcacgacaagagcaatagttacagacatagagaagtgtcctttctggctcttgacgaacaaaaagtatgctcagcacaggacgtggccagagattacagcaaccccaagtgggacgaaactagtcttggttttctagagaagcaatctgatctggaggaagtcaaggggcaggaaaccgtcgccccgcgcctgagccggggacctctccgggtggacaagcatgagattccacaagagagcctcgacgggtgctgcttgaccccttccatcctgccagacctgactccatcctaccacccatattggtcaaccttgtactccttcgaagataaacaggttagtctggctttggtggataagatcaagaaggaccaggaggagatcgaagatcagagccccccctgtcccagattatcacaggagttacctgaggtcaaagagcaggaagtgcctgaggactctgtaaacgaggtttacctgactccctctgttcaccatgatgtgagcgactgccaccagccttactcctcaacactgagctcgcttgaggaccagcttgcctgttccgctctggatgtcgcatctcccacagaagcagcctgtccacaaggaacgtggtccggagacctgtcacatcaccgatctgaagttcagatttcacaagcccagcttgagccatctactcttgttccctcgtgtctccgccttcagctcgaccagggcttccactgtggtaacggcctggcccaaagaggcctgtccagcacaacgtgttcgttctccgccaatgcggacagcgggaatcaatggcctttccaggagttagtgctcgaacccagtctcggtatgaagaatccgccccagctggaggacgatgccctagaagggtcagcatcgaatacacagggacgacaagttaccggacggattagagccagtcttgttctcatactgaaaacgattcgccgcagacttccgttcagcaaatggcgattggcttttcgttttgcggggccacacgccgaatccgccgagatcccgaatactgctgaacgcatgcagcggatgataggatag

SEQ ID NO: 196998 - DNA, 1917 bp, Artificial Sequence
  Description of Artificial Sequence: Synthetic coding sequence
atggtggtgagcgccgaccccctgagcagcgagcgggccgagatgaatatactggagattaaccaggagttgcgtagtcagctagctgagtctaatcagcagttccgtgacctgaaggaaaagtttttgattactcaggccacagcgtattcattggccaaccagttgaaaaagtataagtgcgaagagtataaggatatcatcgactccgtccttagggacgagcttcagtccatggagaaactggctgagaagttacgtcaggcggaggaattgcggcagtataaagcactcgtccactctcaggctaaggagttaacacagcttagggagaagctgagagaggggagggacgcaagccggtggctaaataaacatcttaagaccctactcactccggatgatcccgacaagagccaaggccaggatctgagagagcaactggccgaggggcacaggttggcagagcacctcgtgcacaaactgtcacccgaaaatgacgaggatgaagacgaggatgaggacgacaaagatgaggaggtggagaaggtccaggagagcccagcaccccgggaagtccaaaagacagaggagaaagaggtcccccaagacagcttagaagagtgtgccgtgacctgttctaacagtcataatccttccaacagcaaccagccccacagaagtacgaagatcacatttaaggagcacgaagtagatagcgccctggtcgtggaaagtgaacaccctcacgacgaggaagaagaagcactgaatatcccacctgagaaccagaacgaccacgaggaggaggagggaaaggcaccagtgccaccccggcatcacgacaagagtaactcatatcggcaccgcgaggtcagctttttggccctggatgaacaaaaggtgtgttctgctcaggatgtggcacgcgactattccaaccctaaatgggatgagacgagtctcgggtttctagagaagcagtctgatttggaagaggtgaaaggccaggaaaccgtcgcccccagactctcccgtggaccccttcgcgtggacaagcatgaaattcctcaagagtccctagatggttgttgtcttacccctagcatcctgcccgaccttaccccctcttaccatccctattggagcaccctctactcttttgaggataagcaggtctcactcgccctggtggataaaatcaaaaaagaccaagaagagatcgaagaccagtcaccaccatgcccacgcctgtctcaggaacttccagaagtgaaagagcaggaagtgcccgaggacagtgtgaatgaagtgtatctgactccatctgtccatcatgatgttagtgattgccatcaaccatattctagcaccctgtcttctcttgaggaccagttggcgtgctctgctcttgacgtcgcttcccccaccgaggcggcatgcccccagggaacttggtccggagatctctcacatcaccgcagtgaagttcagatctctcaagcacagttagaacccagtacccttgtgcctagttgcctgcgcctccagctggatcaggggttccactgcgggaatggtctggctcaacgcggtctctctagtacgacatgcagcttttcagcaaatgccgacagtggcaaccagtggccttttcaggaactggtgttggagccctcacttgggatgaagaaccctccacaattggaggatgacgcactggagggctcagcatccaacacccaagggagacaggtcactggacgcattagggcgtctctggtcctaatcctcaaaacaattaggcgaaggctgcccttctccaaatggcgtcttgcctttcggttcgcaggccctcacgcagagtcagccgaaattccaaatacggctgaacggatgcagcgaatgatcggatag

SEQ ID NO: 196999 - DNA, 624 bp, Artificial Sequence
  Description of Artificial Sequence: Synthetic coding sequence
atgctggccagctacaagagctacagcagcaccttccacagcctggaagagcagcaggtgtgcatggctgtggatatcgggaggcaccgatgggaccaagtcaaaaaggaggaccaggaagccacgggcccccgcctgtcgagagagctactcgacgagaaaggtccagaggtcttgcaggattcgttgtaccgatgttacagtactcccagcggatgcctggaacttacagatagctgtcaaccttacaggagcgcattctacgtgctggagcagcaacgggtagggcttgccgttgatatggacgaaattgagaagtatcaggaggttgaagaggaccaagggagatgggaagaggatcaaaacccaccctgcccccggctcaacggggtgctcatggaagtggaagagccagaagtactgcaggattcattagacggatgctactctactccttccatgtacttcgagcttcccgacagctttcagcactaccggtcggtcttctattcctttgaagagcagcacatttcattcgctttatatgttgataatcgctttttcactctgacagtcacaagcttgcaccttgtgtttcagatggaagtcattttccctcaatag

SEQ ID NO: 197000 - DNA, 1830 bp, Artificial Sequence
  Description of Artificial Sequence: Synthetic coding sequence
cccgtgcccggccccaccagcagcgccaccaacgtgagcatggtggtgtccgctggaccccttagcagcgagaaagcggaaatgaacatcctggagatcaacgagaagctaagacctcagctagccgaaaagaaacaacagtttcggaatctgaaagaaaagtgcttcctgacacaactgtccggtttcctggcaaatcagcaaaacaagtacaagtatgaagaatgcaaggatctgattaagtttatgttacgaaacgagcgccagttcaaggaggaaaagttggccgagcagctgaaacaggccgaggagcttcgccagtacaaagtgcttgtgcacgcgcaggaacgggagctcactcaattgcgggagaaactgagggaggggagagacgcatctagaagcctgaatgagcacctgcaggccctactgaccccggatgaacccgataaatcccagggacaggacctgcaggagcagcttgctgaagggtgccgcctagctcagcaccttgtccagaaattgtcgccggaaaatgacaatgatgacaatgaagacgtacaggtggaggtggccgagaaggtacaaaagagctccgctcctcgggagatgcagaaggccgaggaaaaagaagtgccagaagactctttagaggaatgtgcgataacctactcaaattctcacgggccttacgacagcaatcagcctcatcgaaaaacaaaaatcacattcgaggaagacaaagtggattcaactttaatcggaagctcttcgcacgtagagcgcgaagatgccgtccatataattcccgagaatgaatcagacgacgaagaggaagaagagaaagggccagtgagcccaagaaatttgcaagagagtgaggaggaggaggtgcctcaggaaagctgggacgagggatatagtacaccttctattccacccgaaatgctggcaagctacaagagttactcttccacattccactctctggaagaacagcaggtttgtatggccgtcgatattgggagacatagatgggaccaggttaagaaagaagaccaggaggcaactgggccccgcctgagccgggagctgctcgacgaaaagggccccgaagtgttacaggactcactgtacagatgttattctactccaagtgggtatctggaactccctgatctgggccaaccgtatagttctgcagtgtactcactggaagagcagtacttggggctcgcgctcgatttggatcgtattaagaaggaccaggaggaggaggaggaccagggacccccatgcccgaggctatctagagagctactggaggtggttgagcctgaggtgctgcaggactctctggatagatgctattctactccctcaagttgcctcgagcagcctgacagttgccaaccgtacgggtccagcttctacgccctagaagaaaaacatgtgggtttctccctcgacgtcggtgagattgaaaaaaagggaaaaggcaaaaagcggcgaggccgacggagcaagaaggagcgcaggcggggtcggaaggagggcgaggaagatcagaatcccccatgccctaggttgaacggcgtactcatggaagttgaagaacctgaggttctccaggattccctagatgggtgttactcaacaccatcaatgtacttcgaactgcccgatagctttcaacactatagatccgtgttttactcgttcgaggaacagcacatctcttttgctctctacgtggacaaccggttcttcaccctcactgtaacatcactgcatctcgtttttcagatggaagtgatttttccccagtag

SEQ ID NO: 197001 - DNA, 2052 bp, Artificial Sequence
  Description of Artificial Sequence: Synthetic coding sequence
tgacccggccccaccagcagcgccaccaacgtgagcatggtggtgtccgcgggtcccctcagctccgagaaggcagaaatgaacattttggagattaacgaaaagctccgaccccaactcgctgagaaaaaacaacagtttcgaaatctgaaggagaagtgcttcctgactcagctctctggtttcctggccaaccagcaaaacaagtacaagtacgaggagtgcaaggacctgatcaagttcatgctccgaaacgaaagacagttcaaagaagagaagctggccgaacagcttaaacaggccgaggagctgaggcagtataaggtccttgtccatgcccaggagcgcgagctcactcaactgagagagaaacttcgggagggccgcgacgcttctaggagtctgaacgaacaccttcaggcactgctcacacctgacgagcccgataaatcccagggacaggacctgcaggaacagctggcggaggggtgtagactggcccagcatctcgttcaaaagctcagccccgagaacgacaacgacgacaacgaggacgtgcaggtggaagtagcagagaaggtgcagaagtcttcagcccccagggaaatgcagaaggcagaggagaaggaagtgcctgaggactctctggaggagtgcgccattacctacagcaacagccatggaccttacgactccaatcagccacacaggaagactaagatcacgttcgaagaagataaggtagactccacccttatcggctcatcctcgcacgtcgagagagaggacgccgtgcacataattccagagaatgagtccgatgacgaagaggaagaggagaagggtccagtttcaccgcggaaccttcaagagtccgaggaggaagaggtcccacaggagagttgggatgaggggtatagcacccctagtattccacccgaaatgctcgcaagctataaaagctactcttcaacctttcacagcttagaagagcagcaggtctgcatggcagtggacattgggcggcatcgctgggatcaggtgaaaaaggaagaccaagaggccaccgggcctcggcttagccgcgagttactggacgagaagggcccagaggtcctccaggactcactgtatcgctgctatagcactccatccggatgtttggagcttactgactcctgccagccctataggtcagcattttacgtgctggaacagcagcgcgtggggttggcggtagacatggatgaaatcgagaagtatcaggaagtggaagaggaccaagatccttcatgccctaggctgagccgcgagctgttggacgaaaaagagccagaggttcttcaagactctctcgggagatggtacagcaccccatcaggctacctcgagctgccggatctgggtcagccctactcttctgcagtatatagcctggaggaacagtatctgggtctggcattggacctggaccggatcaagaaggaccaggaggaggaagaggaccagggcccgccctgtccccggctttcccgtgaactactggaggtggtcgagcctgaggtgctgcaagacagcttggaccggtgttactcaacaccatcctcttgccttgaacagcccgattcttgtcagccctacgggagctccttctacgctctggaggaaaaacatgtgggcttttctctggatgtcggcgagatcgagaagaaaggcaaagggaagaagagaagaggtcgccggagcaaaaaggagcggaggcgtggtcgcaaagagggcgaagaagaccagaaccccccttgtccccgtttgaacggcgtactcatggaagtcgaagaaccagaggtgctccaggacagtctcgatggttgctacagcacgccttctatgtatttcgagctgccggattctttccaacactaccgatcggtcttctacagtttcgaagagcagcacattagcttcgccttatacgttgataatcggtttttcacgcttacggtgacttccctgcatctcgtattccagatggaagtgatctttccacagtag

SEQ ID NO: 197002 - DNA, 1824 bp, Artificial Sequence
  Description of Artificial Sequence: Synthetic coding sequence
cccgtgcccggccccaccagcagcgccaccaacgtgagcatggtggtgtcagcggggccactgagctccgagaaagccgagatgaatattttagaaattaatgagaagctgcggccccagcttgctgagaaaaagcagcagtttcggaacttaaaagagaagtgctttctaactcagttgtcaggctttctggctaaccaacagaacaagtacaagtatgaggaatgtaaagacctgataaaattcatgctccggaatgagaggcaattcaaggaggagaagctggccgagcagctgaaacaggccgaagaactaaggcagtataaagttctggtgcacgcacaggaacgggagttgacacagctgagagagaaactgcgcgaaggccgtgatgccagccgcagtctgaatgagcatttacaagcactcctgacacccgacgagcccgataagtcgcagggacaggacctgcaggagcagctcgccgagggttgtcggctggctcagcatcttgtccagaaactgagccccgagaatgacaacgatgataacgaggatgtccaggtagaggtggccgagaaggttcagaagagcagtgccccacgggaaatgcagaaagccgaggaaaaggaggtccccgaggacagcctagaggagtgcgctataacatacagcaactctcacggaccctacgattcaaaccagcctcaccggaagacaaaaatcacatttgaagaagacaaggtcgactcaaccctgatcgggtcatccagtcatgtggagagagaggatgccgtgcatatcatcccagaaaatgagagcgacgacgaggaggaggaagagaaaggacccgtatccccaagaaatctccaggaatcagaggaggaagaggttccacaggaatcttgggacgagggctactctacaccgtctatacctcctgagatgcttgctagctataagagttacagttctacgttccattccctggaggagcaacaagtgtgcatggcggtggatatagggcggcaccgctgggaccaggtgaagaaagaagaccaggaggccaccggacctcgcttaagccgcgagctcttagatgagaagggccccgaagtgcttcaggacagcttgtaccgatgctacagtacacctagtgggtgccttgagctgactgactcatgccagccataccgttcagctttctacgtgcttgagcaacagcgggtaggtttggccgtcgacatggacgaaatagagaaatatcaggaagtggaagaagatcaggatccttcttgtcctcggttgagtcgggagttgctggacgagaaggagcctgaagtgctgcaggattccctcggtagatggtattccaccccttctggttacctggagctgccggaccttggccagccatattcctcggcagtgtattccctggaggagcagtacctcggactcgcactggatctcgaccgcataaaaaaagaccaggaggaagaggaggatcagggaccaccatgtccccggctttctcgagagctcctggaggtggtcgaacctgaagtgctacaggattcacttgacgtcattcagttgctccccgttgtcctgaattctttaactccggctagtcccatggaggttccttttatgcattggaggaagaatatgttggcatttttactgacctgggagaagctcaagagacgagggaggggccgaaaggaaggagaggaggatcagcgcaggaaagaagagggtgaggaaaagaaaggaaaaaaaatcaagacacatcacgctcccggtagtaccgcttgttag

SEQ ID NO: 197003 - DNA, 396 bp, Artificial Sequence
  Description of Artificial Sequence: Synthetic coding sequence
atggccgacgtggtggtgggcaaggacaagggcggcgagcagcggctgattagtctacccctgtccaggattcgtgtgataatgaagtcaagtccagaagtttctagcatcaaccaggaggccctagtcttaacggccaaggcaacagaacttttcgtgcaatgtcttgcaacctacagttaccgccacggatcaggaaaagagaagaaagtcctcacttattctgacctggcaaatacagctcaacagtccgagacattccagtttctggctgatattctgcctaagaagattttggcatctaaatacttgaagatgctgaaggaagagaaacgggaagaggacgaagagaacgataacgataacgagagtgaccacgacgaggccgattcttag

SEQ ID NO: 197004 - DNA, 582 bp, Artificial Sequence
  Description of Artificial Sequence: Synthetic coding sequence
atgggcaagcagaacagcaagctgcggcccgaggtgatgcaggacctgctggagtctacggactttactgagcacgaaatccaggagtggtacaagggcttcctccgggactgcccaagtggacacctgtctatggaggagttcaagaagatctacggtaacttcttcccctacggcgatgcgtccaaatttgcggaacacgtttttaggactttcgatgctaatggcgatggaacaatcgatttcagagagtttatcatcgcactatccgtgacttctagaggtaaattggaacaaaagctcaaatgggccttctcaatgtatgacttagacggcaacggctacatttccaaagcagagatgcttgagatcgtgcaggccatatacaaaatggtttcaagcgtgatgaaaatgcccgaagatgaatcaacacccgaaaagcgtacggaaaaaatattcagacagatggatactaaccgggatggcaagctgtcactggaagaattcatacggggcgctaagtcagatcccagcattgtgcgcctgctccagtgtgatccaagtagcgctggccagttctag

SEQ ID NO: 197005 - DNA, 582 bp, Artificial Sequence
  Description of Artificial Sequence: Synthetic coding sequence
atgggcaagcagaacagcaagctgcggcccgaggtgatgcaggacctgctcgagtcaactgattttaccgaacacgagattcaagagtggtataagggcttcttgcgggattgcccaagcgggcatctgtccatggaggagttcaaaaagatttatggaaacttctttccatacggcgatgcctccaaattcgccgaacacgttttccggacttttgacgccaacggagatggcacaatcgactttcgagagttcattattgccctaagcgtgacctccagggggaagctcgagcaaaaacttaagtgggccttctccatgtatgatctggatggcaatggctatataagcaaggctgagatgttggagatcgtgcaagccatatacaagatggtgtcttccgtaatgaagatgcccgaggatgagtccactccagaaaagcgcactgagaaaatcttccggcagatggacacaaatcgtgatggcaaactctctctggaggagtttatccgtggtgccaagtctgatccctctattgttaggctgctgcaatgtgacccttcatctgctggacagttctag

SEQ ID NO: 197006 - DNA, 582 bp, Artificial Sequence
  Description of Artificial Sequence: Synthetic coding sequence
atgggcaagcagaacagcaagctgcggcccgaggtgatgcaggacctgctggagagtaccgatttcacggagcacgagatccaggagtggtacaaaggcttcctccgagattgccctagtggacacctgtccatggaagagttcaaaaaaatctatggaaacttctttccatacggggatgcatctaagttcgctgaacatgtgttccggaccttcgacgcaaatggagacggcaccatcgattttcgcgagttcattatcgccctgtccgtgacatctcgcgggaagctagagcagaaactgaagtgggcattttctatgtatgacttggacggtaatgggtatattagcaaagccgagatgttggaaatcgttcaagctatttataagatggtgagtagcgtgatgaaaatgcccgaagatgagtctactccagagaaacggactgaaaagatcttcaggcagatggacacgaatagggacggaaaactgagtctcgaagagttcatcagaggagctaagagcgatcccagcatcgttaggctgctccagtgcgacccttcgtcggcagggcagttctag

SEQ ID NO: 197007 - DNA, 582 bp, Artificial Sequence
  Description of Artificial Sequence: Synthetic coding sequence
atgggcaagcagaacagcaagctgcggcccgaggtgatgcaggacctgctggaaagcaccgacttcaccgaacatgagattcaagagtggtacaagggcttcctgagagactgtccgtcgggacatctctctatggaggaatttaaaaagatttacggaaatttcttcccctatggcgacgccagcaagttcgccgagcacgtgttcaggacatttgacgccaacggcgacgggacaatcgacttcagagagttcattattgcactctccgtgacgagcagaggaaagctggagcaaaagcttaagtgggccttctcgatgtacgatctagatggcaacggctacattagtaaagccgagatgctggagatcgtgcaggccatttacaagatggtatccagtgtcatgaaaatgcctgaggacgaatccactcccgagaagcgtaccgagaagatctttcgacagatggacacgaacagggatggtaaactctcacttgaagagttcattcggggcgcaaagtcagatccatcaattgtgagacttctgcaatgtgacccctcctctgcggggcagttctag

SEQ ID NO: 197008 - DNA, 3966 bp, Artificial Sequence
  Description of Artificial Sequence: Synthetic coding sequence
atgggcgcccccttcgtgtgggccctgggcctgctgatgctgcagatgctgttgtttgtggctggcgaacaggggacccaggacatcaccgacgcctcggagcgaggcttgcatatgcagaaattaggatcagggtccgtgcaggccgcccttgctgaattggttgccttgccgtgtctgtttacactccagcctcgcccaagtgcagcacgcgacgcacctagaatcaagtggacaaaagttcgtactgcttccggccagaggcaggatctgccaattctggtggcgaaggacaacgtggtgcgcgtggctaaaagctggcaggggagagtttcgctgccgtcctatcccaggcggagggctaacgctacccttctcttgggccccctgagggcctcagactctggcctgtatcgttgccaagttgtacggggaatcgaagatgagcaagatctggtcccactggaggttacaggcgttgtgttccactatcgatccgctcgcgaccgctacgctttgacgtttgccgaagctcaggaggcatgcagactctcctccgctattatagcggcacccagacacttacaggctgcctttgaggatgggtttgataattgcgacgctggctggctgtcagacagaacggtgcggtaccctataactcaatccaggcctggctgctatggcgacagatcgtcactgcccggagtaagatcctacgggagaaggaaccctcaggagctttacgatgtttattgcttcgctagagaactgggtggggaggtgttttatgtaggccctgctcgaaggctcaccttggcgggcgcccgggctcagtgcaggcgccaaggtgctgcccttgcttccgtgggacagctgcatcttgcatggcatgaaggcctggatcagtgcgatcctggctggctggccgacggctcagtgcgctaccctatccagacacctagaagacgttgcggaggccccgcaccaggcgtacgaactgtctataggtttgctaatcgtacaggatttccctccccagctgagcgatttgatgcctactgctttagagctcatcaccctacatcccaacatggcgacctggagaccccaagcagcggcgatgagggcgagattctgtcggctgaaggaccccccgtgcgggaacttgaaccaaccctcgaagaggaagaggtagttaccccagacttccaagagccacttgtatctagcggagaggaagaaactctcatcttggaggagaaacaagagagccagcagacattgtcaccaacacctggagaccccatgctggcttcctggccaactggagaagtgtggctcagcactgtcgcaccttctccatctgacatgggggctggaactgctgcctctagccacacagaagtagctcctacggatcctatgcctcgacgccggggacgcttcaaagggctgaatggtaggtatttccaacagcaggaacccgaaccaggactccaaggaggaatggaggcctccgcacagccccccaccagcgaagccgctgtgaaccagatggagcctcctttagcaatggctgttactgaaatgttagggtcgggacagagccggtcgccttgggccgacctgaccaatgaggtcgatatgcccggagcaggcagtgccggaggcaagtcttcccccgaaccatggctctggcctcccaccatggtgccgccatcaatctctggccattcaagagcgccggttttggaactagagaaagctgagggacctagtgcacgcccggctactcctgatctcttttggtctcccctggaggcaaccgtttctgcccctagtcctgcgccatgggaggccttcccagtggccacttcgccagatctccctatgatggctatgctcaggggacccaaggaatggatgctgcctcatcctacacctatatctaccgaggcaaaccgggttgaggcccacggggaagccactgcaacagctccacccagccctgcggccgaaaccaaggtatacagtctccctctgtcactgaccccgaccggacaagggggagaggcgatgcctacgactcctgagtcacccagggcggatttcagagagactggtgaaacgagccccgctcaagtgaataaggctgaacattcttccagtagtccttggccttccgtgaatcgaaacgtggctgtaggatttgttcccactgagaccgccacagagccaacggggctgcgcggcatacccggctcagaaagtggagttttcgacactgctgaatcccctacctccggtctgcaggcgacagtggacgaggtccaggatccctggccctccgtgtactctaaggggctggatgcaagcagcccatccgctcctctggggtcccctggggttttcctcgtacccaaggtcactccgaacctggaaccatgggttgcaactgacgaaggacccaccgtaaacccgatggactctacggtgacccccgcaccttcagacgcgtcaggcatttgggaaccagggagccaggtttttgaagaggcagaatcaaccactctcagcccacaggtagctcttgatacaagtatcgtgactcccttgacaaccctcgagcaaggagataaggtgggagtacccgccatgagcaccctcgggtcgtccagttcacagccccatccagaacctgaagaccaggtggagacccagggcaccagcggcgcctccgtgcccccccaccagtcaagccctctcggaaaacccgccgttccaccaggtacaccaactgccgcatcagtgggagaaagcgcatcagtgtccagcggcgagcctacagtcccctgggacccaagctccacactgctacccgttaccctcgggatcgaggacttcgagttagaggtgcttgccgggagccctggcgtggagtctttttgggaagaagtggccagcggcgaggaacccgccctgccaggcaccccgatgaatgcgggggcggaggaagtgcattccgacccttgcgagaacaatccatgcctgcacggggggacatgcaacgcaaacgggactatgtacggctgtagctgtgaccagggttttgctggtgagaattgcgagatagacatagatgactgcctctgctccccgtgcgagaacggaggtacctgtattgatgaggtgaacggcttcgtatgtttatgcctgcctagttacggtggaagtttctgcgagaaggatacggaaggttgcgaccgcggatggcacaaattccaaggccattgctaccgctacttcgcgcaccgacgcgcttgggaagatgctgagaaggattgccgccgacgctccgggcacttaacttctgttcattcccccgaggagcacagctttattaatagtttcggccacgagaatacctggattggcctcaatgatagaatcgtcgaacgggattttcagtggaccgacaacactggcctgcaatttgagaactggagagagaaccagcccgacaacttcttcgccgggggcgaagactgcgttgtcatggtggctcacgagagtggcaggtggaacgacgtgccctgcaattataacctaccctatgtgtgtaaaaagggcaccgtcctttgtggacccccacccgctgttgagaatgcgagcctgataggagcaagaaaagctaagtataatgtccacgctacagtccgctaccagtgcaatgaagggtttgcccagcatcacgtcgcgacaatccgatgcagatccaatggcaagtgggatcggccccaaatcgtttgcactaagccacggcggagtcatcgaatgagaagacaccaccaccaccatcagcaccatcatcagcaccaccatcataaaagtcgaaaggaacgcagaaaacacaagaagcaccccactgaagattgggagaaggatgagggcaacttctgctag

SEQ ID NO: 197009 - DNA, 2319 bp, Artificial Sequence
  Description of Artificial Sequence: Synthetic coding sequence
atgcccggcgccggcagcgccggcggcaagagcagccccgagccctggctctggccacccaccatggtccctccatctatctctgggcattcgcgggctcctgtgctcgaattggagaaggctgagggtccttcggctcgtccggccacccctgatttgttctggtcacctttggaggccacagtgtccgccccatcccccgccccctgggaggcattcccggtggcgacttctccggacttgccaatgatggccatgctgcgcggacctaaagaatggatgttgccccacccaacacccatatctactgaggccaatagggttgaggcgcatggcgaggcgactgctactgcccctccgtcccctgctgcggaaacaaaagtctactccttaccactgtcattaacacctactggtcaaggaggagaagctatgcctaccactccagaatccccccgcgccgacttcagggagacgggtgagacctctccagctcaggtgaataaggccgagcacagctccagcagtccttggcccagtgtgaatcggaacgttgccgtgggattcgttccaaccgaaacggcgactgagccaaccggccttcgtggaatccctggttcagagtcaggagtgtttgacaccgctgaatcccctacctctgggttgcaggccaccgtcgatgaagttcaggacccttggcctagcgtgtacagtaagggactggacgcctcaagtcctagcgccccactcggttcacctggcgtgttccttgtgcccaaagtgacgcctaacttggaaccttgggtcgccacggacgaggggccaaccgtcaaccccatggactcaacagtcacacccgcgcctagtgacgcgagcggaatctgggagcctggcagccaggtgtttgaggaggcggaatccacaacgcttagcccccaggtagctcttgatacaagcattgtgacaccccttactactctagagcaaggtgacaaagttggagtcccagcgatgagtacccttggctccagtagctctcagccacaccctgagccggaagaccaggtggagactcaggggaccagtggggcctccgtacccccgcaccagtcatcacctctcggaaaaccagccgtgcctcctggaacccccactgcggccagcgtcggagaatccgccagtgtatcaagcggggagccaacggtgccctgggacccatcttcgacactattgcctgtgactctgggtattgaagacttcgagctggaagtgctggcagggagccctggcgtggaatccttctgggaggaggtggcgtccggagaagagccagccttaccggggactcccatgaatgccggagccgaggaggtccattctgacccatgtgagaataatccttgtctgcatggcgggacatgtaacgccaatgggacgatgtacggctgcagttgcgatcagggctttgccggcgagaactgtgagattgacatagacgattgcctttgcagcccctgcgaaaacggcggcacttgcatagacgaagtcaacggtttcgtatgcttgtgcctgcccagttacggagggtcattttgcgaaaaagacaccgagggctgcgatcgggggtggcacaagttccagggacactgttaccggtattttgcccacagaagagcttgggaggatgcagaaaaggattgcagaagaagaagcggccatcttacatccgtccactcccccgaagaacattccttcattaacagctttggacacgaaaacacatggattggccttaatgacagaattgtagagcgcgactttcagtggaccgacaatacgggcctgcagttcgagaattggagggagaatcagccagacaacttcttcgctggtggcgaggattgcgtggttatggtagcccatgagtcaggtcgctggaacgatgtgccctgtaactataatctaccctacgtctgcaaaaagggcacagtcctctgtgggccgccccccgccgtggagaacgccagcctgattggtgctaggaaggcaaaatataacgtgcacgccactgttcgttatcagtgcaatgaagggttcgcccagcatcatgtggcaaccattcggtgcagatctaacggcaaatgggatcgcccgcagattgtgtgtaccaagcctcggcgctcccatagaatgagaaggcatcaccatcatcaccagcaccaccaccagcaccatcatcacaaatctcgcaaggagagaagaaagcacaaaaagcacccgaccgaagactgggagaaggatgagggcaacttttgttag

SEQ ID NO: 197010 - DNA, 4008 bp, Artificial Sequence
  Description of Artificial Sequence: Synthetic coding sequence
cggcccccccgggacgccagcgagctgggcgcccggagccggatgggtgcccctttcgtgtgggcattgggcctgctcatgctccagatgctattatttgtggccggagaacaggggacccaggatattacagacgcctccgaacggggccttcacatgcagaaactggggagtggctctgttcaggcggccctggctgagctggttgccttgccgtgtctgttcacccttcagcccagaccatctgctgctcgggatgcaccacggattaagtggactaaggtgcggactgcctccggacagaggcaggacctgcctatcctggtggccaaagataatgtcgtacgggtggctaagtcctggcaggggagggtatctctaccttcttacccccgaaggcgagccaacgctactctgctgctggggccactccgcgccagcgacagtggtctttatcgctgccaggttgtacgagggatcgaggacgaacaggaccttgtgcccttagaagtgaccggcgtcgtgttccattaccggtcggcccgcgatcgctacgccttgacttttgctgaggcccaagaggcttgtaggcttagttccgcaatcatcgcagcgcctcggcacctgcaagccgccttcgaggatggattcgataattgcgacgccgggtggctttcagaccgtaccgtgaggtaccctataacacagagtcgccccggctgttatggtgatcgtagctcgttgccgggggttagatcttacgggcgaagaaacccacaggagctttacgacgtgtactgttttgcccgggaactgggcggcgaggttttttacgtcgggccggcaagaaggttaactctagccggtgcaagagcccagtgtcggcggcagggcgccgctctagcttcagtgggtcagctccaccttgcctggcacgagggcttggaccagtgcgaccctggctggctcgctgatggctctgtaaggtacccaattcagaccccgcgccggagatgcgggggccctgcccccggtgtgagaaccgtttatcgatttgcaaacaggacaggatttccgtctcctgccgagagatttgacgcatactgctttcgggcacaccatcctaccagtcagcacggagatctagagacgcctagctcaggggatgagggagagatactgtctgcagaaggacctcctgtgcgcgaactcgaacccaccctggaggaagaagaggtggtcacccccgactttcaggagcctttagtaagctcaggggaggaggaaacattgatcttggaagagaaacaggaaagccagcagacattgtcacccacaccgggagatcccatgctcgctagttggcccacaggcgaggtgtggctgtctaccgtggcaccgagtccgagtgacatgggggctggtaccgcagcaagttctcacactgaggtggcgcccaccgatcctatgccaaggagacggggcaggttcaaaggcctaaacgggcgctattttcagcaacaagagccggaacctggcctccagggaggaatggaagcaagcgcccaaccgcctacgtcagaggccgcagtcaatcagatggagccaccactggccatggccgtgactgagatgctcggcagcggccaatccaggtccccttgggcagacctgacaaatgaagtcgatatgcctggggcaggctccgcaggaggtaaaagtagtcctgaaccttggttgtggccacctaccatggtccctccgagcatttcaggtcattcacgagcacctgttctggagctcgagaaagccgaggggccgagtgcacgtcccgcaactccagatttattctggagccctcttgaggcaaccgtgtccgcgccgagccccgctccctgggaggcattccccgttgctacgtcccccgacctcccaatgatggccatgctgagaggtcctaaggaatggatgctgccccatcctacccccatttcaactgaggcaaatcgagtagaagctcatggagaggccaccgcaacggctcccccatcccccgccgcagagacaaaggtttattccctgcctcttagtctcacccctaccggccagggaggtgaggcgatgccaacgactccagaatctccgcgcgcagattttagagaaactggggagacgtcaccagctcaggtgaataaggccgaacatagcagctcctctccatggccatccgtaaataggaacgtggcagtgggattcgtcccaaccgagacggcaacagaaccgacaggcctcagaggtatccccggaagcgaaagtggggtgttcgataccgcagagtctccaacatccggtctccaggctactgtcgatgaagtccaggacccctggcccagtgtctactcgaaggggctggatgcatctagtcctagcgccccactagggtccccgggcgtcttcctggtcccaaaagttacacctaacctcgaaccttgggttgccacggacgaaggaccaactgtgaaccccatggattctacagtgacccctgccccaagcgatgctagcgggatctgggagcccgggtctcaagtattcgaggaagcagaatctacaacattgtctccccaggtggctctggacacctcgattgtgaccccactgacaaccctagagcagggtgacaaggtgggggttcccgccatgagcacactcgggagctcctccagccagcctcatcctgagcccgaagaccaggtggaaacccaggggactagcggcgccagcgtgcctccgcatcagtcgtctcccctggggaagccagccgtaccccccggaacgccaacagctgcttccgtaggcgagtctgctagtgtcagctctggtgaacctactgtcccatgggacccgtcaagcactctgttgccggtgaccttggggattgaagatttcgagctagaggtgctggcaggatcccccggggtagaaagcttttgggaggaggtggcctccggggaagagcctgcgctgccaggcacacccatgaatgcaggagcagaggaagtgcactctgatccgtgcgagaacaatccctgtcttcatggcggcacttgcaacgcaaatgggacaatgtatgggtgctcttgcgatcaaggctttgcgggggaaaactgcgagattgatatcgacgactgcctctgcagtccttgtgagaacgggggtacttgcatcgacgaggtgaatggtttcgtttgcctttgccttccaagctatggcgggagcttttgtgagaaagataccgagggctgtgacaggggatggcataagtttcagggtcattgttaccgatattttgcccacaggagagcctgggaagacgctgagaaggattgcaggaggcgctcagggcacctcacctccgtacacagcccagaagagcactcattcatcaactcttttggccatgagaacacatggatcgggctgaacgatagaatcgttgagagagattttcaatggacagacaatactggcctccagtttgagaattggcgggaaaaccaacccgataatttcttcgcaggtggagaggactgcgttgtgatggtagcacacgagtccggaaggtggaacgatgtgccatgcaactataacttgccttatgtatgtaagaaaggcaccgtgctgtgcggcccgcctcccgctgtcgagaacgcgagtctcattggggctagaaaagctaaatacaatgtgcatgctacagtgaggtatcaatgcaatgagggatttgctcaacaccacgtcgctacaatacgctgtaggagtaacggcaaatgggacagacctcagatcgtttgcaccaaacctagaagatcgcacaggatgaggcgccatcatcaccatcaccaacatcatcaccaacatcaccatcacaagtctagaaaggaacggcggaagcataagaaacacccaactgaggactgggaaaaagacgaaggcaacttctgctag

SEQ ID NO: 197011 - DNA, 2190 bp, Artificial Sequence
  Description of Artificial Sequence: Synthetic coding sequence
atgagctgctgcgacctggccgccgccggccagctgggcaaggcctctataatggcctcagattgcgagccggcccttaatcaggcggaagggcgcaatcctaccctcgagaggtatctgggcgcgttgcgggaagccaagaacgacagtgagcagtttgccgctctactgttagtgacaaaagccgtgaaggcaggtgacatcgacgctaagaccaggagacgcatctttgatgccgtaggttttacatttcctaaccggctcctcaccactaaagaagctcctgatggatgtcctgaccacgtcctccgcgccctcggcgtggccctactggcttgcttttgctctgacccagagttagccgcccatccacaggtcctgaataagatcccaatactatctacatttttgactgccagaggcgacccagatgacgcagcccgaaggagcatgatagacgacacctatcagtgtctgacggcagtggcaggcacccctagggggccccgccatctgatcgcaggggggaccgtttcagccctgtgccaggcatacttaggacatggctatggatttgatcaggctctcgctcttctggttgggctgctggcggcagccgagacccagtgctggaaggaggctgagcctgacctgctagcagtgctgagaggactgagtgaagattttcagaaagcggaagatgcttccaagttcgagctctgtcagcttctgcctctgtttttgccgccaactactgtgcctcctgagtgttaccgtgatcttcaagcggggctggcgcgcattcttggtagcaaactgagctcatggcagcgaaacccagcccttaagctggctgcccgtttggctcatgcatgtggatccgattggatacccgccggatccagcgggtcaaaatttctagccctcttagtgaatctcgcctgcgtagaggtgagactggctttagaggagactggcaccgaagtgaaagaagatgttgtaacagcttgttatgcactcatggagctcgggatccaggagtgtactcggtgtgaacaaagtttgctgaaggaacctcagaaggttcagctggtgagtgtaatgaaagaggctattggggccgtgattcattatcttctgcaggtcggctccgaaaaacaaaaagagccttttgtgtttgctagcgtcagaattctgggcgcatggcttgcggaggagacatctagccttaggaaagaggtctgtcagcttctccctttcttggtgcgatatgctaagactttgtacgaggaagccgaggaggcaaacgaccttagtcagcaggtagcgaatctggccatctcgcccacaacacccggccctacatggcccggcgatgccctgcgtcttctgctgcctggttggtgccacctgactgtggaagacgggccccgggagatactcataaaggaaggcgctccgagcctgctctgtaaatatttcctgcaacaatgggagctgacctcacccggtcacgacactagcgtgcttccagacagtgtggagattgggcttcagacctgctgtcacatttttctcaacttggtcgtgactgctcctgggttaatcaaaagagacgcctgcttcacttctctcatgaatactctgatgacctccctccctgccctcgtacagcagcagggccgcctgttgcttgcagcaaacgtagccaccctgggtttgttaatggctcgcttgcttagcacctccccagcccttcaggggacaccagcctccagaggctttttcgccgcagcaatactgtttctttcccagagccacgtggcccgggccacgccaggaagtgatcaggcagttctcgcgctgagtcccgaatacgaaggcatatgggcagatctgcaggagctgtggttcctcgggatgcaggccttcacaggatgtgtgcccttactaccatggctggcgccagctgccttgaggagtaggtggccgcaggaactcctgcagttgctcggcagcgtttccccgaactccgtgaaacctgaaatggtggccgcctaccagggcgtgctagtggagctcgctcgtgccaaccggctgtgtcgcgaagcgatgaggttgcaggccggggaagaaaccgcctcacattacaggatggcagctctggaacagtgtctgtctgagccgtag

SEQ ID NO: 197012 - DNA, 2190 bp, Artificial Sequence
  Description of Artificial Sequence: Synthetic coding sequence
atgagctgctgcgacctggccgccgccggccagctgggcaaggcctctatcatggcaagcgactgcgaacccgccttgaaccaggcagaaggacggaaccctaccctggagaggtacctcggtgctctgcgggaagctaaaaatgattcagaacagttcgccgccctcctcctcgtgaccaaggccgtgaaggccggggacatcgatgctaagaccagaagacgcatatttgatgcagttggattcacattcccaaaccggctgcttacgaccaaggaggccccagacggctgtcccgatcatgtgctgcgcgcgctgggggtggctctgctagcctgtttctgttcagacccagaactcgccgcacatccgcaggtgctaaacaaaatacctatcttgagtacgttcttgacagctcggggggaccccgatgacgcagcccggcggtccatgattgatgacacctatcagtgcctgacagccgtggctgggactcccaggggcccccgacacctcatcgccggggggacggtttccgctttgtgccaggcttacctgggtcatggctatggctttgaccaagctctggccttgctcgtgggccttctggccgcggctgagacccagtgctggaaggaagcagagcctgatctgcttgccgtgctgagaggcttgtcagaggactttcaaaaagccgaggatgcctctaagtttgaactctgtcagcttttgcccttatttttaccccccacgactgtaccacctgagtgctatagggacctgcaagccggccttgcacgcattttggggagcaagctttccagttggcagcggaatccagctcttaagctggccgcccggcttgctcacgcgtgtggttctgactggattccagccgggagcagcggcagtaaatttttagccctgctggtaaacctggcttgcgtggaggtccgcctggccttggaagaaactggtaccgaagttaaagaagatgtggtcacagcttgttacgcactgatggagctgggaatacaggaatgtacacggtgcgaacaatcattacttaaagagcctcaaaaagtgcagttggtaagcgtgatgaaggaggccatcggggcagtcatccattaccttctccaggtgggcagcgaaaaacaaaaggagccatttgtctttgcgtcggtccggatattgggggcttggctggcggaggaaacgtcaagccttcggaaagaggtgtgtcagttgctgccttttctcgtgcgctatgctaaaacgttgtacgaggaagctgaggaggctaacgacctctcacagcaagtcgccaatctagctatcagccctaccactcctggccctacctggccaggagacgccctgcggttacttctgccgggctggtgtcacctgacggtggaggacggtccaagagagattctgataaaggagggagccccaagcctattgtgcaagtacttcctccagcagtgggagctcaccagcccagggcatgatacatcagtcctcccagatagtgtggaaattgggcttcagacatgctgccacatcttcttgaacttggtggtcaccgcccccggcttgatcaaaagagacgcttgttttacttctctcatgaacaccctgatgactagcctgccagcactggtccagcagcagggaaggcttcttctcgccgccaatgtggccaccctcggcctgttgatggcccgcctcctctccacatcccccgctctgcaagggacaccagcttctagaggcttctttgcagctgctatactgtttctgagccagtcacatgttgcccgggccacccctggtagcgaccaggcagtgctggcactgtcaccagaatacgagggcatctgggcagatctccaggaactctggtttcttggcatgcaggcctttaccgggtgcgtcccgcttctcccatggctcgcccctgcggctttgcgctctcgctggcctcaggaactactccagctcctcggttccgtcagccccaacagtgttaaacccgaaatggtggccgcttaccagggcgtgcttgtggaactggcaagagccaatagactctgtcgcgaggcaatgagactccaagccggcgaagagactgccagccactaccgcatggccgctttggaacagtgtctatccgagccttag

SEQ ID NO: 197013 - DNA, 2139 bp, Artificial Sequence
  Description of Artificial Sequence: Synthetic coding sequence
atggccagcgactgcgagcccgccctgaaccaggccgagggccggaaccccaccttggagcggtacctgggggctctccgcgaagctaaaaacgactccgagcaattcgcggccctgctcctagtcacaaaagccgtgaaggcgggggacatagacgccaagactagacgcagaatatttgacgccgtgggttttacctttcctaaccgtctgctgaccaccaaagaggcccctgacggctgtccagatcatgtgctccgggcattgggagtggcactgctcgcatgtttctgtagcgatcctgagctggctgctcacccacaggtgttgaacaaaataccaattctgtctaccttcttaacggcacgcggcgaccctgatgatgccgctcgacgctccatgattgatgatacataccaatgcctgactgcagtggcagggactcctcggggcccaagacatctgattgcagggggaactgtgagtgccctgtgccaggcttacctgggccacgggtacggattcgaccaggctttggccttgctggtaggcttacttgctgccgctgaaactcagtgctggaaggaggcggagccagacttactcgctgtactgcgcggcctctcagaggattttcaaaaagccgaggatgccagtaagttcgagctctgccaactgcttcctctgttcctgcctcctaccactgttccacctgaatgttatagggatttacaggccggcctggctcgcattctggggtcgaagctcagctcctggcaaaggaaccccgctctgaagctcgcagcccgcctcgctcacgcctgcggcagtgactggattcctgctggatccagcggttctaagttccttgccctcctcgtaaatctcgcgtgtgtggaagtgaggctggcccttgaggagacagggacagaagtgaaggaggacgtcgtgaccgcctgttacgctctcatggaattgggaatccaggagtgtacacgctgtgaacaaagtctgttgaaggaacctcagaaggttcagctagtttcagtgatgaaagaggcaatcggagctgtgattcattatctgctgcaagttggcagcgagaagcagaaagagccttttgtcttcgcatcggtgcgcatcctcggagcctggctcgccgaggagacttccagtctgcggaaggaagtgtgtcagctgctccccttcctggtccgctatgctaaaacactttacgaggaggctgaagaagcaaatgatctatctcagcaggtagccaatttggcaataagccccaccactccagggccgacatggccgggtgatgccctgaggctgctgctccctggttggtgccacctcacggttgaagacgggccaagagagatactcattaaagagggcgctccctctctgttgtgcaaatactttctgcagcagtgggagctaacgtcccctgggcacgacacaagtgtgctgcctgattctgtggagataggcttgcagacctgctgccacatcttcctgaatctggtcgtcacagcgccaggactcataaagagagatgcctgtttcaccagtctgatgaatacgctgatgacttcgctaccagccctggtacagcagcagggaagacttttactggccgcgaacgtggccaccctgggtctccttatggcccgtctgctttcgacaagccctgccttgcagggcacgccggccagtaggggtttcttcgccgcagccatcctctttctgtcccagtctcatgtggccagggccactccaggttcagaccaggccgtacttgcactgagccctgaatatgagggtatctgggccgacctccaagaactgtggttcttgggcatgcaggcctttaccggttgcgttccactgcttccatggctggcgcccgctgcactccgttctcggtggccccaggaacttctccagttgctgggttccgtgtctcccaatagcgttaagcccgagatggtcgcagcctaccagggagtcctggttgagttagcgagagcaaataggttgtgcagagaggccatgcgtctgcaggctggagaagaaacagccagtcactataggatggcggccctcgagcagtgcttgtctgaaccctag

SEQ ID NO: 197014 - DNA, 531 bp, Artificial Sequence
  Description of Artificial Sequence: Synthetic coding sequence
atgccccacagcttccggtacctggccgccctgcagggcacccccgctagccgaggtttcttcgcagcagccattctgtttctgtctcagagccacgtggctcgtgctacacccgggagcgaccaggcagtactggctctgtcccctgagtatgagggcatatgggccgatcttcaggaattgtggtttctaggcatgcaggccttcaccggctgcgtccctctgcttccttggctggcccctgccgcccttagatctcgctggcctcaagaactgctccagttgctgggttctcaacctcagttatgccaggcccgagacgggggacgcctgagtggatgtcccgggggggctggagccggccagcccgctgtgccaggcggtcacgaagccgccggagggaggggagatgggcagccactgccccatggctgtctcggcgcagtgccggttcgggctctgagaggagtacaccgtgggcagacccagggacgtgcagaaagggaggggggtagacggcatctcccatag

SEQ ID NO: 197015 - DNA, 582 bp, Artificial Sequence
  Description of Artificial Sequence: Synthetic coding sequence
tgaagcagcctgcggaaggaggtgtgccagctgctgcccttcctggttaggtacgctaagacattgtacgaggaagcagaagaggccaacgacctgagtcagcaagttgcaaacttggctatctccccgacaaccccaggaccaacgtggcctggagacgctttgagactgctgctgcctggctggtgccacctgactgtggaagatggcccgagggaaatactgattaaggagggggctccgtctcttctctgtaagtactttctgcagcagtgggagctgacatccccgggacatgataccagcgttttacccgactccgttgagatcggtctccagacctgttgtcacattttcctgaacttagtcgtgacggctcccggactgattaaaagggatgcttgcttcacttctctcatgaataccctgatgacctcactgcctgcactcgtgcagcaacagggcagactgctgctggctgccaacgtggctacgctaggtctgctgatggcccgcttgctgtccacctcccctggctccatatctagccagcttcccggtgccgagcatatgccatgttag

SEQ ID NO: 197016 - DNA, 735 bp, Artificial Sequence
  Description of Artificial Sequence: Synthetic coding sequence
atggccagcgactgcgagcccgccctgaaccaggccgagggccggaatccgacactggaacgttatctaggcgccctccgggaggccaagaatgattctgagcagtttgccgctctgctgctggtcaccaaagctgttaaggccggcgatatcgacgctaagacccgcagaagaatttttgacgccgtgggcttcacatttcccaaccgtctgttgaccactaaggaggcaccagacggctgcccagatcatgtcctgcgcgccttaggagtggctctgctcgcctgtttttgtagcgacccagagcttgccgcacatcctcaagtgttgaacaagattccaatactgtccactttcctgaccgctagaggagacccagacgacgctgcccgccgatccatgatcgacgatacttatcaatgtttgacggcagtcgccggaacccctagaggaccccgccatctgatcgctggagggacagtgagcgcgctctgtcaggcctatctgggtcatggctatggcttcgaccaagcgctggcactactcgtgggcttgctcgctgcagccgagacacagtgttggaaagaggccgaaccggatctgctggccgtgcttaggggactgtccgaagattttcagaaggccgaagatgcctccaagttcgaactgtgccagcttctgccactgtttctgcccccaaccacagtacctcctgaatgttaccgcgacctgtag

SEQ ID NO: 197017 - DNA, 1791 bp, Artificial Sequence
  Description of Artificial Sequence: Synthetic coding sequence
atggagcccgagctggccgcccagaagcagccccggccccggcggagatctaggagggccagcggactgtccactgagggtgctaccggtccctccgctgatacatcaggctctgagttagatggccgatgctcacttcgcagaggctctagcttcacgttcttgacccctggccccaactgggacttcacattgaagaggaagcgtagggagaaagacgatgatgtcgtttccctgagctcgctggatttgaaggagccttctaacaagcgtgtccggcctcttgcacgtgtgacctctctggcaaatctgatctcaccagtccggaacggagccgtgcgtcgctttgggcagacaatacagagtttcaccctgcgcggcgaccaccgtagccctgcaagtgcccagaaattttcctctcgatctaccgttcccactcccgccaaaagaaggagtagcgcgctttggtccgaaatgctggacatcacaatgaaggaaagcctgaccactcgtgaaatacggaggcaggaggccatctacgagatgagcaggggggaacaggatctgatcgaagatctgaagctagctaggaaggcttatcacgaccccatgctaaaactaagcattatgagcgaggaagagcttacacacatcttcggcgacctcgatagttatatccctctgcatgaggacctcctgactagaataggtgaggcaaccaagcctgacgggacggtggaacaaattggccacattctggtcagttggttacctcggctgaatgcatatcgcggttactgctcgaatcagctggctgcaaaggccctactcgatcagaagaaacaggacccacgggtgcaggacttcctgcagcgatgcctggagagcccttttagtcggaaactggacctgtggtcattcctcgatatccccaggtcccgattggtgaaatatccactgctgctcaaggagatattgaaacacacccccaaagagcaccctgacgtgcagctcctggaggacgcgattcttatcatccaaggtgtgttgtccgatatcaacctgaagaaaggggagagtgagtgccagtattacattgataaattagaatatctggatgagaagcagagggatcctagaatcgaagcatctaaggtgctgttgtgccatggggaactgcggtctaagagtggccacaaactttacatcttcctgttccaggacatccttgtgcttacacgccccgtgactaggaacgagcggcattcttaccaggtgtatagacagcccattcccgtgcaggaactggttctcgaggaccttcaggatggagacgtcagaatgggcgggagttttaggggagcattctccaacagtgaaaaggcaaagaacatcttcaggattcgctttcacgaccccagccctgcccaatcccatacactgcaagctaatgacgtttttcacaaacagcagtggtttaattgcatccgggccgctatcgcaccatttcaatcggctggttccccccctgagttgcaaggtctacccgaactgcacgaggagtgcgaaggtaaccacccttcagcgagaaaattaacagcgcagcggagagcgtctaccgtctcttccgtaacccaggtggaggttgacgagaatgcctatcggtgtggatcagggatgcaaatggccgaagactctaaatcactaaagacccatcagacacagcccggtatcaggagagctagggacaaggctttgtccggcggaaaacgcaaggagactctggtgtag

SEQ ID NO: 197018 - DNA, 483 bp, Artificial Sequence
  Description of Artificial Sequence: Synthetic coding sequence
atggtggcccacgacgagaccggcggcctgctgcccatcaagcggactattagggtgctggacgtcaacaaccagtcctttcgggaacaggaggaactcacacatatttttggtgacctggactcatacattccgttgcatgaggacctcctgactcgtatcggcgaggctacaaagcctgacggaacagtggagcaaatagggcatattctagttagctggttgccaagactcaatgcgtatcgagggtattgctcaaaccagctcgcggctaaggctctgctggatcagaagaagcaagacccacgggtgcaggactttctacaacggtgtctagaaagcccatttagtcgcaaacttgacctgtggtctttcttggatatccccaggagcagattggtgaagtatccgctgctgcttaaagaaatcctaaagcacacgccaaaggaacatccagacgtgcaattgctggaggacgcctag

SEQ ID NO: 197019 - DNA, 1629 bp, Artificial Sequence
  Description of Artificial Sequence: Synthetic coding sequence
atggtggcccacgacgagaccggcggcctgctgcccatcaagcggactattcgtgttctcgatgtcaataaccagagtttccgggagcaggaagagccatctaataagagggtgagacctctggcgagggtcacatctctggctaatctgatctcgcctgtgagaaacggtgccgtgcgccgattcggtcagacaatccagtccttcacattgagaggagaccaccggtcaccggcgagcgcccagaaattttcttcccgctcaactgttccaacccccgctaaacggagatcctcggccctctggagtgagatgctcgacatcaccatgaaagaatccctgacaactcgcgagattcggcgacaggaggccatctacgaaatgtcccgaggcgagcaggatcttatcgaggatcttaagctggccaggaaggcttatcatgatccgatgcttaagctgtctatcatgagcgaggaggaattaacacatatatttggtgatcttgacagctatatcccacttcatgaagacctgctgactcgcattggtgaagcaaccaagccagacggcacagtcgaacagatcgggcacatccttgttagttggctgccaaggttgaatgcttatagagggtactgcagcaatcagctcgctgccaaggcgctgctggaccaaaaaaaacaggaccctcgcgtacaggatttcctgcaaaggtgcttggagagcccatttagtagaaagctcgatctctggtccttccttgatatccccaggtcaagactcgtcaagtacccacttcttctgaaagaaatcctgaagcacacccccaaggaacacccggacgtgcaacttttagaggacgctatcctgatcatccaaggggttctatcagatattaatctcaagaaaggggagtccgagtgtcaatactatatcgacaagctagaatacttagacgagaagcagcgggaccctaggatagaggcttcaaaagtgttgctctgccacggtgagctaaggagcaaaagtgggcacaaactctacatatttctgttccaggatatccttgtgctgacgcgcccagtaacaaggaacgagagacacagttatcaggtgtacagacagccaatacctgtgcaggaattagttcttgaagatcttcaagatggagacgtcaggatggggggatcttttagaggagctttcagtaactccgagaaggccaaaaatatttttaggatccgttttcatgaccccagtcctgcccagtcccacacattgcaggctaacgatgttttccataaacaacagtggttcaactgtattcgcgctgcaatcgctccttttcaaagtgctggtagtccccctgaactgcaaggtctgccagagctgcacgaagaatgtgagggcaaccaccccagcgcaagaaaactaaccgcgcagcggagggctagcactgtttcctcagtaactcaggtggaagttgacgagaacgcctatagatgtggctccggcatgcaaatggcagaggattccaagagcctgaaaacgcaccaaacccagcctggtattaggcgtgcaagggacaaggctttgtctggcggtaagagaaaagagaccttggtctag

SEQ ID NO: 197020 - DNA, 483 bp, Artificial Sequence
  Description of Artificial Sequence: Synthetic coding sequence
atggtggcccacgacgagaccggcggcctgctgcccatcaagcggacaataagagtcttggacgttaacaatcaaagctttagggagcaagaggagttaacccacatcttcggagatctggacagctatatacccctacacgaagatctcttgactagaattggggaagctaccaagccagatggcacagtcgaacagatcggacacatacttgtgtcctggttgcctcgtctgaacgcgtacagagggtattgttctaatcagcttgctgcaaaggccttgctggaccagaagaaacaggacccacgagttcaagattttctgcagagatgtttggagagcccattctcacgcaagctcgatttgtggagcttcctcgacatccctaggtcccgccttgtgaagtaccccctgcttctgaaggagatcttgaagcatacgccgaaagaacatcctgacgtgcaactgctggaggatgcatag

SEQ ID NO: 197021 - DNA, 1248 bp, Artificial Sequence
  Description of Artificial Sequence: Synthetic coding sequence
atgagccggggcgagcaggacctgatcgaggacctgaagctggccagaaaagcttaccatgaccccatgctcaaactgtctatcatgtcagaagaggagctgacacacatctttggggatctggacagctacattccacttcacgaagacctgctgacgagaataggagaagccacaaagcccgacgggactgtagagcagatcggccatatcctcgttagctggctgccacgactcaacgcttaccggggctattgcagcaatcagctagccgcaaaagccttactcgatcaaaagaagcaggacccaagagttcaggatttcctgcagagatgcctggagtctccttttagccggaaattagacttgtggtcgttcttagacatacctaggtcccgcctggtcaagtatccccttctgctgaaggagatcctaaaacacaccccaaaggagcatccagatgtgcaattgctggaggacgcgatccttattattcagggagtcctctctgacatcaacttaaaaaagggtgaaagtgaatgccaatactatatcgacaagctcgagtacctcgacgagaaacaaagagaccctcgcatcgaggcctctaaggtcctgctctgccatggagaactgagatctaaaagtggacataaattgtacatttttttgtttcaggacatcctcgtgctcacccgtccagttaccagaaacgaacgacattcttatcaagtctatcgtcaacctattccagtccaagagctagtcttagaggacctgcaggacggagatgtccgtatgggcggatcatttcgcggggcttttagtaactctgagaaggcaaagaacatcttccgtatccgctttcacgaccctagccctgcccagagccacaccctacaggccaatgacgtgtttcataaacagcaatggtttaattgcattcgggctgccattgctccctttcaatccgccggaagtccacccgaacttcagggcctccccgagctccacgaggaatgtgagggcaaccacccgagtgctaggaaactcaccgcacagagacgcgcgtcaactgtatcctccgtcacacaagttgaagtggatgaaaacgcttaccggtgcggatctggaatgcagatggctgaggacagcaaatccttgaagactcatcagacgcagccagggatcaggcgcgcgcgcgacaaagctctcagcgggggaaaacgaaaggagacactcgtgtag

SEQ ID NO: 197022 - DNA, 3063 bp, Artificial Sequence
  Description of Artificial Sequence: Synthetic coding sequence
atgatgagcttcggcggcgccgacgccctgctgggcgcccccttcgctcccttgcatggcgggggaagtcttcattatgccctggcgaggaaagggggggcaggcggcacacgctcagctgcaggcagctctagcgggtttcactcctggacacgtactagcgtatctagcgtgagcgcaagccctagtcggttcaggggcgccggagcggcttcctcgaccgattctctcgacaccttgagtaatggaccagaagggtgcatggtcgcggtcgcgacctcccgctccgaaaaggagcaactccaggctcttaacgaccggttcgccggttacatcgataaggtgcggcagcttgaggcccacaacagatcactggaaggtgaggcggctgcccttcgacagcaacaagccggacggtcagccatgggagaactgtatgaaagggaagtgagagaaatgagaggagccgtgttacgactgggggccgccaggggccagctgcgactggaacaggagcacctcttggaggacatcgcacacgtgcgtcagagactggacgacgaagctcgccaacgtgaggaggctgaggcagcggccagggcactggctagatttgctcaggaagccgaggctgccagggttgacctacagaaaaaagctcaggccctgcaggaagagtgtgggtacctgcgccgacatcaccaggaagaggtcggggagctgctgggccagatacagggttcaggggccgctcaggctcagatgcaagctgaaacgcgggatgctctcaagtgtgacgtcacctcagcgctgcgtgagataagagcccagcttgagggacacgccgtccaatctactttgcagtcagaagaatggttccgggtacggctggacaggctatctgaggcagctaaagtgaatacagacgcaatgcgctcagcacaggaggaaatcacagagtatcgcagacaattgcaggccagaaccactgagttggaagctctgaagtcaacgaaagacagtctggagaggcaaagatctgagctggaggaccggcaccaggccgacattgcctcctaccaggaagccatccagcaacttgacgcagagctcagaaacactaaatgggagatggccgcacagctgcgagagtaccaagacctgcttaatgttaagatggccctcgacatcgagatagctgcatatcggaaactgcttgagggtgaagaatgccggatagggttcggacctataccgtttagtctgccagaaggccttcctaaaattccctcagtaagcacacatattaaggttaagagcgaggagaaaattaaggtggtggagaagtctgaaaaagagacagttattgtcgaagagcaaaccgaagaaacccaggtgaccgaggaggtgacagaggaggaggagaaggaagctaaggaagaagaaggcaaagaggaggaaggcggcgaagaggaggaagctgaaggcggggaagaggagaccaagtcccctcccgccgaggaggccgcctcacctgaaaaagaggcaaaatccccagtaaaagaggaggctaagagccccgccgaagccaagtcgccagagaaggaggaggcaaagagccctgccgaagttaagagtcctgaaaaggcgaagtccccagcaaaggaggaagccaagtccccgccggaagctaagagtcccgaaaaggaagaggcaaagtctcctgccgaagtgaagtccccggagaaggcaaagtcccccgccaaagaggaggccaagagccctgcagaagccaaatcccccgagaaagccaaaagccccgtcaaagaagaggcgaagtcccccgcggaggctaagtcacctgtgaaagaggaagccaagagccccgccgaggtcaagtccccggaaaaggcaaagtcccccacaaaggaggaggctaaatcccccgagaaggctaaaagccctgagaaggaggaggctaaaagcccggagaaagccaaatctccggtcaaggccgaggcaaagagcccagaaaaagccaagagcccggtgaaggctgaagctaaatcacctgagaaagctaaatctcccgttaaggaggaggcgaaatctccagaaaaagcgaaatctcctgttaaagaagaagcaaaatcacccgagaaggccaagtctcccgtgaaagaagaggccaagaccccagagaaggccaaatctccagtgaaggaggaggcaaaatcccctgaaaaggccaaatctcccgaaaaggctaagacactcgacgtcaagagcccagaagccaaaacaccagccaaggaggaggctcgttctcccgcagacaaattccccgagaaagccaagagtccagtcaaagaagaagttaagtctcccgagaaagcaaagtcaccgctgaaggaagacgccaaggcccctgaaaaagagatccccaagaaagaggaggtgaagtctcctgttaaggaggaggagaagccccaggaagtcaaagtgaaagaaccccccaaaaaagccgaggaggagaaggcgcctgcgacacctaagacagaagagaaaaaggatagcaagaaagaagaagccccgaagaaagaagcccccaaacccaaagtggaggagaaaaaagagcctgctgtggagaagccaaaggaatcgaaggtggaagcgaaaaaagaggaagctgaagacaaaaagaaagtgcccacaccggagaaagaagccccggcgaaggtcgaggtcaaggaggacgctaaacccaaggagaagacggaagttgccaaaaaagaaccagacgatgccaaagctaaagaaccaagcaaacccgccgagaaaaaagaagccgccccagagaagaaggacactaaggaggaaaaggccaagaagcctgaggaaaagcctaagactgaagccaaagctaaagaagacgacaaaaccctctccaaagagccatctaagcctaaagccgagaaggcagaaaagagcagcagtacagaccagaaggactctaaacctcctgagaaggctacggaagacaaagctgctaagggcaaatag

SEQ ID NO: 197023 - DNA, 2916 bp, Artificial Sequence
  Description of Artificial Sequence: Synthetic coding sequence
atgatgagcttcggcggcgccgacgccctgctgggcgcccccttcgctcccctccatggagggggatcactccactatgcacttgctaggaaaggcggtgctggtgggaccagaagcgccgcaggctcgtccagcgggttccactcttggacaaggacctccgtctcctccgtcagtgcctccccgtctcgttttcgaggcgctggagctgcctcttcaactgactccctggataccctgtccaacggacctgagggctgcatggttgcagtcgcgacgtcgcgaagcgaaaaggaacagctgcaggctttaaacgatcgatttgctggatacattgataaggtgaggcagctggaggcccataatcgatctctggagggtgaagcggccgcactccgacagcagcaggctggaaggagtgccatgggggaactgtacgaacgagaggtgagagaaatgcgcggagccgtcttgcggctaggggccgccagagggcagttacggctggagcaagaacacctcttggaggatatcgcgcacgtacggcagagactggacgacgaggcccggcaaagggaagaggcggaggccgcagccagagcactggccagattcgcacaggaggccgaagctgcaagagtcgatctgcagaagaaggcccaggccctgcaagaggagtgcggatatcttcgaagacatcaccaggaagaggtcggcgaactccttggacaaattcaggggtctggcgctgcccaagcccagatgcaggccgagacgcgagatgcacttaaatgcgatgtgacttccgctctgcgggagatacgggcccagttggagggccatgcagtccagtcgactttgcagagcgaggaatggttcagggttaggcttgatagactgtctgaagcagctaaggtgaacactgacgccatgcggtccgctcaggaggaaattacagagtatcgcagacaactccaggcacgcaccactgagcttgaggccctgaagagcactaaggattctctggaaagacaaaggagcgaactagaagaccggcatcaggcggatatcgcaagttatcaggaagccatccagcaactggatgccgaacttcgaaacaccaaatgggaaatggctgcccaactgagagagtaccaagatctcctgaacgtgaaaatggctcttgacattgaaattgccgcctaccggaagttactcgagggcgaagagtgtaggatcgggttcggccccatacctttcagcctgcctgaggggttgcccaaaataccatccgtcagtacccatatcaaggtcaagtcagaggaaaagatcaaggttgtggaaaaatctgagaaagagacagttattgtggaggagcagacagaagaaacacaggtgacagaggaggtgactgaggaggaggagaaagaagctaaggaagaggagggtaaagaagaggagggaggcgaagaagaggaagcagaagggggtgaggaggagactaaatcccctcccgccgaagaagctgcatcccccgagaaagaggcgaaatcacccgtgaaagaggaggccaaaagccccgcggaagcaaaatcccccgaaaaggaggaggccaaaagcccagcagaagtgaagtcgcccgaaaaggctaagagtcctgctaaagaggaggccaaatcccctccggaggcaaaatcccctgagaaggaggaagccaaatctcccgcagaggtcaaaagccctgaaaaggccaaaagccccgcaaaggaagaggccaagtccccagcagaggctaagtccccggagaaagctaagtcgccagttaaggaagaagctaaaagtcccgcggaggcaaagagtcccgttaaagaggaagctaagagtccggcggaagttaaaagccccgagaaagcaaagagccccaccaaagaagaagctaagagtccggaaaaagccaagtctcctgagaaggaggaagccaaatcccctgaaaaagccaagtcacctgttaaggccgaagccaagtctccagagaaagctaaatcacccgtaaaggcagaagccaaaagccctgaaaaggccaaatccccagtgaaggaagaagcaaaatcacctgaaaaagctaagagcccagttaaggaagaggcaaagagtcccgaaaaagctaaaagtcctgttaaggaggaagcgaagactccagagaaagcaaagagtccagtgaaggaagaagccaaatcgccagagaaggccaaatcaccgttgaaagaggatgccaaagccccagaaaaggaaattcctaaaaaagaggaagtgaagagccctgtgaaggaagaagaaaagccacaggaagtgaaggtgaaggagcctccgaaaaaggcggaggaagagaaggcacctgccacacctaagacagaggaaaaaaaggactccaagaaagaagaagctcctaaaaaggaggcccccaaaccaaaggttgaggaaaagaaggagcccgctgtcgagaaacctaaagaatctaaggtagaggcaaagaaagaagaggcagaggacaagaaaaaagtacctacgcccgaaaaggaggcccctgcaaaggtggaagtgaaggaggatgccaaacctaaggaaaaaaccgaggttgcaaaaaaagagcccgatgatgccaaagccaaggaacctagtaaacccgccgagaagaaggaggccgccccagaaaaaaaggatactaaagaggagaaggccaaaaaaccagaagagaagccaaagaccgaggccaaagccaaggaagacgacaaaacactctcaaaagagcctagcaaacccaaagccgaaaaggccgagaaatctagcagcaccgaccagaaggattccaagccccctgagaaggcaactgaagacaaggccgctaaaggtaagtag

SEQ ID NO: 197024 - DNA, 930 bp, Artificial Sequence
  Description of Artificial Sequence: Synthetic coding sequence
atggacgacaaggccttcaccaaggagctggaccagtgggtggagcagctcaatgagtgtaaacagctcaacgagaatcaagtacgcacactgtgtgaaaaagctaaggaaatattgaccaaggagagtaatgtgcaggaggtcaggtgtccagtgacagtttgtggggacgtgcatggtcagttccacgatctgatggaactattcaggatcggcggtaagagccccgatacgaactacttattcatgggcgactacgtggataggggttactacagcgtcgagacagtgacactcctcgtggcactgaaagtgaggtaccccgaaagaatcactattcttaggggaaaccacgagtctcgccaaattactcaggtgtatggattctacgacgaatgcttaagaaagtacggcaatgcaaatgtgtggaaatactttactgacctgttcgactatttgccactaacggcactggtggacggtcagatcttctgtctgcacggcggtctgtccccctccattgacacgctggaccacatcagagctctcgacagattgcaggaggtgccccatgaggggcccatgtgtgacctactctggagcgaccctgacgaccgaggtgggtggggtatcagtcctagaggggccggatacactttcggacaggatatatcggaaactttcaaccatgcgaacggcctgacgctcgtgagtcgcgcccaccagctcgtcatggagggctataattggtgccatgaccgaaatgtggtcacgattttctccgcccctaattactgttatagatgcggtaaccaggcggccatcatggaactggacgacacactgaagtacagctttctgcagttcgatcccgcccccagacgcggcgaaccgcacgtgactagacgcacacccgattacttcctgtag

SEQ ID NO: 197025 - DNA, 1623 bp, Artificial Sequence
  Description of Artificial Sequence: Synthetic coding sequence
atggcccggcacctgcgggagtaccaggacctgctgaacgtgaagatggctttagatattgagattgcggcttatcggaagttgctcgagggagaggagacaagatttagcacctttgctggctctataacaggtccattgtacacccaccgccccccaatcaccatttcctctaaaatacagaaacctaaagtggaagcccctaagctgaaagtgcaacataaatttgtggaggaaatcatcgaagagaccaaagtggaggatgaaaaatccgagatggaggaagccttgaccgctattaccgaagaacttgctgtgtccatgaaagaagagaaaaaagaagccgctgaggagaaggaggaggaacctgaagctgaagaggaggaggtggccgccaaaaagtctccagtgaaggctacagcgcccgaagtgaaggaagaagagggggagaaagaggaagaggaaggacaggaggaggaggaggaagaggacgagggcgccaagtctgaccaggcagaagagggaggatccgaaaaggagggttcgtccgagaaggaggagggagagcaggaagaaggcgaaactgaggcggaggcggagggagaggaagctgaggccaaggaagaaaagaaggttgaggaaaagagcgaagaagtggcaactaaggaagagctggtggctgacgctaaggtcgagaaacccgaaaaggccaaaagccctgttccaaagtcgcccgtggaagaaaaaggcaagtcaccagttcctaaatcgccagtggaagaaaaaggaaagtctcccgtgccaaagtctcctgtggaagaaaagggaaagagtcctgtgccaaaaagccccgtggaggagaaaggaaaaagcccagtgagcaaatcgccggtcgaagagaaggcaaaatcccctgtgccaaagagccctgtagaagaggctaagtcaaaggccgaggtcgggaaaggagagcagaaggaggaggaagaaaaagaagtcaaagaagctcccaaagaggagaaagttgagaaaaaagaagaaaagcccaaggacgtacctgaaaagaaaaaggcagagtctcccgtcaaagaggaggcagtggccgaggttgtcactataaccaaatccgttaaagtccacctcgagaaggaaaccaaagaggagggcaaaccgctccagcaagaaaaggagaaagagaaagcgggcggtgagggagggtctgaagaggaaggctcagacaagggcgcaaagggttctagaaaagaggacatcgcagtgaacggtgaggtagaaggcaaagaagaagtcgagcaggaaactaaagaaaagggttcagggcgggaggaagagaaaggcgtagttaccaacggcctcgatctgtcaccagccgacgaaaagaagggaggggacaagagcgaggagaaagtggtcgtgaccaagaccgtcgagaaaatcacttccgaaggcggtgacggagcgacaaaatacatcaccaaatccgtcacggttacgcagaaagtggaagagcacgaggagacattcgaagagaagttagtgtccaccaagaaagtcgagaaggtgacttcacacgctatcgtgaaggaagtgacacagtctgactag

SEQ ID NO: 197026 - DNA, 2634 bp, Artificial Sequence
  Description of Artificial Sequence: Synthetic coding sequence
atgagctacaccctggacagcctgggcaaccccagcgcctaccggcgcgttaccgagacccgaagctccttcagtagagtgtcaggctccccaagcagtgggtttcgcagccagtcatggtctcgagggtcaccctccaccgtgtccagctcttacaagcgctcaatgctggcgccacggttagcctactcgtcagcgatgctgtccagtgccgagagctctctggacttctcacagagttcgtctctgctaaatggagggtcggggcctggcggcgattataagctgtctcgaagtaatgaaaaggaacaattacagggactcaacgaccggtttgcggggtacattgagaaagtgcactacctggagcagcagaacaaggagatcgaggcagaaattcaggccctacgccagaaacaggcaagccacgctcaattaggagatgcctatgaccaagaaatccgtgagctgcgggcgacgctcgaaatggttaatcatgaaaaggcacaggtgcagctcgactctgaccacctagaggaggacatacaccgattgaaagagcgtttcgaggaggaagcgaggcttcgggacgacacagaggctgccattcgtgctctcagaaaagacatcgaagaggctagccttgtgaaagtggagctggacaaaaaagttcagtcactccaggatgaagttgcctttctgaggtcgaaccatgaggaagaggttgccgacctgttagctcagatacaagctagccacattaccgtcgagcgaaaagattatcttaagacagatatctccacagcacttaaagagatccgaagccagctggaatcccactccgaccagaatatgcaccaggcagaggaatggtttaagtgcagatatgccaagttgaccgaagctgccgagcaaaacaaggaagccatcaggagtgctaaagaagagattgccgaatacaggagacagctgcagtccaagtccatagagcttgaaagcgtgcggggtacaaaggagagcttggaacgccaactgtccgacatcgaggaacgccacaatcacgatctcagttcgtatcaggacacaatccaacagctcgaaaacgagctccgtggcacgaaatgggaaatggcccgacatctacgggagtaccaggacttattgaatgtgaagatggctctggatatcgagattgcagcttatcggaagctgctagagggcgaggaaaccaggttctccacttttgcaggatctatcaccggtcccctgtacacacataggccgcctataaccatctcgtcgaaaattcagaaacccaaggtcgaagccccgaagctgaaagtgcagcacaagttcgttgaagaaatcattgaggagactaaggtggaagatgaaaagtccgagatggaagaggccttaaccgccatcaccgaggagctggcagtgtccatgaaagaggagaagaaggaggcagccgaggagaaggaggaggaaccagaagccgaagaggaggaggtggccgccaaaaagagtccggtcaaggcaacggcccccgaggtgaaggaggaggagggagaaaaagaagaagaggaaggtcaggaggaggaggaagaggaagatgagggagccaagtcagaccaggctgaagaggggggcagcgaaaaggagggatccagcgagaaagaggagggggagcaggaggaaggcgagaccgaggccgaggccgagggagaagaggcggaggcaaaggaggagaagaaggtggaggaaaagtcagaagaggttgctacaaaggaggagttggtagccgacgccaaagttgagaaacctgaaaaggcaaaatcacctgtgcccaagtctcctgtagaggagaaaggcaagtcccctgtgagtaagtctccggtagaagagaaagccaagtccccagttcccaagtcacccgtcgaagaagctaaatctaaggctgaagtaggcaaaggtgaacagaaggaagaagaggaaaaggaagtgaaggaagctcctaaggaggaaaaagtcgaaaaaaaggaggagaagcccaaagatgtccccgaaaagaaaaaggctgagagcccggttaaggaagaggcagttgccgaagtcgtcacaataacaaagagtgtgaaggtgcaccttgagaaagagacgaaggaagagggaaaaccactgcagcaggaaaaagagaaggagaaagccggaggggaaggggggtctgaggaagaaggatcagacaaaggggctaagggatcaagaaaagaggatattgcggtgaacggggaagtcgagggcaaggaagaggtcgaacaggagactaaagagaaaggctccggacgcgaggaagaaaagggagtcgtgacaaacggactggacttgagtcctgcagacgaaaaaaagggcggcgataagtctgaggaaaaggtggtagttaccaaaacagtggagaaaattacttcagagggcggcgacggcgccaccaagtacatcaccaagtcggtgaccgtaactcagaaggtggaggagcatgaggagacgttcgaggagaaactggtatcgaccaaaaaagtagagaaagttacttctcatgctatcgtaaaagaggtaactcagtcagattag

SEQ ID NO: 197027 - DNA, 1071 bp, Artificial Sequence
  Description of Artificial Sequence: Synthetic coding sequence
atgaccaagagctacagcgagagcggcctgatgggcgagccccagccacagggtcctccatcttggaccgatgagtgcctgtcgagtcaggacgaggaacacgaggccgacaaaaaggaagatgatctagaaaccatgaacgccgaagaggattcactgagaaatggcggagaagaggaagacgaggacgaggacctagaggaagaggaggaagaggaggaggaagacgacgatcaaaagcccaagagacgaggccccaagaagaagaaaatgaccaaagccaggctcgagcgatttaaattgaggcgcatgaaagcaaatgctagagagcgcaacaggatgcacggtttaaacgctgccttggacaatcttaggaaagtggtgccttgctacagtaaaacccagaagttatccaagattgaaacccttcgcctagccaagaattacatatgggcactgtccgaaatcctccggagtggcaagtctcctgacctggtgagttttgttcagaccctctgcaaaggactgtcccagcccacaaccaatctcgtcgccggttgcttgcaactgaatccccgaacgtttctcccggaacagaatcaggatatgcctccccatctacctaccgcatctgcgtctttccccgtgcatccatatagctaccagtctcccggccttccgagcccaccgtacgggactatggacagttcgcatgtctttcacgtcaaaccccctccacatgcctacagtgccgctctggaaccgttctttgaaagcccattaacggattgcacttctccctccttcgatggtcccctaagtccaccacttagcatcaacgggaacttttcatttaagcacgagccgagtgcagagtttgagaagaactacgcattcaccatgcactaccctgccgctaccctggccggtgcccagtcgcacggttccattttcagcggcaccgctgctccccgatgcgagatcccaattgacaacataatgagctttgattctcattcccaccacgaaagagtgatgtctgctcagctgaatgcaatcttccacgattag

SEQ ID NO: 197028 - DNA, 1149 bp, Artificial Sequence
  Description of Artificial Sequence: Synthetic coding sequence
atgctgacccggctgttcagcgagcccggcctgctgagcgacgtgccaaagttcgcttcttggggcgatggagaagacgatgagccccgttccgataaaggcgatgccccgccgcctcctcctcccgcgcctggccccggagcacctggtcctgccagggccgcaaagccggtgcccttacgtggagaggagggaactgaggccactctagccgaggtaaaggaggagggcgagctcggaggcgaagaggaagaggaggaagaggaggaagagggcttggacgaggctgagggagagcgaccgaaaaagcgcggccccaagaagaggaaaatgacaaaagcccgccttgaacggagtaagctaaggcgtcaaaaagctaatgccagggagcgcaaccgaatgcacgacctgaatgcagctttagataatctcagaaaggtggtgccatgttacagtaagacccagaaattgtcgaagatcgaaacccttcgcctggcaaagaattatatttgggctctgtccgaaatcctccgctcgggaaagcggcccgatctggtcagttatgtgcagactctttgcaaggggctcagccagcccaccacgaaccttgtggccgggtgtctgcaactgaacagccgtaactttttgacagagcagggcgcagatggcgcgggaagatttcacggctcaggcggtccgtttgccatgcacccttatccttatccatgctcgcgcctggctggggcgcagtgtcaggccgctggaggtttaggcgggggcgcagctcatgccctcaggacccacggctactgcgcggcatatgagaccctgtatgctgccgccggcggagggggggcctcaccggactacaacagtagcgagtatgagggacctctgtccccccccctgtgtctcaacgggaatttcagcctgaaacaagactcttcacctgatcacgaaaagtcttatcactacagcatgcactatagcgccctgcctggctctaggccaacagggcacggactagtcttcggatctagcgctgtgcgcggcggagtacatagtgagaacctcctgagttacgatatgcacctgcatcacgacaggggtcctatgtacgaagagctgaatgcatttttccacaactag

SEQ ID NO: 197029 - DNA, 996 bp, Artificial Sequence
  Description of Artificial Sequence: Synthetic coding sequence
atgagcaagaccttcgtgaagagcaaggagatgggcgagctggtgaacaccccaagctggatggacaagggccttggcagccagaatgaagtgaaagaggaggaatcacgacccggcacctacgggatgctttcttcactgaccgaagagcatgattctatcgaggaagaagaggaagaggaggaagatggtgagaaacccaaaagacgggggcctaaaaagaaaaaaatgaccaaggctagattggagcgattccgagcccggcgcgtgaaagctaacgctcgcgaacggacccggatgcacggtctgaacgacgccctggataacctgcgaagggttatgccatgttacagcaaaacccaaaagctctccaaaatagaaacactccggctggcgaggaattatatttgggccctcagtgaagtgctcgagacaggacagactcccgaaggtaagggatttgtggagatgctctgcaaaggcctgtcccagcctaccagcaacctggtggctggctgtctccaattgggtccgcagtctgtgctccttgagaaacacgaagataaatcccccatttgtgatagcgctatctctgtgcataattttaactatcaatccccgggacttccctctcctccatacggacacatggaaacccacctgctgcacctaaagccccaggtctttaagtctctgggagagtcctctttcggtagtcacctgcctgactgctcaacgcccccctatgaaggcccactaactcctcctctgagtatcagcgggaatttttcgctcaaacaagacggaagtcctgacctcgaaaagtcttattccttcatgccacactacccatccagctctttgtcgtcaggtcacgtccatagcacaccattccaagccggcacccctcgctatgatgtgcctatcgatatgtcttatgactcatatccccaccacggaatagggacacagcttaataccgtatttacggaatag

SEQ ID NO: 197030 - DNA, 1014 bp, Artificial Sequence
  Description of Artificial Sequence: Synthetic coding sequence
atgctgaccctgcccttcgacgagagcgtggtgatgcccgagagccagatgtgcaggaagttctctagggagtgcgaagaccaaaagcagatcaaaaagccggaatcgttttcaaagcagatagtcctgagaggtaagtccatcaaaagggcacctggcgaggaaacagaaaaggaggaggaagaggaggatagggaagaggaagatgagaacgggcttcctagaaggcgaggactccggaagaaaaagacaaccaagctgaggttagaaagggtgaagtttaggagacaagaggctaatgctcgagaaaggaacagaatgcacggactgaacgatgccctggacaacctgagaaaagtggttccatgctattccaagactcagaagctgtcaaaaatagaaaccctcagactggcaaagaattacatctgggccttgagcgaaatactgaggatcggcaagcggccggacttgcttacctttgtccagaacctctgtaagggactgtcacagcctactactaatctcgtggcgggatgcctccaattgaatgctcggagctttcttatgggtcaagggggggaggccgcccatcatacacgttcaccctattccacattctaccctccctatcacagccccgagctgaccaccccccccggccatgggaccctggacaattccaagtctatgaaaccgtacaactattgctccgcatatgagtctttttacgagtcgacttcaccagaatgcgcttcaccccagttcgaaggtcctctgtcccctccacctatcaactataacgggattttctccctgaagcaggaagagacacttgactacggaaagaactataactacggcatgcattattgcgctgtgccgcccagaggccctctcggacagggggctatgttcagactaccaactgattcacactttccctatgatctacacttgcgcagccagagtctgaccatgcaagatgagttgaacgctgttttccataactag

SEQ ID NO: 197031 - DNA, 714 bp, Artificial Sequence
  Description of Artificial Sequence: Synthetic coding sequence
atgcccgcccggctggagacctgcatcagcgacctggactgcgcctcttcaagtggaagcgacttgtctgggttcctgactgatgaagaggattgcgctcggcttcaacaggccgcttcagcttccgggcctcctgcccctgcaagacgcggagctccaaatatctcgcgggcatcagaggtgcctggggctcaggatgacgagcaagaacgccgacgccgccggggtagaacacgggttagatccgaagctctgctgcactcccttaggcggtcgaggagggtaaaggccaacgatagggaacggaaccggatgcataacctgaatgctgctctcgacgctctcagaagcgtattgcccagtttccccgatgacacaaagctcacaaaaatcgaaaccctgaggttcgcgtacaactacatctgggcattggccgaaaccctcaggctcgccgatcaggggttacccggaggtggtgctcgtgagagactgttgccaccgcaatgcgtaccctgccttcccgggccaccaagcccagcaagcgacgctgagagctggggcagcggagctgctgccgccagtcccctgagtgacccctcctcccccgctgcctcagaggattttacctacaggcctggggaccccgttttttcatttccaagtctccctaaagatctgctacacacaacgccgtgtttcatcccataccactag

SEQ ID NO: 197032 - DNA, 645 bp, Artificial Sequence
  Description of Artificial Sequence: Synthetic coding sequence
atgaccccccagcccagcggcgcccccaccgtgcaggtgacccgggagaccgagaggtcttttccccgtgcctcagaagacgaagtcacctgccccacctctgctcctcctagcccaaccagaactcgtggtaactgcgctgaggcagaggagggcggctgcagaggagcacctaggaagctaagagccaggcgcggcggtcggtctcggcccaaatccgagctggctctcagcaagcagcgccgaagccgccggaaaaaagctaacgatcgcgagcgcaatcgcatgcataatctcaattccgcactggacgcgctcaggggagttctccccaccttccctgacgacgccaagctgactaaaatcgaaacgttgcgtttcgctcacaactatatctgggctctgacccagaccctccgtatcgctgaccacagcttatacgctctcgaaccaccagccccccattgcggtgagctggggtcccctggcggcagtcccggggattggggctcgttgtattcacctgtgtcccaggctgggtcactgtcgcccgcagcatccttagaagagcgacccgggcttttgggagctactttcagcgcttgtctgagccccgggtcactggcattcagcgactttctatag

SEQ ID NO: 197033 - DNA, 456 bp, Artificial Sequence
  Description of Artificial Sequence: Synthetic coding sequence
atggagcggcccgagcccgagctgatccggcagagctggcgggccgttagccgttctcctctggaacatggcacggtgctgttcgctcgcctgtttgcgcttgagccggacctgttgcctctgttccagtataattgcagacagttttccagcccagaggactgcctctcttcacctgagtttttggaccatatacgcaaggtaatgttggttatagatgccgctgtgaccaacgtggaagatttgtcatcattagaagagtatcttgctagcctggggaggaaacatcgggctgtgggggtgaaactgtcttccttcagcacagtgggtgaatctttgttgtacatgctggaaaaatgcctggggcccgcctttactcctgccactcgtgccgcctggtcacaactgtatggcgctgttgtgcaagcaatgtccagaggctgggatggagagtag

SEQ ID NO: 197034 - DNA, 237 bp, Artificial Sequence
  Description of Artificial Sequence: Synthetic coding sequence
atggactgctgcaccgagaacgcctgcagcaagcccgacgacgacatcttggatatccccctcgacgatcctggagcaaacgccgctgccgccaaaatccaggcctcattccgtggacatatggcccggaagaaaatcaaatcaggagagaggggaaggaaaggccctggacctggaggaccagggggcgccggtgtggctaggggcggtgcgggggggggcccgagtggggactag

SEQ ID NO: 197035 - DNA, 237 bp, Artificial Sequence
  Description of Artificial Sequence: Synthetic coding sequence
atggactgctgcaccgagaacgcctgcagcaagcccgacgacgacatccttgatattcctctagatgaccccggggccaacgctgcggctgctaagatccaggcttctttcaggggccacatggcgaggaaaaagatcaaaagtggagagcgcgggcgaaagggaccagggcccggaggacctggcggcgctggcgttgcccgcggaggcgccggtggaggccctagtggagactag

SEQ ID NO: 197036 - DNA, 237 bp, Artificial Sequence
  Description of Artificial Sequence: Synthetic coding sequence
atggactgctgcaccgagaacgcctgcagcaagcccgacgacgacatcctggacattcctttggatgatccaggagcgaacgccgcggccgctaaaattcaagcctctttccggggtcacatggcccggaagaagattaagagcggcgagcggggaagaaagggccccggaccagggggccccggaggagctggcgtcgctagaggaggcgctgggggcggaccatcaggcgattag

SEQ ID NO: 197037 - DNA, 936 bp, Artificial Sequence
  Description of Artificial Sequence: Synthetic coding sequence
atggccgccctgggcgtgctggagagcgacctgcccagcgccgtgacactcctcaagaatttacaggaacaggttatggctgtgaccgcacaggtgaagtccttaacccagaaggtacaggcgggggcgtacccaaccgagaaaggtctgagctttctagaggttaaggaccagctcttgctgatgtatctgatggatctgacgcacctcatcctggataaagcgtctgggggctcgctgcaggggcacgacgccgtgctgagattggtcgagattagaaccgtccttgaaaagctacggcctttggaccagaagttgaagtaccaaatcgacaagctgattaaaaccgccgtgaccggctccctgtccgagaacgacccattacgattcaaaccacatccttcaaatatgatgagtaaactgagttccgaggatgaagaggaagatgaagcggaggacgaccaatccgaagcctcaggcaaaaaatctgtcaagggagtttccaagaaatatgtgcctcctaggctcgttcctgtccactacgacgagacagaggctgaacgcgaaaagaagcggctggaacgcgctaagcggcgagccctgtcatcgtctgttattagagaattgaaggaacaatatagcgatgcaccagaggaaatccgcgatgcaagacatccacatgttacgagacagtcccaagaggaccagcatcgaattaactacgaagaaagcatgatggtgcggctttcggtgagcaaacgagagaagggtaggaggaaacgagctaacgtaatgagctcccagctacattcattgacacactttagcgatataagcgccctgaccggaggaacagtccatctggacgaggaccagaatcctatcaagaagcgcaaaaagattccccagaaaggccggaagaaaaagggtcaatag

SEQ ID NO: 197038 - DNA, 948 bp, Artificial Sequence
  Description of Artificial Sequence: Synthetic coding sequence
atggccgccctgggcgtgctggagagcgacctgcccagcgccgtgacattactcaagaacctgcaggagcaggtgatggccgtaacagcccaggttaagagtctaactcagaaagtgcaggccggagcttacccaacagaaaaaggcctgagtttcctcgaggtgaaggaccagctgctgctaatgtatctcatggacctgacccacctcatcctggacaaggccagtggaggctcgctacagggccatgatgctgtgttgaggttagtcgaaattcggaccgtgctggaaaagctaaggcccctcgaccagaaattgaaataccagatcgataagcttattaaaactgccgttactgggtccttgagcgagaatgatcctctgaggtttaaacctcacccatccaatatgatgtctaaactgtcgtctgaagacgaagaggaggatgaggccgaggacgaccagtccgaggcgagcggcaaaaagagtgttaagggtgtgagcaagaagtacgtgcctccacgcctggttcctgtccactatgacgaaactgaggcggagagggagaagaagcgcctagaacgagcgaaacgacgcgccctgtcaagtagcgttattagggaattgaaagagcagtattcagacgcaccagaggagatacgtgatgcccgacaccctcatgtgacacgacagagccaggaggatcaacatcgtatcaattacgaggagtcaatgatggtgaggcttagcgtgtctaagagagagaagggccgccgtaagagagccaatgtcatgagcagccagctgcactctttgactcacttttcagatataagcgcacttactggagggaccgtgcacctagacgaagaccagaatccaatcaagaaacgaaagaagattcctcagaaaggccgtaagaagaagggcttccggagaaggcgctag

SEQ ID NO: 197039 - DNA, 2472 bp, Artificial Sequence
  Description of Artificial Sequence: Synthetic coding sequence
atggccctgccccggtgcacctggcccaactacgtgtggcgggccgtcatggcatgcttggttcacagagggctcggtgcccccctgactctgtgtatgctgggatgtcttttgcaagcgggacacgtcttatcccagaagctggacgatgtcgatccactggttgctacaaattttggcaaaatccgaggcatcaaaaaggaactcaacaacgagattctggggccagtgattcagtttcttggagtcccctacgccgctccaccgactggagaaagaagattccagcctccagagcctccctccccttggagcgatatccgcaatgccacacagttcgcgccagtttgcccgcagaatatcatcgacgggcgcctccccgaggtcatgctgccggtgtggtttaccaacaacctcgatgtagtgagttcctatgttcaggaccaatcagaagattgtctgtacctgaatatctatgttcccactgaggatgatattagagactcaggaggacccaaaccagtgatggtgtacatccacggcgggtcatatatggagggaacggggaacctgtacgatggtagtgtcttggccagttacgggaatgttatcgtgatcaccgtcaactacagactgggtgtgttggggttcttgagcaccggggaccaggccgctaaaggtaattacgggctgttggaccttattcaggctctgcgttggacatccgaaaatatcggatttttcggtggtgacccccttcgaatcaccgtgttcgggtccggggcaggaggctcttgtgtcaacctccttacgttgtctcactattccgagggcaacaggtggtctaattcaaccaagggcctgttccaaagagcaatcgctcaatctggtacagcgctgtccagctgggctgtatcttttcagccagccaaatacgcgcgaatgctggcaacaaaggtcgggtgcaatgtgagcgatactgtcgagctcgtggagtgtttgcaaaaaaaaccttataaggagttagttgatcaggatattcaacctgctcggtaccatatcgcattcggaccagtgattgatggcgacgtcatccccgacgacccccagattcttatggaacagggtgaatttctgaactacgatattatgctcggcgtcaaccagggtgagggcttgaaattcgtcgagaatattgtggactccgacgatggaatttcagcgagcgattttgactttgccgtatccaattttgtcgataacctatacggctatcctgagggaaaagacgtgttgagggagactataaaattcatgtacaccgactgggcagatagacataatcctgaaacccgacgcaaaactctcctggcccttttcactgaccaccaatgggtagcccctgccgtggccaccgcagacttgcattctaattttgggtcaccaacgtacttctacgcattttatcaccattgccagacagatcaagtcccagcgtgggctgacgccgcacatggtgatgaggtgccttacgtgctgggaattcccatgatcggacccacagaattgttcccatgtaacttctccaagaacgacgtcatgctcagtgcagtggtgatgacatactggaccaactttgctaaaacgggtgacccaaatcagcccgttccccaggatacgaagttcattcacacaaagccaaatcggttcgaggaagttgcctggaccaggtattcccagaaagaccagctttacctgcacatcggtctcaagccacgcgtgaaagagcactacagggccaacaaagtgaatctctggctcgaactcgtcccgcatctgcacaatttaaacgacatcagtcaatataccagtacaaccaccaaggttccctctaccgatattacctttcggccaacgcgcaaaaatagcgtgccagtcactagcgcttttccaacggcaaagcaagatgaccctaaacagcaaccctcccctttttccgtggaccagcgggactatagcaccgaactttctgtcaccattgccgtgggcgctagtcttctcttcctcaatatccttgctttcgctgccttatattacaaaaaggacaaacgtagacacgacgtgcatagacggtgttcaccacaacggacgactaccaatgatctgacccatgcccaggaagaggagatcatgtcactgcagatgaaacacacagatctagatcatgagtgcgagtcaatccaccctcacgaggttgtccttagaacagcatgtcctcctgattatactttggcgatgaggaggtctcctgacgatgtacccctgatgactccgaacacaatcactatgatcccaaataccattcccggaatacagcctctgcatacctttaatacatttactggagggcagaacaacacattaccacacccacatcctcacccccactctcactccacgacaagagtgtag

SEQ ID NO: 197040 - DNA, 2592 bp, Artificial Sequence
  Description of Artificial Sequence: Synthetic coding sequence
atggccctgccccggtgcacctggcccaactacgtgtggcgggccgttatggcatgtcttgtccacagggggctaggagctcctctgacactttgtatgctgggatgcctgctccaagccgggcacgtgctgtcccagaaactcgatgacgtggaccccctcgtggctaccaactttggcaagattcgagggataaagaaggagcttaataatgagatcctcgggcccgtgattcagttcctgggagtgccttatgccgccccccccacaggagaacggagattccagcctcctgagcctccctccccttggtctgatatccgcaacgctacccagtttgctcccgtgtgtccgcagaacatcatagatgggcgactccctgaagttatgttgcctgtgtggttcacaaacaatctggacgtggtgtctagttacgtgcaggaccagtccgaggattgtctgtatctcaatatttacgtgcctacggaggatgtaaagcggatatcaaaagaatgtgcaagaaagcccgggaagaagatatgccggaaaggtgggcccttaacgaaaaagcagacggacgacctcggagataatgatggcgctgaagacgaggacattcgcgacagtggtggaccaaaacctgtgatggtctatatccacggcggatcatacatggagggcaccggaaatttatatgacggatcggtgcttgcctcttatggcaacgtaatagtaatcaccgtcaactaccggcttggggtgctgggctttctgtctacaggcgatcaggcagccaaaggcaattatggactgcttgatcttattcaagccctgcgctggacttcggaaaacattggatttttcggcggagatccgctcagaattacggtattcggcagcggggccggagggagctgtgtgaacctgctgacactgtctcactactcagaaggaaaccggtggtccaattccacaaaaggtttatttcagcgggccattgctcagtccggcacggccctgagttcatgggctgtgtcattccaaccagccaaatacgctaggatgttagccaccaaggtgggctgcaacgtgtcagacacagtggagctggtagaatgtcttcagaagaagccatacaaggagctggtagatcaggatatccagccagccagataccacattgcgtttggccccgttatcgatggagacgtaatacccgatgaccctcaaatcctaatggagcagggagaatttctgaattacgacattatgctaggtgtcaatcagggagaaggactaaagtttgtggagaatattgttgattccgacgacggcatatcagcgtcagatttcgacttcgccgtgtctaatttcgttgacaatttatacgggtatccagagggaaaggatgtgctacgggaaaccattaaatttatgtacacagactgggccgatcggcataaccccgagacgcggaggaagacactcctagctctcttcacggaccaccagtgggtcgctcccgcagtcgccacggcagacctgcacagcaattttgggagcccaacctacttctacgcattttaccaccattgccaaactgaccaggtccccgcatgggctgatgcggcgcacggggacgaagtgccttacgtgctgggcattccgatgatcggccctactgaactgttcccttgcaactttagtaagaacgacgtcatgttgagtgccgttgtgatgacttattggacaaattttgcaaaaactggtgatccaaatcagccagtgccccaagatacaaagtttatccataccaaaccaaaccgcttcgaagaagtcgcctggactcggtatagtcagaaagaccagctgtacttacacatcggcctgaaaccccgcgtaaaggagcattatagggctaacaaggtcaacctatggctggagctggtaccacaccttcacaacttgaatgacattagtcagtatacgtccacgaccacaaaggtgccctccactgacatcacattcagacccacacggaagaattcagtacccgtgacttcagcctttccaacagctaagcaggatgaccctaaacagcagccaagtccattctctgtggatcagcgagattactccaccgaactgagtgtgactatcgctgttggcgcctccttgctctttctcaacattcttgcattcgccgcactgtattataaaaaagacaagaggcgccacgatgttcaccgaagatgctcgccccagagaacaacaacgaatgatctcactcatgcacaggaggaagagatcatgtctttacagatgaaacatacagatctggaccatgagtgtgagtccattcatccacatgaagtggtgctgcgtacggcatgtccccccgattatactctcgcaatgaggcgatcaccagacgatgtgccattgatgacacccaacactatcaccatgatccctaacaccattcccgggatacagccgctgcacactttcaatacattcactggagggcagaataacactctcccccatcctcacccccaccctcattcgcattctacaacaagagtgtag

SEQ ID NO: 197041 - DNA, 33 bp, Artificial Sequence
  Description of Artificial Sequence: Synthetic coding sequence
atggccctgccccggtgcacctggcccaactag

SEQ ID NO: 197042 - DNA, 42 bp, Artificial Sequence
  Description of Artificial Sequence: Synthetic coding sequence
atggccctgccccggtgcacctggcccaactacgtgtggtag

SEQ ID NO: 197043 - DNA, 2472 bp, Artificial Sequence
  Description of Artificial Sequence: Synthetic coding sequence
atggccctgccccggtgcacctggcccaactacgtgtggcgggccgtgatggcgtgcctggtccatagaggtctgggggcaccattgaccctgtgtatgttgggatgtttacttcaggcgggccacgtgttatcacaaaaacttgatgacgtcgatcccctggtggcaacgaacttcgggaagattaggggtataaagaaagaattaaataacgaaattctcggtcctgtgatccagttcctgggggttccctacgccgctcctccaactggcgagcggcgatttcagccccccgaaccaccttccccctggtccgatatacgcaacgcaacgcagttcgcacccgtgtgcccacagaatattattgatggcagactgccagaggtgatgttacccgtgtggttcacgaacaacttggatgtggtgtcttcctacgtgcaggaccagagcgaggattgcctgtacctcaacatctatgtgcctacagaggacgatatcagggatagcggcggtccaaaacctgttatggtctatattcacggtggcagctacatggagggcaccggaaatctctatgacggaagtgtgcttgcctcctatggcaacgtgatagtaattaccgtgaattaccgccttggcgtcttaggattcctcagcacaggtgatcaagcggcaaagggtaactacgggctgttagatctaatccaagccctccgctggacaagtgaaaacattggattcttcggcggagacccactgagaataacagtctttggcagtggcgctggtggatcttgtgtgaacctactgacactgagccactacagtgagggaaacagatggagtaattccacgaaggggttgttccaaagggccatcgcccagagcgggaccgcactgtcttcttgggccgtgtcatttcaacccgctaagtacgctcgcatgcttgccaccaaagtcggttgcaacgtctccgataccgtggagctggttgagtgtctccagaaaaagccatacaaggagctcgtggatcaggacattcagccagctaggtaccacatagctttcggccccgttattgatggagatgtgattccagacgatccccagatcttaatggagcagggtgaattcctgaactatgatatcatgctaggcgtcaaccagggagaggggctcaagttcgttgagaacatagtggacagcgatgatggcatttctgcctcggattttgattttgcggtctcaaattttgtggataacttatatggttaccccgaaggcaaagacgtgttgcgcgagactatcaagttcatgtacaccgattgggcggacaggcataatccagagaccagacgcaagactctgctcgccttgtttactgatcaccaatgggttgcccccgcagtggccaccgccgatctgcatagcaacttcgggtcccccacctacttctacgctttctaccaccactgccagactgatcaagtgcccgcttgggcagacgccgcacatggagacgaggttccatacgtgttggggatccctatgattggtcctactgagctcttcccttgtaacttctcaaaaaacgatgtgatgttatccgccgtcgtcatgacttattggaccaatttcgcgaagacaggcgacccaaaccagccagtgccacaggacacaaagtttatacatactaagccgaaccgctttgaggaggtggcatggactaggtacagccagaaggatcagctgtatcttcatataggactgaagccacgagtgaaggagcactatcgcgctaacaaagtgaacctttggctggagctggtgccccacctgcacaatctgaatgacattagccagtacaccagcacaacgaccaaagtgccaagcacagacattacgtttaggccgaccagaaagaattctgttcccgtgaccagcgcatttccgacagccaagcaagatgaccccaaacagcagccaagccccttcagcgtggatcagcgggattacagcactgagctgagcgttacaatcgcagtcggggcgtccctgctgttcctgaacattttagcctttgccgcgctgtattacaagaaggataaacgaagacacgatgtgcacaggagatgcagtccacaaaggacaacgactaatgatctgacccatgcccaggaggaagaaatcatgagcctgcagatgaagcacacagatctcgaccacgaatgcgaaagcattcatccccacgaagtggtgcttcgaaccgcctgcccacccgattacaccttggcaatgcgcaggtctccggacgacgtcccactcatgacaccaaatacaattacaatgattcccaataccatccctggaattcagccattacacacttttaatacattcacagggggccagaacaatacgctaccccacccccacccgcacccgcacagtcatagtactacacgggtgtag

SEQ ID NO: 197044 - DNA, 2472 bp, Artificial Sequence
  Description of Artificial Sequence: Synthetic coding sequence
atggccctgccccggtgcacctggcccaactacgtgtggcgggccgtcatggcgtgcctggttcaccggggactgggtgctccactcactctttgcatgctgggctgtcttctccaagcaggacacgtgcttagccagaaactggacgatgtggacccactggtcgcaacgaatttcggaaaaataagaggaataaagaaagagttaaataacgagatactgggacctgtaattcaattcctgggtgtgccttacgccgcacctccaacaggggagcgccggttccagccaccggaacccccatctccttggagtgacatccggaatgctacacagttcgcccccgtgtgtccacaaaacattatcgacggacgcctgccagaggttatgttacctgtttggtttaccaacaacttagacgtggtttcctcctacgtgcaagaccagagtgaggattgtttgtacctcaacatttacgtgccaaccgaggatgacatcagagactctggggggccaaaaccagtgatggtgtacattcatggaggctcttatatggaagggaccgggaacctttatgacgggtccgtgttagccagttatgggaacgtgatagtcatcaccgtcaactaccggctcggtgtgctcggtttcctgtctactggtgatcaggccgcaaagggtaactatggtcttctcgaccttatacaggcactccggtggacatcggagaacattgggttcttcgggggcgaccctctgcgcataactgtgtttggttccggggcagggggatcctgtgtgaacttgctcacactgtcccattattcagagggcaatagatggtcaaattccacgaaaggattgttccaaagagccatcgcacagtctggaactgctctgtctagctgggctgtttcattccagccggccaaatacgctcgtatgctggcgactaaggttggatgcaatgttagcgatacagtggagctggtcgaatgcctgcagaagaaaccgtacaaagagctggtggaccaagatatacagccggctcgataccacatagccttcggccccgtgatcgacggagacgttatccctgacgacccccagatcctaatggaacagggggagtttttgaactatgatatcatgctaggagtcaatcagggcgagggcctgaaatttgtcgagaatattgtcgacagtgacgacggtatttctgcaagcgactttgattttgctgtgagtaactttgttgataatctctacggatacccggaagggaaggatgtactgcgagaaacgattaaatttatgtacacagactgggccgacagacataatccagaaacacggcgcaagacactgctggccctgtttaccgaccaccagtgggttgcaccagcagttgctacagccgatctccattcgaactttggctctccgacctacttttacgcattctaccatcactgtcagacagatcaagtgcccgcctgggctgacgccgcacacggagatgaggtgccttacgtcctcgggatcccaatgatagggcccaccgagttattcccatgtaatttctccaagaacgatgtcatgctgtctgcggtcgttatgacatattggaccaatttcgctaaaacaggcgatcccaaccagcctgtaccgcaggacaccaaattcatccacaccaagcccaaccggtttgaggaagtggcttggactcgttactcacaaaaggatcaactgtacttgcatatcggcttaaagcctcgggtaaaggaacattatcgggcaaacaaggtaaacctgtggttggagttggtcccacatctacacaacctaaacgatatatcccagtacacttccacgaccaccaaggtgccgagcaccgatataacattcaggccaaccagaaaaaatagcgttccagtgacttccgcatttccaaccgccaaacaggacgaccccaagcagcagccaagcccgttctccgtggatcagcgcgactactctacagaattgtccgtcacaatagcagtgggagcgtccctgctgttcctgaacatactggccttcgccgcactctattataagaaagacaaacgaaggcatgatgttcacagacggtgttctcctcagcgaaccactactaatgacctgacacacgcccaagaggaggagatcatgagcttgcagatgaagcacacagacctagatcacgagtgcgaatcgatccatccgcatgaagtggtgttgagaactgcgtgccctccagattatacactcgccatgcgacggagtcccgatgacgttcctctgatgacccctaatactattaccatgatccctaacactatccctggaatccagcctctgcatactttcaatacctttacaggaggccagaacaatacactgcctcacccacacccacaccctcactcacattcaacaacccgcgtttag

SEQ ID NO: 197045 - DNA, 2508 bp, Artificial Sequence
  Description of Artificial Sequence: Synthetic coding sequence
atgtggctgctggccctgtgcctggtgggcctggccggcgcccagagaggaggcggggggcccgggggtggtgcgcccgggggaccgggcctcggcttggggtcattgggggaggaacgattccctgtggtcaataccgcctatggtagagtgcgaggggtcaggagggaactcaacaacgaaatcctgggccctgttgtacagttcctgggcgtgccctatgccacaccaccactcggggcccgtcggtttcagccgcctgaggctccagcttcctggcccggcgtgcgcaacgccactaccctccctcctgcatgccctcagaacttgcacggcgccctccccgccatcatgctgcctgtgtggttcacggacaatctggaagccgcagcaacctatgttcagaatcagtcggaggactgtttgtacctaaacttatacgttcccacagaggatggacccttgaccaagaaacgcgacgaagccacactgaacccaccggacacagatatcagagacccagggaagaagcctgttatgcttttcctccacggcggcagttacatggagggaacagggaatatgtttgacggttctgtcttggctgcgtacgggaacgtgattgtggccaccctgaattacaggttaggcgttctcgggtttctatccacaggggatcaggccgcgaaaggaaactatggactgttggaccagatccaagccctcagatggctgtcagagaacattgcacacttcggcggcgacccggaacggataacaatctttgggtccggggcaggcgccagttgtgtgaatttgctcatactctcacaccactcagagggcttgttccagaaggccattgcccaatcggggacggcgatatcaagctggagtgtgaactaccagccgttgaaatacactaggctattagcagcgaaagtaggctgcgacagggaagactctgccgaggcggtcgagtgccttcgtcggaaaccttcgagagagctggtagaccaggacgtacaacctgcccgataccacatcgcctttggcccagtcgtcgatggcgatgtagttcctgatgatccagaaattctgatgcagcaaggggaattcctgaactatgacatgctgattggcgtcaatcaaggagagggcctgaaatttgttgaggacagcgcggaatccgaggacggagtcagtgcatctgcattcgatttcaccgtgagcaactttgtagataacctgtatggttaccctgaaggcaaggatgtgcttcgggagactatcaagttcatgtacaccgattgggcagatcgcgacaatggcgagatgaggcggaagaccctcctcgccctgtttacggaccaccagtgggtggcccctgccgtggccacagccaagctccatgcagactaccagtcacctgtatatttttataccttctatcatcactgccaggccgagggccggccagaatgggccgatgctgcccacggcgacgagcttccatacgttttcggcgtgcccatggtgggcgccacagacctgttcccttgcaacttcagcaagaacgatgtgatgctcagtgcggtggtgatgacctactggaccaactttgcaaagaccggcgatccaaatcaacctgtgccacaggatactaagttcatccataccaagcctaaccgtttcgaggaggtcgtgtggtccaaattcaactcaaaagagaaacagtacctgcacatcggcctcaaaccaagagtgcgggacaattatcgcgctaacaaggtagctttttggttagaactggttccacacttgcataacttgcatactgagctctttaccactaccactcggctgccaccatatgccaccaggtggcctccacggcctcccgccggcgccccaggaacaagaagaccgcctcccccagccaccttgccaccagaaccggagccggagcctgggccgcgagcttatgacagattccctggcgattccagggattacagtactgaactgagtgtaactgttgctgtgggtgcctccctcctctttctgaatatccttgctttcgccgctctgtactataagcgcgacagacgccaggaactgagatgtcgaagactcagtccacccggcggatctggtagtggcgtacctgggggcggaccactgttaccagcagcaggtcgggaactgcctcctgaagaggaactcgtgtctcttcagttaaagagaggtggcggagttggggccgatccagcagaagctctgcggcccgcctgtccccctgactacacattagcgctgagaagagcccccgacgatgtgccactactggcgcccggtgctctcaccctcttgccttctggtttgggaccaccgccacctcctcctcccccgagtctacaccccttcgggccgttccccccaccaccacctactgcaacttcccacaacaatactttgccccaccctcactctacaacccgagtctag

SEQ ID NO: 197046 - DNA, 2547 bp, Artificial Sequence
  Description of Artificial Sequence: Synthetic coding sequence
atgtggctgcggctgggcccccccagcctgagcctgagccccaagccgacagtcggccggagtttgtgcctgaccttgtggtttctgagcctagccctgcgtgcctcaacccaagcaccagcgccaacagtcaacacacactttgggaagttgcggggcgcccgggttcctttaccaagcgagattctaggccctgtggatcaatacctgggcgtcccctatgccgcgccccccattggggagaaacgcttcctcccgccagagcctcccccttcatggagcggcatccgcaacgccacccacttcccccccgtttgcccccagaacatccacactgcagtgcccgaggttatgcttccggtgtggtttaccgctaacctggatatcgtcgccacatatatccaggaaccaaacgaggattgtctgtatctaaacgtgtacgtgccaacagaggatgtgaaacgtatctctaaggagtgcgcccgcaagcccaataaaaaaatttgcaggaaaggcggatcaggggccaaaaaacaaggtgaggatctcgcagataacgatggcgacgaggacgaggatattcgagacagcggcgccaagccagtcatggtgtacatccatggtggaagctatatggagggaactgggaacatgatcgacgggtcaatcctggcctcttatgggaacgttatagttatcactctcaactaccgagtgggggtgttgggattcctttctacaggcgaccaagccgcgaaaggaaattacggcctgttggaccaaatccaagccctcaggtgggttagcgaaaacatcgcttttttcggcggggatccacggcgtattacggtctttggatcaggcataggagcatcttgcgtgagcctgcttacgctgtctcatcatagtgaagggttgttccaacgcgccatcattcagtctggaagtgcactgagttcttgggcggttaactaccagccggtgaaatatacctccctgttggcggacaaggtgggatgcaatgttctggacacagtggatatggtggactgcctccgccagaagtccgccaaagaattggttgagcaggacattcagccagccagatatcacgtcgccttcgggcccgtgatagatggggacgttattccggacgaccccgagatcctcatggagcagggggagttcctcaactacgacatcatgctgggcgttaatcagggagagggtttaaaattcgtggagggtgtggtcgatccagaagacggagtgtccggtacagactttgattacagcgtgtccaattttgtcgataacttgtatggctatcctgaaggcaaggatacccttcgtgagaccattaaattcatgtacacagattgggccgatcgtgataaccctgaaacccggagaaagacattggtagccctgttcactgatcatcaatgggtggaaccaagtgttgtcacagcagatcttcatgcacgctacggctctcccacatatttctacgccttctaccatcattgccaaagccttatgaaaccagcttggtctgatgcagcccacggagacgaggtgccctacgtctttggggtacccatggtcgggcccactgatctgttcccatgcaattttagcaagaacgacgtgatgctcagcgccgtggtgatgacctactggaccaacttcgccaaaacaggggatccaaacaaaccagtgcctcaggacacaaagtttatccatacaaaggccaaccgctttgaagaggtcgcctggtctaagtataatccaagagatcagctgtacctgcacattggcctgaagccacgcgtgcgcgatcattaccgtgccaccaaggtcgcattttggaaacacctcgtcccccacttgtataacctacacgacatgttccactatacctccacaaccacaaaggtccctcctcctgataccactcattcatctcacatcactaggcgaccaaacggaaagacatggagcactaagcggccagctatatcccccgcatattctaatgagaatgcacagggaagctggaatggtgaccaagatgcgggccccctcctggttgaaaaccccagggattattctacagagctctcagtgacgattgctgtgggggcctctcttctatttctgaacgtcctcgccttcgctgctctatactaccggaaggacaagaggcggcaggaacccctgcgtcagccttctccacaaaggggtgcaggggctccagagcttggtgctgccccagaagaagagcttgctgctctgcagctcgggccaacgcatcacgagtgtgaggccggcccgccccatgacaccctgcgtttgactgccctgccagactacacactgaccttgcgacgaagcccagacgacattcccctaatgacccctaacacgataactatgatccccaactctctcgtagggctgcagaccttgcacccttacaatactttcgctgccggatttaattctaccggtctcccacacagtcattcaaccacaagagtgtag

SEQ ID NO: 197047 - DNA, 2487 bp, Artificial Sequence
  Description of Artificial Sequence: Synthetic coding sequence
atgtggctgcggctgggcccccccagcctgagcctgagccccaagcccaccgtcgggagaagtctctgtcttaccttgtggttcttgagtttagcgttgcgagcctctacacaggcacctgcaccaaccgtgaacacacacttcggtaaattgcgtggagccagggtccctctgccgtcagagattttggggcccgtggatcagtacctgggcgtgccttacgctgccccacccattggtgagaaacggtttcttcccccagagccgcctccttcttggagtggcattagaaacgccacccacttcccccccgtctgtccgcagaatattcatacagcagtgccagaggtaatgctgccagtttggtttacagcaaacctggacatagtggctacctatatccaggagcccaacgaagactgcctgtaccttaatgtgtacgtccctacggaggacggttctggcgcgaagaagcagggagaggacctggcagataatgatggagatgaggatgaggatattagggacagcggggctaaacccgtgatggtgtacattcacggtggatcctacatggagggtacgggtaacatgatcgacggaagcattctcgccagctacggaaacgtcatcgtaatcaccctcaactaccgtgtgggtgtgctggggtttttgtccacgggcgaccaggctgccaagggtaactatgggctgctggatcagatccaggcgctgcgctgggtgtctgaaaacattgctttctttgggggtgatcctcgccggattaccgtgttcggctcaggcatcggagcatcatgtgtgtctctcctgactctctctcaccactcagaaggcctgttccagcgcgctatcattcagagcggttctgccctaagttcctgggcggtgaactatcagcccgtcaaatacacctctttgctcgctgacaaggtggggtgcaacgtactcgatacagtggatatggttgattgtctgcgccagaagtcagcaaaggagctggtggaacaagacatacagcccgctagataccacgtggccttcggtccagtgattgacggtgatgtgatcccagacgacccagagatcctgatggaacaaggagagttcttgaattatgacatcatgctgggggtaaatcagggcgaaggcctcaaattcgtcgaaggagtggtggatcccgaggacggagtgtcaggaacggacttcgactactccgtgtcgaatttcgtggataacctgtatggatatcccgaggggaaggacacgttgcgcgaaaccattaaatttatgtacactgattgggctgatcgggataatcctgagacacggagaaagactttggtggctttattcaccgatcatcagtgggtcgagccctctgttgtaactgcagatctacacgcacgttatggatcccccacctatttttatgccttctaccaccactgccagagcctcatgaaaccagcttggtctgacgcagcccacggggatgaggtgccgtacgtctttggcgtcccgatggtgggacccacagatctatttccctgtaatttttcgaagaacgacgtgatgctgagtgcggtggtgatgacatattggaccaatttcgcaaagactggggaccctaataaaccggtccctcaagacaccaaatttatccataccaaggcgaaccgcttcgaggaagtggcctggagtaagtacaaccccagagaccagctgtatttgcacattggactcaaaccccgcgtcagagaccactatcgggcaaccaaggtagcgttttggaagcacctcgttccacacctttacaatctccacgatatgttccactacactagtacgaccacaaaggtgccaccaccagataccacacactcttcacatatcactcggagaccaaacggtaaaacgtggtctacaaaacggcctgctatctcacccgcatattcaaacgagaacgcgcagggctcttggaacggagaccaagacgccggtcccctcctggtcgaaaatccgagggactactccaccgagctgagcgtgacgatagccgtgggggcgagccttttgttcctaaatgtgcttgctttcgcagcactgtattaccggaaggacaagcggagacaagaacctctgcgccagccatcccctcagcggggtgcaggggcaccagaattaggtgccgctcccgaagaggagctggcagccctccaacttggccccacccaccacgagtgtgaggctgggcctccacacgatacgctgcgcttgacggctctccctgattacacgttaactctcagaaggtcacccgatgatatccccctaatgacacccaataccatcaccatgatccccaattctctcgtaggtttacagactctgcatccttataacactttcgctgctggatttaactccaccggcctgcctcactcacactctaccactcgggtgtag

SEQ ID NO: 197048 - DNA, 1542 bp, Artificial Sequence
  Description of Artificial Sequence: Synthetic coding sequence
atgtggctgcggctgggcccccccagcctgagcctgagccccaagcccaccgtcggtcgaagtctgtgcttaacgttgtggttcctgagtctggcgcttagagcaagcacccaggcccccgccccaaccgtgaacacccactttgggaaactgaggggagccagagtccccctgcctagcgaaatattgggtccagtggaccagtatctcggagtaccctatgcggccccgcccatcggggaaaagcgctttctgcccccagaacctcctccaagctggagtgggattagaaacgccactcactttccccccgtctgcccacagaatatccacacagccgtgcccgaagttatgctacccgtttggtttactgccaacctggatatcgtagcgacatatatccaggaacccaacgaagactgcctttacctcaatgtgtacgtcccaaccgaagatgacataagggactctggggccaaaccggtgatggtctacatccacggtgggagctacatggagggaacaggaaatatgatagatggaagtatccttgcaagttacggtaatgtgatcgtgataacccttaactacagagtgggagtgttaggatttctgagtacaggggatcaagccgcaaaaggaaactacgggctgctggatcagattcaggccttgagatgggtgtcagaaaatattgcgttcttcggcggcgatcctaggagaataacagtttttggctctggcataggggcatcctgtgtcagtttacttactctgtctcatcactccgagggcctgttccaacgtgcaatcattcagtccggcagcgctcttagttcatgggcagtgaattaccagcctgtcaaatacacatccctgctggcggataaagtgggctgcaatgtgttggacaccgtggatatggtggactgtctccggcagaaaagcgctaaggagctcgtcgaacaggatattcagccagcccgttaccacgtggctttcggaccagtgatcgatggtgacgtcataccagatgatcccgagatcctgatggaacagggcgagtttttaaactatgacattatgctgggcgtgaaccagggtgaagggctgaaattcgtcgagggcgtcgtggatcccgaggatggcgtaagcggcacggactttgactattctgttagtaactttgtggataatctgtatggctatcccgaaggtaaggacacattacgggagacaatcaagtttatgtataccgattgggccgatagggataatcctgaaacccgcaggaaaaccctcgtcgccctgttcacagatcatcagtgggtggagccgagcgtagtaaccgccgacctgcacgcccgatatggcagtcctacctatttctatgcattttatcatcattgtcaaagcctcatgaagccagcttggagcgatgcagcacatggcgacgaagtgccttacgtcttcggagtgcccatggttggacctaccgatcttttcccgtgtaattttagcaagaacgatgtgatgctgtag

SEQ ID NO: 197049 - DNA, 2427 bp, Artificial Sequence
  Description of Artificial Sequence: Synthetic coding sequence
atgtggctgcggctgggcccccccagcctgagcctgagccccaagccaaccgttgggcgaagcttgtgtctcactctgtggttcctaagcctagcccttcgtgccagcacgcaggctcctgcacccacagtcaacacacattttggcaagctgcggggggctagagtccctcttccttcagagatactcggacccgtggaccagtatctaggggtgccatacgctgccccgcctatcggggaaaagagattcctccctcccgagccccctccgagttggagcggcatccgaaatgctacgcatttcccacccgtgtgtcctcagaatattcataccgcagtccctgaggtgatgctcccggtgtggttcacagctaacttggacatcgtcgccacctacattcaggaaccaaacgaagactgtctttacctgaatgtctacgttccaactgaagatgacatacgggattccggagcgaaacccgtcatggtgtatatccacggcgggtcatatatggaggggaccggcaacatgatcgacggcagcatcctcgcctcttatggcaacgtaatcgtgatcactctaaactacagagtcggcgtgttgggcttcctgtccactggggatcaggctgcaaaggggaattatgggctgctggatcagatccaggccctaaggtgggtttctgagaacatcgcctttttcggcggagacccccggcgaatcaccgtgtttgggtccggaatcggtgcctcatgcgtgtctttactgaccctgagtcaccactccgagggactctttcagcgcgctattatccaaagtggcagcgcattgtctagctgggctgtcaattaccagcctgtcaaatacacctccctgttggctgacaaggtgggctgcaatgtcctggacaccgtcgacatggttgactgtttaaggcagaagagtgctaaagagcttgtcgagcaggacatccagccagcccggtaccacgtggccttcggccccgttatcgatggcgacgtcattccagatgatccggaaatcctcatggaacagggggaattcttaaactatgatattatgctgggtgtgaaccagggcgaagggctcaagttcgtggagggagtcgtggaccccgaggatggagtttctggcacagactttgattatagtgtctccaatttcgttgataacctgtacggttaccctgagggcaaggacactttgagagaaacaataaagtttatgtataccgactgggcagaccgcgacaaccccgaaacacggcgaaagaccttagtcgcattgtttacggaccatcagtgggtcgaaccatccgtagtgaccgctgatctgcacgccaggtacggcagccccacttacttctacgccttctatcatcactgtcaatctctgatgaagcctgcctggtccgatgcagcccacggagatgaggtgccgtatgtcttcggtgtcccaatggtcggacccacggacttgtttccctgtaatttttccaaaaatgacgtaatgttgagtgcagtggtaatgacatactggactaatttcgccaagacaggcgaccccaacaaacccgtacctcaggatactaaattcatccatactaaggctaatcggttcgaggaggtagcgtggtccaaatataaccccagagaccagctctatctgcacatcgggctcaaaccccgggtccgggatcactatcgagccaccaaggtggcgttctggaagcacctagttcctcatctttacaacttacatgacatgttccattacacctccacaacaacaaaagtcccacccccggacactacacactcatctcacataactcggcgtcctaacgggaaaacatggtcgactaagcgcccagccatctccccagcatatagtaatgaaaatgctcagggttcatggaacggggaccaggacgccggacctctgcttgtcgaaaaccccagggattattccacggagctaagcgtcaccatcgccgttggtgcctctttgctcttccttaacgtccttgctttcgccgccctctactaccggaaagacaagagaaggcaagaaccccttagacagccttctccgcagaggggagccggcgcgcccgagctgggcgccgctcccgaggaggagttagctgcacttcagcttgggcctacgcatcacgaatgtgaagcaggcccaccccacgacaccctacgcctcactgcgctgcctgattatactctcacccttagacgcagccccgacgatattccacttatgacaccaaatacgattaccatgatccccaattcattggtgggtttacagacgctccacccctataacacatttgctgcggggtttaacagcaccgggttacctcactcccactcgacgacacgagtgtag

SEQ ID NO: 197050 - DNA, 1056 bp, Artificial Sequence
  Description of Artificial Sequence: Synthetic coding sequence
atgctgcccgtgtggttcaccgccaacctggacatcgtggccacctatatccaggaaccgaacgaggactgtctgtatttaaacgtgtacgtgccgacagaggatggctccggagcgaagaaacagggggaggatctggccgataacgatggcgatgaagacgaggatatccgggattctggagccaagcccgtgatggtttacattcatggagggtcatacatggaaggcactgggaacatgatcgatgggtctattctcgccagctatggcaacgtgattgtgatcactctgaactatcgggttggtgtgctcggatttctctccaccggagatcaggccgccaaggggaactacgggttgctggatcaaatccaagcattgagatgggtaagcgagaacatcgcgttttttggcggagatcctcgacgaatcacagtcttcggttccggcataggggccagctgtgtgagtcttctgaccctcagccaccacagcgagggattatttcagagagccattatacagtccggtagcgcacttagctcctgggctgtgaactaccagcctgttaaatatacaagtttgctagccgacaaagtgggttgcaatgtgcttgacaccgtagacatggttgactgtctgcggcagaaatctgcgaaggagttagtcgagcaagacatacagcccgcccgttatcacgtagccttcggccccgtgatcgacggcgatgtgatacccgacgatccagagatcctgatggaacagggcgagttcctcaactatgatatcatgcttggcgtcaaccagggggagggactgaagtttgtggaaggagtggtggaccctgaggatggggtttcaggtaccgactttgattatagcgtgtctattctatggacgatttgtatggcaattttgagagtacgcactccatgcgagagaccttcctcaagctgtattcagacaggccagactgttaccaccctacgtcctgcagtgaagcactggtggcacagctcgcttacaaccagtggatggagcccacagtggtag

SEQ ID NO: 197051 - DNA, 771 bp, Artificial Sequence
  Description of Artificial Sequence: Synthetic coding sequence
atgctgcggccccagggcctgctgtggctgcccctgctgttcacctccgtgtgcgtgatgctgaatagtaacgtccttctgtggattactgctctggcaatcaagttcacactcatcgactcacaggctcaatatccggtggtgaatactaactacggcaagattcagggcttgaggaccccactgcccagcgagatcctgggcccagtggagcagtacctgggagtgccctatgcttcaccgcccaccggagaacgccgctttcagccgcccgagtccccttcctcgtggaccggaattcgcaatgccacgcagttcagtgctgtgtgtccacagcacctcgacgagaggttcctgctgcacgacatgctccccatttggtttaccacttcactcgacactctgatgacgtacgtccaagaccaaaatgaagactgcctgtatctgaatatatatgtccccatggaagatgggactaatatcaaacgaaatgcagatgatatcacgtctaacgaccacggggaagataaggacattcacgagcagaattccaaaaaacccgtgatggtatatattcacggggggtcttatatggaaggcacgggcaatatgatcgatggttccatccttgccagctacggtaatgtcattgtgatcacaatcaattatcggttaggcatcctggggatgcaggaggcacgcctgtgtgggagctccaaaatgttcaactattttaagtctccctttacaaacctgatcaacttcttttag

SEQ ID NO: 197052 - DNA, 2451 bp, Artificial Sequence
  Description of Artificial Sequence: Synthetic coding sequence
atgctgcggccccagggcctgctgtggctgcccctgctgttcaccagcgtgtgtgttatgcttaactctaatgttctgttatggatcactgcactcgccatcaagtttactttaatcgacagtcaagcccagtacccggtggttaacacgaactacggcaagatccaaggcctccgaacaccactcccgtctgaaatcctggggccggtggaacagtaccttggagtgccttacgcttccccaccaaccggagaaaggaggtttcagcctcccgaatcgccatctagctggactggcattagaaacgcaacccaattttcagctgtgtgtccacaacacctggacgaacggttcctgctgcacgatatgctgcctatctggtttaccacatcactcgacacattaatgacatacgtccaagatcagaacgaagactgcctgtatctgaatatctacgtcccgatggaggacgatatacatgagcagaacagcaaaaaacccgtgatggtgtatattcacggtgggagttacatggaaggtacaggcaacatgattgatggctcaatcttggccagttatgggaatgtcattgttataaccattaattatcgactgggaatattgggttttctttctaccggcgaccaagctgcaaaaggaaactacgggctgctcgaccagatccaggcattgcgctggattgaagaaaatgtaggggccttcggcggcgaccctaaacgcgttacaatcttcggaagtggcgccggcgccagttgtgtcagcctcctgactttgtcgcattatagcgaaggactcttccagaaggccattatccagagtggaactgcactctccagctgggccgtgaattaccaacccgccaagtataccagaatcctagctgacaaagtagggtgcaatatgctcgatacaacagacatggtggagtgcctcaaaaacaagaactataaggaacttattcagcaaacaatcacgccagcaacgtaccacattgcctttggacccgtgatcgatggtgatgttatcccagatgaccctcagattctcatggaacagggcgaattccttaactatgacattatgttgggagtcaaccaaggagagggtcttaagttcgttgatgggatcgtcgataatgaggacggggtgacccctaatgatttcgacttcagcgtgagcaattttgtggataatctgtacgggtatccagaaggcaaggacactctgcgggagaccattaagtttatgtacactgattgggccgacaaggagaaccctgagacacgtcggaagactctggttgccttgtttaccgaccatcaatgggtcgcacctgcggtggccaccgctgatttgcacgcccagtatggtagccctacctacttctatgctttctaccaccactgtcagtcagagatgaagccaagttgggctgattcagcgcatggcgatgaggtaccttatgtcttcggaattccaatgatcggccccaccgagttgtttagctgcaacttttccaaaaacgacgtgatgctgagcgccgtggtgatgacatattggaccaacttcgcgaaaaccggggatccaaatcagccggtacctcaggacaccaagtttatccacacgaagcctaacagatttgaagaggtcgcctggtcaaaatacaatcccaaagatcagctgtacctgcatattggcctgaaacctcgcgtacgcgatcactatagagctactaaggtagccttctggctggagctggtccctcatttacacaatcttaatgagattttccagtatgtgagcacaaccaccaaggtgcctcctccggatatgaccagtttcccttatggcactcgccggtctccagccaagatttggcccaccacaaagcggccagccataactccggctaataatccaaagcactccaaggacccacacaaaacaggccccgaagacaccacagttctcatcgaaaccaagagagactattcaaccgaactcagtgtgacaatcgccgtgggcgccagtctactgtttctgaacattttggcttttgctgccctttattataaaaaagataagcgacggcatgagactcacagacaccccagtccgcaacggaacacgactaatgacataacccacatccaaaacgaagagatcatgtcattacagatgaagcagctcgagcatgatcacgagtgtgagtctctgcaggctcatgacacgctccgcctcacctgtcctccggactacactctgactttacggaggagtccagacgatatccctttcatgaccccgaatactatcaccatgatccccaatacgctcatgggaatgcagcccctacacaccttcaaaaccttcagcggcggccagaattcaacaaacttgccacacgggcattcgactacccgcgtgtag

SEQ ID NO: 197053 - DNA, 2451 bp, Artificial Sequence
  Description of Artificial Sequence: Synthetic coding sequence
atgctgcggccccagggcctgctgtggctgcccctgctgttcacctccgtttgcgtcatgctgaatagtaatgtgctgctttggattaccgcgcttgcaataaaattcaccctgatcgattcgcaagcccaatatcctgtggtgaatacaaattacgggaagatacaggggcttagaactcctctaccctccgaaattctgggccctgttgaacagtaccttggggttccatatgcaagcccccctactggagaaagaagatttcaacccccagaaagtcctagtagctggactggcataagaaatgcaacccagtttagcgcagtgtgccctcaacacctggatgaacggtttctgcttcacgatatgttgccaatatggttcaccacttctcttgataccctaatgacctacgtgcaggaccagaatgaggattgcctttacctgaatatatacgtacccatggaagacgatatccacgaacagaatagtaagaaaccggtgatggtatacattcatggcggctcctacatggagggcacaggtaatatgattgatggcagcatcctggctagctatggcaatgtcatcgtgattactatcaattatcgcctgggtatcctggggttcctttctacgggagatcaagcagccaaagggaattatggactgcttgaccaaatccaggccctgagatggatcgaagagaacgtgggtgcatttgggggggatcctaaaagagtgactattttcggatccggagctggggcctcatgtgtttcgctgttgacgctgagtcactatagcgagggcctctttcagaaggcaataattcagtcgggtaccgccttgtcttcctgggctgtaaactatcaaccagccaaatatacaagaatcttagccgataaggttggttgtaatatgctcgacacaaccgatatggtggaatgcttaaagaataaaaactacaaggagctcatacagcaaacgatcacaccagctacctaccacattgcatttgggcccgtcatcgacggggatgttattccagacgacccgcagattctgatggaacagggggagtttctaaactatgacatcatgttgggagtgaaccagggtgaaggcctgaaattcgttgacggtatcgtggataatgaagacggagttactccaaatgacttcgatttttccgtctctaacttcgttgacaacctatatggctatccagagggcaaggacactctgagggagaccatcaagttcatgtatactgactgggccgacaaggaaaatcccgaaacccgaaggaagaccctcgttgctctgttcactgatcaccaatgggtcgcccctgctgtggccaccgctgacttgcacgcacagtacggcagtcctacctatttctatgcattctatcaccattgtcagtctgagatgaagccgtcttgggcagattcagcacacggagatgaggtgccatatgtcttcgggatccctatgataggaccaaccgaattattctcatgtaatttcagcaagaatgatgttatgctgtcagccgtggtcatgacgtactggacaaactttgccaagacaggagatcctaaccagcccgtgccacaagatacaaaattcatccatactaagcctaatcgctttgaggaggtggcctggagcaaatacaatcctaaggatcaactttatcttcacatcggactgaagcctcgggtgagggatcactatcgagctactaaggtggccttttggttggagctggtgccccatctccacaacttaaacgagattttccaatacgtctccactaccacaaaggtgcctccacctgacatgacctcgtttccatacgggacccgcaggtctcctgcgaaaatctggccaacaaccaaaagacctgctatcacgcctgcaaataaccctaagcactctaaggaccctcacaagaccggtccagaggacacgaccgtcttaatcgaaacgaagagagattattccacagagctgagtgttactattgcagtcggtgctagccttctcttcctgaatatactggcctttgccgcactgtactacaagaaagataaaaggcgtcacgaaactcatagacaccccagcccccaaaggaacaccactaacgatataactcatatccaaaatgaggagattatgagccttcagatgaaacagctagagcacgaccatgagtgtgaaagcttgcaggcgcacgatactcttagattaacctgccctcccgactatacccttacactgcggagatccccggatgatataccctttatgacaccgaacacaatcacaatgatccccaacaccctgatgggtatgcagcccctccacacatttaaaacgttttctgggggacaaaactctaccaacctcccacacggacattccacaacacgagtgtag

SEQ ID NO: 197054 - DNA, 2622 bp, Artificial Sequence
  Description of Artificial Sequence: Synthetic coding sequence
atgctgcggccccagggcctgctgtggctgcccctgctgttcacctctgtgtgcgtgatgctgaattcaaacgtgttgctgtggatcaccgccctggctatcaaattcacactgattgattcgcaggcccaatatccggtggtcaacaccaattacggcaagatacagggcctccgcacaccgcttcctagcgagatcctggggcccgtagagcagtacctgggtgtgccttatgcatctccacccaccggtgaaagaagatttcaaccacctgagagtcctagctcatggactgggataaggaacgcaacccaattttcagctgtttgtccacaacacctagatgaacgctttctactccacgacatgctaccaatctggttcaccacctcactggacaccctcatgacgtatgtgcaggaccagaatgaggactgcctgtatctgaacatctacgtccccatggaagacggcaccaacataaagcggaatgctgatgacatcacatccaacgatcacggtgaggacaaagatatccacgaacagaattccaaaaaacctgtaatggtgtacatccatgggggaagctatatggaaggaactggcaatatgattgacggcagtatcctggctagctacggcaacgtgatcgtgattacaattaattatcggttggggattttagcccagaatacattggcccacggaaactgtaagcatcggtgtcagcttcatctgcaggctccaagagattgcaaatcagcttatcccttcagaaacgaggacgaaattcgcggatttctttcaaccggtgatcaggccgctaaaggaaactacgggctgctggatcaaattcaggctctccgctggatcgaggagaacgtgggcgccttcggtggcgatcctaagcgggtgaccatctttggttccggcgctggggcctcctgtgtgtctctgcttactctatctcactattcagaggggctgtttcagaaagctatcattcagagtggaacggcattaagctcatgggcagttaactatcagcccgctaagtatacacgtatactggctgacaaggtgggttgcaacatgctggacaccactgacatggtagaatgccttaagaataagaactataaggaactcatccagcagaccatcacacctgctacataccacatcgcttttggcccagtcatcgatggggatgtaatcccggacgatccacagatattaatggaacagggcgagtttctgaattatgatataatgctcggagtgaaccaaggcgaaggtctgaagttcgtcgacgggattgtggataacgaagatggtgtcactcctaatgactttgacttctctgtctccaacttcgtagacaacctctacggctacccagaaggcaaagacactcttagagaaaccatcaaatttatgtacacagattgggcggataaggagaaccctgagactcgcaggaagacactggtcgcccttttcactgaccaccagtgggtggctcctgccgtggcaactgccgaccttcacgcccagtatggctcacccacgtatttttacgcattttaccaccactgtcaatcagagatgaaaccttcttgggctgatagcgcccacggcgatgaggtgccttatgtgttcggaatccccatgattggcccaacagagctgttcagctgcaacttttcaaaaaatgacgtcatgctttctgcagtcgtgatgacctactggactaactttgcaaaaaccggagatcctaaccagcccgtaccccaggacactaagtttatccacacgaaacccaaccggtttgaggaagtggcttggtccaaatataacccgaaagatcaactctatttacacatagggttgaaaccgagggtgagggatcattacagagccaccaaggtcgctttctggctagagctggtgccacacttacacaatctcaacgaaatttttcagtatgtgagcactaccactaaggtcccgccccctgacatgacttcatttccatacggtactagaaggagccccgctaagatctggcctacaaccaaaaggcccgcgattactcccgcaaataatcccaagcattccaaagacccgcacaaaaccggaccggaagacactacagtactgattgaaacaaaacgtgattactctactgaactatcagtaacaatagccgtgggcgcttcccttttgtttctaaacatcctggccttcgccgccttgtactataagaaagataaaagacgccacgagactcaccgccacccaagccctcaacggaataccacaaacgacatcacccatatacaaaacgaggaaattatgtctctgcaaatgaagcagttagaacacgaccatgaatgtgaaagtttgcaggctcacgatactctcaggctcacctgcccccctgattacacgctcacactgaggcgctcccccgatgacatacctttcatgacacctaacaccatcacgatgatacctaatacactgatgggaatgcagcctctgcacacttttaagacatttagcggcggtcaaaattccactaatctgcctcacgggcacagtacaacaagagtgtag

SEQ ID NO: 197055 - DNA, 1947 bp, Artificial Sequence
  Description of Artificial Sequence: Synthetic coding sequence
atggtgtacatccacggcggcagctacatggagggcaccggcaacatgatcgatggctcaattctcgcctcttacggcaacgtgatcgtaataacgattaactacaggctgggaattctggggttcttaagcaccggtgatcaggctgccaaaggaaattatgggcttttggaccagattcaggcgctccggtggattgaggaaaacgtgggcgccttcgggggcgatcccaaacgtgtaactatattcgggtcgggggccggtgctagctgtgtgtcactgttgactctgagtcactacagcgagggtttgtttcagaaggctataattcagtctggaacagcactcagtagctgggctgtcaattaccagcccgcaaaatacacccgcatcctcgctgacaaggtggggtgtaatatgctcgacacgactgacatggtggagtgcctgaaaaacaaaaattacaaagagcttatccagcaaactattactcctgccacgtaccatatcgcttttggcccagtgattgatggagacgtaatcccggatgacccacagatcttgatggagcagggcgaattcctgaactatgacattatgttaggtgtgaatcaaggtgaaggactcaaatttgttgacggaatcgtcgacaacgaggacggcgtcacgccgaatgatttcgacttcagcgtgtcaaacttcgtcgataatctgtacggctacccagagggaaaagacacactccgcgagaccatcaagttcatgtatacagactgggccgataaggagaatcctgagacgagaagaaaaaccctggttgcgctgtttaccgaccatcagtgggtggcacccgctgttgccaccgctgacctgcacgctcagtacggatctcccacctatttttatgcgttctatcaccactgtcaatcggagatgaagccttcctgggccgactcagcccacggggacgaggttccttacgtcttcggcatcccaatgataggcccgacagaactgttctcatgcaacttctccaagaacgacgtaatgctgtcagccgttgtaatgacatattggacaaatttcgctaagacaggggatcctaaccagccagtaccccaggacacgaaattcatccataccaaaccgaacagattcgaagaagttgcttggagcaagtataatccaaaggatcagctttacttgcacattgggctgaagcctagggtccgcgatcattacagggccactaaagtggctttttggttggaactggtgccccaccttcacaatctgaacgaaatcttccagtacgtgagcaccacgaccaaggtgcccccccctgacatgacaagctttccgtatggaacccgcaggagccccgctaagatctggccgactacaaagcgcccagcgatcaccccagctaacaacccgaaacacagcaaggatccacataagactggtccagaggacactacggttctcattgaaacaaagagggactacagcacagaactatccgtgacgatagcagtgggagcctctctgttatttctgaatatcctcgcgtttgctgctctgtattataagaaagacaagcggcgtcacgagacccaccgccaccctagtccccagagaaataccacaaatgacataactcatatccagaacgaggagattatgtctctccaaatgaagcagctggaacacgatcatgaatgtgagagtctacaagcacacgacacactccgactgacctgcccccccgactacacactcactctgcggcggagcccggacgatatcccctttatgacaccaaatactatcactatgatccccaacacgctgatgggaatgcagccactgcacacttttaagaccttctcaggtggtcagaatagcaccaatctgcctcatgggcatagtactaccagggtctag

SEQ ID NO: 197056 - DNA, 711 bp, Artificial Sequence
  Description of Artificial Sequence: Synthetic coding sequence
tgaaacagcaacgtgctgctgtggatcaccgccctggccatcaagttcaccctcattgatagccaggcccagtatccagttgtaaacaccaattacggcaaaatacagggtcttcggactcctctgccttctgaaattttaggccctgtggagcagtacttaggagtgccctacgcaagccccccaaccggcgaaaggagatttcagccccctgagtccccatccagttggacaggcatccgaaacgccactcagtttagtgcggtctgtccgcagcatctggatgagcgttttctgctgcatgatatgctccccatctggttcaccacgtctctggacaccctgatgacttatgtgcaagaccagaacgaagactgtctttacttgaacatctatgtgccaatggaggatggaacgaatattaaacgcaatgccgatgacatcacctccaacgatcacggggaagataaggatattcacgaacagaattctaagaagcccgtgatggtatatattcatggcggctcctacatggaaggaacaggcaacatgattgatgggagcattttagccagctacggcaatgtgatcgtgattacaataaattaccgcttaggcatattgggaatgcaggaagcccggctgtgcggatcttcaaagatgttcaactactttaagtctccattcacaaacctgattaactttttctag

SEQ ID NO: 197057 - DNA, 2511 bp, Artificial Sequence
  Description of Artificial Sequence: Synthetic coding sequence
atgctgcggccccagggcctgctgtggctgcccctgctgttcaccagtgtctgcgtgatgttgaattcgaacgtgctgctgtggataacagcccttgccattaaattcaccctgatcgattcccaggcccagtatcctgtcgttaacacaaattacgggaaaatccagggcctacgcacccctttgcccagtgagattttaggtcctgtcgagcagtacttgggcgtcccatatgcctcacccccgacgggcgagagacgcttccaaccccccgagtctccttcctcctggacaggtattcgtaacgccactcagtttagcgcagtctgtccacagcacttagatgagagattcctgttgcatgatatgctgcctatatggtttactacaagcctggacaccctgatgacgtatgtgcaggatcaaaatgaagactgcttatacctgaacatctatgtgcctatggaggatggtaccaacattaaaaggaatgccgatgatatcacctctaacgaccacggggaagacaaagacattcacgagcagaatagtaaaaagcccgtgatggtgtatatccacgggggttcatatatggaggggactggcaacatgatcgatggatccatcctggcatcatacgggaacgtgatcgtcatcaccatcaattatcgtctgggcattctgggtttcctttccaccggcgaccaggccgccaaaggaaattatggcctgctggatcagattcaagctctccgatggatcgaagaaaatgtgggggccttcggaggagatcctaagagggtgaccatttttggcagtggcgcgggcgccagttgtgtttcactgctgaccctgtcccactacagtgagggacttttccaaaaagccataatccagagcgggaccgcgctgagctcttgggccgtgaactaccagccagctaagtatacccggatccttgccgacaaggtggggtgcaacatgttggatacaaccgatatggtggagtgcctcaagaacaagaactacaaagagttgatccagcagaccattacacctgccacctaccacattgccttcggacccgtgattgacggcgatgtgatcccggacgacccgcaaatactcatggaacagggggagttcctcaattatgatatcatgctgggcgtcaaccaaggggagggactgaagttcgtcgatggcatagtggacaacgaggacggtgtcacacccaatgatttcgacttcagtgtgagtaactttgtggacaacctttacggatatccagaggggaaggacacactcagggagaccattaagtttatgtacacggattgggccgacaaggaaaatcccgaaacaaggcgcaaaacattggtcgctttatttacggatcaccagtgggtggcacctgctgtggccaccgccgacctgcatgcgcagtatggatctcctacctatttttacgcattctatcatcactgtcagagtgagatgaaaccctcctgggcagactcagcccacggagatgaggtaccatacgtttttggcatacccatgatcggtccaaccgaattgtttagctgcaacttttcaaagaacgatgtgatgctgagtgcagtcgtcatgacctactggacaaacttcgcaaaaactggagatcctaaccagcccgtcccacaggataccaaattcattcataccaaacccaataggtttgaagaagtggcttggagcaagtacaatcctaaagatcagctgtatttacacatcggtctgaaaccgcgagtaagagaccattatcgcgctaccaaggtggctttttggctggagttggtgccccatttacataacctgaacgagatatttcagtatgtgtcgacaacgactaaggtcccacctccagatatgacttcgttcccatacggtacgaggagatcccctgccaaaatctggccaacgacaaagcgtcccgccataacgccggccaacaatccaaaacactctaaagatccccataagactggccccgaagacacaactgttttgattgagacaaagcgcgactattccactgaactgagcgtgaccattgccgtgggtgcgtctctgttgttcctgaacatcctcgcattcgctgccctgtactacaagaaggacaagaggagacacgagacacatcggcaccctagcccacagagaaataccaccaatgatataacccatatacagaacgaggagataatgagcctgcagatgaaacaactggaacacgatcacgagtgcgaaagtctgcaggcccacgacacactccgtttgacttgccccccagactatacgctgacactgaggcgctcaccagatgatatcccattcatgaccccgaatacgatcacaatgatccccaacactttaatgggtatgcagccactgcacaccttcaaaaccttcagcggcggtcagaactcaacaaatctcccccatggccactccacgaccagggtttag

SEQ ID NO: 197058 - DNA, 1824 bp, Artificial Sequence
  Description of Artificial Sequence: Synthetic coding sequence
atgatcgcccggtgcctgctggccgtgcggagcctgcggcgggtgggtgggagtcggattctgctgcgaatgactctcgggcgagaggtaatgagcccactgcaggcgatgtcctcttacactgtcgccggccgcaacgtgctgcggtgggatctctcaccggagcagattaagacacggaccgaggagcttattgtccagaccaagcaagtgtatgatgctgtcggcatgttgggaattgaggaagtaacctatgagaactgcctgcaagctctcgctgacgtcgaggtgaaatatattgtggagcggacaatgttagactttccacagcacgtctcctcggacaaagaggtaagagccgcctccaccgaggccgacaagaggcttagtagattcgacatcgaaatgagcatgaggggagacatatttgaacggatagtacatttgcaggaaacgtgcgacctgggtaagataaagcccgaggccagacggtacctcgaaaagagcattaagatgggtaagcggaacggactccatctacccgagcaggtgcagaacgaaatcaaaagtatgaagaaacgaatgagtgagctttgcatagactttaacaagaatctgaatgaggacgacaccttcctcgtttttagtaaggctgaattgggagcattgcccgatgactttatcgattctctggaaaaaaccgatgacgacaagtacaagatcaccctcaagtaccctcattactttcctgtgatgaagaaatgttgtattccagaaacccggagacgtatggagatggccttcaatacacggtgtaaagaggagaatacaatcatcttgcagcagttgctcccactgagaacaaaggttgcaaagttgcttggatattcaacccatgctgattttgtcctggagatgaataccgctaagagcacctccagagtaactgccttcctcgacgacctttcacaaaagctgaaaccactcggagaggcagagcgggagttcattttgaacctgaagaaaaaagagtgtaaggatagaggatttgaatatgacggaaagatcaacgcctgggatctctattactacatgacccagactgaggagttgaaatattctattgatcaagaattcctgaaggaatacttccctatagaggtcgtgaccgaggggctactcaacacctatcaggagctactaggtctgtcgtttgaacagatgactgatgctcacgtctggaacaaatccgttacactctatactgtaaaggacaaagccaccggagaggtgctggggcagttctatctggacctttatccccgagaggggaagtacaatcatgccgcatgtttcggtctccagcctgggtgcctccttccagacggatcacgcatgatggccgtggcagccctggtcgtgaactttagccagcctgtggcagggcggccgtcgttactccggcatgacgaagtgcgcacctattttcatgagtttgggcatgtgatgcaccagatttgtgcccagaccgacttcgcccggtttagcgggaccaacgtcgaaacggactttgtggaggtcccctctcagatgttagaaaattgggtgtgggacgtagactctctccgaagactgtctaagcactataaagatggatcccctatcgctgacgatctcctcgagaagctcgtggcatcaagattagtgaataccggcttgctgacactcagacaaattgtcctctccaaggtggatcagtcccttcacactaacacaagtctggacgctgcttctaatatgccaaacactgcacagaaatactag

SEQ ID NO: 197059 - DNA, 2115 bp, Artificial Sequence
  Description of Artificial Sequence: Synthetic coding sequence
atgatcgcccggtgcctgctggccgtgcggagcctgcggcgggtgggcggttcccgcattctcctgcgcatgacactgggcagagaagtgatgtccccactgcaagcgatgagcagctatacggtggccggccggaacgtgctccgctgggacttatcaccggaacagattaagacaaggacagaggagctgatcgtgcagacaaagcaggtgtacgacgcggtaggaatgttaggtattgaagaggttacatacgagaattgcttacaggcacttgcagatgtggaggtgaaatacatcgtagagaggacaatgctagatttcccacaacatgtgagttccgacaaagaagtgcgcgcagctagcaccgaggctgacaagcggctgtccagatttgacatcgaaatgagtatgcgaggcgacatatttgaacggatcgtacatcttcaggaaacatgtgaccttggcaaaataaaacccgaggctcggaggtacttagaaaaatccatcaaaatgggaaagagaaatggattacatctccctgaacaggtacagaacgaaatcaagagcatgaagaagcggatgagcgagctgtgcattgactttaacaaaaatttaaatgaggacgatacatttctggttttcagcaaagctgaactgggtgctctgcctgatgacttcattgacagcttggagaaaaccgacgacgataagtacaaaatcactctcaaatatccccactattttccagtgatgaagaagtgctgcataccagaaactaggcggaggatggaaatggcttttaacactcgctgcaaagaggagaacaccatcatcctacaacagctgttgccacttaggaccaaagtggctaagttgctgggatacagtacccacgcagactttgtgctggaaatgaatactgcaaagtccacttccagagtgaccgccttcctggatgacttgagtcagaaactaaagccattgggcgaagccgagcgggaattcatcctcaatttaaaaaaaaaggaatgcaaggacagggggtttgagtatgacggtaaaattaatgcctgggacctgtactattacatgactcagaccgaggagctcaagtactcaatcgatcaggagttcctcaaggaatacttcccaatcgaagttgtaacggaagggctgctaaacacataccaagagctgctgggcctgtcgtttgaacagatgacggatgcccacgtatggaacaagtctgtcactttgtatactgtaaaggacaaggcaactggcgaagtcctaggacaattttatctggacttgtatcccagggaaggtaagtacaatcatgctgcatgcttcggtctccagccaggatgcctgttgccagacggcagtcgtatgatggcggtcgccgcattagtggtgaacttttcccagccggtggcagggaggccctccttgctgagacatgatgaggtgaggacctacttccatgaatttggccatgttatgcaccagatttgcgcccagaccgacttcgcaaggttctctggtacaaatgttgaaaccgacttcgtggaagtcccatcacagatgctggagaactgggtatgggacgtggacagcctgcgcagactctcgaaacactacaaggatggatcacccatagcagatgacctgcttgagaagctggtggctagtaggctcgtgaatacaggcctcctaactctgcgtcagatagtcctgtccaaagtagatcaatctctccatacaaatacctcactcgacgcagcgagcgaatacgctaagtattgcagtgaaatccttggcgtggcggctacacctgggaccaatatgcctgcgaccttcggtcacctggccggtggctatgatggacagtactacggctacctgtggagcgaggtctttagtatggacatgttctatagctgtttcaaaaaggaagggattatgaaccccgaggttggcatgaagtaccggaacctcatcctaaagccaggtggcagtttggatggcatggacatgctgcataatttcctgaagcgagagcccaaccagaaggccttcctgatgtcaagaggcctgcatgctccatag

SEQ ID NO: 197060 - DNA, 1803 bp, Artificial Sequence
  Description of Artificial Sequence: Synthetic coding sequence
atgctggacttcccccagcacgtgagcagcgacaaggaggtgcgggccgcctccacagaagcggacaagagactctcgaggttcgacatcgaaatgagcatgcgcggagacatttttgaacgtatcgttcacttgcaggagacttgcgatctaggcaaaatcaaaccagaggctcggaggtacctcgagaagtcaattaagatggggaagcgtaacggcctgcatctgcccgagcaagttcagaacgaaatcaagtccatgaaaaaacgcatgtcagaactatgtatcgatttcaataagaacctcaacgaggacgacacatttctggtctttagtaaagccgagctgggagccttaccagacgacttcatcgacagtctggagaagacagatgatgacaagtataaaattacacttaaataccctcattacttccccgtgatgaaaaagtgctgtattcccgaaacacgacggcgcatggaaatggctttcaacacaaggtgcaaggaagaaaatactataattttacagcagcttctgccccttcgcactaaggtggctaaactccttggctattcaacacacgccgacttcgttcttgaaatgaatactgccaagagcacttctcgagtgactgctttccttgacgacttgtcacagaagctgaaacccctgggagaggctgagagagagtttattctgaatctgaaaaaaaaagagtgtaaagatagaggatttgagtacgatggcaaaatcaacgcctgggatctttattattatatgacccagacagaggagctcaagtactctatcgatcaagaatttctaaaagaatatttccccattgaggttgtcaccgaagggctgttaaacacatatcaggagttgctaggactgtcatttgagcagatgacggatgctcatgtgtggaataagagtgtgacgctctataccgtgaaggacaaggccacaggggaggtcctcggccagttttatctggacctgtacccaagggagggaaagtataatcacgctgcgtgtttcggtctgcagcctggatgtttgttgcccgatggttcacgcatgatggcagtggcggcactcgtagtcaattttagccaaccggtggccgggcgtccgagtctccttcgccatgatgaagtaagaacctatttccatgagttcggacatgtgatgcatcaaatctgtgcccagacggacttcgcaaggttctcaggcacaaatgtggaaactgatttcgtagaagtgcctagccaaatgctggagaattgggtttgggatgtcgattcactcagaaggctaagcaaacactataaagatggatctccaattgctgatgatctcctggaaaaactcgttgcttcaagactagtgaacactggtttgcttaccctgagacagatcgtattatccaaagttgatcagtccctccatactaacaccagcttggacgcagccagtgagtacgcgaagtattgctccgaaatcctcggggtggcagccacacccggcaccaacatgccagcaacattcggtcatctcgccggcgggtatgatggccagtactatggatacctgtggagcgaggttttcagtatggacatgttttattcctgttttaaaaaggaaggtatcatgaaccctgaagtgggtatgaagtacaggaacctaatcctgaaaccgggcggaagtctggatggcatggatatgctccacaactttctgaagcgggaaccaaaccagaaggcgttcctcatgtccaggggcctccatgccccatag

SEQ ID NO: 197061 - DNA, 366 bp, Artificial Sequence
  Description of Artificial Sequence: Synthetic coding sequence
atggcccggcgggccggcggcgcccggatgttcggcagcctgctgctgttcgctctcctcgctgccggagtggcaccactgagctgggacctccctgaaccccgaagccgcgcatccaaaatccgcgttcactccagaggcaatctctgggctactggacactttatgggcaaaaaatctctggagccaagttctccgtcccccctcggcacagccccacacacgagcctccgcgaccagcggttacagctctcccatgacctgctaggcatactgctgttgaagaaggctctgggcgtttctctctctagacccgccccccagatccagtatcgccgcttactggttcagattctgcagaagtag

SEQ ID NO: 197062 - DNA, 465 bp, Artificial Sequence
  Description of Artificial Sequence: Synthetic coding sequence
atggcccggcgggccggcggcgcccggatgttcggcagcctgctgctgtttgctctccttgcggccggtgtggccccactgtcatgggatctgcccgaacctcgtagtcgtgccagtaagattcgcgtccacagccgcggaaacctctgggccacgggccactttatgggtaagaagagtctggaaccttcttcacctagccccctcggcactgcaccccatacgtcgctgcgggatcagcgattgcagctgtcgcatgacttgctggggatcctacttctgaagaaagccctcggcgtatccctgtctcggcctgccccccaaatccaggaggccgccggaacgaatactgccgaaatgactccgatcatgggccagacccagcaaaggggcctggattgtgcacacccaggaaaagttctcaacggcactctgctgatggcacctagcggatgcaagagctag

SEQ ID NO: 197063 - DNA, 1173 bp, Artificial Sequence
  Description of Artificial Sequence: Synthetic coding sequence
atgcccagcaagagcctgagcaacctgagcgtgaccaccggcgccaatgagagtgggagcgttcccgaaggatgggagcgggattttctgccagccagcgatggaactaccactgagctcgtgatcaggtgcgtgataccgtccctatatctattgataatcacagtaggactgttggggaatatcatgctcgtaaaaatctttatcaccaactcagcgatgagaagcgttcccaacatatttatcagtaatttggctgctggagatctcctcctcctcctgacgtgtgtccccgtggatgcctccagatactttttcgatgagtggatgttcggcaaggtcggctgtaaactgataccggtgatccagctgacctctgtcggagtgtccgtcttcaccctgaccgcactctctgctgaccggtaccgcgcaatcgtaaatccgatggacatgcaaacttcaggagcactgctgagaacatgtgttaaggcaatgggcatctgggttgtgagcgtgctgctggccgttccggaagccgtgttcagcgaggtggcccggatcagtagtctggataattctagcttcacagcttgcatcccatacccccaaaccgacgagcttcatcctaagatacactctgtgttgatatttctggtgtatttccttatcccgttggccattatctccatatattactaccacatagcaaaaaccctgatcaaatccgcgcataatctgccaggcgagtacaacgagcacactaaaaaacaaatggagacgcgcaaaagactggcaaaaatcgtgctagtttttgttggatgtttcatcttctgctggttccccaaccatatcttgtatatgtaccgcagctttaactacaacgagattgacccctccctagggcacatgatagtgaccctcgtggcgagagtgctcagcttcggaaattcttgtgttaacccctttgccttgtacctgctgagtgaatccttcaggaggcacttcaatagccagctgtgttgcggtcgcaaaagctaccaagagagaggcacctcatatctactgagcagcagcgccgtgaggatgacaagtctgaaatccaacgccaagaacatggtgaccaattcagtacttctcaacggacactccatgaagcaagagatggctctgtag

SEQ ID NO: 197064 - DNA, 1281 bp, Artificial Sequence
  Description of Artificial Sequence: Synthetic coding sequence
atgacccccctgtgcctgaactgcagcgtgctgcccggcgacctgtacccagggggggctaggaaccccatggcctgtaacggctcagctgcacgagggcattttgaccctgaggatctgaatctcactgacgaagccctgaggttgaaatacctgggtccacagcagacagaactgtttatgccgatttgcgccacctacttgctaatttttgtggtgggggccgtaggaaacggattaacatgcctagtgatcctgagacataaagccatgagaacacctacaaattactacttgttttctctcgccgtgagcgaccttctcgtcctgctggtggggttgcccctcgagctgtatgagatgtggcacaactacccatttcttttgggcgtgggcggctgttactttcgaactctcctgttcgagatggtctgtttagccagtgttttgaatgttacagccctatctgtggaaagatacgtggctgtcgttcatcccctccaggcaaggtctatggtgacccgggcccacgtacgtcgagtgttaggcgcagtctggggactggctatgttatgcagcctgcccaacacaagtctgcacgggattcgtcagctgcatgtcccatgccgggggccagtgcctgactccgcagtatgtatgctggtgagaccacgagctctttacaacatggttgtgcagaccacagcgttgctcttcttctgcctgcccatggcgatcatgtctgtgctctatctgcttataggcctgagactgcgtagggagcgtctgctccttatgcaggaagctaaaggaagaggcagcgctgcggcacgaagcagatacacatgtcggcttcaacagcacgatcgggggcggaggcaggtcaccaaaatgctgttcgtcctggtcgtggtctttgggatctgctgggctccttttcacgctgatagggttatgtggtccgtggtcagtcaatggaccgatggactgcacctggcttttcagcacgtgcacgttatctcagggattttcttttatctggggtccgccgcgaaccctgttctgtacagtctcatgagctctagattcagggaaaccttccaggaagctctgtgcttaggcgcatgttgtcaccgtttgcgacctcgtcatagcagccactcactgtcaagaatgactacgggaagcactttgtgcgatgtgggaagcttagggtcttgggtgcaccctctggcgggtaacgacggacctgaagctcaacaggagacagacccatcctag

SEQ ID NO: 197065 - DNA, 1248 bp, Artificial Sequence
  Description of Artificial Sequence: Synthetic coding sequence
atgagcggcatggagaagctgcagaacgccagctggatctaccagcaaaaattagaagatcccttccagaaacatttgaattctactgaggaatacctggcctttctgtgtggaccacgacggagtcatttcttcctcccggtttccgtcgtctacgtgccaatcttcgttgtgggtgtgataggcaatgttctggtatgtctcgtaatcctgcagcatcaagcaatgaagacccctacgaattactaccttttcagcttagcagtctcagatttacttgtattgctcttgggcatgcctctggaagtttatgaaatgtggagaaactatccattcttgtttggcccagttggttgctacttcaaaacagccctgttcgaaacagtatgctttgctagcatcctgtctatcaccactgttagcgtcgaaaggtatgtggcaattttgcatccttttcgggccaagctgcaatccacaagacgtcgagcgctaagaatcctgggtatcgtatggggcttttctgtgttgtttagcttgcctaataccagcatacacggcattaaattccactactttcctaatggctccctcgtgcccggctcagcaacctgcacagttatcaagcctatgtggatctataacttcattattcaggtgacgagctttcttttttaccttctgcccatgacagtgatttctgtgctctactatctgatggccctacgcctgaaaaaggataaatccctcgaagcagacgaggggaacgccaatatccaacggccctgcaggaaatcagtcaacaagatgctttttgtcttagtattagtatttgccatctgttgggcaccattccacatcgacaggctgtttttttctttcgtggaagagtggtctgagagcctggccgctgtgtttaatctggtgcacgtagtttccggcgttttcttttacctttcttccgcagtgaatcccatcatttataacctcctgagtcgcagattccaggctgccttccagaacgtcatctcaagttttcataaacaatggcatagtcagcacgatcctcagctgcctcccgcacagaggaacatctttcttacagagtgtcactttgtcgaactaacagaggatattggaccgcagttcccatgccagagttctatgcataattcacatttgccagcagctttgtcatcagagcagatgtcccggaccaactaccagtctttccactttaataagacatag

SEQ ID NO: 197066 - DNA, 5625 bp, Artificial Sequence
  Description of Artificial Sequence: Synthetic coding sequence
atgctgggcagcagcgtgaagagcgtgcagcccgaggtggagctgagcagcgggggaggtgatgaaggcgcagatgaaccccgcggcgccggacgaaaggctgcagccgcagacggacgcggcatgctgccaaagcgtgctaaagcgccgggcggcggcggtgggatggcaaaagcatctgctgccgagctgaaagtgtttaagagcggttccgttgattcgagagtgcccggaggaccacccgcctccaatctccgcaagcagaagtccttgactaatttatcttttctgacagattccgagaagaaactccagctgtatgagccagaatggtcagacgacatggccaaagcacccaagggacttgggaaggttggttctaaggggcgggaggcccccctcatgtccaagactctttccaaaagtgagcactctcttttccaggccaagggttccccggccggaggcgccaagacaccgcttgcccctctggctccaaacttgggcaagccatctcgtattcctcgggggccttacgccgaagtcaaaccattgtcgaaagcccctgaggccgctgtgtccgaagacggcaagtctgacgatgagttactgtccagcaaggcaaaggctcagaaatcctctgggccagttcctagcgccaaagggcaggaagaaagagcgttcttgaaagtggacccggagctggtggtaacagttctgggagacctcgaacaacttttatttagtcagatgttggaccccgaaagccagcgtaaaagaaccgtgcagaatgtactggatctgagacagaatctcgaagaaaccatgagttctctccgtgggtcacaggtgactcatagctccctcgagatgacttgctacgattcagatgacgccaatccccgctcagtatcatcccttagtaacagaagctccccactctcgtggaggtatggccagtcttctccaagactacaggcaggagatgctccgtccgtggggggttcatgtcgctcggaaggcacgccagcctggtacatgcatggtgagcgtgcccattacagccatactatgccgatgaggtcccctagcaagctgtcccacatctctcgactggagctggtggagagtctggatagcgatgaagtcgacttgaaatccggctatatgagtgactccgacctgatgggaaaaacaatgactgaagacgacgatatcacaacaggttgggacgagtcaagctccatttcgagtggtctgtctgatgcctccgataacctttcctccgaggaattcaatgccagcagcagccttaacagcctcccctccaccccgacagcctctcggcggaatagcacaattgtcctacgcaccgattctgaaaaaaggagtttagccgagagcggtctgtcatggttcagcgagagcgaggaaaaagctcccaagaagctggaatatgacagcggttccctgaaaatggaacccggcacaagcaaatggagaagggaaagaccggagagctgcgacgattcttccaaagggggtgagctcaagaaacccatctcacttggacatccaggatcgcttaagaaaggcaagacaccaccggtcgctgtgacctcccctattactcacaccgctcagtctgcattaaaggttgcaggaaagccagagggaaaggccaccgacaagggtaaactggcagtaaaaaacaccggactgcagcggagcagcagcgacgccgggagagaccgcctttccgacgcaaaaaaaccaccgagcggcattgcaagacccagtacttccggctcctttggttacaagaagcctccaccggccaccggtacagccaccgtgatgcaaaccggaggcagcgctacactttcgaaaatccagaagtcatctggcatccctgtgaagcccgttaatggacgtaaaacttccctagatgtgagcaactcagcggaaccggggtttctcgcccccggagctagatctaacatacaatacagatctctcccaaggccagctaagagcagctcgatgtcagtgacaggtgggagaggcggcccaagaccagtttctagcagtatcgacccatctctattatccaccaagcagggggggcttacaccctcccgcttgaaagagcccacaaaagtggcctcaggaagaacaacgccggcccccgttaaccagactgatcgcgagaaggaaaaggcgaaagcaaaggctgtggcactggactctgacaatatctccctgaagtccatcgggagccccgagtccaccccgaaaaaccaagcctctcaccccaccgccacaaagctggccgagctgcctccgaccccgctgcgcgcaacagctaagagcttcgtgaagcccccctcgctcgcaaacctagacaaggtcaactcaaacagtctcgatctcccttcctcctccgataccacacacgcctcgaaagtccccgatcttcatgccactagctccgcaagcggtggtccactgccaagctgcttcacacctagcccagctcctatcctgaatatcaactccgcctcctttagccaagggctggaactcatgtcaggattcagcgtgcccaaagagactcgcatgtacccgaagctctcaggcctccaccggtcaatggagagcctgcagatgccaatgagtttaccgtccgcatttccctctagcacaccagtgccaacccctcccgcaccaccagccgcccctacggaggaggagaccgaggaactaacctggtcgggcagtccaagggccggacagctggatagcaatcagcgggacaggaacaccttgcctaagaagggcctgcggtatcaattacaaagccaagaggaaaccaaagaaagacgccattcccacactatcgggggactccctgaaagcgatgaccaatccgagctccctagtccccctgcgcttccgatgtcactgagtgctaaggggcagctcacgaacatcgtctcaccaaccgccgctacaacccctagaataaccagatctaacagcatccccactcacgaagccgcctttgagctctactcaggctcacagatgggctccacactctctcttgctgaacggccaaaggggatgatcagatccggctcctttagagatcccaccgacgatgtgcacggctccgttctgtctttggcgagtagtgcttccagcacttacagctccgccgaggagaggatgcaatcggagcaaatccggaagctgaggcgagagctggagtcatcacaggaaaaggttgccacattaacctctcagctgagcgctaacgcaaacctggtggcagccttcgagcaatccctggttaatatgacaagtagactcagacatctggcagagaccgccgaggaaaaggacaccgagctgctggatctgcgtgaaacaattgattttctgaagaagaaaaacagcgaagctcaggcggtcatccagggcgctctgaacgcctccgaaacaacacccaaggagcttaggataaaacgccagaacagctcggactccattagttctctgaactcaattactagccattcctcgattggatcatcaaaagacgctgatgcgaaaaagaagaagaagaaatcatggctgcggtccagttttaacaaagcattctctattaagaaaggacccaaatcagcctcctcctattccgacatagaggagatcgccacacccgatagctccgccccgtcttcccctaaactgcagcatggttcaaccgagacagcctccccatccatcaagtcaagtactagctcgtcagtgggtactgatgtgactgaaggtcctgcacatcctgcaccacataccaggctgtttcatgcaaatgaggaagaggagcctgaaaagaaggaggtgtcagagcttcgatccgagctgtgggaaaaggaaatgaagctcaccgatataaggctggaagcccttaattcagcccaccagctggatcagcttcgcgagactatgcataacatgcaactggaagtcgatttacttaaggctgagaacgatcggctgaaggtcgccccagggccgagctctggttccactcccggccaggtgccaggatcatcggcactctcctcgcccagaagatctctggggctggccctcacccactcttttgggccgtctctggcagataccgatttgtcccccatggacggtatctccacctgtggacctaaagaagaggtaacactgcgcgtggtagtcaggatgcctccacagcacattatcaagggtgatctgaaacagcaggaattctttcttggctgcagcaaggtctcaggtaaggttgactggaaaatgctcgatgaggctgtcttccaggtattcaaggactacatttcgaagatggatcctgcttcaaccctcgggctgtcaactgaaagtatccacggctattccattagtcacgttaagcgcgttctggacgccgagccacccgagatgcccccatgtagaaggggcgtcaataatatttctgtgtcgctgaaggggcttaaggaaaagtgcgtagacagccttgtcttcgaaacccttatccccaagcccatgatgcagcactatattagtctgcttctcaagcatagaagacttgtcctctctggaccttctggcacaggtaagacttacctgacaaatcggctcgccgaatatttggtggaacggtcaggccgcgaggtgactgagggtatcgtttccacttttaacatgcatcaacagtcatgtaaggacctacagctgtacctgtccaatctggccaatcagatcgatcgtgaaacggggatcggtgatgtccctctggtgatcttacttgatgatctgagtgaggcaggtagcatcagcgaactggtgaatggtgctttaacctgtaagtatcacaagtgcccttacattatcgggacaacaaaccaaccggttaagatgacacccaaccacggactgcacttatcattccggatgctcaccttctccaataatgtggaacccgctaatggcttcctcgtgagatacctccggcggaagctagtggagtccgattctgatatcaatgccaataaagaggaattgttacgggtgctggattgggtgcctaagttatggtaccatctgcacacgtttctcgagaagcacagtacctctgactttttgattgggccatgctttttcttgagttgcccaatcggcatcgaggacttccggacatggttcattgacctgtggaacaactcaataatcccttatctccaggaaggagccaaagatggaatcaaagttcacggccagaaggccgcctgggaagaccctgtggagtgggtaagagatactttaccgtggccaagtgcacagcaagatcagtcaaaattgtaccacttgcctccaccaactgtgggtccccatagcattgccagcccacccgaggacaggacagtgaaagacagtactccatcatcactggattctgacccactgatggctatgctgttaaagttgcaggaggctgctaactacattgagtcccccgacagagagacgatcttggacccaaacctgcaggcaactttatag

SEQ ID NO: 197067 - DNA, 5634 bp, Artificial Sequence
  Description of Artificial Sequence: Synthetic coding sequence
atgctgggcagcagcgtgaagagcgtgcagcccgaggtggagctgtctagcggcggcggagacgaaggagccgatgaaccgcgcggtgcggggcgcaaggctgccgcagcagatggacgtggaatgctcccaaagcgcgcaaaagcgcctggaggaggcggcggaatggctaaagcgtctgctgcagaactaaaggttttcaaaagcggcagtgtggactctagagtacctggggggcctcctgctagcaatctgagaaaacaaaaatctctcactaatctgtcgtttttgacagattctgagaaaaagttacaactgtatgagcccgagtggtcggacgatatggccaaggcgccgaaaggactcgggaaagtcggaagcaagggccgcgaggccccgctcatgagtaagacgctctcaaaatctgagcacagtctgttccaggcgaaagggtctcccgctggtggggccaaaacacccctggcccccctagctcctaaccttggtaaaccgagccgcatccctagagggccttatgctgaagtgaaaccactgtccaaggcccccgaggctgccgtttcagaggatggcaaaagcgatgatgagctcctgagcagtaaggcgaaagcacagaaaagctccgggcccgttccctccgccaaggggcaagaggagcgtgccttcttgaaagtggatccggagctggttgtgactgtgctgggtgacctggaacagctgctcttcagccagatgttagaccctgagtcccaacgcaagaggaccgttcagaacgtattagacctaagacagaatctggaggagacaatgtcctccctgaggggatcccaggtaacgcactcttcattggaaatgacctgctacgattctgacgatgccaacccgcggtctgtcagctctctgtccaacagatcctctcctctcagttggagatatggacagtcaagccctaggctccaggctggtgatgccccttccgtcggtggctcatgcaggagcgaggggacgccagcctggtatatgcacggggagcgggctcattactctcatacaatgccgatgcgctctccgtccaagctatcccatatctccagattggaactggtcgagtctctagattccgatgaagtggatctgaagtcggggtatatgagcgattctgatctgatgggcaaaaccatgaccgaggacgatgacatcactaccggttgggacgaatcttcttctataagctctggcctgtccgatgctagtgacaacttgtcaagcgaagaatttaacgcaagttcaagcctaaacagtcttccaagcactcccacagcttcccgacgcaatagcacaatcgtgcttcggactgacagcgagaagaggtcactggcagaatccgggcttagttggtttagcgaatcagaagagaaggcccccaagaagctggaatatgacagcggctccttaaagatggagcccggcacttcaaagtggaggcgggagcggcctgagtcatgtgatgactcctctaaaggcggcgaacttaaaaaaccaatctctttaggacatcctggtagccttaagaagggcaagacaccccctgtggccgtgacttcacctatcacccataccgcccaatccgctctgaaggtggccggaaaacccgaaggaaaagccaccgataaaggtaagttggccgtcaagaacacaggtttacaaagatcctcctcagacgcgggtcgcgatcggttatctgacgctaaaaagccgccaagcggcattgcccggccttctaccagcggctcttttgggtacaagaaaccacccccggcaaccgggacggcaactgttatgcagaccgggggcagcgccaccctctctaagatccagaaatcttccggaattcccgtcaaacccgtgaatggccgcaagacgagcctcgacgtgtcaaattccgctgagccaggctttctggccccaggtgcaaggagcaatatccagtatagaagcctgccacgtccggctaaatctagcagcatgtcagttacgggtggccgaggaggacctaggcctgtgtctagctccattgacccatctctgctctcaaccaaacagggtggcctcacccctagtcgtttgaaggagccaacaaaagttgcctccggcaggaccaccccagcacctgtaaatcagacagaccgggagaaggaaaaagcgaaggctaaggctgtggccctcgacagtgataatatctctcttaaatctatagggagtccggagagcacgccgaaaaatcaggcatcacaccccaccgccacaaagcttgctgagcttcctcctactcccttaagagccacagccaaatcttttgtgaagcccccttctttggccaatctggataaggtgaattcaaattccctggacctcccctcttcttctgataccacccatgccagcaaagtgccagacctacacgccacgtctagcgcatcaggggggcccctgccaagctgttttacccctagcccagctccgatccttaacataaattccgccagcttcagtcagggccttgagctgatgtctggtttttctgtgccaaaggaaacacgcatgtatcccaaactgtccgggctgcaccgatcaatggaatcactccagatgcccatgtctcttccaagtgcatttccatccagtactccagtgcctacaccacctgcaccccccgcggctcctaccgaggaggagactgaggagctcacttggtcgggaagcccgagggccggccaacttgactccaaccagagggacaggaatactctccccaaaaaaggccttcggtatcagctgcagtcccaggaggagacaaaggaacggagacattctcataccattggaggactgcctgaaagtgacgatcagtcggagttaccatcgccacccgccctgcccatgagtttgtcagccaagggacagctgacgaatatcgtctcacctacagctgccacaactccgcgcatcacccggagcaatagtatccccacccacgaagccgcgttcgaactgtactcgggctcccaaatgggctccaccctgtccctggctgaaaggccgaaaggtatgatccgcagcgggagttttcgggaccctacggatgacgttcacggatccgtgctgtcactagcgagttcagcaagctccacatatagctctgcagaagaacgtatgcagtccgagcaaatcagaaaattaagacgggagctggagagttcccaagagaaggtggcaacactcacgtcccagctgtccgcaaatgccaacctggtggctgctttcgaacagtctctggtgaacatgacctcccgactacgccacctggcagagaccgccgaggaaaaagataccgaactgctggacctgcgcgagaccattgactttctgaaaaagaaaaactccgaggcccaggctgtgatccagggagctttgaacgcctcggagacgacaccaaaggagctgcgcataaagcgccaaaactcctcagattctatctctagcttgaattccattacgtcccatagctcaatcggatccagcaaggatgccgacgctaaaaagaaaaagaagaagtcatgggtgtatgaactgcgttcttctttcaacaaggcatttagtattaagaaaggaccaaagtctgcttctagctactcggacattgaagagatcgccacccctgattctagcgcacccagttcacctaagttgcagcacggcagcaccgaaacagcgtccccaagtatcaaatcgagcacctcttctagtgtgggcaccgatgtaacagaaggaccagctcaccccgccccgcacactaggctgtttcatgcaaacgaggaagaagaacccgagaagaaagaagtttccgagctgagaagcgagctgtgggagaaagaaatgaagcttaccgacatcagattagaagccctgaatagtgcccaccaactagatcagttgcgtgaaacaatgcacaacatgcaactggaggtagatctcctcaaagccgagaacgataggctgaaggtggcacctgggccgtctagtggcagtacgcctggtcaggtgccgggatctagcgctctgtctagcccacgcaggagcctcggccttgctctcacacactcttttggcccttcactggccgacaccgacctgtcaccaatggacgggatctccacatgcgggccaaaggaggaggtcaccctgagagtggttgtgcggatgccaccccagcatatcattaagggcgatcttaaacaacaggagtttttcctgggatgcagtaaagtctcagggaaagtcgattggaagatgcttgatgaggcagtgttccaggtattcaaggactacatctctaagatggacccagccagtaccctaggactgagcaccgagtccattcacggatacagcataagccatgtgaagcgggtcctggatgcagagccccccgaaatgccgccctgtaggcgaggagtcaataacataagtgtctcgttgaagggcctaaaggagaagtgtgtcgactctctcgtgtttgagacactcattcctaaacccatgatgcagcactacatcagcctgcttctgaagcatcgccggctggtactctctgggccatcaggcacaggcaagacttacctgactaaccggctcgccgagtacctcgtggaaagatccggcagggaagtgaccgaggggatcgtgagtacgttcaacatgcatcaacagagctgcaaggatctccagctgtacctgagtaatctcgctaatcagattgatagggagactggaataggggatgtcccgttggtgatccttctggacgacctctctgaagccggttccatctctgagctcgtgaacggggctctgacctgtaaatatcataagtgcccttatattatcggcaccacaaaccagcccgttaagatgacccctaaccacgggctgcatcttagcttccgtatgctgactttttctaacaacgttgagccagcgaacggattcttagtgcgatatctgaggagaaagctcgtggagagtgatagtgacatcaatgccaataaagaagaactgctgcgtgtcttagactgggtcccgaagctctggtaccacctccacaccttcctcgagaagcactccacatccgacttcctgatcggtccctgcttctttctgagctgtcccatcggcattgaggactttcgaacctggttcatcgacctctggaataacagtattataccttaccttcaagaaggggcaaaggatgggatcaaggtccatgggcaaaaggccgcgtgggaggacccggtagagtgggtgcgagatacacttccgtggccctcagcacagcaggaccagtccaagctgtatcacctccctccacccacagtcggcccacatagcatcgcctccccccctgaagaccggaccgtgaaggactccaccccatcaagtctcgacagtgatccattaatggccatgctactcaagctgcaggaagcggcaaattatatagagtctcctgacagagaaaccatcctcgaccctaatctccaggcgacactttag

SEQ ID NO: 197068 - DNA, 5610 bp, Artificial Sequence
  Description of Artificial Sequence: Synthetic coding sequence
atgctgggcagcagcgtgaagagcgtgcagcccgaggtggagctgtcatctgggggcggagacgaaggagccgacgagcccagaggcgcagggcgcaaggctgcggcagccgatgggcgcggtatgctgcccaagcgagcgaaagctccggggggaggtggcggaatggcaaaggcttcggccgcggaacttaaagtgtttaagagcggatccgtggactctagggtgcccggcggtccccctgccagcaatctgagaaagcagaaatccctcaccaacctgagttttctgactgactccgagaagaagctccagctgtacgaacctgagtggtccgacgatatggccaaggccccaaagggactggggaaggtgggcagtaaggggagggaggctccactgatgtccaaaaccctttccaagagcgagcattcactctttcaggctaagggctcacccgcagggggagcaaaaacacctctcgcacccctcgcaccaaacttgggaaagcctagtcggatacctcggggtccttatgccgaagttaaacctctgagcaaagcccctgaggctgcggtgtctgaagatggcaagtccgatgacgaactgctaagctcaaaggctaaggctcaaaaaagttcaggcccagttccatcagctaaaggtcaggaagagagagcatttctgaaggtcgatcccgagctggtggttactgttctgggcgatctggaacaactcttgttttctcagatgctcgacccagaaagccagcgaaaacgcaccgttcaaaacgtgttggacctgcggcagaacttggaggagaccatgtcttccctaaggggctcccaagttacacattcatctctcgagatgacatgctatgatagtgacgacgctaacccgagatccgtgagcagcctgagcaatcggtcttcacctctttcctggcgatacgggcagagtagtcctcggttacaggccggcgatgctcccagcgttggaggatcttgcaggtccgagggaacgcctgcctggtacatgcacggcgagagggcccactacagtcacaccatgcctatgcgttctccaagcaaattgagccacataagtaggctggaactggtagagtctttagactcggatgaggtcgacctgaagagcggctatatgtcagacagcgacttaatggggaaaacgatgaccgaggatgatgatatcacgacggggtgggacgaatcctcttccatttcgagcgggcttagcgatgccagcgataacctatcctcagaggagtttaatgcttctagttcgctcaactcacttccctccaccccaacagccagcaggagaaacagcactatcgttctgagaaccgactccgagaaacggtctttagctgagtctgggctttcatggttctccgagtcggaagagaaggcgcctaaaaaactcgagtatgattctggctctcttaagatggaaccgggcactagcaagtggaggagggagcgccccgaaagctgtgatgacagctccaaaggcggggaacttaaaaagcccatctcattggggcatccgggcagcctaaagaagggcaagacgccccccgtggccgtgacttccccaattacccacaccgcgcagagcgccctgaaggtcgccggtaaaccggagggcaaggcaactgacaaaggcaaactagccgtaaagaatactggtttgcagaggagttcttcagatgcaggaagagaccggctgagtgatgccaagaaacccccgtccggtattgcccggccgagcacatccgggagctttgggtacaaaaaacccccccccgctaccgggactgcgactgttatgcagaccggaggctctgccacattatctaaaatacagaagtcctctggaataccagtgaaacctgtgaacggccggaaaacatctctcgacgtgtccaactctgcagaaccaggattcctcgcccctggggcgcggtctaacatccaatacagatctttaccaagacctgctaaaagttcatccatgtccgtgaccgggggacgaggggggccaaggcccgttagctccagcatcgacccaagcctgctgtccaccaagcagggtggcctgaccccatcacgcctaaaggaacctacaaaagtggcttcaggaagaacgacacccgctccggtgaaccagacggacagggagaaagagaaggccaaggctaaggcggttgccctggattctgacaatattagtctgaaaagcattggctctccggaaagcacccctaagaatcaggcctcacaccctactgcaaccaagcttgcggagctaccaccaacgccactgcgggctaccgctaagagcttcgtaaagcccccatcgctggctaacctggacaaagtgaactcaaatagcctggatctgccttcaagttcagatactacgcacgcttcgaaagtacccgaccttcatgcgacgagctccgccagtggcggcccattgccatcttgtttcacccccagtccggcacccattctgaatattaatagcgcatctttctcccaaggcctggagctgatgtcagggttcagtgtgcctaaagaaaccaggatgtatcccaagttgtctggcctgcacaggagcatggaaagcttgcaaatgcctatgtcacttccatccgcatttccttcttcaacccccgtgcccacgccgccagctccaccagcagcacccacggaagaagaaacggaggaactgacatggtccgggagcccgagagctggacagttagattccaatcaacgtgatagaaatactcttcccaaaaaaggattaaggtatcagctccagagtcaggaggagaccaaagaacgtaggcattcgcacactatcggcggccttcctgaaagcgacgaccaaagcgaactcccatccccacccgcactacctatgtctttaagtgctaaaggccagcttactaatattgtaagtccaactgccgcaacaacaccacgcatcactcgcagcaatagcatacctactcacgaggccgctttcgagctatactcaggctctcagatgggatctaccctgtcactggcagaaagacccaaaggtatgatacgtagcgggagctttagagacccaacagatgacgttcacggatccgttctcagtctggccagttctgccagctcaacatactctagtcaaattcggaagctgcggagggagctggagtcctctcaagaaaaggtcgccaccttgaccagccagctgagcgccaatgccaacttggtggccgcgttcgagcaaagcctcgtgaatatgaccagtcgcctaagacacctggctgaaacagcagaagaaaaggatacagagttattggacctcagagaaactatagattttctgaagaaaaaaaattcagaagcacaggccgttatccaaggggctctgaatgctagcgagacaacgccaaaggagctcagaattaagagacagaactctagtgattccattagctcccttaatagtatcacgtcccactcctccatcggatccagtaaggatgccgacgccaagaaaaaaaagaaaaagtcctgggtgtatgagctcaggtcctcatttaataaagcgttttcaattaaaaagggcccgaagtccgcgagctcatatagcgatattgaagagattgccacacccgattcaagcgctccaagctcaccaaagttgcaacatggctccacggagactgccagcccttctataaagtccagtacaagctcttcggttggaaccgacgtgaccgaaggcccagctcaccctgccccccacacaaggctgttccacgccaacgaagaagaggaacccgagaagaaagaggtttcagaattgcggtctgaactttgggagaaggagatgaagcttactgatattcgcctcgaagctctgaacagcgcccaccaactggatcagctgagggagacgatgcataacatgcagctcgaggttgacctgttgaaggccgaaaacgacagactgaaagtggcaccaggcccttcctctgggtctacgcccggacaagttcctggttcctccgccctcagcagtcctaggaggtctctcgggctggccctgactcatagtttcggcccgagcttggccgatacagatcttagcccgatggacggcatttccacctgcggcccaaaggaggaggtgaccctgcgggtagtggtaaggatgcccccacagcacattattaagggagacctgaagcaacaggagttcttcctgggctgttcaaaagtttccgggaaggtggactggaagatgctagatgaagcggtcttccaggtcttcaaggactacatcagtaagatggatcctgcaagcaccctgggcctgagcacagagtcgatccacggttacagtatctctcatgttaagcgcgtgctcgacgccgagccacccgagatgccaccctgtcggagaggcgttaacaatatcagtgtatccttgaagggacttaaagagaaatgtgtggacagcctcgtcttcgaaactttgatacccaaacctatgatgcagcactatatttctctgctcctgaagcataggaggctagtactgtccggccctagcggaaccggaaaaacgtatttaaccaataggctcgctgaatatcttgttgaaagaagcggacgcgaagttacagagggcattgtctctacctttaacatgcatcagcagagctgtaaggatctgcagctatatctctccaatttggcaaaccaaatcgaccgtgaaactggaatcggggatgtgcccttggttatcttgctcgatgatctgtccgaagccggatcaatcagcgaactcgtgaacggggctttgacttgcaagtatcataaatgcccttacattattgggacaactaaccagcccgttaaaatgaccccaaatcacgggctgcacctcagcttccggatgctgactttctccaacaatgtagagcctgctaatggcttcctggtgagatacctccgccggaaactcgtcgagagcgactccgacattaatgcaaataaggaagaactgctacgggtcctggattgggtcccaaagctgtggtatcacttgcacacctttctggagaagcattctacgagcgatttcttaatcggcccctgcttttttctgagctgccccattggtatcgaagattttcgcacatggttcatcgatctgtggaataactcgataattccatacctccaggagggagctaaagatggtataaaggtccacggccagaaggccgcctgggaagacccagtagagtgggtgagggataccctgccatggccgtcagctcaacaggatcagtcaaagttgtatcacctgccccctcctaccgtggggcctcactctatcgcctcccctcctgaggatcggactgtcaaagactctacaccatctagtctggatagcgatccactgatggccatgctacttaaactgcaggaagctgctaattatatagaatcccccgatcgcgaaaccattcttgacccaaatctacaagctacactgtag

SEQ ID NO: 197069 - DNA, 5454 bp, Artificial Sequence
  Description of Artificial Sequence: Synthetic coding sequence
atgctgggcagcagcgtgaagagcgtgcagcccgaggtggagctgtcctccggagggggagacgagggcgcagacgagccgcggggagcgggccggaaggccgcagcagccgacggccgcggaatgctgcccaagcgggccaaagcaccaggtggggggggagggatggccaaggccagcgcagctgagcttaaggtttttaagtccggaagtgtggactcccgggttccgggggggccccccgccagtaatctgagaaagcagaagtctctgaccaatctgtcattcctaacggattcagagaaaaagttgcaactgtacgaaccagagtggagcgatgacatggctaaggcgcccaaaggcctcggcaaggtgggctctaaaggaagagaggctcccctgatgagcaaaacactctcaaagagtgaacattccctgtttcaagccaaaggaagccccgctggcggagcaaagacgcccctcgctcccttggccccgaaccttggaaagccctcgcgcattcctaggggaccctatgccgaggttaaaccactgagcaaggctcccgaggccgctgtcagcgaggacggcaaatccgacgacgagctgctctcaagtaaggccaaagcccagaagtcaagtggaccagtgcctagtgcaaaggggcaggaggaaagagccttcctcaaggttgacccggagctcgtggtaacagtattaggggatctggagcagcttctgtttagccagatgttagaccccgaaagccagcgcaaacgcacagttcagaacgtcttggacctcaggcaaaacttggaggagacaatgtcctccttaaggggctcccaagtgacacatagctcactcgaaatgacgtgctatgatagtgacgacgccaacccccgaagtgtgtctagcctctccaaccgaagctcacccctctcctggcggtatggccagagtagcccacggcttcaggctggggatgccccatctgtgggcggctcttgcaggtccgagggtacacccgcgtggtacatgcatggagagagagctcactactcccatacgatgccgatgagaagccccagtaagctgtctcatatctcaaggttagagctggtcgagtcccttgatagtgatgaggtcgacctaaaatcgggatatatgtctgattctgatcttatggggaaaactatgaccgaagacgacgacatcactactggctgggacgaatcttcaagcatttcttccggcctgtcggatgccagcgacaacttgagcagtgaagaatttaacgccagcagcagcctgaatagccttcctagcacacccactgcgtcgagacgcaacagcactattgtgctccgcacagacagcgagaagaggtcactggcagaatctggcctgtcctggtttagtgagtccgaagagaaagctccaaagaagctggaatatgatagtggctctctaaagatggagccgggtacctccaagtggcgccgagagaggcctgagtcatgcgacgacagttcaaaagggggtgagttgaagaagcctatcagcttgggacaccccggctccctgaagaagggtaagaccccacctgtggccgttacaagccctattacacacactgcccagtccgctctgaaggtggctggcaagcctgagggcaaagctactgataaaggaaaacttgcggtgaaaaataccggactgcagcggtcctccagcgatgctggcagagaccgactatctgacgccaaaaagcccccatccggcatcgcccggcctagtacatcaggatccttcgggtacaagaaaccaccacctgccaccggaaccgccaccgttatgcagaccggcggcagtgcaaccctctcaaaaatacagaagtcctctggcattcccgtcaagcctgtcaacggccgcaaaacatccctggacgtttcaaactctgcagaacctgggtttctggctcctggcgccagatctaacatccagtataggtctctgccacggcccgctaagtcttcttccatgtctgttaccggcggccgtggtggcccccgccctgtgagtagttcaattgacccatccttgctctcaactaaacagggcggactgactccttctagacttaaagagccaactaaagtggcaagcggccgcacaacacccgcgcctgtgaaccagacggatagggagaaggagaaagctaaagccaaagccgtcgctctcgattctgataatataagcctaaaatctatcggcagtcccgagtctactcctaagaatcaggcatcccacccaactgccacgaagttggcagagctgccaccaacgcccctccgcgctaccgccaagtcgttcgtgaaacctcccagcctggccaatctggacaaagtgaattccaattctttggaccttccatcatcatccgacaccacacacgcatctaaagtgccagacctccacgccacgtcaagcgcgagcgggggcccacttccatcctgttttactccttcacctgcgccaatcttgaatatcaacagtgcttcgttcagccagggcctcgaactgatgagtggattttccgttcccaaggagacccgaatgtatccaaagctttcaggcctacatagaagtatggagagcttacaaatgcccatgtctctcccaagtgcattcccatcgagcactcccgtacctactccaccggccccacccgccgcaccgactgaggaagaaacagaagagctcacctggtcaggcagtcccagggcagggcagctggattctaaccaaagggaccgcaatactctgccaaagaaaggcctgcgctaccaactccagtcacaggaggagaccaaagaaagaaggcatagccacaccatcggaggcctgccagagtccgacgatcagtcagaacttccttcacctccggccttgccaatgtcactctcagccaaagggcagcttacgaacatagtgcacggcagcgtgctgtccttggcatcctcagcctctagtacatattcctctgctgaagagagaatgcagagcgagcaaattcgcaaacttcgacgcgaactcgagtccagccaggaaaaagttgctacactgacaagccagctctccgctaatgccaacctagtggccgctttcgagcagtccctggttaatatgacaagcagactcagacatctggctgaaactgctgaagaaaaagacactgagctgttggatttacgcgagactatcgattttctgaagaagaagaattctgaagctcaggcagtcatccagggcgcgctaaatgcttcagagaccacccccaaggaactcagaatcaagcggcaaaactcctctgactctatcagctctcttaatagtataacatctcactcgagcatagggtcaagcaaagatgccgatgcaaaaaagaaaaagaaaaagtcatggttacggagttcatttaacaaggctttttccatcaagaagggcccgaaatctgcatcctcctactctgatatagaagaaatcgctaccccagattcatcagcaccaagcagccccaagctgcagcatggatcgacggaaacagctagtccaagcattaaaagttccacatcctcttcagttggaaccgatgtgacagagggaccggcccatccggccccgcacaccagactgttccacgctaatgaagaggaggagcccgagaaaaaagaggtgagcgagctgaggtctgagctctgggaaaaggagatgaagctcacagacattcgtctcgaggccctgaactcggcccaccagctagatcagttgcgcgaaacaatgcacaacatgcaactcgaagtggatctgctgaaggccgagaatgacaggcttaaagtggccccaggcccatcctccggatctacccccggccaagtacccggcagcagcgctttgtcttctccacgacgatccctcggcctcgcactgacacacagcttcggaccctccctggccgacaccgatttgtcaccgatggacggtataagtacatgtggtccgaaggaggaggtgacacttcgggtggtcgtgaggatgccaccccagcacatcattaagggtgatctgaagcagcaggaatttttcttgggttgtagtaaggtttctggtaaggtggattggaagatgctggacgaggccgttttccaggtgtttaaggactacatcagtaaaatggacccagccagcacccttgggctcagcacagaatcaatccacgggtactctatctcccacgttaaaagggtcctggatgcagaacccccagaaatgcccccttgcaggagaggggtcaacaacatcagcgtgagtcttaagggattgaaagaaaagtgtgtcgactcactcgttttcgagacgctgattcccaagccaatgatgcagcactacatctccttgctgctgaagcaccgaaggcttgttttatcaggcccctcggggacaggtaaaacatacttgaccaatagactggcagaatacctagtagagaggagcggtagagaagtgaccgagggcatcgtgagtacatttaatatgcatcaacaaagctgcaaggatctgcaactctatttgtctaacctcgccaaccagatcgatcgcgagaccggtataggagatgtgcctttggtcatactgcttgacgatttgtccgaagcaggctcaatcagcgagttggtgaatggagccttgacttgtaagtatcataaatgcccatacattattggcacaaccaatcaaccagtgaaaatgacaccaaatcatggtcttcatctcagtttcaggatgctgacgttcagcaacaatgttgagccagcgaacggatttctggttcggtatctgagacgaaagctcgtggagagtgatagcgatatcaacgcaaacaaggaagagttacttcgcgtgctagactgggtgccaaagttatggtatcacctccacacgtttcttgagaaacactctacgtcagacttcctgattggtccctgtttctttttaagctgtcctattggcattgaggacttccgtacctggtttattgacttgtggaataacagtattattccctatctgcaggagggagccaaggacggaattaaggttcacggacagaaagctgcctgggaagacccggtggagtgggtcagggatacactgccatggccctctgctcagcaggaccagagcaagctgtatcacctcccacctccaacagtcggaccccattcaattgcctcaccaccagaagaccgtacggtgaaggactccacccccagctctctggactctgaccccctgatggccatgctgttgaaactgcaggaagctgcaaactacattgagtctcccgaccgagagacaatactggacccaaacctgcaagccacactctag

SEQ ID NO: 197070 - DNA, 783 bp, Artificial Sequence
  Description of Artificial Sequence: Synthetic coding sequence
atgcaccagcagagctgcaaggacctgcagctgtacctgagcaacctcgctaaccagatagatcgggaaacaggaatcggagatgtcccattagtgatcctgctcgacgatctcagtgaggcggggagcatttcagaactcgtaaatggagcactgacctgtaaataccataaatgtccttacatcattggcacaacaaatcagccagtgaagatgaccccaaaccatgggctccatctgagtttctctagaatgctgacatttagtaataacgtcgagccggccaatgggtttctcgtcaggtacctccgcaggaagctggtcgaatcggactcagacatcaacgccaataaagaggaacttctgagagtgcttgactgggtgcctaaactgtggtaccacttgcatacatttctggaaaagcactccacctctgatttcctcatcgggagtccgtgtttcttcctatcttgtccaatcggcatcgaagatttcagaacctggttcattgacttgtggaataatagcatcataccctacctgcaagagggtgcaaaagatgggatcaaagtgcacggtcagaaagctgcctgggaagaccctgtggagtgggtccgagatactctcccatggccttccgcacagcaggatgattctaccccgagttccctggactctgacccgttgatggctatgctactcaagttgcaggaagcagccaactatatcgagtcaccggatagagagaccatcctggacccgaacctccaggcaaccctgtag

SEQ ID NO: 197071 - DNA, 2193 bp, Artificial Sequence
  Description of Artificial Sequence: Synthetic coding sequence
atggagcccggcaccagcaagtggcggcgggagcggcccgagagctgtgacgacagttctaagggcggggagctgaagaaaccaatttcattggggcaccctggaagtttaaagaaaggaaaaacaccccctgtggcggtgacgagcccaatcacgcacactgcgcagagtgccctgaaggtcgcaggcaaacccgaagggaaagccacggacaagggcaaactcgccgtgaaaaacaccggcctccagcgctccagctctgatgccggtcgcgaccggttatcggatgctaagaaaccaccctccggcattgctcgtccctcaaccagcggcagcttcggttacaaaaaaccacctcccgccaccggaaccgctaccgtgatgcaaactggtgggtcagcgactttaagcaaaatacaaaaatcttctgggataccagtgaagcccgtcaacggtcgcaagacgagcctggacgtcagcaatagcgcggagccgggattcctggcgccgggggcccgttccaatatacagtaccgcagcttgcctcgccctgcaaaaagctctagtatgtccgttacaggcggaagaggaggcccaagacccgtaagctcaagtatcgacccctcactgctcagtaccaagcaggggggtctcaccccctcgcgcctgaaagagcctaccaaggtggccagtgggagaaccacaccagcccccgttaaccagaccgatagggaaaaggagaaagctaaggccaaggctgttgctctcgactctgacaacatatccctgaagtcgattggctctccagagtccacacctaagaaccaggccagccaccctacagctacaaagctggcggaactgccacccaccccgctcagagcgactgcaaaatcttttgtgaagccaccatctctcgccaacctcgataaggtgaatagcaactcgctggacttaccatctagtagtgataccactcacgcatcaaaagttccagacctgcacgctacgagcagcgccagcgggggtcctttaccctcctgttttacacctagtcctgcccctattctgaacattaacagcgcctccttttcccagggactggaactcatgtcgggcttctctgttcctaaagaaaccaggatgtatccaaaactgagcgggttgcacagaagcatggaatcgctgcagatgcccatgagccttccgtccgcctttcccagttccacacctgtaccaacccctccagcaccgcccgccgccccaactgaggaggaaacagaagagctgacatggtccgggtcccctcgcgccggacagctggactcaaaccagcgggatcggaacacattacccaaaaaaggcctccgctatcagttgcagtcccaggaagagacaaaggagcgccgccactcacacactatcggtgggcttccagaatccgacgaccagagtgagctcccgtccccccccgcactgcccatgagcctgagcgcgaagggccagctaacaaacatagtgagcccgactgccgctacgaccccaagaattacccggtcaaactccattcccacccatgaagcagcctttgagctgtactccggatctcagatggggtccacactatcgctggctgagcggccgaaaggcatgatcaggtccggctccttcagggaccccacagacgatgtgcatgggtcggtgctgagtctggcgagctcagctagctcaacctatagctcccagattcgtaaattacgccgagaactggagagcagccaagaaaaagttgcaacgttgacttcacagctgtctgctaacgccaaccttgtagcagcatttgagcagagcctggtaaacatgacatctaggttgagacatctcgcggagactgccgaggagaagatggaatttcgatcatgccatcctgggtggtccgccctggccaggtcctggctgacagctaactctgcttcacaggacactgagctgctagacctccgcgagacgattgacttcctcaagaagaagaactccgaagcccaggcggtgatccaaggggcgctgaatgcgtccgaaactaccccgaaggagctccgcatcaaacgacaaaactctagcgattcaatatcttccctaaactcgattacctcccactctagtatcggctcttctaaggatgccgatgcttag

SEQ ID NO: 197072 - DNA, 4452 bp, Artificial Sequence
  Description of Artificial Sequence: Synthetic coding sequence
atgctgcacctgcccctgccccggagcggccggaccgtgaacttccccagatcctgggatgagtctagtagcattagtagtggactttctgacgcctccgacaatctgtcatccgaagaatttaacgcctcttcctccctgaacagtctgccatccacacccaccgcatcaagacgtaattcaacaatcgtccttcggactgactctgaaaaaagaagcctcgctgagtctggactgtcatggttttcagagagcgaggagaaggccccaaaaaagctggagtatgacagtgggtccctgaagatggagcccggcacgtcaaagtggcgtcgggaacggccagagtcgtgtgatgattccagcaagggcggagaactgaagaaaccaatctccttgggacatccagggagtttgaagaagggcaaaactcctccagttgccgtcacctctccaattactcacacggctcaaagcgccctgaaggtcgccggaaaacctgagggcaaagcgaccgacaagggaaaactggctgtgaaaaatacagggctgcaaagatcttctagtgacgcagggagagatagactcagtgacgccaaaaagcccccatctggtattgcgcgccccagtacatcaggctcctttggttacaaaaaacctccccccgcaacgggaactgccactgtcatgcagacaggtggttccgcaacactgtccaagatccagaagtcttcagggatcccagtcaagcccgtgaatggacggaaaacatcattagatgttagtaactccgctgaaccaggattcttggctcctggtgctaggtctaacattcagtaccggtccctcccaagacctgccaagtcatccagcatgagtgtgactgggggtaggggtgggcctcgcccagtgtcttccagcatagatccgtctttactctctacaaagcaggggggtctgacccccagccgactcaaggaacctaccaaggtggcctctggaagaacgacgccggcccctgtgaaccagaccgaccgggagaaggagaaagctaaggctaaggcagtcgccttggattccgacaacattagtctgaagagtatcggatccccagagtccaccccaaagaaccaggcatcgcaccctaccgcgactaagctggctgagttacccccaaccccgcttcgcgccacagctaaaagtttcgttaagccaccatcattagccaaccttgacaaagtgaattcaaattccttagacctgccaagctcatccgatacaacccacgcttctaaagttcccgacctgcatgccacctcttccgccagcggtgggcccctgcccagttgcttcaccccatcaccggcccccatcttaaatattaattcagcctctttctcccaggggctggagctgatgtctggattcagcgtgcctaaggaaacaagaatgtacccaaaattgtctggcctccaccggagcatggagagtctgcagatgcccatgtcacttccatctgcgtttccaagctccacccccgtccctactccacccgctccccccgctgcccccaccgaggaagagacagaggaactgacatggagcggaagcccacgggccggccagttagattcaaatcaacgcgacagaaatacccttcctaagaaagggctgcggtatcagctgcagtcccaggaagaaacaaaagaacggcgccattcccatactattggtgggctaccagaatcggatgatcagtcagagctgccttcaccccctgccctgcctatgagcctgagcgccaaggggcaactgactaatatcgtctctccaaccgccgcgacgacgcctcggattacccggagcaacagtatcccgacccacgaagccgcgtttgagctgtattctggcagccagatgggaagcaccttaagcctggcagagaggccaaaaggcatgattcggagcggctcattcagggaccccaccgatgacgtccatgggagcgtattgtccttagcctcgagtgcatcaagtacctattctagtgcagaagaacgtatgcagtcggagcagatcaggaagttgaggcgcgagctagagtctagccaggagaaggtcgccacactgaccagccagcttagcgctaacgcaaacctggttgccgcattcgaacagagcctcgtgaacatgacgtctcggttacgccaccttgcagaaacagccgaagagaaagatacagaactgcttgatctcagagagaccatcgactttttgaagaaaaagaattctgaagcccaggcagtcatccagggcgcactgaacgccagcgagactacaccaaaagagctacgcatcaaaaggcagaattctagtgatagtatttcctccctgaatagcattacctcccacagcagtattggcagtagtaaggacgccgacgccaaaaagaagaagaagaagagctggttaagatccagctttaataaagccttctctatcaaaaaaggcccgaaaagtgcaagctcctatagcgatatcgaggagatcgcaactcccgatagttctgccccgtcttccccgaagctgcagcacggctcaacagaaaccgcgagtcccagcatcaaatcatctacatcaagttctgtcggtacggatgtgacagaaggccctgcccatcctgccccacacactcgtttgtttcacgccaatgaggaagaggagcccgaaaagaaagaagttagtgagctgcggtcagaactctgggaaaaggagatgaaactgaccgacattcgccttgaagccctgaactccgctcatcagctggatcagctgagggagaccatgcacaatatgcagctggaagtcgacctcctgaaggccgagaatgatcgcctgaaggtagcccccggcccgtcgtcagggagtacccccggacaggttcccggcagcagcgctctaagctcccctcggaggtcactcggtctcgcattgacacattcgttcggcccttcactcgctgatacggacttaagtcctatggacggtatctcaacttgcggcccaaaagaggaggtcacattgcgtgttgtggtgaggatgcctccgcagcacataattaagggggatcttaagcagcaggaattttttttaggttgcagtaaagtatccggcaaggtcgattggaagatgctagacgaggcagtctttcaggtgttcaaggattacatttccaagatggatcctgcatccaccttgggtctttctacagagagtatccatgggtatagtatcagtcacgtgaaaagagtgctcgacgctgagccgcccgagatgcccccatgtaggaggggcgtgaacaacattagtgtcagcctaaagggtctcaaggagaagtgcgtggactccttggtattcgaaactcttattccaaaacccatgatgcaacactacattagcttactgctcaaacaccgccgcttggtcctgtccggtccttctgggaccgggaagacctatctgacgaaccgcctggccgagtatctagtggagcgcagtggccgggaagtcacagaaggcattgtgtccaccttcaatatgcatcagcagtcctgtaaggaccttcaactatacctctcaaacctagctaaccaaattgatagagagactggaatcggagatgtgccattagtgatactgctggatgatctctccgaggctggtagcatttcagagctggtgaacggggctcttacatgcaagtatcacaaatgcccctatatcatagggaccactaaccagcctgttaagatgactccaaatcacggactgcatctatcttttaggatgctgacatttagcaacaacgtggagcctgccaacggttttttggtgagatatctgcggcggaaactggttgagtctgactccgacatcaatgctaacaaggaagagcttcttcgagtgctggactgggtacccaagctctggtaccacctgcatacctttctggaaaaacattccacatctgacttcttaattgggccatgttttttcctcagctgtccaattggtattgaggacttccgaacatggttcattgatctttggaacaatagtattattccgtacctccaggagggcgctaaagacggcatcaaggtacacggtcagaaagcggcttgggaggatccggtggagtgggtgcgcgataccctgccatggcctagcgctcagcaggaccagtctaaactgtaccacctgccacctccaaccgtcggcccgcacagcatcgcttctccccctgaggaccgaaccgtgaaagactccaccccttcatccctggacagcgatcctctgatggcgatgcttctgaagctgcaggaggctgccaattatatcgaatcacctgaccgtgaaacaatattggacccaaatttgcaagcaacgctatag

SEQ ID NO: 197073 - DNA, 4482 bp, Artificial Sequence
  Description of Artificial Sequence: Synthetic coding sequence
atgctgtggccccggaacctgaccagctgggacgacagcagcagcgtgagctctggcatcagcgatacaattgacaacttaagtactgatgacataaacactagctcctccatcagtagttacgctaatacaccggcttcaagccggaagaacctggacgtacagacggacgctgagaagcactcacaggttgaaaggaactcactgtggagtggcgatgatgtcaagaaaagtgatgggggcagtgacagcggaattaagatggaaccaggcagtaagtggcggagaaacccctccgacgtgtctgatgagtcagataaatcaacctcaggaaaaaaaaaccccgtcatcagccagaccggcagctggcggcgcggcatgacagcccaggtcgggataactatgccaaggacaaagccctctgcgccagctggagctctcaaaacgcccgggaccggtaaaaccgatgacgccaaagtgtccgagaaaggcagactcagccccaaagcttctcaggtcaaacgtagcccatccgatgcgggaaggtcttccggggatgaatctaagaagcctctgccatcctcttcaaggacgcctacagccaatgcaaactcgtttgggtttaaaaaacagagcggaagtgctgccggattggctatgatcactgcgagcggtgtcacagttacatcccgatcagccacccttggaaagattcctaaaagcagcgcgctggtgagcaggagtgctggacgtaagagcagcatggatggggcacagaaccaggacgatggatacctggctttaagcagcaggaccaacttgcagtacagatcattgcccagaccctcaaagagcaattcccgaaatggcgcaggcaatcgctcttctacttcatccatcgattccaatattagcagcaagagcgccggcttgccggtacccaagctgcgcgagccgagcaaaaccgcactcggctctagccttcccggcttggtcaatcagactgataaggaaaagggcatctcttctgataacgagagtgttgcgtcctgcaattctgttaaagtgaaccctgcggctcagcccgtatcgtcccccgcccagactagcttacagccaggtgcaaaataccctgatgtcgcctctccaaccctgcggcgtctatttggggggaagccaaccaagcaggtgcccatcgcaactgccgaaaacatgaagaattccgtggtcatttccaatcctcacgctactatgacccagcagggtaaccttgacagcccttcgggatccggcgtgctatccagcggcagcagttcgccactgtactcgaaaaacgtcgacttaaatcaatcgccgctcgcctcaagcccatccagtgcacattccgccccttcaaacagtctaacctgggggaccaacgccagttcatccagtgccgtatccaaggatgggctcgggttccagtcagtatcttcactgcacaccagctgtgagtcaattgatatctctctctcttccgggggtgtcccttctcacaatagcagtacaggactcattgccagcagcaaggatgactccttgactccatttgtgcgtacaaacagcgtgaagacaactttgagtgaatctgatccacatctcgacagaaacactctccctaagaaaggtctgcgctacacaccgacgtcgcagctcaggacccaggaggacgctaaggagtggctgagatcgcatagcgctggcggtctgcaagataccgccgccaattccccattttcttcaggctcctctgttacaagtccctctggaacccgctttaattttagccaacttgcctctccaacaactgtcacgcagatgtccttatctaaccctactatgctgcggacccactcactgtccaatgcagatggacagtacgacccttatacggactctaggtttcgaaattcttcaatgtcactcgacgaaaagtcacgaaccatgagccgctctggcagcttccgtgatgggttcgaggaagtgcacggcagttcactgtctcttgtgtccagtacttccagcgtgtacagcacacccgaagaaaaatgccaatcagaaataagaaagctgcgacgggaactggatgcctcccaggagaaggttagcgccctgaccacccaactgacagctaatgcccatctagtggcagccttcgagcagtccctcggcaatatgacgatcaggttacagtcgctgaccatgacggccgaacagaaggactcggagctaaatgaacttaggaagaccattgagctcctgaaaaagcaaaacgctgcggcccaggctgccatcaatggcgttatcaatactccagagttgaattgcaagggcaatggaacagcccagagcgctgacttacggatcaggagacaacacagcagcgattccgtgagctccatcaactctgcgacttcacattctagtgtggggtccaacattgaatcagacagcaaaaagaagaagcgcaagaactggctgaggagctcttttaagcaggcctttggaaaaaaaaaaagcccaaagagtgcaagttcacacagcgacatagaggaaatgacagacagcagcctgccttcatctcccaagctgccacataatggaagcaccggaagcacccctctccttagaaacagccacagcaatagtttgatatccgaatgcatggactccgaggccgaaacggtcatgcagcttcgcaacgagctccgtgacaaagaaatgaagctgacagatataaggctggaggccctctctagtgcacaccagctggaccagctgagggaagccatgaaccgcatgcaaagcgaaatagagaagttaaaagctgagaatgaccggttgaagtccgagtcccaggggtcaggatgctcaagagctccttcccaggtctcaatctcggcctcaccacgtcaaagcatgggactgagtcagcacagcctaaacctgaccgaatctacatcactggacatgctgctggatgatacgggcgaatgcagcgcccgcaaggaaggtggtagacacgttaaaatagttgtgtcttttcaggaagaaatgaaatggaaggaggactccagacctcatttatttctgatcgggtgcataggggtgtctgggaagaccaaatgggatgtgttagatggtgtagtaagaagattatttaaagagtacataatccatgtcgatcctgtgtcccagctgggccttaattccgactccgtgctgggttactccatcggtgaaattaagaggagcaatacaagtgaaactcctgagctcctgccatgcggatacctggtgggtgagaacacgacaatttcagtcaccgtcaaaggacttgcagaaaactccctggactctctcgtcttcgaatccctgattcctaagccaatcctgcagcggtacgtgagcctcctcatagagcaccggagaattatactgtccggcccttcaggaaccggaaagacgtacctagccaatcgtttgtccgagtacatcgtgctgcgcgaaggtagggagctcaccgacggggtgattgctactttcaacgtggaccataagagttccaaggaattacgacaatacttatcgaatctcgctgatcagtgtaattccgaaaataacgccgtggacatgccgctggttatcattctggacaaccttcaccatgtgtcaagcctgggagagatcttcaacgggctgctgaattgcaagtaccataaatgcccctacattataggcaccatgaaccaggctacatccagcacacctaatctgcaactgcaccataactttaggtgggtactttgcgctaaccacacggaaccggtaaagggctttctggggaggttcctgaggagaaagttgatggaaaccgaaatctccggtcgagttcgaaatatggaactagttaagatcattgattggatacctaaggtctggcatcacctcaaccggttcctagaggcccacagtagctcagacgttacaatcggaccacgcctcttcctttcctgccccatcgatgtcgacgggtctagagtttggtttacagacttatggaactatagcattatcccctaccttctggaggccgtgcgtgagggattacagctgtatggccgacgcgctccctgggaagatccagctaaatgggtgatggatacttacccttgggcagcttcgccacagcagcacgaatggccccccttgctccagcttcgcccagaggatgtcggctttgacggctattcaatgcccagggaaggaagcacttctaagcagatgcctccttctgacgcagagggggaccccctgatgaatatgctgatgaggctgcaggaggcagccaattatagcagtccccagagttacgatagtgatagcaattctaactcacatcacgatgatatactggactcttcactggagagcaccctttag

SEQ ID NO: 197074 - DNA, 7290 bp, Artificial Sequence
  Description of Artificial Sequence: Synthetic coding sequence
atgcccgccatcctggtggccagcaagatgaagagcggcctgcccaaaccagtccactcagccgctccaattttgcatgtcccaccggccagagctggaccccagccatgttacctgaagctgggctccaaggtcgaggtgtcaaagaccacgtaccccagtcaaatcccgctgaagagccaggtcctgcaaggtttgcaagaacctgccggggaaggcctgcccctcagaaagagcggttctgtggaaaacggctttgacacacagatatacacggattgggctaaccactaccttgctaaatcaggccataagcggcttattagggacttgcagcaggatgtgaccgacggagtgctgctcgcccagatcattcaagtggtggctaacgagaaaatagaggatattaatgggtgtccaaagaaccggagccagatgatcgaaaatatcgatgcatgcctaaatttcctggctgcgaaaggcattaacattcagggcctaagtgccgaagaaatcaggaacggcaacctgaaggcaatcctggggctattcttcagcctgtcgcgctataaacagcagcagcagcaaccgcagaaacagcacctcagctctcccctgccgccagcagtgagccaggtggctggcgcaccttctcagtgccaggccggcaccccccagcagcaagtccccgtgaccccccaggccccttgccagccccaccaaccagccccgcaccagcaatccaaggcacaggctgaaatgcagtcaagactgcccggaccgaccgcacgcgtgtcagctgccggatcagaggccaagacacgaggcggctctactaccgctaacaatagaagaagtcaatcctttaacaattacgataaatccaaacccgttacatcccccccgcctcctccgtcttcccacgagaaggaaccccttgcatcatcagcctccagccacccgggtatgagcgacaacgcccctgcatctctggaatctggctcctcctctacccctaccaattgttcaacatcttcagctattccacagcctggggccgccacaaaaccttggcggagcaagagcctttcagtgaaacattcggcgactgtgtccatgctgtctgtaaaaccacccgggcccgaagcccctcgtcccacacccgaagccatgaagccggcacccaataaccaaaaatccatgctggagaaactgaagctatttaattccaaaggtggttcaaaggccggtgagggccctgggtctcgggacacttcctgtgaacgtctagagacgctgccgtctttcgaagaaagcgaggagttggaagccgcttcaaggatgctgactaccgtggggcctgcatcctcttcccctaagattgccttgaaaggaattgctcagcgtacattcagtagggctcttaccaacaagaaaagctctctgaaaggcaacgagaaggaaaaggagaaacaacaacgcgagaaggacaaggaaaagagtaaagatctcgcaaagagggcctctgtgaccgagagactggatcttaaagaagagcctaaagaagaccctagtggcgcggcagtccccgaaatgcccaagaagtctagcaaaatcgccagctttatacctaaagggggcaagctcaatagtgcaaaaaaggagccgatggctccttcgcactcaggaatccccaaacctgggatgaagagtatgcctggcaagagccccagcgcccccgccccttctaaagaaggagagcggtctcggtcaggtaagctttcaagcggcctgcctcaacagaagccacaactagacggccggcattcctcaagtagttccagtttagcctccagcgagggcaaaggcccaggtggtacaacgctgaaccattctatatcttcccagacagtgagcgggagcgtgggcacgacccagactaccggctccaacactgtgagcgtccaactgccccaaccccagcagcagtacaatcaccccaacactgccaccgtagcaccattcctgtacagatcacagactgatacagaggggaatgtgacggcagagtcgtcttcaacgggagtatcagttgaaccatcccacttcactaaaacaggacagccagccctcgaggagctgaccggagaagacccagaagcgcgacggttgagaacggtcaagaatattgccgacctccgacagaacctggaggagaccatgagcagccttaggggtactcaagtcacgcattcgactctcgaaacaaccttcgataccaacgttactacagagatgagcggacggagtattttaagcctcaccggacgaccaacacctctgtcgtggagactcgggcagagttctcctcgcctgcaggcgggcgatgctccatcaatgggtaacggatatcctccaagagcgaacgcgtcacggtttattaatacagaaagtggcaggtacgtctactcggcccccctgaggcgacaactggcatcccgtggctcttctgtttgtcacgtggacgtaagtgataaagctggcgatgagatggatctggagggaatttctatggacgcacccggatacatgtctgacggcgacgtgctgtctaagaatattcggactgacgacatcaccagcggatacatgacagacggggggctgggactgtacacacgtcggctgaatcgattgccggatggcatggcagtggtgcgagaaacgttacaacgaaatactagtctggggcttggagacgcggattcctgggatgattcctccagtgtgagctccgggatcagcgacaccattgataaccttagcacagacgatattaatacgtcttcttcaattagctcttacgccaacacccccgcttcgtcacgcaaaaacttggatgtccaaaccgatgccgaaaaacactctcaggtggaaagaaactcactgtggagcggcgatgatgtcaaaaagagcgatggtgggagtgacagcggaatcaagatggaacccggtagtaaatggaggcgtaaccctagtgatgtgagcgatgagagcgacaagtccacctccgggaagaagaatccagtcatttcccagacaggaagctggcgtcggggtatgacagcacaggttggaatcacaatgcctcgaactaagccgtctgcaccagccggggccctgaaaactccaggaacgggaaaaactgacgatgctaaagtttcggaaaaaggaaggctcagcccgaaggctagtcaggtcaaaagaagcccctctgacgccgggcggtcaagcggcgatgagagcaaaaagccgctcccctcaagctccaggacacctaccgctaatgctaactcttttggttttaagaagcagtctggaagcgcagcaggactggcgatgatcactgcttccggggttacagtaacgtctagatcggccacactcggtaaaatacctaaaagcagtgccctggtgagtaggagcgcaggccgcaagtctagcatggacggcgcccagaatcaggacgatggttatctggccttatccagtaggaccaatcttcagtatcgctccctacccaggccatctaaaagtaactctcggaatggagctgggaacaggagtagcacctctagcattgatagtaacatcagttcaaaaagcgcaggcctgcctgtccccaaattgcgagagccgtccaagaccgcgttgggaagctcactgcccggactcgttaaccagaccgataaagaaaagggcatctcgtcagacaacgaatccgtggcctcctgtaacagcgtgaaagtcaaccctgcagcccaacctgtgtcaagtcctgcacagaccagcttgcagccaggggcgaagtacccggacgtagcatctcccaccctgagaagactgttcggggggaagcctaccaagcaggtccctattgcaaccgctgaaaatatgaagaactctgtggtaatatcaaacccacacgccacaatgacacaacaaggaaatctggatagcccctcaggtagcggtgtgctctcctcaggctcatcctcaccactgtattccaaaaatgtcgacctgaaccagagccccctcgcctcctccccttcttccgcccatagcgccccgagcaatagcctcacttgggggaccaacgcgtccagcagcagcgccgtttccaaagatggactgggcttccaatcagtgagtagtcttcacacctcttgcgaatcaatcgacattagcctgtcctccggaggagttccgtcacacaacagctccacaggcctgatcgccagcagcaaagacgactccctgacgcctttcgttcggaccaattctgtaaaaactactctgtctgaatcccccctgagctctccagccgcctctcctaaattttgtcggtccacgcttcccaggaagcaagattctgacccccacttagataggaacaccctgcctaaaaaggggctgcggtatacccctacctcccagctgaggacacaggaagatgccaaggagtggctgcgcagccattccgcgggcggattacaggacacagccgctaactccccgttttctagcggcagctctgtaacctctccttcagggactagattcaactttagccagttggcgagtcctaccactgttactcagatgagcctgtcaaatccgacaatgctgcgcacccactcgttgagcaatgcagatggccagtatgatccatacaccgactcgaggtttcgtaactcttccatgagcctggacgaaaagagtaggacaatgtcgaggagtggcagttttagagacggtttcgaggaggtgcatggctcaagcttgtcactggtgagttccacttcctcagtgtactctacacctgaggaaaagtgccagtccgagatccgaaaactgcggcgggagctggacgctagccaggagaaagtttcagccctcaccacacagcttacggcaaacgcgcatctggtggccgctttcgaacagtcacttgggaacatgacaatcaggttgcaatccttgactatgactgctgagcaaaaggatagcgagctgaatgaattacgaaagaccatagaactattaaagaagcagaacgcagccgcgcaggcggctatcaatggcgtgattaatacccctgaattaaactgtaaggggaacggcactgcgcagtcagctgatcttaggatacggagacagcatagttctgacagcgttagctctattaattcagcaacttctcactctagtgtgggttcaaacattgaaagtgattccaagaaaaagaagcgaaaaaactggttaagaagcagtttcaagcaggcattcggtaagaagaaaagcccaaagtctgcctcaagtcactcagatatcgaggaaatgactgactcgagcctgcccagtagcccaaagctcccccacaacggctcaacaggtagcaccccccttctacggaatagtcactcgaactcactgatttcagaatgcatggatagcgaggcagagactgtcatgcagctgcgtaatgaactgcgtgataaagaaatgaaattgaccgatatccgcttagaagctctgtcgtcggcacaccagctcgatcaattgagggaagccatgaacagaatgcaaagtgaaattgagaaactgaaagctgagaacgacagactgaagtccgagagtcagggctcgggctgttcgagagctcctagccaggttagtatttctgcctctcctcggcagagcatgggcctctcccagcattctcttaatctgactgaatcgacttcactcgatatgttactcgacgacaccggtgagtgtagcgcacgtaaggaagggggaaggcatgttaaaatcgttgtgagctttcaggaggaaatgaagtggaaggaggattccagaccccacctgttcctgatcgggtgcatcggggtttccggaaagaccaagtgggatgtcctagacggcgtggttcggagactgttcaaggagtacattatacatgtcgatccggtgtcacaactgggtctgaattcggacagcgtgcttggttattcaattggggagataaaaaggtccaacacctcagaaacccctgagctactcccttgtggctatttagttggcgaaaacacaaccatctccgtgactgtgaagggcttggctgagaactctctggatagcctggtatttgagagcctgatcccaaaacctatcctccagcggtacgtcagcctgcttattgagcacagacggattattctttccggcccatctggaactggcaagacgtaccttgccaaccgtctgagtgagtacatcgtgttacgtgaggggcgtgagctgaccgatggggtgatcgccacatttaacgtggatcataaatctagtaaagagctgcgccagtatctgtctaatctcgccgaccagtgtaactccgagaacaatgccgtggacatgccgctcgtcattatcctggataatctacaccacgtgtcttccctgggagaaatcttcaatgggttactgaactgcaaataccataaatgcccctacattatcggtacaatgaaccaggcaacctctagcacgcctaaccttcagcttcatcataatttcagatgggtactctgcgccaatcacactgaacctgtcaaaggctttctcggacgatttctgagacgaaaattgatggagacagagatctctgggcgagtacggaacatggagctcgtcaaaattatcgattggatacccaaagtttggcaccacctgaaccggtttctggaagcacacagctcttcagacgtgaccatcggaccgcggctcttcctatcatgtcccatcgacgtcgacgggtcccgcgtctggtttacagacctctggaactattccatcatcccgtacctgctcgaggccgtgagagaaggactccagctctacggaaggcgtgctccctgggaagaccccgcgaagtgggtgatggatacctatccatgggcagcttccccacagcagcacgagtggccacccctcctgcagctgagaccagaagatgttggttttgatggctactccatgccacgggaggggtcaactagcaagcaaatgcccccttccgacgccgaaggtgacccgttaatgaacatgctgatgcgcttgcaggaagctgccaactattcttcacctcagtcctacgactcggatagcaattccaattcacaccatgacgacatactagatagcagtctagaaagtaccctgtag

SEQ ID NO: 197075 - DNA, 7299 bp, Artificial Sequence
  Description of Artificial Sequence: Synthetic coding sequence
atgcccgccatcctggtggccagcaagatgaagagcggcctgcccaaacctgttcactccgctgcccccatcttacatgtgccccctgcacgggccggtccccagccttgctatttgaagctcggaagtaaagtagaagtgtctaagaccacatacccatcccagatccctctcaagagccaagtgcttcagggtctgcaggagcccgcaggtgaggggcttccactacggaaaagtgggagtgtcgaaaacggtttcgacacccaaatatacaccgactgggccaatcactaccttgccaaaagtgggcacaagagactgatccgtgacctccagcaagatgtgacggatggagtcctgctcgcccaaattattcaggtcgtggccaatgaaaaaattgaggacatcaatgggtgcccaaagaacagaagccaaatgatcgaaaacatagatgcttgcctgaactttctcgccgccaaggggattaatatccagggcttgagtgcagaggagataaggaatgggaatctcaaagctattctgggactctttttctcactgagtcgatacaaacagcaacagcagcagccccaaaaacagcatctctccagcccactgcctccagccgtttctcaggtggctggggctccaagtcaatgtcaagctgggacgccacaacagcaggtcccggttacgcctcaggctccctgccaacctcaccaacctgcgcctcaccaacagtctaaagcgcaggccgagatgcagagccggctgcctggcccaaccgctagagtgagtgctgcagggagtgaggccaaaacccgggggggctctactaccgccaacaataggcgaagtcagtccttcaataactatgataagtccaagccagtgacaagtccccctccccccccttctagtcacgaaaaagagccactcgcgtccagcgcatcctcccaccctgggatgtccgacaatgccccggcctccttggaaagcggttcctctagcacccccacgaattgttccactagttcggctataccgcaacccggtgctgcaacaaaaccttggaggagtaaatccctctctgtgaagcactcagcaacagtctcaatgctatcagtgaagccccccggccctgaagctccacgccccaccccagaggccatgaaaccggccccaaacaaccagaagagtatgcttgagaagctgaaattattcaatagcaaggggggatcaaaggccggcgaaggtccaggcagcagagacactagttgtgagaggctggaaacgctcccctcttttgaagagagcgaggaactggaggctgcttcacgaatgctgacaaccgtcggacccgctagctccagccccaagatagccctaaaaggcattgcccagcgaacgttctctagagccctgaccaacaagaagtcaagcctcaaggggaatgagaaggaaaaagagaagcagcagcgggaaaaggataaggaaaagtccaaggatctcgcaaaaagagcctccgtgacagagaggctcgacttgaaagaggaacctaaggaggaccctagcggggccgccgtgccagaaatgcccaagaaaagtagcaaaatcgcatctttcattccaaaaggcggcaagttaaactccgctaagaaggaacctatggcccctagccacagtggaatccctaagcctggaatgaaatcaatgcctgggaaaagcccctccgcccctgcacctagcaaggagggggagagatcccgctctggcaaactttcatccggtctgcctcaacagaagccccagcttgatgggcggcacagtagttcatcatcatcactggcttccagcgaagggaagggacctggtggcactaccctgaatcactctatcagcagccagacagtgagcggctcggtgggcacaacccaaactaccggctccaacactgtctctgttcagttgcctcagccccagcagcaatacaaccaccctaatacagcaacagtggccccctttctgtatcggtcccagactgacaccgagggcaatgtgactgctgagagcagctctaccggcgtctctgtcgagcctagccattttacaaaaaccggacagccggcacttgaggaactcaccggagaggatccggaagctcgtaggctgaggaccgttaagaacatcgccgatctgaggcagaacttggaggagaccatgtctagcttgcggggaacacaggtaacgcactccacactggaaaccacctttgacaccaacgtaacaacggaaatgagtggcaggagtattctctcactgaccggtcggcctacacccttgtcttggcgcctgggtcagagcagtccgcgtttgcaagccggagacgcgccttccatgggtaatggttacccaccacgcgccaacgcgtcgcggttcataaataccgaatccgggcgttacgtctattctgcacctctccggagacagctggcgagcagagggtcatcagtgtgtcatgtcgatgtgagtgacaaggctggggatgagatggatctcgaggggatcagcatggatgccccaggttacatgtcagatggcgatgtcctgagcaaaaacatccggacagatgatatcacaagtggctatatgacagacgggggcttggggttatacacacggcggctgaataggctaccagatggcatggccgtagtacgtgaaactttgcagaggaacacatccctcggtttaggcgacgcagacagttgggacgatagttcgtccgtctcaagcgggatttccgacaccatcgacaacctgtccacagatgatattaacacgtctagttcaatttcatcctacgccaatactcccgcctctagccgtaagaacctcgatgtgcagaccgatgcagagaagcatagccaggttgaacggaattccttatggtctggcgatgacgtcaagaagtcggatggaggtagcgattcaggcatcaagatggaacctggctctaagtggcgccgcaacccatccgatgtgtcggacgaaagtgacaagtctacctccggaaaaaaaaacccagttatttctcagacggggagttggcggcggggcatgactgctcaggtgggaattaccatgcccagaacgaagccctcagcccctgctggtgctctgaaaacaccaggcacaggaaagactgatgacgccaaggtgtctgaaaaaggtcggctgtctcctaaagcttctcaggtgaaaaggagcccgtcagacgcaggacgttcgtccggagacgagagcaagaagccactgccttcttcttcaagaaccccaactgccaatgccaactcctttgggttcaagaaacagtccggtagtgccgccggcctggccatgatcaccgccagtggcgttactgtgacttctcggtccgctaccctggggaaaattcccaagagcagcgctctggtgagtaggagcgcaggaagaaaaagcagcatggacggggcacagaaccaagacgacggatatctggccctgagtagcaggaccaacctacagtacaggagtctgccccgtccctcaaagagcaacagccgcaatggagcagggaacaggtctagcacttccagcattgactcaaacatatccagtaaaagtgccggactccccgtccctaagctgcgcgaacccagcaagaccgccctgggatcttccctgcccggcctcgtgaaccagacagacaaagaaaaaggaatttcgtctgataacgaaagtgtggctagttgtaacagcgtgaaggtgaaccccgccgcccagcctgtttctagccccgcacaaacgagcctccagcccggagcgaaataccccgatgttgcctcccctacgctgcgacgcctatttggcggcaaacccaccaaacaagtccccatagccacagcagagaacatgaaaaattcagttgtcattagtaatccccatgccaccatgacccaacagggcaatctcgactctcccagtggcagtggtgttttgagttctggatctagcagcccactgtacagtaaaaacgtggatctgaaccagtccccacttgcaagctcaccatcgtccgcacactcagccccctctaacagcctgacatggggaacaaacgcaagttcgtcaagtgccgttagcaaagatggactgggcttccagtctgtgtcttctctacatacttcttgcgaatccatcgatatttctctttccagtggtggcgtccccagtcataacagtagcaccggcctcattgccagttctaaagacgactctctgaccccattcgtccggactaactcagtaaagacaaccctgagcgagtctcctctcagttcacctgctgcttctcctaagttctgccgttctaccctgccacgaaaacaggatagtgatccacaccttgatcgcaacaccctgccaaagaaagggttgaggtacacgccaacatctcagctgcgcacccaggaagacgccaaggaatggctgagaagccattccgcggggggcctacaagatactgccgctaattctccatttagcagtggctcgagtgtgaccagcccatcgggaacccggtttaacttctctcagctcgccagcccgactactgttacacagatgagtctctcaaaccccaccatgctgcggacacattcactgtcaaatgctgatggtcagtacgatccatataccgatagtcggttccggaacagtagtatgtccctagatgagaagagcagaactatgtcccgatccgggtcattcagggatgggtttgaggaagtgcacggatcgtctctgtccctcgtcagttctaccagctcggtgtactccacgcctgaggagaaatgtcaatctgaaattcggaaactcaggcgcgagctggacgcctcccaggagaaggtctctgctctgaccacccagttgaccgctaacgcccacctggtggcagctttcgagcagtccctggggaacatgacaattcggctgcagtctcttacaatgacagccgagcagaaagactcagagctcaacgagttacgaaaaactattgagctcttgaagaaacagaatgctgctgcgcaggctgccatcaacggcgtgataaatacccctgagctcaattgtaagggtaacggtaccgcccagtcagcagatctccggatccgcagacagcactcctcagacagcgtgtcaagcatcaattcagcaacgtcccattccagtgtcgggagcaatattgagtcggattctaagaagaaaaagcgaaagaactgggtcaatgagctacggagctctttcaaacaagccttcggcaaaaaaaaaagcccaaagtccgcttccagtcatagtgatatcgaagagatgactgatagcagcttgccgtcgtcgcccaagctgccccacaatgggtccaccggatctactccacttctccggaattcacacagcaattcccttattagtgaatgcatggactcggaggcagagaccgtgatgcagctgagaaatgagctgagagataaggagatgaaactaactgacattcggctggaagcgctctcttcagcacaccagctggatcagttgcgcgaggccatgaaccgtatgcagtctgaaatagaaaaattgaaggccgagaatgaccgccttaagtctgagtcgcagggcagtgggtgcagcagagcaccttctcaggtgagtattagtgctagtccacggcagtcgatggggctcagtcagcattcgctgaacttgacggaaagtacctcattggacatgttattagacgatactggggagtgctcagctaggaaggagggcggcagacatgtgaagatcgttgtttcattccaggaggagatgaagtggaaggaggacagtcgccctcacctgtttctgattggctgcataggtgtgtcagggaagaccaaatgggacgtgttggatggtgtggttcgccgactttttaaggaatacatcatccatgtggatcccgttagccagctgggattaaattctgacagtgtgctcggttatagtataggcgagattaaacgctccaatacaagtgagactccggagctgctgccttgcgggtatctggttggcgagaataccactatctccgtcactgtgaaggggctcgccgagaatagtctggacagcctggtttttgaatcgctgataccaaagcctatcctccaaaggtacgtgagcctgctaatcgaacacaggcggattatcctctctggcccctcaggaactggaaagacttacttagctaaccgactttcggagtacatcgtactccgagagggccgcgaactaacggatggagttatcgcaacctttaacgttgatcacaagtcctccaaagagctcaggcagtacctctccaacctggccgatcaatgtaacagtgagaacaatgccgtcgacatgcccctggtcatcatcctcgacaatctgcatcacgtgtcttctctcggggaaatttttaacggattgcttaactgcaaatatcataagtgcccatatatcataggtactatgaatcaggccacatcaagcacccccaacctgcagctccaccataatttccgatgggtcctatgcgccaatcacacagagcctgtgaaaggttttctgggtcggttcctccgaaggaaactcatggaaactgaaatttctggacgcgtgcgtaacatggaactagtgaagattatcgactggatccccaaggtctggcatcaccttaaccgctttcttgaggctcattcttcttccgacgttacaatcgggccccgcttatttctcagttgccctattgacgtagatggttcacgcgtctggttcactgacttatggaattatagcatcatcccttacctgctcgaggctgttcgggaaggcctccagttgtatggacgtagggctccctgggaggatcctgccaaatgggtgatggacacttacccttgggccgctagcccccagcagcacgagtggccaccgcttctccaactacggcccgaggacgtgggcttcgatggatatagcatgccacgcgaaggatcaacaagtaaacaaatgcccccgtctgatgcagaaggagatccattgatgaatatgctcatgcgattacaggaggccgcgaactactcatcccctcagtcatacgactctgatagtaatagcaatagccaccacgacgatatcctcgattctagtttagaatccacactgtag

SEQ ID NO: 197076 - DNA, 7467 bp, Artificial Sequence
  Description of Artificial Sequence: Synthetic coding sequence
atgcccgccatcctggtggccagcaagatgaagagcggcctgcccaaacccgtgcacagtgctgccccgatccttcatgttccccccgctcgggccggtccacagccttgctatcttaagctcggctcgaaagtggaggtatctaaaaccacatacccgagccagatcccacttaaatcccaggtgttacagggcctacaggagcctgctggtgaagggctccccctccggaagtcagggtcagtagagaacggctttgacacccagatttacaccgattgggctaatcattacctcgccaagtcaggtcacaagcgcctcatcagagacttgcagcaagatgtaacggacggagtactgttggcacagatcatccaggtggtggcgaatgagaaaattgaggacataaatgggtgccccaagaacaggagccaaatgattgaaaacatcgacgcttgcctgaacttcctggcagccaaaggcataaatatacagggcttgagcgccgaagagataaggaatggcaatctcaaagccatactgggcctgttcttctcgcttagcaggtataaacagcagcagcagcagccccagaaacaacacttgagttctcctctcccacccgcagtttcacaagtggccggcgctccttcccaatgccaagcaggcaccccgcagcagcaagtgcccgttacaccacaagctccatgccagccacaccagcccgccccccaccagcagagcaaagcacaggccgaaatgcagtcaagcgccagctccaaagactcctctcagagcaaaattattaggtttacgctgggtcaaaagaagattagcagactgccagggcctactgcccgggtctctgccgctggctctgaggctaaaacaagaggcggtagcacaacagctaacaacagacggtctcagtcctttaacaactatgacaagagcaaacccgtcacctcaccgcctccaccaccttcaagtcatgagaaggagcctctggcatcttccgccagctcacatcccggcatgtctgataacgcaccagcttcactggagagcgggagtagcagcacaccaaccaattgcagcacctcatccgccataccccagccaggcgccgcaacaaaaccttggcggagtaagagtctcagcgtgaagcactccgccaccgtttcaatgctttccgtgaaacccccaggaccagaggctcctcgccctactcctgaggctatgaaaccagccccgaacaaccaaaaaagcatgctggaaaagctaaaactgtttaattctaaaggtggcagcaaagctggggaaggtccaggttctagggacaccagctgcgagaggttagagacattgccaagttttgaggagagcgaggaactggaggccgctagtcgtatgctgactacagtgggcccagccagctcatccccaaagattgcactgaaggggatcgcacaaaggactttctcacgggcactcacaaacaaaaagtcgagcctgaagggtaatgagaaggagaaagagaaacaacagcgagaaaaggataaggagaagagcaaggaccttgccaagcgtgccagcgtgactgaacgcctggacctgaaagaagaacccaaggaagacccttctggcgcagccgtgcctgagatgcctaaaaaaagcagtaaaatagctagttttatccctaagggtggtaagttaaactctgcaaagaaggaacccatggcaccctctcacagtgggattcctaaacccgggatgaagagtatgcctgggaagtctccgtcagcccccgccccatccaaagaaggagaacgctcacggtcaggcaaactgtcctccggtctcccacagcagaagcctcagttagacggccggcattccagttcttccagctccttagcgagctctgaaggaaaaggtcccggggggacaacactcaatcattccatttcttcccaaacagtgtccgggtctgtgggaacgacccagacaaccgggtctaatacggtgtctgtgcaactgcctcaaccccagcagcagtacaaccaccctaacaccgctacagttgctccattcctctaccgatcgcagaccgataccgaggggaacgtgaccgctgagagttcaagtacaggcgtgagtgtagaaccgtcccatttcaccaagacagggcagcctgccctggaggagctgactggagaagaccctgaggccaggaggttgaggaccgtgaagaatatcgcagatctgcgacagaacctggaggagaccatgagctcactgagggggacacaggtcacgcactccactctggagaccacctttgacactaacgtcactactgaaatgtctggccgcagcatcctctccctgaccggccggcctacacccctgtcttggcgtctgggccagtctagtccgcgactgcaggctggcgacgctccatccatgggcaatggatacccaccccgcgccaatgctagcagatttattaatacagaatcaggacgctatgtctattctgcaccactgagacgccaactcgcatcacgcggatcaagtgtgtgccatgtcgacgtgagtgataaggcgggagatgaaatggaccttgagggaatttccatggatgccccaggatacatgtcagatggggatgtactcagtaagaatatcagaactgatgatatcaccagcggctatatgactgacggcgggctgggcctatatactagaaggttgaaccggctgcctgacggcatggccgtggtaagagagaccttgcaacgaaacacttcactgggacttggtgatgcagattcctgggatgattcgtcctccgtttcctctggaatctctgacactatagataatttgtccactgacgacattaatacgtcatctagtatctcctcttacgcaaacacgcccgcaagctcccgcaagaatctcgatgtgcagacagacgctgagaaacattcacaggtggagcggaactcgttatggagcggagatgatgtgaagaaatcagacggtggcagcgatagtgggatcaagatggagcccggcagcaaatggcggcgaaatccgtccgacgtctccgatgagagcgacaaaagcacaagtggaaagaagaatccggtgataagccaaacaggatcttggagacggggcatgacggctcaggtggggataactatgcctagaacgaagccatcagcaccggccggcgctctgaagacgccagggaccggtaagacagacgacgctaaggtgtctgagaagggacggctgtcacctaaggcctcccaggtgaaacggagccccagcgatgctggtcggagcagtggggacgaatctaaaaagcccctccccagttcctctaggacccccactgccaatgcaaactcctttggttttaaaaaacagtccggatcagcagctggccttgctatgatcactgcttccggcgttacagttacctcccgctcagcgactcttggcaagatccccaagagttcggctctagtgagcagatctgctggccggaaatcttcaatggatggtgcccagaaccaagacgacggctacttggcgctatcttcacgaaccaatttgcaatacagatctcttccgagacctagcaagtcaaacagccgaaatggggctggtaaccgcagctccacttcgtctattgacagcaacatctcatctaaaagtgcagggcttcccgtccccaagctgcgggagccaagtaagactgcgttgggttcaagcttgcccggcctggtgaatcagaccgacaaggagaaagggatctcaagcgataatgagtcagtggcctcatgcaactctgtgaaagtcaaccccgcagcacagccagtctcatctcctgctcagaccagcctgcagcccggggcaaaatacccggacgtggcttcgccgaccctgcgaagactgttcggcgggaaacccacgaaacaggtccctattgctaccgcagaaaacatgaagaattccgtggttataagcaatccccatgctacaatgacacagcagggaaatttagactctccatctggttctggggtgctgtcatccggatcatcctcacctttgtacagcaagaatgtcgacctgaaccaaagtccacttgcttcttccccctcctcagcccacagtgcaccgagcaactcactgacctggggtacaaatgcaagctccagctccgccgtttcaaaggacggcctcggattccagtcggtgtcgtcgctccacacatcctgcgaatccatcgacatatctctgtccagcggcggcgtgccaagccacaattcgtctacgggcttgatcgccagctctaaggacgacagcctcactccgttcgtgagaaccaacagcgtgaagacaactctgagtgagtcccctctgagcagtcccgctgcctcacccaaattttgcaggtccacgctcccacggaagcaggactctgatccccacctagacagaaataccctccccaaaaaaggtctgcgctataccccaacatcccaactgcgaactcaggaggatgcgaaagaatggctcagaagccattcggcggggggtctgcaggatacagccgccaactctcccttctccagtggttccagcgtgacttcccctagcggcacccggttcaatttttcccagcttgcaagtcctaccaccgtcacccagatgtctttgagcaaccctaccatgttacggactcacagcctgtccaatgccgacggacaatatgacccttacaccgatagccgtttcagaaacagctccatgtccctggatgagaagtcgcgcacgatgtccagaagcggaagcttccgggatgggtttgaagaggaatcatgggaaaaaagcagcgtggataatttcgtcagcagacttcattcatccctgcacttttctctccccttattccaccacgctaggtatgaactggtccatggaagtagtctttcactggttagcagcacctcgagcgtttattcaacccccgaggagaagtgccagtctgagatcaggaagttacggcgcgagttagacgcttctcaggaaaaggtcagtgccctgacgacccagctgaccgccaatgcgcacctggtggcagcttttgaacagagtttgggaaacatgactatccgactgcagagcctgactatgactgccgaacagaaagactctgagctcaatgagttgagaaagacgatagaactcctgaaaaaacaaaacgcagccgctcaggccgcaataaacggtgtgatcaacactcccgaactgaactgtaaaggaaatgggactgcacaatctgccgacctccgtatcagaagacagcactctagtgactctgtatctagtataaactccgcgacttctcatagcagtgttggttcaaatatcgagagtgactccaagaaaaaaaagcgtaaaaactgggttaatgaattgcgcagttcctttaaacaggctttcggcaaaaagaaatctcccaaatctgcctcaagtcacagtgatattgaagagatgacagatagctctctgccctcttcccccaagctcccccacaacggcagtaccggttcaactcctctactgcgaaattcgcatagcaactccctcatctccgaatgtatggactcggaggcagagaccgtcatgcagctgcgcaatgaacttagagataaagagatgaaacttacggacatacgactggaggctctttcctctgcccaccaactggaccagctgcgggaagccatgaaccgaatgcagagtgagattgagaaactcaaggccgaaaacgatagattaaaaagcgaatcccagggctctggctgctcacgtgctccatcacaggtcagcatttcagcttcaccccggcagagtatggggctgtcccagcattctctgaacctgacggagtctaccagcttagacatgctccttgacgataccggggagtgtagtgcgcgcaaggagggtgggcgccatgtgaagattgtcgtaagctttcaggaagaaatgaagtggaaagaggattcccggccgcacctattcctgatagggtgtatcggggtgtctggaaagaccaagtgggatgtcctggatggagtggttcgcaggctgttcaaagagtatattattcatgtcgatcccgtctcccagctgggtctaaattctgatagcgtcttaggctactccattggcgagatcaagcgctctaacacgagcgagacacccgaactgctcccctgcggctatctggtgggcgagaataccaccatctcagtgaccgtgaagggtttagctgagaattccttggatagcctggtgttcgagagcctgattcctaaacccattctgcaacgttatgtaagcctgctcatagaacacagacgcattatcttgtctggcccaagtgggacagggaagacctaccttgctaaccggcttagcgaatacattgtgctgagggaaggacgggaactgacagatggtgttatcgctacctttaatgtagaccacaaatcttcaaaagagcttcgccaatacttgtccaacctggctgatcagtgtaactcggaaaacaacgctgtggacatgcctctcgtgattattcttgacaatcttcatcacgtgtctagtctaggcgagatctttaacgggctcctcaattgtaagtatcacaaatgtccatatatcattgggactatgaaccaggccacatccagcacccccaatctgcagcttcaccataatttcagatgggttctatgcgctaatcacactgaaccggtcaaagggttcctgggaagattcctacggcgtaaactcatggaaaccgagataagcgggcgcgtcagaaacatggagctggtcaaaatcatcgattggattcccaaggtgtggcaccatttaaacaggtttctggaggcccactcctccagcgacgtcacaattggtcctcgcctcttcctgtcctgccctattgatgttgatggatcaagagtctggttcacagatctttggaactattccatcatcccctacctgctggaggcagtaagagagggactccagctctacggtcggcgcgccccgtgggaggaccctgctaagtgggtcatggacacttacccctgggccgctagcccccagcaacacgaatggccccctttattacagctgagaccggaagatgttggattcgatggatactctatgccgagggagggatccacctccaaacagatgcctccctctgatgctgagggtgatcctcttatgaacatgctcatgcgactgcaggaggcagccaattatagtagtccacagagctatgattcagatagtaactctaattctcaccatgatgacatccttgatagcagcctcgagtctacgttatag

SEQ ID NO: 197077 - DNA, 7254 bp, Artificial Sequence
  Description of Artificial Sequence: Synthetic coding sequence
atgagcgtgatgctgtggcggtgggagcagaacaacaccaccatgaagctccaaatctacactgactgggcaaatcactacttggccaaaagtggccacaaacggttgattcgggatttgcagcaggatgtgaccgatggggtgttgcttgctcagatcattcaggttgtcgccaacgaaaagatcgaagacattaatgggtgtcccaaaaacaggtcacagatgatcgagaacattgatgcgtgtctgaatttcctagctgctaagggcataaacattcagggactgtcagcagaagaaatccgcaacggaaatttgaaagccattcttggcttgtttttctcgttaagccggtacaaacaacagcagcagcagccacagaagcagcacctgtcgtctcccttgcctccagccgtgtcacaggtagctggggcgccatctcagtgccaggccggtacccctcagcagcaggttccggtgacaccccaggcaccctgtcagccacatcagcccgcccctcaccagcagtcaaaagcccaagccgaaatgcagagctcagcctcttccaaagattcctctcagtccaagatcatacgtttcactcttgggcagaagaaaatctctcgtcttccaggccctacagccagggtttcagccgccggctcagaggctaaaacacgcgggggttccacaacagctaataaccgcagatcacagtccttcaacaactacgacaaatccaagcctgtcaccagccccccgcctcccccatcttcacacgagaaggagccactggcctcctctgcttcctctcaccctgggatgtccgacaatgcaccagcctcattagagagcgggtcgagcagcactcccacgaattgttcaactagctccgctattccacaaccaggagccgcaacaaaaccctggaggagcaaaagcctgtcagtgaagcatagtgctactgttagcatgctgtcggtcaagccacctgggccagaggcaccacgaccaacccccgaggccatgaagccagcgccaaataatcaaaagtcaatgctggagaaactcaagttgttcaatagcaagggcggctctaaggccggcgaagggcccggatcccgagatacttcttgtgagaggttggaaaccttgccgtccttcgaggaatctgaagaactcgaagccgcttctagaatgctgactactgtcggcccggcctcctcatcacctaaaattgctttgaagggcattgctcaacgcacattttccagggcgctgacaaataaaaagagcagtctcaagggcaacgaaaaggaaaaagagaagcaacagcgagagaaagacaaagagaagagtaaggatttagctaagcgggcctctgtaaccgaacgcttagacttgaaggaagagccgaaggaagatcccagtggcgcagcggtcccagaaatgccaaagaaaagctcaaagatcgcctcttttattccaaaaggcggaaagctgaactccgcaaagaaggagcccatggcaccgtctcacagcggtattccaaaaccggggatgaaatccatgcccggcaagtcccccagcgcccctgccccttctaaggagggtgagcggtcacgctccgggaagctaagctccggcctgcctcaacagaaaccccagctagatggtcggcactctagctccagttccagtttggcaagcagtgagggcaagggcccaggcggcacaacactgaatcatagtataagttctcagacagtgtcaggttccgtcggaaccacacagaccaccgggagcaacacggttagcgttcagctgcctcagcctcaacagcagtacaaccacccaaacaccgcaacagtggcacccttcctctacagatcccagactgatacagagggtaatgtgaccgcagaaagctccagcaccggagtctctgtggaaccaagccacttcacaaagactggtcagccagcacttgaggagctcacaggcgaggaccccgaagcaagaagactccgcaccgtgaaaaatattgccgacctgcgacagaaccttgaagagacgatgtcctctctgaggggcacccaggtgacacacagcactttggaaaccacttttgacacaaacgtgactactgaaatgagcggtaggtctatcctgtctcttacgggccggccaactccattatcttggcgtctaggacagtcaagtcctcgcctccaggccggagacgctccttcaatgggcaatgggtatccaccacgcgcaaacgcctctagatttattaatactgagtcgggaagatacgtgtacagtgcccccctgagaaggcaactcgcatccaggggaagtagtgtctgccatgtggatgtcagcgacaaggccggcgacgagatggatctagaaggcatttccatggatgccccgggttatatgtcagatggcgacgtcctgagtaagaatatcagaacagacgatattactagcggctacatgaccgatgggggtctggggctgtacacacgccgactgaaccggctgcctgatggcatggcagtggtccgcgaaaccctgcagcgcaataccagtttgggacttggggacgccgacagctgggatgattcaagttctgtatcttccgggatctcagacaccattgataatctctctaccgacgatatcaacacatcttcaagcatcagcagctatgccaacacccctgcttcttcaagaaagaaccttgacgtccagactgacgccgagaagcactcccaagtggagcggaattccctctggtccggcgacgacgtcaaaaagtcagacggcggctccgactcagggatcaaaatggagccaggctctaagtggaggaggaacccaagcgacgtgagcgacgaatcagacaaaagcacttctgggaagaagaaccccgtgattagccaaactggttcatggaggcgaggaatgaccgcacaggtaggcatcaccatgcctaggaccaaacccagcgcccccgccggagctttaaagacccccggaacaggcaagaccgacgacgcaaaggtcagcgaaaaaggtaggttatccccaaaggcatcccaggtgaagcgatctccaagcgacgcgggacgctcatccggggacgagagcaaaaagcctctccccagttcatcccgcacccccacagctaatgctaacagtttcggcttcaagaaacaaagcggctcagccgcgggcctggccatgattacagcttcgggggttaccgtgacctccaggtcggccacgctgggaaaaataccaaagagttccgccctcgtctcacgatcagcaggccgtaaaagctctatggacggtgcccagaaccaggatgacggatatctggctctgagcagccgcaccaacctccagtatcgctcactcccccggccttcaaaatccaattcgagaaacggggccggcaaccgttcctccacgtcttcaatcgacagcaacatcagcagcaagagcgccggtctgcctgtccccaaactgagggagccgtcgaaaactgccctcggctcaagtctgccaggcctggtcaatcaaaccgacaaggaaaaagggatcagtagtgacaacgagtcagtggctagctgcaactccgtgaaggtaaaccccgccgctcagcctgtgagttctcccgcccagacctctctgcagccaggggccaaatatccagacgtggcgtccccaaccttgcggaggctcttcggtggaaagcctactaaacaggtgcccatagccacagcagagaacatgaagaatagcgtcgtgatctctaatccacacgcgaccatgacccaacaaggcaacctggactctccttccggatcaggtgtcctttcatccggatcttcatcccccctatattcaaagaatgtggacctgaatcagtctcctcttgccagttcaccctctagtgcccactctgcccctagcaatagtttgacctggggaaccaatgcttcgagctcatccgccgtctctaaagatgggttggggttccagtctgtgagtagcctgcacaccagctgcgagtctattgatattagtcttagctccggcggagtcccatcacacaattcttcaacaggcctaatcgcttcaagcaaggatgactcgctgaccccattcgtgagaacgaactcagtgaagacaactctatcggagtctcctctgagtagcccggccgcgagtccgaagttttgccgtagtaccttgcctcgcaagcaagacagcgatccccatctggatagaaatacactgccgaagaagggattgcggtacacgcccacatctcagctgcgaacccaagaagacgcgaaagagtggctgcgatcacatagtgctggtggtctacaagatacggccgctaatagcccgttcagctctgggagctccgtaacatctccatctgggactaggttcaacttttcacaattagcctctcctacgaccgtgacacagatgtctctgtccaatcccaccatgcttcgaacccatagcctgtcgaacgcggacgggcagtatgacccttatacagactcccggtttagaaactcctccatgagcctggacgagaagagtcgcactatgtcccgaagcggttcttttagagatggcttcgaggaggagtcttgggaaaagagctctgtagataactttgttagtagactgcatagctcgctgcacttttctctgccattattccatcacgccaggtacgaacttgtgcacggatctagtctatctctggtgtcatctacttcatcagtgtacagcacccccgaagaaaagtgccagagcgagataaggaagctaagacgggagctggatgcctcacaggaaaaagtctcagctctgactacacaactgaccgctaacgcacacctcgtcgccgcattcgaacagtcacttggaaacatgaccatccgtttgcaatccttgaccatgaccgctgaacaaaaagattccgaactgaacgagctcaggaagacaatcgagttgctaaagaagcagaatgccgcagcccaggccgcaatcaacggcgtgatcaatacccctgagcttaattgcaaagggaatggcactgctcaaagcgccgacctgagaatacgccgccaacactccagcgattcggtgtcctctataaatagcgccacgagtcactccagtgtagggtctaacatcgaatcagactcaaagaagaagaaacgtaaaaattgggtgaacgagctcagatccagcttcaagcaggcttttggcaaaaaaaagtcacccaaatccgcttccagccatagtgatatcgaagagatgaccgattcatcgctgcccagctcacccaagctgccacacaatgggagcacgggttccaccccccttctcagaaacagtcactccaattccctaatcagcgagtgtatggattcagaggctgagacagtaatgcaactccgaaatgagttgcgagataaggagatgaagctcactgatattcgcctcgaggcactttctagcgcacatcagctggatcaacttcgggaggctatgaacaggatgcagagtgaaatcgaaaagctgaaggcagagaatgataggctgaagtccgaatctcaagggagcggttgctccagggccccttctcaggtatctattagtgcttcacctagacagtccatgggacttagtcagcattccctgaaccttactgagtctacatctttggatatgctactggacgataccggcgagtgttctgctcgcaaggagggaggccgacatgttaagatagtggtatcttttcaagaggagatgaaatggaaggaggactcgcggccgcaccttttcctgattggctgtatcggggtgtccggcaagacaaagtgggatgtgttagatggagtcgtgagacggctgttcaaagagtacatcatacatgttgacccagtgagccaattgggtttgaacagcgacagcgtcttgggctattctattggtgaaataaagaggtcgaacaccagtgaaacacccgagctccttccatgtggatatctggttggagagaatacaaccatttccgtcacagtgaaaggactggcggagaattcacttgattccctggtgtttgagtcactgatacctaagccgattcttcagcgttacgtgtccttgctgattgagcatcgccgaattattctcagtggcccaagcggaaccggcaagacttacctagctaatcgactatccgaatacatagtgcttagggaggggcgcgagctgacagacggggtcatcgctacctttaacgtcgaccacaagtcctctaaggaattgcggcagtacttgagcaatctcgccgaccagtgtaactctgagaacaatgcagtagacatgccgctggtgatcatccttgataatctgcatcatgtctcaagcctcggggaaattttcaacgggcttctgaactgtaagtatcataaatgtccttatatcatcggtacaatgaaccaagccacgagctctactccaaatctgcagctccatcataactttcggtgggtgctgtgtgctaaccacactgagccagttaaaggcttcctcggtcgcttcttgcggcgcaagctcatggaaacggaaatctccggacgggtacggaacatggaattagtcaaaattatcgactggatccccaaggtgtggcaccacctcaatcggtttttggaagctcatagcagctctgacgtgaccattggcccacggctgttcctcagttgtccgatcgacgtggacggctccagagtttggtttactgatctttggaactactcaattattccttacctccttgaggcggttagggaaggattgcagctttacggtaggcgcgctccttgggaggatccagcaaaatgggtcatggatacatacccctgggccgcgtctccgcagcagcacgaatggccacctctccttcagctgagaccagaagacgttggttttgacggatactcaatgcctagggagggttcaacttcaaaacagatgcctccttcggatgccgagggggaccctctcatgaatatgcttatgcgtctgcaggaagccgccaattacagtagtccccagtcttatgatagcgactccaatagcaactcacaccacgatgacatacttgattcctcgctggagtccacactttag

SEQ ID NO: 197078 - DNA, 4482 bp, Artificial Sequence
  Description of Artificial Sequence: Synthetic coding sequence
atgctgtggccccggaacctgaccagctgggacgacagcagcagcgtgagctccggaatttcagataccatcgacaatctctcaaccgatgacattaacacttcctcttcaatttccagctacgccaacacccccgcctcttccagaaaaaacctggatgtccagacggacgccgaaaaacacagccaggtggagcgcaatagcctgtggtccggagatgacgtgaaaaagtccgatgggggctctgatagtggaatcaaaatggaacccggctctaagtggcgaagaaatccatcagatgtcagcgacgagtctgataagagtacaagtgggaagaagaaccccgtgatctcacagacaggttcatggaggcgcgggatgacagcccaggttggaatcaccatgcctagaaccaaacccagtgcgcctgctggtgctctgaaaactccagggacaggaaagactgacgacgccaaggtgtccgaaaaggggagacttagtcccaaagcctcccaggtcaagaggtctccttcagatgctggacgctccagcggcgatgagtccaagaagcctttgccaagttctagcagaacacctaccgcgaacgccaactctttcggtttcaaaaaacagtccggatcagccgctggactggccatgatcacagcgagcggtgtaacagttacctctcggtctgcgacactaggaaaaattcccaagtcatcagctctcgtgagtcggtcagcaggaaggaagtcctccatggacggtgcccagaatcaggacgatgggtatctggctctgtcttcccgcacaaaccttcaatatagatctctgccacggccctccaagagtaattctcgaaatggagccgggaatcgctctagtacatcatctattgattccaatattagttctaaatctgcagggctcccggtgccgaagttacgcgagccttcaaagacagcccttggaagctctctgccaggcttggtgaatcagactgataaagagaaaggcatctcgtctgacaacgaatccgtcgctagttgcaactccgtcaaagtcaatcccgccgcccagccggtcagctcgccagcccagacgtccttacaacccggcgccaaataccccgacgtggcatcacctactctgcggcggttatttggaggcaagcctacgaaacaggtcccaatcgcaacagcggaaaatatgaagaattcagtcgtgatttccaacccccacgctaccatgacgcagcagggcaatttggactctccatctgggtcgggcgtgttgtcctctgggagttccagccctctgtactcgaagaacgtggacctcaatcagagcccgctcgccagcagtccctccagcgctcactctgctcccagcaattctttgacatgggggacaaatgcctcaagttccagtgccgtgtcaaaggacggcctgggattccagtcagtgtcgagtctacacactagctgtgagagtatcgacatctcacttagctctgggggggtgccgagccacaacagctcaacagggctcatcgcctcctcaaaagacgatagcctgactccattcgtgagaaccaactccgttaagaccacactgtctgaatcagatccccatctggatcgcaatactttaccaaagaagggcctgagatacacccccacgtcccagctcagaacacaggaagatgccaaggaatggctacgatcccactcggccggcggactgcaggataccgctgccaattcccccttctctagcggatcctctgttacaagtcccagcggtaccaggttcaatttttcccagcttgcttctccaacaaccgtcacccagatgtccttaagtaaccccaccatgcttcgcacccactcgctttctaacgcggacggccagtacgacccctacacagattcccgctttcggaatagctctatgagccttgatgaaaaaagtagaacgatgtcacggagcggaagtttccgtgatggcttcgaggaggttcatggatcatcactctcgttggtgagctcaacaagctccgtgtactccacccctgaggagaagtgccagtctgagatccggaagctgcgacgagagttggatgcttctcaggagaaggtctcagccctcaccacccagctgactgcgaacgcgcatttggtagctgcgttcgaacaatccctggggaacatgactattcggttgcagagcttgaccatgactgcagaacagaaagatagcgaattgaatgagctccggaaaacaattgagctgcttaaaaagcagaacgctgcggcccaagctgcaattaatggtgtgataaatacccctgagttgaattgtaagggcaatggcacggcccagtcggctgaccttcgcattagaaggcagcactcatcagactccgtatcctccataaattccgcgacctcgcacagcagcgtgggctccaatatcgagtcagattctaagaaaaaaaaaaggaaaaactggctgcgcagtagctttaagcaagcattcggaaagaagaagagcccgaaatccgcctcctcacacagcgatatcgaggagatgactgacagtagtttgccctcaagccccaagctgccccacaacggctctacggggtcaacccccctcctcagaaattcacatagtaactcccttatatcggagtgtatggatagcgaggcagagacggttatgcagcttaggaacgagttaagggacaaggaaatgaaactgaccgacatcagactggaggctttgtcttcagcccaccagctcgaccagctcagagaggccatgaacaggatgcaaagcgagatagagaagctgaaagcggaaaatgatagactgaaatctgaatcccagggatccggctgtagcagagctccgtcgcaggtgtccataagtgcatccccaaggcagtcaatggggctttcccaacactctctcaatctcacagaatcaacatctctagacatgctcctcgacgacaccggggagtgcagcgctagaaaggaaggggggcgccacgtgaaaatcgtggtcagctttcaagaagaaatgaagtggaaggaggacagtagacctcacctctttcttatcggctgtattggagtgagtggcaaaacgaagtgggacgttctggatggggtggtgcgacgcctctttaaggagtacatcattcacgttgaccccgtgtcccagttagggcttaattccgattccgtcctgggatacagcatcggcgaaatcaagagatcaaacacatcagagaccccagaactgctgccttgtggatatcttgtaggcgagaatacaactattagcgttactgtcaaaggacttgctgagaattccctcgattccttggtatttgagagtcttatccccaaacctattctgcagaggtatgtgagtctgcttatagaacatcgtagaattattctgtccgggccatccggaacaggtaaaacctatctagccaaccgtttgtccgagtacatagttttaagggaggggcgagagctgactgatggggtcattgcaacatttaacgtcgaccacaagagctccaaggagctccgccaatatctaagcaatttagcggaccagtgcaattctgaaaataacgctgtggatatgcctctggtgataattctggataatctgcatcacgtgagctcgctcggtgaaatctttaatgggttattaaactgcaaataccataagtgtccctacattattggcacgatgaatcaagccacaagttccacccccaacttacagctgcatcacaatttccgatgggtgctttgcgcaaaccataccgagcccgttaagggctttcttggacgttttctgcggcgcaagttgatggagaccgaaatttcaggacgcgtgcggaatatggaactggtaaaaatcattgattggatcccgaaggtgtggcaccacctgaacaggttcctggaagcccacagcagcagtgatgtcactatcggtccacggctgtttctttcctgcccaatcgacgtcgatgggtctagagtatggttcactgatttgtggaactattccatcatcccttaccttctcgaggctgtgagagaagggctacagctgtacggacgaagagctccttgggaagacccagcgaagtgggtcatggacacctatccatgggcagcctcaccacagcagcacgagtggccacctctgctccaactcaggcctgaggatgtcggatttgacggatactccatgccacgcgaagggagcacatctaagcaaatgcccccctccgacgccgagggtgatccactgatgaatatgctcatgagactccaagaggctgccaattacagctctccacaaagctatgactccgactccaattctaattcccaccacgacgatatccttgatagttccctggaatctactttatag

SEQ ID NO: 197079 - DNA, 2451 bp, Artificial Sequence
  Description of Artificial Sequence: Synthetic coding sequence
atgctgtggccccggaacctgaccagctgggacgacagcagcagcgtatcatctggtatcagtgatacaatcgacaatttgtccacagacgacatcaatacatcatccagtatttcctcctatgcaaacacccccgcttcttcacgaaaaaacctggacgtccagactgacgccgaaaagcatagtcaggtcgaaaggaactctctgtggtctggagatgacgttaagaagtctgacggcgggtcagatagcggaataaagatggagcccggcagcaagtggcgacgcaatccctcagacgtatctgatgaatctgataaatctaccagcggcaagaaaaatccggtaatcagtcagacagggagctggagacgggggatgaccgctcaggtgggcatcaccatgccgaggacgaaacccagtgctcccgcaggcgctttgaagacaccggggaccggaaaaactgatgatgccaaagtttccgagaaggggcggttgagcccaaaagcgtcacaggtgaaaaggtcaccatcagatgcagggcggtcttctggcgatgagagtaagaagcccctgccttcctcaagccggaccccaacggcaaatgcgaattcctttggattcaaaaagcagagcggtagtgccgccgggctggctatgataacagcgagtggcgttactgtcacatcaaggagcgccaccctcgggaagatccccaagtcatccgccctagttagccgatccgctggacgaaagtcctccatggacggagcacagaatcaggacgatgggtacctcgcgctgtcctcaagaacgaatcttcagtatagatctcttccccggccctccaaaagcaatagtcgtaacggagcgggaaaccggagcagtacatccagcattgattctaacatctctagcaaatccgccgggctcccagtccctaagctaagagaacccagcaaaaccgccctcggctcctcacttccgggacttgtcaaccaaactgacaaggagaaagggatatctagcgataacgagagtgtggcttcttgcaacagcgtgaaggtaaaccccgcagcccagccagtaagcagccctgcgcagactagcctgcaacccggggcaaaatatcctgatgtagcatctccaacacttaggcgactgtttggcggcaaaccaactaaacaggttccgattgctacagccgagaatatgaaaaattcagtcgttatttccaacccacatgcgaccatgactcaacaggggaacctcgactcaccgtcggggagcggtgtactgtcgagtggatcctcctcgccactctacagcaagaatgtggaccttaatcagtctcccctggcgtctagcccctcctcagctcactccgctccatctaattctctgacctgggggaccaacgcttcttcctccagtgctgtgagtaaagatggcctgggttttcagagcgtgtcttccctccacacctcctgtgaatcaatcgacataagcctcagtagcgggggagtgccctcccacaattcgtcaacgggtctgattgcatcctctaaggacgatagtctcaccccttttgtgcgtactaattccgttaagacgaccttatcggagcgttatactccaacatctcagctccgcacccaggaagacgccaaggagtggctacgcagccattccgcaggaggactgcaggacaccgctgccaactctcccttcagttcaggcagctctgttacttcaccatctggcacgcggttcaatttttctcagctcgctagtcccacgacagttactcaaatgtccctttctaaccctacaatgcttcgcactcactctctctccaacgctgatggtcagtatgatccgtacaccgacagccggtttcgaaacagctccatgtctctagacgagaagtccaggacaatgagccggtctggatccttcagagacgggtttgaggaagtgcatggctcttccctgtcgctggtgagcagcacatcgagcgtgtactcaaccccagaggaaaaatgccagagtgaaataagaaaactccgaagagagctggacgctagtcaagagaaggtatctgccctgactacgcaactgactgccaacgcccacttagtagccgcctttgagcagagcctgggtaacatgacgatccgattgcaaagtctcaccatgacggcagaacaaaaggattccgaactaaatgaactgcggaagaccatcgagctcttgaagaagcagaatgcagcagcacaggcggccattaacggggtgatcaacacacctgagctcaactgtaaaggcaacggtaccgcacagtcagctgaccttaggattcgcaggcagcacagctccgactcagtcagcagcatcaacagcgcgacctctcattctagtgtgggcagtaacattgagtccgacagctag

SEQ ID NO: 197080 - DNA, 7260 bp, Artificial Sequence
  Description of Artificial Sequence: Synthetic coding sequence
atggccatcgacctgtactgcggcctggcctgcctgtggggcatccacgagcctcggcaaatatataccgactgggctaaccactatctcgcgaaaagtggtcataagaggctcatcagggacctgcagcaagatgtgacagatggggtgttactggcacagatcatccaagtggtcgctaacgaaaaaattgaggacataaatggctgccctaagaaccgcagccaaatgattgaaaacatagacgcgtgtctgaactttcttgccgccaagggaatcaatatccaaggccttagtgcggaggagattcgaaatgggaatctgaaagctatcttaggtttgtttttctctctgtccaggtacaagcaacagcagcagcagcctcagaagcaacacctgagttcccctctgcctcccgctgttagccaggttgccggcgctcccagccagtgccaggcaggcactccacagcagcaggtgccggtgacccctcaggctccttgccaaccccatcaaccagccccacaccagcagagcaaagcgcaagccgagatgcaatctagcgcttcctcaaaggattcttcccaatcaaagataattaggtttaccctcggccagaagaagatcagccggctgcccgggcctaccgcaagggtgagcgcggcagggtctgaagctaagacgcgggggggttctacaacagcaaacaacagaaggagccaatccttcaataattatgacaaatccaagccagtgacctccccacctcctcctccctcttcccatgagaaggaaccgcttgcaagttccgcatcctcccatcctgggatgtctgacaatgcgccggcgagcctggaatccggctcctcttccacccccactaattgcagcacatcctcagccataccccagcccggtgcagcaactaagccctggagaagcaaaagcttgagcgtgaagcatagtgctacggtgtcgatgctcagcgtcaagccccccgggcccgaagccccgaggccaacccctgaggccatgaagcctgcacccaataatcagaagtcaatgttggaaaagctgaagctatttaactctaaaggtggaagtaaagctggagaaggacccgggtcaagagatacatcttgcgagaggttggagactctgccatctttcgaagaatctgaagaactggaagctgcatcaaggatgctgacaacggtaggccctgctagctcgagcccaaaaattgcgctgaaaggaatagcccaaagaacctttagccgggcgctgactaacaaaaagagctctctgaagggaaacgagaaagagaaggaaaaacagcagagagaaaaggacaaagagaagtcaaaggacctcgccaaaagagccagcgtaacagaaagattggatctcaaggaagaaccgaaggaggatccgtcgggcgcagctgtcccagagatgcctaagaaatcatccaagatagcttctttcattcctaagggcggcaagcttaatagcgcgaagaaggagccgatggcaccatctcattctggtatccctaaacccggcatgaaaagcatgcctggaaaatccccctccgcacctgcacccagtaaagaaggggaacgttctcgcagcggcaaactctcctctgggctgcctcaacagaaacctcaactggacggacgacacagctctagctccagcagtcttgctagcagcgagggcaagggtcctggaggcacaactctcaatcactccatctcttcccagaccgtttctggctctgttggaaccactcagacaacagggagtaacacagtttcagtacagctccctcagccgcaacagcagtataatcacccgaataccgctactgtggctcctttcctctaccgatcgcagactgacacagagggaaacgtgactgccgagtcttcttctacaggcgtaagcgtggaaccgagccattttacaaagactggccagcccgcactcgaggagctgactggtgaagacccagaggcgaggcgcctgaggaccgtaaagaacatcgccgacctgagacagaacctggaagagaccatgtcaagcttgagaggcacgcaggttacgcatagcacactagaaacgacgtttgatactaatgttaccactgaaatgtcaggccggagtattctgtcacttactggccggccaactcctctgtcctggcgcctgggacagtccagccctcggttgcaagctggagatgccccaagtatgggcaacggttatcctcctcgggcaaacgccagccgcttcatcaacacggagtcaggtcgctacgtctactccgcccctctgcggcgccagctggcgtctcgtggctcctcagtgtgtcacgtagacgtctctgataaagcaggtgatgagatggatttagagggaatctccatggacgctccagggtacatgagcgatggtgacgtactgtcaaagaatattcggacagatgacataacatctgggtacatgactgacggcggcctgggcctctacactcggcgtctcaaccgccttccggacggcatggctgttgttcgtgagacactgcagagaaacacttccctgggattgggcgacgccgattcctgggacgatagttcctccgtgagcagcggtatcagcgatacaattgataatttgtccaccgacgatatcaatacatcgtcgagtatttcctcatacgccaacacgcctgcatccagcaggaaaaacttagatgtgcaaactgatgcagagaaacactctcaggtcgaacggaacagtttgtggtctggcgatgacgtgaaaaaatctgacggcgggtccgattcaggaattaaaatggaacctgggtcaaaatggcggcgaaatcctagcgacgttagtgacgaatccgacaagtctacgagtggcaagaaaaacccggttataagccagaccggttcctggagaagaggcatgaccgcccaggtgggaatcacaatgccaagaaccaagccaagcgcgcccgcaggcgctctgaagaccccagggacaggcaagacagacgatgccaaggtgtccgagaagggtaggctaagccctaaggcttcccaggtgaagagatcgcccagtgacgcgggacggtcaagtggagacgaatccaagaaaccactgccttcatcgagccggacgcctacggcaaatgcaaattccttcggattcaagaaacagtctggtagcgctgcgggattagcaatgatcactgccagcggggttactgtcactagcagaagtgctaccctcggcaagatacctaagtcatccgccttagtgagcaggtccgccggccggaagtctagtatggacggagcccaaaaccaggacgacggctacctggccctgtcttcccggaccaatctccaatatcggtccctgcctagacccagtaagtctaacagcaggaatggcgcaggcaatagatccagtacaagcagcatcgattccaatatctccagtaagtctgctggccttcccgtgcccaagttgagagagccatccaaaacggcacttggcagtagcctccccggcctcgtcaaccagacggacaaagagaagggaatctccagcgacaatgagtccgtggcttcatgcaattcggtgaaggtgaacccagcagcccaaccagtttccagccctgcccagacgtctctccaaccaggagctaaatatccagacgtcgcaagccccactctcagaaggctgttcggggggaaacccaccaagcaggtgccgatagcaacagccgagaacatgaagaatagcgtagtgatcagcaatcctcacgcaactatgacacaacagggaaatcttgacagcccctccggtagcggggtgttgtcctctggaagctcttcccccttatactccaagaacgtggaccttaaccagtccccactcgcttcaagccctagctccgctcattcagccccaagtaactctttgacatgggggacaaatgcttcgagctcctccgctgttagtaaggacggtcttggcttccaatcagtgtcttccctgcataccagttgtgagagtatcgatatttctcttagctcgggaggcgtacccagccataactcgagtacaggcctgatcgctagtagcaaggatgacagcctgacaccatttgtccgcaccaactccgtgaagacaaccctttcagaatcacccttgagctctccagccgctagccccaaattttgcagaagcaccctgccaagaaaacaggacagcgaccctcacctcgatagaaataccctgccgaagaaaggcctgcggtacacgcctacatcccagttgagaacccaagaagacgcgaaagaatggttaagatctcatagcgccggaggccttcaggatactgcagctaactccccattcagcagcggcagttccgtcacgagcccatccggaaccagatttaacttcagccaactcgccagcccaacgaccgtaactcagatgagtctttcaaaccctacaatgctacggacccattcgttgtccaacgctgatggacaatacgacccttacactgactctagatttaggaattcatccatgtcattggatgagaagtcgaggaccatgagccgatctgggtcattcagagacggtttcgaggaagagtcttgggaaaagagcagcgtggataattttgtctcccggcttcactcatccttgcatttctccctcccacttttccatcacgccaggtatgaactggttcacggctccagtctgagtcttgtctccagtacctccagcgtgtactctactcctgaggaaaaatgtcagagcgaaatccggaagctgcgaagggagttggacgcctcccaggaaaaggtgtccgccctcactacacaattaaccgctaacgcacacctcgtggctgcctttgaacaatccctcggtaatatgactatcagacttcagtctttgacaatgactgccgagcagaaagattcagaactaaatgagctgcgcaaaacgatcgagctcttgaaaaaacaaaatgccgctgcacaggctgctattaacggggtgatcaatacacccgagttgaactgtaaaggcaatggcaccgctcagtcagccgatctccgtataaggcgacaacacagttctgattccgtttccagtatcaattccgcgacctcccatagttcagtcggcagtaatattgagtctgactcaaaaaaaaaaaagcgcaaaaactgggtgaacgagttacgctctagttttaaacaagcattcggaaagaaaaaatctccgaagtcagcctcgtctcattcagacatagaagagatgaccgattctagtctgcctagctcaccaaaattgccccacaacgggtccacaggcagtactcctcttctccgaaattcacactccaatagccttataagtgagtgtatggacagcgaggctgagactgtcatgcagctgagaaatgagctgcgtgataaagaaatgaagctgacagacatcaggcttgaagccctgtccagcgcccaccagcttgaccaactccgagaagctatgaatagaatgcagtctgagatagagaaacttaaagccgaaaacgacagactgaagagcgaaagtcaaggcagcggttgttcccgggcaccaagccaagtctccatctccgcatcccctcgccagtcaatgggactgtcccaacatagtctcaatctcacagaatctacatctttggatatgctcctggatgacacaggggagtgttctgcacggaaagagggcggcagacatgttaagatcgtggtgagctttcaggaagagatgaaatggaaagaggactctaggcctcacttatttctcattggttgcatcggcgtcagtgggaaaactaagtgggacgtgctggatggcgtggtgcggcgcctctttaaagaatatatcattcatgtcgacccagtctcacagctggggctcaatagcgatagtgtcctgggctattcaattggcgaaattaagcgaagcaacacctcagagacacctgagctcctcccctgcggctacctggtgggcgaaaatactacaatcagcgtgacagtcaagggcctggccgaaaattctctggactcacttgtgttcgagtccctcatcccgaaacccatcttgcagagatacgtatccttgctgatagaacatcgccgcatcatcctctctggaccctctggcactggtaagacctatcttgccaatcgcctgagcgaatatatcgtcctccgcgaggggcgggagctgacagacggcgtgatcgccacctttaacgtcgatcacaagagttccaaagagttaaggcagtacttgtcgaatctggcagaccagtgcaactccgaaaacaatgcagtcgatatgcccttagtgattattctcgacaatcttcaccacgtttcctcactgggtgaaatcttcaacgggctcctaaattgtaaataccataagtgtccctacattattggcaccatgaaccaagccacctcctcgactcccaacctgcagctccatcataactttcgatgggtgctgtgcgccaaccatacagaacccgtgaaaggctttctcggccggttcctgaggcgaaagcttatggagaccgaaatatccggcagagtgcgtaacatggagcttgttaagatcatcgattggattcctaaggtgtggcaccacctcaaccggttccttgaagcccacagtagttcagatgtaaccatcggccctcggctgtttctgtcatgccctatagacgtcgatggcagccgcgtctggtttaccgacctgtggaactactctattattccttacttactggaagctgtgcgcgagggattacagttgtacgggcgtagggccccatgggaggacccggcaaagtgggttatggatacatacccctgggcggcctcacctcagcagcacgagtggcctcccctgcttcaattgcggcctgaggatgttgggtttgacggctactcaatgccaagagaggggagcacaagcaaacagatgcccccctctgacgcggagggcgatccgctgatgaacatgctaatgcgtttacaagaagccgctaattactcaagcccccagtcctatgactctgattcaaactcaaactctcatcatgatgacatcctggattcttccttagagtcaaccctgtag

SEQ ID NO: 197081 - DNA, 7098 bp, Artificial Sequence
  Description of Artificial Sequence: Synthetic coding sequence
atggagagcgtgagcgagagcagccagcagcagaagcggaagcccgtgatacatggcttagaagaccaaaagcggatctacactgattgggctaaccactatctggcgaaatccggccataagcgactgattcgcgatctgcaacaagatgtgaccgacggagttctgttagctcagataatccaagtcgttgcaaacgagaaaattgaagacatcaacggctgccctaagaatagatctcagatgatcgagaatatcgatgcttgcctgaactttctggctgcaaaaggcatcaacatccagggtctatccgcagaggagattcgtaacggaaacctgaaggcaatactggggctgtttttttctctatccagatacaagcaacagcagcagcagcctcaaaagcagcacctgagttcgcctctaccccccgcagtgtctcaggttgctggggccccttcccagtgtcaggccgggaccccacagcagcaggttcccgtaacacctcaggccccttgccaacctcaccagcctgcgcctcatcaacagagcaaggcacaggctgagatgcagagccggctgccaggacccaccgcccgggtatccgccgctggaagcgaggctaagacacggggcggaagcaccactgcgaacaatcgaaggtctcaatcgtttaataattatgacaagtccaaacccgtgaccagccccccacccccaccatctagccatgagaaagagccacttgcgagctcagcgagctcccaccccggtatgtcagataatgcccctgcatcattggagtcaggcagttcaagcactcctaccaattgcagcacatctagcgccataccccagcccggggccgcaacaaagccatggaggagcaagtctctgagtgttaagcactccgctaccgtcagtatgctgagcgtcaagcccccggggcctgaggctccccggccgactcctgaagcaatgaagcctgcccccaataaccagaagtcaatgctggagaagttgaagctgttcaactccaagggcgggtcgaaggctggcgagggccctgggtcccgcgataccagctgcgagaggctggagactctccccagttttgaggaatcagaggagctggaagccgcttcacggatgctgactacagtgggccccgcctctagctcaccaaagattgcactgaagggcattgcacagagaaccttctctcgagcccttaccaacaagaagagctcccttaaaggtaatgaaaaagagaaagaaaaacagcagcgcgaaaaagacaaggaaaaatccaaggacctcgcgaagagggcgtctgtgacggagagactggacttgaaggaggagcccaaagaggacccatccggggccgccgtccccgagatgcccaaaaaatcctcaaagatcgcgtccttcattcccaaagggggaaagctcaatagcgccaaaaaggaacctatggccccgagccacagtgggattcccaaacccggaatgaagtccatgcctggaaagtcaccttcagctccagcccccagcaaggaaggtgagaggtctcggtcggggaagctttcctccgggctgcctcaacaaaaaccccaattggatgggcgacactcatccagcagctcaagtctggcgtcttcagagggaaaagggcctgggggtacaaccttgaatcacagtattagttcacagactgtgtcaggaagtgtgggaacaactcagacaacagggtctaataccgtgagcgttcagctcccacaaccccagcaacagtacaaccacccgaacacagctacagtggctcctttcctctaccggtcacagactgacaccgagggaaacgtgaccgccgaaagctcctccactggggtgagcgtggagccaagccatttcacgaaaacgggacaaccagcgctggaggagcttacaggcgaggatccagaggcccgacggctgaggaccgtcaaaaatatcgccgatcttagacagaaccttgaagaaaccatgtcttccctccggggaacacaagtaacacacagcactctggagactacattcgatacgaatgttacaaccgagatgtcaggccgcagcattctgtctctgactgggcggcctacacctctctcatggcggcttggtcaatcgagccccaggctgcaggcgggcgatgctccctcgatgggaaatggctatcccccacgggcaaacgcgagccgttttatcaacaccgagagcggacgctacgtttattccgcacctctgcggcggcaattggcttctcgtggttcaagcgtctgccacgtcgacgtctctgataaggcgggggatgagatggacctcgagggtatttctatggatgccccaggttatatgtctgacggagacgttcttagcaaaaatattagaactgacgatataacttctggatacatgacagatgggggcctgggactctatacaaggcggttaaataggctgcctgatgggatggctgtggtcagggaaactctccagcggaataccagcctcggactgggagacgctgatagctgggatgatagcagttccgtatcctcaggtattagcgatactatcgacaacttatcaaccgacgacatcaacactagctcgagcatctcaagctatgccaatacacctgcttcttctcggaagaacctagatgtgcagactgatgccgagaaacattcccaggttgaaaggaacagcctttggagtggagacgatgttaagaaatccgacgggggcagtgattccgggataaaaatggaaccaggatcgaagtggcgcaggaaccctagcgatgtgagcgacgaaagtgataaaagcaccagtggaaaaaagaacccagtgatctctcagaccggctcgtggcggagaggcatgaccgctcaagttggtattacgatgccacggaccaagcctagcgcaccagcaggagcattgaagacccctggaactggaaagacagatgacgctaaggtgtcagaaaaaggccgtctctcaccaaaggcatctcaagttaagcgctctccaagcgacgctggacgctctagtggcgatgaatcaaaaaagcctctcccttcgagcagccggacgccaaccgccaatgctaacagcttcggattcaagaagcagtcaggcagcgccgccggcctggccatgatcactgcctctggagtcactgtgaccagccgctctgctactctcggaaagatccccaaaagcagcgcattagtgtcccgcagcgccggccgcaaatcctctatggacggcgcgcagaaccaggacgatggatacctggccctcagttccaggactaacctccaatatagatcattacccaggccttccaagtcaaacagccggaacggcgctggtaatcggtcctctacctcgtctatcgactcaaacataagctcaaagagcgcaggattgcccgtcccaaaactgagggagccgagcaagactgccctggggtcatcgctgcctggtttggtgaaccagacggacaaagagaaaggtatctccagtgacaatgagagtgttgcaagctgtaactcagtaaaagtgaatccagctgctcagccagtcagctccccggcgcagacttccctccagcctggggcgaaatacccggatgtggcatctccaacattacgtaggttgtttggaggtaaacctaccaagcaagtccccattgccacagccgaaaacatgaaaaattcagtggttatctcgaatccacacgcaaccatgacccagcaaggaaaccttgactcacctagcggctccggggtcctgagctctggcagtagctcacctctgtactccaagaacgtggacctgaatcaaagtcccctagccagcagcccctctagcgcacatagtgcgccaagtaattccctaacctggggcaccaatgcctctagctcaagcgctgtttctaaggatggactcggttttcaaagtgtcagcagtcttcacacgagttgcgaaagcattgacatttcactaagcagcggcggtgtgccaagtcacaacagttcaacaggtctcatagccagttcaaaggatgattctctgacacccttcgtgcgtactaactctgtaaagacaacactgagcgagtcaccactgtcttcacccgccgcctctccaaaattctgtcgcagcacactacctcggaaacaggattcggaccctcacttagaccgcaacacccttccaaagaaaggcttacggtatactcctacctcacagttgcgtacccaggaggacgctaaagaatggctgcgcagccactctgccggcggcttgcaggatactgctgcaaattcccccttttcttcaggatcgtccgtgacttctccttccggcactcgctttaatttttctcagctggcctcacctactactgtcacccagatgtccctatctaacccaactatgttgcgcacacactctctcagcaacgctgatggacaatacgacccatacacagactcgcgcttccgcaattcgagcatgagcctcgatgaaaaatcacgcaccatgtcccggagtggtagtttcagagatggttttgaggaagtgcatggttcctctctaagcttggtgtctagcacatcgtcagtgtattcaactcctgaagaaaaatgtcagagtgagattaggaagttaagaagagagctggatgcctctcaggaaaaggtcagtgccctaacaacacagctgacagctaacgcccatctcgtggctgcgtttgagcaatctctggggaatatgacaattaggttacagtctctcaccatgactgccgagcaaaaggactccgagctcaacgaactcaggaagactatcgagttgctcaagaagcagaacgctgccgcccaggccgccatcaatggggtgattaatacaccagagctgaactgcaagggcaatggcacagcacagtctgccgacctaagaatacgacgccaacacagcagcgattccgtctcctccattaacagcgccacatcccactcctctgttgggtcaaacatcgaaagtgattctaaaaaaaagaagcgcaagaactggctgcgaagcagcttcaagcaggcttttgggaagaaaaaatcccctaaatcagcttctagccactccgatatagaagagatgactgattcatcattgccaagcagtccaaaactcccacataacggctcaacaggcagcactcccctgctacgcaactcccactctaactcacttatctctgaatgcatggacagtgaagcggagacagttatgcagttacggaatgagctacgggacaaggagatgaagttgacagatatccgattggaggctctatctagcgctcaccagttggaccagctgcgtgaagccatgaataggatgcagagtgaaattgagaaactgaaagcggaaaatgatcgcctcaagagcgagagtcaaggttctggttgttccagagccccaagtcaggtatcaatctccgctagccctcgccagtcaatgggcttatcacaacactcactcaatctcactgagtcgacaagcttggatatgctgcttgatgacactggcgagtgttcagcccggaaagagggcggtcgccacgtgaagatcgtggtaagcttccaggaagagatgaagtggaaagaagacagccggcctcacctttttcttatcggctgcatcggggtcagtgggaagacaaaatgggatgttctagatggcgtggtccgccggctgttcaaggagtatattattcatgtggatcccgtgtcacagctgggactgaacagcgatagcgtgcttggctactctataggtgagataaaaagatccaatacgtccgaaacccctgaacttctgccctgcggctacttggtcggagaaaacacaacgattagcgtcacagtgaaaggcttagctgaaaactccctggattccctcgtcttcgagtcgttgatacctaagcccattctccagagatacgtgagccttctgatagagcaccgtagaatcattttatcgggacctagtggaacaggcaaaacttacctcgctaatcgactgagcgaatacatcgtgctgcgggagggacgcgagctgactgacggggttatagcaactttcaacgtagatcataagagctccaaagagctgcgccagtatctatccaacctggctgatcagtgcaactccgagaacaacgcagtcgacatgcccctggtaattatcctggataatctgcatcacgtgtccagtctgggcgagatcttcaacgggctgctgaactgcaaataccacaagtgcccatacatcattggcacaatgaaccaggccacatcaagcaccccaaacctccagctacatcacaactttagatgggttctttgtgcaaatcacactgagccagtgaaaggattcctcggaaggttcctgaggaggaaattgatggaaaccgagatcagtgggcgcgtgaggaacatggaacttgtcaaaatcattgattggattcctaaagtgtggcatcacctcaaccgcttcctcgaagctcactcatcttcggatgtcacaatcggcccacggcttttcctgtcatgccctattgacgtagacggtagccgcgtgtggtttactgatctgtggaattactccatcatcccatacctgctcgaagccgtgcgtgaggggctccagctgtacggccgacgcgcgccatgggaggacccagctaagtgggtgatggatacctatccttgggcagcatcccctcaacagcatgaatggccccctcttctgcaattgcggccagaggacgtaggctttgatggttactccatgccacgcgaaggcagtaccagtaagcaaatgccaccaagcgacgcagaaggggaccctctgatgaatatgcttatgcgtctgcaggaagccgccaactattcatctccccagtcatacgactctgactcaaactccaactcccaccatgatgacatcttggactcaagcctagagagtacattgtag

SEQ ID NO: 197082 - DNA, 1089 bp, Artificial Sequence
  Description of Artificial Sequence: Synthetic coding sequence
atgttcagcagcgtggcccacctggcccgggccaaccccttcaacaccccccatctccaattagtgcacgatgggctcggtgatcttagatcaagcagcccgggccctactggccagcctcgccggccgaggaatttagccgccgccgctgtggaggaacaatacagctgcgactatgggagcggacgcttttttatcctctgcggactcggaggcatcatctcctgtggcactacacatactgccttagtgccactcgacctcgttaaatgccgcatgcaggtcgacccccagaaatacaaaggaatcttcaatggctttagtgttactctgaaggaggatggtgtgcgcggactggctaagggttgggccccaactttccttgggtactccatgcaaggcctgtgtaagtttggtttctatgaggtatttaaggtgctgtactccaacatgctgggggaggaaaacacatacttgtggcgtacaagcctatacctggctgcctccgcaagtgccgaattttttgccgacattgccttagccccgatggaggctgctaaggttagaattcagacccagcccggctacgctaataccctgagagacgctgcacccaagatgtataaggaagaaggcctgaaggccttttataagggcgtggctcctctctggatgagacagattccctacactatgatgaagtttgcctgcttcgaaagaacagttgaagcgctttacaaattcgtggtccccaagccccgttccgaatgctctaagcccgagcagctcgttgttactttcgtcgcaggctatatagccggcgttttttgcgctattgtgagccacccagcagactccgtggtgtccgtgttaaacaaggagaaagggtcaagcgcctctttggtgctcaagcggctgggcttcaagggggtctggaaaggcctgttcgctagaataataatgatcggtacactaaccgccctccagtggttcatctacgactcagtgaaggtatacttccgactgcccaggccgccaccccccgaaatgcctgaatccctcaagaagaagcttgggttaacacagtag

SEQ ID NO: 197083 - DNA, 6561 bp, Artificial Sequence
  Description of Artificial Sequence: Synthetic coding sequence
atgcccgtgctgggcgtggccagcaagctgcggcagcccgccgtggggagcaaaccagtgcataccgcccttccaattccaaatttggggaccactggctctcagcattgctctagcagacctttagagctgaccgagaccgaatcgtccatgctttcctgccagctagctctgaagagcacatgtgagttcggggagaaaaaaccacttcaaggcaaagctaaggagaaagaggacagtaagatctacacagactgggccaaccattacctggctaagtccggccacaaaagactgatcaaagacttgcagcaggacatcgccgatggcgtgcttctagccgagataatccagatcatcgcgaacgagaaggtggaagatattaacggatgtccaagaagccagtcccagatgattgaaaacgtggatgtgtgcctcagctttctcgccgctagaggggtcaacgtgcaaggcttgagcgctgaagagatccggaacggcaacctgaaagctatcctggggctgttcttctcgctgtctagatataagcagcagcagcaccaccagcaacagtattaccagtctctggtcgagcttcaacagagggtaacacatgcaagccccccttccgaggcgagccaggctaagactcagcaggacatgcagagctctttggctgcgcgctacgctacacagagtaatcattctggcattgccaccagtcagaagaagccgactcgactccccggcccatcaagagtgccagccgctggcagctcaagtaaagtccaaggggcttctaatctgaatagacggagccagtcttttaactctatcgataaaaacaagccaccaaattacgcaaatggcaatgaaaaagacagcagcaaaggtccccaatcatcatctggggtgaacggtaacgtacagccgccttcaacagccggtcagcctcctgcttcagctatacccagcccaagtgcttcaaaaccttggcggtccaagtctatgaacgtgaaacacagcgctactagtaccatgttgactgtgaaacaatctagtacggccacaagccctacccctagtagcgatagactgaagcctccggtttctgaaggcgtaaaaaccgcccccagtgggcagaaaagcatgttagagaaattcaaactagtgaacgcccggaccgctctacggcctcctcagcctcctagtagtgggccttcagatggaggaaaagatgatgatgcgttttcagaatctggggaaatggagggcttcaacagtggtcttaacagtggagggagtaccaactcatcccctaaggtgtctccaaagctggcaccaccaaaggctggcagtaaaaatctcagcaataagaaatcccttctccaaccaaaagagaaagaagaaaaaaatcgtgataagaacaaggtgtgtaccgaaaaacctgtaaaagaggaaaaggatcaggtcacggagatggcacccaaaaagacctccaagattgcctctttaatcccaaaaggctcgaagacaacggcagctaaaaaagaaagcttgatccctagtagttccggcatccccaaacctggttcaaaagttcccacagttaagcagacaattagcccagggtctaccgcaagcaaggagtcagagaaatttagaaccaccaaaggttcccccagccagagtctctcaaaaccgatcactatggagaaggctagcgcctcctcctgtcctgcccccctggagggtcgtgaggctggccaagcttctccgagcgggtcatgtaccatgaccgttgctcagagttctgggcagagcaccggcaatggggctgtccagctcccgcagcagcagcagcacagccatccaaataccgcaaccgtcgccccattcatttacagggcgcacagcgagaatgaggggacagctctcccctccgctgactcatgcacttctccgacgaagatggatctgtcctacagcaaaactgcgaaacagtgtttggaagaaatttcaggcgaagatccagagacccgccgtatgaggacagtgaagaatatcgccgatttgagacagaatctcgaggaaaccatgagttctctccgcggcacccaaatatcacatagcacgctggagactaccttcgactcaacagtgacaaccgaggtcaatggccggacgattccaaacctaacttcccggccaacgcccatgacctggagacttggacaggcatgtccaagactgcaggccggcgatgcaccaagtctgggtgccggctacccccggtcgggcacttctcggtttatccacactgatccttcccgcttcatgtataccacgcctctgcgaagggcagccgtcagccgccttggaaacatgtctcagatcgacatgagcgaaaaagcctcatccgatctcgacatgtccagtgaggtggacgtggggggttacatgagtgacggagacatattgggaaaaagtttgcggactgatgatatcaattccggatatatgaccgatgggggtctgaatctctacactcggtcactgaaccggataccagataccgctacttcccgtgacataatccaaagaggggtgcacgacgttaccgtggacgcggatagttgggacgactccagctcggtttccagcggcctgagcgataccctcgacaatattagtaccgatgatctgaacactacatcatcagtttcaagttacagtaacatcaccgtccctagccgcaaaaacacacagctgaggacggatagtgagaaaagatccactacagacgaaacttgggactcccctgaggagctgaagaagccggaggaggattttgattcccacggtgatgcaggggggaaatggaaaacggtcagctccggcttgccagaagacccagaaaaggcaggacaaaaggcatccctgtcagtgtcgcagaccggctcttggcgccgagggatgtctgcgcaaggcggagctccgtcccgacagaaggccggcacctccgccctgaaaaccccagggaaaactgacgatgcaaaagcctcagagaagggtaaagcaccattaaagggatccagcttgcaacgaagtccgtctgatgcggggaaaagtagtggggatgaagggaagaagccaccctccgggattggcagaagcaccgccacctcttcattcggttttaagaaacctagtggtgtgggctcatctgcgatgatcacatcttcgggtgctaccattacctctggctctgctaccctggggaagattccgaagtcagctgcgatcgggggaaagtcgaacgcgggacgaaagacaagcctcgacggaagccagaaccaggacgatgtggttctgcacgtgtctagtaaaacaaccttgcagtacagatctttgccgcggccaagcaagtcatctactagtggcatccctggtagaggcggccatcggagctcaactagtagcatcgactccaatgtgtcatccaaaagtgctggagctactacatctaaactgagagagccaactaagattggtagtgggcgttcctcccctgtaacagtgaatcagacggataaggaaaaggagaaggtggctgtatctgactccgagtccgtgagtttgtccggatcaccaaaatcatctcccacttcagctagcgcctgtggggcccaagggctccgacagcctgggagcaagtatcccgatattgcatcccctacgtttcgaagatacacacctagctcacggcaggccaaccaggaggaagggaaggaatggcttaggagccactctaccggcggacttcaggacaccgggaaccagtctcctttggtttccccctccgcgatgagttccagtgctgccggcaaataccatttttctaatctggtcagccccaccaacctgagccaattcaatctccctggcccaagtatgatgagatccaacagcataccagcccaggacagctcatttgatctctatgatgacagccagctgtgtggcagcgctacttcccttgaggagagaccacgagccatttcacacagcggatcctttagagactcaatggaggaggtgcacggttcttctctgtcactggtgagttctacatcttctctttattccacggccgaagccggtggctctttggaacagatccacaagctgcggagggaactggttgcttcccaggagaaagtggccacattgacctcccagctttctgccaatgcccatctcgtcgcggcttttgagaagtccctgggaaatatgactggccggctccagagcctcactatgaccgcagagcagaaggagtctgaacttatcgagttaagggagactattgagatgctgaaggctcagaattcagctgcccaagctgctatccagggggccctgaacgggccagaccatccaccaaaagatctgcgcataagacgccaacactctagtgaatctgtgagctcaattaactcagcgaccagtcacagctctataggctctgggaacgacgcagacagcaagaagaagaaaaagaaaaactgggttaactctcgcgggtctgagctgcgaagcagtttcaagcaggcattcgggaagaaaaaatctacaaagcctcccagtagccactctgacatcgaggagctgaccgactccagcctgcccgcgagtcctaaactgccccataacgcaggggattgtggctctgccagcatgaaaccaagtcaatcagctagtgctatttgcgagtgcaccgaagcagaggctgagattattctgcagctgaagagcgaactgcgggagaaggagctgaaactaactgatatacgcctcgaagccctctcaagcgcacaccacctggaccagattagggaagcgatgaacaggatgcagaacgaaattgagatcctaaaagctgagaacgacagacttaaggccgagacaggtaacacagcaaaacccacaaggccaccatccgagagctcctcttctacctccagctctagctcccgacagtctctgggcttgagcctgaacaatctaaacatcactgaggctgtgtccagcgacatcctcttagacgacgccggcgatgccacagggcataaagacgggaggagtgtcaaaattatcgtgtcaatctcaaaaggatatggccgcgccaaggatcagaaatcccaagcctacctcatcgggagtatcggagtatctggcaaaacaaagtgggacgtgctggatggtgtgatccgccgactgttcaaagaatatgtcttccggatcgatacatcaacctcactgggactgagcagcgactgcattgcgagttactgcattggagatctcatcaggtcacacaatttggaggtgcccgagctgctcccgtgcggatatctggtcggcgacaataacatcattacagtgaatcttaaaggagttgaagagaattcactggattctttcgttttcgacacactcatccctaaaccaatcactcagcggtacttcaatctcttgatggaacatcatcgaatcattctgtccgggccaagcgggactggcaagacctatctggccaataagctggctgaatacgttatcaccaaatcaggcagaaaaaaaaccgaggacgcaatagccacctttaacgtagatcacaagagttccaaagaactgcagcagtacctggccaacctggctgagcaatgtagcgccgacaataacggggtggaattgccagtggtgatcatactagataatctgcatcatgtgggctccctttctgatatatttaatggtttcctgaattgcaaatataataagtgcccatacatcatcgggacaatgaaccaaggcgtcagttcttcccccaacctggaactccaccataactttcggtgggtgctatgcgccaaccatactgagcctgtgaaaggctttctggggagatatcttcggaggaaactgatcgaaatagaaatagagagaaatatacgtaacaatgatctggtgaaaattatcgattggatccctaaaacttggcatcaccttaattcctttttggaaactcattcctcttcagatgtcacaatcggacccagactgtttctgccatgcccaatggacgtcgagggctcccgtgtctggttcatggacctctggaattattcgcttgtcccctatatcttggaggcggttagggaagggcttcagatgtacgggaaacgcaccccatgggaggatccgtccaaatgggtgctggatacgtacccctggtcttccgccacactgcctcaagaatctccggcactccttcaactgcgcccagaggatgtgggatacgagtcttgcacaagcaccaaggaagctaccacatccaaacatattccccagaccgacactgaaggggatccactcatgaacatgctgatgaagttacaggaggcagccaattacagcagtacccagtcatgcgattcagaaagtacttcacatcatgaggacatcctggattccagtctagaaagcactctgtag

SEQ ID NO: 197084 - DNA, 2376 bp, Artificial Sequence
  Description of Artificial Sequence: Synthetic coding sequence
atgaccagcctgcacaccagcagcgagagcatcgacctgcccctgagtcatcatggttccctttccgggctcacaacaggcactcatgaggtgcaatctcttttaatgagaacaggcagtgtcaggtccaccctctcggaacgctacactccatcttcccggcaggctaatcaggaggagggtaaggagtggctgcggagccattccaccggaggactgcaggacacagggaaccaatccccactggtgtctccaagtgctatgtcatcttcagcggccggaaaataccatttttctaatcttgttagccccacaaacctaagccaattcaatctacccgggccatcaatgatgagaagcaattccatacccgcccaggactctagcttcgacctatatgatgattcccagctctgcggcagtgccacaagcctcgaggaaagacccagagctatttctcatagtggttctttcagagactcaatggaagaggtccatggctccagtctcagcctggtaagttccacttcctctctatactctaccgccatccagaaacctaatatacaacagattcataaattgcgcagagaattggtggctagccaggagaaggtagcaacactgactagtcaactgagtgctaacgcccatctcgtggccgctttcgagaaaagcttaggtaacatgacgggacgtctccagtccttgactatgactgccgaacagaaagaatccgagctaatcgaactacgagagacgattgagatgctcaaggcacagaattcggcagcacaggcagccatccagggggccctgaacgggcctgaccaccccccgaaagatctacgcattcggagacagcattcaagcgaatcggtcagtagtattaattccgctacttcacatagctccatagggtctgggaatgacgccgactctaaaaagaaaaagaagaagaactggctaaggtctagtttcaaacaggccttcgggaaaaaaaaaagcaccaagcctcctagttcccacagcgatatcgaagagctaactgattcctcactgccggccagcccaaaacttcctcacaatgcgggcgattgcggtagcgcatctatgaaacctagccagagtgcgagcgctatctgcgagtgtaccgaagcggaagccgagattatactccaactgaagtccgaactgagagaaaaagagctgaaacttaccgatattaggctcgaggcactgtccagcgctcaccatctggatcagatccgggaagccatgaataggatgcagaatgagattgaaatcctcaaggctgagaatgacagactgaaagccgaaacaggaaatacagcgaaacctacacggccaccgtccgaaagttcgagttcaacgtcatctagcagcagtagacaatctcttggccttagtttgaacaatctgaatattaccgaggctgtcagtagcgatatcctcctggacgatgctggagacgctaccggccataaagacggccgctcagtcaagattatcgtcagcatcagtaaggggtacggccgcgcaaaggatcagaagtcccaagcctacttaataggttctattggcgtgagtggcaaaaccaaatgggacgtgttggacggcgtgattaggagactgttcaaggagtacgtgttcaggattgacactagtacctctctgggcctaagcagtgattgtatcgcatcttactgcattggggatttgatcagaagccacaacttagaggtgcctgaactcttaccgtgcggatatctggtcggcgacaataatatcatcaccgttaatctcaaaggtgtcgaagaaaactctctcgattccttcgtgtttgacactctgattccgaagcccatcacacagcgctatttcaacctgctgatggaacatcatagaatcattctctcagggccaagcggcacggggaaaacataccttgccaataagctcgctgagtacgtgataaccaaaagtggacgcaaaaagaccgaagacgccattgccacattcaacgtcgaccacaagagctccaaagagcttcagcagtatctggcaaatctcgcagaacagtgctcagctgataacaatggcgtcgagctccctgtggtgattattctggacaacctgcatcatgttggttctctgagcgacatcttcaatggcttcttaaattgcaagtataataagtgcccgtacataattgggacaatgaaccagggggtgagctcctctccaaacctagagctgcaccataatttccggtgggttctgtgcgctaatcataccgaaccagtcaagggattcctcggtcggtatctacggaggaagctgattgagatctag

SEQ ID NO: 197085 - DNA, 7158 bp, Artificial Sequence
  Description of Artificial Sequence: Synthetic coding sequence
atgcccgtgctgggcgtggccagcaagctgcggcagcccgccgtgggtagtaagcccgtgcacacagcgctgcctatccccaatctgggaacgaccggctctcagcattgctcttcacggccactggagctgactgaaactgagtctagtatgctgtcatgccaactcgccctgaaatcaacctgtgaattcggagaaaaaaagccactccagggaaaggcaaaggaaaaagaagattccaagatttacaccgactgggcaaatcactatttagccaaaagcggacacaagcggctgattaaagatctccaacaggacattgcagatggcgtgctgctggcagagattatccaaatcatcgcaaatgagaaggtagaggacattaacggctgtcctcgttctcaatctcagatgatcgaaaacgtagacgtatgtctctcctttctagctgcccggggcgttaatgtccaaggcctatcggctgaggaaatccggaatggtaacctgaaagccatactagggctgttcttcagcctatcccgatacaagcagcagcagcatcaccagcaacaatattaccaatccctcgtcgaactccagcagagggttactcacgcctctcctcccagcgaggcctctcaggcaaagacgcaacaggacatgcaatcatcgttggccgcaagatacgcaacacagagcaatcattccggtattgccacatcccaaaagaaacccactagactccccggacctagccgtgtccctgcggccggcagtagctccaaggtacaaggcgcatctaatttaaatcggcgctctcaaagcttcaatagtatcgacaagaacaagcctcccaattatgcaaatggcaatgaaaaagactcttccaaggggccacaatcaagcagtggcgtgaatggcaacgtccagcctccatcgactgcggggcagccacctgcttcagcaatccctagtcccagcgctagcaaaccctggcgttcaaagtccatgaatgttaagcactcagcaacttccacaatgctcactgtcaagcagtctagcaccgccaccagccccacgccgtcctctgatagactcaaacctcccgttagcgagggcgtgaagacagcacccagcggtcagaaatcgatgctcgaaaagtttaagctcgtcaacgcaaggacagctttgcgacctccacagcctccgtcctcaggtcctagcgatggcgggaaggatgatgacgccttcagcgaaagtggcgaaatggaaggatttaactcagggcttaattccggtggctccaccaatagctcgccaaaagtctctcccaagcttgcccctccgaaggctgggtccaaaaacctctccaataagaaaagcctgttacagcctaaggagaaagaagaaaagaatcgggacaaaaacaaggtgtgcacagagaagccagtgaaggaagaaaaagaccaagtcactgagatggcccccaaaaagaccagcaagatcgcttcactgattccaaagggaagtaaaactactgcagccaagaaagagtctctgattccctcttccagcggaatcccgaaacccgggagcaaagtgccaacggtcaagcagacaatatctccagggtccactgccagcaaggagtctgaaaaattcaggacaaccaagggctccccttcccaatccctgagcaagcccatcaccatggaaaaagccagcgccagttcctgtcctgccccgctggaaggccgcgaggccgggcaggctagcccttccggatcttgcactatgaccgtcgcgcagagcagcggccagagcactggcaacggcgccgtgcagctgccacaacagcaacagcacagccaccccaacaccgccacagtggcccccttcatttaccgggctcattccgagaatgaggggaccgccctgcctagtgcagattcctgtaccagccccaccaagatggatctctcctacagcaagacagcaaaacaatgcctcgaggagatttccggcgaggatcccgaaacaagacggatgaggacagtgaaaaatattgctgacctccgacaaaatttagaagaaacgatgtcgtccctgagaggcactcagatttctcattcaacattagagaccacattcgattctactgtgacaaccgaagttaatggtaggaccatcccaaatctgacctctaggccaactccaatgacgtggagactgggacaagcgtgccctaggctgcaggccggagatgccccgtcgctgggggccggatacccccggagtggcacctctcggttcattcatactgatcccagccggtttatgtacaccacacccctgcggcgggctgccgtgtccaggcttggcaatatgagccagatcgatatgtcggaaaaggcatcctccgatcttgatatgagttctgaagtagacgtgggtgggtacatgtcagacggcgacatcttggggaaaagtttgaggacagacgacattaattctgggtatatgacagatggcggactcaatctctatacccggtccctgaatcggattccagatactgccacttcacgggatattattcaacgcggggtacacgatgtcaccgttgacgccgatagctgggacgacagttccagcgtttcgagcgggttaagcgacactctcgataatatttctactgatgaccttaacacaacctcttcagtgagctcatatagcaacattacagtcccctcaaggaagaatacccagctgaggaccgatagtgaaaagcgctccaccacagacgagacatgggactcgcctgaggagctcaagaagcccgaagaggactttgatagtcacggcgacgcaggcgggaagtggaagacagtcagctctggtctgccggaggatcctgaaaaggccggccagaaagccagcctgtctgtctctcaaacaggctcttggcgccgcggaatgtctgctcagggaggcgcgccaagtcgccagaaagctggtacgtctgccctcaagactcctggtaaaaccgacgatgctaaggcaagtgaaaaggggaaagccccactgaaggggagctccttacaaaggagtcctagtgacgccgggaaatcatcgggggatgaggggaagaagcctccctccggcatcgggaggtcaacagccactagcagtttcgggtttaagaaacctagcggtgttgggagttccgcaatgatcacatcaagcggtgccacaattacttctggatcggccacactcgggaagatccctaaaagcgccgcaattgggggcaagagcaatgccggccgcaaaacatcgcttgacggaagccaaaaccaagacgacgtggtattgcacgtgtcaagtaagacaaccttgcagtaccgttccctccctcggccaagtaagtcaagcacgagtggaatcccaggacgaggtggtcaccgctcgtctacttcgagcattgatagcaacgtatcatccaagtcagccggagcaactacaagcaagctccgcgagcccactaagatcggcagtggaaggagttcccctgtgaccgttaaccagaccgataaggagaaggagaaagttgcagtgtccgactctgagagcgttagtctcagcggctcgcccaagtccagtccaactagcgctagcgcatgcggtgcccagggcctgcgccagccaggatcgaaatatccagacattgcaagccctactttccggcgtttgttcggggcaaaagcggggggcaaaagcgcaagtgccccaaatacagagggcgttaagtcctcctcagtgatgccgtcgccatccaccacacttgcccgccaaggctcccttgagagtccctcctctggaacaggaagcatgggcagcgctggtggactttctggaagctcaagcccgctgtttaataaaccatccgacctcacgactgatgttatctctctgagccactcgttagctagcagccctgccagcgttcacagcttcacaagtgggggattggtgtgggccgccaacatgtcctcttctagtgccgggtctaaggacacgccctcgtaccagtctatgacatccctccatacctcatccgaatccatcgacctgccactcagccatcacggctccctgtctggtctcactactggtacacatgaagtgcagtctctgttaatgcgcactggctcagtacggagtaccctttccgagtccatgcagctggatcgaaacaccctgcctaaaaaagggctaaggtacactcctagttcaagacaggcgaatcaggaagaggggaaggaatggctgcggtcacactctacagggggcctgcaagatactgggaatcaatcccctttagtgagcccatccgccatgtcctcctccgccgccggaaagtatcacttcagcaacctagttagtcccacgaacctcagccagtttaacctcccaggccccagtatgatgagatctaatagcatacccgctcaagattctagctttgatctttacgacgattcccagctgtgcggctccgcaactagcctggaggagaggccccgcgccatcagtcactcgggttcgtttcgagacagtatggaggaagtccatggttcttcgttgagtcttgtgtcgagcacctctagcctgtacagtacagcagaggaaaaagcccattcggagcagatccacaagctgaggcgcgagctggtagcctcccaggagaaagtggcgactctgactagccagctgtcggccaatgcccatctggtagccgcctttgaaaagtccctgggcaatatgaccggcagactgcagtctttgacgatgactgctgagcagaaagagtcagagctgatagagctaagagagacaattgagatgcttaaggcccagaattctgctgctcaggcggccattcagggcgcactcaacggtccagaccatccccccaaagacctgcgcataaggcgccaacactcatctgaaagtgtctctagcataaactcagccacttctcattccagtattggctcaggtaacgatgctgattccaagaaaaaaaaaaaaaaaaattgggtgaacagtcgggggtccgaactcaggtcatcgtttaagcaagcgttcggcaagaaaaagtccactaaaccacctagctcccatagcgatattgaagagctgacggatagcagtctacctgcttcacccaaacttccccataatgcaggcgattgcggcagtgcaagtatgaagccctcccagtccgcaagtgcctcacctctggtttggcctccaaagaagagacagaatggacctgtgatctacaaacacagatcacggatctgtgaatgtaccgaagctgaggctgaaatcatcctccagctcaaatcagaattgcgggagaaggagcttaaactgactgacatccggctggaggcgctgtcctctgcccaccacctggatcagatacgcgaggcgatgaatcggatgcagaatgagattgagatactgaaagccgagaatgaccgcctcaaggccgagacaggaaatactgcaaagcctacaagacccccatccgaatccagctcttccacgagctcgagcagttcacgccaaagcttgggcctctcacttaataatttaaatatcacagaggccgtttcaagtgatattcttcttgatgacgccggtgatgctaccgggcacaaagatggtcgatccgtcaaaataatcgtgtctatcagcaaggggtatggcagagccaaagatcagaagtcgcaggcgtacttaattgggagcattggtgtgagcgggaaaacaaagtgggatgtgttggacggggttatccgacggttgttcaaggagtatgtctttcggatagatacctctacttcactaggcctgtcgagtgattgtatcgctagctattgtattggcgatctaatacgttcccacaacctggaggtgcctgaactgctgccctgcgggtacttggtcggggataacaacattatcacggtaaaccttaaaggcgtcgaggagaactcgttggattcattcgtgttcgatactcttatccccaagcctatcacacaacgatacttcaacttattgatggaacaccatcgaattattctgtccggccccagtggtactggcaagacctacctcgccaataagctggccgaatacgtgattactaagagcggtcgcaaaaagactgaggatgctattgcaactttcaatgttgaccataaatcctctaaggaactgcagcagtaccttgccaacctggctgagcagtgctccgccgacaataacggggtggaacttcctgtcgtcattattttagacaacttgcatcacgtggggtcactgtctgatattttcaacggcttcctgaactgtaagtacaacaagtgcccctatatcattggtaccatgaaccagggcgtctcatcatctcctaacctggagttacatcataatttcaggtgggtgctctgcgcaaaccatacggaaccggtcaaagggtttctggggcgctacctgcggaggaaactaatcgagattgaaatcgagcggaatatcaggaataacgacctcgtgaaaatcatcgactggatcccaaaaacttggcaccacctgaactctttcttagagacacactcttctagcgacgtcacaataggaccgcggttatttcttccctgtcctatggatgtagagggatcaagggtctggttcatggacctgtggaattactccctcgttccttatatcctggaggccgtgcgggagggactgcagatgtacggaaagagaacaccttgggaggatccctccaagtgggtgttggacacttatccttggagctctgctactctgccccaagaaagtccagccctcttgcagctgcgccccgaggacgtgggatacgaatcatgtacaagcactaaggaggccaccacatctaaacacatcccccagacggacactgaaggtgacccccttatgaatatgttgatgaaattgcaagaggctgcaaactattcttcaacacagtcatgcgactcagagtctacgtcccaccatgaggacattctggacagcagccttgagtcaactctttag

SEQ ID NO: 197086 - DNA, 7092 bp, Artificial Sequence
  Description of Artificial Sequence: Synthetic coding sequence
atgcccgtgctgggcgtggccagcaagctgcggcagcccgccgtggggtcaaagccggtccataccgccctgcctatcccgaacctgggaacaaccgggagccagcactgcagtagccggccattagagctgacagaaacagaatcatccatgttatcttgtcagcttgctctaaagagcacttgcgaattcggagaaaaaaagccgttgcagggcaaggctaaagagaaagaggattcaaagatctataccgattgggccaatcattacctcgcaaagagcgggcacaagcggctgatcaaggacttacaacaggacatcgcagatggagtcctcctggccgagataattcagatcatcgcgaatgaaaaagtggaagacattaatggatgccctagaagccaatctcagatgatcgaaaacgttgacgtgtgcctatcctttttggctgcacggggagtgaacgttcagggactgtccgcggaagaaattagaaacggcaatcttaaggccattctggggctctttttcagcttgagcagatacaaacagcagcagcaccaccagcagcagtattaccagtctctggtcgagttacagcagagagttacccacgcctctcctcctagtgaggcctcccaggctaagactcagcaagacatgcaatccagccttgccgcaaggtatgccactcaaagtaaccacagcggtatcgcgacttcgcaaaaaaaacccacacgtttaccgggtccctcacgcgtgcccgcagctgggtctagctcgaaagttcaaggcgcttccaacttgaatcgtcggtcccagagtttcaactccattgataagaataaaccgcctaactacgctaatgggaacgagaaggactcctctaagggcccccagtcttcctccggggtgaatggaaacgtgcagcctccctccaccgctggccagcccccagccagtgccattccgtccccgagcgccagtaagccctggagaagtaagagtatgaatgtcaagcattctgccacctccacgatgctgaccgtcaaacagtcatccacagctactagtcctactcccagcagtgatcgtctcaagcctcctgtgtccgagggagtaaaaaccgctccaagcgggcagaagtcgatgttagaaaaattcaagcttgtcaacgctcgcaccgcccttaggcccccccagcctccgtccagtggacctagcgacgggggaaaagacgacgacgccttctctgagtccggggagatggagggtttcaattctggcctgaactccggcggctcaactaactcaagccctaaggtgtcacctaagctggcgccacctaaagccgggtccaaaaacttatccaacaaaaagagcctcctgcagcctaaggaaaaagaggaaaagaatcgggacaagaataaggtttgcaccgaaaagccagtcaaggaagagaaggaccaggtgacagagatggcgccaaaaaagactagcaaaatagcttctctgattccaaaaggtagtaaaaccaccgccgccaaaaaggagagcctcatcccgagcagctctggaataccgaaaccaggtagcaaagtgcctacggtcaaacaaactatctccccaggatcaacagcctccaaagagagcgaaaagtttagaaccactaaaggttccccgtcacaatccttatccaaacctatcaccatggagaaggcatccgcttcatcctgtcctgccccattagagggacgggaagcgggccaagccagtccatccggttcgtgcaccatgaccgtggctcagagctctggacagtcaacagggaatggggccgtccagctacctcaacagcagcaacattcccatcctaacacagcaaccgttgcgccatttatttatcgcgcacactccgaaaatgagggtacggcgctcccctccgccgacagttgcacctctcccaccaaaatggacttaagctattctaagactgctaaacagtgcctggaggaaatctctggtgaagatccagagacacggcggatgcgaacagtgaagaatatagctgatttgagacaaaatttggaagagaccatgagctcattacgagggactcagatatcacacagtacgctcgagacgaccttcgatagcactgtgaccactgaggtgaacggtaggaccatcccaaatttaactagcaggccaacccccatgacgtggagactggggcaggcttgccctcgactgcaggctggagatgcgcccagtctgggcgcgggatacccacggtcgggcacatctagattcatccacacggacccttcacgattcatgtataccacacctctccgccgggccgccgtgtctcgactgggcaacatgtcccagatcgacatgtcggagaaggcctcctctgatctcgacatgagctctgaggtcgacgtcggcgggtatatgagtgacggggatatccttgggaagagccttagaactgatgatataaattccgggtacatgactgatggcgggctgaatctatatactcgctctcttaatagaatacccgatactgctaccagccgagatattattcagaggggtgttcacgatgtcaccgttgatgctgattcgtgggacgactctagttccgtctcctcgggtttaagtgacaccctggataacatctccacagatgacctgaataccacgtcaagcgtgtcttcatactccaacatcaccgttccaagccgaaaaaatacgcagttaaggaccgatagtgagaagcgatccacaacagacgagacctgggactcacccgaggagctgaagaagccggaggaggacttcgactctcacggcgacgccggaggcaaatggaagaccgtgtcatcgggcctccccgaggatccagagaaggcaggacagaaagcgagcttgagcgtgtcacaaactggttcctggcgccgtggaatgtcagcacaggggggtgcgccatcgaggcagaaggccgggacatcagccctgaagacccccggaaagaccgatgatgcaaaagcctccgaaaaggggaaggctcccctgaaggggtcttccctccagcgctcccctagcgacgcaggtaagagcagcggggacgaggggaagaagcccccgtccggcataggtagatccacagccacgtctagcttcggcttcaagaagccgagtggggtcggctcatcggccatgataacgtcgagtggcgccacaataaccagtgggtccgccacgcttgggaaaattcctaagtctgcggctatcggaggtaaaagcaacgccggtcggaagactagcctggacggctcacaaaatcaagacgacgtggtgctccacgtcagctcgaagacgaccctgcagtacaggtctttgccacggcccagcaaatccagtactagcggcattcccgggagaggaggtcaccgtagtagcactagttcaattgattcgaatgtatccagtaagagcgcaggagccaccacatctaaacttcgtgaaccgactaagataggctctggtagatccagtccggtcacagtcaatcaaaccgataaggagaaagaaaaggtagccgtatccgacagtgagtctgtgtcccttagcggctcccccaagtcatctcccactagcgcctccgcttgcggtgcccagggcctgcgacagccagggagcaagtatcctgacattgctagtccgactttccggaggctcttcggcgcaaaggcgggagggaagtcggccagcgccccaaatactgaaggcgtcaagtcttcctctgtgatgcccagcccctctactacacttgccagacaggggtctctggagtctcccagttcaggcactggaagcatgggcagcgccggaggtctttctggaagcagctcgcccctctttaataagccctcagatctcactactgacgtgatctccctgtcacactcactggcatcctcgcctgcctctgttcacagttttaccagtggaggccttgtgtgggcagccaacatgagctccagtagtgccggaagtaaagacacaccaagctatcaatccatgaccagcctgcacactagcagtgaaagtatcgatctgccactgagccatcacgggagcttgtccggcttgactacaggcacacatgaagtgcagtcgctgttgatgcggactggaagcgtgcgcagtacattgtccgagagcatgcaactcgatcgcaacacactgccaaaaaagggactgcggtacactccatcttcacggcaggctaatcaggaagaaggcaaagaatggctgcgctctcattccaccggcggtcttcaagacaccggaaatcaatctcccctcgtctcaccatctgccatgtcttcaagcgccgctggtaaataccacttcagtaacctcgtctccccgaccaatctatcacagtttaacctgccagggccatctatgatgagatcaaattccatccccgcccaggattcatcgtttgatctgtatgacgattcacagctatgcgggtccgccacatccctagaagaaaggccaagggctatatctcactccggctcatttagggactcaatggaagaagtacacgggtcctctctctctcttgtgagtagcaccagcagcctctactccacagcagaagaaaaagcacacagtgaacagattcataagctgaggcgggagctggtggcatcccaggaaaaggttgccaccctgacttcacagctgtccgcgaatgcacatttggtggccgctttcgagaagtcactcggtaatatgaccggccgcttgcagagtctgacaatgactgccgagcagaaggaatctgagctgatcgagcttcgcgagactatcgagatgctgaaagcacagaatagcgccgctcaggccgctatccagggtgccctcaatggaccggaccaccctcccaaagacctccgcattcgacgccagcactcgagtgagtcagtctcatctattaacagtgccaccagtcacagtagtattggctccgggaatgacgctgatagcaaaaaaaagaaaaaaaaaaactgggttaacagtcggggctctgaacttagatcctcctttaaacaggcattcgggaaaaaaaaatcaacgaagcctcctagcagtcactccgacatagaggagttgacagatagctcactcccagctagccccaagttgcctcataatgcaggggattgtggttctgcatccatgaagccatcccagtccgccagtgctatctgtgagtgcaccgaggccgaagccgagattatcctgcagctgaagagcgagctccgagaaaaagaactgaagttgaccgacatccgcctggaggcgctgtcgtctgcgcaccatttagaccagattcgcgaggctatgaaccgcatgcagaacgagatcgagattttgaaggccgaaaatgacaggctcaaggctgagacagggaacactgcaaagcccacccgcccgccctctgagtcttcatcatccaccagtagtagcagcagcagacagtccctgggcctgtccctcaataatctgaacatcactgaagcagtgagctctgacattctgctggacgacgcaggcgacgccacgggccacaaggatgggcggagtgtgaaaattatagtgtctatcagcaaagggtatgggagagctaaagatcaaaaaagccaagcctatctgataggctcaatcggcgtgtccggcaaaacaaaatgggacgtgcttgacggagtgatccgtcgtttgtttaaagagtatgtgttccgtattgacacttctacgtctctgggtctctcttctgattgtatagctagctattgtattggggaccttattagatcacacaacctagaggtgcctgagttgctgccatgtgggtacttggttggcgacaacaacattatcaccgtcaacctgaaaggggtggaggagaattccctggattcttttgtcttcgatactctgatacccaagcccattactcaacgttattttaatctgctcatggagcaccacagaataatcctgtcggggccttccgggaccggcaagacgtacctcgcaaacaagttggctgaatacgtgatcaccaagagcgggcggaagaaaacagaggatgctatagctaccttcaatgtggatcataagtcaagtaaggaactgcagcaatacttggccaacttagctgaacaatgtagcgcggacaacaacggcgtggagctgccagtcgtaattattctcgacaaccttcatcatgtgggctcactgtcagatatttttaatggtttcctgaactgcaagtacaataaatgtccatatatcataggaacgatgaatcagggcgtaagttcctctccaaaccttgagctgcaccataacttcagatgggttctgtgcgctaatcataccgaaccagtaaagggcttcctcgggaggtacttgagacggaaactaattgaaatcgagattgaaagaaacataaggaataatgatttagtcaagataatcgactggattcccaagacatggcatcacctgaattcttttctggagacccattctagctctgatgtgaccatcggcccacgcttatttcttccatgtcctatggacgttgaggggtcccgcgtctggtttatggatttgtggaattactccctcgtgccttatatcctggaggccgtacgagagggactgcagatgtatgggaaacgcaccccatgggaggatccatctaagtgggtgctggatacgtatccctggagctccgccacattgccacaggaaagccccgccttgctccagctgcggcctgaagacgttggctatgagtcctgcacgtcaacaaaagaagctacaactagcaaacacatcccacagaccgatacagagggagatccattgatgaatatgctcatgaagcttcaagaggccgcaaactatagcagcactcagtcttgcgactctgagtcaacaagccatcatgaggatattctggactccagtctcgagtccaccctgtag

SEQ ID NO: 197087 - DNA, 648 bp, Artificial Sequence
  Description of Artificial Sequence: Synthetic coding sequence
atgaagcggtgggtgctgtgcgccaaccacaccgagcccgtgaaggggttcttgggaaggtacctgcgcaggaaattgattgagatagaaattgagcgcaatatccggaacaacgatctcgtaaagataattgactggattccaaagacatggcaccacttgaactcttttctcgagacccattcctccagtgacgtcaccataggacccaggctgttcctcccctgtcccatggacgtagagggctctagagtgtggtttatggacctatggaattattccctggtgccctatatcctggaagcagtgagagaagggctccagatgtacggaaagcggacaccctgggaggacccgtctaagtgggtcctagacacatatccgtggagctcagcaactctgccacaggaaagtcccgccctgttgcagctgcggcccgaggacgtaggttacgagagctgtaccagcacaaaagaagcgacaacatcaaaacatatcccacaaaccgataccgaaggggacccattgatgaacatgttgatgaagctgcaggaagcagccaattactcgagcacccaaagctgcgattccgagtctacctcacaccatgaggacatcttagattcatctcttgaatctacgctctag

SEQ ID NO: 197088 - DNA, 573 bp, Artificial Sequence
  Description of Artificial Sequence: Synthetic coding sequence
atgggcaagagcaacagcaagctgaagcccgaggtggtggaggagctcacccgcaagacctacttcaccgaaaaggaagtgcagcagtggtacaagggctttatcaaggactgcccaagcggccaactggacgctgcgggattccaaaagatttacaaacaattcttcccgttcggggaccccacaaagttcgccacattcgtgttcaatgtgttcgacgagaataaagacggtcgcatcgagttttccgagtttattcaggccctgtcagtgacctctagaggcacactggacgaaaaactccggtgggccttcaagctctacgatctcgacaatgacgggtatattaccagaaacgaaatgctggatatcgttgacgccatctatcagatggtcggtaacacagtggaactgcccgaagaagagaacactccagagaagagagttgaccggatcttcgccatgatggataaaaatgccgacggaaagctcacactgcaggagtttcaagagggcagtaaagcggacccgtcaattgtgcaagccctgagtttgtatgatgggctggtctag

SEQ ID NO: 197089 - DNA, 519 bp, Artificial Sequence
  Description of Artificial Sequence: Synthetic coding sequence
atggccaccatcaccgagaaggaggtgcagcagtggtacaagggctttatcaaagactgtccgagcggccagctggatgccgcaggattccaaaagatttataagcaatttttcccctttggcgacccgacaaagttcgccactttcgtgttcaacgtgttcgacgagaataaggatggtaggatcgaattctccgagttcattcaggcactgtctgtgaccagccggggcacactggacgaaaagctgcgttgggcattcaagctctatgacctggataacgacggatacattacccgcaatgaaatgctcgacatagtagatgctatctaccagatggtgggtaacactgtcgaactccccgaggaggagaacaccccagaaaaaagggtcgacaggattttcgcaatgatggacaaaaacgctgacggcaagttgacattgcaggagtttcaagagggttccaaggcagatccttcaatcgtccaagctctgagcttgtatgatggcctggtttag

SEQ ID NO: 197090 - DNA, 3552 bp, Artificial Sequence
  Description of Artificial Sequence: Synthetic coding sequence
atgcagctgaagatcatgcccaagaagaagcggctgagcgccggcagggtgccgttgatcctgtttctgtgtcagatgatctctgccctggaggtgcccctggacttagttcagccgccaacgattacccaacagtcccctaaggattacatcatcgaccccagagaaaacattgtgatccaatgtgaggccaaggggaagcctcccccgtccttctcttggactcgaaatggaacacattttgacatcgacaaggatcctcttgtcaccatgaagccaggaacaggtactctaataattaacatcatgagtgaagggaaagctgagacctacgaaggtgtatatcagtgtacggccagaaatgagcgaggcgccgcagtctcaaataatatcgtggttcgaccttctcggtcgccgctttggacgaaagagaagctcgaaccaatcacactccagagcggccaatcgctcgtcctgccttgccgccctcctatcgggctcccaccgccaatcatcttctggatggacaactcattccagaggctgccgcagagcgaaagggtatcgcagggtttaaacggcgacctctacttttctaatgttctacccgaggatacaagagaggattacatctgttacgctaggttcaatcatactcagacgattcagcagaagcagccgattagtgtgaaagttatctcggttgatgagttgaacgatacaatagccgccaacttgagtgacacagaattctacggagccaaaagttcaagagaacggccccctacgttcctcaccccggagggaaacgcaagtaataaagaggaactgcgcggaaatgtgctgtctctcgagtgtatcgcagaaggtctgccaactccaattatttactgggccaaagaggatggaatgcttcctaagaatcggacagtgtataagaatttcgagaagacattgcagattatccacgtgtcagaagcggatagtggcaattaccaatgcattgccaagaatgcgctgggcgctatccatcatactatttcagtccgggttaaggcagcaccatactggatcacagcccctcaaaatttggtgctgtccccaggcgaggatggtacactgatatgtcgggcaaatgggaatcctaagccccggattagttggcttaccaatggcgtaccaatcgaaatcgcccccgacgacccatctcgtaagatcgacggagacactattatcttctccaatgtgcaagaaaggagcagtgccgtatatcagtgcaatgccagcaatgagtacgggtacctccttgccaatgccttcgtcaatgtccttgccgagcccccccgcatcctcacccccgctaacactttgtaccaggtcattgcaaacaggcctgctttactcgattgtgccttcttcggctccccactgcctactatcgaatggttcaagggcgcaaagggatccgcactgcatgaagacatctacgtccttcacgagaatggaacacttgaaattcccgtagctcaaaaagacagcaccgggacctatacatgtgtggccaggaataaattaggtatggccaagaatgaggtgcatctcgagatcaaagaccccacgtggatcgtgaaacaacctgagtacgcggtcgtgcagagaggtagcatggtctcctttgagtgtaaggtgaaacatgaccacactttgtccctgacagtattatggctcaaagacaatagagagctgccctctgatgagcgcttcacagtggacaaagaccatctggtggtggctgatgtcagcgatgacgacagcggaacttacacttgcgttgccaatacaaccctggattccgttagcgcatctgccgtcctgtctgttgtggacgtgccaaatccacctttcgatctcgaactgaccgatcagctggacaaatctgtgcaacttagctggacgccaggggatgataataattctcctatcacaaagttcattatcgagtacgaggacgcgatgcataagcccggcctctggcaccatcagactgaggtctcaggcacccagacgacagcccagttaaagctcagtccatatgtgaactattcctttagagttatggcggtcaattctattggcaaatctctcccatccgaggccagcgaacagtatttgacaaaagcaagtgagccagacaaaaatcctaccgccgtcgagggcttggggtctgagcccgataacttagtcataacctggaaaccgctgaatgggtttgagtcgaatggccccggcctacaatacaaggtcagctggcggcagaaggacggagacgatgaatggacatcagttgtcgtggcgaacgtttccaagtacattgttagcggaacaccgacattcgtgccatacctgataaaagtgcaggcattgaatgacatgggttttgcccctgagccggccgtcgtcatggggcacagcggggaggatctgccaatggtggcccccgggaacgtgagagtgaatgttgtgaactccaccctggccgaggttcactgggacccagtcccgctgaaatctattagaggccacctgcagggatacaggatttactactggaagacgcagtcgagcagcaagagaaatcgacggcatatcgaaaaaaagatactgacgtttcagggctctaaaacacatggtatgttaccaggcttggagccattctcccattataccctgaacgtaagagttgtgaacggtaaaggcgaagggcccgccagtccagacagagttttcaacactcccgaaggtgttccttcagcccccagcagcttgaaaatcgtaaacccaacactggatagtctgacattagagtgggatccaccctcacaccctaatggcatcttgaccgagtacactcttaagtatcagcccatcaatagtacccacgaacttgggcctttggtggatttgaagattccagccaataaaacacgatggacactcaaaaacctcaacttctctaccaggtataaattttacttctatgcgcagacatcagccgggtcaggatcacagattacagaagaagcagtgacaactgttgacgaggccatggcaagccgacaggtcgatattgcaacccagggctggttcatcggcctcatgtgtgctgtcgccttactcattttgattcttctgatcgtgtgcttcatccggagaaataagggcggcaagtatccggtgaaggagaaagaagatgctcacgccgacccagaaatacagccaatgaaggaagacgacggcacattcggggaatacagtgatgcggaagatcataaaccactgaagaaggggagtcgtacaccctctgatcgcactgttaaaaaggaggatagtgatgactctcttgtggattatggagaaggggttaatggacagtttaacgaagacgggtcattcattggccagtactcaggaaagaaggagaaagagccagccgagggaaacgaatcaagcgaggccccctcccccgtgaatgccatgaattccttcgtgtag

SEQ ID NO: 197091 - DNA, 3711 bp, Artificial Sequence
  Description of Artificial Sequence: Synthetic coding sequence
atgcagctgaagatcatgcccaagaagaagcggctgagcgccggccgtgtccccctgatcttgtttctgtgccagatgatctccgccctggaagtgccactggaccagaagtcaactgaggtgatggtgcagcctccaaccataacacagcagtcccctaaggactatatcatagatccccgggaaaacattgtgatccagtgtgaggcaaaagggaagcctccaccttcattctcctggaccaggaatgggacgcatttcgacatcgataaagatcccctggtgacaatgaagcctgggaccgggactctgatcatcaatattatgagtgaagggaaagccgagacctatgagggagtgtaccagtgtacagcccggaatgagcgcggcgccgcagtgagtaacaatattgtggtgcgacctagccggagccctctttggacgaaggagaagctggaaccaatcaccctgcagtctggtcaaagtctggtcctgccttgtaggccaccaattggccttccacctcccatcatcttttggatggacaactcctttcaacgcttgcctcaatctgagcgggtgtcccagggcctgaatggcgatttgtatttcagcaacgtgctcccagaggatacgagagaagactacatctgctacgcccggttcaaccacactcagactatacagcagaaacaacccatctccgtcaaggtgattagcgtcgatgaactcaacgataccatagcagcaaacctgtcagacaccgagttctacggagccaaaagtagcagggagagaccacctaccttcctaacacccgaggggaacgcgagcaataaggaagaactgcgtggcaacgtgttatcattggaatgcattgccgaagggctcccaacacccatcatctattgggccaaagaggatgggatgctgcctaagaaccggactgtctacaagaatttcgagaagacccttcagatcatccacgttagcgaagccgacagtggaaattatcaatgcattgccaagaacgctctgggagcgatacatcacacaatttctgtccgtgtgaaagccgccccatactggataactgcgcctcagaacctggttttaagccctggtgaggacgggaccctcatctgccgggcaaatggaaacccaaaacccaggatctcctggttgaccaacggcgtaccaatcgagatagcgcctgacgacccatctcgcaagatagatggggatacaataattttctctaacgtacaggagcgaagcagcgcggtgtatcaatgcaatgcaagcaacgagtacgggtaccttcttgccaacgccttcgtgaatgtcctggcagagccacctcggatcttgaccccggccaataccctgtaccaggtgatagcaaacaggcctgcactgctggactgtgcctttttcggcagccctttaccaactattgaatggtttaagggagctaagggctctgccctgcacgaggatatttatgtcctgcatgaaaacgggacattggaaatcccggtggctcaaaaagacagcaccggtacatatacttgcgtagcccgcaataaactaggcatggcgaagaatgaggtgcaccttgaaatcaaggatccaacatggattgttaagcaaccagaatacgcggtggtgcagaggggaagtatggtgagctttgagtgcaaagtaaaacatgaccatactttgtctctcacggtgttgtggctcaaggacaaccgagagctgccatctgacgagaggtttacagtagacaaagatcatcttgtggtggccgacgtcagcgacgacgacagcggaacctacacttgcgtcgccaacacaactttagacagcgtatcagccagcgctgtgttatccgtggtggctccaacgccaactcctgcccccgtatatgacgtacctaatccgccctttgatctggagttgacagatcaactggataagtcagtgcagctctcatggacgccgggagatgataataacagccctattacaaagttcatcatcgagtacgaagatgccatgcacaagccaggcctgtggcaccaccagacagaagtatccgggacacaaacaaccgctcagctcaaactgtcaccctatgtcaattacagtttcagagttatggccgtgaatagcattgggaagagtctccccagcgaggcaagtgagcaatatctcactaaagccagcgaacccgacaaaaaccctaccgcggtggaagggcttggctccgagcctgacaacctggtcattacctggaagcccttgaacggctttgagtctaacggtccggggctgcagtataaggtatcgtggaggcagaaggacggggacgatgagtggacatccgtggtggtcgctaacgtctcgaaatacattgtttcgggtacaccgaccttcgtgccttaccttataaaagttcaggctcttaatgacatgggattcgcccccgagcccgccgttgtgatgggccattccggagaagacttgcctatggtggctcccggcaacgtccgggtgaatgtagtcaattcgacgctcgccgaggtgcactgggatcccgtgcccctaaaatccattcggggtcacctccagggatacagaatctactactggaaaacacagtcgtcttccaaaaggaatcgacggcatattgaaaagaaaatcctgacattccaggggtctaagacacacggcatgctgcccggactggaacccttctcccactatacactaaatgtccgggtggtgaatggaaagggtgaggggccagctagccccgatcgtgtgtttaacactcccgaaggggtgccatctgcgccgtccagcctgaaaatcgtgaaccctacactggatagcctaactctggagtgggatcctccctcccatccaaatggcatcctcactgagtacaccttaaagtaccagcccattaattcaacacatgaactgggcccgctggtagatctgaaaatccctgctaacaaaacacggtggacacttaaaaacttgaatttcagcacccgttataaattctacttctatgcacagacatccgctggcagcggctctcagataacagaagaggcagtgaccaccgtggatgaggcaggcatcctcccaccagatgtcggggcaggaaaggtccaagccgtgaatccccggattagcaacctgacagctgctgccgccgagacttacgccaacattagctgggagtacgagggtcctgagcacgtcaatttttacgtcgaatatggtgtcgcaggaagtaaggaggaatggagaaaagaaattgtcaacggctctcgttcctttttcggccttaagggattaatgcctggcacagcctataaggtcagagtgggagctgtgggtgattcaggatttgtatctagcgaagatgtctttgagactggcccagcaatggcttccaggcaggttgacatcgctactcagggatggtttattggccttatgtgcgcagtggcgctgctcatcctgattctgctgattgtatgctttataaggcgcaataagggaggaaagtaccccgtaaaagagaaggaggatgcccatgccgaccctgagatccaaccaatgaaagaagacgacggtacctttggcgagtatagactattttcattcgtctcctccgcaagcttttag

SEQ ID NO: 197092 - DNA, 3579 bp, Artificial Sequence
  Description of Artificial Sequence: Synthetic coding sequence
atgcagctgaagatcatgcccaagaagaagcggctgagcgccggcagggtgcccctgattctatttctttgccaaatgatcagcgccctcgaagtcccactagaccccaagctgctggaggacctcgtacagccgccaactataacccagcaaagccccaaggactatatcattgatccccgcgaaaatatcgtgatccagtgtgaggccaagggtaagccgccgccctctttctcctggaccaggaatgggacccacttcgacattgacaaggatcctctagtcaccatgaaaccgggcacaggaacccttataattaacataatgtccgaaggaaaagccgaaacctatgaaggggtgtaccagtgtacagctcgtaacgaaaggggagccgctgtcagcaataacatagtcgtgcgcccttcacggagccctctgtggacaaaagagaagctggagcctattacccttcagtcggggcagtcactggtgctgccctgccgcccacccattggactgcctcctcccattatcttctggatggataactcttttcaacgactgccccagtctgagagggtaagtcaggggcttaatggcgacttgtatttctcaaatgttttaccagaagacacaagagaagattacatatgctatgccaggttcaatcacacccagactatacaacagaaacaacctatctccgtgaaggtgatcagtgctaagtcctcaagagaaagacctccaacatttctgactcctgaaggcaatgcatcaaataaggaggagctcagaggtaacgttctgtctctggagtgtattgctgagggcctgccgacacccatcatctattgggcgaaagaggacggaatgctgccaaaaaatcgtaccgtctacaagaatttcgagaagaccttacagatcattcacgtttccgaggccgactccggaaattaccagtgcatcgctaagaacgccctgggcgcaattcatcacactattagcgtgcgcgtaaaggctgcaccctattggatcactgccccacaaaacctggttttgtcccctggggaggacggtaccctcatctgcagggcaaacgggaatccaaaaccgaggatcagctggctcactaacggcgtccccattgagatcgctccggacgacccttcacggaagattgacggcgacactatcatctttagcaacgtgcaggagcggtcaagtgccgtgtaccaatgcaacgcttcaaacgagtacggatatctcctcgcaaatgcatttgtcaatgttttagcagagccccccagaatcttgacaccagctaacacattatatcaggtgattgccaacagaccggccctgctcgactgtgcgtttttcggctctcctctccccaccattgagtggtttaaaggagcaaaagggtctgcccttcacgaggatatctacgttttgcacgagaacggtaccctcgaaatacccgtagcgcagaaagattcaacgggaacctatacttgcgtagctaggaacaagttgggaatggctaaaaacgaagtgcacctggagatcaaggaccccacatggattgtgaagcagcccgaatatgccgtcgtccagcggggttccatggtgtccttcgagtgtaaagtcaagcatgatcacactctgtctctcaccgtcttgtggcttaaagacaatagggagcttccctcggacgaacgctttaccgtggacaaagaccacctggtggtcgctgatgttagcgacgatgattcgggaacgtacacctgcgtggcaaacacgacactggattctgtgtctgcaagcgctgtcctctcggtggttgctcccactcctacgccagcgccagtttatgacgtccctaatccaccgttcgaccttgaactgaccgaccagctcgataaatccgtccaattgtcttggactcccggggatgataacaatagtccaatcacgaaatttatcattgaatacgaagacgccatgcataagcctggcctctggcaccatcaaacagaagttagtggcacacagacgacggcccagctcaagctgtccccttatgtcaattatagtttcagagttatggccgttaattctattgggaagtctctgccttccgaggcctcagagcaatatctgaccaaggcctcggagccagacaaaaatccgaccgccgtggaaggtctcggcagtgaaccggacaatctggttattacttggaagcccctgaatgggttcgagagcaacgggccaggactgcaatacaaggtgagttggcgccagaaagacggggatgacgagtggaccagtgtggtggtggccaatgtctcgaagtatatcgtctcgggcacccccacctttgtgccctacctgatcaaggtacaagccctgaacgatatggggtttgcacctgaaccagccgttgtgatggggcacagcggcgaggatctgcctatggtggctcctgggaacgtgcgggtaaatgtcgtgaattcgacactagctgaggtgcactgggaccccgtgcctttaaagtccattaggggccatctgcaagggtaccggatctattattggaaaacccagtcctcttcaaagcgcaaccgccgacacatcgagaaaaagattctcaccttccagggcagtaaaacacacggcatgctacctggactcgagccattttcacactataccttgaacgtgcgggtcgtcaacggcaagggtgagggtccagcctcccctgaccgcgtgttcaacactcccgagggtgtaccgtctgcaccctcatctttgaagatcgtcaatccgacccttgactctttaacactagaatgggatcctccttcacaccctaacggcattctgactgagtacaccttgaagtaccagcctatcaacagtacccacgaactgggccccttggtggaccttaagattcccgccaacaagacaagatggacccttaaaaatctcaacttcagcactagatataaattctatttttacgctcagacctctgcagggtctggctcgcaaatcaccgaagaagcagtgacgaccgtcgacgaggctggcatcttacccccagacgttggcgcagggaaggcaatggcttccagacaagtggatatcgcgactcaagggtggttcatcggcctgatgtgtgctgtggcactgctcatcctgattttgctgatcgtgtgttttattaggagaaacaaaggcggtaagtatcctgtaaaggaaaaggaggatgctcacgcagaccccgagattcagcccatgaaagaggacgacggaactttcggcgaatattctgacgccgaggaccataaaccacttaagaaaggaagtaggacgcctagcgaccgaaccgtcaaaaaagaggacagtgacgattctctggtggactacggggagggtgtaaacggacagtttaatgaggatggttcttttatcggtcagtattcgggcaaaaaagagaaggagcctgccgagggaaatgaaagcagcgaagctccctcccccgtcaacgcgatgaacagcttcgtgtag

SEQ ID NO: 197093 - DNA, 3915 bp, Artificial Sequence
  Description of Artificial Sequence: Synthetic coding sequence
atgcagctgaagatcatgcccaagaagaagcggctgagcgccggccgcgtgccattgatcctcttcctgtgtcagatgatttcagcacttgaggtacctctcgatcctaagctgttggaagacctagtgcaaccaccaaccatcacccagcagtcgcctaaggactacattattgatccacgtgagaatattgttattcagtgcgaggccaaagggaagcctcctccttcgttctcttggacccggaacggaactcatttcgatattgataaggacccactcgtcaccatgaaaccaggaaccggcactcttattatcaatattatgtctgaaggcaaagcagagacctacgagggggtctaccagtgtactgcccgcaacgagcgtggggcagcggtgtccaacaacatcgttgtccgaccatccagaagccctctttggaccaaggagaagctggaaccaataaccctccaaagtgggcaatccctggtcctgccctgcaggccccctattggcctcccgccccctatcatcttctggatggataatagttttcaacgactcccacagtcggaacgcgtcagccagggccttaacggcgacctctacttcagcaacgttctcccagaggatacaagggaggactacatatgttacgccagattcaaccacacgcaaacaatccagcaaaagcagcctatctcagtgaaagtgatcagtgtagacgagctgaatgataccatcgccgccaacctctccgacacagaattctatggggcgaaaagttcgcgagaacggccccctacatttctcacacccgagggaaatgcctccaacaaggaggaattgcggggaaatgtgttgtccctcgagtgcatagccgagggcttacccacaccgatcatttattgggccaaagaggacggcatgcttccaaagaataggaccgtctacaagaatttcgaaaagaccctgcagatcatccacgtcagcgaagcagatagtggcaattatcagtgtatcgctaagaatgcgctgggcgctatccaccacacaatctcggtgagagtgaaggctgcaccttattggatcaccgccccccagaatctcgtgctatccccaggggaagacgggaccttaatctgtcgggctaacggaaaccctaagcctagaatttcctggctgacaaacggtgtccccattgagattgcacccgatgacccctctagaaagatcgacggagataccatcatctttagtaacgtacaggagaggtccagtgctgtgtaccaatgtaacgcttcaaatgaatacggttatctcctggcaaatgctttcgtcaatgttctcgctgagccaccccgcatcctcacccctgccaacactttgtatcaggtgatcgccaacagacccgccttactagactgcgccttctttggcagccccctgccaactattgagtggttcaagggagcgaaagggtcagccctccacgaagacatttatgtcctgcatgagaatgggactcttgagattcccgttgcgcagaaagacagcacaggcacctacacctgtgtggccaggaataaattaggcatggctaagaatgaagtccacctggagatcaaagaccccacttggatagtaaaacaacccgaatacgctgtggtacagaggggatcgatggtctcatttgaatgtaaggtgaaacacgatcacaccctcagccttactgtcctctggcttaaagataatagggagctgccctccgatgaacgctttacggtcgacaaagatcatcttgtggtggccgatgtctctgatgatgactcagggacgtacacctgtgtggctaatacgactcttgacagtgtgagtgccagtgccgttctctctgtggtcgctcccacgccaacccccgcccccgtctatgacgtcccaaacccccccttcgatctggagctgaccgaccaactggataaatccgtgcagctttcctggacaccaggagatgataacaatagtccaatcacgaagttcatcatagaatacgaggacgcaatgcacaagcccggactctggcatcatcaaactgaggtgagcggcacgcagacaactgcccagctgaagctgtctccttacgtgaattactcctttagagtcatggccgtgaactctatcggtaagtccctcccctcggaagcttccgagcagtacctgaccaaagcatcggagccagataaaaatccgacagcggtggaaggcttgggatctgaacctgacaacctggtcattacctggaaacctcttaacggttttgagtcaaacggccctggactgcagtataaggtcagttggagacaaaaagatggcgacgatgagtggacgtccgtcgtggttgccaatgtttccaagtacatagtgtccgggaccccaaccttcgtcccttacctgattaaggttcaagccttaaacgacatgggcttcgcaccagagccggccgtggtgatgggccatagcggcgaagatttgcccatggtggcccctggcaatgttagggtcaacgttgtcaactctactcttgctgaagtgcattgggaccccgttccactaaagtctatccggggacatctgcagggatacagaatctactactggaagactcagagctcatcaaagaggaaccggagacatattgagaagaaaatcttgacttttcagggttcaaaaactcatgggatgcttcccgggctggagccgttctcccactatactctgaacgtgcgggttgtaaatggtaagggagaagggcccgcatcccccgaccgcgttttcaatactcctgagggtgtgcccagcgctccttctagcctaaagatcgtcaatcccacacttgactccctcaccctggaatgggaccccccgtcacatccaaacgggattctgactgaatacaccctaaaataccagcctatcaacagcacccacgagctcggaccacttgtggacttgaaaataccagctaacaaaacaaggtggaccctgaaaaacctaaatttctctactaggtacaaattttacttttatgcccagacctccgcaggctctggctcacagattactgaagaggccgtcaccaccgtcgatgaggctggaatcttgccaccagatgttggggcaggtaaggtccaagcagtgaatccccgaataagtaacctgactgctgctgccgctgagacctacgccaatatctcttgggagtacgaaggacccgaacacgtgaacttctacgtcgagtacggcgtggcgggtagcaaagaagaatggcggaaagagattgtaaacggctcgcgatcattttttggcctcaaggggcttatgccagggacagcatacaaggtacgcgttggggcagtcggagatagtggctttgtttcttcagaggatgtatttgaaaccggccccgcgatggcatccaggcaagttgacatcgccacccagggatggtttattggtctcatgtgcgctgtagccctcttaattctaatcctgctcatagtatgtttcatacggagaaacaaagggggtaagtatccagtgaaggaaaaggaagacgcccatgccgatcccgagatccagcctatgaaagaggacgatggaactttcggtgaatattccgacgctgaagatcacaagcctttaaaaaagggttccagaacaccatccgaccgaaccgtgaagaaggaggactctgatgacagcctggtcgattacggggagggagtgaatggacagtttaatgaggatgggagctttattggtcagtactccgggaagaaggaaaaggagccagccgagggaaacgagagctcagaggccccatcgcccgttaatgccatgaactctttcgtgtag

SEQ ID NO: 197094 - DNA, 3927 bp, Artificial Sequence
  Description of Artificial Sequence: Synthetic coding sequence
atgcagctgaagatcatgcccaagaagaagcggctgagcgccggcagagttccattgattctattcctgtgccagatgatcagcgctctggaggtaccgcttgatcagaaatcaactgaggttatggtacagccccccacaatcacccagcagagtccaaaggactacataattgaccctagggaaaatatcgttattcagtgcgaggcaaagggtaaacctccccctagtttttcctggacccggaacgggacacactttgacatcgacaaggatcccctggtcactatgaagcctggcacaggcaccctaatcatcaacattatgtcagagggcaaagctgagacctatgagggggtctaccaatgtacagctagaaatgaacgaggtgctgcagttagtaataatatcgtggtgcgaccttctcggtcccccctgtggaccaaggaaaagcttgaacccatcaccctgcagtcaggacagagtctagttttgccctgtcgaccccccattggactgcctcctcccatcatcttctggatggataacagttttcaacggttacctcaaagcgaaagagttagccagggtctaaacggggatttgtacttctccaacgtgttgcccgaagacacaagggaagattatatctgctacgcccgcttcaaccacacacaaactattcagcagaaacagcctatctctgtgaaagtgatttctgtcgatgagctgaacgacaccatcgccgcaaacctgagcgacactgaattctatggagccaagtcttctagagagcggccccctactttcctcacacccgagggaaatgctagtaacaaagaggaactccgcggcaacgtgctgtccctggagtgcatcgctgaggggctgccaaccccgattatatattgggctaaggaggatggcatgctgcctaagaatagaaccgtctacaaaaacttcgagaaaacattacagattatccatgtcagtgaagccgactctggaaactaccagtgtatcgccaaaaatgccctgggcgctatccatcatactatttctgtgcgagtaaaggccgccccttactggatcactgcaccccaaaacctggtcctgagtcccggggaggatggtacactgatatgccgggcaaatggaaatcctaaacctcggatctcctggctcaccaatggagtgcctatcgagatcgcaccagatgatccaagcagaaagatcgacggagataccataatctttagcaacgttcaggagcgctcgtcagccgtctatcagtgtaatgccagcaacgaatacggctaccttctcgcaaacgcattcgtgaacgtgttagccgaacccccaaggatactcacgccagccaatactctgtaccaggtgatcgccaacagaccggccctgctggactgtgcgttttttggctctcctttgcccacgatcgagtggttcaaaggagccaagggatccgcactccacgaagatatttatgtgcttcatgaaaacggaacactggagatccccgtggcccaaaaggactctacaggaacttacacctgcgtggcgcggaataagctggggatggctaagaatgaggtccatctcgaaatcaaggaccccacatggattgtcaagcagcccgagtacgccgtggtgcaaagggggagtatggtttcgtttgaatgcaaggttaagcatgatcacacgctgtctctaaccgtcttgtggttaaaagataacagggagctgccttccgacgaacgcttcacagttgataaggatcacctggtcgtggcggatgtgtcagatgatgactcagggacctacacatgtgtggctaatacaacgttagattctgtgagcgcgtctgccgttctcagtgttgtcgccccgaccccgacgcccgcccccgtgtatgacgttcccaaccctcccttcgacctggagcttaccgaccagttggacaaatcggtgcaactcagttggacccccggggatgataacaattcaccaataaccaaatttattattgaatacgaggatgccatgcacaaacccgggctgtggcaccaccaaacagaggtgagtgggactcagactaccgcccaacttaaactcagcccatatgtaaactactcctttcgcgtgatggcagtgaactctatcggtaaaagcctgccaagcgaagccagcgagcagtacctcacaaaagcctctgaaccagacaaaaaccctacagccgtggagggacttggcagcgaacctgataacctagtcattacttggaagcctttgaatgggtttgaaagcaatggcccgggcctgcaatacaaagtttcctggcgacagaaagacggagatgacgaatggacgtccgttgtggttgctaacgtttcgaagtacattgtatctggaacccctaccttcgtaccttaccttattaaggtgcaagcactgaacgacatgggcttcgcccctgaacccgccgtggtgatgggccattccggggaagacctgccgatggtggccccaggcaacgtgcgcgtgaatgtagtcaacagcacactggcagaggtccactgggatcccgtccctctgaagtctatccggggccatttacagggctacaggatttactactggaaaacacagagctcgagcaaaagaaaccgacgccacattgaaaaaaagatactaacctttcagggcagtaaaacacacggcatgctgcctggtctggagcctttttcccattacaccctgaacgtccgtgtcgttaatggtaagggagagggtcccgcttcacccgatagagtgttcaacacacctgagggcgtacccagtgccccttcctccctgaaaattgtaaaccccaccttagactctctcactctggagtgggaccctccttctcatccaaacgggatcctgacagagtatacgcttaagtaccagcccataaactctacccacgagctcggacccctggtggatttgaagatcccagcaaataagacacgctggaccctgaagaatcttaacttcagcacccgctacaagttttatttttacgcacagacctccgccggtagcggttcacagatcacggaagaggctgtgaccacagtggacgaagcagggatccttccccccgacgtgggggcgggaaaagttcaggcagtgaatccccgtatatcaaatttgacggctgcagcggcagagacatacgcaaatatatcctgggaatatgaagggccagagcatgtgaacttctacgtagagtacggagtggccggcagcaaagaggaatggcgaaaagaaatcgtaaacggatctaggtccttttttggactgaagggtctgatgccgggcacagcgtacaaggtgcgcgtgggcgcagtgggcgattccggctttgtgtcatccgaggacgtgttcgagactgggcccgctatggcaagccggcaggtggacatagcgacccagggatggttcattggcctgatgtgcgcggtggcgctgctcattttgatcctcctgattgtgtgtttcattaggcgtaataaaggggggaaatatcctgtgaaggagaaagaagatgcccatgccgaccctgaaatccagccaatgaaggaggatgatggtaccttcggagagtactcatcactcaagaatgatgccgaagatcataaacccctgaagaaggggagcaggacccccagcgatcggaccgtgaagaaagaagacagtgatgactcgcttgtggactatggagaaggagtcaacggtcaatttaacgaagacggtagcttcattggccaatactccggaaaaaaagagaaagagcccgctgaaggcaacgagagcagtgaagccccctctcccgtgaacgctatgaactcttttgtctag

SEQ ID NO: 197095 - DNA, 3543 bp, Artificial Sequence
  Description of Artificial Sequence: Synthetic coding sequence
atgcagctgaagatcatgcccaagaagaagcggctgagcgccggcagagttccgctgatccttttcctctgtcagatgatctccgctctcgaagttcccctggaccagaagagtacagaagtcatggtccaacctcctacgatcacccaacagtcccccaaagattacatcattgatccaagagaaaatatcgtcattcagtgcgaggcaaagggaaaacccccaccctcgttctcatggactaggaacgggacccatttcgatatcgataaggatccattagttaccatgaaacccgggaccggcaccctaataattaacattatgagtgagggaaaggccgagacatatgagggcgtttaccagtgtaccgctcgcaatgaaagaggcgccgctgtttctaacaatatcgtagtgcgccctagtcgctccccgctgtggactaaggagaagctggagccaatcactctacaatccggccagtccctcgtcttaccgtgtcgcccccctatcggcctgccaccaccaataatcttctggatggacaatagttttcagcgcctcccccaaagcgaacgcgtcagccaaggtctgaacggagacttgtacttttctaatgtgctgcccgaagacacccgggaggattacatatgctatgctagatttaaccatacccagaccattcagcaaaagcagccaatctccgttaaagttatcagtgccaagagctccagagagcgaccgccaaccttcctgacccctgagggcaatgcatcaaacaaggaggaattgcgcggcaacgtgctgagtctggagtgcatcgctgagggtttaccaacgccaattatttattgggctaaagaggatggcatgttaccaaagaataggactgtctacaaaaacttcgaaaaaaccctccagatcatccacgtctccgaggcggactcagggaactaccagtgcatagctaaaaatgcacttggagccattcaccacaccatcagcgtgcgagtaaaggccgccccatattggatcaccgcgccccaaaaccttgtgctgtctcctggtgaggatggaacactgatctgtagagcgaacggcaacccaaagccccgcatatcttggctaactaatggtgtgcccatcgagattgctcctgacgaccccagcaggaagatcgacggggacactatcatcttctctaacgttcaagagagaagctctgcggtctatcagtgcaacgcctcaaatgagtacggctatctgctagccaacgcctttgtaaatgtgctcgccgagccaccccggatcctgacccctgcaaacactttgtaccaggtgattgccaacaggcccgcgctcctggactgcgcttttttcggctcgccacttcccacaattgagtggtttaaaggcgctaagggcagtgcattgcatgaagatatctacgtcctacacgagaacggcactctcgaaatccctgtcgcccagaaagatagtactggcacatacacctgtgtggcccgcaacaaactggggatggctaaaaacgaggtgcacctggaaataaaagatcctacgtggatcgtgaagcaaccagaatacgcggtcgtgcagcgtgggtccatggtgagcttcgagtgtaaggtgaagcacgaccacacactgtccctgactgtgttgtggctgaaggacaacagagaactgccgagcgacgagcggttcactgttgacaaggaccatctggtagttgccgacgtgtccgacgacgatagtggcacctatacctgtgtcgcaaacactactctcgatagtgtttccgcaagcgcggtattaagtgtagttgcccctacccctacacctgcccctgtgtacgacgttcccaacccgcccttcgatctcgagctgacggaccaattggacaagtctgttcaactgtcatggactcctggggacgacaataattctcccattaccaagtttataattgagtatgaggatgcgatgcataaacccggcctatggcaccatcaaacagaagtgagtggaacccaaactaccgcccagctcaagctctctccctatgtgaattattcctttagagtgatggccgtcaattcgatcgggaagtccctgccaagcgaagcttctgagcaatatcttaccaaggcgagtgaacctgataagaacccgactgccgtggaaggcctgggctccgagcccgacaatctggtgatcacatggaaacctctcaacggctttgaaagcaacggcccagggctgcaatataaggttagttggcgccaaaaggatggagacgatgaatggacctccgtggtcgtagccaacgtctcaaaatatattgtttctggaacccctactttcgtgccttaccttatcaaggtacaagcactgaacgatatgggctttgcccccgagcctgctgtcgtgatggggcacagcggcgaggatttgccaatggtggccccgggaaacgtgagggtgaacgtggtaaacagcaccctggccgaggttcactgggacccggtgcctctgaagtcaatccgtggccacctgcaggggtatcggatctactactggaaaacccagtccagcagcaagcgcaatcggagacatattgaaaagaagatcctaactttccaggggtccaagacccacggaatgcttccgggactggagcccttctcccactataccctgaatgtgcgcgtcgtgaatggcaagggagagggccccgcatctcccgacagagtttttaacaccccagagggtgtaccatctgcaccctcttcactgaagattgtgaatcccactctagattccttaacactcgaatgggacccccctagtcatccgaatgggatattgacggaatatactctgaagtaccagccaataaatagtacacacgaattagggcctctcgtggacctaaagatccccgccaacaaaacgaggtggaccctgaagaatctgaacttctctacccgctacaaattctatttttatgcgcaaacctccgccggtagtggttcgcagatcaccgaggaggctgtcaccactgtggacgaggccatggcctctaggcaggtggacatcgctacacagggctggtttatcgggctaatgtgcgccgttgcccttttaatcttaattctcctgatcgtgtgcttcattcgaagaaataagggcggcaaatatcccgtgaaagagaaggaagatgcccacgctgatccagagatccaacctatgaaggaggatgacgggacctttggcgaatactccgatgccgaagaccataagccactcaagaaaggcagtcggacgccctccgacaggactgtcaagaaggaggactctgatgacagcctggttgactatggagagggggtgaacggacaattcaacgaagacgggagttttattggacagtattccggcaagaaagagaaagagcccgctgaaggcaacgagtcatcagaagcaccatctcccgtaaatgctatgaatagtttcgtttag

SEQ ID NO: 197096 - DNA, 1296 bp, Artificial Sequence
  Description of Artificial Sequence: Synthetic coding sequence
atgcagctgaagatcatgcccaagaagaagcggctgagcgccggcagggtccccttgatactgttcctgtgccaaatgatcagcgcactcgaggtgcccctggatcttgttcagccgcccaccatcacccaacagagtccaaaagactacattattgaccctcgggagaacatcgtgatccagtgtgaggctaaagggaagccgcctccatcctttagttggacacgcaatggcactcattttgatatcgataaagatcctttggtcacgatgaaaccaggcacaggaaccttgattatcaacattatgtctgagggcaaagcggaaacctacgaaggggtctatcagtgtactgctcgaaacgagcgcggcgccgctgtctccaataacattgtggtgagaccatctaggagccccctgtggaccaaagagaagctcgaacccatcacactgcaaagtgggcagtccctcgtcctaccatgtcgcccccccatcggactgcctcctccgattattttttggatggataacagttttcaacgcctcccccaatcagaaagggtctcccagggcctcaacggagacttatactttagcaatgtgctgccggaggatacacgagaggattacatatgctacgccagatttaatcatacacagaccatacagcaaaagcagcctatcagcgtgaaagtaatcagcgtcgatgaattaaacgataccatagcagcaaacctgtccgatacagaattctatggggcaaagagcagtcgggagaggcctcctaccttcctgactccagagggcaacgcctctaataaggaagagctgcggggcaatgtgctgagcctcgagtgtatcgcagaagggctaccaaccccaattatatattgggctaaagaggatggtatgttgccgaaaaaccgcacagtctataagaacttcgagaagactctgcaaattattcatgtcagtgaggccgattcgggaaattaccagtgtattgccaagaacgcgctgggggctattcaccatacgatttctgtgcgtgtgaaagccgctccttactggattaccgcgccacagaacctagtactgagcccgggcgaggacggtaccctgatatgcagggccaacggcaaccccaaaccgcggatcagttggctaacaaacggggtgccaatagagattgcccccgatgacccatcccgcaagattgacggtgacaccataatcttcagtaatgtgcaggaacgcagcagcgccgtatatcaatgcaacgcaagtaacgagtag

SEQ ID NO: 197097 - DNA, 186 bp, Artificial Sequence
  Description of Artificial Sequence: Synthetic coding sequence
atgcagctgaagatcatgcccaagaagaagcggctgagcgccggccgggttccattaatcttattcctgtgccaaatgataagcgctcttgaggttcctctggaccctaagttgctggaggatctggtgcagccccccaccattacgcagcagtccccaaaggactacatcatcgacccaaggtag

SEQ ID NO: 197098 - DNA, 321 bp, Artificial Sequence
  Description of Artificial Sequence: Synthetic coding sequence
atgcagctgaagatcatgcccaagaagaagcggctgagcgccggcagggtacctctcattttgttcctctgtcaaatgatttcagcccttgaagtgcccttggaccttgtccagccacccactattactcaacagtcacctaaggattatattatcgacccccgcgagaacatcgtgatccaatgtgaggctaaggggaaacctccgccatcatttagttggacgagaaacggtacccattttgatatcgataaagatcctctagttactatgaagcccggaaccggaaccctgattattaacatcatgagcgagggatag

SEQ ID NO: 197099 - DNA, 3915 bp, Artificial Sequence
  Description of Artificial Sequence: Synthetic coding sequence
atgcagctgaagatcatgcccaagaagaagcggctgagcgccggcagggttcccctcatcctgttcttgtgtcagatgatctcggccctggaagtaccactggatcccaaactgcttgaagacttggtgcagccccccacgatcacccagcaatcccccaaggattatattatcgatccacgggagaacattgtgatccagtgcgaggcaaaagggaagccaccaccctcttttagctggacacgaaatggcacccatttcgacatagacaaagacccattagtgactatgaagccaggcacgggaacactgatcatcaatatcatgtcagaggggaaggctgagacctacgaaggggtgtatcaatgcaccgcaaggaacgaacggggcgccgccgtgtctaataatattgtggtgagacccagtcgtagccctctgtggaccaaggaaaagctcgagcctatcactctacagtccgggcagtccttggtccttccctgtagaccacctatcggactgcccccgccaattattttttggatggacaactccttccagagactgccacagagtgaaagagtcagccaagggttgaacggagatctgtacttctccaatgttctccccgaagatacacgcgaggactacatttgttatgctcggttcaatcacacccagaccattcagcagaaacagccgatttcagttaaggtgatatctgtggacgaacttaacgacactattgccgccaacttgagtgataccgagttttacggcgctaagtcctcccgcgagaggcctcccacttttctgacgcccgaagggaacgcctcaaacaaggaagaactgaggggcaacgtgctaagtcttgagtgcatcgccgaaggtctcccaactcccattatctactgggcgaaagaggacggaatgctccccaaaaacaggaccgtttacaagaatttcgaaaagaccttgcaaattatccacgtttcagaggctgatagtggcaactaccagtgcatcgctaagaacgctcttggtgctatccaccacaccatttctgtgcgagttaaagctgcaccttattggatcaccgcaccacagaatctggtgctgtcgccgggagaggatggcaccctgatttgcagagccaacggcaaccccaagccgcggatttcctggctgaccaacggagtgcccatcgagattgcacctgatgacccctcacgtaaaatcgacggagacactataatttttagcaacgtccaggaaaggtcttctgccgtatatcaatgcaacgctagtaacgaatacggatatctgttggccaacgcctttgtgaacgtcctcgccgagccccctcgaatcctaacacctgctaatactctgtaccaggtcatagctaatcgcccggctctcctagactgtgctttttttggttctcccctgccgactatcgagtggttcaaaggcgccaagggttctgccttacatgaagacatatacgtcctgcatgaaaatggcaccctggaaatccccgtggcccaaaaagattccactgggacttacacctgtgtggcgcggaataaactcgggatggccaagaatgaagtgcacctggagatcaaagacccgacctggatcgtgaagcagcctgagtacgcagtcgttcagcgaggaagcatggtgtcgtttgaatgcaaggtgaagcacgaccacactctgtccctgactgttctctggcttaaggacaaccgggaactcccctcagacgagcggtttacagtggataaagatcaccttgttgtggctgatgtgtctgacgatgatagcggaacctatacatgcgtagccaacactacacttgactcggttagcgcaagcgctgtactgtccgtggtcgcacccaccccaacccccgccccagtttacgatgtgcccaacccaccattcgaccttgagctcaccgaccagctggacaagtctgtacagctctcctggacaccaggggacgataacaacagccctataacaaaattcattatcgaatatgaggacgccatgcacaaaccaggactctggcatcaccagacggaggtctccggcacccagacaacagcccagctgaagttaagtccatacgtgaactactcctttagggtaatggctgtgaattcaatcggtaagtcccttccatcagaggcttcagaacaatacttgaccaaggcctctgagcctgataagaatcctaccgccgtagagggccttggctcagaaccagacaatttagtgatcacttggaaaccgctaaatggattcgaatccaatggccccggactccagtacaaggtaagttggagacagaaggatggagacgatgagtggactagcgtggtggtcgctaacgtaagcaagtatattgtgtctgggactcctactttcgttccctatctcatcaaagtgcaggctctgaacgacatgggctttgctccagagcccgctgtcgtgatggggcactcaggagaagacctgcccatggtggctcccggtaacgtgcgcgtcaatgtcgttaactccaccttagctgaggttcattgggacccagtgccccttaagtcgatccggggacacctgcagggttacaggatctactactggaaaacccagtcttcttcaaagcggaatcgcaggcacattgagaagaaaattctaacattccagggtagtaagacccatggaatgctgcctggtctcgagccttttagtcactatactctaaatgtacgggtagtgaacggtaaaggcgagggcccagcaagccccgatagggttttcaacacgcccgaaggggtgccttccgcaccctcctcactgaaaattgtgaaccctaccctggatagtctcaccttagaatgggatcctccgtcccatccaaacgggattcttacagagtatacattgaaataccaacctattaatagtactcacgaactagggccgctggtggatctgaagatacctgcaaataagacaagatggaccctcaaaaatctaaacttttcaaccagatataaattctatttttatgctcagacttccgccggatcgggtagccagattaccgaagaggccgtcactactgtcgacgaagccgggatcttaccacccgatgtgggtgcaggcaaagtgcaagcagtgaatccccgcattagcaatttgactgctgccgccgcggaaacctatgcaaatatttcatgggagtacgaaggtcccgaacacgtgaacttttatgtagagtatggggtggccggcagcaaagaggagtggaggaaagagatcgtgaacgggtcgagaagttttttcggacttaagggactgatgcccggcacagcttataaagtgcgggtcggtgctgtaggcgacagtggatttgtgtcgtccgaggatgtcttcgagaccggccccgcgatggctagccgccaggtggatattgctacacaaggctggttcatcggtcttatgtgcgcggtggccttgctgatcctgatactgctgatcgtgtgctttatcaggcggaataaaggcgggaagtaccccgtcaaggaaaaggaggacgctcacgcggatcccgaaatccagcccatgaaggaggatgatgggacattcggcgaatactccgatgccgaagatcacaagcccctgaaaaagggttcacggacccccagcgataggacagtgaagaaagaggatagtgacgacagtcttgttgattatggagagggtgttaacggccagttcaacgaggatgggagctttatcggtcaatattccggcaaaaaagagaaggagccggccgagggaaacgaatcaagtgaggccccttctccagttaacgccatgaactctttcgtgtag

SEQ ID NO: 197100 - DNA, 447 bp, Artificial Sequence
  Description of Artificial Sequence: Synthetic coding sequence
atggccagccggcaggtggacatcgccacccagggctggttcatcggtctaatgtgcgcagtcgccctcttgatcctgatactgctgattgtgtgctttatcagaagaaacaaaggtggtaagtatcccgttaaggaaaaagaagatgcccatgctgacccggaaattcaacccatgaaagaggacgatggaacgtttggtgagtatagcgatgcggaagaccataaacctctcaagaaagggagccggacccccagcgaccggacagtgaaaaaagaggatagcgatgatagtctggttgactatggtgaaggcgtgaatgggcagttcaatgaggatggcagcttcatcggacaatacagtggcaagaaggaaaaagaacccgctgaaggaaacgaatcaagtgaggcaccctctcctgttaatgcaatgaatagctttgtttag

SEQ ID NO: 197101 - DNA, 357 bp, Artificial Sequence
  Description of Artificial Sequence: Synthetic coding sequence
atgcagctgaagatcatgcccaagaagaagcggctgagcgccggccgtgtgcctttgatactctttctctgccaaatgatctccgccctcgaagtgcctttggacccgaagctgctagaggatctagtgcagcctcctacgatcacacagcaaagtcccaaggattacattatcgatccacgcgaaaacattgtgatccagtgcgaggccaaggggaagccaccgccgtcttttagctggactcgtaatggaacccattttgacattgataaggaccctttggtgaccatgaaaccaggaactggcactttaataatcaacatcatgagcgaggggaaggctgagacttacgagtag

SEQ ID NO: 197102 - DNA, 2316 bp, Artificial Sequence
  Description of Artificial Sequence: Synthetic coding sequence
atgcagctgaagatcatgcccaagaagaagcggctgagcgccggcagggtgcctctcatccttttcctatgccaaatgatttctgccctcgaggtcccattggatcttgtgcagccccccacaataacccagcagagtcccaaagattatattatcgaccctagggagaatatcgtgattcagtgtgaggccaaaggaaagccgccacccagcttctcatggacacgaaatggtactcacttcgatatagacaaagaccccctggtcactatgaaacctggaaccggcactcttatcataaatatcatgtcggaaggcaaggctgaaacgtatgaaggggtgtaccagtgcaccgcacgcaacgagaggggggctgctgtgagcaacaatatcgtggtcaggccatcccgctcacccctgtggacaaaggagaaattggagcctataaccttgcagagtggtcaatctctggtgctaccctgtaggcctcctattggtcttccccctcccataattttctggatggacaactcctttcagagactcccccagtctgagagagtgtcccaaggattgaatggcgacctgtacttctccaacgtcctcccggaggatacgagggaagactatatttgctacgccagattcaatcacactcagacaatccagcaaaaacagcccatttctgtgaaagtgatatctgtggacgagctcaatgacacgatagctgcgaatctgtcagacacggaattttacggagcgaagagctccagggagcgtcccccaacttttctaacgcccgaaggcaatgcttccaacaaggaagagctgcggggcaatgtattaagcctggagtgcattgccgaagggctgcccaccccaattatatattgggcgaaagaggacggtatgctgcccaaaaacagaacagtctacaaaaacttcgagaaaaccctgcaaattatccatgtgtcagaagccgattctgggaattaccaatgtatcgcaaagaatgccctgggggcgatacaccacaccatctccgtgcgggtgaaggcggccccttactggattaccgcaccacaaaacttggtactctcgcctggggaggatggcacactcatatgcagggctaacggcaatccaaagccccgaatctcttggctgactaatggagttccgatcgaaatcgcaccagacgacccaagcaggaaaattgatggggataccataattttcagtaacgtccaggaacggtcatctgcagtctatcagtgcaacgcctcaaatgagtacggatacttgttggctaacgcctttgttaacgtgctcgcagagccccccagaattctgacacctgccaatacactttatcaggtgattgccaaccggccggccctgctagactgcgccttcttcggctcacccctccccacgatcgagtggtttaagggagctaagggctctgccctgcatgaggatatctacgttctgcatgagaatggaacactggagattccagtcgcacagaaagactcaacaggaacatacacttgcgtggcccgaaataaacttggaatggccaagaacgaggtgcacctcgagatcaaggacccaacctggatcgtgaagcaaccggagtatgccgtcgtgcagagaggctcaatggtttcatttgagtgtaaggtcaaacacgaccatacactgtccctgacagtgctgtggctgaaggataatagggagctaccgagcgacgaacgctttacagtcgacaaagaccacctagtggtagccgatgtcagcgacgatgacagtggaacgtacacttgtgtcgcaaatactaccctggatagtgtctccgctagcgcggtcctcagcgttgttgacgttccaaatcccccgttcgatctggagctgacagaccaactcgacaagtccgtccagctgtcgtggacaccaggagacgataataactccccgatcacaaagtttattatcgaatacgaagatgcaatgcataagcccggcctgtggcatcaccaaaccgaggtctcaggaacccaaactacagcccagctgaagttaagcccctatgtgaactatagctttagggtgatggccgtcaactcgattggcaagtccctgccttccgaggcctccgaacagtatttaacgaaggcttccgaaccagacaagaatccaaccgccgtggagggactgggatctgaaccagataacctcgtaatcacatggaagccactcaacgggtttgaatcaaatggtccgggcctccagacaagtactgccagtttctag

SEQ ID NO: 197103 - DNA, 321 bp, Artificial Sequence
  Description of Artificial Sequence: Synthetic coding sequence
atgcagctgaagatcatgcccaagaagaagcggctgagcgccggccgcgttcctctgatcttgtttctctgccagatgataagcgccctggaggtgccactggatttagtacagccaccgacaatcacccagcagtcccccaaagattacataatcgatccgcgggagaacatcgtgatccagtgtgaggccaaaggtaagccgccccccagcttctcatggaccaggaatggaacccacttcgatattgacaaggaccctctggtgactatgaaaccaggcacaggaaccctgatcatcaatattatgagtgaggggtag

SEQ ID NO: 197104 - DNA, 3462 bp, Artificial Sequence
  Description of Artificial Sequence: Synthetic coding sequence
atgcagctgaagatcatgcccaagaagaagcggctgagcgccggcagggtccccttaattctattcctgtgccagatgatttccgcactggaagtaccactggaccagaaaagcacggaagtgatggtacagccccccactattacccaacagtctcccaaagactatataatcgatccccgagagaatatcgttatccagtgcgaggcgaaagggaagccaccgccatccttctcctggacgcgaaacgggacgcactttgatattgataaagatccgctggtgactatgaaaccgggcacaggcacactgatcatcaatatcatgtcggaaggtaaggctgagacctacgagggagtctaccagtgcaccgcacgaaatgaaagaggcgcagccgtgtccaataacatcgtagtgcgcccaagtagaagcccactgtggactaaagaaaagctggaaccgatcactttgcaatccggccagagtttagttttgccttgtcgccctcccatcggcctgccccccccaattatcttttggatggataattcgtttcagcgtctacctcagtccgagcgtgtgtctcaaggactcaatggggatctctatttctcaaacgtgctcccagaggatacccgtgaagattatatctgctacgcaagattcaatcatacccagacaatccagcaaaaacagcccatcagcgtaaaagtcatttccgtcgatgaactcaacgataccatagcagccaacctttctgatactgagttctacggggccaaatcaagcagggagaggccacctacgtttctaactccagagggcaatgcatctaacaaagaggaactgagggggaatgttctcagccttgagtgcatagccgagggtttgcccacgccaattatctactgggcgaaggaggatggcatgcttcccaaaaacagaactgtttataagaacttcgagaagacactacagattattcatgtctctgaggcggattcaggtaattaccagtgtattgctaaaaatgccctcggagccatccatcatactatctctgtgagagtgaaggcagctccatattggattacagccccgcagaacctagtgctatctcccggggaggacggcacactaatctgtagggccaacggaaatcctaagcctagaatctcctggcttaccaatggcgtgcctatcgaaatagcaccagatgacccaagccgcaaaatcgatggcgacaccataatcttctcaaacgtccaggaacgctccagcgcagtctaccagtgtaatgcctcaaacgagtatgggtacctgcttgcgaatgcattcgtgaacgttctggctgaacctccacggatcctcaccccagctaacaccctatatcaggttatcgctaatcgccctgcacttcttgactgcgccttttttggatcacctctccccacaatcgagtggtttaagggagctaagggctcagctttacatgaagacatctatgtgctgcacgaaaatggcactctggagatccccgtggctcaaaaggactcaacaggaacctacacctgtgtggctaggaacaaattgggtatggctaagaatgaagtccacctagagattaaggaccccacttggattgtgaagcagcccgagtatgccgtagtgcagagaggaagcatggtgtcatttgagtgtaaggtgaagcacgaccatacactttctcttactgtcctttggctgaaggataatagagagctccctagcgatgaacgtttcaccgtggacaaagatcacttggtcgtagctgacgtttctgacgacgacagcggcacctatacttgcgtagctaatacgactctcgattcagtgtccgccagcgcagttctgtctgttgtcgccccaacgcctacacctgcacctgtatatgatgtccccaatccgcctttcgatctcgagctaacagatcagctcgataaatctgtccagttgagctggacaccaggcgacgacaataattcccccatcaccaagttcatcattgagtatgaggacgccatgcacaagcccggcctctggcatcaccagaccgaggtttcgggcactcagactaccgctcagctgaagctctctccatacgtgaattactccttcagagtcatggccgtcaattccattggcaagtcgctcccctctgaagccagtgagcagtatctgaccaaggccagcgaacctgacaagaatcccaccgcagtcgaggggctgggctccgagcccgacaacttagtcatcacctggaagccgctaaatggcttcgaatccaacgggccaggtctgcagtacaaagtgtcctggcgtcagaaagacggagatgacgagtggaccagcgtcgtcgtcgcgaatgtgagcaagtatatcgtgtctggcacgccaacctttgttccctacctgatcaaggtgcaggccctcaacgatatgggcttcgctcctgagcccgctgtcgtgatgggccattcaggagaggacttgcctatggtggctccaggcaatgtgcgcgttaatgtggtcaacagcaccctcgccgaagtgcactgggatcccgtaccactcaagagtattcgcggacatctacaggggtaccgtatctattattggaagacccaatcctcctccaagagaaacagacggcatattgaaaaaaagattctgactttccagggttccaagacgcacggcatgctgcccggtctcgagccattcagccactacacgttgaatgtgcgtgtcgtcaatggtaaaggagaagggccagcgtccccagatcgcgtgtttaatactcctgagggggttccttctgcccccagctcactcaagatagtgaaccccaccttggacagtctgaccctggaatgggacccaccatcccatccaaacggcatcttgacggagtacaccttgaaatatcagcccatcaattccactcacgaactgggacctttagttgacctgaagataccggccaataagactagatggacgctgaagaacctcaacttttctacgcgttacaagttttacttctatgcacagacaagtgccgggagtggatcccagattacagaagaagccgtcacaaccgttgatgaggctgggatcctgccgcctgacgttggagcgggcaaagccatggcctcaaggcaggtggatatcgcaactcagggctggttcataggacttatgtgcgctgtggcactcctgattctcatacttttgattgtctgcttcattcgcagaaataagggtggtaagtaccctgtgaaggagaaagaagacgcgcatgccgaccctgagattcaacccatgaaggaggacgacggcacatttggagagtactccgacgctgaggaccacaagccgttgaagaaagggtcccggactcccagtgacaggactgtttag

SEQ ID NO: 197105 - DNA, 681 bp, Artificial Sequence
  Description of Artificial Sequence: Synthetic coding sequence
atgcaggtgcacctgaccgtgcaggtgccccccaagatctacgacatctcaaacgatatgaccgtcaatgaaggtacgaatgtcacacttacttgcctggccacggggaaaccagagccgtcaattagctggcggcacatctccccgtccgccaagccatttgagaacgggcagtaccttgatatttacggcatcacacgtgaccaggctggcgagtatgagtgtagcgccgaaaacgatgttagcttcccggacgtacgaaaagtgaaggttgtcgtgaattttgcaccaactattcaggaaattaaatccgggaccgttacacctgggagatctggccttatacgttgtgaaggagccggcgttccaccaccagccttcgaatggtacaaaggggaaaaaaagttgttcaatggccagcaaggcattattatccagaacttctcaacaagatcaatcttgacagtaacgaacgtcacccaggagcattttggcaactacacctgcgtggctgcaaataagctaggaaccaccaacgcaagcctgcctctcaatcctccctccactgcccagtacgggatcactggatctgccgacgtcctgtttagctgttggtacctggtgctgacattgtctagtttcacaagcattttctacctcaagaacgcgatcctgcagtag

SEQ ID NO: 197106 - DNA, 1065 bp, Artificial Sequence
  Description of Artificial Sequence: Synthetic coding sequence
atggacatgatgctgctggtgcagggcgcctgctgcagcaaccagtggcttgctgccgtgcttctctccctgtgttgcctgctcccatcatgcttgcctgcaggtcagagcgtcgactttccttgggcggccgtggataacatgatggtccggaaaggtgacacagctgtgctccgctgctatctagaggacggggctagcaaaggcgcctggctcaaccgcagctcaatcatcttcgccgggggtgataaatggagcgttgacccccgagtgagcatctcaacacttaataagcgggactacagtctccaaatccagaacgtggacgtgacggacgatggaccctacacgtgttcggtccagacccagcatacccctcggaccatgcaggtacacctcacggtgcaagtacctccaaagatttatgacatttcgaacgatatgacagtaaacgaaggcacaaatgtcacattgacatgcctggcaaccggaaaacccgaaccttccatcagttggcgacatatctccccctcagcaaagccttttgagaatgggcagtacctggacatctatgggattacgagggatcaggctggggaatatgaatgctccgccgaaaacgatgtttccttccctgatgtacgtaaggtgaaagtcgtcgtgaatttcgcaccaacgattcaagagattaagtccggtacagttactccaggcaggtcgggccttataaggtgtgaaggtgctggagtgccaccgcccgcttttgagtggtacaaaggcgaaaaaaagctcttcaacggccagcagggcatcattatccagaacttcagcacacggtcaattctaacagtgaccaacgttacccaggaacatttcggaaattacacctgcgtcgctgccaacaaattgggaacgaccaacgcatccttacctctaaatcccccctctacggctcagtacggcatcacggggagtgctgatgtgctcttcagctgctggtacctcgtcttaacactttcatcctttacgtctatcttctacctaaagaacgcaatccttcagtag

SEQ ID NO: 197107 - DNA, 927 bp, Artificial Sequence
  Description of Artificial Sequence: Synthetic coding sequence
atgatgctgctggtgcagggcgcctgctgcagcaaccagtggctggctgcagttttgctttctttgtgctgtttacttccctcatgtctgcccgctgggcaaagtgtagacttcccttgggcagccgtcgataacatgatggtgcgaaaaggagatacagcagttcttcggtgttatcttgaagatggcgcctcaaagggagcctggctgaaccggtcgtcaatcatatttgctggaggggataaatggagtgtagatccacgggtgtctattagcacacttaataaacgggactactccctccagattcagaacgtcgacgtgaccgacgacggtccttatacctgttccgtccagacccagcacacacctaggaccatgcaagtgcacctgaccgtacaggtgccaccaaaaatctatgatatatctaacgatatgaccgttaatgagggcactaatgttacgcttacatgtctcgcaaccggcaaacctgagccttcgatttcctggaggcacatatcgccatcagtggctcctacaatccaggagataaaaagcggtaccgttacaccaggcaggtctggcctcattcgttgtgagggagctggggtccccccaccagcctttgaatggtataaaggtgaaaaaaaactgtttaatggacaacagggcatcatcatccaaaactttagtactagatctattctaactgttaccaacgtgacccaggaacatttcggtaattacacatgcgttgctgctaataagctgggtacaacgaacgctagcctgcctctcaatcctccttccaccgcccaatatggaatcacaggttctgctgatgtactgttctcatgctggtacctggtactcactctgagcagctttacctcgatcttctacctgaagaacgctattctgcagtag

SEQ ID NO: 197108 - DNA, 2133 bp, Artificial Sequence
  Description of Artificial Sequence: Synthetic coding sequence
atggagacccgggagagcgaggacctggagaagacccggcggaagtccgcctccgaccagtggaatactgataacgaaccagcgaaggtcaagcccgaactgctcccagaaaaggaagagacctctcaggcagaccaagacatccaggacaaagaaccgcactgccacattccaataaaacgcaatagtatcttcaacaggtctatccggcgaaagtccaaggccaaggcgcgcgacaatcctgagcggaacgctagctgccttgccgactctcaggataatggaaaaagtgtgaatgaacctctgactcttaatattccctggagcaggatgccgccctgcaggactgctatgcagacagaccctggcgcacaagagatgtccgagagtagttctacccctggcaatggagccacgccagaggagtggccagccctggccgactcgccaaccacgttgactgaagccctgcgaatgatccatccgataccagccgattcatggcggaacctgattgaacagattggcctgctttaccaggagtaccgtgataaatcaacactgcaggaaatcgagactcgacgccagcaagacgcggaaattgaagacaacactaatggatctcctgcctcagaggacactccagaggaggaagaggaggaagaagaggaagaagagccagcatcgccacccgaacgtaagacgctgcctcagatctgcctgctgtccaatccccacagtagatttaatctatggcaagacttgccagaaattcgaagctccggagtcctggagattctgcagcccgaggagattaagctgcaggaggctatgttcgaactggtgacctccgaagcgagctattataagagcctgaacctccttgtgagccacttcatggagaatgagcggatccgtaagatcttacacccctccgaggctcacattctattcagcaacgttctcgacgtcttagccgtgagcgaacggtttctgcttgagttagagcacaggatggaagaaaatatcgttatctctgacgtttgcgatatcgtctataggtatgccgcagaccactttagtgtatacataacctacgtctccaaccaaacctaccaggaaagaacgtataaacagctgttgcaggagaaggccgcttttcgcgagttaatcgcacagctggagctggatcccaaatgcaggggcctgccattctcaagcttcctgatactgcctttccaaaggatcaccagattgaaacttctggtgcaaaacattttaaagcgcgtcgaggagaggagcgaacgtgagtgcacagccctggatgcacacaaagaactcgaaatggttgtgaaagcctgcaatgaaggcgtgagaaaaatgtctcggacagaacagatgatatcaattcagaagaagatggagttcaagattaaatctgtccctatcatcagccactctcggtggctgttaaagcagggcgagttgcagcagatgtccgggccaaagactagcaggaccctgagaacgaaaaagttattccacgagatttatctgtttctatttaatgatctgttggtcatctgtcgacagattcccggggataagtaccaggtgttcgatagtgctccaaggggattgctaagggtcgaggaacttgaagatcaggggcagactctggctaacgtgtttatccttcggctgctggaaaatgcagacgatcgcgaggctacgtatatgctgaaagcctcctcacagagcgagatgaagcggtggatgacgtcccttgccccaaataggcgcactaagttcgtatcttttacatctcggctgctggattgtccccaagtgcagtgcgttcatccttacgtggctcagcagcctgacgaacttacattggaattggcagacatacttaacatcctggacaagacagacgacggctggattttcggtgaacgactccacgaccaggagaggggttggtttccaagcagtatgactgaagaaattctaaatcctaagatccgcagccagaatctaaaggagtgctttagagtgcataagatggatgaccctcagaggagccagaacaaagatagaaggaaactgggatccaggaatagacagtag

SEQ ID NO: 197109 - DNA, 1857 bp, Artificial Sequence
  Description of Artificial Sequence: Synthetic coding sequence
atggagctgctggccgccgccttcagcgccgcctgcgccgtggaccatgacagctccaccagcgaatcggacgctcgggactccgcagccggccatctcccgggaagcgaatcttcttctacccctgggaatggcgctacaccggaagagtggcccgctctggcggactctcccaccaccttgactgaggcacttcggatgatccatcccattcccgccgatagctggcgcaaccttatcgaacaaattggcttgctgtatcaggagtatcgagataagagtactttacaggagattgaaacaaggaggcagcaggatgccgaaattgaagataacactaacggttcccctgcaagcgaggatacgcccgaggaagaggaggaagaggaagaagaggaggagcctgcctctccccccgaacggaagacactgccgcaaatctgtttgttgagcaaccctcatagccgtttcaatctttggcaggacctgcctgagattaggtcatctggggtactcgaaatattgcagccagaagagataaagctgcaagaggctatgtttgagcttgtgacctccgaggcctcatattataaatccctgaacctgctcgtgtctcacttcatggagaacgagcgcatcaggaaaatcctgcacccaagtgaagcccatattctgttcagtaacgtgctggacgttctcgcagttagcgaacgcttcctgctggaacttgaacatcggatggaagaaaacattgtcatttctgatgtgtgcgacattgtataccggtatgccgccgaccacttcagcgtttacattacttatgtgagcaaccagacataccaggaacgcacatataaacagcttttgcaagagaaagctgcctttagggagctgatcgcccagctggagctggacccaaaatgtcggggacttccttttagtagtttcttaatcctgcctttccaaaggatcactagactaaagctcctagtacagaacattctaaaacgagtggaggagcggagtgaacgggagtgtactgcattggatgcccacaaggagctcgaaatggttgttaaggcctgtaacgaaggggtaaggaagatgtctagaacagaacagatgatcagtatccaaaaaaagatggagttcaagattaaatctgtcccaataatcagtcatagccggtggctgcttaagcaaggcgaactgcagcaaatgagcggacccaagacaagtcggacgctgagaaccaagaagcttttccatgagatatacctctttttgtttaacgatttgcttgtaatctgcagacagatcccgggggataagtaccaggtgtttgattcagctccccgggggctcctccgggttgaagagttggaagaccaagggcaaaccttggccaatgtgtttatcctccggcttctggaaaacgcagatgatagggaggccacatatatgctgaaggcgtcctcccaatcagagatgaaacgttggatgacatctctggcccctaaccggcggacaaaattcgtgagttttacttcccggctcttggactgtccacaggtccagtgtgtacacccttacgtagcccagcagcccgatgaactaacattggaactggccgacatccttaatatcttggataaaacagacgacgggtggattttcggcgaacggctgcatgaccaggagcgaggatggtttccaagctcaatgacagaggagatactgaaccccaagattaggagtcagaatctgaaggagtgtttccgcgtgcacaaaatggatgatcctcaacgctcccagaacaaagatcgaaggaagctcggcagccgtaacaggcaatag

SEQ ID NO: 197110 - DNA, 717 bp, Artificial Sequence
  Description of Artificial Sequence: Synthetic coding sequence
atggagctgctggccgccgccttcagcgccgcctgcgccgtggaccatgattcatctaccagtgaaagcgacgcaagagacagtgcagcaggacacctgcctggctccgagagctcgtccacccctgggaatggtgccacccccgaagaatggcctgccctcgcagacagtcccaccaccctgactgaagccttacggatgatacacccgatccctgcggatagttggagaaacttgatcgaacagatagggctgctgtaccaggaatacagggacaagtcaacactgcaagaaatcgagactcgtaggcagcaggacgcggagattgaggacaacaccaatggctctcctgcatccgaggatacgcccgaggaggaagaggaagaggaggaagaagaagaacctgcctctcctcctgagcgaaagacgctgcctcaaatatgcctgctgtcaaatcctcactcccgctttaatctttggcaggatctgcccgagatccgtagctcaggtgtgttggagattctccaacctgaggaaatcaagctgcaggaggccatgttcgagcttgtgaccagtgaggcatcttattacaaaagtctgaacctcctggtttctcacttcatggagaatgagagaattcggaagattctgcatccgtcagaggcccatattctgttctctaatgttctggatgtgctcgcggtatctgagcggtag

SEQ ID NO: 197111 - DNA, 1302 bp, Artificial Sequence
  Description of Artificial Sequence: Synthetic coding sequence
atgttcgagctggtgaccagcgaggccagctactacaagagcctgaatctcctggtgtcccactttatggagaacgagagaattcgcaagatacttcatccttccgaggcacacattctgttctccaacgtcctggatgtgctagccgtgtccgagaggtttctcctcgaattagaacatagaatggaagaaaatatcgtgatctccgatgtgtgtgatatagtgtaccgatacgcagccgaccatttctcggtctacatcacatatgtgagtaatcaaacatatcaggagagaacttacaagcaattgctgcaggaaaaggccgcgtttagggagctcatcgcccagctggagctggaccccaagtgcagaggccttcccttttcctctttcttaattctgccctttcagagaatcacaaggttaaagctcttggtccagaacatcctgaagagagtggaagagcggtctgagagagagtgcaccgcactcgatgcccataaagagctggaaatggtggtcaaggcctgcaatgaaggagtcaggaagatgtcccggacagaacagatgatatcaattcagaagaagatggagtttaagattaagtctgtgcctattatctcacactctcgctggcttttgaaacagggagaactccagcaaatgtccggcccaaaaacatcgcgcaccttaaggacaaaaaaactcttccacgaaatatatctcttcttatttaatgatttgctggtgatttgtcgccagatccctggggacaagtatcaggtgtttgacagcgcccccagaggtctgctgcgggttgaggagctggaagatcagggtcaaaccttagctaacgtgttcatccttcgcctgctggagaacgccgacgatagagaggccacttatatgctgaaagcctcttcacaatctgagatgaaaaggtggatgacaagtcttgcccctaaccgacgaactaagtttgtctctttcacatctaggcttctggattgtcctcaagtccaatgtgtgcatccttatgtcgcccagcagccagatgaactaaccctggaacttgccgatatcctgaatattctcgacaagacagacgatggttggatttttggcgagcgccttcatgatcaggagagaggctggttccccagcagcatgacagaggaaattctgaaccccaagattcgaagccagaatctgaaagaatgtttccgggtccacaagatggacgaccctcaacgctcccagaacaaggacaggcgcaaattgggaagtagaaatagacagtag

SEQ ID NO: 197112 - DNA, 1803 bp, Artificial Sequence
  Description of Artificial Sequence: Synthetic coding sequence
atgcccccctgccggaccgccatgcagaccgaccccggcgcccaggagatgtctgagagcagcagcacccctggtaacggcgctactcccgaggaatggccagctctggccgattctccaacaaccctgaccgaggctctgaggatgatccatcctatccctgctgatagctggaggaatctgatcgagcaaattgggctgctctaccaggagtaccgagacaaatccactctgcaggaaatcgaaacccggagacagcaggacgcggaaattgaggacaacaccaacggaagccccgcttctgaggacaccccggaagaggaggaggaagaggaggaggaagaagagcctgccagtccacccgagcggaaaacgttgccccagatttgccttttatctaatccccacagtagattcaacttatggcaggacctccccgagattaggagctctggagtcttggaaatcctacagcctgaggagatcaaactgcaggaggctatgttcgagcttgtcactagcgaagcttcctactataaatccctcaatctgttagtctcccattttatggaaaatgagaggatacgcaaaatcctacatccatctgaggctcatatacttttttccaacgtgctggatgtcctggcagtgagtgagcgattcctccttgaactggagcataggatggaggaaaatattgttattagcgacgtttgcgacatcgtctatcggtatgctgccgatcactttagtgtttatattacctatgtttccaatcagacctatcaggaaaggacgtacaaacagttgctccaagagaaagccgcctttagagagctgatcgctcagctggagcttgacccgaagtgtcgcgggctcccgttcagctccttcttaatcctgccattccaaagaattactaggctcaaactgctcgtgcagaatatcctgaagagggtagaggaacggagcgagcgcgaatgtaccgccttagatgcacacaaggagctcgaaatggtcgtcaaggcgtgtaacgagggggtaagaaagatgtcgcggacagagcaaatgatctcgatacagaaaaaaatggagtttaaaattaaatcagtgcccatcatctctcatagtaggtggcttctgaagcagggagagctgcaacagatgtccggacctaagacctcgcggactctccgcaccaagaaattgttccacgaaatctacctgttcctttttaacgacctgctcgtaatatgccggcagatcccaggagataagtatcaggttttcgactcagccccaagaggactcctccgagtggaagagctggaggatcagggtcagacccttgcaaacgtgtttatcctgcggttgcttgagaacgctgacgatcgggaggcaacatacatgctgaaggcctcatctcagtctgagatgaaacgttggatgacatcactcgcccctaaccgccgaaccaaatttgtcagttttaccagtagattgttggactgccctcaggtgcagtgtgtgcatccatatgtcgcgcagcagccggacgagctgaccttagagctagccgatatattgaacattctagacaagacagacgacgggtggatttttggagagcgactgcatgatcaggaaaggggttggtttcccagttccatgactgaggagattctcaaccccaagatccgttctcagaatttaaaggagtgtttcagagtccataagatggacgacccacagagatcccagaataaagacagacggaaactgggctcaaggaacagacagtag

SEQ ID NO: 197113 - DNA, 705 bp, Artificial Sequence
  Description of Artificial Sequence: Synthetic coding sequence
atgaccggcagcagcgtgttcgactacatccaccccggcgaccactctgaggtgcttgagcagctcggcttaaggactcctacgcctggcccgcccacccctccgtctgtgtcttcgtcatcttcctcttcgtcctccctcgccgatactcctgagatcgaggcatcactgacaaaggttcctccaagttcactggttcaggaacgatcatttttcgtgcgcatgaagtcaactctcacaaaacgaggattgcatgtgaaagcctccggttataaggtgatccacgtgactgggaggctgcgcgctcatgctctgggcctcgtggccctgggccataccctcccgcctgctcctctggcggagctgccgctgcacgggcacatgatagtgtttcgcctttcactgggattgactattttggcatgcgaatctagggtatccgaccacatggatctgggaccctccgaactagttgggcgcagctgttatcaattcgtgcacggccaggacgcaaccaggatcagacagtcgcacgtcgacagctgcagaggcttgcgagtggcagcagtgtgtgggcattccggctgggaacgagaggagccccgcggcgcaccctgtgccctgggacagcctcgagcccagccttctaggggttggcctaactcttttggctgtctgcctgcctcatctcaaagggggctttag

SEQ ID NO: 197114 - DNA, 1773 bp, Artificial Sequence
  Description of Artificial Sequence: Synthetic coding sequence
atggccgccccctaccccggcagcggcggcggcagcgaggtgaagtgcgtaggagggaggggcgccagcgttccctgggactttctgccgggtctgatggtcaaagccccgtcaggcccgtgccttcaagctcaacggaaagaaaagtcccgtaacgccgctcgtagtcgccgcggcaaggagaatctcgaattttttgagcttgccaaactgttgcctctccccggggcaatctcaagtcagctcgacaaagcttccattgtgcgattgagtgtgacctatctgagactccgccgttttgccgcccttggcgcgccgccatggggactaagagctgctggacccccagccggccttgcccccggccgccgaggtcctgcagcactcgtttcggaagtgttcgaacagcacctgggcggacatatcctccagagcctggatggcttcgtgtttgctctcaatcaggagggcaaattcctttatatatcagagactgtgtcgatctatctgggcttatctcaagttgagatgacgggcagctctgtgttcgattacatccatccgggggatcattctgaggttcttgagcagctggggctgcgcactccgacacctgggccacccactccacctagcgtcagctcaagctcttcctcatccagctctctggcagacaccccagaaatcgaagccagcctcacaaaagtccccccgtcctcgctggtgcaggaaagatcttttttcgtccgcatgaaatctactctcactaaacgcggactacacgtcaaggccagcggctacaaagtgatccacgtgacaggtaggttgagagcccacgccctgggtctcgtggcattgggacacaccttacctcccgcccccctggcggagctcccactccatggacatatgattgtctttcgacttagtctcggactaacaatactggcctgtgaaagtcgggtgagcgatcacatggacctcggccccagcgagctggtgggcagatcttgttaccaatttgttcatggacaagacgccaccagaatccgccaatctcacgttgatctgcttgataagggccaagtaatgaccggttattatcgctggctgcagcgggctggcggttttgtgtggctccagagcgtggccacagttgcaggctcaggaaaaagtcccggtgaacatcatgtgctttgggtgtctcacgtcctgagtcaggccgaaggcggccagacacctttagacgctttccagctgccagcatccgttgcttgtgaagaggcgtctagccccggccccgagcccacagagcccgaaccccccacagaagggaaacaggcagcacctgcagaaaatgaggccccccagacccaagggaaacgcatcaaagtggaacccggccctcgagaaacaaaaggcagcgaagacagcggagatgaagatcctagtagtcatccagccacgccacggcccgagttcacgagtgtcattcgggctggcgtgttgaagcaggacccggttaggccctggggtctggcaccccccggtgacccaccgcccacactgttgcatgcagggtttctgcccccagtggttcgcgggctctgtacgcccgggactatccggtacgggcctgcagaattggggctggtctatccccacttgcaaagactgggacctggacctgcactgcctgaggccttctacccccccctggggctcccgtatcccggcccagcaggcacaaggctgcccaggaagggagactag

SEQ ID NO: 197115 - DNA, 2475 bp, Artificial Sequence
  Description of Artificial Sequence: Synthetic coding sequence
atggacgaggacgagaaggaccgggccaagcgggccagccggaacaagtcagagaagaaaaggcgcgaccagttcaatgttctgatcaaggaactatcttccatgcttcctggaaacacgaggaaaatggataaaaccactgttctcgagaaagtgatcggattccttcagaaacacaatgaagtatctgctcagacagagatttgcgacattcagcaggactggaaaccaagctttttatcaaatgaagaattcacccagctgatgctggaggcccttgacggcttcattattgcagtcacaacagacggctccattatatatgtcagcgacagtatcacaccactgctaggacaccttcccagcgatgtcatggatcagaacctgctgaattttctgcccgagcaagagcactcagaagtgtacaagatcctttcaagccatatgttggtgaccgatagcccttctccagagtatctgaagagtgatagcgatttagaattttactgccatctgttacgggggagtctgaaccccaaagaattcccaacatacgaatatattaagtttgtggggaacttcaggagctacaacaatgtccctagcccaagctgtaacggcttcgataacacattatctcgtccctgccgggtgcccctgggtaaagaagtgtgcttcatagccactgttagactggctacacctcagttcctcaaggaaatgtgtattgtagacgagcccctggaggagttcacaagcagacacagccttgagtggaagttcttgttcttagaccaccgggcaccacccataataggatacctgccatttgaagtgcttggcacgagtggttacgattactaccacatcgacgacctggagctcttggcaagatgccaccagcacctaatgcaattcggtaagggcaaatcttgttgttacagatttttgacaaaaggacagcaatggatctggctgcagacgcactattacattacctaccatcagtggaattccaagcctgaatttattgtctgcacccacagcgtcgttagttacgccgacgtgcgagtcgagcgtcgtcaggagctcgcgctcgaagaccccccatctgaggcccttcactcctcggcactcaaggataaaggtagctctcttgagccaaggcagcacttcaatactctcgacgtgggggcctcgggtctcaatacaagtcacagtccatctgcttcctcaagatcaagtcataagtcatcccacacggcgatgtcggaaccgaccagcacaccaactaagctaatggctgaggcaagcacccctgccctcccccgctctgctacactgccgcaggaattaccagtgccgggcctgtcccaggcagccacgatgcctgcgccattgccaagtccctcatcatgcgacctgacacaacagcttctgccacagactgtgctgcagtccacaccagcgcccatggctcagtttagcgcacagttcagtatgtttcaaaccattaaagaccagctggagcaacggaccagaatcctgcaagcaaatatacgctggcagcaggaagagttacataagatccaggagcaactgtgtctggtccaagatagtaatgtgcaaatgttcctccagcagcccgccgttagcttgtctttttcatcaacccagcgccccgaagctcagcagcagttacagcagcgctccgccgcagtgacacagccccagctaggcgccggacctcagcttccaggccagatatcttccgcccaggtgacatctcagcacttattaagagagtcctctgtgatctcaacacaaggtcctaaaccaatgcgatcatcccagctcatgcagagctctggtaggagcggttcttctttagtgtctcctttctcttccgctaccgccgctcttccccctagtctcaatctgactactcccgcgtcaacgtcacaagacgccagtcaatgtcagccatcacctgactttagtcatgaccggcagttacgcctgcttctaagtcaacccattcagccaatgatgcccggatcctgtgatgctcgacaaccttcagaagtctcaagaaccggacgacaggtgaagtatgctcagtcgcaaaccgtcttccagaatcctgacgctcatcctgccaattcctcctccgcccccatgccagtgttgctgatggggcaagcagtgctccacccatcttttccagcctctcaaccctcccccctgcagcctgcacaggcccgacaacaaccaccgcagcactacctgcaggtgcaggcgccaacgagtctgcacagcgagcagcaggatagcctgcttctgtctacttactcacagcagcccgggacgctgggctacccccaacctcccccagcccagccccagcctctccggcccccaaggcgcgtgtcctcactcagtgagtcatccgggttgcagcagccacctcggtag

SEQ ID NO: 197116 - DNA, 2670 bp, Artificial Sequence
  Description of Artificial Sequence: Synthetic coding sequence
atgtacgcctacggcttcgtgggccggtgcgcccccttccccgccgaggaagggcgcacatttgacctttctgaagagctgggtagatcagtgactcgggaggggactggtacaacccgactgaattctgagcctgtcccactactttgcctcccactgctaaattgttcccgcaagaactgcattgagaatctaatggacgaagacgaaaaagatcgcgccaagagggcatcgagaaacaaatcggaaaagaagaggcgggaccagtttaatgttctgattaaggagctgagtagcatgcttcctggcaacacaaggaagatggataagaccaccgttcttgagaaagttattggctttcttcagaagcataatgaagtctccgcccaaacagaaatctgcgacatacaacaggattggaaacctagctttctcagtaacgaagagtttacacagctgatgttagaggccttggatggcttcatcattgctgtgactacggatggctccatcatttatgttagcgactctattacccctttactgggccacctccccagcgatgtgatggatcagaatttacttaattttctgcccgagcaggaacactcagaagtctataagatcctgtcctcacacatgctcgtgaccgatagccccagcccagagtaccttaaaagcgattccgatctagagttttattgccacctgctcagggggtcactgaaccccaaagagtttccgacgtacgagtacattaagtttgtggggaacttcaggtcttataacaatgtaccgtctccttcttgtaacggctttgataacaccctgtcacgcccttgccgcgtaccgctgggaaaagaggtatgtttcatcgcgaccgtgcgcctcgctacaccccagtttcttaaagaaatgtgtattgtggacgagcccctagaagagtttacaagtcgacactctctggagtggaagtttctttttctggatcaccgggcgcccccaatcataggatacctgccttttgaagtcctgggtacttccggctacgattactatcatatagatgacctcgagctactcgcgcggtgtcaccagcatctcatgcagtttggcaaggggaaatcatgttgttatagatttttaacaaagggacagcagtggatttggctgcagacacactactacataacttaccaccaatggaattctaagcctgaattcatcgtctgcacccattccgtggtgagctatgcggatgttcgtgtggagaggcggcaagaactggctctcgaagatcccccgagcgaagcactacattcaagtgcattaaaagacaaggggagttccctggagccacgccaacatttcaacacattggatgttggagcgtccggcctcaacacatcgcatagtccatccgcatccagtcgatctagccacaagagctcccacaccgcaatgagtgaacctacatcgaccccaactaagctgatggctgaggcctccacgcctgctctcccccgctcggccactctgccacaagagttgcccgtacccggattatcccaggctgcgaccatgcctgccccactgccctccccgagttcctgcgatctgactcagcagctgctgcctcagaccgtattgcagtcaacacctgctccaatggctcagttcagcgcgcagttctccatgtttcagaccatcaaagatcagttagaacaacgcacacggattcttcaggccaacatcaggtggcaacaagaagaattgcacaaaatccaggaacagctgtgccttgtgcaggattctaatgtgcaaatgttcttacagcaacctgctgtgagtctcagtttttcatccacccagaggccggaggcacagcaacagcttcagcagaggtcggctgcggtgactcagccccaactgggcgccggacctcagctgcctgggcaaatctcttctgcgcaagtgacctcccagcacctcttaagagaaagcagcgtcatctcaacccagggcccaaagccgatgaggtcatcccagctgatgcaatcatccggccggagcggatcatctctcgtgagcccatttagcagcgccacagcagccctgcctccatcccttaatcttaccacccccgccagcacaagccaggacgcgtcacaatgtcagcctagtcctgacttttcccatgacaggcagctccggctgctgctgagccagcctatccagcccatgatgccaggatcttgcgatgcccgtcagccgtctgaggtatcacgaacaggacgccaagtgaaatatgcacaaagccagaccgttttccagaaccctgatgcacacccagccaattcttcatccgccccaatgccagtgttactcatgggccaagctgtactgcatccaagtttcccagcatcacagccttccccattacaacccgcacaggcacgtcaacagcctccacagcactatctccaggtgcaggcccctacctccctgcactctgagcagcaggactcactcctgctaagcacctattcccaacagccaggtactctcggctatccgcagccaccacctgctcagcctcagcctctgcgacccccccgtcgagtttcttcactgtctgagtcctcaggcctccaacagccacccagatag

SEQ ID NO: 197117 - DNA, 774 bp, Artificial Sequence
  Description of Artificial Sequence: Synthetic coding sequence
atggcccccaccaagcccagcttccagcaggaccccagccggcgggaaagaatcacagcacagcatccactgcctaatcagtccgaatgtcgtaaaatctaccgctacgacggcatatattgcgaatccacctatcagaacctccaagctcttcggaaggagaagagtagagatgctgctcgaagtcggcgcggcaaggaaaactttgagttctacgaattagctaaactcttgcccctcccagctgctatcacctcacagttggataaggcttctattatccgcctgacaatttcatacctgaagatgcgcgatttcgcaaaccaaggcgacccaccctggaatctcagaatggagggtcctcctccaaacacatctgtcaaggtcattggcgcccagcgccggagatccccaagcgccttggccatcgaggttttcgaagcacacctggggtcgcacatcttacagtctcttgacggattcgtttttgctctgaatcaggaaggcaaattcctgtatatttcagagacagtgagcatttacctgggattatcacaggtggaactcactggctccagcgtgttcgattatgtccatcccggcgaccatgtggagatggccgaacaactgggcatgaaattgcccccaggtagggggttactgtcacaggggaccgccgaagacggggcgtcctcagcgtcgagttctagccagtcagagacacccgaacccgtggtttgttttccgcccgcttctgaccagttccttctatag

SEQ ID NO: 197118 - DNA, 2706 bp, Artificial Sequence
  Description of Artificial Sequence: Synthetic coding sequence
atggcccccaccaagcccagcttccagcaggaccccagccggcgggaaaggttacaagccctgagaaaagagaagtcacgagacgcagctcgatccaggaggggcaaagaaaacttcgagttctatgagttagcgaagctgctgccactgcccgctgccattacaagtcagctggacaaggcgagcataattcgattgacgatttcatacttgaaaatgagggacttcgcaaaccaaggtgatccaccctggaacctccgaatggaggggccgccccctaacactagtgtgaaaggagcccaacgacgccggtcgccctccgccttagcaattgaagtattcgaggcacacctgggatcccatatccttcaatcactcgacggatttgtgtttgctctcaaccaagaagggaaattcttgtatatttctgagacagttagtatctacctcggactgagccaagtagagctgaccggctcatcagttttcgactacgttcaccctggggatcatgtcgaaatggctgagcagctgggcatgaaattaccaccaggacgcggcctgctaagtcagggcactgcagaagacggcgccagctcagcttcctcaagtagccagtccgagacccctgaacctgtggagagcactagcccaagccttttgacaactgacaataccctggagcggtctttcttcatccggatgaagtccactctgaccaagaggggggttcacatcaaatcttccggctacaaggttatccatatcaccggcaggctgcggctgcgcgtttccttgtcacatggccggacagtgccaagccagatcatgggactcgttgtcgtggcacacgccctcccaccaccaactatcaatgaagttcgaatcgattgccacatgttcgtcacacgggtcaatatggacctgaacattatctattgtgagaaccgcatctcggactatatggatctcaccccggttgatattgtgggtaaaagatgttatcactttatccatgccgaggatgtggagggcatcagacatagccacctggatttattaaataagggtcagtgtgtgactaaatactacaggtggatgcagaagaacggggggtatatctggatccagagctctgccactatagcaatcaatgcgaagaacgccaatgaaaaaaacattatttgggtcaattatttgctctctaaccccgaatataaggatacaccgatggacatagctcagcttccacatctgccagagaaaaccagtgagtccagtgaaaccagcgattccgaatctgattcaaaggacacatctggaataaccgaagacaatgagaactccaagtcagatgaaaaaggtaaccagtctgaaaatagtgaagaccctgaacctgaccgcaaaaaatcagggaatgcttgtgacaatgatatgaactgtaacgatgacggccatagcagtagcaatccggatagccgggatagtgatgattcgttcgaacacagtgacttcgaaaatccaaaggccggggaggacggttttggcgctttgggggcaatgcagattaaagtagaaaggtatgtcgagtcagagtccgatctcaggttgcagaattgcgagagcctgacctctgattccgccaaagactcggacagcgccggggaggccggagcgcaagcaagttcgaaacatcagaagaggaaaaagagaaggaagaggcagaagggcggttctgcgtctcgccgtcgcttgagttcagcatcaagcccgggtggcttggacgctggcctcgtggagcctccacgtctcctctcttcacctaattcagcttctgtgctgaaaattaagaccgagatcagtgagccaatcaacttcgataatgatagctctatttggaactatcccccaaacagagaaatttcacgtaacgaaagcccctactccatgacaaagcccccttcttctgaacactttccgtctccacagggcggtggaggagggggggggggaggcggtggcttgcatgtcgcaattcccgacagcgtgcttacccctcctggagctgatggggccgccgccagaaaaacacagtttggagccagtgctacagccgccctggctcccgtggccagcgacccgctgagtccacctttgtctgcaagtccacgggacaaacaccccgggaacggcggaggggggggaggaggaggagggggggctgggggggggggacctagtgcatctaactctttgctatacacaggggatctagaagccctccagcgtcttcaggctggaaacgtcgtcctgcctttggtccatcgcgtgactggaacacttgccgccactagcactgccgcgcagcgcgtatatacaactgggacgattaggtacgcccccgctgaagtcacactggcaatgcaatccaatttgctaccgaacgcgcacgcagtaaactttgtcgatgtcaacagccctggtttcgggctggaccccaagacaccaatggagatgctgtaccaccacgtccatcgcctgaacatgagcggtccgttcggcggcgccgtttctgcagcgagccttacacagatgccagctggcaacgtgtttactacagctgaaggccttttcagcactttgccgttccccgtctacagcaacggaatccacgccgctcagaccctggaaaggaaagaggattag

SEQ ID NO: 197119 - DNA, 2802 bp, Artificial Sequence
  Description of Artificial Sequence: Synthetic coding sequence
atggcccccaccaagcccagcttccagcaggaccccagccggcgggaacgcatcacggcccagcacccacttccaaatcaatcagaatgtcgcaaaatttatagatatgatggaatttactgcgaaagtacctaccagaaccttcaggccttgagaaaggaaaaatctcgagatgcggcccgatcccgcaggggtaaagaaaactttgaattttacgagctcgcgaaattgctgcctttgccggctgccatcacgtcccaactggacaaagccagcattattaggttgactatttcatatttgaaaatgagggattttgctaatcagggtgatcccccatggaatctgcgcatggagggtcccccccccaacactagcgtcaaagtcataggcgcgcagcgccggcggagcccaagcgctctggcaatcgaggttttcgaggcacacctcggtagccatattcttcagagcttagatggatttgtttttgcactgaaccaggaaggcaagttcctgtatatcagcgagacagtttccatatatctgggcctctcacaggtggaactgaccggatcctcggtcttcgattatgtgcatccaggggaccacgtggagatggcagaacagctggggatgaagttgccaccggggagagggctcctttcgcaggggacagccgaagatggagctagctccgccagctcttcatcgcagtccgaaacccccgagcccgtcgaatcaacctcacctagtctcctgacaacggacaatacactggagcgctcttttttcatcaggatgaagtccaccttgaccaaacgcggtgtccacattaagagcagcgggtacaaggtaatccacattaccgggaggctgcggcttagagtttcattatctcacggcagaaccgtgcccagtcagatcatgggtctagtcgtggtagctcatgctctaccaccacccaccatcaatgaagtccgcatcgattgtcacatgttcgtcacacgtgtaaacatggacctcaacataatatattgcgaaaacaggatctctgactacatggacctcacgcccgtagatatagtgggtaagagatgctaccactttattcatgctgaggacgtggagggtataaggcattctcacttagatctgttgaataagggacagtgtgtcacaaaatattataggtggatgcagaaaaacggaggctatatctggatccagtctagcgccactattgcaatcaatgcgaaaaatgcgaatgaaaagaatatcatttgggttaattacctgttatctaatcccgaatataaagacaccccgatggacatagcccaactgcctcaccttcccgaaaaaacgtccgagtcctctgaaaccagcgactctgagagtgattctaaagacacttctggcatcacagaagacaacgaaaattccaagagcgatgaaaagggcaaccaatctgaaaattccgaggatccggagccggaccggaaaaaatctggcaatgcctgcgacaacgatatgaactgtaatgacgacggccatagttctagtaaccccgactccagggattctgacgactcattcgagcattcggactttgaaaacccgaaggctggggaagacggcttcggagccctgggcgcaatgcagatcaaagtcgaaagatatgtagaatcggaatccgatctgcggctgcaaaattgcgagtcgctcacaagcgacagtgcgaaggatagcgactccgctggggaggcgggcgcccaagcatcttcaaagcatcagaaaagaaaaaaaagacgcaagcgtcagaagggaggctctgcttctaggaggaggctgagttccgcatcctcccctggaggccttgacgcaggcctggtcgagcctcctagattgttgtcaagcccgaactccgcctccgttcttaagattaaaacagagatcagcgaacctatcaattttgataatgattcgtctatatggaactaccctcctaacagggagatcagtagaaacgaatctccctactccatgaccaaaccaccaagttccgaacatttcccctccccgcagggaggaggaggcggcggcggcggtggcggggggctgcacgttgcgattcccgatagtgtcctgaccccccccggagctgatggcgccgcagccagaaagacgcagtttggcgcaagcgcgactgcagcactggctcccgtggcatccgacccactcagtccccctctctcagcaagtccacgggataagcaccccggcaatgggggcgggggagggggcggagggggaggcgccggtggcggaggcccctccgccagcaattccctcctgtatactggagatttagaggccctccagaggctgcaggctgggaatgtcgttttgccgctggtgcatcgggtgactggtaccctggctgccactagcaccgccgcgcaacgcgtctatactactggaacgattagatatgccccagccgaagtcactctggctatgcaatccaatctcctcccaaatgcccacgcagtaaatttcgtggatgtgaattccccaggattcggtctggatccaaagacccccatggagatgttgtatcaccatgtacaccgcctcaacatgtccggaccattcggcggggctgtcagcgctgcgtcactcacacagatgcctgccggcaacgtgttcaccaccgctgagggactctttagtaccctgccctttccagtatactccaacggcattcacgccgctcagaccctcgagagaaaagaagactag

SEQ ID NO: 197120 - DNA, 2763 bp, Artificial Sequence
  Description of Artificial Sequence: Synthetic coding sequence
atggcccccaccaagcccagcttccagcaggaccccagccggcgggaacgacttcaggctttgaggaaagaaaaatctcgcgatgccgctaggagccggaggggaaaggagaactttgaattctacgagcttgccaaactccttcccctccctgccgcaatcacaagccagctggacaaggcatctattattcgcctgaccatctcatacctcaagatgcgcgattttgccaatcagggcgaccccccatggaacctgagaatggaaggtccgccaccgaatacgtctgtgaagggcatccagatgtggaaatcagagctttgtatgcgtaaaacgccgtgcgaggtgattggagcccagagacggaggtcaccctccgctctagcaattgaagtttttgaggcccatttggggagtcacatcctgcagagcctggatgggttcgtgtttgcgctgaaccaagaggggaaatttctatacatctccgagactgttagcatatacttgggtctctcacaagttgagctgactgggtcgtcggtttttgactatgtccacccaggtgatcatgtggaaatggcagagcagctaggaatgaagcttcctcccgggcggggtctcctgtcgcagggaacagcggaggatggagcctcatcagcatcaagttccagtcaatctgaaactcctgagcccgtggagagtacatccccctccctcctgaccacagataacactcttgaaagatcttttttcatccgcatgaagagtacgcttacaaagcgtggggttcatattaaaagctcaggatacaaggtcattcacattaccggtcgattacggttacgtgtgtcactctctcacggccgcaccgttcctagccagatcatgggcctggtggtagtggctcatgctctgcccccccctactatcaacgaggtccgtatcgattgtcacatgtttgttactagagttaatatggatctgaatattatttactgtgagaatcggatttcagactatatggatcttactccagtagatattgtcggaaaacgatgctaccacttcatccacgctgaggacgtggagggtatcagacacagccacctggatctgttgaacaaggggcagtgcgtgacgaagtactaccgttggatgcagaaaaatggtggttatatctggattcagtctagcgcaaccatcgctatcaacgctaagaatgccaacgaaaagaatatcatttgggtcaattacctgctgtcaaaccccgagtataaggatacaccgatggatatagcccagctcccccacttgcctgagaaaaccagtgagtcttccgagacttctgacagtgaatccgacagcaaagataccagtggtatcaccgaggataatgagaacagtaagagcgacgaaaagggaaaccaatcggagaactcggaggatccagaacccgatagaaagaaaagcggaaatgcctgcgataatgacatgaactgtaatgatgacggacacagttcatctaatcccgatagcagggactctgacgatagcttcgaacacagcgatttcgaaaacccaaaggcgggcgaagatggtttcggtgcattaggcgccatgcagatcaaggtggagagatatgtggagtccgagtccgatttgcgactccagaactgcgagtcgttaacttctgactccgccaaggatagtgacagcgccggtgaggcaggcgcgcaggctagcagcaagcaccagaaaaggaagaaaagaagaaaacggcaaaaggggggctccgccagcagaaggagactttcgtcggctagtagtcccggcgggttggatgctggacttgtggaaccaccgcggctgcttagcagtccgaattctgcctcggtgctcaagattaaaactgagatctcagaacctataaatttcgataacgactcaagtatttggaactatccacccaatcgggaaatctctagaaatgaatccccttattctatgactaaacctccaagcagcgaacacttccctagtcctcaggggggaggaggcggaggaggaggaggggggggtctccatgtggccatcccagatagcgtgctcacaccaccaggcgctgacggtgccgcggccaggaagacccagtttggggccagcgctactgccgccctggccccagttgcatctgatcctcttagtccacctttaagcgctagccctcgggataaacatcccggaaacgggggcgggggcggaggcggaggcggcggcgctggagggggggggccatcagcttctaactcattactgtatactggagacttggaagccctccagcggctccaggccggaaatgtcgtgctgccgcttgtgcatagagtgactggcacattggcggccaccagcacggccgcgcagcgggtatatactaccggtactattcgttatgccccagctgaggtaaccctggccatgcagtccaacctgctccctaacgcccacgccgtcaattttgtggatgtcaactctcctggatttgggctggaccccaaaaccccaatggagatgctctaccatcatgtgcatagactcaacatgtctggaccatttggcggggctgtctccgctgcctcgcttactcagatgccggcggggaacgtgtttactaccgctgagggactgttctccactctcccattccccgtgtactccaacggtattcatgccgcccaaactctggagcgcaaggaggactag

SEQ ID NO: 197121 - DNA, 462 bp, Artificial Sequence
  Description of Artificial Sequence: Synthetic coding sequence
atgcgggacttcgccaaccagggcgaccccccctggaacctgcggatggaagggccccccccaaacactagcgtgaaaggagcacagcgaagacggtcacccagtgctttagcaatagaagtgttcgaggcacaccttggaagccacatcctgcagtctctggatggctttgttttcgcactcaaccaagagggcaaattcctttacatcagtgaaaccgtctccatttacctcggattgtcgcaagtggagctcaccgggagctctgtctttgactatgttcatcctggggaccatgttgagatggcggagcaactgggcatgaaactccctcctggtaggggactcctatcccaaggaactgccgaggacggggcttcctctgcatcctcatcatcccagagcgagaccccagaaccagtggtttgcttcccacccgcatccgaccagttcttgctttag

SEQ ID NO: 197122 - DNA, 2712 bp, Artificial Sequence
  Description of Artificial Sequence: Synthetic coding sequence
atggcccccaccaagcccagcttccagcaggaccccagccggcgggaacgcctccaagctcttcggaaagagaaatcacgggacgccgcgcgatctcggagaggcaaagagaacttcgaattctacgaactggctaaactactgcccctccccgccgctatcacctcccagttagacaaggcatctatcatacgtctaactatttcctacctgaagatgagggatttcgcaaaccagggggaccccccttggaatctgaggatggaggggccgccccctaataccagtgttaaagtcatcggagcgcagcgtcgaaggtcacctagcgctctcgctattgaggtgttcgaagcccacctgggctcccacatcctgcagtccctggatgggttcgtgtttgccttgaatcaggaaggcaagttcttgtacatctctgaaacagtgtcaatctacctcggactctcacaggttgaactcacaggaagttctgtgttcgattatgtgcacccaggcgaccacgtagaaatggccgagcagttaggaatgaaactgcctccgggcaggggactgcttagtcagggcaccgccgaggatggagcaagttctgcttcttcctcctctcagagtgagacaccagaacccgtcgaatcaacatctccaagcctattgactactgataatactcttgagaggtcttttttcatcagaatgaagtccaccctcacgaaaagaggagtccacataaagtcgagcggctataaagtaatccatatcaccggaagattgcggctgagagtcagcctgtctcatggaaggactgtccctagccagattatgggccttgtggtggtggcgcacgccctgcctcctcccaccattaacgaggtaaggattgactgtcacatgttcgtcacccgggtgaacatggacctcaacatcatttattgcgaaaatcgaatttcagactacatggatctgactcccgtggacatcgttggcaaacgctgctaccattttattcacgccgaagatgtcgaaggtataaggcatagtcaccttgatctgttgaacaagggccagtgcgttaccaagtactataggtggatgcagaagaacggaggctacatttggatacagagttccgcaaccatcgctatcaacgccaaaaacgcaaatgagaagaacatcatctgggtcaattacctgttatcgaaccccgagtataaggataccccaatggacattgctcagctcccccatctacctgagaaaacctctgagtccagtgaaacaagtgactcggagagtgatagtaaagacacctcggggataacagaggacaacgaaaatagtaaatccgacgaaaagggcaaccaatccgagaactctgaagatccagaaccggatcgcaagaagtcaggcaacgcctgtgacaatgacatgaactgtaacgatgacggccatagctcctcgaatcccgattcacgagactctgacgactcattcgagcatagtgattttgaaaatcctaaggcaggcgaagacggtttcggagctctgggcgctatgcaaatcaaagttgagcgatacgtggagagtgaatccgaccttcgtctgcaaaattgtgagagcctgacatcagattcagcaaaagattcagattctgccggcgaggccggtgcgcaggccagctccaagcaccagaaacgtaaaaagcggagaaagagacagaagggtggttctgcctcgagacgaaggctgagttccgcctcctcccctgggggactggatgccggcctggtggaaccccccaggttactctcctcccccaactcagccagtgttctgaaaattaaaacggaaatttctgagcctatcaattttgacaacgattcttccatctggaattatccccctaacagagagatctcgcgaaacgagtccccttactctatgaccaaacctccgagtagtgaacatttcccttcgccacaaggcggaggtggtggtggagggggcgggggggggttgcatgtggccattccagacagtgtgctcacaccccccggagcagacggagctgcggccaggaaaacgcaattcggcgccagcgccacggctgccttggcgccagtcgcctctgatcctctatctcctcctctgtcagcatctccgagggataagcaccccgggaatggggggggggggggaggcggaggcggcggagcagggggaggaggtccaagcgcaagcaactctcttctgtacacgggggacctcgaggcacttcagaggctgcaggctggaaatgttgtattgcccttagtccatcgcgtgacaggtacgctggcggccacatctactgctgctcagcgagtctacaccaccgggactatccggtatgccccggcagaagtaacactggcaatgcaatccaacctcttgccaaacgcccacgcagtcaattttgtggacgtaaacagtccgggtttcgggctcgatcctaagactccaatggaaatgctgtaccatcacgttcacagactcaacatgagtgggcctttcgggggtgcggtgtccgccgcctccctgacccagatgccagccgggaacgtgtttactaccgcagaggggttgttttcaactctgcccttccccgtgtactcaaatggaattcatgccgcccaaacgctggagcgtaaagaagattag

SEQ ID NO: 197123 - DNA, 2409 bp, Artificial Sequence
  Description of Artificial Sequence: Synthetic coding sequence
atgtaccggagcaccaagggcgccagcaaggcccggcgggaccagattaatgcagagattcggaatttaaaggaattactacccctcgcggaggcggacaaagtccggttgagctacctgcatatcatgagccttgcttgcatctataccaggaagggggtgttctttgctggggggaccccactcgccgggcccacagggctcttgagcgctcaggaactggaagatatcgttgctgccttgcccggtttcctgctggtatttaccgcagagggtaagttgctgtatctcagcgagagcgtcagtgagcaccttggacactcaatggtggatctagtcgcccagggggatagcatctacgatattatcgacccagctgaccacctgaccgtccgacagcagctgacactcccttctgccctcgatactgatcggctatttcgatgccggttcaacacttctaagagccttcggagacagtccgcgggcaacaagctggtgctgattagggggcggttccacgcccacccaccaggggcttattgggctgggaatccggtctttaccgccttctgcgctcctctggagccaaggcccaggcccggacccggccctggaccaggccctgcatccctattcctcgccatgttccagagtcgacacgcaaaggacttggctctgctggacatcagcgagagtgtcctgatctatcttggattcgagcgcagcgagctcctgtgcaaaagttggtacgggctccttcatccagaggacttggcacacgcgtctgctcagcattatcgtcttctggctgagtccggagacattcaggctgagatggtcgtgcggctacaagccaaaaccggcggctgggcgtggatctattgtttactgtatagtgagggccccgaagggccaattaccgcaaataactatcctatttcggacatggaagcctggagcttgagacagcaacttaattccgaggacacccaagcagcctatgtgctcggcactcctaccatgcttccctctttccccgagaacattctttctcaagaggagtgctcatccacaaaccctctgtttaccgctgctctcggggcgcctcgctccactagctttccatccgcaccagaactctccgtggtgtccgccagtgaggaattgcctaggccctcaaaggagctggacttttcatacttgacctttcctagtggaccggagccatccctgcaggcagagctctcgaaggacctagtctgcacacctccgtacacacctcaccaacctggaggttgtgcttttctgttctctctccacgaacctttccagacccaccttcctacaccaagtagcaccctccaggagcaactgactccctctacagcgacttttagtgaccagcttacaccgagctcagccaccttcccagatcctctgacaagtccactgcagggacagctaacggagacctccgtacggtcttacgaagaccagctcaccccctgcacaagtactttccctgaccagttactcccatcaacggctactttcccagaaccgctggggtccccagctcacgaacagctgacccctccttctaccgcgtttcaagcacacctggatagcccctcacagacctttcccgagcaactgagcccaaaccccactaaaacctacttcgctcaggagggctgctcgtttctgtatgagaagctgccaccttccccctcctccccggggaacggagattgcaccctgttagcgctcgctcagctcagaggcccattgtcggtcgatgtgccccttgtgccagagggcctccttacccctgaggcatcacccgtaaagcagagtttctttcactacagcgagaaggagcaaaatgagatcgacaggcttatccaacaaatctcgcaacttgcacagggaatggaccgaccattttccgctgaggccggcactggaggcctcgaaccactagggggcctagagccactggacagtaatctgtcgctgagcggagccggcccacctgtcttgagccttgacttaaaaccctggaaatgtcaagaactggatttcctcgccgacccggataacatgttccttgaagaaacaccagttgaagacattttcatggatctgtccacgcccgatccatccgaggaatggggaagtggcgatcccgaagcggagggacctggcggggcaccaagtccgtgtaataacttatctccggaggatcactctttccttgaagatctggccacctatgagacggccttcgagaccggggtgtcggctttcccatacgacggttttactgacgagctccaccagctgcagagccaagtccaggacagcttccacgaagatggctccgggggagaacccacattctag

SEQ ID NO: 197124 - DNA, 705 bp, Artificial Sequence
  Description of Artificial Sequence: Synthetic coding sequence
atgtaccggagcaccaagggcgccagcaaggcccggcgggaccagatcaatgccgagattagaaatctcaaagaactgctgcccctggccgaagcggataaagtgcgcctgtcctatctgcacattatgagcctggcgtgcatttatacccggaagggagtattctttgctggtggtactcctttagcggggcctaccggccttttatccgcccaagaactggaggatatcgtggccgccctgcctgggtttctcctagtgtttactgctgaaggcaagttactgtacctgagcgagagcgtctcagagcatctcggccactcaatggtcgacctggttgcgcagggggattcaatttacgacattatagatccagccgatcacttgacagtgaggcaacaacttactctcccttcggctctggacaccgatcggctgttcaggtgtaggttcaatacatctaagtccttacgtaggcagtccgccgggaataagctcgtgttgataaggggccgcttccacgcgcatccccccggagcctactgggcggggaaccccgtcttcactgctttttgcgcgcctttggaaccccgacctaggccagggcccggaccaggcccggggcccgcctccctcttcttggctatgtttcagtcccggcatgcaaaggacctcgcactgttagatatctccgagtcaggatag

SEQ ID NO: 197125 - DNA, 1299 bp, Artificial Sequence
  Description of Artificial Sequence: Synthetic coding sequence
atgcccgccggccgggccgcccggacctgcgccctgctggccctgtgccttctgggcgccggcgcccaggatttcggcccaactcggtttatctgcacaagcgtgccggtggacgctgatatgtgcgcagccagcgtggctgccggtggagccgaagaactccgctccagtgtgcttcagttgcgcgaaaccgtgctccaacaaaaagaaaccatcctgagccaaaaagaaactatcagggaattaactgcaaagctagggcgatgcgagtcgcagagcacgctggaccctggcgcaggggaggcacgagccggcggcggaagaaaacaacctggcagcggcaagaacactatgggcgatctgagtcgcacacctgctgctgagactctaagccagttagggcagacattacaaagtctaaagacaaggttggaaaacctggagcagtatagcaggctgaatagctcaagccagacaaactccctcaaagaccttctccaatccaaaatcgatgagctggaaaggcaggtgttgagtcgcgtgaacacgctggaggaaggaaaaggcgggcctcgcaacgacaccgaagagagggtgaaaatagagaccgcgctgaccagtctacaccagcgcataagtgagctggagaaaggtcagaaagataatcgacccggtgataaatttcagctgactttcccgctgcgtacaaactacatgtatgccaaagtgaaaaaatcactacccgagatgtacgcgtttaccgtgtgcatgtggctgaagtcttctgccactcctggggtgggtaccccattctcttatgccgttcccggccaggcaaatgaactcgtactcatcgagtggggaaataatccaatggagattctgattaacgacaaggtggccaaattgccatttgttatcaacgatgggaaatggcatcacatctgtgtgacttggacaactagggacggcgtatgggaagcgtatcaggatggaacccaagggggttcgggcgagaatctcgccccctaccatcccatcaagccccagggggtgctggtgctgggtcaagagcaggacaccctggggggtggtttcgatgccactcaggccttcgtcggcgaacttgctcatttcaacatctgggataggaaattgacgccaggagaagtatacaacctggcaacttgctccacaaaggccctgtccggcaatgtcatcgcctgggcggagtcccacatcgagatttacggaggcgccactaagtggacctttgaagcgtgccggcagatcaattag

SEQ ID NO: 197126 - DNA, 585 bp, Artificial Sequence
  Description of Artificial Sequence: Synthetic coding sequence
atgtacgccaaggtgaagaagagcctgcccgagatgtacgccttcaccgtttgcatgtggctgaagtcatccgccactcctggggtgggaaccccgttctcttatgccgttcccggacaagccaatgaattggtgctgattgagtggggtaataaccctatggagattctaatcaatgacaaagtggccaaactgccatttgttatcaatgatggcaaatggcaccacatctgcgttacctggaccacacgtgacggggtttgggaagcatatcaggatggaacccaggggggtagcggtgagaacctagcaccttatcatccaattaagcctcagggtgtactcgtcctaggacaggaacaggatactctgggcgggggctttgatgccacacaagcattcgtcggcgaactcgcccatttcaacatttgggaccgtaagcttactcccggagaagtttataacctcgctacttgcagtacaaaggccctctcggggaacgtgatcgcctgggcagagtcccacattgaaatctacggcggagcaacaaaatggacgtttgaagcttgcagacagattaactag

SEQ ID NO: 197127 - DNA, 1296 bp, Artificial Sequence
  Description of Artificial Sequence: Synthetic coding sequence
atgctggccctgctggccgccagcgtggccctggccgtggccgccggtgcacaggatagtccggcccctgggagcaggttcgtttgcaccgctctgccaccggaggctgtacatgctggatgccccttgcccgcaatgcctatgcagggtggcgcccaatcacccgaggaggagctccgggcagccgtgcttcagctcagggagactgtcgtccagcagaaagagaccctcggtgcccaacgcgaagccattcgcgagctgaccggcaagctggcaaggtgcgagggccttgcaggtggcaaggctcggggcgcaggcgcaaccggaaaagataccatgggagatttaccccgggaccctggccacgtagtggagcagctgagcagaagtctgcaaacgctgaaagaccggctggaatcgttagagcaccagcttcgagcgaatgtgtccaacgccggtctccccggggacttcagagaagtcctacagcagaggttaggagaacttgagcgccaactattacgcaaggttgccgaactggaagatgagaagagtctgctgcacaacgagacaagcgcccataggcagaagactgagtccactctcaacgctctactgcagagagtcaccgaactcgagagaggcaatagtgcattcaagagtcccgacgcttttaaggtgtccctgccattacgcacgaactatctatacggaaagataaagaaaactctgcctgaactgtacgcctttacaatctgtctatggcttcgaagttcagcctcccctggcatcggaactcccttcagctatgcggtgccaggccaggccaatgagattgtcctgattgagtggggcaacaacccaatagagcttttaatcaatgataaggtcgctcagctacccctgttcgtgagcgacgggaagtggcaccacatctgcgttacctggaccacccgtgacgggatgtgggaggcctttcaggatggcgagaagctgggcacaggggaaaatctggcaccttggcatccaatcaaacccggcggagtgcttatcctgggtcaggaacaggataccgtgggcggcaggttcgatgctacacaggcgtttgtcggcgaactgtctcaattcaacatctgggaccgcgtgctacgcgcacaggagatcgtaaatatcgccaattgttccacaaacatgcccggtaacatcatcccatgggtcgataacaacgtggatgtgtttggtggcgcctctaagtggcctgtggagacctgtgaagagcgcctgttagacctttag

SEQ ID NO: 197128 - DNA, 246 bp, Artificial Sequence
  Description of Artificial Sequence: Synthetic coding sequence
atggccgccgtggccgccgccagcgccgagctgctgatcatcggctggtatatttttcgcgtgttactccaggtgtttttggaatgttgcatttactgggtggggttcgccttccgcaacccccctggtactcagcccattgctcgttctgaagtctttcgttatagcctacagaagctggcctacaccgtgtccagaaccggacggcaggtgctcggagagaggaggcagcgcgccccaaattag

SEQ ID NO: 197129 - DNA, 165 bp, Artificial Sequence
  Description of Artificial Sequence: Synthetic coding sequence
atggccgccgtggccgccgccagcgccgagctgctgatcatcggctggtatatttttagagtactgcttcaggtgtttcgttacagcctgcaaaagctggcatacacagtgagtcggactgggagacaggttctgggcgaacggagacagcgcgcaccgaattag

SEQ ID NO: 197130 - DNA, 270 bp, Artificial Sequence
  Description of Artificial Sequence: Synthetic coding sequence
atgatcagcagcgtgaagctgaacctgatcctggtgctgagcctgagcactatgcacgttttttggtgttatcccgtaccctcctccaaggtgagcggaaagtctgattacttcctaattctcctcaattcttgtccaacaaggctggacagatcaaaggaactggcctttctgaaacctattctcgagaagatgtttgtgaaaagatcattcagaaacggagtcggcactggtatgaaaaagacctccttccagagggccaaatcatag

SEQ ID NO: 197131 - DNA, 525 bp, Artificial Sequence
  Description of Artificial Sequence: Synthetic coding sequence
gtggtgctgctgtacgccagcacctacgtgctggtgagcctgagcatagataggtatcacgctatcgtatacccaatgaaagtcttgatagtgattgcctggagccttagtttcctattttccatccccacgctaatcattttcggcaagcgtacactgtctaatggggaagtgcaatgctgggccttatggcccgacgattcctactggaccccttacatgacgattgtggcattcttgggcagcttgattacttttatctgctgttggagcccttatttcttgttcgacatactggataactttaatctgctgcccgacacacaggagagattctatgcttccgtaataatccagaaccttccagcattgaattctgccattaatccactcatctattgcgtcttctcctcttccatatcttttccttgccgcgaacagagaagccaagactcacggatgaccttccgggaaagaactgagaggcacgaaatgcaaatattgtctaagcccgagttcatctag

SEQ ID NO: 197132 - DNA, 1134 bp, Artificial Sequence
  Description of Artificial Sequence: Synthetic coding sequence
atgcccgccaacttcaccgagggcagcttcgacagcagcggcaccggtcaaactttggatagttcccctgtggcttgtacagagacggtgaccttcaccgaggttgtcgagggcaaagagtggggctctttctactactcctttaagactgagcagcttattacgttatgggtcttgtttgttttcacaattgtggggaatagcgtcgtactattcagcacttggaggcgcaagaagaagtcacggatgacgttcttcgttactcagctggcaatcaccgacagctttacgggcctggttaacatactaaccgatatcaactggagattcacaggagacttcacagcacctgatctggtgtgtagggtcgtgcgatacctgcaggtggtgctgctgtacgcgtcgacatacgtactggtatcgttgagtattgacagatatcatgcgattgtgtacccaatgaagtttctacaaggagagaaacaagctagggtgctgatcgttattgcctggtccctttccttccttttctcaatacccacacttatcatcttcggcaagcgcactctgtccaacggggaagtgcagtgttgggccctgtggccagatgactcttactggacgccctatatgacaatagtggccttccttgtctacttcatccccttgacaattataagcatcatgtatggaatcgtgatccgaaccatctggattaagagtaagacatacgaaactgtgattagtaactgcagcgacggtaaactgtgctcttcttataatcgcggactgatcagtaaagccaaaataaaagcgatcaagtattctatcataattatcttagccttcatttgttgttggtccccatacttcctgtttgacatcctggataatttcaatctgttaccagacacccaggaaagattctatgcctcggtgataatacagaacctacctgctctcaattcagctatcaatcccctgatctactgtgttttctccagtagcattagctttccatgtcgagtaatccgcctgagacagctccaggaggccgccctaatgctatgcccacagcgggaaaactggaaagggacatggccaggcgtgccatcatgggccttgccaaggtag

SEQ ID NO: 197133 - DNA, 1116 bp, Artificial Sequence
  Description of Artificial Sequence: Synthetic coding sequence
atgcccgccaacttcaccgagggcagcttcgacagcagcggcaccggacaaactcttgattcgtcccccgtcgcctgcaccgagacagtgacgttcaccgaagtggtcgagggaaaggagtggggcagcttttactacagtttcaagacagaacagcttattacgctatgggtgttgtttgtattcacgattgtaggaaatagtgtggtcctgttttccacatggcgacgtaaaaagaagagcagaatgactttctttgttacacagcttgctatcacggattcttttaccggtttggtgaacatactgacagacattaattggagattcacgggggattttactgccccagacctggtgtgcagagttgtgaggtatctgcaggtggtgttgttgtacgcctctacttacgtcctcgtttcattgagcatcgaccgataccacgccatcgtatatcctatgaagtttttacagggagagaaacaggcaagagttctgatcgtaattgcttggagtttaagtttcctgtttagcattcccaccttaattatctttggtaaacggacactatcaaatggtgaggttcagtgctgggccctctggcctgacgattcctactggactccttacatgacaattgtggcctttctggtttactttattccacttacaatcatctcaattatgtacggcatcgtgattcgcacaatttggattaaatccaagacatatgaaaccgtaatctctaattgctctgacggcaagctgtgttccagctataataggggattaatatccaaggccaagatcaaggcgataaagtattccataatcattatccttgcattcatctgctgttggtcgccttacttcctgtttgatatcctggataatttcaacctgctcccagatacccaagagcggttttacgcctcagtcattatccaaaatctccctgctctcaattccgccataaaccctttaatttactgcgttttcagcagtagcatctcattcccttgccgcgagcagaggtcacaggactcgaggatgaccttcagagagcgaaccgaacgtcacgagatgcagattctgtccaagcccgagttcatctag

SEQ ID NO: 197134 - DNA, 1173 bp, Artificial Sequence
  Description of Artificial Sequence: Synthetic coding sequence
atgcccgccaacttcaccgagggcagcttcgacagcagcggcaccggccagacacttgattcttctcccgtagcctgcacagaaacagtgacgttcactgaagtggttgaaggcaaagagtggggtagtttttactactcctttaagactgagcagctgatcacactgtgggtgctctttgtttttactatcgtcggcaattctgtggtcctcttttccacttggagacgaaaaaaaaaatcccggatgacattttttgtgacacaactggctattacagacagttttactgggctggtaaacattttaactgacataaactggaggttcaccggggactttactgcaccagacttagtgtgtagagtagtgcggtacctccaggtggtgcttctgtatgctagtacttacgtcctggtcagcctgagcattgaccgataccatgccatagtataccccatgaagtttttgcagggggaaaaacaggccagagtgctgattgtgattgcctggtctctgtcttttctttttagcatccctacgctgatcatttttggcaagcgaaccttgtcaaacggtgaagtccaatgctgggctctgtggccagacgactcatactggacgccctacatgacaatcgtggcctttctcgtctattttattccactgactatcatatccataatgtatgggatcgtgattagaaccatctggataaaatctaagacatacgagacagtgattagcaactgttctgacggcaaactctgctcctcctataatcgaggacttatttccaaagctaaaattaaagccattaagtacagtattattataatcttagcctttatctgttgttggagtccctacttcctgttcgacatcttagataacttcaatctgctgcctgatacccaggagagattttatgcctcagttatcattcagaatttgcccgccctgaactccgccataaatcctctgatctattgtgtctttagcagctccatatcgttcccctgtagggctaactcaagtgtctatttgcttgcatgcgacgtgtccgtcctctgggccttggtcttaacatccgaaaaggaatcatgcgaaagctggaggcggaaaggagccaagatcacggggtttcagaacgacgtgcccggcgagaactag

SEQ ID NO: 197135 - DNA, 918 bp, Artificial Sequence
  Description of Artificial Sequence: Synthetic coding sequence
atgcccgccaacttcaccgagggcagcttcgacagcagcggcaccgggcagacgttggatagctctccagtggcgtgcaccgagaccgtgacattcaccgaggtggtagagggaaaggaatggggaagtttctactatagtttcaaaaccgagcaactgattacgttgtgggtcctctttgtcttcactatagtgggaaattctgtggtgctgttttcaacgtggcgtaggaaaaagaagtccaggatgacattttttgttacccaactggcgatcacagaaaaacaagccagggtcttgattgtaatcgcgtggtccttatcgttcctgttttcgattccaactttgatcattttcggaaagcggacgctgagtaacggagaggtgcagtgctgggctctgtggccagatgacagctactggacaccctatatgactatcgtggcgttcctggtgtactttatacccctgacgatcatttcgatcatgtacgggattgtcatccgcacaatttggattaaatccaaaacttacgagacagttattagcaactgtagcgacggaaagctatgtagctcctacaacagaggtctgatttctaaggccaagattaaggctatcaagtatagtattataattatccttgcctttatttgctgctggtcaccatacttcctcttcgatattctggataactttaatctgctccccgatacgcaagagaggttttatgctagcgtcatcatccagaatctgcccgcactgaattcagccataaaccccctgatctactgtgttttctcttcctcaatttcttttccatgtcgggaacagaggtcacaggattcccgcatgaccttcagagaaagaaccgagagacatgaaatgcagatccttagtaagcccgagttcatctag

SEQ ID NO: 197136 - DNA, 432 bp, Artificial Sequence
  Description of Artificial Sequence: Synthetic coding sequence
atgcccgccaacttcaccgagggcagcttcgacagcagcggcaccggacagacattggacagttcccctgtggcttgtacggagacagtgacttttacagaggtggttgagggcaaagagtggggctcattttattattccttcaaaactgaacagttaattactctgtgggtgctctttgtttttacgattgtagggaattcggtagtcctattttccacctggcgacggaagaagaagtcacggatgacattttttgtgactcagctcgccattacagactctttcacagggctcgtgaatattctgaccgacattaattggaggttcacgggagatttcacggcccctgacctcgtctgcagagtggtgaggtatctccaggtaatggttatgaagctgttccacattcaaaaaatgaacatggaatag

SEQ ID NO: 197137 - DNA, 285 bp, Artificial Sequence
  Description of Artificial Sequence: Synthetic coding sequence
atgcccgccaacttcaccgagggcagcttcgacagcagcggcaccggtcagaccttggacagttccccagtggcctgtaccgaaacagtgacctttacagaggtcgtcgagggaaaagaatggggctccttttactattcgtttaaaactgagcagctgataaccctctgggttttattcgttttcaccatcgtgggaaatagtgtcgtgcttttttcaacgtggcgtaggaaaaagaagagcaggatgacatttttcgtaacccagttggctatcacagtatag

SEQ ID NO: 197138 - DNA, 294 bp, Artificial Sequence
  Description of Artificial Sequence: Synthetic coding sequence
atgctgggcaacaagcggctgggcctgagcggcctgaccctggcccttagtttactggtgtgcttaggagcactggctgaagcctacccgtccaagccagataatcctggcgaggacgctccagcagaggacatggcccgctactatagtgccctgcgccactatatcaacctgatcacgcggcagcgatacggtaaacggtcatcgccagagactctcatctcagacctcctgatgagagagtccacggaaaatgtccccagaacccggctggaagaccccgccatgtggtag

SEQ ID NO: 197139 - DNA, 294 bp, Artificial Sequence
  Description of Artificial Sequence: Synthetic coding sequence
atgctgggcaacaagcggctgggcctgagcggcctgaccctggccctcagcctgctcgtctgtctgggtgctctggccgaagcctacccaagcaaacctgacaaccctggggaagatgccccggctgaagatatggccaggtattactcagccctccggcattacatcaacctgataaccaggcaaagatatgggaaacgctcctctccagagaccttaatatcagacctcctgatgagggagtcaaccgagaatgtaccaaggaccagactggaggaccccgctatgtggtag

SEQ ID NO: 197140 - DNA, 294 bp, Artificial Sequence
  Description of Artificial Sequence: Synthetic coding sequence
atgctgggcaacaagcggctgggcctgagcggcctgaccctggccttatcactactggtgtgcctcggggctctagccgaggcttatccttcaaagcctgacaaccccggggaggatgctccagccgaggatatggctcggtactattctgcactgaggcactatatcaatctgatcacccggcagcgctatggaaaaagaagtagtccggaaactctgattagtgatctactgatgagggagagcactgaaaatgttccccgaacgagactcgaagacccagctatgtggtag

SEQ ID NO: 197141 - DNA, 1155 bp, Artificial Sequence
  Description of Artificial Sequence: Synthetic coding sequence
atgaacagcaccctgttcagccaggtggagaaccacagcgtgcactctaatttcagtgagaagaacgcccagcttctggccttcgagaatgatgactgccacttgcccctggctatgatatttactttggcattggcttatggtgctgtaatcattctgggggtctctggcaacctggcactcataataatcattctgaagcagaaagagatgaggaatgtgaccaacattctgattgtaaacctttcctttagcgaccttctggtagcgatcatgtgtctgccatttacctttgtgtatacactgatggaccattgggtttttggagaagctatgtgcaaactgaatccgttcgtccagtgcgttagcatcacagtgtctatcttcagtctggtgctcatcgcagtagaaagacaccaactgatcatcaatccacggggatggagacccaataatagacacgcctatgtcggtatcgccgttatttgggtgcttgccgtggcctcatctctcccctttcttatttaccaggtgatgaccgatgagccgttccagaatgtgaccttggatgcatataaggataaatacgtgtgctttgatcagtttccctcagacagccacagactctcttatactaccctcctgctcgtcctgcaatactttggacccttatgctttatatttatttgttatttcaagatctacattcggctgaagagacggaataatatgatggacaaaatgcgggacaataagtatcgcagcagcgagactaaacgcatcaatatcatgctcctctcgatagttgtcgcttttgcagtgtgttggctgcccctgacgatcttcaacaccgtcttcgattggaaccatcaaatcatcgcgacttgcaaccacaatctgttgttcctcctgtgtcacctgaccgcaatgattagtacatgcgttaatcccattttttacgggttcttgaataaaaacttccagagagatctacagtttttctttaatttttgtgattttcgcagcagagacgatgactacgagactatagctatgtccaccatgcacacggatgtgagcaaaactagcttaaagcaggcttcgcccgtggcctttaagaaaattaataataacgatgacaacgagaagatttag

SEQ ID NO: 197142 - DNA, 186 bp, Artificial Sequence
  Description of Artificial Sequence: Synthetic coding sequence
atgaacagcaccctgttcagccaggtggagaaccacagcgtgcactccaacttcagcgagaagaacgcacagcttttggctttcgaaaacgacgattgccacctgccactcgccatgatttttacactggctcttgcctacggagccgtgattattctgggtgtgagtggcaatctggccctctag

SEQ ID NO: 197143 - DNA, 426 bp, Artificial Sequence
  Description of Artificial Sequence: Synthetic coding sequence
atgatggacaagatgcgggacaacaagtaccggagcagcgagaccaaaagaattaatatcatgctgctcagtatagtggtcgcttttgccgtctgttggttgcctctcactatatttaataccgtctttgactggaatcaccagattatcgcaacttgtaaccataatttgttatttttgttatgccacttaaccgcaatgatttctacgtgtgtcaatccaattttttacggatttctcaataagaatttccaacgcgatctgcaattcttcttcaatttttgcgattttcggtcaagggacgacgactatgagaccatcgctatgtctactatgcatactgatgtgtccaagacatccttaaaacaagccagtcctgtggctttcaagaagattaacaataacgatgataacgagaaaatctag

SEQ ID NO: 197144 - DNA, 78 bp, Artificial Sequence
  Description of Artificial Sequence: Synthetic coding sequence
atgaacagcaccctgttcagccaggtggagaaccacagcgtgcactcaaatttttctgaaaagaatgctcaactttag

SEQ ID NO: 197145 - DNA, 183 bp, Artificial Sequence
  Description of Artificial Sequence: Synthetic coding sequence
atgaacagcaccctgttcagccaggtggagaaccacagcgtgcactccaatttcagcgagaaaaatgcacagttactggccttcgagaatgacgactgtcatctgcccctggccatgattttcactctggctctcgcatacggggctgtgatcattctcggcgtaagcggcaatctggcctag

SEQ ID NO: 197146 - DNA, 1146 bp, Artificial Sequence
  Description of Artificial Sequence: Synthetic coding sequence
atgggccccatcggcgccgaggccgacgagaaccagaccgtggaggaaatgaaagtggagcaatacggcccacagacaactcctcggggggaactggttcccgatcctgagccggagttgatcgacagcactaagctgatcgaggtccaggtggtgctcatcctggcctattgtagtattattctgctgggggtaatcgggaactctttggtgatccatgtggtgataaagttcaagtcaatgaggaccgtaaccaattttttcatagctaatctggctgtagcggacctgttggttaataccctttgtctaccttttaccctgacttatacccttatgggggagtggaagatgggccccgtcctctgtcatctggtgccgtacgcccagggactggcagtgcaagtatctaccataaccctgacggtgatagccttggaccgccacagatgtatcgtctatcatttggagtctaaaatatctaaacgaatctctttcctgattatcgggctagcctggggaatttccgctctccttgcatcccccctggctatcttccgcgagtattcactgatcgagatcatcccagactttgaaatcgtggcatgtacagagaagtggccaggcgaggagaagagtatatatggtactgtgtactcactgtcctccctcctcatcctctacgtgctgcctcttggcattatctccttctcatatacacgcatctggagtaaattgaagaatcatgtcagccccggggctgctaacgaccactatcaccagagacgccagaaaaccaccaagatgctggtgtgtgtcgtcgtcgttttcgccgtgagctggctcccactacacgcttttcagctagctgttgacatcgactcccaggtcctcgatctcaaggagtacaaacttattttcactgtctttcacattatcgcaatgtgctcaacctttgccaatcccctgctgtatggctggatgaactccaactatcgaaaggccttcctgtctgcattccgctgtgaacagcgcctggacgcaatccattcggaggtctcagtgacctttaaggcgaaaaaaaatctggaagtgcgaaagaactcgggccccaatgatagcttcactgaagccaccaacgtctag

SEQ ID NO: 197147 - DNA, 1146 bp, Artificial Sequence
  Description of Artificial Sequence: Synthetic coding sequence
atgggccccatcggcgccgaggccgacgagaaccagaccgtggaggaaatgaaggtggagcagtatggaccacagaccacacctcggggagagctagttccagaccccgagcctgaactgattgatagtactaaattaatcgaggtacaagtcgttcttattctggcgtattgcagcatcatcctattgggcgtgattgggaattcccttgttatccatgtcgtcattaagttcaagtccatgcgcacggttaccaatttttttatcgccaacttagcagtggcagatctgttggtgaacacactgtgcttacctttcaccctaacatatacgctcatgggagagtggaaaatggggcccgtactgtgccatctcgtcccctatgcccaaggcctcgccgtgcaggtatctactattaccctgactgtcattgcccttgatcggcaccgctgtatcgtctaccacctggagtctaaaatctctaagagaatctccttccttatcatcgggctggcatgggggatatctgcactgttagcctcacccctcgcaatcttccgcgaatatagcttaatcgagatcatcccagatttcgagatcgtggcctgtacagagaagtggcctggagaagagaaaagtatctacggcacggtttactctctgagctcattgctcatactttatgtgctgccactcggtatcatctccttttcctacacccgtatctggtccaagctgaagaaccatgtttcaccgggggcagccaatgatcattaccatcagagacgtcagaagacgacgaaaatgctggtatgcgtcgttgtggtgttcgccgtctcctggcttccgctgcatgcttttcaattggccgtagatattgatagtcaggtgctcgatctcaaggagtataagcttatctttacagtgtttcatattattgccatgtgctccacgtttgctaatccactgctgtatggctggatgaattctaattaccggaaggcctttctctccgcttttcgttgcgagcagcgtctcgacgctatacattcagaagtctccgtgaccttcaaggctaaaaagaatcttgaggtacggaaaaatagcggaccaaacgactccttcacagaggcgacaaacgtttag

SEQ ID NO: 197148 - DNA, 1338 bp, Artificial Sequence
  Description of Artificial Sequence: Synthetic coding sequence
atggacctggagctggacgagtactacaacaagaccctggccaccgaaaataacacggccgccacccgcaatagcgatttcccagtgtgggatgactataagtcctcagtagatgacttacagtatttcctgatcggactgtacacttttgtctccctgcttgggtttatgggaaatctactgatccttatggcgctcatgaagaagcgtaaccagaagaccaccgtcaatttcctcataggcaatctggcgttctccgacatcctggtcgtactattttgttcaccattcacacttacctccgtgcttctggatcagtggatgtttggcaaggtgatgtgtcacatcatgccttttctgcagtgcgtcagcgtcctcgtaagtacactgatactgatctcgattgctattgtgcgctaccatatgatcaaacacccgatctctaataatctcacggccaaccatggatacttcctgatcgcgacagtgtggaccttggggttcgctatttgttctccccttcccgtgtttcactcccttgtggaattacaagaaaccttcggctcggcactgctctcttcacgctacttgtgtgtggaaagctggccttcagactcataccggattgcatttacaatctcgctgcttttggtacagtatattctgccactggtgtgcctgaccgtttcgcacacctccgtgtgcagatctatttcctgcgggctttccaacaaggaaaacagattggaggaaaacgaaatgattaatctaaccctccatccctccaaaaaatcaggaccccaagtgaaactcagcgggtcgcacaagtggagctacagcttcattaaaaagcatagacgacggtactcaaaaaaaaccgcttgtgtgctgcctgccccagaacgaccttcacaagaaaatcatagtcgtattttaccagagaactttggaagcgtacggagtcagctatcctcttcttcgaagttcatccctggtgtgcccacctgtttcgagatcaagcctgaagagaactcagatgttcacgagctcagagttaaacgctctgtgactagaattaaaaagcgcagccggtccgtattctacagactgaccatccttatccttgttttcgcagtttcttggatgcctcttcatctcttccatgtcgtgaccgactttaacgacaaccttatttctaaccgtcactttaagctagtgtactgtatctgccatctcctgggtatgatgtcttgctgcttgaaccccatcctctatggctttctgaataacgggattaaagccgatctcgtgtctctgattcactgtctacacatgtag

SEQ ID NO: 197149 - DNA, 1338 bp, Artificial Sequence
  Description of Artificial Sequence: Synthetic coding sequence
atggacctggagctggacgagtactacaacaagaccctggccaccgagaacaacaccgctgccacaagaaacagtgattttccagtatgggatgactacaagtcctcagtggatgacctgcagtactttctgattggattgtatacgtttgtcagcctgctcggctttatgggcaatctgttaatcctcatggcactcatgaagaagagaaatcagaaaaccacagtcaactttcttattggcaatctcgcttttagtgacatcctggtggtattgttctgtagcccgttcacactcacatctgtactgttggatcagtggatgtttggtaaggtcatgtgtcatatcatgccatttctgcagtgcgtgtcagtgcttgtgtcaacgcttatattgatttctattgcaatcgtaaggtatcacatgatcaaacaccctatcagcaacaaccttacggctaaccatgggtattttctaatcgcgacagtctggaccctcggatttgctatttgcagtccgttacccgtgttccattcactggtagagctgcaagaaacatttgggagcgccctactgagtagtaggtacctgtgcgtggaatcttggccatccgactcgtacagaatcgcctttacgatatccctattactcgtccaatacattttgccccttgtttgcctaactgtaagccacactagcgtttgcaggagcatcagttgcgggctctctaacaaggaaaaccgactggaagaaaacgagatgataaacctgacgctgcacccgtctaaaaagagcggtccccaagtgaagttgtccggttcccacaagtggagttacagctttatcaagaaacatcgccgtcgatattcaaaaaaaaccgcttgtgtgttacctgctcctgaacgaccctctcaggaaaatcattcaagaatcctgcccgaaaattttggaagcgtgaggtcccagttgtcaagtagcagcaaattcattccgggggtgcccacctgttttgaaatcaagccagaggagaattctgatgtacacgagctgcgggttaaaagatctgttaccagaatcaaaaaacgcagcaggtcagtgttctaccggttgactatcctcattctcgtgttcgcagtgagttggatgcctctccatctgtttcatgtggtgacagacttcaacgacaacctaatttccaatcgacactttaaactggtttattgcatctgccaccttctcggtatgatgagttgctgtcttaatcccattctatatggcttcctcaacaatggcataaaggcagatctggtgagtctgattcactgcctacatatgtag

SEQ ID NO: 197150 - DNA, 1338 bp, Artificial Sequence
  Description of Artificial Sequence: Synthetic coding sequence
atggacctggagctggacgagtactacaacaagaccctggccaccgagaacaacactgcagctacgaggaactcggattttcccgtgtgggatgattacaaatcctctgtggacgatctccagtattttctgattggactgtataccttcgtttctctgcttgggttcatgggcaatttgctcatcctaatggcccttatgaaaaaaaggaaccagaaaacaacggttaacttcttaattggcaacctggccttttctgatattcttgtggtgctgttctgcagtcctttcacactgactagtgtactgctcgatcaatggatgttcggaaaggtaatgtgccatatcatgccatttcttcagtgtgtttccgtgcttgtgtccacgctcatcctgatctcgatcgctattgttcggtaccatatgatcaaacatcccatatccaataatctgacagccaaccacggctatttcctcatagccacagtgtggacattgggcttcgcgatttgttccccactacctgtctttcattcactggtggagctccaggaaacgtttgggtccgcactattatctagtagatacctgtgcgtcgagtcctggccttcagacagctaccggattgctttcacaatctccctgctcctggtgcagtacattttacccttggtttgtcttacagtgtcacacacttctgtctgtagaagcatcagctgcgggctgagcaataaagaaaaccggttggaagaaaatgagatgattaacctgaccctgcacccatccaagaagagtggtcctcaagttaagctgagcggatcacataagtggtcttatagcttcatcaaaaagcacagacgaagatatagcaagaagacagcctgtgtgctgccggcaccagaaaggcccagccaggagaatcacagcagaatactccctgagaatttcggctcggtgcgctcccagctatcctcttcgtcgaaattcattcctggcgtccccacttgttttgaaatcaagcccgaggagaactctgacgtgcatgaactgagggtcaaaagaagtgtcacaagaatcaaaaaacgctccagatcagtgttttatcgactcactatcttaatcttggtatttgctgtgagttggatgccacttcatctttttcacgtggtcactgacttcaatgataaccttatcagcaaccgtcatttcaagctcgtgtattgcatatgccacctcctgggaatgatgtcttgctgcctgaatccgattctctacggctttctgaacaacggaattaaagcagatctggtgagcctgatacattgtctgcacatgtag

SEQ ID NO: 197151 - DNA, 987 bp, Artificial Sequence
  Description of Artificial Sequence: Synthetic coding sequence
atggacaacgccagcttcagcgagccctggcccgccaacgccagcggcccagaccctgcactgtcctgttccaacgcatccaccctggctcccttacctgccccactcgcggtggcagtacccgtggtgtatgcagtcatatgcgcggtgggtctagccgggaacagcgctgtgttatacgtgctcttacgcgcccctcgcatgaaaactgtcaccaacctcttcatcttaaatctggccatcgccgatgagctctttactctggtcttgcctatcaacatcgctgacttcttgttgagacagtggcctttcggggaactgatgtgtaagctcatagtcgcgatcgaccagtataatactttcagttctctctacttccttaccgtgatgagcgccgacaggtacctggtcgtcctggccaccgcagaaagtaggagggtcgcgggaaggacctactccgcggctagagccgtgtcgctggccgtctggggtatcgtgaccttagtggttctgcccttcgcagtctttgcccgcttagacgatgagcagggaagacgccagtgcgtcttggtgtttcctcaacccgaagccttctggtggcgcgcttctaggctgtacaccctggtcctcggatttgccattcctgtctctactatatgcgtgctctatactacactcttgtgccgtctgcacgccatgcgcctcgacagtcacgctaaggcgctcgagcgagccaagaaacgggtgacgtttctagtcgtggctatactcgccgtgtgcctcctctgctggactccttatcacttgtcgaccgtggtcgctctgaccacagatctgccccagaccccccttgtgatcgctatctcttattttatcacatccctgtcttacgccaatagctgcttgaatccctttctctatgccttccttgacgctagctttcgtagaaatctaaggcagttaattacctgtcgcgctgcggcgtag

SEQ ID NO: 197152 - DNA, 1599 bp, Artificial Sequence
  Description of Artificial Sequence: Synthetic coding sequence
atgctggccgagcccttccccaaggtggtggccagcctgatcatcctgcacctatcaggcgctactaaaaaaggtaccgagaagcagacgacatcagagactcagaaatcagtccagtgcggcacctggacaaagcacgcggagggcgggatattcactagtcccaactatccctccaagtatcccccagaccgggaatgcatttatattatagaggccgccccccgccagtgcatcgaactgtacttcgacgagaagtacagcatcgaaccctcttgggagtgcaaattcgaccacattgaagtgagagatggaccattcgggtttagccccataatcggccggttttgcgggcagcagaatcctcccgtgatcaagtcctcgggtaggttcctctggatcaagtttttcgccgatggcgagttggagagtatggggttctccgcccggtacaacttcacaccagacccagacttcaaagacctgggagctctcaaaccactacctgcctgtgagttcgaaatgggtggaagcgagggcatcgtggagtctatccagattatgaaggagggtaaagcaactgcttcagaggccgtggactgtaagtggtatattcgtgctccaccccgcagcaagatttatttgcgctttttagattatgagatgcagaactctaacgagtgcaagcgaaatttcgtggccgtttacgacgggtcttcaagcgtggaagacttgaaggctaagttctgttccaccgttgcaaatgacgtcatgttgagaaccggcctgggcgtgatccgcatgtgggccgacgaaggcagcagaaactcccgtttccagatgctgttcacgtcatttcaggagcctccgtgcgaaggcaatacctttttctgtcactctaacatgtgcatcaacaatactttggtttgtaacggacttcagaattgtgtatacccttgggatgagaaccactgcaaagagaagcgcaaaacgtctttactcgaccagctcactaacactagtggtactgtaatcggggtcacctcgtgcatcgtgattatcctgattattatcagtgtgattgtacagatcaaacaaccccggaagaaatacgtgcagaggaaaagtgattttgatcagacagtgttccaagaggtgttcgaaccacctcactatgagctgtgcactctgcgcggaacaggggccaccgccgattttgctgatgtagccgacgacttcgagaattaccataagctcaggcggtcctcctccaagtgcattcatgaccaccattgcggttcccagctctcttcgactaaaggctcgcggtcaaacctgtccacgcgagatgcctcgattctcacagaaatgccaacccagcccgggaagcctctcatccctcctatgaaccggcgcaacatccttgttatgaagcattcttacagtcaggacgcagcagacgcatgcgacatcgatgaaatcgaggaagttcccacaacttcccacaggctgagccgccacgacaaggccgtgcagaggttttgtctgatcgggtccctctcaaaacatgagtcggaatacaatacaacccgggtatag

SEQ ID NO: 197153 - DNA, 1602 bp, Artificial Sequence
  Description of Artificial Sequence: Synthetic coding sequence
atgatccacggccggagcgtgctgcacatcgtggccagcctgatcatcttgcatctgagtggggccacaaaaaagggcacagagaaacagaccacaagcgagacccaaaagtccgttcagtgtgggacgtggacaaaacacgccgaaggcggcatttttacctcccccaattacccaagcaaatacccacccgaccgcgagtgcatctatattatagaagccgctccacgacaatgtattgagctttacttcgatgagaaatactctatagaaccgtcttgggaatgcaaattcgatcacattgaggtgcgggatggccctttcgggttttcaccaatcattgggcggttctgtggccaacaaaatccaccagtgattaagtcctcaggacggtttctttggattaagtttttcgctgacggcgaactggaatcaatggggtttagtgctcgctataacttcacgccggaccctgatttcaaggatcttggcgcactcaagcctctaccagcctgtgaatttgagatgggcgggtccgagggaatagtggagagcatacagattatgaaagagggcaaggcgactgcctccgaggcggtggactgtaaatggtacattcgagccccaccaagatccaagatctacctgaggttcctggactatgagatgcaaaactccaatgagtgtaaacgcaactttgtggctgtttatgatggatccagttctgtcgaggacctgaaagctaaattttgctccacagtggccaacgatgtgatgctgcgaactggactgggagtaataagaatgtgggctgacgaggggagccggaatagtagattccaaatgctgtttacatcttttcaagagccaccttgcgaaggcaataccttcttctgccactcaaacatgtgtatcaacaacactctggtatgcaacggactgcagaattgtgtgtacccttgggacgaaaatcactgcaaagagaagaggaaaaccagcctgctggatcagctcacaaacacttctggtaccgtgatcggggtaaccagctgtattgttattatcctgatcatcatcagcgtgattgtccaaatcaagcagcctcgaaagaaatatgtgcaaaggaaatcagactttgaccagaccgtcttccaggaggtcttcgaacctccccactacgaactgtgtacgctccgcggaactggggccacggccgactttgcggacgtagcagatgatttcgagaactatcacaagctgcggcgctccagctccaaatgcattcatgaccaccattgtggatcccagctcagcagcactaagggcagtagaagcaatttgtccacaagagatgcttccatccttaccgagatgcccacccaacccgggaagccactgattccacccatgaatagacggaacatcctggtgatgaagcactcctattctcaagacgccgcagacgcatgtgatattgatgaaatcgaggaagtgcccacaactagtcacagactttcaagacatgacaaagcagtgcagcgcttctgccttatcggatcactgtctaagcatgaaagcgagtacaacaccacaagggtgtag

SEQ ID NO: 197154 - DNA, 471 bp, Artificial Sequence
  Description of Artificial Sequence: Synthetic coding sequence
atgctggccgagcccttccccaaggtggtggccagcctgatcatcctgcacctgagtggagctaccaagaagggcaccgaaaaacagacaaccagcgaaacccagaaaagcgtgcagtgcggcacctggaccaagcatgctgagggtggtatctttacgtcccctaattatccttcaaagtaccctccggatagagagtgtatctacattatcgaggccgctccaagacaatgcattgagctttatttcgacgaaaagtactctatcgagccctcttgggaatgcaagtttgatcatatcgaagtgagagacggtccctttgggttctcacctatcattggccggttctgtggccagcaaaacccacctgtcattaagtccagtggcagatttctatggattaagttcttcgcagacggcgaacttgaaagcatgggcttcagtgcccggtacaactttaccccagaatag

SEQ ID NO: 197155 - DNA, 1602 bp, Artificial Sequence
  Description of Artificial Sequence: Synthetic coding sequence
atgatccacggccggagcgtgctgcacatcgtggccagcctgatcatcttgcatctttccggagcaacgaaaaaaggaaccgaaaaacagaccacaagtgagacccagaaaagcgttcaatgtgggacttggacaaagcacgcagagggagggatcttcacctccccaaactatccaagtaaatatcccccggaccgggaatgcatttatatcattgaggccgccccgcgacagtgcatcgaactgtatttcgacgagaaatattcaatagagccctcatgggaatgtaaattcgatcacatcgaggtccgagatggcccatttggcttctccccgatcattggcagattctgcgggcagcagaatccacccgtcatcaaatcttctggacgcttcttgtggatcaagttttttgcggatggtgagttggagagtatgggctttagtgctcgctacaatttcacccccgatcccgatttcaaagatctcggtgcactcaaacctctgccagcctgtgagttcgagatgggaggttcagaggggattgtggagagcatccagatcatgaaggaagggaaggccactgcctccgaggccgtggactgcaaatggtacatcagagccccaccccgcagtaaaatctacctgagatttctggattacgagatgcaaaactcaaacgaatgcaagagaaattttgtggccgtttacgatggctcaagctcagtggaggacctgaaggccaagttctgcagtaccgtagccaacgacgtaatgctaagaactggattgggagtgatccgcatgtgggctgatgagggtagccgtaatagtcgtttccagatgctgttcactagtttccaagaacccccatgtgagggcaacacatttttctgtcatagcaatatgtgcataaataacactttggtttgcaacggacttcagaattgcgtgtacccctgggatgagaaccactgcaaagaaaagaggaaaacttcattgctcgaccagctcactaacacctcaggaaccgttatcggagtgacctcatgcatcgttataatccttatcatcattagcgttattgtccaaattaagcagcccaggaagaaatacgtgcagcggaagtcagattttgaccagacggtctttcaggaggtgttcgagccaccccactatgagctctgcacactccgcggcaccggagcaacagctgacttcgctgacgtggcggatgattttgagaattatcacaaactgcgcaggtcttccagcaagtgtatccatgatcaccactgcgggagccagctgagcagtaccaagggctccaggtctaatctctccacaagggatgcctccattctgaccgagatgcctactcagcccggaaagcctctcatcccccctatgaacagaaggaacatccttgtgatgaagcattcatatagccaggacgccgcggacgcttgtgacattgacgagatcgaggaggtgccaaccacaagtcatcgcctaagcagacacgacaaggccgtgcaaagattttgcctcattggcagtctctcaaagcatgaatctgagtataacactacaagggtgtag

SEQ ID NO: 197156 - DNA, 1017 bp, Artificial Sequence
  Description of Artificial Sequence: Synthetic coding sequence
atgagcggcagcagcctgcccagcgccctggccctgagcctgctgttggtgtctggtagcctgctgccaggaccgggggctgcacaaaacgcagggttcgtcaaaagccccatgtccgagacaaagctcaccggagatgcatttgagctttattgtgacgtggttggctcccctacccccgagatacaatggtggtacgccgaagtcaaccgggcagagagttttaggcaactctgggacggagccaggaaacggcgagtgacagtaaatacggcttatggcagtaatggagtcagtgtgctccggattacgcggctaacactggaagacagcggtacgtacgagtgtcgtgcgagcaacgaccccaagcgtaatgacttacgtcagaatccatcgattacgtggatcagagcccaggccaccatctcagtgttgcagaagccacgcatcgtgacgtccgaagaggtcatcatcagggattcaccagtcctgcccgtcacactgcagtgcaaccttacctcttcctcacataccctgacatattcatattggacgaagaacggcgtggaactatccgctactcggaagaatgcgtctaatatggagtatcggataaataagcccagagcggaggattccggcgagtatcactgcgtctaccatttcgtgagtgctccgaaagctaatgctaccatagaggttaaggccgctccggacatcaccggccacaaacggtcggaaaacaagaatgaagggcaggacgctaccatgtattgtaaaagcgtgggttatccccaccctgactggatatggcgcaagaaggaaaacgggatgccaatggatatcgtcaacacgtccggcagattttttatcattaacaaagagaattacactgagctcaacatcgtgaacctgcagatcacggaagacccaggggagtacgaatggtgtggcgctacctggcctcacagcggcctctcttgggagttctggttgaagctaagttctctttggtag

SEQ ID NO: 197157 - DNA, 1197 bp, Artificial Sequence
  Description of Artificial Sequence: Synthetic coding sequence
atgagcggcagcagcctgcccagcgccctggccctgagcctgctgcttgtgtcagggtcactcctgcctggccctggtgccgctcagaacgcaggctttgttaaaagcccaatgtccgagacgaagctcacgggggatgcattcgagctctattgtgatgtggtaggtagtcccacccccgagatccaatggtggtacgccgaagtgaaccgcgcggaatcctttcggcaactgtgggatggcgcccgcaaacggagggtcaccgtcaacactgcctatggctcaaacggggtgtcggttctgcggataactaggttgaccctagaggatagcggaacttacgagtgtcgtgctagcaacgatccaaaacggaatgacttacgtcagaacccgagtataacatggattcgggcacaggcaactatcagtgtgctacagaaacccagaattgtaacgtccgaggaggtcataatccgcgatagtcctgtgctccccgtgaccctccagtgcaacctgacgtccagctcgcacaccctaacatactcctactggacaaagaatggcgttgaactcagtgccacacgtaagaatgctagcaacatggaataccgtataaataagccccgtgcagaagacagtggagaataccactgcgtgtatcacttcgttagcgctcctaaggcgaacgccaccatagaagtgaaagccgctcctgacatcactggccacaaacgtagtgaaaacaaaaatgaaggccaggatgccacaatgtactgtaaatcggtcggatatccacacccggattggatatggagaaaaaaggaaaatggtatgcctatggacatcgtcaacactagcggccgttttttcattatcaacaaagagaattacacggagcttaatattgtgaacctccagatcacggaggacccaggtgagtacgagtgcaatgccaccaacgccataggttctgcgtctgtcgtaaccgtgttgagggtgcgatcacatctcgctcccctgtggccttttctcgggattcttgccgagataatcatattagtcgtgatcattgtggtctacgagaagaggaagcggcctgatgaggtcccagacgacgacgaacctgccggacccatgaagaccaattcaaccaacaaccacaaggacaagaacctacgccaacgcaacaccaattag

SEQ ID NO: 197158 - DNA, 849 bp, Artificial Sequence
  Description of Artificial Sequence: Synthetic coding sequence
atgagcggcagcagcctgcccagcgccctggccctgagcctgctgcttgtgtcgggttctctcctccccggacccggagccgctcagaacgagccgcgcatcgtgacctccgaggaggtgatcatcagggattccccagttctgccagttacgcttcagtgcaatttgaccagtagttctcataccctgacctactcttattggaccaaaaacggggttgagctgagtgcaacgcggaagaacgcatcaaacatggaataccgaataaataagcctcgagcagaggactcaggtgagtatcactgcgtgtatcactttgtgagcgctccgaaggccaatgctacaatcgaggtcaaagccgctcccgatattaccgggcataaacgctctgagaataagaatgagggccaggacgccaccatgtattgcaaatctgtgggatatccccaccctgactggatctggagaaaaaaggagaatgggatgccaatggacattgtcaatacgtccggtcggttttttatcattaacaaggagaactatacagagctgaacattgtgaatctgcaaattacagaagatcccggagagtacgagtgcaatgccactaacgccattggatccgcctcggtcgtgaccgtcctaagagttcgctcacatcttgcacctctttggccattcctcggaattttggcagaaatcattattcttgtcgtgatcatagtggtctatgagaagcgaaaacgcccagacgaagtgcccgacgacgacgagcctgccggcccgatgaagaccaattctactaataaccataaggacaagaatctgaggcagaggaatacgaactag

SEQ ID NO: 197159 - DNA, 582 bp, Artificial Sequence
  Description of Artificial Sequence: Synthetic coding sequence
atgagcggcagcagcctgcccagcgccctggccctgagcctgctgctggtgtcaggctctttacttcccggtcctggggcggcccagaacgctgccccagacattacgggacacaagagaagcgagaacaagaacgaaggtcaagacgccacgatgtattgtaagagcgtcggatatccccatcccgattggatctggagaaagaaggagaacggaatgcctatggacatcgtgaacacatccggcagatttttcattatcaataaggagaactacaccgaactcaatatcgttaatttacagattactgaagaccccggcgaatatgaatgcaacgcaaccaatgccatcggaagcgcctcagttgttactgttctgagggttaggtcccacctggcccctttatggcccttcttagggatattggcagaaattataatcctagtcgtaattattgtcgtctacgagaagcgtaaaagaccagacgaggtgcctgatgatgatgaaccagccggtcctatgaaaacaaactctaccaacaaccataaagacaagaatttgcgccagcgcaataccaattag

SEQ ID NO: 197160 - DNA, 1185 bp, Artificial Sequence
  Description of Artificial Sequence: Synthetic coding sequence
atgagcggcagcagcctgcccagcgccctggccctgagcctgctgctcgtaagtggctccttgttacctgggcctggagccgcacaaaacgcaggctttgtgaaaagcccaatgagcgagacgaaactgacaggagacgcattcgaactgtattgcgatgtcgtagggtcgcccacccccgaaatccagtggtggtacgcagaggtcaatagagccgagtctttccgccagctttgggacggcgcccgcaaaagaagggttacagtaaacacggcgtatggaagcaatggagtttcggttctgcgcattacgcggttgaccctcgaagatagcggtacttacgagtgccgggcatccaatgacccaaagagaaacgacctcagacagaacccaagcattacatggatccgcgctcaggcaaccatcagcgtgctgcaaaagccgcgcatagtcacttcggaagaagtgatcatacgggactctccagtgctcccggttacgttacagtgcaatctcactagttctagtcatactctgacttattcgtactggacaaaaaatggtgtggagctgtccgctacccggaaaaacgcctccaacatggaatatagaatcaacaaaccacgggcggaggactcaggggaatatcactgcgtatatcacttcgtttccgctccaaaggccaacgctactatcgaggtcaaggcggcgcctgacattaccggacataagcgatctgaaaataaaaatgagggacaagacgctactatgtactgcaaaagcgtaggatacccccatcccgactggatctggcgaaagaaagagaacgggatgcccatggacattgttaacaccagcggtcgtttcttcatcatcaataaagagaattatacggagctgaatattgtcaatctccaaattactgaagaccctggagagtacgaatgcaatgcgaccaacgccatcggatccgcaagtgttgtaacggtgctgcgtgtgcgcagccatctggctccactgtggcctttcctgggtatcttggcggagattattatcctggtggtgatcatcgttgtatacgagaagagaaagcggcctgacgaggtccctgacgtgccccctcggaagactaacagcaccaacaatcacaaggacaaaaatcttcggcagagaaatacgaactag

SEQ ID NO: 197161 - DNA, 513 bp, Artificial Sequence
  Description of Artificial Sequence: Synthetic coding sequence
atgatggccggcatgaagatccagctggtgtgcatgctgctgctggcattctcatcgtggtctctgtgcagcgactcagaggaggagatgaaggccctcgaggcagatttcctcaccaacatgcatactagcaagatcagtaaggcccatgtgccttcgtggaagatgacactcttgaacgtgtgctcgctcgtcaataatctgaactcccctgctgaagaaacaggggaagtgcacgaggaagagttagtagcgcggaggaagctgccaacagccctggatgggttttccctggaggccatgctaacgatataccaactgcataaaatctgtcactcccgcgcatttcagcattgggaactgattcaggaagatatactcgacaccgggaacgataagaatgggaaggaggaagttatcaagagaaaaatcccttatatcctgaagagacagttgtatgagaacaagccccggcgcccatacatcctaaaaagggattcttactactactag

SEQ ID NO: 197162 - DNA, 348 bp, Artificial Sequence
  Description of Artificial Sequence: Synthetic coding sequence
atgaccctgctgaacgtgtgcagcctggtgaacaacctgaacagcccggcggaggagaccggcgaggtgcatgaggaggaacttgtagccagacgaaaattgccaacagcccttgacggcttttcacttgaagctatgctgaccatctatcagttacacaaaatttgtcactctagggcatttcaacactgggagttgatccaggaggatatcctagacacagggaatgataagaatggcaaggaagaggtcatcaagcgcaagattccctatattctgaagcggcagctctacgaaaacaagccccggcggccctatatactcaaacgggactcttactattattag

SEQ ID NO: 197163 - DNA, 288 bp, Artificial Sequence
  Description of Artificial Sequence: Synthetic coding sequence
atgatggccggcatgaagatccagctggtgtgcatgctgctgctggcattttcctcatggtctctttgctcagacagcgaagaagagatgaaagctctcgaagctgattttctgacgaacatgcatacctcaaaactgatccaggaagacatcttggacaccgggaatgataaaaacggcaaagaagaggtgataaagagaaagattccctacatcttgaaaagacagttatacgagaataaacccagacgcccatatatcctgaagagggactcttattactattag

SEQ ID NO: 197164 - DNA, 1257 bp, Artificial Sequence
  Description of Artificial Sequence: Synthetic coding sequence
atgcggctgaacagcagcgcccccggcacccccggcacccccgccgctgacccttttcagcgggcccaagccggtctagaggaagcccttcttgctcccgggtttggcaatgcctccggcaacgcctccgaaagagtactggccgctccttcgtctgaattggacgtcaataccgacatttactctaaggtgttggtgacagccgtgtatcttgctctattcgttgtgggcaccgtaggcaacacggtgacagcgtttacgctggcacgcaagaaaagccttcaatcactgcaaagcactgtgcactaccatctgggatccctcgcgctgagtgatctcttaactttgctcttggctatgcccgttgaactctacaatttcatctgggtgcatcacccatgggccttcggcgatgccggctgtaggggctactacttcctgcgtgatgcgtgcacttacgctacagcactgaatgtagccagtctgtccgtcgagagatacttggccatttgccaccccttcaaagcaaagactttgatgagccgcagtcgcactaaaaaatttattagcgctatctggctggccagtgctctgctggctgtgcccatgctgtttacaatgggggagcagaatagaagcgcagacggccaacacgctggaggtctggtttgtaccccgacaatccacactgcaacggtcaaggtggttatccaggttaacacttttatgagcttcattttccccatggtggttatcagcgttcttaacacaatcatcgcgaataagcttaccgttatggtccggcaggccgcagagcagggtcaggtgtgtacagtggggggagagcatagcaccttctcaatggcgattgaacctgggcgggtgcaggcccttcggcacggtgtgcgcgtcctgcgggcggtggtgatcgcatttgtggtctgctggctaccgtaccacgtcagaaggctcatgttttgttatatctccgatgaacaatggacgccgttcctctatgatttctaccattacttttatatggtgacgaatgcactgttttacgtgtcatccacaatcaaccccatattgtataatttggtgtctgcaaattttagacacattttcttggccactcttgcttgtctatgccccgtttggaggagaagaaggaaaaggccagccttttccaggaaagccgattccgtgagctccaatcacaccctgtctagtaatgcgactcgcgagaccctctactag

SEQ ID NO: 197165 - DNA, 951 bp, Artificial Sequence
  Description of Artificial Sequence: Synthetic coding sequence
atgggcgtgtgcggctacctgttcctgccctggaagtgcctggtggtagtgtctctcagactgttgttcctagtgcctacaggggtacctgtgaggtccggggatgccactttcccaaaggcaatggacaacgtgacagtacggcagggcgaatccgctacactacggtgcactatagacaaccgagtcacccgtgttgcctggttgaatcgatcgacaatcctgtatgccggcaacgataaatggtgcctggaccccagagttgtgctgctcagtaatacccaaacgcaatattcaattgaaatacaaaacgtggatgtgtacgatgagggaccttatacctgttccgttcagactgacaaccacccaaaaacctcccgggtccacttaatcgtccaagtgtcgcctaagatagtcgagatatcgtccgacatttctatcaacgaggggaataacattagcttgacctgtattgctaccggccgacccgagcctactgtcacatggagacacatcagccctaaagccgtaggtttcgtgtccgaagatgagtaccttgagattcagggcatcactcgcgagcagtcaggcgactacgaatgctcggctagcaatgacgtggccgcccccgttgtgcgcagggttaaggtcactgtaaattatccaccttacataagtgaagctaagggcactggggtacccgtcggccagaagggaacactccagtgcgaggccagcgcagtgccgtccgcggaatttcagtggtacaaagacgacaaaagattaatcgagggcaagaagggagtaaaagtcgagaatcggcctttcttaagtaaactcatcttcttcaatgtatccgaacacgactacggaaactatacatgtgttgccagcaacaagctggggcacacgaatgcctctattatgttgtttggagaaactgtcctgtag

SEQ ID NO: 197166 - DNA, 1035 bp, Artificial Sequence
  Description of Artificial Sequence: Synthetic coding sequence
atgggcgtgtgcggctacctgttcctgccctggaagtgcctggtggttgtgtctctgagattgctattcctggtgcccactggcgttcccgttcgttcaggagacgcaacgtttcccaaagccatggacaacgtcactgtgagacagggagagagtgctacgcttcgttgcacaatcgacaatcgggtgacacgggtggcttggctgaatcgatctaccatcctctatgcagggaatgataagtggtgcctcgacccaagagtggtgctccttagcaatacacagacacagtacagcatcgaaattcagaacgtggatgtgtatgacgaagggccctatacttgttcggtgcagacggataatcatccaaagacgtcaagggttcacctgattgtgcaggtgtctcctaaaatcgttgagatctcctccgacatcagcataaacgaaggaaacaacatttccctgacatgtattgctacaggccgacccgaacccaccgtgacatggaggcacatcagtcctaaggctgtgggcttcgtttccgaggacgaatacctcgagattcagggcatcacccgagagcagtcaggcgattacgaatgtagtgcctccaatgatgtcgccgcgccagtcgtgcgccgcgtgaaggtcacagtaaactaccccccctacattagtgaagctaaaggtacgggggtgcctgttggccaaaaagggacccttcagtgtgaagcgtcggctgtacccagcgcagagtttcagtggtacaaggatgacaaacgactcatagaaggcaagaagggtgtcaaggtggagaaccggccattcctgagtaaactgatcttttttaatgttagtgagcatgactatgggaattacacatgcgttgcaagtaacaaactcggtcacacgaatgcatcaatcatgctatttggtcccggcgctgtaagcgaggttagcaatggcacatcccgaagagcgggctgcgtgtggctactgcccctattggtacttcaccttttattgaagttttag

SEQ ID NO: 197167 - DNA, 1035 bp, Artificial Sequence
  Description of Artificial Sequence: Synthetic coding sequence
atgaagaccatccagcccaagatgcacaacagcatcagctgggccatctttaccggtcttgcggccctgtgcctgtttcaaggagtccctgtgaggtctggagacgctacctttcccaaagcgatggataatgtgactgtgcgccagggcgagtcagcgaccctacgctgtacgattgataacagagtgactcgcgtggcttggctgaaccgctctacgattctgtatgccgggaatgataaatggtgccttgatccacgggtcgtgctgctatcgaacacacagacccagtactccatcgagatacagaacgtggatgtgtacgatgaggggccttatacctgttccgtccagaccgataaccaccctaagacttctagggtgcatctgattgtgcaggtttcccccaaaattgttgaaatttcatcagatatcagtatcaacgagggaaataacatttcactgacatgtatcgcaactggcagaccagaaccgacagtgacatggcgtcatatctctcccaaggcagtcggattcgtcagcgaagatgagtatctcgagatacaaggtataacaagagagcaatcaggagactacgaatgttctgcgtccaacgacgtggccgccccggtcgtcagacgcgttaaggtgacagtcaactatccaccctacatctcagaagccaaggggaccggtgtgccggttggccagaaaggcacgctgcagtgcgaagcttccgccgttcctagtgctgagtttcagtggtataaggatgataaaaggttgattgagggcaagaaaggagtaaaagtcgagaatagacccttcctgagcaaattgattttcttcaatgtgagcgagcacgactacggcaattacacgtgcgtcgcctccaacaagctcgggcataccaacgcaagtatcatgctctttggccccggcgccgtgtccgaggtaagcaatggcacaagcagaagggcgggctgtgtgtggctactcccactattggtgctgcacctcctgctcaaattttag

SEQ ID NO: 197168 - DNA, 1041 bp, Artificial Sequence
  Description of Artificial Sequence: Synthetic coding sequence
atgaacggcaagcggaacggcgagggcggcaagcggtggaagtggaaaggcaccggtgtgcccgtgcggagcggggacgcgacatttccaaaagccatggacaacgtcactgtccgccagggcgagtctgccacactaaggtgcacaatcgacaatagggtaacaagagtggcctggctcaatcgtagtacaatcctttatgccggaaatgacaaatggtgcctcgacccccgagtggtgctgctgtcaaacacccagacgcagtattctattgaaattcagaacgttgatgtttacgacgaaggcccatacacctgtagcgtgcagactgacaaccaccccaagacttcccgggtgcatttgatagtccaagtgagtcccaagattgtggagatctcatccgatatcagtataaatgagggaaataacataagtttgacctgcatcgcgaccggacgacctgagcccacagtgacatggcgacatataagcccaaaggcggtgggatttgtcagcgaagatgaatacctcgagattcagggcataaccagagagcagtcaggcgactatgaatgctcagccagcaatgacgtggccgccccggtcgtgcggcgcgtaaaggtgactgtgaactaccccccatatatatcagaagccaagggcaccggcgtgcctgtcggccagaagggcaccctgcagtgcgaggcctccgccgtgcccagcgctgaattccaatggtataaagacgataagcggttaatcgaaggaaagaaaggcgtcaaagtagagaataggccgtttctgagtaagctgatcttttttaacgtgagcgagcatgactacggcaattacacttgtgtcgcttctaacaagctgggacacaccaatgcctccattatgctttttgaggttaagaccacggctttgacaccatggaagggtcccggcgctgtaagtgaggtttcgaatggcacctcaaggagggccggatgtgtatggctgctgcctctgcttgtgctgcatctacttcttaaattttag

SEQ ID NO: 197169 - DNA, 1068 bp, Artificial Sequence
  Description of Artificial Sequence: Synthetic coding sequence
atgaagaccatccagcccaagatgcacaacagcatcagctgggccatctttaccggtctggcggcattgtgtctgttccagggagtgcccgtgaggtccggcgatgcgacgtttccaaaagctatggacaatgtcacggtccgacaaggggagtccgcaactttaaggtgcaccatcgataatcgcgttactcgggtggcatggctgaatagaagcacaattttgtatgccggaaatgacaaatggtgtctcgatcctagggtagtgctgctcagtaacacccagacacagtattcgatcgagatacagaatgttgacgtgtatgacgagggaccctacacttgctctgtgcagaccgacaaccaccccaaaacctcacgagtacacttgattgtccaagttagtcctaaaattgtcgaaatctctagtgatatctcaattaacgaaggtaataatatctctctaacctgtatcgccacaggcaggcccgagcccacagtcacatggcgacacattagcccaaaagccgtcggcttcgtttcagaggacgagtacctcgaaattcagggcataacacgggaacagtctggagactacgaatgcagcgcatcaaacgacgtggcggctccagtggtccggcgcgtaaaggtgaccgtcaattaccccccatatatttcagaagctaaaggcacaggggtgccggtgggtcagaaagggacgctgcagtgtgaagcaagcgcagtaccgtcggcagaatttcaatggtataaagatgacaagaggcttatcgaaggcaagaagggcgtgaaagtggaaaaccggcccttcttaagtaagctcatttttttcaatgtgtctgagcatgactacggaaattacacttgtgtagcttctaacaaattgggacacaccaatgcaagtattatgctcttcgaagtaaaaacaacggcgctcactccttggaaggggcccggagccgtatccgaagtgagcaacggaacttcccggcgggcggggtgcgtttggttattacccctgctcgtcctgcatctactgctgaaattttag

SEQ ID NO: 197170 - DNA, 1068 bp, Artificial Sequence
  Description of Artificial Sequence: Synthetic coding sequence
atgggcgtgtgcggctacctgttcctgccctggaagtgcctggtggtcgtttccctgagacttctgttcctggtgcccacgggggtcccagtgagaagcggggatgctacattccccaaagctatggacaatgttaccgtgcgccagggtgaatctgccactctccgatgcacgatcgataatcgcgtaaccagggtcgcctggttgaataggagcacaatcctctatgccggaaatgacaaatggtgcttagaccctagggttgtccttttgtcaaatactcaaactcagtattctattgaaatccagaacgtcgatgtctatgacgaaggaccatatacctgttccgtccagactgataaccatcccaagaccagccgcgtgcaccttatagtgcaggttagcccaaagatcgtcgaaatctcgtccgatatctccattaacgagggtaacaatatttcccttacttgcatcgctacagggaggcccgaaccgactgtgacctggagacatatctcgccaaaagcagtaggctttgtttctgaggacgagtatctggaaatccagggaataactagagaacaatctggggactacgaatgcagcgcgagtaatgacgtggccgcccccgtagtgcggagggtcaaagtcacggtaaactatccgccctacattagcgaggcaaagggaacaggcgtgccggtggggcagaaagggactctccagtgtgaggcgagcgcagtgccctctgccgagtttcagtggtataaggatgataagcgtttgattgaaggcaaaaagggcgtgaaggtggagaatcgtccctttctgtccaagctcatcttcttcaacgtgtcagaacatgactatggtaattacacttgcgtggcgtcaaataagttgggccataccaatgctagtatcatgctatttgaggtgaaaaccaccgctctgacaccatggaagggacccggagcagtatccgaggtcagtaacggcacatcgcgacgtgccggctgtgtctggctcctcccactgctcgtcctccatctgttgctgaaattctag

SEQ ID NO: 197171 - DNA, 2373 bp, Artificial Sequence
  Description of Artificial Sequence: Synthetic coding sequence
atgctgcggggcggccggcggggccagctgggctggcacagctgggccgccgggcctggttccctgcttgcttggctcattctcgcctcagcgggagcagctccttgccctgacgcgtgttgccctcatggttcctcaggtctcagatgtaccagagacggagctctagactccctgcatcacctgccaggcgctgaaaacctcaccgaactgtatattgagaatcagcaacatcttcagcacctggagctgcgcgacttgcgtgggctgggcgagctccgcaaccttactattgtcaaatctggcctgcggtttgtggctccagatgcttttcatttcaccccaaggctctccagactaaatctgtcttttaatgcactggagagtcttagctggaagaccgtccaaggactttctctgcaagagctggtcctgtccggaaaccctctgcattgctcatgtgccctgaggtggctccagcgatgggaagaagaaggccttggtggcgtcccagaacagaagttacagtgtcatggacagggccccctggctcacatgcctaacgcatcgtgtggggtaccaactctaaaggttcaagtccccaacgcttccgtcgacgtgggtgatgatgtgctgctgcgctgtcaggtggaagggcgcgggctcgagcaagccgggtggattctcacagaactggaacagtccgctactgttatgaagagcggaggcctgccatcactgggcctaactctggctaacgtgaccagcgacctaaataggaaaaacgtgacctgctgggctgagaatgacgtgggcagagccgaagtttccgttcaggtgaacgtgtccttccctgccagcgtgcaactgcacactgccgtagagatgcatcactggtgtatacccttctccgtggacggccagcccgcacccagtctgaggtggctattcaatgggtccgtgttgaacgagacatcctttatctttacagagtttctagagcctgccgccaacgaaaccgtgaggcacggctgcctgcgtctgaatcagccaacgcacgttaataatggcaactacacccttctggcagcgaaccctttcggtcaggcctccgccagtatcatggcagcatttatggacaatcctttcgagtttaaccctgaggatcccatccctgacacaaactccactagtggggacccagtagaaaaaaaggatgaaacacctttcggcgtttccgtcgctgtcggcctggccgtgtttgcgtgcctgtttctttccacgttgctactggtgcttaataagtgcggcaggcgtaataaattcgggattaacagacctgccgtcctggctcctgaagacgggctggccatgagcctccacttcatgactcttgggggcagctctctgtcccctaccgagggaaagggcagtgggttgcagggtcacattattgaaaatccccaatatttcagcgacgcgtgtgtgcaccacatcaaacgcagagacatcgtgctgaagtgggagttaggtgaaggggcttttggaaaggtatttcttgctgaatgtcacaatctactgccagaacaggataagatgctggtggcggtaaaagcactcaaggaggcctccgagtctgcgcgccaggatttccaacgcgaggccgagctgttaacaatgctgcaacatcagcatatcgtcagattttttggagtgtgtaccgagggcaggccactgcttatggtttttgagtatatgcgccacggggacctgaataggttcctgcggtctcacgggcctgatgcaaaactccttgccggcggcgaagacgtggcccccggaccgctcggtcttgggcagctcctcgctgtggcctcgcaagtggcagccggaatggtttacctcgccggcctacattttgttcacagagatctcgccacccgtaattgtctcgtgggccaaggcctcgtagtgaaaatcggagattttggaatgtcaagggacatctattccactgactactatagagtgggcggaaggaccatgctacctatccgatggatgccaccggagtctatcctatacaggaagtttaccacagagtctgatgtatggtcctttggagtcgtgctgtgggaaattttcacatatgggaaacagccctggtaccaactgagtaatacagaagccatcgattgcattacccaaggacgtgaactggaaagacctcgggcgtgcccacccgaggtgtacgcaattatgaggggatgctggcaaagagagcctcagcaaaggcacagtatcaaggacgttcatgccaggctgcaggcacttgctcaggcacctcccgtgtacctggacgttctgggatag

SEQ ID NO: 197172 - DNA, 2283 bp, Artificial Sequence
  Description of Artificial Sequence: Synthetic coding sequence
atgaaggaggccgccctgatctgcctggcccccagcgtgccccccatcctcacagttaaatcctgggatacaatgcagctgagagccgctagatctcggtgcaccaatctcttagcagcctcatatatagagaatcaacaacacctccagcacctcgagctccgggacttgagagggctgggcgagctgcgcaacctcactatcgtcaagtcaggtcttaggttcgtagctccggacgcattccacttcactccccgcctctcccggctgaatctgagctttaatgctttggagagcctttcatggaagacagtccaaggactcagtctgcaggaactggtactgagtggcaatccactccattgctcatgcgcgttgcgatggctgcaacggtgggaggaggagggcctggggggcgtgcccgaacaaaagttgcagtgccacggccagggccctttggcgcacatgcccaatgcttcctgcggggtgcctacactcaaggtacaggtcccgaacgcgagtgtggatgtgggggacgacgtcctcctgaggtgtcaggtggaaggccgcggactggagcaggccggctggatcctgactgagttggagcagtctgcaaccgtgatgaagagcggcggcctgccctccttgggcctgacccttgctaacgttacctccgacctcaacagaaaaaatgtcacttgctgggccgagaatgacgtaggacgggctgaagtctctgttcaggtgaatgtgagcttccccgcaagtgtgcaactgcataccgcagtcgagatgcaccactggtgcatcccattttcagtagacggtcaacctgcaccatcactccgatggttgttcaacgggagcgtgctgaatgaaacatcatttattttcacagaatttctggagcctgctgcgaatgagaccgttcgtcacggatgcctgagattgaaccagcccacacatgtcaataacggcaattacacgctgctcgcagccaacccgtttggacaggcctctgcatcaattatggctgctttcatggataacccctttgaatttaatcccgaggatcctattcctgacaccaacagcacgagcggcgatcctgtcgagaagaaagatgaaactccatttggcgtgtccgtggctgtcggattagcagtctttgcctgcctgttcctgtccaccctgttgctggtgctgaacaagtgcggccggcggaataagttcgggattaatagacccgcggtccttgcgccagaggatggactagcaatgagcctccattttatgacactgggagggtcaagcttgtcccctactgaaggtaaaggctccggcctccaagggcatattatcgagaatccgcaatattttagcgatgcctgcgtgcaccacattaagaggcgggacatcgtgctaaagtgggagctgggcgagggggcgtttggaaaagtgttcctggccgagtgtcataacctgttgcccgagcaggataagatgcttgtggctgtgaaagcattgaaggaagccagcgagagtgcccgtcaggactttcaacgggaggcagagttattgaccatgctgcaacatcaacatattgtcagattctttggggtgtgtactgaggggcgaccgctgctgatggtgttcgaatatatgagacacggtgacttgaaccgctttctccgaagccatggccctgacgctaagttgcttgcaggcggcgaggacgttgcccctggtcccctcggcttgggacaactgctcgccgtggcgtcccaggtcgctgctggaatggtctatttggcaggcctgcattttgtccaccgcgacctcgcaacgagaaactgcttagtgggccaagggctcgtagtgaagataggcgattttggcatgtcacgcgatatttatagcactgactactatagggttggtggtcggaccatgcttccgatcaggtggatgcccccagaaagtattttgtaccggaagtttaccaccgagagcgatgtgtggtctttcggcgtcgtgttgtgggaaattttcacttatgggaagcaaccatggtatcagttgagcaacactgaggccatcgattgcataacacagggtcgcgagctggagcggcctcgcgcctgccctccagaggtttacgcaataatgcgggggtgctggcagagagaaccacagcagcgacactcaataaaagacgtacacgctagacttcaagctctggcccaggcacctccagtttatctcgacgttctggggtag

SEQ ID NO: 197173 - DNA, 2391 bp, Artificial Sequence
  Description of Artificial Sequence: Synthetic coding sequence
atgctgcggggcggccggcggggccagctgggctggcacagctgggcagctggacccggaagtctcctcgcatggctgatcctagcatccgcaggcgccgctccatgccccgacgcctgctgcccacacggctcttctggtctgagatgtaccagggatggcgccctcgattccctccatcatctgcccggcgctgagaacttgactgagctgtatatcgagaatcagcagcacctgcagcatttggaactcagggatctgaggggcttaggagagctcagaaatttgacaatcgtgaaaagcggcctcagatttgtggctcccgacgcgtttcacttcacccccagacttagcaggctaaacctatccttcaatgccctagagtccttatcttggaaaacggtacaaggtctatcactgcaggaactggtgttaagtgggaatcctctgcattgttcttgtgccctacgctggctccaaaggtgggaggaggagggactgggcggggtgcctgaacagaagttgcagtgtcatggccaaggacccctcgcgcacatgccaaacgcgagctgcggcgtccccactttgaaagtgcaggtgcctaatgcatcagtagacgtcggcgacgacgtcctactgaggtgtcaggtcgaaggcagagggttggagcaggcagggtggattctgacagagcttgaacagtccgcgaccgtgatgaaatctggtgggctgccaagcctgggcctcacgctcgccaatgtgacctccgacctgaataggaagaacgtcacttgctgggcagaaaacgacgtgggcagggctgaggtttctgtgcaggtaaatgtctcgttccctgcatctgtgcagctgcacaccgccgtggagatgcatcactggtgtataccattctctgtggatgggcagcccgcccccagcttacgctggttatttaacgggtcagttctcaatgagactagcttcatttttaccgaatttctcgagcctgccgctaatgagacagtaagacatgggtgcttacggcttaatcagcccacacatgttaacaacggtaactacactctgctggccgccaacccatttggccaggcctctgccagcattatggccgcttttatggacaatccattcgagtttaatccagaagatcctattccagtgagcttcagcccagtggataccaactctaccagcggtgaccccgtggagaagaaggatgagacccctttcggggtctccgtggccgtcggcctcgccgtctttgcttgcctgtttctgagtaccttactccttgtgttgaataagtgtggcaggcggaataaattcgggattaatcgcccagccgttttggcccctgaagacgggctcgcaatgagcctgcactttatgaccctggggggcagttccttgtcccccacagaaggcaagggaagcgggctgcagggccatataatcgaaaacccccagtacttctcagacgcctgcgtccaccacatcaaacgacgggacattgtcctgaagtgggaacttggagagggcgccttcgggaaggtcttcctggcagaatgccataaccttctgcctgaacaggacaagatgttagtcgccgtcaaagccctcaaggaggcaagtgaatcagctcgtcaggatttccagcgggaggctgaactgcttaccatgttgcagcaccagcacattgtgaggtttttcggtgtgtgtacagaagggagaccactcctcatggtgtttgagtacatgaggcacggcgatctgaacagattcctgaggtcacacgggccagatgccaagctattagcagggggagaagatgttgcacccggcccgctgggccttgggcaacttctggccgtcgcttcccaggtggccgctggcatggtctatctggctggccttcacttcgtgcatcgagacctggccactaggaactgtctcgtcggtcaaggtctcgtggtgaaaatcggggacttcggcatgagccgcgatatttactccactgattattaccgggtcggtgggcgcacaatgcttcccataaggtggatgcccccggagtccatcctttatcgaaaattcactacggagtctgatgtgtggagcttcggtgtggtattatgggaaattttcacttacggaaaacagccttggtatcagctgtctaatactgaggccattgattgtattacccaggggagagagcttgaacggcctcgggcatgtccgcccgaggtttacgccataatgaggggttgctggcaacgcgagcctcagcagcgtcacagtatcaaggacgtccacgctcggctgcaggccctggcccaggcccccccagtctatctggacgtcttagggtag

SEQ ID NO: 197174 - DNA, 2517 bp, Artificial Sequence
  Description of Artificial Sequence: Synthetic coding sequence
atgagcagctggatccggtggcacggccccgccatggcccggctgtggggcttttgttggctagtcgtgggcttctggagagcagcgtttgcgtgtccaacttcatgtaagtgttcagccagtcgaatttggtgtagtgaccctagccccggcatagtggcttttcctcgcctggagcctaacagcgtggatcccgagaacattacagaaatcttcatcgcaaaccaaaaaagactggagattataaacgaagacgatgttgaggcctacgtgggtctccgtaatctcacgattgtggactccgggctcaagttcgtggcacacaaggccttcctcaagaactccaacctccagcacataaactttaccaggaacaaactcacaagcctcagccgcaaacacttccgccatttggacctcagtgagctgattctagtgggcaacccattcacgtgttcttgtgacatcatgtggattaagactttacaggaggcgaagagttctccagatacacaggacttgtactgtcttaatgagtcatcaaagaacattccattggccaatcttcagatcccaaattgtgggctccctagtgcaaacctggccgcaccaaatctcaccgtggaagaaggaaagagtataaccctatcctgttctgtggccggcgatcctgtgcctaatatgtactgggacgtgggaaaccttgtgagtaagcacatgaacgagacgagtcacactcagggttctcttcgcattaccaacatctcatccgacgattctggcaaacagattagctgcgtcgctgagaatcttgtgggcgaggatcaggatagcgtgaatctcaccgtccacttcgcccccacaatcacttttctggagtctcctacctctgaccatcattggtgtattcctttcacagtgaagggaaaccctaaacccgcactgcagtggttttataacggtgctatcttaaatgaaagcaagtacatctgtacaaagattcatgtaaccaatcacacagagtaccatgggtgtctccagctggataaccctacccacatgaacaacggcgattacaccctgatcgccaaaaatgaatacggtaaggacgaaaagcaaatctctgcccatttcatggggtggcccggcatcgatgacggggcaaaccctaactaccccgatgtcatttacgaggattatggaacagctgctaatgatatcggcgatactacgaaccgtagcaatgaaattccgtccactgatgtgacagataaaaccggacgtgagcatctctcagtatatgcagttgtagtgatcgcctcagtagtggggttttgtctgctcgtgatgctttttctcctgaagttggcccggcactctaaattcgggatgaaagatttttcatggtttggcttcgggaaagtcaagtcgcggcagggcgtcggcccggcctctgtgatcagcaacgatgatgattcagccagccccctgcatcatatctccaatgggagtaatactcccagttcctctgagggaggaccggatgctgttataattggcatgaccaagattccagtcattgagaatcctcagtattttggcattactaatagccagctcaaacccgatacctttgtacagcacatcaagcgtcataatattgttcttaagcgtgaactaggggaaggagccttcggaaaggtatttttagccgagtgctataatttgtgccccgagcaggacaagatcctggttgccgtgaaaaccctcaaagatgcctctgacaacgctaggaaggatttccaccgcgaggctgaattattgactaacctccagcacgagcacatcgtgaaattttacggggtttgcgtagaaggcgaccctctgatcatggttttcgagtacatgaaacacggagatctgaacaaattcctcagagcccacggccccgatgccgtacttatggcggaaggtaaccctcccaccgagctgactcagagccaaatgttgcatatcgcccagcagattgctgccggtatggtgtatctggctagccaacacttcgtgcatagggatctagccaccaggaactgtctcgtcggggagaacctgcttgttaaaattggcgacttcggcatgtctagggatgtttattcaacagattattaccgggtgggtggtcatactatgctcccaatccggtggatgccgccagaaagcatcatgtaccgcaagtttacaacagaaagcgacgtttggtccctcggggtggtgctatgggaaattttcacctatggaaagcagccctggtatcagttaagtaataacgaggtgatcgagtgcattacgcaggggcgggtactccagagaccacggacatgtccccaagaagtgtacgagttgatgcttgggtgttggcagcgcgaacctcacatgaggaagaatatcaaaggcattcataccctccttcagaacctggccaaagcgtcccctgtttacttagacatcctgggttag

SEQ ID NO: 197175 - DNA, 1662 bp, Artificial Sequence
  Description of Artificial Sequence: Synthetic coding sequence
atgagcagctggatccggtggcacggccccgccatggcccggctgtgggggttctgttggctcgtggtcgggttctggcgcgccgccttcgcatgtcctacttcctgcaaatgtagcgcttcgagaatctggtgctctgatcccagccccggtattgtggctttccctcggctggagcctaattctgtcgatcccgaaaacatcacagagatcttcatagcgaatcagaagcgccttgagattattaacgaagacgacgtagaggcctacgtggggctgcggaacctaacaattgtggattccggactaaaattcgtggcccacaaagccttcctgaagaattccaatttgcagcatatcaacttcacaagaaataagctgaccagcctaagtagaaagcacttcagacacctggacctgagcgagcttattctggtggggaatccttttacctgttcttgcgatatcatgtggattaaaacactgcaggaagcaaagtcttcgccagacacccaagatctttactgcctgaacgaatcttccaaaaatattcccctggctaatctgcagatccccaattgcgggctgccctccgccaacctggcggctcccaatcttaccgttgaagaagggaagagcatcactctttcctgtagcgtggccggagatccagtaccaaatatgtactgggatgtgggcaatcttgtgagtaagcatatgaacgagacttcacacactcaaggttctttgagaattaccaatatcagctcggacgattccggaaaacagatcagctgcgttgcggagaacctagtgggcgaggaccaagacagcgtcaatctgactgtgcacttcgctccaactataacttttcttgaatcacctacttctgaccaccactggtgcattccgtttacagtgaaaggcaacccgaagccagccctccagtggttctacaacggcgccatcctgaatgagagtaagtacatttgtaccaagattcacgttactaatcatactgaatatcacgggtgtctccagctggacaacccaacgcatatgaacaatggagactacacactcatcgccaagaatgagtacggcaaagacgaaaagcagattagcgcccatttcatgggctggccaggaatcgatgatggtgccaaccctaactatccagatgttatctacgaggactatggcaccgctgccaatgacattggggacacgactaataggtcgaatgagattcctagcaccgatgtcaccgataaaaccggaagggaacacttgagcgtgtatgccgtggtggtgatcgcttccgtcgtcggtttttgtctgctggtcatgttgtttctgctcaagctggctcggcactcaaaatttggaatgaaggatttctcttggttcggctttggaaaagtgaaaagccgccagggagtcggccctgcaagcgtcattagcaacgatgatgattccgcctctcctcttcaccacatctctaacggatccaacacgccgagcagttcggagggcggaccagatgccgtgatcatcggcatgaccaagataccagtgatcgagaacccccagtattttggcataacaaactctcagctgaagccggatacctggcctcggggttcaccaaaaactgcctag

SEQ ID NO: 197176 - DNA, 2469 bp, Artificial Sequence
  Description of Artificial Sequence: Synthetic coding sequence
atgagcagctggatccggtggcacggccccgccatggcccggctgtggggcttctgttggctcgttgtggggttctggcgcgcagcgtttgcctgtccaacatcatgcaaatgcagcgcatcccgaatatggtgtagcgacccatcacctgggattgtggccttcccacgcctcgaaccaaattctgttgatccggaaaatatcaccgaaattttcatcgccaatcagaagcggcttgaaataatcaacgaggacgatgtcgaagcctacgtgggcctgaggaaccttacaatagtggacagcggactcaagtttgtcgctcacaaggcatttctcaaaaatagtaacctacaacacataaatttcacccggaataagctgacctcactgtccaggaagcacttccgccatttggacctctcggagctgattcttgtggggaacccatttacctgctcttgtgacatcatgtggataaaaacactccaggaagctaagagctcgccagacacacaagatctttactgcctaaatgagtcatccaaaaatataccattagccaaccttcagatccctaattgtggtctccccagcgccaacttagccgcgcctaacctaacagttgaggagggaaaatctatcaccctgtcttgcagtgttgccggggatcccgtgcctaacatgtattgggacgtggggaacctggtgagtaagcacatgaacgagacgtcccacacacagggttcactcaggatcaccaacatctccagcgatgactcgggcaagcagatctcatgtgtggccgaaaatctcgtgggcgaggaccaggacagcgtcaatctcactgtccacttcgcccccacgatcacctttttggagagcccgacgtccgaccaccactggtgtatacctttcacggtgaaaggcaacccgaagccagcgctgcagtggttttacaacggcgccatattaaatgagagcaagtacatctgtaccaagattcacgttactaatcacactgaatatcacgggtgcctgcaattagacaatccgacccacatgaataacggagactatactcttatcgccaagaatgagtatggtaaggatgagaaacagatcagcgcgcatttcatgggctggcctggcatcgatgatggtgccaacccaaactatcctgacgtgatatatgaggattatgggacagcagctaacgacatcggggacaccactaatcggtcaaatgagatccctagcacagacgtgaccgataagactggacgcgaacacctgtcagtttacgccgttgttgtcatagcctccgtggtgggattctgcctacttgttatgttgttcttgctcaagctggctcggcactccaaattcgggatgaaaggacccgcctctgtgatcagcaacgatgatgactccgcaagtcccctgcatcatattagcaacggatccaatacgccctccagctcagagggagggcctgacgctgtgatcataggtatgaccaagatcccagtgatcgaaaatcctcagtactttggtatcactaattcccaactgaagcctgatactttcgtgcaacacataaagcgtcacaatattgtgctcaagcgagagctgggagagggcgcgttcgggaaggtgtttctagcggagtgttataacctgtgtccagaacaggacaaaatcctggtggctgtcaagaccctcaaggatgcatcagataatgcacgaaaggatttccatagggaggctgagctcttgaccaacctgcagcatgaacacatcgtgaagttctacggagtgtgtgtagagggcgatccgctcataatggtgttcgagtacatgaaacacggcgacctcaataaatttctgagggcgcacggacctgatgcggtgcttatggctgaggggaacccacccaccgagcttacccagtctcagatgttgcatattgcccagcagatcgccgccgggatggtgtacctggcttcccagcactttgtccacagagacctggcaacccgaaattgcctggtgggggaaaacctcctcgttaaaatcggtgactttggcatgagtcgggacgtgtatagcacagattattatagagtgggagggcatacgatgcttcctatacgctggatgcccccagaatcaatcatgtatcgcaagtttacgacagaatccgacgtgtggtccctgggtgtggtattatgggaaatcttcacatatggaaaacagccttggtatcagttaagcaacaatgaagttattgagtgcattacacagggacgggtgctacagcgaccccggacctgcccacaggaagtctacgaactaatgctggggtgctggcaaagagagcctcacatgaggaaaaacattaaaggcatccacacgctgctgcagaatctcgccaaagccagtcctgtgtacctcgacattctgggctag

SEQ ID NO: 197177 - DNA, 1434 bp, Artificial Sequence
  Description of Artificial Sequence: Synthetic coding sequence
atgagcagctggatccggtggcacggccccgccatggcccggctgtgggggttttgttggctagtggtcggtttctggagagccgcttttgcctgtcccaccagctgcaagtgttctgccagccgtatttggtgcagcgacccatcccctggcatcgtagcttttccacgtctggagcccaactccgttgatcccgagaacataacggagatcttcatcgcgaatcagaagcgtctcgaaatcatcaacgaggatgacgttgaagcttacgtaggcttgaggaatctcaccatcgtagacagcggactgaagttcgtcgcacacaaggcctttctgaaaaactcaaatctgcaacacatcaatttcacaaggaacaaactcacatctcttagtaggaagcatttccgtcatctggacttgtccgaactcatcctcgtggggaatcccttcacatgctcctgtgacattatgtggattaagactctgcaggaagcaaagagctcgcccgatacccaggacctctattgcttgaatgaatcttccaaaaacataccgctcgccaatctacaaatccctaactgcggactccccagcgccaatctggccgctcctaacctaacagtggaggagggaaagtccatcaccctaagctgttctgtggccggtgatccagtgcccaatatgtattgggatgtgggcaatcttgtgagcaagcacatgaacgaaaccagccatacccagggaagccttagaatcacaaacatatcttctgatgactcaggaaagcagatttcatgcgtagccgaaaacctcgttggagaggatcaggactccgtaaaccttaccgtccatttcgctccaaccattaccttcctggaatcccccacttctgaccatcactggtgcatcccctttacggtgaagggcaaccccaagccagccctgcagtggttctacaacggtgccatcctgaatgagtccaagtatatctgtactaaaattcatgtcactaaccatacggaataccatggttgccttcagttagataacccaacacacatgaacaacggagattacaccctgatcgccaaaaacgagtacggcaaggacgagaagcagattagcgcccactttatgggctggccgggtattgacgatggcgctaaccccaattaccctgatgtgatatatgaagattatggcacggcagctaatgatattggggacacgacaaaccgcagcaacgaaattccaagcacggacgttaccgacaagaccggcagagaacacttgagtgtctatgctgtagtagtgattgcctccgtcgtgggtttctgccttctagtaatgctgtttctcttgaagttggcacgccacagtaagttcggaatgaaaggttttgttctgttccataaaatccctctagatggttag

SEQ ID NO: 197178 - DNA, 1614 bp, Artificial Sequence
  Description of Artificial Sequence: Synthetic coding sequence
atgagcagctggatccggtggcacggccccgccatggcccggctgtggggcttctgctggctggttgtcggattttggcgagcagccttcgcatgtcccacctcatgcaaatgttcagcatcccgtatctggtgtagtgacccctcccctggaattgtggcattcccccgcctggagccaaatagtgtggacccagaaaacattactgaaatcttcattgccaatcagaagaggctggaaatcattaatgaagacgatgtggaggcctacgtaggtctccgtaacctcacaatagttgacagcgggctgaagtttgtagcccacaaggcattccttaagaattccaacctccagcacataaacttcactaggaacaagcttaccagcctctcacgcaagcattttcgacacctcgatctcagcgagttgatactggtgggcaatccattcacttgctcttgcgacataatgtggatcaaaacactccaagaagcaaaaagtagccccgatacgcaagacctgtattgtctaaatgagtcatccaagaatatcccactggccaacctgcagattcctaactgcgggctgccctcggctaacctggcggcaccgaatttgactgttgaggagggcaagagtatcactctaagctgttcggttgccggagacccagtgcctaacatgtactgggacgtggggaatctggtttctaaacacatgaacgagaccagtcacacccaaggcagtttgcgtattacaaacatttcctccgacgatagcggcaagcagatctcgtgcgtcgctgagaacttggtgggagaagaccaggactcagttaatctgactgtccatttcgcacctaccataacctttctggaatctcccacctctgaccaccattggtgtattccttttacggtgaaaggcaatcccaaacccgctctgcagtggttttacaacggagcaatccttaacgaaagcaaatatatctgcaccaagatccatgtgaccaatcacacagagtaccatggatgcctgcagctcgacaatcccacccacatgaacaatggcgattacactctgattgctaaaaatgagtacggaaaagatgaaaaacagatcagcgcacacttcatgggatggcccggcatcgatgatggcgccaacccaaactaccctgacgttatatacgaggactatgggacggccgccaatgacatcggcgacaccacaaaccggtccaatgaaattccatcaaccgacgtgactgacaagaccgggagggagcacctgtccgtgtatgccgtcgtggttattgcctcagttgtgggtttttgcttactggttatgctcttcctgttaaaattagctaggcactccaaattcggaatgaaggggcccgccagtgtcatctctaacgatgatgacagtgcttctccattgcaccacattagtaatggatctaacaccccttcatctagcgaaggtggcccagacgccgtaatcatagggatgaccaagatacctgtcatcgaaaatccccagtacttcggcatcaccaacagccagctgaaacccgacacatggcccagaggctcccctaaaactgcctag

SEQ ID NO: 197179 - DNA, 2469 bp, Artificial Sequence
  Description of Artificial Sequence: Synthetic coding sequence
atgagcagctggatccggtggcacggccccgccatggcccggctgtgggggttctgctggctggttgtgggattttggcgggccgcattcgcttgtcccacctcatgcaaatgctctgcctctcgcatttggtgttcagacccctcccctgggattgtcgccttccctaggctcgagcccaactccgtcgacccagagaacattaccgaaatattcatcgccaaccaaaaacgcttggagatcatcaacgaggacgatgtggaagcttatgtggggctccgcaatcttactatcgtcgacagcggattgaagttcgttgctcacaaagctttcctcaagaactcaaacctccaacacataaacttcacacggaataagctcacctcactctcacggaagcactttcgtcatctcgatctgtccgaactgatcctggtgggcaatcctttcacgtgttcctgtgacattatgtggatcaaaacattacaagaggccaagtccagtcccgacacccaggatctgtattgcctcaacgagtctagcaaaaatattcctttagcgaatctgcagataccaaattgtggtttgccgagtgccaacctggccgccccaaaccttactgtggaggaggggaagtctatcacactgtcgtgttccgtggccggggatcccgtccccaacatgtattgggatgtgggcaacctggtatcaaagcatatgaacgaaacctcgcatacccaaggctcacttaggattactaacatctcctccgacgacagcggcaaacaaatcagctgcgtcgccgagaatctggtcggtgaagaccaagatagtgttaacctgacagtgcacttcgctcccaccattacttttctggaatcacctacctcggaccaccattggtgtattcctttcaccgtgaaaggcaaccctaagccggctttacagtggttttacaatggtgcaatcctgaacgaatccaaatacatttgcactaagattcatgtcacgaaccacaccgaatatcatggatgtctccagttggataaccccacccacatgaataacggcgactataccctaatcgctaagaatgagtacggcaaagacgaaaagcagatctccgctcacttcatgggatggcccggtatagatgacggtgcaaaccccaattacccggatgtgatatacgaggactacggcacagctgcaaacgacattggcgatacaacaaacagatctaatgagattccttctaccgacgttacagacaagaccggacgggaacacctaagtgtttacgccgtggtagtgatcgcaagtgttgtgggattttgtctcctggtcatgctgttcctgctcaagctggcccggcattccaagtttgggatgaagggcccagcttccgttatctcaaatgatgacgacagcgccagtcccctacaccatatctctaacggctccaacacaccgtcatcatcagagggaggacctgacgctgttattataggaatgacaaaaattccagtgatagagaacccacagtattttggaattacaaacagccaactcaaacccgacacctttgtgcagcatatcaaacggcacaacatagtgctcaaacgtgagttaggggagggggcctttggaaaagtattcctagctgagtgctacaatttgtgccctgagcaagacaagattctagttgccgtgaaaaccctgaaggatgcctctgataatgctcggaaggattttcatcgggaggccgagctgttgacaaacctacagcacgaacatatagtgaaattttacggagtctgtgtggaaggagaccccttgatcatggtattcgagtacatgaaacatggggatctaaataagtttttacgggcccacgggcctgacgctgttctgatggctgaggggaacccacctacagaacttactcagtcccagatgcttcacattgcacagcagatagcagccggcatggtttatctggcctcacagcattttgtacaccgggatcttgccacccgaaactgcctggtgggagaaaaccttctggttaagatcggagactttggtatgtctagggatgtctattcaacagactactatcgcgtcgggggccatacaatgctgcccatacggtggatgccacctgaatctattatgtaccgaaaattcactacagagagcgacgtgtggtcactgggggtcgtcctctgggagatatttacttatgggaaacagccatggtaccagttatccaataatgaagttattgagtgtatcacacagggccgagttctccaacggccacgaacctgtcctcaggaagtgtatgagctgatgctgggatgctggcaacgtgagccgcatatgcggaaaaacatcaaagggatacacacacttctgcagaaccttgctaaagcatctcccgtgtacctcgatatactgggctag

SEQ ID NO: 197180 - DNA, 2517 bp, Artificial Sequence
  Description of Artificial Sequence: Synthetic coding sequence
atgagcagctggatccggtggcacggccccgccatggcccggctgtgggggttctgctggctggtggttggattttggagggccgccttcgcgtgccccacctcttgtaaatgctctgctagcagaatttggtgctctgacccatctcctgggatcgtggcattccctcgtttagagcctaacagcgttgacccagagaacatcaccgagatcttcattgcaaatcagaagaggctggagatcattaatgaggacgatgtggaagcttacgttggcctaagaaatcttaccatagtcgacagtggactaaagttcgttgctcataaagcattcttgaagaacagtaatctgcagcacataaactttacacgtaacaagttgacatccctgagcaggaagcattttagacacctggatctttctgagctcatcctggtgggaaatccattcacgtgttcctgcgatataatgtggatcaagaccttgcaggaagctaaatcctccccagatacgcaggatctctattgtctgaatgaatctagcaagaatataccactggcaaatctgcagattcccaactgtgggctgcccagcgctaatcttgctgcacctaatctaactgtggaggagggcaagtctatcaccctgagttgctctgtggccggagatcctgtccctaatatgtactgggatgttggcaacctggtttccaagcatatgaacgaaaccagccacacccaaggttcccttagaatcacgaacatctctagcgatgatagcggtaagcagatatcctgcgtggcagagaatctggtaggtgaggatcaggattctgttaatctgactgtacatttcgccccaacgatcacttttttagagagccccacgagcgaccatcattggtgcataccattcaccgtgaaagggaacccaaaacctgccctccagtggttctataacggtgcaatcctgaatgagtcaaagtacatttgcaccaagattcacgtgaccaaccatacagagtaccacgggtgcttacagctggacaatcccacacacatgaacaacggcgattacaccctcatcgcaaagaatgagtacggaaaagatgagaagcaaatttcggcccactttatgggttggcccggcatagatgacggagctaatcccaactatcctgacgtcatctatgaggattacggaaccgctgctaatgatatcggcgacactaccaatcgctccaacgagattccgtccacagacgtaacagacaaaacagggcgcgaacatctcagtgtgtacgcggtggttgttatcgcctccgtcgttggcttttgccttctcgtgatgctttttctcctgaagctggctaggcatagtaaattcggcatgaaggacttctcctggtttggcttcggcaaggtgaagtctagacaaggcgtagggcctgcatctgttattagcaacgatgacgatagtgcaagtccactgcatcacataagcaacgggagtaacactccgtcctcctcagagggtggtcccgacgctgttattattgggatgaccaagatccctgtgattgaaaacccacagtatttcggtataaccaatagccagctgaaacctgatacctttgtacagcacataaagcgacacaacatcgtgttaaagcgtgagctgggagagggcgcattcggaaaagtgttcctggcagagtgttacaatctctgtcccgaacaagacaagattctggttgcggtcaagaccctgaaagacgcttccgacaatgctcgcaaagatttccacagggaagcggaactgctaactaatctccagcatgagcacatcgttaaattctatggggtgtgtgttgagggggacccgctgatcatggtgttcgagtacatgaagcacggcgacctgaacaaattcttgcgtgcgcacgggcccgacgctgtgttaatggccgaaggtaaccctcccacagagcttacacagagtcaaatgctgcacattgcccagcaaattgcagcaggcatggtgtatctcgcttcacagcactttgtacatcgcgatctcgctaccaggaactgcctggttggtgagaatctgttggtcaaaatcggagacttcggcatgtcccgtgacgtgtatagcacagattactatagggtcggaggccatacaatgctgccaatccgctggatgcctcctgaaagcatcatgtataggaaattcacaactgagagtgatgtgtggtctttaggggtggtgctgtgggaaatttttacttacgggaaacagccatggtatcagctgtcaaacaacgaggtgatcgagtgtatcacccaaggcagggtgttacagcggccaaggacctgtccccaggaggtgtatgagctgatgctgggctgctggcagagagaacctcacatgcgaaaaaatattaaaggaatccataccctcctgcaaaatctggccaaggcgagtccagtgtatctggacattcttggctag

SEQ ID NO: 197181 - DNA, 966 bp, Artificial Sequence
  Description of Artificial Sequence: Synthetic coding sequence
atgtggatcaagaccctgcaggaggccaagagcagccccgacacccaggacctgtactgcctgaacgagagttcaaaaaatatcccactggccaacttacagattcccaattgtgggcttccgtctgctaaccttgccgcccctaacctgaccgttgaagaaggtaagagtattaccttatcctgcagtgttgcgggggatcccgtgcctaacatgtactgggacgtggggaacctggtttcaaagcacatgaatgagacttcacacactcaaggatctttgagaattaccaacataagcagtgatgactctggtaagcagatcagttgtgtcgctgagaaccttgtgggcgaggatcaggattccgtcaatctcacagtgcactttgcccctaccatcacatttctggaatcgcccactagcgatcaccactggtgtatccctttcacagtgaaagggaatccgaaacccgcgctgcagtggttctataacggtgccatcctgaatgagagtaagtacatctgtacaaagattcacgtcacaaatcacaccgagtatcatggctgccttcagttggacaaccccacccatatgaataacggcgattacactctgattgcaaaaaacgagtacggaaaggacgagaagcagattagtgcacatttcatggggtggcccggcattgacgacggagccaatccaaattatcctgatgtgatctatgaagattatggcacggcagcaaacgacattggggataccacgaatagaagtaacgagatcccttctactgatgtgaccgataaaaccggcagagaacacctctctgtttacgcagtggtcgtcatcgcaagcgtagtaggcttttgcctccttgtgatgctgttcctgttgaaactggctcgccacagtaaattcggaatgaagggctttgtcctgtttcacaaaatacccttggacggctag

SEQ ID NO: 197182 - DNA, 1434 bp, Artificial Sequence
  Description of Artificial Sequence: Synthetic coding sequence
atgagcagctggatccggtggcacggccccgccatggcccggctgtggggattctgttggttggtggttggtttctggcgcgccgctttcgcatgtccaacctcctgcaaatgcagcgccagtcgaatatggtgcagcgacccttctcccggcattgtggcattccccaggctggagcctaattcagtagatccagaaaacatcacagagatatttatcgctaaccaaaagcgcctcgagataattaacgaagacgacgtggaggcctacgtcggcctgcgcaatctgacgattgtggattcagggctgaaatttgtcgcccacaaggcattccttaaaaattctaaccttcaacatattaacttcacacggaataaattaaccagcctctctcgcaagcattttcgccacctggatcttagtgagctgatcctcgtggggaacccattcacgtgctcgtgcgacataatgtggatcaagactcttcaggaagctaagagtagccccgacacccaggatctctattgcctgaacgagtcaagcaaaaacattcccctagctaatttgcagataccaaactgtgggctgccctcagctaacctggctgcccctaacctgacagtcgaggaaggcaagagcattacactttcctgctctgtcgccggtgacccagtcccaaacatgtactgggatgtggggaatcttgtgtccaaacatatgaacgaaactagtcatactcaggggagcctcaggataacgaatatttctagcgacgatagcgggaaacagattagctgcgtggccgagaacctggtgggggaggatcaagactctgtgaatctgaccgtacattttgcccctaccattaccttcctggagtcacccacctcagaccaccattggtgcataccattcacggtaaaaggcaatcctaagcctgcactccaatggttttacaacggggctatcctgaacgagagcaagtacatttgtacgaagattcatgtgaccaatcacacagaataccacggttgcctgcaactggacaatcccacccacatgaataacggcgactataccttaatcgctaagaatgagtacggcaaggacgagaaacagatttctgcccactttatggggtggcctggcattgatgatggtgccaatcccaactacccagatgtaatctacgaagactatggcaccgcagcaaatgacattggcgacacaacaaaccgctccaacgagatacctagcaccgacgtgacagacaaaaccggacgtgagcacttgtctgtgtatgccgtggttgtcatagcatcagttgtgggtttctgtctcctcgtgatgttattcctactgaagctggctcgccattctaagttcggaatgaaaggcttcgtcctatttcataagatcccacttgatggttag

SEQ ID NO: 197183 - DNA, 1839 bp, Artificial Sequence
  Description of Artificial Sequence: Synthetic coding sequence
atggacgtgagcctgtgccccgccaagtgcagcttctggcggatcttcctgttgggaagtgtgtggcttgattacgtcggttcagtgctcgcctgccctgcgaattgcgtctgttctaaaaccgagatcaactgccgcaggccagatgatgggaacctgttccccttgttagagggtcaggatagcggtaattctaacggaaatgcttcaatcaatatcaccgacatttcgcgtaacatcacctctatccacatcgagaattggcgatcgctgcatactttgaacgccgtggatatggagttatatacaggactgcagaaacttacgattaaaaattccgggctgaggagcatccaaccacgcgcctttgctaagaaccctcacctccggtatatcaacctgtcctcaaaccggctgaccacgcttagctggcaactattccagactctctcacttagagaactgcagctagagcagaactttttcaattgttcttgtgatatacgctggatgcagctgtggcaggaacagggcgaggcaaaacttaactcccagaatctctactgtattaacgccgatggaagtcaactgccacttttcaggatgaatatctcacagtgcgacctcccagaaatctctgtttcgcatgtgaatctcacagtgcgcgagggtgacaacgcagttatcacttgcaacggatcgggtagccctcttcccgacgttgattggattgtgacaggcctacagagcattaacacacaccagactaatttgaactggacaaacgtacacgccattaatttaaccctagtgaacgtaacgtctgaagacaacggatttactctcacatgtatcgctgagaatgtggtaggtatgtctaacgcatccgtggctctaactgtatactatccccctcgcgtggtaagcttggaagagcccgagttacggctggaacactgtatagagtttgtcgtgcgaggcaacccgccaccaacgctgcattggctgcacaatgggcagccacttcgggagagcaaaattattcacgtggagtactatcaagaaggtgaaatcagcgaagggtgtctgctgtttaataagccaactcactacaacaatggtaactataccctgatcgccaagaatcctctgggcacagcgaatcagaccattaatgggcatttcttgaaggaaccctttccagagagcactgacaatttcattctgtttgatgaggtgtcaccaactcctccaataacagtcacccacaagcctgaggaagatacctttggcgtctctatagccgttggactggctgcgttcgcatgtgtgctgctcgtggtgctgtttgttatgattaacaagtacgggcggagatcaaaattcggcatgaaaggtccagtcgccgtgatcagtggtgaagaggactccgcatctccccttcaccatattaaccacggaatcacaactccctcatccttggatgccggaccagatacggtcgtcatcggcatgaccaggatacccgttatagaaaatccacaatacttccgccagggccataattgtcacaagcccgacacttgggtgttcagcaacatcgataaccatggcatcctgaacctgaaagacaatcgggaccatttggtgccttccacacactatatctacgaagagcctgaagtccagagcggggaagttagctatccgcgctctcatggatttcgggaaatcatgcttaatccgatctccttacccggacactccaaacctctcaaccacgggatttacgttgaggatgtaaacgtgtacttttccaaaggcagacacggtttttag

SEQ ID NO: 197184 - DNA, 414 bp, Artificial Sequence
  Description of Artificial Sequence: Synthetic coding sequence
atgacccggatccccgtgatcgagaacccccagtacttccggcagggacacaactgtcacaagcccgacacctacgtgcagcacatcaaaagacgagatatagtcctcaaaagagagctgggcgagggagcattcggcaaggtgttcctggctgagtgctacaacctgagccccaccaaggataaaatgctcgtagccgtgaaagccttaaaagacccaacgttagccgcgcgcaaggattttcagagagaggccgaactactgaccaacctccaacatgaacacatcgtcaaattctatggcgtgtgtggcgatggggacccacttattatggtcttcgaatacatgaagcacggcgacctgaacaagtttctttcatcaatatccagcccaaaatctcaccagcaagggtag

SEQ ID NO: 197185 - DNA, 2478 bp, Artificial Sequence
  Description of Artificial Sequence: Synthetic coding sequence
atggacgtgagcctgtgccccgccaagtgcagcttctggcggatctttctcctgggcagcgtgtggctagattacgtcggtagcgttctagcttgcccagccaactgcgtgtgttccaagactgagataaactgtaggagacctgacgatggcaatctcttccccctccttgaaggacaggattctggcaacagcaacggcaacgcctccattaacatcacagatatcagccgaaatatcacgtccatccatattgaaaactggagatcactgcacacactcaacgccgtcgatatggagctgtacaccggcctgcagaaactcactataaaaaacagcggactacgcagcatccaacctagggcttttgctaagaatccacatttgcgctacatcaacctgtcatccaaccggttgaccactctttcgtggcagctgtttcaaactctgagtctccgagagctgcaacttgagcaaaatttttttaactgctcctgcgatataagatggatgcagctctggcaagaacagggagaggctaaactgaattcgcagaatttatactgcattaatgctgatggctctcagctgccactgttccgaatgaacattagccagtgtgacttaccagaaatttctgtgtcgcacgtcaatctcacagttcgagaaggcgacaatgccgtcatcacgtgcaatggcagcgggtctcccctccctgacgtagactggattgtgactggtctgcagagcataaacactcaccagaccaacctcaattggacaaatgtacatgcgattaacctcactttggtgaacgtgacttctgaagataatgggtttactctgacctgtattgccgagaacgttgtgggaatgtctaatgctagcgtggccttgacagtgtattatcccccaagggttgtgagtctcgaggagcctgaactgagacttgagcactgcatcgagttcgttgtgagaggaaatcccccacctaccctgcactggctccacaatggacagccgctccgcgaaagcaagatcatccatgtggagtattatcaagagggagaaattagtgagggctgcctgttgtttaataaacctactcattacaataacggtaactacacgctaattgccaaaaatcctctcggcacggccaatcaaaccatcaacgggcacttcttaaaagaaccctttccggagtccactgataactttattcttttcgacgaagtgtctcctaccccccctatcacagtgacgcataaacctgaagaagacacatttggggttagtatcgccgtgggcctcgctgcctttgcatgtgtgctgctagttgtgctctttgtgatgataaataagtatggacgccggtccaagtttggaatgaaaggcccagtggcagtgatctctggggaagaggacagtgcatctcccctgcaccatattaatcacgggattacaacacccagctctctggatgcgggacccgatacagtcgtgatcggaatgacacgcatccccgtgatcgagaaccctcagtacttccggcagggccacaactgtcacaaaccagatacatatgtgcaacacattaagagacgggacatcgtcttaaagagagagctgggagagggcgctttcggaaaggttttcctcgcggagtgctataacctgtcccccacaaaagataaaatgttggtggcggtgaaagcccttaaagaccctactctggcggcacgaaaagatttccagagagaagctgaactgttgaccaacctgcagcacgagcacatagtgaagttctatggcgtttgtggggatggagatccccttattatggtctttgagtacatgaaacacggggatctcaacaaattcctccgagcccatgggcccgacgctatgattttagtcgacggccagcccaggcaggctaaaggggagttgggattatctcagatgctacacattgcatcccagattgcatctggcatggtatacctggcgagccagcattttgtccatagggacctcgcaacccgcaattgcctcgtgggggccaatttacttgtcaagatcggcgacttcggaatgagccgtgacgtttattccacagactattacagagttggaggacataccatgctgcctatcagatggatgccccccgagagcatcatgtatcgcaaatttaccacagagagtgatgtttggtcttttggagtaattctgtgggagatattcacctacggcaagcagccctggttccaactgtccaatactgaggttatcgagtgcatcacccaaggccgagttctggaacggcccagggtgtgcccaaaggaggtgtacgatgtgatgttagggtgttggcagagagagccacagcagcgactgaatatcaaggagatatataagatcctccatgccctcggaaaagctactccaatttacctggacatcctaggctag

SEQ ID NO: 197186 - DNA, 2496 bp, Artificial Sequence
  Description of Artificial Sequence: Synthetic coding sequence
atggacgtgagcctgtgccccgccaagtgcagcttctggcggatctttctgctgggaagtgtgtggctggactacgtgggatcagtgctcgcatgccctgctaactgcgtgtgctctaagacagagatcaattgccgaaggcctgacgatgggaacttgtttccgctcttagagggtcaagactctggcaactccaatggaaacgcgtcaatcaatataaccgatatttcgcgtaacattaccagtatccacatcgagaactggaggagcctgcacacgctcaatgccgtggacatggaactgtacaccggtttacaaaagctaactattaagaattctggtctgagatctattcagcctcgggcgttcgcaaagaatcctcatctcaggtacatcaatttatcctcaaatcgtctcaccactcttagctggcagttgttccagacactgtcacttagagagctgcagctggagcagaacttcttcaactgtagctgcgatatccggtggatgcaactctggcaagagcagggggaggcaaaattgaactcacagaacctgtattgcattaatgccgacggctcacagttgcccctgttcagaatgaacatatcccagtgcgacttacctgaaatctccgtgagtcatgtcaacctgaccgtaagagaaggagacaatgcagttataacatgcaacggctcaggctctcctctcccagacgtggactggattgtcacagggctacagagtatcaacactcaccaaactaacttgaattggacaaacgttcacgcaataaacctgacccttgtaaacgtgacgagtgaggataatggatttaccctcacatgtattgcagagaacgttgtcggcatgtctaacgcgagcgttgccctgacggtatactatcctccgcgggtcgtgagcctcgaggaacctgaactgcgcctcgagcactgcatcgagtttgtagtgagggggaaccccccccccacacttcactggttacacaatggtcaacccttgcgcgagtccaaaatcattcacgtagagtactaccaggagggggagatctccgaaggttgtctgctcttcaataaacccacccactataacaacggaaattataccctaattgccaaaaaccccttaggaacagcgaaccagactattaatggacattttctgaaagagccttttccagttgacgaggtgtctcccacaccccccatcacagtcacccacaagcctgaggaggacactttcggcgtgtccattgccgtgggactggccgcattcgcttgcgtgctattagtcgttctattcgtcatgatcaataagtacggaagacggtccaaatttggaatgaaaggacccgtggcagtgatatcgggggaggaagattctgcctctccgttacatcacatcaatcacgggattactacaccctcatccctcgatgccggacccgacaccgtggtcatcggtatgactcgaattcctgtaatcgaaaatccacaatatttccgacagggtcataactgtcataagcccgacacctatgtccagcacatcaaacgacgggatatcgtactgaagagagagttgggggaaggagcattcggcaaggtctttctggctgagtgttataatctgtctccaaccaaggacaagatgctcgtagccgtgaaagcactgaaggatccaacactcgccgccaggaaggattttcaaagagaagcggaactgctcacaaatctgcagcacgagcatatagtcaaattttacggagtctgcggggacggggaccccttaattatggtgtttgagtatatgaagcatggagacttgaacaagtttctgcgcgctcacggccctgacgctatgattctcgttgatggccagccacgccaggcgaagggagagcttggcctgagtcagatgctgcatatagcatctcaaatagcatccggtatggtatacttagccagtcaacactttgtgcatagggacctggcaacaaggaactgtcttgtgggcgccaatctactagtgaaaataggagacttcggtatgagtcgcgacgtttactctacagattactatcgtctatttaatccctcaggaaacgatttctgcatttggtgcgaagttggcggacacactatgctccctattcgatggatgccaccagagtcaatcatgtataggaagttcacaactgaaagtgacgtctggtctttcggggttattctctgggagatcttcacttacggcaaacagccatggttccagctctcgaacacagaagtgatcgaatgtattactcagggccgcgtgcttgaaagaccacgagtgtgccctaaggaggtttatgatgttatgttaggatgctggcagcgcgagccacagcagcgactgaacatcaaagaaatctacaaaattctccacgccctgggaaaggctacacccatctatttggatattctggggtag

SEQ ID NO: 197187 - DNA, 2520 bp, Artificial Sequence
  Description of Artificial Sequence: Synthetic coding sequence
atggacgtgagcctgtgccccgccaagtgcagcttctggcggatctttctgcttggctcggtgtggttggattatgtcggcagcgttctagcatgcccagcaaattgcgtttgttctaagactgaaatcaactgccggaggcccgacgacgggaatttattccctctactcgagggccaagacagcggcaacagcaacggtaatgcttctataaacataacagatatttcacgtaatatcacttccattcacatcgagaactggaggtcactccatacactcaatgctgttgacatggagttgtacacgggtttgcagaaattgaccattaagaattccgggctgaggagcatacagccaagggcctttgctaaaaatccccacttacgctacatcaacctgtcgtccaataggctgaccacactgagttggcaactatttcaaactctttcgcttcgggagctgcaactggaacaaaacttcttcaactgttcctgtgacattcggtggatgcagctgtggcaagaacagggcgaggctaaactgaacagccagaacctgtactgcatcaatgctgacggatctcagctgcccctgttccgcatgaacattagccaatgcgacctgccagaaattagcgtgtcccacgtgaacctaacagtcagagaaggcgataatgccgtaattacctgcaatggtagtgggtccccactgccagacgtggattggattgtcaccggactgcaaagcattaacacacaccagactaacctgaattggaccaacgtacacgctattaatttgacgttggtcaatgtgacttcggaggacaatggtttcacgctgacgtgcatagccgagaatgtagtgggaatgagtaacgcctcggtggctcttaccgtttactaccccccacgcgtggtgagcttggaagaaccagagctcaggctggagcactgcatcgagtttgttgtgagaggaaacccaccaccaaccctgcattggctccataatgggcagccgctgcgcgaatccaagatcatccacgtggagtattaccaggagggtgagatctctgaagggtgcctcctgtttaataagccaacacattataataacggtaactatacgctgattgctaagaacccgcttgggaccgctaaccagaccatcaacggacattttcttaaggagcctttccctgaaagcactgataatttcatcctatttgacgaggttagtcctaccccaccaataaccgtcacacacaagcccgaagaggacactttcggcgtgtccatcgcagtcggactagcagctttcgcctgcgtcctcttggtggtgctgtttgttatgatcaacaaatacggccgccgctctaaattcggtatgaaggggccagtagccgtcatatccggcgaggaagactctgcatccccattgcaccatattaaccacgggatcaccacgccgtcctctttggacgccggccccgatacagtggtcataggaatgacgagaatccctgtgatcgagaacccacagtacttccgacagggacacaactgtcacaagccggacacctatgtccagcatatcaagcggagggatattgtgctgaagagggaactgggtgagggcgccttcggcaaagtatttctggcagagtgctacaatctgtcccctactaaagacaagatgctggtggctgtgaaggcccttaaagacccaactctcgctgctcgaaaggacttccaaagagaggccgagctgttaacgaaccttcagcacgagcacatcgtcaagttttacggcgtgtgcggtgacggggatcccctcattatggtgttcgaatatatgaaacacggcgatctcaataaatttttgcgcgcccatggaccggacgcaatgatccttgttgacggccagcccaggcaagccaaaggcgagctggggctgtctcagatgctacacatcgcctctcagatagcctcaggtatggtttacctggcttcacagcatttcgtccaccgagacctggcaactaggaattgcctcgtcggggctaatctcctcgtcaagatcggggactttggcatgagcagagatgtttactccactgactactatagactgtttaatccttctgggaacgatttctgtatctggtgcgaggttggggggcacactatgttgcctatcagatggatgccccccgagtctatcatgtatagaaaatttactacggaatccgacgtctggtctttcggtgtaattctttgggaaatctttacgtacggcaagcagccatggttccagttgagtaatactgaagttattgaatgtatcacacaaggtagagttctggagagaccacgggtctgtccaaaagaagtctacgacgtgatgttgggctgttggcagcgcgagccgcaacaacgcttaaacataaaagagatttataaaatactgcatgcactcggtaaggccacacccatatacctggacatactgggttag

SEQ ID NO: 197188 - DNA, 2478 bp, Artificial Sequence
  Description of Artificial Sequence: Synthetic coding sequence
atggacgtgagcctgtgccccgccaagtgcagcttctggcggatcttcttgctggggagtgtttggctcgattacgtaggatccgtgctagcctgccccgcaaattgtgtgtgcagcaagactgaaattaactgtcggcgacctgacgacgggaatctattcccactgctggaaggacaggattcgggcaatagcaatggaaacgcatctatcaacatcactgatatttccaggaatataactagcattcacatcgagaattggaggtccctgcacaccttgaatgccgttgatatggaactttacaccggacttcagaagctcaccatcaagaattcagggttacggtcgatccaaccccgcgcattcgcaaaaaatcctcacctgaggtatattaatctgagctccaacagactgacaactctctcttggcaactattccagactctgtccctgagagagctacagctggagcagaacttcttcaattgttcgtgcgacatcaggtggatgcaactttggcaggagcagggggaagccaaacttaatagtcagaatctgtattgcattaatgctgacggctctcagctgccactgtttaggatgaacattagtcagtgcgacttaccggagatctcggttagccacgtgaatctcacagtgcgtgaaggagacaacgcagtgatcacgtgtaatggcagtggaagcccactcccagatgtcgactggatcgtgaccgggctgcaaagcattaacacacaccagactaacctcaattggactaatgttcacgccatcaacctgactctagtgaacgtcacaagcgaagacaacggctttaccctgacatgcattgcagaaaacgtcgtcggcatgtcaaatgcttccgttgcactcacggtatactaccccccgagggtggttagtttggaggagccagaactccggctggagcactgcatcgagttcgtagttagggggaacccgcccccaaccctccactggctgcacaacgggcagcccctgcgcgagagcaagatcatccatgtggaatactaccaggagggcgagatttccgaagggtgtctgttattcaacaagccaacacactataacaatggcaattacacactaatcgcaaagaaccctctcggtacagctaaccagactatcaacggacactttttgaaggagccattccctgaatctactgacaactttatcctgttcgatgaagtgagtcctacgccgccaataaccgtgacccacaagccagaggaggacacttttggagtgtccattgctgtgggcctggctgcctttgcatgcgtgctcctggtggtcttgttcgtaatgattaacaagtatgggaggcgttccaagtttggaatgaagggcccagtggctgtaattagtggagaggaagactctgctagcccactgcaccatatcaaccacggcattactacacccagctcccttgatgcaggcccagatactgtggtgattggaatgaccaggatacctgttatcgaaaatccccagtacttcagacaggggcataactgccacaagcctgacacttatgtgcaacacatcaaacgccgggatattgtgctcaaacgagaactcggggagggggctttcggcaaagtattccttgccgaatgttataacctctcccccaccaaggacaaaatgctagtagctgttaaggctctcaaagacccgaccctggccgcccgcaaagactttcagcgcgaggctgaactgctcaccaatctccaacatgaacatattgtgaagttttatggcgtgtgcggcgacggagacccactgattatggtgttcgagtacatgaagcacggggacctgaataaatttttgagagctcacggcccagatgctatgattctggtcgatgggcagcctcgacaggccaaaggtgagctcggtctctctcagatgctgcacattgcctctcagattgcatccggtatggtctacctagcctcacagcacttcgttcacagggatcttgccaccagaaactgcctcgtgggtgccaacctcttggtgaaaattggagatttcggcatgtctagagacgtttatagcactgactattatcgggtcggaggccacacaatgctgcctatccgttggatgcccccggagtcaattatgtatagaaagttcaccacagagagcgatgtctggtccttcggagtgattctgtgggaaatcttcacgtacgggaagcaaccttggttccagctgtcgaatacggaagttattgaatgcataacacagggccgagttcttgagaggccccgtgtgtgccccaaggaagtctatgatgtgatgctagggtgttggcagagggaacctcagcagaggcttaacatcaaagagatatacaaaatcttacacgctctcggaaaggcgacccccatttacctggatatccttgggtag

SEQ ID NO: 197189 - DNA, 1839 bp, Artificial Sequence
  Description of Artificial Sequence: Synthetic coding sequence
atggacgtgagcctgtgccccgccaagtgcagcttctggcggatctttcttttaggatcggtctggctcgattacgttggatcggtactcgcgtgccctgctaattgcgtatgcagcaagactgagattaactgtcgaagacctgatgatgggaaccttttccccctgcttgagggccaggatagtggaaacagtaatggcaacgcgtctatcaacataacagacatctcccgaaacatcacgagcatacacatcgagaactggagaagcttgcacacactcaatgccgtggatatggaactgtacactggcttgcagaagcttaccatcaaaaacagtgggctacggagtattcagcctagagcattcgcaaagaatccacacctgaggtacattaatttaagctctaaccggctgacaactctctcttggcagttgttccagacactttcgcttagggagctacaattggaacaaaatttctttaactgttcatgcgacattcggtggatgcagctgtggcaggagcagggtgaagctaagctgaactctcaaaacctgtattgcatcaacgccgacggctctcaattgcccttgttccggatgaacatatcccagtgtgatctgccagagatttcagtctcccacgtaaacttgactgtgcgggagggcgataacgctgttatcacgtgtaatggttcaggcagccctttgccagacgttgactggatcgtaaccggcttgcagtcaattaacacccaccagacaaatctgaactggacaaatgtgcacgctatcaacttaacactggtcaatgtgactagcgaggacaacggattcaccctgacatgtattgccgagaacgttgtggggatgagcaatgcatctgtcgcactgacagtttactatcccccccgcgtggtgagcctcgaggaaccagagctgcgtctggaacattgcatcgaattcgtggtgaggggaaatcccccaccaacgctgcactggctgcacaatggacagcctctgcgcgagtcaaaaattatccatgttgaatactatcaggaaggagagatttctgaggggtgcctgctttttaataagccaacgcactacaataatggtaattacacactcatcgctaaaaacccactgggcaccgctaatcagacaattaatgggcatttcctgaaggaaccgttccccgaaagtaccgataattttatcctgttcgacgaggtgtcccccacaccccctatcaccgtcacacataagcccgaggaggacacgtttggggtctcaattgcggtgggactcgccgccttcgcctgcgtcctgctcgtagtgctttttgtgatgatcaacaagtacggccgccgctcaaaatttggcatgaaaggcccagttgctgtcatctctggcgaggaggactctgcctcccctctgcatcatattaaccacggtattacaaccccctcctcacttgacgccggtcccgacaccgtcgttatcggaatgacccggatacccgtcatcgagaatccacagtacttccggcaggggcacaattgccataagcccgacacctgggtgttctcgaatatagataatcacggcatccttaatctgaaggataacagggatcatctggttccgtcaacccactatatttatgaggagccagaggtccagtccggcgaggtatcctacccccggtcccacgggttcagagagatcatgcttaatcctatctcactcccagggcacagcaagcccctgaatcatggcatatatgttgaggatgtcaacgtatatttttccaagggcagacacggcttctag

SEQ ID NO: 197190 - DNA, 1854 bp, Artificial Sequence
  Description of Artificial Sequence: Synthetic coding sequence
atggagctgtacaccggcctgcagaagctgaccatcaagaacagcggccttaggtctattcaacccagggcttttgcaaagaacccgcatttaagatatattaatctctcttctaatagactgacaacactgagctggcagctgtttcaaaccctctccctgcgcgaactccagctggaacagaactttttcaattgtagttgtgatattcggtggatgcaattgtggcaagagcagggggaggctaaactgaattcgcagaacttgtactgcattaatgccgatggtagtcagttgcccctttttcggatgaacattagccagtgtgatctgccagagatctccgtctcccacgttaatctaacagtcagggaaggggataatgccgtgatcacctgcaatggatccggaagtccacttcccgatgttgattggatcgtgacagggctgcagagcattaatactcaccaaaccaacctgaactggacaaacgtgcatgccattaacctgaccttggttaatgtcacctcagaagacaatgggttcactctgacctgtattgccgagaatgtggtgggcatgtccaatgcaagcgttgctctcaccgtgtactacccgccgagggtggtgagcttggaggagccggagcttagactcgagcactgcatcgagttcgttgtgcggggtaatcctccaccaactcttcactggttgcacaacggccagccgctaagggaatccaaaattattcatgtggagtactaccaggagggggagatatccgagggctgtttgcttttcaacaagcctacacactacaacaacgggaattacacactgatcgccaagaacccactgggcacagctaaccagaccatcaacggccatttcctcaaggagccatttccagaatcaaccgacaacttcatcctgttcgacgaggtttcacctaccccacctatcacagtaacacataaaccagaggaagataccttcggagtgtccatcgccgtcgggctggccgcctttgcgtgtgtgcttctggtggttcttttcgtgatgatcaacaaatatgggcgccggagcaagttcgggatgaaaggacctgttgccgtgatttcaggggaggaggacagtgcctcgccactgcaccatatcaaccatgggattaccacacctagcagccttgatgccgggcccgacaccgttgttattggaatgactaggatccctgtgattgagaacccccagtacttcagacaaggccacaattgtcataagcccgacacgtacgttcagcacataaaacggcgagatatagtgctgaaacgcgaactgggcgaaggtgccttcggcaaggtgtttcttgccgagtgttataacctgtccccgactaaagacaagatgttagtcgcagttaaggccttgaaagacccaaccctggctgcgagaaaggatttccagcgcgaggccgagctacttactaacctgcaacatgagcacatcgttaagttctacggagtttgtggcgacggtgatcctctcattatggtatttgaatatatgaagcatggtgacttgaacaagtttttgcgtgcccacggaccagacgctatgatcctggtcgatggtcagccacggcaggctaagggcgaactgggtctgtctcagatgctgcatatcgctagccagatcgccagcggcatggtctacctggcgagccagcactttgtgcacagggatctcgctactcgtaactgcctagtgggtgccaacttgttagttaaaattggcgactttggcatgtccagagatgtgtacagtacagactactaccgggtggtccaggcttag

SEQ ID NO: 197191 - DNA, 774 bp, Artificial Sequence
  Description of Artificial Sequence: Synthetic coding sequence
atgagcatcctgttctacgtgatcttcctggcctacctgcggggcatacagggaaataacatggatcagaggtctctccctgaggacagccttaactcgctcatcattaagctgatccaggccgacattctgaaaaataagttaagtaaacaaatggtggatgtcaaagagaactaccagagcacactcccaaaagccgaagccccccgtgagcctgagcgcggcggccccgctaagtctgccttccagccggttatcgctatggacaccgaacttctgcggcagcagcgccgatacaacagtcctcgcgtgctcttgtccgatagcacaccactcgaaccccctccactgtatttgatggaggactatgtgggatcaccagtggtggccaatcggacatcgagacgcaagaggtatgctgagcacaagtctcaccgtggggagtactccgtctgcgactccgaatccctgtgggtcacagacaaatcatctgcgattgatatcagggggcaccaggttaccgtccttggggagataaaaacaggcaacagtcccgtgaagcagtatttttacgaaacccgctgcaaggaggctaggcccgttaaaaatggctgcaggggaatcgacgacaaacattggaattctcagtgcaaaaccagtcagacgtatgtcagggcactgacatctgaaaataacaagctcgtaggttggcgctggatccgaatagacacttcatgcgtatgtgcattgagccgaaagatcggccgcacttag

SEQ ID NO: 197192 - DNA, 813 bp, Artificial Sequence
  Description of Artificial Sequence: Synthetic coding sequence
atggtgaccttcgccaccatcctgcaggtgaacaaggtgatgagcattctgttttacgttatatttctcgcctatctgagggggattcaggggaacaatatggaccagcggtccttacccgaggactcactcaactctctcatcattaagcttatacaggctgacattctgaaaaacaaactttccaaacagatggtcgacgttaaggaaaattaccagtctactttacctaaggccgaggctcccagagagcctgaacgagggggccctgccaagagtgctttccagcctgtaattgcgatggatactgagttactgcgacagcaaagacgttataatagccccagagtgctcctatcagactcaaccccactggagcccccacctctgtatctcatggaggattacgtcggctccccagtggtcgcgaacaggacatcccgccggaaacgctacgctgaacacaagagccaccgaggcgagtatagcgtatgtgattccgaaagtctatgggtgaccgacaaatcgtccgctatagacattaggggtcaccaggtgaccgttcttggggagattaaaaccggcaattcacctgtgaagcagtatttctacgaaacacggtgcaaggaagctcgtccagttaagaacggttgtcgaggtatcgatgacaaacattggaactcccagtgtaaaacctcgcaaacctacgtccgcgcccttacttcagagaacaacaaactcgtcggctggcggtggattagaatagatacatcttgcgtatgcgcgctaagccgaaaaatcggaaggacctag

SEQ ID NO: 197193 - DNA, 633 bp, Artificial Sequence
  Description of Artificial Sequence: Synthetic coding sequence
atgctgcccctgcccagctgcagcctgcccatcctgctgctgttcctgctgccgtctgtgccaatcgagtcgcagcccccacccagcacactgcctcctttcctggcacccgagtgggacttgctctcaccacgcgtggtgctctcccgcggtgcaccagcgggaccccccttgctgttcctgcttgaggcaggagccttccgagagtcagcaggagcaccagctaatcggagccgccgcggagtgagtgagactgcccccgcgtcaaggaggggagagcttgccgtttgtgatgcagtcagcggctgggttaccgaccggagaaccgccgtggacctgcggggccgcgaggtcgaggtcctaggcgaggtgcccgccgcagggggcagtccactcagacagtattttttcgagacacggtgcaaagcggacaatgctgaggaaggcggacccggcgccggtggcgggggctgtcgtggcgtggatcggcgtcattgggtttcagagtgcaaggcgaaacaaagctatgtaagagccctcactgccgacgcccaaggcagggtagggtggaggtggattaggattgacactgcctgtgtctgtaccctgttatcacgtaccgggagagcttag

SEQ ID NO: 197194 - DNA, 594 bp, Artificial Sequence
  Description of Artificial Sequence: Synthetic coding sequence
atgcagcggtggaaggccgccgccctggccagcgtgctgtgcagcagcgtgctctctatctggatgtgtcgggagggcctgttattaagccaccggcttggtcccgccttggtgccattgcatcggttaccccgcaccctggacgccagaatcgctaggctggctcagtatcgggctttactgcagggcgccccagatgctatggagttacgggaactaactccgtgggccgggcgacctccaggcccccggcgtcgggcgggaccccgccggcgaagagcgcgagcacggttaggggcccgtccgtgtggccttcgggaactggaggtgcgtgttagcgagctcgggctgggctacgccagtgatgagaccgtcctttttcggtactgcgctggagcctgcgaggcagccgctagagtctacgatcttggactacgtaggcttcgtcagcggcggaggttgcgccgtgaacgggtgagggcccagccgtgttgccggcccacggcatatgaggacgaggttagttttctagacgcccatagccggtatcatacggttcatgaactttccgctcgagagtgtgcgtgtgtatag

SEQ ID NO: 197195 - DNA, 1323 bp, Artificial Sequence
  Description of Artificial Sequence: Synthetic coding sequence
atgagcagctgccggggccagaaggtggccggcggcctgcgggtggtctcccccttcccattgtgtcagccggccggggagccctctcagggcaagatgcgctccagttgtgttctgctgacagccctggttgcccttgccgcgtactacgtgtacatcccactgcccggcagcgtgtctgatccttggaagttaatgttactcgatgccacctttcgcggggcgcagcaagtcagtaatcttatccactacctgggccttagtcatcatctactggccttgaactttattatcgtgtcctttggcaagaagagcgcctggtcctctgcccaggtgaaggtgacagacaccgacttcgacggcgtcgaggttcgcgtgtttgaaggaccccctaaacctgaggaaccccttaaacggtcagtcgtttacatccacgggggagggtgggcccttgcatccgccaaaatcagatattatgatgaactctgcacagccatggcagaagagctgaatgccgtgatcgtctcaatcgagtacagactcgtcccaaaagtgtattttccagaacagattcatgacgttgtgcgggctaccaagtacttcctaaagccagaagttctgcagaagtacatggtagaccccggtaggatctgcatttcaggcgattcagctggcggaaacctcgcggctgcactgggtcagcagttcacacaagacgctagcttgaagaataagctgaagctccaggcgctgatctatccagtgctgcaggcactggatttcaacacccctagttatcagcaaaacgtgaacactccaatcctccctaggtacgtgatggtgaagtattgggtggactactttaaaggcaattacgatttcgttcaggccatgatcgtgaataaccatacttccctggacgtggaagaagctgctgcagttcgggcccggctgaactggacatctctattgcctgcctccttcacaaaaaattataagcccgtcgtgcaaaccacaggaaatgctagaattgtacaggagcttccccagctgctagatgcccgcagcgcccccctcattgctgaccaggccgtgctgcaactgttgcctaagacgtacattttgacatgcgagcatgacgtccttcgggatgatggaatcatgtacgccaaaaggcttgaatcagccggagtcgaggtcaccttagaccactttgaggatggtttccacggctgcatgatctttacaagttggccaacgaatttcagcgtaggaatacggacaagaaacagctatattaagtggctggaccaaaatctttag

SEQ ID NO: 197196 - DNA, 1227 bp, Artificial Sequence
  Description of Artificial Sequence: Synthetic coding sequence
atgcggagcagctgcgtgctgctgaccgccctggtggccctggccgcctattatgtgtacatccccctgcccggatccgtcagcgacccatggaagcttatgctgctggatgctactttccgcggagcccagcaggtcagcaacctgattcactacttaggattatcccaccacctcttagcactcaattttattatcgtgagtttcggcaagaagtccgcatggtcctctgcccaagtgaaagtaacggacaccgattttgatggggtggaggttagggtctttgagggcccacccaagcccgaagaaccactcaagcggagcgtggtgtacatccacggcgggggatgggccctcgcctcagccaaaatccggtattacgatgaactctgcacagccatggccgaggaactgaacgccgtgattgtgtcaatagaataccggctggtgccaaaggtatatttccccgagcagatacacgatgtcgtacgggcaaccaagtacttcttgaagcctgaggttctgcagaagtacatggtcgatcccggcaggatatgtatttctggcgattccgctggaggaaatctggctgctgcacttggccagcagttcacgcaagacgcctccctcaagaacaagctgaagctccaggcattgatttaccctgtcctgcaagcgttggacttcaatacccctagctatcagcagaacgtgaatactccaatcttgccaaggtatgtgatggtgaaatattgggttgactacttcaaggggaattacgatttcgttcaggccatgattgtcaacaatcacacttccctcgacgtcgaagaggcggctgcagtcagagctagactgaactggacatcactgctaccagccagtttcaccaaaaattacaaaccggtagttcaaactaccggcaacgcaagaatagtacaggagctgccccagcttctagacgctagatccgccccgctcatcgcagatcaggcggtgctccagctgctccccaaaacgtacattctgacgtgcgagcatgacgtgcttagggacgacggcatcatgtacgcgaaacgactggaatccgctggggtggaagtgaccctggatcacttcgaggacggattccatggttgcatgatctttactagttggcccacaaatttctctgtgggaattagaactcgcaattcatatattaaatggctggaccaaaacttgtag

SEQ ID NO: 197197 - DNA, 1347 bp, Artificial Sequence
  Description of Artificial Sequence: Synthetic coding sequence
atgagcagctgccggggccagaaggtggccggcggcctgcgggtggtctcaccctttcctctgtgtcaacctgccggggagccctcacaagggaagatgagaagttcttgcgttctcctgaccgccttagtcgctctagccgcctactacgtgtacatcccacttccagggtcagtgagcgacccttggaaactcatgctgctcgacgcaactttccgaggcgctcagcaggtgagtaatctgattcattatctcgggctttcacaccacttgttggcactcaactttattattgtgtcctttggaaagaagtcagcgtggagtagtgcacaagttaaggtcaccgataccgacttcgatggggtcgaggtccgagtttttgagggcccacccaagcctgaagaaccactgaagcggagcgtcgtctacatccatggagggggttgggcgctggcctccgcttccgctagctggtcgccctccgacgaaatacgctattacgacgagctctgcacagccatggcggaagagctgaacgcagtgatcgtctcgattgagtaccgactggtgccaaaagtttattttcctgaacaaattcatgacgtagtacgggctactaagtacttccttaagccagaagttctacagaaatatatggtggaccctggccggatctgcatctcaggagacagtgccggggggaatctggccgccgcacttgggcagcagtttacacaggacgccagtctaaagaataagcttaagttgcaggcgttaatctatcccgtgcttcaggccctcgactttaacactccatcgtaccagcagaatgtgaacacacccatcctgcctaggtatgtaatggtgaagtattgggttgactactttaaaggaaactatgacttcgttcaagccatgattgtgaacaatcacacctctctcgacgtcgaggaggcagccgctgtccgggctaggttgaactggacttctctactccccgcttctttcaccaaaaactacaaacctgtagttcagaccaccggtaatgccagaatcgtccaggagctgccacagctcctcgacgcaagaagcgcgcccttgatcgcggatcaggctgtgctgcaattattgccaaaaacttacatccttacttgtgaacacgatgtgcttcgggacgatggtatcatgtacgcaaagcggctggaatcagccggggttgaggtcacccttgatcatttcgaagatggctttcacggttgtatgatttttacgagctggccaaccaacttcagtgtcggcatcaggactagaaacagttatatcaaatggttagaccaaaacctgtag

SEQ ID NO: 197198 - DNA, 828 bp, Artificial Sequence
  Description of Artificial Sequence: Synthetic coding sequence
atggccgaggagctgaacgccgtgatcgtgagcatcgagtaccggctggtaccgaaagtctattttcccgagcagatacacgacgtagtgcgcgctaccaagtatttcttaaaaccagaagtactacagaagtacatggtggatccaggccgcatctgtatctcaggcgactctgctggcggcaacctcgcggccgccctaggccagcagtttacccaggatgccagcctgaaaaataagcttaagctgcaagcgctcatttaccctgtccttcaagccctggacttcaacactccttcatatcagcagaatgtgaatacccctattttgcctcgctacgtcatggtcaagtattgggtcgattacttcaagggcaattatgacttcgtgcaagccatgatcgtgaataatcacacatctctggacgtcgaagaagcggcagctgtgcgtgccaggctcaattggacctctttgcttcctgcctcttttaccaaaaattacaaaccagtggtgcaaaccacgggaaatgcccgcatcgtgcaggagttacctcaactgttggacgcaaggtccgctcccctgattgcagaccaggccgtattgcagcttcttcccaaaacttacatcctcacctgtgagcacgatgtgctcagggatgatggcataatgtatgccaaacgcttggagagtgccggggttgaagtgacactggaccattttgaagacggatttcatggctgcatgatttttacttcctggcctaccaatttctccgttggtattaggacccgcaactcttacatcaaatggctagatcagaatctctag

SEQ ID NO: 197199 - DNA, 2754 bp, Artificial Sequence
  Description of Artificial Sequence: Synthetic coding sequence
atggccttcatccggaagaagcagcaggagcagcagctgcagctgtactccaaagaaagattctctctgctgctgttaaatctcgaagagtactattttgaacaacacagagccaaccacatcctgcataaggggtcccatcacgaacggaaaatcaggggatctctgaaaatctgcagcaaatccgtgatattcgaaccggattccatttcccagcccatcatcaagattccgctgcgtgactgtattaagattggcaaacatggagaaaacggagcaaatcggcacttcactaaggctaagtctggcgggatttcactaatctttagccaggtgtactttattaaggaacataacgtggttgccccatacaagatcgagagagggaaaatggaatacgttttcgaactggatgtgccgggcaaggtggaggacgtggtagaaactctcctgcagctccatcgggctagttgtctggacaagcttggtgatcaaacggccatgataaccgcaattttgcagtctagactggctagaaccagctttgataagaaccggttccaaaatataagtgaaaaactgcacatggaatgtaaagctgaaatggttaccccactggtaacgaaccccggacacgtctgtataaccgacaccaatctgtacttccaaccgctcaatgggtacccaaagccagttgtgcagatcactctgcaggacgtgcgcaggatttataagcggagacacgggctgatgcccctgggattggaagtgttttgtacagaagatgatctatgctctgacatctaccttaaattctatgaaccccaagatagagacgacctctacttctacattgctacatacctcgagcatcacgtagctgagcacacagcggaaagctatatgctgcagtggcagagagggcacctgagcaactaccagtatttgctgcacctcaacaacctggcagatagaagctgtaatgatctctcacaatatcctgtgttcccttggatcattcatgattacagctcaagtgagttagatcttagcaatccaggcacattccgcgatctttcaaagcccgtaggggcactgaacaaggagagattggaaaggctgctcaccagataccaggaaatgccggagcccaaatttatgtatgggtcgcattacagttcacccggctacgtgttgttctacttggtgcggattgcccccgagtatatgctgtgcctccaaaatggcaggttcgacaatgccgaccgcatgtttaacagcatcgccgaaacctggaagaattgtttggatggagcgacagatttcaaagaactaatacccgagttctacggcgacgatgtgtcatttctcgtcaacagtttaaagctggacctcggaaagagacaaggcggccagatggtggacgatgtggaactgcctccctgggcatcgtcccccgaagattttctgcagaagtccaaggatgctctcgagtctaactacgtctctgaacacttgcacgagtggattgacttgatctttggttacaagcagaagggctctgacgctgttggcgcacataatgtgttccacccgctcacatatgagggcggagtggacttaaattctatccaagatcccgacgagaaggttgcgatgctcacacagatcttagaatttggccagaccccgaaacagctctttgtgaccccgcaccctagacgaattacccccaagttcaagtcactttcacaaacctcctcgtataacgcctctatggccgactctcccggggaggaaagcttcgaagatctgaccgaggaaagtaagacacttgcctggaacaatatcacaaagctgcagctccacgagcactataagattcacaaggaggcagtcacgggcatcaccgtgagcagaaatggatcgagtgtctttactacatcccaggattctacgttgaaaatgttttccaaggagtccaagatgctgcaaaggagcatcagttttagcaatatggcactcagtagctgcctgctactgcccggtgacgctacagtcattacatcaagctgggacaataatgtatacttctacagtattgcctttggacggcgccaggacactctgatgggtcacgatgacgccgtgtcaaaaatttgttggcacgacaataggctatactctgccagttgggactctaccgttaaggtttggtcgggtgtcccagcggagatgccggggaccaagcggcaccactttgacctgctcgctgaactcgagcacgacgtgtcagttgacaccatcagcttaaacgccgcctccaccctgctggtcagcggcacaaaggaagggactgtgaatatctgggacttgacaacggccacactgatgcaccagattccctgtcatagtggaatcgtgtgtgacacggcattttcacctgactctcgtcacgtcttgtctaccgggacagacgggtgcctgaacgtcattgacgtccagaccggcatgctgataagttctatgacctcagacgagccgcaacggtgcttcgtctgggatgggaacagtgtgctctcaggctcccagagcggagagctcctggtgtgggatctgctcggcgcaaaaatcagcgaacggatccagggtcacacaggagccgtgacctgcatttggatgaatgagcaatgtagctcaataatcacagggggggaagatcggcagataatcttctggaagctgcagtactag

SEQ ID NO: 197200 - DNA, 2847 bp, Artificial Sequence
  Description of Artificial Sequence: Synthetic coding sequence
atgaccggccaggcccggttccaccggggcgccgaggcctgccgggctatacgccaatgccggtctcggcgtccgcgggccgcacacccagagggccgggccggctctggtcggggttctaggcacgcatctccaggtgtgcggaggggtggcttctctctactgctgctgaacctggaggagtactactttgaacaacaccgggccaatcacattttgcataaaggaagtcaccatgaaagaaaaatccgaggcagcttgaagatctgttcgaagtccgttatttttgaacccgattccatctctcaaccaatcattaaaatacccctgcgcgactgtatcaagatcggaaaacacggcgagaacggcgctaatcgtcacttcaccaaagccaaatccgggggaatctcgctgatatttagtcaagtgtacttcattaaagagcataatgtcgtggcaccatacaagatcgaaagggggaagatggaatatgtgtttgaactcgatgtgccaggcaaagtagaggatgtggtcgaaaccctcctccagctgcacagagcatcctgcctggacaagctcggagatcagaccgctatgatcacagctattcttcagagcaggctggcacgcaccagctttgataaaaatcgcttccaaaatatcagtgaaaagttgcatatggagtgtaaagccgaaatggtcacccccctcgttaccaaccccggacacgtgtgcattacagacacaaacctctatttccagcctttgaatggctaccctaaaccagtcgttcagatcaccctgcaggatgtacggcgtatctacaaacgccggcacggcttgatgcctctcggcctggaggtcttctgcaccgaagacgacctgtgcagcgatatttatctgaaattttatgaacctcaggacagagatgacctttatttttacatcgccacatatttggagcatcatgtggctgaacatacagctgaaagttacatgctgcagtggcagcggggacatcttagcaattaccagtacttgctgcatctcaataacctggcggataggtcgtgcaatgatctatcacagtatccagtgtttccttggatcattcacgactacagctctagcgagttagatctttcaaatccaggcacattccgggacttatccaaacctgtgggggcacttaacaaggagcgactggaacgcctccttacccgttaccaggagatgccagagcctaagttcatgtacggctcccattactccagtcccggttacgtactattctatctggtgaggatcgcccctgagtatatgctttgtttgcagaatggacggtttgataacgctgaccgcatgtttaactcgattgccgaaacttggaaaaattgtctagacggggcaactgacttcaaggaactgattcccgaattctatggggacgatgtcagttttctggtgaatagccttaagctagatctcggcaagcgccaggggggacagatggttgacgatgtggagttgcccccctgggcctcgtctccggaggatttccttcagaagtctaaggatgctttggaatcgaactacgtttcggagcatctgcacgagtggattgatctaatttttggatacaagcagaaagggagtgatgctgtaggggcccacaatgttttccatccacttacatatgagggtggcgtggacctgaactccatacaggacccggacgagaaggtagccatgctgacacagattctggaattcggacagactcccaaacagttgttcgtcacgccacaccctcgccgcattactccaaagtttaaaagtctgagtcagaccagcagttataacgcttctatggctgactctcccggtgaggaaagttttgaggacctgaccgaggagtctaagaccttggcctggaataacatcaccaaactgcagctccatgaacactataagattcacaaggaggccgtgaccgggatcactgttagccgcaacgggtcgagcgtgtttacaacatcccaggatagcacactcaagatgttctctaaagaaagcaagatgcttcagcggagtattagctttagcaacatggcgctatcatcgtgcctcctgctccctggggacgccactgtgataacatccagctgggataataacgtctatttttactccattgcctttgggaggagacaagacactctgatggggcacgacgacgctgtgtccaagatctgctggcatgacaataggctgtatagcgcttcctgggattccactgtcaaggtgtggtccggcgtcccagccgagatgcctggaactaagaggcaccacttcgatcttctggcagagctggagcatgacgtcagtgtggatactatttccctgaatgccgccagtacactattggttagcggaacgaaggagggaactgtcaatatctgggacttgactacagccaccttaatgcatcagataccctgccattctggaattgtctgcgacacggcgttcagccccgattcccgccatgtcctgagcacaggcactgacggttgtctgaacgtgattgacgtgcagaccggtatgttgatctctagcatgacttctgacgaaccccaacggtgttttgtctgggacgggaattccgtgctgtctggatcacaatcaggagaactcctggtgtgggatttgttaggcgcgaagatatcagaaagaattcagggacacacgggcgcagtgacttgtatctggatgaatgagcaatgcagtagtataatcacggggggggaagataggcagatcatcttttggaagcttcagtactag

SEQ ID NO: 197201 - DNA, 1173 bp, Artificial Sequence
  Description of Artificial Sequence: Synthetic coding sequence
atgggcgacaccttcatccggcacatcgccctgctgggcttcgagaagagatttgtaccgtcccaacattacgtgtacatgtttttggttaaatggcaggacctatccgagaaggtggtttaccgccgctttacggaaatctacgaattccataagacactgaaagaaatgttcccaatagaagccggcgctatcaatcccgagaacagaattattccccaccttcctgcccctaagtggtttgacgggcagcgagctgccgagaaccgtcagggcacccttacagaatattgcggaaccctgatgtcacttccaacaaaaatctctcgatgccctcacttgctcgacttcttcaaagtgaggccagatgatcttaaacttcccaccgataaccagacgaaaaagcccgaaacctatctcatgcctaaggatggaaaaagtaccgcaacagatattactgggcccataattcttcaaacatatagagctattgcgaattatgagaagacatcaggatcagaaatggcactgagtaccggtgacgttgtggaggtcgtggaaaagtctgagtcgggctggtggttctgccagatgaaagcaaagcgtggctggatacctgcatccttcctcgagcccctggattctccagacgagacagaagacccagagcccaactacgcgggagagccttacgttgcaattaaagcttataccgcagtcgaaggggacgaggtgagcctccttgagggggaggctgtcgaggtgatacacaaattactggacggctggtgggtcattagaaaagacgacgtaactggatatttcccctctatgtatctgcaaaagagtggacaggatgtatcgcaggcccagcgacagataaaaaggggcgctccacccaggcgttcctccattcgcaacgcacatagcattcaccagcgatctagaaagaggctgtcccaggatgcctacagaaggaatagcgtgaggtttttacagcagcggcgaagacaggcaaggcccgggccacaatccccagggagtcccctggaagaagaaaggcagacgcaacgatctaaaccccagcccgcagtacctccacgcccaagtgctgatctgatcctcaatcgctgctccgagagcaccaaacggaaactggctagcgcagtgtag

SEQ ID NO: 197202 - DNA, 444 bp, Artificial Sequence
  Description of Artificial Sequence: Synthetic coding sequence
atgaccaagaagcccgagacctacctgatgcccaaggacggcaagtctaccgcaactgatatcacaggaccaatcatactccagacatatagggcgatcgccaactacgaaaagacaagcggatcggagatggcactctccaccggcgatgtcgtcgaggtggtcgaaaaatccgagtccgggcagacctctcacctgacagggttgcttcccctcgttttgcgcaacccgcagccccaagccccctgccaaggctcaggttccttggctcctggaagaacccccgccctgttgggggctcttaacgtgttaccgactctatgggtggcattttgcctaagcgttcacccagtcgtggctgttggcatctgcgcctggcaagctggcgccggccacgtttgcgtattctgcctggacggttacggaacagtctgttcactgtag

SEQ ID NO: 197203 - DNA, 759 bp, Artificial Sequence
  Description of Artificial Sequence: Synthetic coding sequence
atgggcgacaccttcatccggcacatcgccctgctgggcttcgagaagagatttgtgccatcacaacattacgtgcacgttccgggagagatggcagggcccgtgggagagggcggcttgccagctctacaccgggacctgcgcgtgccttctccaaagtggtttgacggccagcgtgccgccgaaaaccgccagggcacgcttaccgaatattgcggcacattgatgagcttgcccactaaaatctctagatgccctcatctactagatttctttaaggtgcgccccgacgatctgaagttgccaacagataatcagactaaaaagcccgagacctaccttatgcccaaggatggcaaatccactgctaccgacatcaccggcccgatcatcttacagacatatagggcaattgcgaactatgagaaaacaagtgggtctgagatggcgctttctactggcgatgtcgtcgaagtggtcgagaagtctgagtcggggcagactagtcacctcaccggtcttctgcccctggtgcttcgcaacccccagccacaagcaccgtgccagggctcggggtcacttgcccctgggaggaccccagccctgctcggcgccctgaatgtgctcccgaccctgtgggtggcgttttgtttgtcggttcatccagtggtggctgtcggtatttgcgcgtggcaagccggcgccgggcacgtgtgcgtattttgcctcgatggttacgggacagtttgtagcctgtag

SEQ ID NO: 197204 - DNA, 1581 bp, Artificial Sequence
  Description of Artificial Sequence: Synthetic coding sequence
atgagcctggtggaggccatcagcctgtggaacgagggcgtgctggcagctgacaaaaaagactggaagggagcgctggacgcgttcagcgcagtacaggaccctcacagcagaatatgctttaacatcggttgtatgtacaccatccttaagaacatgaccgaagcagaaaaggctttcactagaagtatcaaccgggacaagcatctggctgttgcttatttccagcgagggatgttgtactaccagacagagaaatatgacctggccatcaaggacctgaaagaagccttaattcagctaaggggcaaccagctgattgactataagatcctcggcttgcagttcaagctgtttgcttgtgaggtgctgtataacatcgcgttcatgtatgcgaagaaggaagagtggaaaaaagccgaagaacagctcgcccttgccacttccatgaagtccgagcccagacacagtaaaattgataaggccatggagtgcgtatggaaacagaagctgtatgagcctgtagtgatccctgtgggaaagctgtttaggcctaatgagaggcaggtggcacaacttgccaagaaggactacttgggaaaggccaccgtggtggcctctgttgtggatcaggacagcttcagcggattcgctccactccagccccaggcagctgagcccccacctcgtccgaagacgccagagatttttcgggcattggaaggcgaggctcacagagtcttgttcggctttgtgccggagacaaaagaggaactgcaggtgatgcctgggaacatcgtctttgtgctgaaaaagggtaatgacaattgggcaacagtaatgttcaatggacagaaaggtctggtgccctgtaactacctggagccggtggagctgaggattcacccccagcagcaacctcaagaggagagctctccacaaagcgatattcccgccccgccctcatctaaggcacccgggcgtcctcagttgagtcctggccagaaacaaaaagaggagccaaaagaggtgaaactcagcgtccccatgccttacacactaaaggtgcactataagtatacagtcgtgatgaagacccagcctgggctcccgtattctcaagtgcgtgatatggtgagcaagaagttggaactgcgactggagcacactaaactctcgtatcgtcccagggactccaacgagctggtcccgttaagcgaagattctatgaaggatgcttgggggcaggtcaaaaactattgcctcacgttgtggtgtgagaacaccgtgggagaccagggttttcccgacgaaccgaaagaatccgaaaaggcagacgcaaataatcagaccacggagccacaactcaaaaagggaagccaggttgaggcgcttttttcctacgaagcgacccaacctgaagacctggaattccaggagggggacataatactcgttttgtccaaggtgaacgaagaatggctggaaggcgagtgcaaaggcaaagtgggcattttccctaaggtgttcgtggaagactgcgcgaccactgatctcgagtccactcgtagagaggtgtag

SEQ ID NO: 197205 - DNA, 1581 bp, Artificial Sequence
  Description of Artificial Sequence: Synthetic coding sequence
atgagcctggtggaggccatcagcctgtggaacgagggcgtgctggcggccgataaaaaagattggaagggggccttagatgccttcagcgccgttcaagacccccactccagaatttgttttaacattggatgtatgtacacaatcctcaaaaatatgaccgaagccgagaaggcatttacacgttccataaatcgggacaaacacttggctgtggcctattttcagaggggcatgctttattatcaaacagaaaagtacgatcttgctatcaaggacctgaaagaggctctgatacagctgcgcggcaaccagctaatcgactacaagatcttggggctgcagtttaagctcttcgcctgcgaagtgctatataacatcgccttcatgtatgccaagaaagaagaatggaaaaaagcagaggaacagctggcgttggccacatctatgaaatcagaaccacggcattccaagattgacaaggcgatggagtgcgtgtggaaacaaaagctgtacgaacccgtggtcatcccagttggaaagctgtttagacccaatgaaagacaggtagctcaactggccaaaaaggactaccttggcaaggccacagtggtggcaagcgtagttgaccaagatagcttcagcggatttgccccccttcagccccaagctgcggagcccccgccgcgtccaaagacgccagagatcttccgtgcgctggagggagaagcccaccgggtgctgttcggcttcgtgccagagactaaggaggaactccaagtcatgcccggaaatatcgtgtttgtcttaaaaaaagggaatgacaactgggctacagtgatgttcaatgggcagaaagggctagtgccctgcaattacttggaacctgtagaactgaggatacatccgcaacagcagccgcaggaggagagctcacctcagtcagatatccccgcgcctccctctagcaaagcccccggaagaccacagctgtctccaggtcagaaacaaaaggaagaaccaaaagaagtgaagctgagtgtgcctatgccgtacacactgaaggtccactacaaatatacggtcgtcatgaagactcagccagggctgccttactctcaggtgcgcgacatggtgtccaagaaactggagctgcggctagagcacacgaagctgtcctacagaccgcgggacagcaacgagcttgtcccattgtcagaggatagcatgaaggacgcttggggtcaagtcaagaactactgtctaaccctctggtgtgagaataccgtgggagatcagggctttcccgatgagcccaaagagtcagagaaggccgacgccaataatcagaccactgagccgcagctgaagaagggaagtcaggttgaggcactgttctcttacgaagcgacccagcccgaggacctggaatttcaagaaggagatatcattttagtgttatccaaggttaatgaggaatggcttgagggcgaatgcaagggaaaagtaggcatatttcctaaggttttcgtagaggactgcgccacaaccgatctagaaagcacacgcagggaggtgtag

SEQ ID NO: 197206 - DNA, 1797 bp, Artificial Sequence
  Description of Artificial Sequence: Synthetic coding sequence
ggcagccccgcccggggcgacgcccccacctgcctgctgagcgtgagttggcagttgtcctggccacccagtttctacctgataatgtccctagtggaagccatttcgctgtggaatgagggagttctcgcagcagacaaaaaggattggaagggggctctggacgcttttagcgcagtgcaggatccccactctagaatctgctttaatatcggctgcatgtacacgatcctcaagaacatgaccgaggccgagaaggcatttactcgatctattaacagggacaaacacctcgccgtggcatatttccaaagagggatgttatactaccagactgaaaaatacgatctggccataaaagacctgaaagaagcgttaatccagctgcgggggaaccagctcatcgactacaaaattctaggcttgcagtttaagctctttgcttgtgaggtactctataacatcgctttcatgtacgctaagaaagaggaatggaagaaagccgaggagcagctggccttggccacaagtatgaaatccgaacctcggcactcgaagatcgataaggctatggagtgtgtttggaagcaaaagctgtacgagccagtagtcatacctgtcggcaaactctttcgacccaacgagcggcaagtcgctcaactcgctaagaaagactacctcggtaaggctactgtcgtcgcatcagtggtcgaccaagactccttctcgggcttcgcacctctgcagccgcaggtgagacagtccgacctacttggcgcccaggccggatcagtttcatcaagacaattgcaactcgacgtggagctcgagccaggttggtcccaggtccccgggtccaaattctctgtgtttgctccctggcaccacgttcgagggtggggcttagacctcgtctctattctctgtcgggccctggagggcgaggcccatcgagttttgttcgggttcgttcccgagacaaaagaggagctgcaggtgatgccaggaaatattgtattcgtgctaaagaaaggaaatgacaattgggcaacagtcatgtttaacgggcagaaaggcctggtgccatgtaactacctcgagcctgttgagctgcggattcatccacaacagcagcctcaggaagagagctcccctcagagtgacatccctgcccccccaagcagcaaggccccaggcaggccacagctgtcgcctggacagaagcaaaaagaagagcccaaggaggtcaaactatccgtgcccatgccgtatacattgaaagtccactacaaatacacagtcgtgatgaaaacgcaaccaggcttgccctattcacaagtgagagatatggtgtctaaaaaactggagttgagactggagcatactaagctgtcttatagaccccgagactcaaacgaactggtgcccctgtccgaagacagcatgaaggacgcctggggtcaggtaaagaattactgcttgacactgtggtgtgagaataccgtcggcgaccagggatttcctgacgagcccaaagagagtgagaaggctgacgctaataaccagacaaccgagccgcagctgaagaaagggtcgcaggtggaggccctattctcttatgaagctacgcagccagaagatttggagtttcaggagggggatatcattcttgtcctgtcaaaggtgaatgaggagtggctggaaggggagtgtaaaggtaaggtcgggatatttcctaaggtgtttgtcgaggattgcgccaccaccgatctggagtcaacaaggcgagaggtctag

SEQ ID NO: 197207 - DNA, 1446 bp, Artificial Sequence
  Description of Artificial Sequence: Synthetic coding sequence
atgagcctggtggaggccatcagcctgtggaacgagggcgtgctggcagccgataagaaggactggaaaggagcactggatgcgttttcagccgtgcaggatccacatagcagaatctgctttaacatcgggtgcatgtacacaatattgaaaaatatgaccgaagccgagaaggcgttcactaggagcataaatcgggataaacatctggccgttgcatactttcagagaggaatgctttactaccagaccgagaagtacgacctggcgatcaaggacctgaaagaggccctcattcagctgcgagggaaccaactgatagattacaagatccttggcctccagttcaaactgttcgcctgcgagaaacagaaactctacgaacctgtggtgattcctgtgggtaaactgtttcgacccaatgaaaggcaagtggctcaactagccaagaaggactacctgggcaaggcgacagtggtggcttctgtggtggatcaggacagcttttctgggttcgcaccgttacaacctcaggccgctgaaccccccccaaggcctaagactcctgaaatcttcagagcccttgaaggcgaagctcatcgggttcttttcggtttcgtccctgaaacgaaggaggagctgcaggtgatgcctggcaatatcgttttcgtgctaaaaaagggcaatgacaattgggccacggtgatgttcaatgggcagaaggggttagtgccctgtaactacttggagccggtggaactgcgcatccacccacagcagcagccccaggaagaaagcagcccccagtctgatatcccagccccccccagctcgaaggcccccggccgaccccagctctctcccggacagaaacagaaggaggaaccaaaggaagtgaagctgagcgtccctatgccctacactttgaaggtgcattataagtataccgtggttatgaaaacccagcccgggctcccttactcacaagtgagagatatggtttctaaaaaactggagctgcgcctggaacatacaaagctgtcctatcggcctcgggacagcaatgaacttgtacccctcagtgaggattccatgaaggacgcttgggggcaggtaaagaattactgcctgaccctgtggtgtgagaataccgttggggatcaaggatttcccgacgagcctaaagagtctgagaaggcagacgccaacaaccagaccacagaacctcaactgaagaaggggtcccaagtcgaggccctgttctcttacgaggccacgcagccggaggacctggagtttcaggagggcgacattatacttgtcctttcaaaagtgaacgaagaatggttggagggtgagtgcaaagggaaggttggaatctttcctaaggttttcgtcgaggattgcgcgacgactgaccttgagagtaccagaagagaagtttag

SEQ ID NO: 197208 - DNA, 1338 bp, Artificial Sequence
  Description of Artificial Sequence: Synthetic coding sequence
atgagcctggtggaggccatcagcctgtggaacgagggcgtgctggcagcagataagaaggattggaagggcgcgcttgatgcatttagtgccgtgcaggaccctcactcacgaatatgcttcaacatcggatgtatgtacacaatattaaaaaacatgacagaagccgagaaagccttcacacggagtattaatagggacaagcatctggcggtggcatatttccagagaggcatgctgtattatcagacagagaaatacgatttggccatcaaggacctcaaagaggcgcttatccagctacgaggcaaccaactcatcgattacaagattctgggacttcagtttaagctgtttgcttgcgaggtagtcgcctccgtcgtcgaccaggatagtttttccggttttgctcccctgcagccgcaggctgcagagccccctcctcgaccaaaaacccctgagattttccgagcgctggagggtgaggctcatcgcgtcctcttcggatttgtgcccgaaacaaaagaggaactgcaggtgatgccgggtaacattgtgtttgtcctcaaaaagggaaacgataactgggcgaccgtaatgtttaacggccagaaggggcttgtcccatgcaattatcttgaacccgttgagctcaggatccatccacaacagcagccccaagaagagagttcccctcagagtgatataccggcgccacctagttctaaagcccccggacgaccccaactgtcaccaggacaaaagcagaaagaggagcctaaggaggtgaaactttctgttcccatgccttataccttgaaggtccattataaatataccgtagtgatgaaaacacaacctgggctgccctactctcaggtccgagacatggtctctaagaaacttgaactccgtttggagcacaccaagctgagctaccgcccaagggattccaacgaattggttccattgtcagaggattcgatgaaagatgcttggggtcaagtgaaaaactattgcctgactctctggtgcgagaacaccgtaggagaccagggatttcccgacgagcccaaggagtccgaaaaggctgacgcaaataatcaaacaacggagcctcagttaaagaaaggttcccaggtcgaagcattgttctcctatgaagccactcagccggaggatctggagtttcaggaaggggacataatactggtgctgtctaaggtgaacgaagagtggctcgaaggcgaatgcaagggtaaagtaggtatcttccccaaggttttcgtggaggactgcgctaccactgatttggagtccacgcgacgggaagtttag

SEQ ID NO: 197209 - DNA, 432 bp, Artificial Sequence
  Description of Artificial Sequence: Synthetic coding sequence
atgcccggcaacatcgtgttcgtgctgaagaagggcaacgacaactgggctactgtcatgttcaacgggcaaaaaggcctcgtgccatgtaattacttagagcctgtggagttgcgaatccatccacagcaacaaccacaagaggagtcttccccccagtcggatattccggccccgccgtctagcaaagcaccagggcgtccccagctgtcccccggacagaaacagaaggaggaacccaaagaggtaaagttgagtgtgccaatgccgtacacattgaaggtgcactacaagtataccgtggttatgaaaacccagcccgggttgccctactcacaagtgcgagatatggtcagtaaaaagctggagctcagactggaacacactaagctctcctacagaccccgggacagcaatgagctggtcccttag

SEQ ID NO: 197210 - DNA, 171 bp, Artificial Sequence
  Description of Artificial Sequence: Synthetic coding sequence
atgccctacaccctgaaggtgcactacaagtacaccgtggtgatgaagactcagccaggacttccgtactctcaggtgagagacatggtgagtaagaagttagagctcagattggagcacaccaagctatcctatcgtcccagagacagtaacgaactcgtgcctctgtag

SEQ ID NO: 197211 - DNA, 1020 bp, Artificial Sequence
  Description of Artificial Sequence: Synthetic coding sequence
atggccgtggcccagcagctgcgggccgagagcgacttcgagcagctccctgacgacgttgcgatctccgctaatatcgccgacatcgaagaaaaaaggggattcacgagccactttgtgttcgtcatcgaggtaaagacgaaagggggctctaagtatctaatctatcgtcgctatcgccagtttcacgccttgcaaagcaaactggaggaacgctttggcccggacagcaaaagttctgctctggcctgtactctccctaccctgccggccaaggtctacgtgggcgtcaagcaggaaatagctgaaatgaggatccccgccctaaatgcctacatgaaatccctgctcagcttacccgtctgggtgctcatggacgaagacgtgcgtatattcttctaccagagtccatacgacagcgaacaagtgcctcaggcgctgagaagactgcggcctagaacccggaaggttaagtccgtttcccctcagggaaattctgttgaccgcatggcagcccccagggcagaagcattgttcgattttaccggcaacagcaagctcgaattgaatttcaaggctggcgacgttatcttccttctgtcaagaatcaacaaggactggctggaaggcaccgtgaggggcgctacaggaatcttcccactgtctttcgttaagattctgaaagacttccccgaagaggacgatcccacaaactggctgcgctgctattattacgaggatacaatctccaccattaaggacatcgcagtcgaagaggatctgagcagcacccccctcttaaaagatctgttggagttaacgaggagggagtttcagcgcgaggatatcgccctgaattacagggatgcagagggtgacctggttcggctgctgagtgacgaggatgtcgccctgatggtgaggcaagctaggggacttccaagccagaagaggctgtttccctggaaactgcacatcacacagaaagacaactatcgggtttacaacactatgccctag

SEQ ID NO: 197212 - DNA, 1047 bp, Artificial Sequence
  Description of Artificial Sequence: Synthetic coding sequence
atggccgtggcccagcagctgcgggccgagagcgacttcgagcagctccccgacgatgtcgccatctcagccaatattgcagatatagaagagaaacgcggcttcacgagtcatttcgtgtttgtaatcgaggtgaagacaaaaggtgggtctaagtatctgatctatcgccgttatcgacagtttcacgcgcttcagtctaagctcgaagaacgattcgggcccgactccaaaagttcagccctggcgtgcacgctgcccaccctgccggccaaagtttacgttggggtgaaacaggaaatcgcagaaatgagaattccagctttgaatgcatacatgaaaagtcttttgtctctacctgtgtgggttctcatggatgaagacgtccgaatcttcttctatcagagcccatacgattccgaacaagtgccccaggccctccgtaggctgagaccccggacgcgaaaggtgaagagtgtttcaccccagggaaattccgtagaccggatggctgctccaagggccgaggccctattcgatttcacaggtaatagcaaactcgaactcaacttcaaagccggtgatgtaattttcctcctcagtcggattaacaaagactggcttgagggaaccgtgagaggagctactggaatctttcctttatcttttgtaaagatactgaaggactttccagaagaagatgatccgaccaattggctccggtgctactattatgaggataccatctctacaataaagtctgttgcatgggaggggggggcctgccctgcatttctgcccagcctccggcccctcccactaactagcccaagccatggtagcttatcccatagtaaggctcccagcgggtctcaaatgtctcacaacgccgtgactagccatcaacgccctggctggcctggccaaccccactcccccttcccgcatcccacaccccattttcagcccgatgcctccctcttgcaacctgtcacacccctggggactagtcgatggagaaagatcagcgccgcccttccatactag

SEQ ID NO: 197213 - DNA, 501 bp, Artificial Sequence
  Description of Artificial Sequence: Synthetic coding sequence
atgcggatccccgccctgaacgcctacatgaagagcctgctgagcctgccagtgtgggtcctgatggatgaggacgtgaggatttttttctaccagagtccctacgactctgagcaggtgccgcaggctcttagaagactgagacctcggacaaggaaggtaaaatcggtgagcccccagggcaatagtgtagatagaatggccgccccccgcgccgaggccctgtttgactttaccggcaattccaagctagaactcaacttcaaggccggcgatgttatttttctgctgagtcggattaacaaagattggctcgaggggactgtgcgtggagcaaccggaattttcccgctgagcttcgtcaagatcttaaaggatttcccagaggaggatgatcccacaaattggcttcggtgttactactacgaggataccatctcaacaatcaagagcgtggcctgggaaggcggggcatgcccagccttcctgccctcactctag

SEQ ID NO: 197214 - DNA, 480 bp, Artificial Sequence
  Description of Artificial Sequence: Synthetic coding sequence
atgaacgacatcagccagaaggccgagatcctgctgagcagcagcaagcctgtgccaaagacgtacgtgcctaagctgggtaaaggcgacgtgaaggataagtttgaagcaatgcagagggcaagggaagagcggaaccagcgcagatctagggacgagaagcagcgccgcaaggagcaatatatcagggagcgggagtggaaccgccgtaaacaggagattaaagaaatgctcgcttccgacgatgaggaggacgtctcttcgaaggtggaaaaggcgtatgtaccaaaactcaccggtacagtcaaggggcgctttgccgagatggagaagcagagacaggaggaacagcgcaagagaaccgaagaagaaagaaaaaggcggatagagcaggatatgttggaaaagagaaagatccagcgagaactggcaaagcgggcagagcagaagttagcaagaagagatggggcacacctttag

SEQ ID NO: 197215 - DNA, 1836 bp, Artificial Sequence
  Description of Artificial Sequence: Synthetic coding sequence
atgaacgacatcagccagaaggccgagatcaaggagatgctggcctctgatgatgaagaggatgtatctagcaaagtagaaaaagcatacgtcccgaagcttactggaaccgtgaagggcagattcgccgaaatggaaaaacagagacaggaagaacaacgcaagcgtaccgaagaagagcggaagagaagaatagagcaggacatgctggaaaaaagaaagattcagcgagaactggccaagcgggccgaacagattgaggatatcaacaacacgggaacagagtccgcgagcgaggaaggggacgattccctcttgataactgtcgtgcccgtgaaaagttacaaaacctctggtaaaatgaagaagaattttgaagacttggaaaaggagcgagaggagaaagagaggattaagtacgaagaggataagaggatccgttacgaagagcagcggccttctctcaaggaggccaagtgccttagcttggtgatggatgatgaaatcgagtccgaagcgaaaaaggaatcactttctcccggcaagcttaagctcaccttcgaagagcttgaacggcagcggcaggagaacaggaagaagcaagccgaggaggaggccagaaaacgactggaagaggagaagagagccttcgaggaagccaggcggcaaatggttaatgaagacgaggagaaccaggacacagcgaagattttcaagggctatcgccccggtaaactgaagctgtctttcgaggagatggaacggcagcggagagaggatgagaagaggaaggccgaagaagaggctcgacgtcgcatcgaggaggagaagaaggctttcgccgaagcccgacgaaatatggtggtagatgatgatagccctgagatgtacaagacgattagccaggagtttctaacacctggaaagttagagattaactttgaggaattgctgaaacagaaaatggaagaggaaaagcgccgaacggaggaggagagaaaacacaagctggaaatggagaaacaggagttcgagcagctgagacaggagatgggtgaggaagaggaggagaacgagacattcggattaagccgagagtatgaggagttaatcaagctcaagcgatccggaagcattcaggcgaagaacctcaaatctaagtttgagaaaatcgggcagctgagcgaaaaggagatccagaaaaagatagaggaagaaagggcaagaagaagagccatagacctcgagatcaaggaacgagaggctgagaactttcatgaggaggacgacgtggacgtgagaccagctaggaagtcagaggcaccttttacacacaaagtgaacatgaaggccaggttcgagcagatggccaaagctagagaagaagaggagcaaaggcgcatcgaggagcagaaacttctgcgaatgcagtttgaacagcgcgagattgatgcagcactccagaagaagcgagaagaggaggaggaggaggagggctccatcatgaacgggtcaactgcggaagacgaagagcagaccaggtccggggccccctggttcaaaaaaccccttaaaaatacttctgtggtggattcagagcctgtccgatttactgtgaaggtaaccggcgaaccaaaaccagaaattacatggtggttcgagggcgagatcctacaagacggagaggattatcagtatattgagcgcggagaaacatattgtctgtatttacccgaaaccttccctgaggatgggggagaatacatgtgtaaggctgtgaataacaaggggtccgctgcttctacctgtattctgaccatcgagtctaaaaattag

SEQ ID NO: 197216 - DNA, 2028 bp, Artificial Sequence
  Description of Artificial Sequence: Synthetic coding sequence
atgaacgacatcagccagaaggccgagatcctgctgagcagcagcaagccagtccctaaaacatatgttcctaagctgggcaagggagatgttaaagacaagtttgaggctatgcagcgagccagagaggagagaaaccagaggcggtctagagacgaaaaacagcggaggaaggagcaatacatcagggaaagggagtggaaccggagaaagcaagagattaaagaaatgttagctagcgatgatgaggaggacgttagctcaaaggtggagaaagcctacgttcccaaactgaccggaaccgtcaagggccggttcgccgagatggagaaacagcggcaggaggaacagcgaaagcgcaccgaagaagagcggaagagacgaatcgaacaggatatgcttgaaaagcggaaaatacagcgggagttagcgaaaagggccgagcaaatcgaagacatcaacaacacgggcactgagtctgccagcgaggagggtgacgactctctgctgatcaccgtggtgccagtgaaatcatacaaaacttcaggaaagatgaaaaaaaatttcgaagatttggagaaagagagggaggagaaggagcggatcaaatatgaggaggacaagaggatcagatacgaagaacagagacctagcctaaaagaagcaaagtgtctgtccctagtgatggacgacgagatcgaatccgaggccaagaaagaaagtctgtcgcctgggaaactcaagctgacgtttgaggagctcgaacgccagcgtcaagaaaaccgcaagaagcaggccgaggaagaagcccgcaaacgcttagaggaggaaaagcgcgcgttcgaggaagctcggcgccagatggtaaacgaggacgaggagaaccaggacaccgctaagatcttcaagggttaccggcccggtaagctgaagctcagctttgaagagatggagcgacaacggcgagaagacgagaagcggaaggccgaagaggaagcacgtcggcgtatcgaggaggagaaaaaagcatttgctgaggctcgccggaatatggtggtcgacgatgacagtccagaaatgtacaaaactatttcacaggagttcctcacgcccggcaagctcgagattaacttcgaagaactgcttaagcagaaaatggaagaagaaaaaagaaggacagaggaagaaagaaagcataaactagaaatggagaaacaagaattcgagcagcttcggcaagaaatgggtgaagaagaggaagaaaatgaaacattcggtctaagcagagaatatgaggagctgatcaagttaaagcggagcggcagtatacaggccaagaatctgaaatcaaagttcgagaagatcggccagctgtcagagaaggagatccaaaagaaaattgaagaggaacgagctaggagacgagcaatcgatctcgaaatcaaggaaagggaagcggaaaacttccatgaagaggacgacgtcgatgtccggcccgctcggaagagcgaagctccatttacacacaaggtgaacatgaaggccagattcgaacagatggcaaaagcccgcgaagaagaggagcagcggaggattgaagagcagaagcttctaaggatgcaattcgagcagcgggaaatcgacgcggcactgcaaaaaaaacgggaagaggaggaggaggaggaaggctctatcatgaacgggagcacagcggaggatgaagagcagacaaggtccggggcgccttggtttaagaagccattgaagaatacatcagttgtggatagtgaacccgtacgatttaccgttaaagtcaccggcgagcctaagcccgagattacatggtggttcgaaggagagattctgcaagatggggaggactatcagtatatcgaaaggggcgagacatattgcctgtatctgccagaaaccttccctgaggatggcggcgagtatatgtgcaaagctgtgaacaataagggcagcgctgctagtacgtgtattctgaccatcgagtccaagaattag

SEQ ID NO: 197217 - DNA, 1731 bp, Artificial Sequence
  Description of Artificial Sequence: Synthetic coding sequence
tgagtgaagggccggttcgccgagatggagaagcagcggcaggaggagcagcggaaacgtactgaggaggaacgaaagagacgaatcgagcaggatatgttggagaagcgtaaaatccagagggagctcgccaaaagggcggaacagatcgaggacataaataacacggggaccgagtctgcgagcgaggagggagacgactcgctcttaattactgtcgtgcccgtaaagtcatataagaccagcggtaagatgaagaaaaacttcgaggatctggaaaaagagagggaagagaaagagcgtattaagtatgaggaggataagaggatccggtatgaagagcagaggcccagcctgaaggaggcgaaatgcctgagcttggtgatggatgatgaaattgagagcgaggccaagaaggaaagcctgtcgccaggtaaactgaagctgaccttcgaagaacttgaacgccagcggcaggagaacagaaaaaagcaagccgaggaggaggctaggaaaagactggaagaggagaagagagcatttgaggaggccaggcggcagatggtcaatgaagacgaggaaaatcaggataccgccaagatatttaagggctatagaccaggcaaactcaaattgtcattcgaagagatggaacgccagcggagggaggatgaaaaacgaaaagccgaggaggaggctcgaagaagaatcgaggaagagaagaaggcttttgcagaggcacggagaaatatggtcgtggacgacgacagtccagagatgtataagacaatctcacaagagttcctgacgcccggtaagctcgaaattaatttcgaggaactcctgaagcagaagatggaggaggagaagagaaggaccgaagaagaacgtaagcacaagctggagatggagaagcaggagtttgaacagctgcgccaagaaatgggggaggaggaggaagaaaacgagacctttggactgagtcgggagtatgaagagcttatcaagctcaagcgaagtgggtccatccaagcaaaaaatctgaagagtaaattcgagaagatcgggcagctcagcgaaaaagagattcagaagaaaattgaagaagagagagccagaagacgggctattgatctcgaaattaaggagcgcgaggcggaaaattttcacgaggaagacgacgttgatgttaggccggctcgcaagagcgaagcccccttcactcacaaggtaaatatgaaggccaggtttgaacagatggctaaagcaagggaggaagaagaacagagaagaatcgaagaacagaagctactacggatgcagttcgaacagagagagattgatgctgctttacaaaagaagagagaggaggaagaagaggaggaaggaagcattatgaacggcagtactgctgaggacgaggagcagacaagatccggggcaccttggttcaagaagccattaaaaaataccagcgtggtggattccgagcccgtgcgcttcactgtgaaagtgacgggggaaccaaagccagagattacatggtggttcgagggtgagattctgcaggatggggaggattatcagtatatcgagcgcggggaaacctactgcctgtatttacctgagacctttccagaagacgggggtgaatacatgtgcaaagctgttaataacaagggttccgctgcaagcacgtgtatccttactattgagaccgacgactactag

SEQ ID NO: 197218 - DNA, 966 bp, Artificial Sequence
  Description of Artificial Sequence: Synthetic coding sequence
atgaacgacatcagccagaaggccgagatcaaggagatgctggccagcgatgacgaggaggacgtatcttcaaaagtcgagaaggcgtatgtgcctaaactcaccggcactgtgaagggccgatttgctgaaatggagaagcagcgacaagaagagcagagaaagcgcacagaagaggaaaggaagagacggatagagcaggatatgctcgaaaagagaaagatccagagagaactggcaaaacgtgccgaacaaatcgaggacatcaataatacgggtaccgaatctgccagcgaggagggcgatgactcactactgatcaccgtggtgcccgtcaagtcctataaaacgagtggcaaaatgaaaaaaaattttgaggacttggaaaaggagcgagaggagaaggagcggattaagtacgaggaagacaaacgcataagatatgaggaacagaggccttctctgaaggaggctaaatgtctgtcgctcgtgatggatgacgagatagaatccgaagccaagaaggagtcactaagccctggaaaactaaaactgactttcgaagagctggagcgacagcggcaagaaaatcgcaaaaagcaggctgaagaagaggcaaggaaacggttagaggaggagaagagggcattcgaagaggcgagacgtcagatggtgaacgaggacgaagagaatcaggacaccgctaaaatctttaaggggtaccgtcctggaaagcttaaactgagttttgaggagatggaaaggcagcggagagaagatgagaagcgaaaggccgaagaagaagccaggcgcaggatagaagaagaaaagaaagcatttgcagaggcccgccggaacatggtggtggatgatgattccccagagatgtataagacaatcagtcaggaattcctcacaccggggaagcttgagattaacttcgaggaactccttaagcagaaatag

SEQ ID NO: 197219 - DNA, 1308 bp, Artificial Sequence
  Description of Artificial Sequence: Synthetic coding sequence
atgaacgacatcagccagaaggccgagatcctgctgagcagcagcaagccagtgcctaaaacgtacgttccaaagctagggaagggtgacgttaaggacaagttcgaggctatgcagagagccagggaagagcgcaaccagcggcgatcacgcgatgaaaaacagcgtcgcaaggagcagtacatccgcgagagagaatggaatcggcggaagcaggagattaaggaaatgctggcttcagacgacgaggaggatgttagttccaaggttgaaaaagcctatgttccaaagctgacagggactgtgaaggggaggttcgccgaaatggagaagcaaagacaggaagaacagaggaagcggactgaagaggagagaaaaaggaggatcgaacaggatatgctggagaagagaaaaattcaacgtgagctggctaagagagccgaacaggaaggagacgactccctcctcattacagttgtgccagtaaagtcctacaagacctcaggtaagatgaagaagaacttcgaggacctggaaaaagagagggaagagaaagaaagaattaaatacgaagaggataaaaggataagatacgaagagcagcgcccgtctcttaaggaggccaaatgtctgtcactggtaatggacgacgaaatcgagagtgaggcgaaaaaggagtctcttagccccggtaaactgaaactgacttttgaagaactggagcgccagcgtcaggagaaccggaagaagcaggccgaggaggaagctcgcaagaggctggaggaagagaagcgtgccttcgaggaggccaggcggcagatggtgaacgaagatgaggagaaccaggacactgccaagatatttaaagggtacagaccaggaaagttaaaactaagcttcgaggaaatggaaagacagcggcgagaggacgagaagcggaaggcagaagaagaagcacgcagacggatcgaagaggagaagaaggcttttgcagaggcccggagaaatatggtcgttgacgacgattctccggagatgtacaaaactattagtcaggagtttctgacccccggcaaactggaaatcaactttgaagagctgctgaagcagaagatggaagaagagaaaaggcgaacagaggaggagaggaagcataagctggaaatggagaaacaagagttcgagcagttgaggcaagagatgggtgaagaagaggaggaaaacgaaacctttgggctttcccgggaatacgaggaattaattaagttgaagagatccggctcgatccaggccaaaaatttgaaatag

SEQ ID NO: 197220 - DNA, 1989 bp, Artificial Sequence
  Description of Artificial Sequence: Synthetic coding sequence
atgaacgacatcagccagaaggccgagatcctgctgagcagcagcaagcctgtaccgaagacctacgtacccaaactgggcaagggggatgtcaaagataaattcgaggcaatgcagcgcgccagggaggaacggaaccagcgaagatcgcgggacgaaaagcagagacgtaaggaacaatatatccgagaacgagagtggaaccgcaggaagcaagagataaaggagatgctggctagcgacgacgaggaagatgttagctctaaagtcgagaaagcctatgtgcctaagctcaccggaaccgtaaaaggacgtttcgccgaaatggaaaaacaacggcaggaggagcagcggaaacgcaccgaggaggagcgtaaaaggagaatcgaacaggacatgctggagaagcgcaagatccagagagaactggccaaaagagcggagcaggaaggggacgattcactgttaattaccgtcgtaccagttaaatcttataagacaagtggtaagatgaaaaagaacttcgaggacctggaaaaagagcgggaagagaaagaacgtatcaagtacgaggaagacaagcgcatcagatatgaagagcaaaggccaagccttaaggaagctaaatgtctaagcctggttatggacgatgagatcgagtccgaggctaaaaaggaaagtctttcaccgggcaaactgaaactgaccttcgaggagttagagcggcagcggcaggaaaacaggaagaaacaagcagaggaggaagctcgcaagcgcctcgaagaggagaaacgagccttcgaggaggccaggagacagatggttaacgaggacgaagaaaatcaggatacagcaaaaattttcaagggatacagacccggaaaactgaagctttccttcgaggagatggagcgacagcgaagggaggatgagaagcggaaagctgaagaagaggcgcggcgacgcatagaggaggaaaaaaaggcctttgcagaggccaggcgaaatatggtagtggacgacgacagccctgagatgtataagacgattagtcaggagttcctcacccctggcaaacttgaaattaattttgaggagctactgaagcagaaaatggaggaggaaaagcggaggaccgaagaagaacggaagcacaaacttgagatggaaaagcaggagttcgagcagttgaggcaggagatgggtgaggaagaagaagaaaatgaaacctttggactgtctcgcgagtacgaggagttgatcaaactgaagcgctccgggagtattcaggctaaaaatctcaagtccaagtttgagaaaatcggccagttaagcgagaaagaaatccagaaaaagatcgaagaggagcgcgccagaaggcgggcaatcgacttggagattaaagaaagggaagccgaaaactttcatgaggaggacgacgttgacgtccgcccggcccgcaagtctgaggcgccctttacgcacaaggtcaatatgaaagctcgtttcgaacagatggctaaggcacgcgaggaggaagagcagcggagaattgaggagcagaagctgctgagaatgcagttcgaacagagagaaattgatgccgccctgcagaaaaagcgcgaggaggaggaagaggaggagggatccattatgaatggctcaaccgcagaggacgaggaacagactcgttccggcgctccgtggtttaaaaaaccactgaaaaatacctccgtggtagattctgagccagtgcggtttaccgtaaaggtaaccggggagccaaaaccggaaatcacatggtggttcgaaggcgaaatcctccaggacggcgaggactaccaatacatcgaaagaggagagacgtactgtctttatctgcctgaaacctttcctgaggatgggggcgagtatatgtgtaaggcggtgaataacaagggttcggccgcctcaacctgcattctaacaatcgagaccgacgattactag

SEQ ID NO: 197221 - DNA, 813 bp, Artificial Sequence
  Description of Artificial Sequence: Synthetic coding sequence
atggagaaccagcccgtgcggtggcgggccctgcccggcctgccccgcccaccggggcttccggccgcaccctggcttctgttaggggtcctcctgctgcctgggaccctacgtctggccgggggccagtcagtcacccacaccggtctgcctatcatggctagtctggccaataccgccatctcattttcgtgtcgaatcacctatccctataccccccagttcaaggtgttcacagtctcttattttcacgaggacctgcaagggcaacgctctcccaagaaacccacgaattgccatcctggattgggcactgaaaaccaatcacatacgttggattgccaggtcacgttggtgctccccggggcatcagccactggcacatactattgctccgtccattggccacacagtacagtaagagggagcggcacatttattttagtgagagatgcggggtacagagagccccctcagagcccccagaaactgctgctttttggatttaccgggcttctaagtgtgttgagcgtcgtcggaaccgcactgctgctgtggaataagaagcgtatgcgcggcccagggaaagaccccacccggaagtgccccgaccccagatcagcatcatcacccaagcagcacccaagtgagtccgtgtatactgcactgcagcgccgggaaaccgaagtctacgcctgcatagaaaatgaggatgggtcatcccccacagccaaacaaagccccttgtcccaggagcgaccccatagattcgaggatgacggggaactgaatctggtatatgaaaatctgtag

SEQ ID NO: 197222 - DNA, 1248 bp, Artificial Sequence
  Description of Artificial Sequence: Synthetic coding sequence
atggcccccgtgagcggcagccggagccccgaccgggaggccagcggatcgggaggccgaagacggtcaagctccaaatcaccaaaaccctccaagtccgctagaagccctcgagggaggagatcacggtcccatagctgctcccgcagcggcgacagaaacggcctgacccatcaattaggcggactatctcaagggtcccgaaaccagagttaccgttctcgttcacgtagccgatctcgtgagaggccttccgcacccaggggcatccccttcgcttctgcctcaagtagcgtgtactacggctcctatagccgcccctatggttctgacaagccgtggcctagcctgctagataaggagcgcgaggagagtcttcggcaaaagcggctgagtgaacgggagcgaataggtgagttgggcgcccctgaagtgtggggtttaagcccaaaaaaccctgagcccgattccgatgagcatacccccgtggaggatgaagagccaaaaaagtccacgaccagcgccagtactagcgaggaagagaagaagaagaagtcttcccgcagcaaggagagatccaaaaagaggcggaagaagaagtcatcaaaacgcaagcacaaaaaatatagcgaagacagtgacagtgactccgacagcgaaactgatagctccgatgaggataacaagaggagggctaagaaagcaaaaaagaaagagaagaagaaaaaacatcgcagcaagaaatataagaagaagcgatccaagaaaagccgtaaggagtcttcagattccagttcaaaagaaagccaggaggagtttctcgaaaatccctggaaagatcgaactaaagcagaagagccaagcgacctaatcggtcctgaggctccgaagactctcacctcccaagatgataagcccctgaattatggacatgctttacttcctggggagggagcagcaatggcagagtatgtcaaggctggaaaaaggataccccgccgcggtgagattggccttactagcgaggagatcgcatcttttgagtgctcagggtatgtgatgtcagggagtcggcaccgacgcatggaagctgtacggttgcgcaaggaaaaccagatttactcagctgatgagaaacgcgctctggccagttttaaccaggaggaaaggcggaagcgggaaaacaagatcctagcatcattcagagagatggtgtacagaaagacaaaaggaaaggatgacaagtag

SEQ ID NO: 197223 - DNA, 2073 bp, Artificial Sequence
  Description of Artificial Sequence: Synthetic coding sequence
atggagaagatcctgcagatggccgagggcatcgacatcggcgagatgccttcctatgatcttgttctatccaagccttctaagggacaaaagaggcatcttagtacttgtgacggtcagaaccctcccaaaaaacaagccgggtcaaaattccacgctcggccccgcttcgaacccgttcacttcgtggcctcttcctctaaggacgagcgacaagaggatccctacggaccccaaacgaaggaggtgaatgaacagacgcattttgcaagcatgcccagggatatttaccaggattacacccaagatagcttctccattcaagacgggaactctcagtattgcgacagttccggtttcatcttaacgaaagaccagcccgtgaccgccaacatgtatttcgactcaggaaatcctgctccttccactaccagccaacaggctaattctcagtccacccccgagccatcaccatctcagaccttccccgaatccgtcgttgcagaaaagcagtattttattgagaagctcacagccaccatctggaagaatttgtctaatccagagatgactagtggtagtgataaaattaactacacctacatgctcacgaggtgtatacaggcctgtaaaaccaaccccgagtacatctacgcccctctcaaggagattccgccagctgacattcctaagaacaaaaaactgttaacagacggatacgcttgtgaggtccgctgccaaaacatataccttacaacaggctacgccgggtctaaaaacggcagccgggatagagccacagagctggccgtgaaactgctacagaagcggatcgaagtgagagtggttagaagaaagtttaagcacacattcggggaggatctcgtggtctgtcaaatcgggatgagctcctatgagtttcctcccgccctgaagccccctgaagatctggtggtgcttgggaaagacgcatccgggcagccaatcttcaacgcctctgctaagcattggacgaacttcgtgatcactgagaatgcgaacgacgccataggtattctgaacaattccgcaagttttaacaagatgtccattgagtacaagtacgaaatgatgcccaacagaacctggagatgtcgggtttttttacaggatcactgcctggcagaggggtatgggacaaagaaaacttcgaagcacgctgcagctgatgaggcccttaaaattctacaaaaaacccagccgacctacccgtcagtgaaatcatcacagtgtcacactgggtcttccccccgcggttcaggcaaaaagaaagacatcaaggacttggttgtgtacgagaattcctccaacccggtttgcaccctgaacgacaccgctcagtttaatcgtatgacggtggaatatgtctatgagcggatgacagggctccgttggaaatgtaaggtgattctggaaagtgaagtcatcgcagaggcagtgggtgtaaagaaaactgtgaagtatgaagcggcaggcgaagcagtgaagaccctgaaaaaaacccagcccacagtgatcaataacctcaagaaaggagcagtggaagacgtgatcagccgcaacgaaatccagggccgttcagccgaggaagcctataaacagcagatcaaggaggacaatatcggtaaccagttgctacggaagatgggatggacaggaggtggcctcggcaagtccggcgaaggcattcgagagcctatttcagtcaaggagcagcacaagcgggaaggcctgggactggacgtagagagagtgaataagatcgctaaaagggatattgagcagatcataagaaattacgcccgatctgaatctcataccgacttgacttttagcagggagctgacaaacgatgaacgcaagcagatccaccagatagctcagaagtatggactgaagagcaaaagtcatggggtgggccatgaccgctaccttgtggtcggtcgcaaacggagaaaagaggacctgctagaccagctcaagcaggagggccaagtcggtcactacgaactggttatgccccaggcaaactag

SEQ ID NO: 197224 - DNA, 2073 bp, Artificial Sequence
  Description of Artificial Sequence: Synthetic coding sequence
atggagaagatcctgcagatggccgagggcatcgacatcggcgagatgcccagctacgacctagtactgtccaaacccagtaagggtcagaaaaggcatttgtcaacttgcgacggccagaaccctccaaaaaagcaagctgggagtaagttccacgcccgtcccagatttgagccagttcacttcgtggcatcatcttccaaggacgaaaggcaggaggacccttacggaccacagactaaagaggtgaatgaacagacccacttcgcctctatgcccagagatatttatcaggactacacccaggattcgttctcgatacaggacgggaactcacagtactgtgactcatctgggttcattctgactaaagatcagcctgtgaccgccaacatgtattttgatagcggaaatccagctccttctactacatctcagcaggcaaatagtcagtcaacaccggagccatctccctcccaaacgttcccggagtccgtggtcgcagaaaagcagtactttattgagaaactgacagctactatctggaagaacctgtctaatccagagatgacttcaggtagcgataaaattaactacacttacatgctaactcgttgtatccaagcctgtaaaactaacccggagtatatatacgcacccctaaaagagatcccacctgcagatatcccgaagaacaagaaattgctgaccgacggatatgcttgtgaagttcgctgccagaatatctatttaactacaggatacgcaggctctaaaaacgggtctcgagatcgcgccacagagcttgctgtgaagctcttgcagaaacgcattgaagtaagggtagtgagacggaagttcaagcacacatttggcgaagatttggttgtgtgtcaaattggcatgagttcttacgagttccctccggctctgaaaccgccggaggacctggtggtgctgggaaaagacgcttccggtcagcctatctttaacgcaagtgcgaaacactggactaattttgtgatcaccgaaaacgccaatgacgccataggaatcttaaataactcagcaagctttaataagatgtctatcgagtacaaatatgagatgatgcccaataggacctggcgatgcagagtctttctgcaggaccactgcctggccgagggctacggcacgaagaagacaagcaagcacgccgcggccgacgaagcccttaagattttgcagaagacccaacccacgtaccccagcgttaagagttcacagtgccacacaggctcatccccacgcgggtctggcaagaagaaggacattaaggacctcgtggtgtacgagaacagtagtaatcccgtttgcacacttaacgacacggctcagtttaataggatgaccgtggagtacgtgtatgaaaggatgactggtctcagatggaagtgtaaggttatcttggaatccgaggtgatcgctgaggccgtgggggtcaaaaaaacggtgaaatacgaagcagccggagaagctgtcaagacactgaaaaaaactcagcctactgtcattaacaatttgaagaagggggcagtggaagacgtgatctcaagaaacgagatacagggaaggagcgccgaggaggcctataagcagcagattaaggaggacaatatcggtaatcagctactgcgtaagatgggttggactggagggggcttgggtaagtctggcgaagggataagagagcccatctccgtcaaggaacagcacaaacgggagggattgggtctggacgtggaacgcgtgaataaaattgcaaagcgcgacatagagcagatcatccggaattacgccaggtctgagtctcacactgacctgacctttagtcgcgagcttactaatgacgagaggaagcagatacaccagatcgcccagaagtacggccttaagagcaagagtcacggagttggtcatgatagatacctcgtggtggggaggaaacggaggaaagaagacctgctggaccagctgaagcaggaagggcaggttggccattatgagctcgtaatgcctcaggctaattag

SEQ ID NO: 197225 - DNA, 2118 bp, Artificial Sequence
  Description of Artificial Sequence: Synthetic coding sequence
atgggcttcatgctgcccctgatcttccggtacagcccccggctgatggagaagattctgcagatggcagagggcattgacatcggagagatgccatcatacgatcttgtgttaagcaagccgtctaagggtcagaaacggcacttaagcacctgtgacggccagaatccccctaagaagcaggccggctcaaagttccatgctcgtcctcggttcgaacctgtgcatttcgtagcttcttcatcaaaagatgaacggcaggaagatccttacggtcctcagaccaaggaggtcaatgagcagacgcactttgcgtctatgcccagagacatctaccaggattatacacaggattccttctctatccaagatggtaacagtcagtattgcgactcctccggcttcattctgacaaaagatcagcccgtcactgccaacatgtacttcgacagtggaaacccggcacctagcacaacgtcgcagcaggccaactcacagtcgactcccgaaccatccccatcccagacatttcctgaatctgtggtagctgagaagcaatactttatcgaaaagttgaccgctacaatttggaagaatctcagcaatcctgaaatgacgtccggatcagacaagatcaactacacatacatgctgacacggtgcatccaggcctgcaaaacaaatccagaatacatttacgcccctctgaaagagataccccccgcagatatccccaaaaacaagaaactgctgaccgacggctacgcctgcgaggtccggtgtcagaacatctatttgactacaggttatgccggtagcaagaacggatctagagacagagctacagaattggccgtgaaactgctgcaaaaaagaatagaagtgcgcgttgttcggcggaagttcaaacacacttttggcgaggacctggtagtctgtcagattgggatgtcttcctacgaattcccccccgcgcttaaacccccggaggacctggtcgtactgggcaaagacgctagcggccagcctatatttaacgcttcggccaagcactggacaaatttcgtgattactgagaatgcgaatgatgccatcggaatcttaaataattctgcatccttcaataagatgtctattgagtataaatatgaaatgatgcctaaccggacatggcggtgcagagtgttcctgcaggatcactgtctcgcagagggatacgggacaaaaaaaaccagtaaacatgctgccgctgacgaggccctgaagattttgcagaaaacccagcctacctatccctctgttaaaagcagccagtgtcacaccggctcatccccccggggaagcgggaagaagaaggatattaaggatctggtcgtgtatgagaacagctccaatcccgtgtgtactctcaacgataccgctcagttcaaccgcatgacggtggaatatgtgtacgagagaatgactggattgcgatggaagtgtaaagtgatcctcgaatcagaagttattgcggaagcagttggcgtgaagaagacagtgaaatacgaggccgccggcgaagctgtcaagaccttgaaaaaaactcaacctaccgtgattaacaatctgaagaagggagctgtggaagacgtcatcagccgcaatgagatccaagggcgctccgcagaagaagcatacaagcagcaaatcaaggaggataatatcggcaaccagctgctcagaaagatgggctggaccggcgggggcctcgggaagtctggcgagggcatcagagagcccatcagtgtgaaggagcagcataaacgggaagggctgggactggatgtcgagcgcgtgaataagattgccaagagggacattgagcagatcatccggaactacgcccgcagcgaaagtcacaccgacctaactttcagtcgggagctcactaacgacgaacgcaagcaaattcatcagatcgcccagaagtacggactcaagtcaaagtcccatggggtgggacacgaccgttatttggtcgtggggcggaagagaagaaaggaagatctcctggaccagctgaagcaggaagggcaggtgggccactacgaacttgtcatgccccaggccaactag

SEQ ID NO: 197226 - DNA, 570 bp, Artificial Sequence
  Description of Artificial Sequence: Synthetic coding sequence
atgctgctgcgggccgcctggcggcgggccgccgtggccgtgaccgcggctccagggcccaaacctgccgcccccacacgaggtcttagactgcgggtgggcgatagagccccccaatcggccgtaccagctgacaccgcggccgcccccgaagttggacctgtgctcaggcctctttacatggacgtacaggcaacaacacctctggatccacgcgtgctggatgcgatgcttccctacctgattaactattatggcaatccccattctcggacccacgcctacgggtgggaatctgaggcagcaatggagcgcgccaggcagcaggtggccagcttgattggagccgatccacgggaaatcatctttacaagtggtgccacagaatcaaataacatcgccattaaaacagaaagccactcagtgattcaggccggcgttcagtggcacgatcttgattctctgcaggcccctccccccggtttcacacccttctcctgtttatcactactgagcagctgggattacagacggcccccacctcaccccgctaactttctgtatttctag

SEQ ID NO: 197227 - DNA, 1374 bp, Artificial Sequence
  Description of Artificial Sequence: Synthetic coding sequence
atgctgctgcgggccgcctggcggcgggccgccgtggccgtgaccgcggctccaggtcctaaaccagctgctccaactcgcgggctgaggctgcgggtcggcgatagagcccctcaatccgccgtgcccgccgacactgccgcagctccagaggtgggtcccgtccttcgccctctgtatatggacgttcaggctaccactccgctggatccacgcgtgctggatgctatgctaccatatctaataaattattatggtaatcctcattctcgaacccacgcatacggctgggagagcgaagcagccatggagagggcacggcagcaggttgcttccctgatcggtgcagatcctcgtgagattatctttacatccggggcaacagagagtaacaacatcgccatcaagggcgtggctcgcttctatcgcagcagaaagaagcacctgatcaccacccaaaccgagcacaagtgtgtgctggattcatgcagaagcctagaggcagagggctttcaggtcacatacctgccggtccagaagtctggtatcattgatcttaaagaattggaagcagccatccagcctgacactagtttggtgtccgtgatgacggtcaataatgaaattggagttaagcaacctatagcagaaattggtagaatctgctcatcgcgtaaagtctactttcacactgacgctgctcaggcagtaggcaaaatccccctggacgtaaatgacatgaagatcgatctcatgtctatttctggacacaagatctacggccccaagggggtgggagctatctacatcaggcgcagacctcgcgtgagagtggaagccctccagagtggaggcggccaggagagaggcatgagaagcggtaccgtccctactcctctggtggtgggtttaggggccgcgtgcgaagtggcccagcaggaaatggagtacgaccataagcggatttccaaattgagtgaaagattgatccagaatattatgaaatcactgccagacgtggtgatgaacggcgaccctaagcatcactatccaggatgcataaacctgagctttgcttatgtagagggagaaagcctcctcatggctctgaaggacgtggccctcagttccggcagcgcctgtacatccgcctcccttgagccgtcctatgtcttgcgggctatcggcacagacgaagaccttgctcacagctctatccggtttggaattgggagattcactacagaggaagaagtagattacaccgtggagaagtgtatacagcatgttaagcggctgcgcgaaatgagtccattgtgggagatggtgcaagacggtatcgacctgaagtctattaagtggacccagcactag

SEQ ID NO: 197228 - DNA, 486 bp, Artificial Sequence
  Description of Artificial Sequence: Synthetic coding sequence
atgctgctgcgggccgcctggcggcgggccgccgtggccgtgaccgccgcacctggtccgaaaccggctgcccccacaaggggcctccgtctccgggtcggagaccgagcccctcagtctgccgtcccagcggacaccgccgcggcccctgaggtaggacccgtcttgagacctctgtacatggacgtacaggctacaacccctctggatccgcgggtcctggacgctatgctgccatatctgatcaattactacgggaacccccattcccgcacccatgcttatggctgggaatcagaagctgccatggagcgggcaagacaacaggtagcttcgctgattggggccgacccgagggaaatcatttttacaagtggggccaccgagtccaacaatatagctatcaagggcgtggccaggttctaccgttctcgaaagaaacatctgattactacactcagcgggggcgccgggggctgcgtgtag

SEQ ID NO: 197229 - DNA, 768 bp, Artificial Sequence
  Description of Artificial Sequence: Synthetic coding sequence
atgaccgtgaacaacgagatcggcgtgaagcagcccatcgccgagatcggcagaatctgctcctctaggaaggtgtacttccatactgatgctgcccaagctgtgggcaagattcctctcgatgtgaacgatatgaagattgatctcatgagtataagcggccataaaatctatggacccaaaggtgttggcgccatttatataagaaggcgccctagagtcagggtggaggccttgcaaagcgggggcggccaggaaagaggtatgcgatcaggtacggtaccaacccctctggtagtgggattgggtgctgcgtgtgaggtagctcagcaggagatggagtatgaccacaagcgcatctctaagctgtcagagaggttgatccagaacattatgaagagtttgcccgacgtggttatgaatggcgaccccaaacatcactaccccggctgcattaatctgtccttcgcctacgtcgaaggagagagtctccttatggccctaaaagatgtggcattgtctagtggcagtgcctgcacttcagccagcctggagccctcatatgtgctgcgcgccattggtaccgatgaggacctagcccacagctctattcggttcggaatagggagatttacaacagaggaggaagtagattatactgtagagaaatgtatacaacacgtcaaaagactgcgtgagatgtccccactgtgggagatggtgcaggatggcattgatctgaaaagcataaagtggactcagcattag

SEQ ID NO: 197230 - DNA, 1221 bp, Artificial Sequence
  Description of Artificial Sequence: Synthetic coding sequence
atgctgctgcgggccgcctggcggcgggccgccgtggccgtgaccgccgctcccggtccgaagcccgcagcccctactcgaggactccggctcagggtcggagaccgcgcccctcagagcgcagtcccagccgacaccgctgccgcccctgaggtaggcccagtgctgaggccactgtacatggatgtgcaagccacgacacccttagacccccgagtactggacgcaatgctgccttacttaatcaattactacggtaacccacactcccggacccacgcgtacggctgggagtctgaagcagcaatggagcgggctcggcaacaggtggcttctctcatcggagcagatccgcgggagataatattcaccagcggtgcaaccgaatctaacaacatagcaatcaaagagctggaggcagcgatccaacctgacaccagtctcgtctcagtcatgacagtgaataacgagatcggggtgaaacagcccatcgccgagatcggacgaatttgcagcagccgtaaagtttatttccacacagacgcggcacaggccgttggcaagatccccttagacgtgaacgatatgaagatcgacttaatgtccatctccgggcacaagatatacggccccaagggcgtgggcgctatctacatccggcgccggcctagagtccgcgtcgaggctctccagtcaggaggtggccaggaacgggggatgagatcaggaaccgtccccacccccttggtggtcgggcttggagcggcttgtgaagtggcccaacaagagatggagtacgaccacaagaggatctccaaactgagcgaacgcttaatccaaaatattatgaaatctctccctgacgtggtgatgaacggggaccccaagcaccactatccaggatgtataaacttgtcctttgcttatgtggagggtgagtccctcctcatggccttgaaggacgtggctctgagttccgggtctgcatgcacctccgcaagcctcgaaccatcttacgttctgcgcgccatcgggactgatgaggatctggctcactcatcaattcgctttggcataggcagattcaccacggaggaggaggtcgattatacagtagaaaagtgtatccaacatgtgaaacgcctcagggagatgagccccctatgggagatggtccaggacggcattgacttgaagtccatcaagtggacacagcattag

SEQ ID NO: 197231 - DNA, 693 bp, Artificial Sequence
  Description of Artificial Sequence: Synthetic coding sequence
atgctgaagaacccctacaccatcaagaagcagcccctgcaccagtttgttcagagacctctatttcctttgcctgcggcattctatcacccggtgagatatatgttcatccagacccaggacactccaaatccgaatagcctgaagttcatcccaggaaagcccgttctcgaaaccaggaccatggatttcccaaccccggccgccgcattccgctccccactggcgaggcagctgttccgaattgagggggtaaaatcagttttcttcggacccgactttatcacagttacgaaagaaaacgaagagctagattggaatctgttgaaaccggacatttacgccacaatcatggactttttcgcatcgggattgcctctcgtgaccgaagaaacaccctctggagaggccggatctgaggaggacgacgaagtggttgctatgatcaaagagctgctggatacccgtatcagacccaccgtacaagaagatggcggagacgtgatttacaaaggcttcgaagatggcattgtccagctgaagctgcaaggatcatgcacgtcttgccccagctctatcattactctcaagaatggaatccagaatatgctgcagttctatatcccagaggtggaaggagtggagcaggtaatggatgacgagtctgatgagaaagaggccaatagcccgtag

SEQ ID NO: 197232 - DNA, 342 bp, Artificial Sequence
  Description of Artificial Sequence: Synthetic coding sequence
atggacttcttcgccagcggcctgcccctggtgaccgaggagacccccagtggcgaggctggctccgaagaagatgacgaagtggtcgcaatgatcaaagagttactcgacacacgtattcgccctaccgtccaggaagacggcggggacgttatttataaagggtttgaggatggcatcgtacagctgaaactccagggctcttgtacttcgtgcccatcaagtattatcaccctcaaaaatgggatacaaaacatgctccagttttacatcccagaagtagagggggtggagcaggtcatggatgacgagagcgatgaaaaagaagcgaattcgccttag

SEQ ID NO: 197233 - DNA, 765 bp, Artificial Sequence
  Description of Artificial Sequence: Synthetic coding sequence
atggccgccaccgcccggcggggctggggcgccgccgccgtggccgcagggctgaggagacggttctgccacatgctgaaaaacccctatactattaaaaagcagcctctgcaccagtttgtgcagcgtcccctgtttcctctcccagccgccttttaccaccccgtgcggtacatgtttatccaaacacaagacactccgaaccctaatagtctgaagttcatcccagggaagccggtactagaaacaaggacaatggattttcccacccccgcggctgcgttcaggtctccactggcacggcaactcttcagaattgaaggtgtcaagtcagttttctttggccctgacttcatcactgttaccaaggagaacgaagaattggattggaatctgttgaaacctgacatctacgctacaattatggactttttcgccagtggcctgccactcgtcaccgaggaaaccccatcaggcgaagccggtagtgaagaagatgatgaggtggttgctatgatcaaggagctgctagacacacggatacgtcctactgttcaagaagacggaggtgatgttatctacaagggctttgaggatgggatcgtgcaactgaaacttcagggatcctgcacgtcctgccccagtagcatcattactctgaaaaacggaattcagaacatgttgcagttctatatacccgaggtggagggagtggaacaggtgatggacgacgaatccgacgaaaaggaagccaatagcccatag

SEQ ID NO: 197234 - DNA, 300 bp, Artificial Sequence
  Description of Artificial Sequence: Synthetic coding sequence
atggacttcttcgccagcggcctgcccctggtgaccgaggagaccccaagtggcgaggcagggtccgaagaagatgatgaagtggtcgccatgatcaaggaactgctcgatacaaggattaggcccactgtgcaggaggatggcggggatgtaatttataaagggtttgaagatggcattgtccagctcaagcttcaagggtcctgtaccagttgcccatcgtctattatcacacttaaaaacgggatccagaacatgctccagttctacattcctgaggtggaaggagtggagcagtag

SEQ ID NO: 197235 - DNA, 342 bp, Artificial Sequence
  Description of Artificial Sequence: Synthetic coding sequence
atggacttcttcgccagcggcctgcccctggtgaccgaggagaccccaagtggagaagctggatccgaggaagatgatgaagttgtggcaatgatcaaagaattgctggacacaaggatcagaccaaccgtgcaggaggatggtggggacgtcatctacaaagggttcgaggacggcatcgtacagttaaagttacaaggcagctgtaccagttgtcccagctcgattattacgctgaaaaatggcatccagaatatgcttcaattttacattcccgaggttgagggagtcgaacaagtcatggatgacgagtcggatgagaaggaagccaacagcccctag

SEQ ID NO: 197236 - DNA, 291 bp, Artificial Sequence
  Description of Artificial Sequence: Synthetic coding sequence
atggacttcttcgccagcggcctgcccctggtgaccgaggagaccccctccggtgaggcgggttctgaagaagatgacgaagtagtggctatgatcaaggagctgttggacacacggattagacccacagtacaggaggatggcggtgacgttatatacaagggcttcgaggacggcattgtccagctgaaactccagggctcatgcacctcttgcccatcgtccattataacattgaagaacggaattcagaacatgctccaattctatatccctgaagtggaggggtag

SEQ ID NO: 197237 - DNA, 1464 bp, Artificial Sequence
  Description of Artificial Sequence: Synthetic coding sequence
atggccgccgccctgccccggaccctgggcgagctgcagctgtaccgcattctgcagaaggctaacttgctttcatatttcgatgcgtttatacagcagggcggcgatgatgtgcaacagttgtgtgaagccggagaggaagaattcctcgagattatggcgttggtcggaatggcaagtaaacctttgcatgtacggaggctgcagaaggcccttagagattgggtgacaaacccaggactgtttaaccaacctttgacgagtctccccgttagctcaattccaatttataagttacctgagggctctcccacctggctgggcattagctgttcctcatatgagaggtcttctaacgcccgcgagccccatctcaaaatcccgaaatgcgcagcgacaacttgtgtgcagagtctggggcagggaaagtctgacgtggttggaagcctcgcccttcagtccgtcggagagtccaggctttggcagggacaccatgccacagagtccgagcatagcctgagtccagccgacctgggctctcccgcatccccgaaagagtcctcagaggccctcgatgccgctgcagccctgagcgtcgcagagtgtgtggagcgcatggcaccaacgctgcccaagagcgatttaaatgaagtgaaggaactccttaagacaaataaaaagctggcaaaaatgatcgggcacatcttcgaaatgaatgacgacgacccccacaaggaagaggagatacggaagtacagtgccatatatggacggttcgacagcaaaagaaaggatggtaagcatttgactttgcacgagctcaccgttaatgaggcagctgcacagttgtgtgtaaaagacaacgctctcttgacaaggagggacgagctgttcgccctggctagacagatctcccgagaagtcacgtacaaatacacgtatcgcaccactaagagcaagtgcggggaacgggatgaactcagccctaagcgaattaaagtcgaagacggttttcccgacttccaggactcagtgcagactctgttccaacaggcaagggctaagtccgaggagctggccgccctaagctcacagcaacccgagaaagtgatggcaaaacagatggagtttctgtgtaatcaggctggctatgagcgtttgcagcacgcagagcgcaggctttcggccggactgtatagacagtcatcagaggaacattcgcccaacgggctgacgtcagataactcggatggtcagggggaacggccactcaatctgcggatgcctaacctgcagaacagacaaccccatcactttgtagttgatggggaactttctcggctgtacccctccgaggccaaatcccactcatccgagtccctggggatcttgaaagactaccctcattccgccttcactttggagaaaaaagtcatcaaaacagagccagaggattctcgttag

SEQ ID NO: 197238 - DNA, 1377 bp, Artificial Sequence
  Description of Artificial Sequence: Synthetic coding sequence
atggccgccgccctgccccggaccctgggcgagctgcagctgtacaggatcctccagaaagcaaatctcctgtcttatttcgatgcttttatccagcagggcggtgacgatgtgcagcaactgtgtgaagccggggaagaggaattcctggagatcatggcactcgtcggaatggcaagtaaacccctgcatgtgagaagactgcaaaaagcactgagagactgggtgactaaccctggactttttaaccaacccctgacatccctccccgtgagcagtatcccgatctacaaattgccagaaggtagccctacctggctgggaatcagctgctctagttacgaacggtcgagcaatgctcgggagccccacctcaaaatcccgaaatgcgccgctactacctgcgtacagtccttagggcagggcaagagtgacgtagttggcagccttgcccttcaatccgtgggcgaatcccgattgtggcagggtcaccacgcgacggagtctgagcatagtctctccccggcagacttaggttctcctgcctccccaaaagagagttccgaggcacttgacgctgcagccgccctgagtgtcgctgaatgcgtggaaagaatggcacctaccctcccaaagagcgatctgaacgaagtcaaagagcttctgaaaaccaacaaaaagttggctaagatgattggccatatatttgaaatgaacgacgatgatccacacaaggaagaagaaatcagaaagtacagcgccatctatggacgtttcgactccaagcgcaaggatggaaagcacctgaccctccacgaactgaccgtcaacgaagccgctgcccaactctgcgttaaggacaacgccttactaactcgtcgcgacgagctgttcgccctcgccaggcagataagcagagaggtgacatacaaatatacctatcgcactaccaaatccaaatgcggggaaagggacgagttgtctcctaaaagaatcaaggtggaagatcagccagaaaaggttatggcgaagcagatggaatttctgtgcaatcaagcgggatatgagcgcctgcagcatgccgaaaggcgtctcagcgcaggcctctatcgtcagagcagcgaagaacattcccctaatggtctgacgtcagacaatagcgacggacagggggagcgccctctgaatctgaggatgcctaatctgcaaaatcgtcaaccacaccacttcgtcgtggatggtgaactgtctcgactatatcccagcgaagctaagagccacagcagtgagtcactggggattctgaaggactatcctcactccgcattcacactggaaaagaaggtaattaagactgaacccgaggactctcgctag

SEQ ID NO: 197239 - DNA, 1464 bp, Artificial Sequence
  Description of Artificial Sequence: Synthetic coding sequence
atggccgccgccctgccccggaccctgggcgagctgcagctgtacaggattttgcaaaaggccaacctgctctcttattttgacgccttcatccagcagggtggggacgacgtgcagcaactttgcgaggcaggcgaagaagagtttctcgagattatggcactggtgggaatggcttcgaagcccctgcacgttcgtaggctgcagaaggctctgagagactgggtcacaaaccccggattgtttaatcagcctcttacgagtcttccagtcagctctattccgatttacaaactgcccgaaggaagccccacatggcttggaatatcatgctcaagctacgagcggtcctcaaatgctcgggagccccatttaaagatccctaagtgcgctgcgacaacatgcgtccagagccttggacagggtaagagcgacgttgtgggttctctggcgttacaatccgttggtgagtcgcgactgtggcagggacaccacgctaccgaaagtgagcatagtctgtccccggcagaccttggcagtcccgcaagcccaaaggagtcttccgaggcgctggatgcagcagctgctctgtcggtagccgagtgtgtagagcggatggcacctactctgccaaaaagcgatctgaacgaagtcaaggagctgctgaagaccaacaaaaaactggcgaagatgatcggtcatatctttgaaatgaatgacgatgatccccataaggaggaagagattaggaaatattcagcaatctatggacggtttgactcaaagcggaaggatggtaagcacctcacattgcacgagctgaccgtgaatgaagccgctgcacagttgtgcgtgaaagataatgccctcctgacaaggagagacgagctgttcgcactcgcacgccagatttcgagggaagtgacttacaaatacacatatcggaccactaaatccaaatgtggagaacgggatgagctgtcacccaagcgcattaaagtcgaggacggatttcccgattttcaggactcagtgcagaccctgttccagcaggctcgggctaaatcggaggagctggccgcactgagctcacagcagccggaaaaggtaatggccaagcaaatggagtttctgtgcaaccaggctggttatgaaaggttgcagcacgccgagagacggcttagcgcgggactgtataggcagtcttcagaggagcacagtcccaacggcctgacgtccgacaatagcgatggccagggcgaacggccccttaatctgaggatgcctaacctacagaaccgacaaccccatcacttcgtggtggacggcgaactatccaggttgtacccatccgaagcgaagtcccactctagcgagtccctaggtatccttaaggactacccccatagcgcgtttacactcgagaagaaagtcattaaaaccgaacctgaggattcacggtag

SEQ ID NO: 197240 - DNA, 1461 bp, Artificial Sequence
  Description of Artificial Sequence: Synthetic coding sequence
atggccgccgccctgccccggaccctgggcgagctgcagctgtaccgcatcctgcaaaaagcaaatctgctgtcatatttcgacgctttcatccagcagggcggggacgacgtgcagcagctgtgcgaagctggagaagaggaattcttggagatcatggccttagtggggatggcctccaagcccctgcacgttagaagactccagaaggcgttgagggattgggtgactaaccctgggctattcaaccaaccccttaccagccttcccgtcagtagtatccccatttataagctgcccgaggggagccccacatggctcgggatttcatgctcatcttatgaaaggagcagcaatgcccgggaacctcatctgaaaattccaaaatgtgcagcgacaacgtgcgtacagtctctcggtcagggcaaaagcgacgtcgtgggatcactggctctccaatcagttggagaaagccgcctgtggcagggacatcacgccacagagagcgaacactccctgagccccgctgatctaggttctcccgcttccccaaaggaatcttcagaagccctcgatgctgcagccgccctgtcagtagcagagtgtgtggaacgcatggcaccgaccctgcccaaaagtgatttgaatgaagttaaggaattattgaagaccaacaagaagttggccaagatgatcggccatattttcgagatgaatgacgatgacccgcataaggaagaagaaatccgtaagtactccgccatatatgggagattcgactccaaaagaaaagatggaaagcatctgacacttcacgaactgaccgtcaacgaagcggcagcccagctctgcgtgaaagataacgcacttcttacacggagggacgagctcttcgcgcttgcacgccagatctcccgcgaggtcacatataaatatacctaccgcaccacaaaaagcaaatgtggagagcgggatgaactcagcccaaagcggattaaagtagaggacggctttcctgactttcaggattccgtgcagacattatttcagcaggcgcgtgctaaaagtgaagagctggccgccctttcatcccaacccgagaaggttatggctaaacagatggaattcctgtgtaaccaggctggctatgaacgcctgcagcacgccgaaaggcgactctcagccggtttatatagacagtcctctgaagagcatagccccaacggcttgactagtgacaactccgacggccaaggcgaacgaccgttaaacctgcggatgcccaatctccagaataggcagccacaccatttcgtcgtcgatggagagctgagtagactgtatccctccgaagctaaatcacattccagtgagtctctcggaattttgaaggattatccacactctgcctttacacttgagaagaaagtcataaaaactgagcccgaagacagtcgctag

SEQ ID NO: 197241 - DNA, 474 bp, Artificial Sequence
  Description of Artificial Sequence: Synthetic coding sequence
atggccgccgccctgccccggaccctgggcgagctgcagctgtaccgaatccttcagaaagcaaatctcttaagttactttgatgcttttattcaacagggcggagacgacgttcagcaactgtgtgaggctggagaagaagagttcctggaaatcatggccctggtgggaatggcttcgaagcccctgcacgtacgacgtttgcagaaggctctccgcgattgggtgactaacccaggccttttcaatcagcctctgacaagtctccctgtttcatcgattccaatctataagctgcccgagggaagccccacctggctgggaatttcttgttccagctatgagcgtagctctaacgctagagaaccccatcttaaaatccccaagtgcgcagctaccacatgtgtccagtcactgggccagggcaagagtgacgtggtggggagcctggctctgcagagtgtaggagagtag

SEQ ID NO: 197242 - DNA, 189 bp, Artificial Sequence
  Description of Artificial Sequence: Synthetic coding sequence
atggccgccgccctgccccggaccctgggcgagctgcagctgtacaggatcctgcagaaagcgaacctcctcagctacttcgatgcgttcattcagcagggcggggacgatgtgcagcaattgtgcgaggccggcgaagaggagtttctcgaaattatggccctcgtcggtatggcgagcaagccatag

SEQ ID NO: 197243 - DNA, 303 bp, Artificial Sequence
  Description of Artificial Sequence: Synthetic coding sequence
atggccgccgccctgccccggaccctgggcgagctgcagctgtaccgcattctccagaaggcaaatctactgagctatttcgatgccttcatccagcagggaggcgatgatgtgcaacagctttgtgaggcaggagaggaggagtttctcgagattatggccctcgtggggatggcctccaagcccctgcacgttaggcgtctgcagaaggcgttgagagattgggtgactaacccaggtttatttaaccagccactgacaagccttccggtcagcagcataccgatctacaagctgccatag

SEQ ID NO: 197244 - DNA, 723 bp, Artificial Sequence
  Description of Artificial Sequence: Synthetic coding sequence
tgaaaggagctgctgaagaccaacaagaagctggccaagatgatcggccatatctttgagatgaacgatgacgatcctcataaagaagaagaaatccggaaatattcagcaatctacggccggttcgactctaagagaaaggacggtaaacacctgacccttcatgaactgaccgttaacgaagccgctgctcagttgtgcgtgaaagacaatgctctgctgactcgacgggatgaattatttgcgcttgcgcgccagatttccagagaagtgacctacaaatacacgtaccgtacaacgaaaagtaaatgtggggagagggacgaactctctcctaaaaggatcaaagtcgagcagcccgaaaaggtgatggccaagcagatggagttcctgtgcaatcaagccgggtacgagagacttcagcatgctgaacggagactatcagccggtctttatcggcagagctccgaggagcactcgccgaatgggctcaccagcgataattccgatggacagggggaacgaccactcaacctgcgtatgcctaaccttcagaaccgacaacctcatcacttcgtagtcgacggggaactttccagactttacccttctgaggccaaatcgcacagcagtgagtccctgggtattctcaaggactaccctcattcagcgttcacattagaaaaaaaggtaattaagacggaacctgaggacagtaggtag

SEQ ID NO: 197245 - DNA, 459 bp, Artificial Sequence
  Description of Artificial Sequence: Synthetic coding sequence
atggccgccgccctgccccggaccctgggcgagctgcagctgtacagaattttacagaaagccaatttgctgtcatactttgacgccttcatccagcagggtggcgatgatgtacagcagctgtgcgaagccggggaggaagagtttctcgagattatggctttagtggggatggccagcaaaccactccacgtacggaggctccagaaagcccttagagactgggtgaccaacccagggctattcaatcagcccctaacatccctacctgtgtcttcaattccaatctataagctgcctgagggctctccaacttggctcggaatctcgtgcagctcctacgagcggtcctctaacgccagagagccgcatttgaaaatccccaaatgtgccgccaccacatgcgtccagagtttggggcaaggaaaatccgacgtcgtgggcagtctggcattatag

SEQ ID NO: 197246 - DNA, 684 bp, Artificial Sequence
  Description of Artificial Sequence: Synthetic coding sequence
atgatcggccacatcttcgagatgaacgacgacgacccccacaaggaggaagagattcggaagtactcggcaatctatggaagattcgactctaaaagaaaggatggcaaacatcttacactacacgaactgaccgtgaacgaagcagccgcacagctgtgtgttaaagataacgcactgctgacgcgcagggacgagctgttcgcactggctcggcagatcagtcgcgaagtcacgtacaaatatacctaccgaactaccaagtccaagtgtggggaaagggacgagctgagccccaaaaggatcaaagtggagcagcctgaaaaggtgatggccaagcagatggaattcctttgcaatcaggctggttacgaacgcctacagcacgccgaacggcgcctaagcgctgggttatatcgccagtcttcagaagagcactcccccaacggcctgacctcagacaactcagacggtcagggtgaaaggccactcaatctgagaatgcccaacctgcaaaatagacagcctcaccacttcgttgtcgacggggaattaagccggttgtatcctagtgaggccaagagtcattcatctgagagcctcggcatcctgaaagactatcctcactctgcattcaccctggagaaaaaggttatcaagacagagccagaggattctcgctag

SEQ ID NO: 197247 - DNA, 1578 bp, Artificial Sequence
  Description of Artificial Sequence: Synthetic coding sequence
atgcaccgggcccccagccccaccgccgagcagccccccggcggcggtgattcagctaggcgcacactccagccacgtctgaagccaagcgctcgcgccatggcccttcctaggactctgggtgaattgcagctttaccgggtgctccagcgagccaatctactatcttactacgaaacttttatccaacagggtggcgacgacgtgcagcagttatgcgaggcgggtgaagaagagttcttggagattatggcgctggtagggatggcaaccaagcctcttcacgtccggcgtttgcagaaagcattaagagaatgggccactaatcctggacttttcagccagcccgtccctgctgttcccgtgtctagtataccattatttaaaatatccgagactgccgggacgagaaagggctctatgtctaacggacacggtagcccaggtgagaaggccggcagcgctcggtctttctcacctaaatcccctctcgaattaggggaaaaactgtccccactgcctggcggccctggtgcgggagacccccgaatctggcccggacggtcaactcctgaatcagacgtgggagcgggaggggaagaggaagccggtagccctcccttcagccctcctgccggggggggcgtgccggaaggaacaggagccggtggattagcggccggcgggaccgggggaggcccagaccgcttagaacccgagatggtgcgcatggtggtagaatcagttgagcgtatttttcgaagcttcccacggggagacgcaggcgaggtgacttcactactcaagcttaacaaaaaactcgcacggagcgtgggtcacattttcgagatggacgataatgactctcaaaaggaagaggaaatacgtaaatacagtatcatttacggtcggttcgactccaaacgccgggaaggaaagcagctgagtctacatgagctgactattaacgaagcagcggcacaattctgtatgcgagacaatactctcctcctgcgccgagttgaactgtttagcttatctagacaggttgccagggaaagcacttatctgtcttctctgaagggttccagactgcatccagaggagctgggggggccgcccctgaaaaagctgaaacaagaggtcggggaacagtcccacccagagatacagcagccacctccaggtcccgaatcgtacgtgccgccttacagaccttccctcgaagaggactcagcctccctgtccggcgagagccttgatggccatctgcaggctgtgggttcttgcccacggttgaccccaccacccgctgacctgccattggcactacccgcccacggactgtggtcaaggcacatcttgcagcagacattgatggatgaagggctgcgtctcgcacgcctggtctcacacgaccgggtaggaagactatcaccttgtgttccagccaaacctccactcgccgaattcgaggaggggctacttgatcggtgtcctgctcccgggccccatcccgccctggtggaaggaaggcgatccagtgtgaaggtggaggccgaagcctcacgacagtag

SEQ ID NO: 197248 - DNA, 1386 bp, Artificial Sequence
  Description of Artificial Sequence: Synthetic coding sequence
atgcaccgggcccccagccccaccgccgagcagccccccggcggcggtgattctgccaggagaaccctccaacctcgccttaagccttccgcaagggctatggcactgcctcgaacactgggagagctgcagctttacagagttctccagagagcaaacctgctgagttactacgaaacctttattcaacagggcggcgatgacgtccaacagctttgtgaagccggcgaggaagagttcctggagatcatggccttagtgggcatggcaacgaagcctctccatgttaggcgtctgcagaaggcactaagggaatgggcaaccaaccctggcctgttcagtcagcccgtccctgcggttcccgtgtcttccatccctttattcaaaatctcagaaaccgctgggacccggaagggctctatgagtaatgggcacgggagtcctggagagaaggcagggtctgcacggtcattttcccccaagtcacctctcgaattgggggagaaactctcacccctaccaggcggtccaggcgccggcgaccctagaatttggcctgggaggtccacacctgagtcagacgtcggcgccggcggggaggaggaagccggctcccccccctttagtcctccagctggaggcggcgtccctgaaggcaccggcgctggagggcttgcagcaggaggcaccggcggcgggccagaccggctggagcccgaaatggttagaatggtggtcgagtctgtcgagcgtatatttcgatccttccctcgcggcgatgccggtgaagtcacatccctgcttaagctaaacaaaaaactcgcccgctctgtaggacacattttcgagatggatgataatgatagtcagaaggaggaagagatacgcaagtactccataatatacggaaggtttgactctaagcggagagagggaaaacagttgtcgctgcatgagctgactattaacgaggccgctgcccagttctgtatgcgggacaacaccttacttctgagacgggtggaactgtttagcttgtcacgacaggtggcgcgcgagtccacttatctcagtagtttgaaagggtcccggctgcaccccgaggagttaggcggcccccctttgaaaaagctaaaacaggaggtcggcgagcaatcgcaccctgagatccagcagccccctccaggacccgagagttatgtgccaccataccgcccctctttggaagaggacagcgccagtttgtcaggtgaaagcttggacggtcatcttcaggagttcgaggagggtctcctggaccgatgtcctgctccagggccacatccagccctggtggaaggtaggagaagctctgtaaaggtagaggcggaggcctcacggcagtag

SEQ ID NO: 197249 - DNA, 969 bp, Artificial Sequence
  Description of Artificial Sequence: Synthetic coding sequence
atgcaccgggcccccagccccaccgccgagcagccccccggcggcggggacagtgcaagacggactctgcagcctaggctcaaacccagtgcacgggctatggcactccccagaacgcttggagagcttcagctgtatcgagtactccagcgggccaacctgctctcgtattacgagaccttcatacagcagggaggagatgatgtgcagcagttgtgtgaagctggcgaggaagaattcctggaaatcatggccctggtgggtatggcaaccaagcctctccatgtgcgacgcttgcagaaagctttgcgcgagtgggccactaatcctggactcttcagtcaaccagttcctgcagtgcccgtatcatccataccactgttcaagataagcgagacagctggcaccagaaagggatcgatgtcaaatgggcacggttcccccggagaaaaggctgggtctgctcgctcgttcagccctaagagccctctggaactgggggagaaactcagtccgctgccaggggggcccggcgcaggcgacccacgcatttggcccgggagaagcacacccgagtccgatgttggcgctgggggcgaagaggaggccggttcgccacccttcagtcccccagcggggggcggagtaccagagggcacaggcgcaggaggtctcgctgctggaggcaccgggggtgggcctgaccgcctggagccagagatggttcgtatggttgtggaaagcgtggaacgcatctttcggtcctttccgaggggagacgccggtgaggttacttccctgctcaagctgaacaagaagcttgcaagatcagtcggacatatctttgagatggacgataacgattcccagaaagaggaagagatccgcaagtacagcattatatacggccgcttcgactctaaaaggagagaaggaaagcagctgtcactgcatgaggcaagcccttag

SEQ ID NO: 197250 - DNA, 723 bp, Artificial Sequence
  Description of Artificial Sequence: Synthetic coding sequence
tgaagcggcagcgccagccccgccgtggccgagctgtgccagaacacgccagagacatttctcgaagcatctaagttgctacttacctatgccgataatatcctgagaaaccccaatgatgaaaaatacaggagcatccgcatcggaaatacggcttttagtacccggctccttcccgtgcgaggagcagtagagtgtttgtttgaaatgggattcgaggagggcgaaactcatctgattttcccgaaaaaagcgtccgtggagcagttgcaaaaaattagggacctaatcgctatagagcggtcatctagactcgacggaagcaataagagccacaaggtgaaatcgagccagcagcctgcggcatccacacagctgccaaccaccccctcgtctaacccctcgggtttgaatcagcatacgaggaaccgccaggggcagtcctcagatcctccttccgccagtactgtagccgctgatagcgccatactggaagtgttacaatcaaacatccagcacgttctcgtgtatgagaaccccgcactgcaggagaaggcccttgcttgcattccagtgcaagagctgaagcggaaatcccaagaaaaactctcccgggcgcgcaaactagacaaagatatcattactctcagaaacttctggaagcaggacgtggacggcgtggcctccggacccatagtgctgcactgcgctgccgagctatag

SEQ ID NO: 197251 - DNA, 1965 bp, Artificial Sequence
  Description of Artificial Sequence: Synthetic coding sequence
atggccgccgccgccctgggcagcagcagcggcagcgccagccccgccgtagctgagctctgccagaacacccctgagacgttcctggaggctagcaaactgcttctgacctacgctgacaacatactccgaaatcctaatgacgaaaagtatcgcagcatcaggatcggaaatactgcattcagcactcggctgcttcccgttcgtggcgcggtggaatgcctttttgagatgggatttgaggagggagagacccacttgatctttcccaagaaggcgagtgtcgaacagctgcagaagatcagagacctgatcgccatagaacggtcatcaaggctagatggatctaacaagtcccacaaggtcaagagcagccaacagcctgcagcttctacccaactgccaacaactccctcctctaatccgtctggattgaatcagcatacccggaacagacaaggacagtcttccgaccccccaagtgcctcaaccgtggctgccgatagcgctatcctggaggtgctccaatctaatatccaacatgttctggtctacgagaatcccgctttgcaggaaaaggctttggcctgtatccctgtgcaggagttgaagagaaagagccaggagaaactcagccgtgcccggaaactggacaaagggattaacatttcagatgaagattttcttcttctggagctgctccattggttcaaagaagaattcttccattgggtcaataatgtcctgtgttccaaatgcggagggcaaacaaggtctagagatcgatcgctcctgccctcggatgatgaacttaagtggggggctaaggaagtggaggaccattactgcgacgcttgccagttttcgaatcgttttccaagatacaacaaccctgagaagctgctcgaaactaggtgcggaagatgtggggagtgggccaactgcttcaccttgtgctgtcgcgccgtcggttttgaagcaagatatgtctgggactatacagatcatgtgtggaccgaagtgtactcaccctctcaacaacgatggctgcattgcgacgcatgcgaagacgtttgcgacaaaccattgttgtatgagatcggttggggcaaaaagctatcatacgttatcgctttctcgaaagatgaggtcgtggatgttacctggcgctattcctgcaaacacgaagaagtgatcgcccgaagaacgaaggtgaaggaggccttactgagggacaccattaatgggctcaataagcaaaggcagctgttcctttctgaaaaccgtcgcaaagaattgttacaaagaatcatagtggagcttgtggaatttatatcacctaaaaccccaaaacccggggagctgggagggcgcatatccggtagcgttgcatggcgtgttgctcggggcgaaatgggcctgcagcgcaaagaaacactcttcatcccttgtgagaacgagaagatatccaagcaattacatctctgctataacatcgtcaaagataggtacgtgcgagtaagcaataacaatcagactatcagcgggtgggagaacggtgtgtggaaaatggagtcaatctttaggaaagttgagactgactggcatatggtctacctcgccaggaaggagggctcgtctttcgcttatatctcttggaagttcgagtgcggctccgtgggcttgaaggtggactccatttcaatcaggacttctagccaaacttttcagactggaacagtggagtggaaactgcggtccgatacggcccaagtcgagctgactggagacaatagcctgcacagctatgcagacttcagcggtgctacagaggtgatactggaagccgaattaagccgcggagacggtgatgtggcttggcagcacacacaacttttcaggcagtcactgaacgatcacgaagaaaactgtctcgaaattatcattaaatttagcgacctctag

SEQ ID NO: 197252 - DNA, 1902 bp, Artificial Sequence
  Description of Artificial Sequence: Synthetic coding sequence
gccgccctgggcagcagcagcggcagcgccagccccgccgtggccgagctctgccagaacacccctgagaccttcctggaagccagcaagctcttgcttacatacgcagacaatatactgagaaaccctaacgatgagaagtatcgatctatccgcatcggcaacacagccttctccacgaggctgctgcccgtcaggggcgccgttgaatgcctgttcgagatgggcttcgaagagggcgagacccatctgatcttccctaaaaaagcctcagtcgagcagctgcaaaagatccgcgatctaatcgccatcgaaaggagcagccggctggatggaagtaacaaatctcacaaggtcaagtctagccagcaacccgccgctagtacacagctgcctaccacaccttcttctaatccgagtgggttgaaccagcacacccgcaacaggcaggggcaatctagcgatccaccctccgcctccaccgtggcggcagattcagccattctcgaggttctccaatctaacatccagcatgttctggtgtacgaaaatccggccctgcaggagaaggcactggcctgtattccggtgcaggagctgaagcggaagtcgcaagagaagcttagccgcgcaaggaagttagataaaggaatcaatatttccgatgaggattttctccttttggagctcctccactggttcaaggaagagttttttcactgggtgaacaatgtactgtgtagtaagtgcggcggacagacacgtagtcgggatcggagtctgctccctagcgatgacgagctgaagtggggagccaaagaggttgaagatcattactgcgatgcgtgccagttcagcaataggtttccacgatataataatcccgaaaagctcctggagacaagatgtggtcggtgcggagagtgggccaattgcttcaccttgtgctgtcgcgctgtgggattcgaggcgagatatgtgtgggactatacggaactgcagcggactttgtcgcttaagctaaccacactgaaggagattggcaaaacatttcttaggatcagcaagcgtcagaaactgattcaggtcgtagacgtaacctggaggtactcttgtaagcatgaagaggttatagctcgtaggacaaaggtgaaggaggctcttctgcgcgataccattaacggcttgaataagcagaggcagctttttctgagcgagaatcgaaggaaagaattgctgcaacgtatcatagtggaactagtcgaattcatctcgccaaaaactcctaaacctggcgagctcggaggccggatttctgggtctgtcgcctggagagtggctagaggcgagatgggactgcagcgaaaagagactctgtttataccttgcgagaatgagaaaatttcgaagcagcttcacctatgttataacatcgtgaaggatcgctatgtgagagtgagcaacaataatcagaccattagtggctgggaaaacggggtttggaagatggagtcaatcttccgaaaagtggagaccgactggcacatggtgtatttagcaagaaaagaaggctcttccttcgcatacataagctggaagtttgaatgtggttctgttggactgaaggtggactccatctctattagaacatcatcacagactttccaaaccggcaccgtcgaatggaaactgaggagcgatactgcacaggtcgagctgacaggcgataactctctgcactcctacgccgacttctccggagctaccgaggtaatactggaagccgagttgtccagaggcgatggcgacgtagcatggcagcacacccagctgttccggcagtcgttgaacgaccacgaagagaactgccttgaaatcatcataaaatttagtgatttgtag

SEQ ID NO: 197253 - DNA, 1677 bp, Artificial Sequence
  Description of Artificial Sequence: Synthetic coding sequence
atggccgccgccgccctgggcagcagcagcggcagcgccagccccgcggtcgccgagctttgccagaatacaccagaaacattcctcgaggccagcaaactgctgctgacatacgctgacaacatcctgcggaatccaaatgacgagaaataccgcagcatccggatcggaaacacagcatttagtacccgcctactacctgtccgaggagcagtggaatgtctgtttgaaatggggtttgaggagggggagacacacctgatattcccaaagaaggcctcagtcgaacagctgcaaaaaattagggatctcattgccattgaacggagcagccggctggatgggagtaataagtcacacaaggtaaagtcctcacagcagcctgccgcttctacgcagttgcccacaacaccctcatcaaaccccagtggactgaaccagcacacaaggaaccggcagggtcaatcatctgatcctccctccgctagcacagtcgcggctgacagcgcgattctggaagtgctgcagtcgaacattcagcacgtgttggtgtatgagaacccggccttgcaggaaaaggccctggcttgtatccctgtgcaggagctgaagcgaaaatcgcaagaaaaacttagcagagctaggaagttggacaaggggatcaatattagcgacgaagactttctgctgctggagttgcttcattggtttaaggaagagttttttcactgggtgaacaacgtactttgctcaaaatgtggcggacagactagatccagagacaggtccttgctgccctctgatgacgagttgaaatggggcgcgaaggaggtggaggaccattattgtgatgcgtgccaattctctaaccggtttccacgttacaacaatcccgaaaagcttctggaaacccggtgcggccgctgtggtgaatgggccaactgcttcaccctgtgctgcagggccgtgggattcgaggcacggtatgtctgggattacacagatcatgtttggacagaggtgtattccccaagccagcagagatggctccactgcgacgcttgtgaggacgtatgcgacaagccactcctgtatgaaatcgggtggggcaagaagctcagctacgtgattgcattttctaaggacgaggtcgtcgatgtgacttggagatatagctgtaagcatgaagaggtcatagctcggcgaactaaagttaaagaggccctgcttagagacactattaacggtctgaataagcaaagacagcttttcttgtctgaaaataggcgaaaagagctgctgcaacgtatcatcgtggaactggtagaattcatcagccccaagactcccaaacctggggaattaggtggccggattagcgggtctgtagcatggagagtggcccggggagaaatgggcctgcaaaggaaagagaccttgtttattccatgtgaaaatgagaaaatcagtaagcagctccatctctgttataacatcgttaaagaccggtatgtgagagtgtccaacaataatcaaacaattagtgggtgggaaaacggcgtctggaagatggaatcaatcttccgtaaggtggaaactgattggcacatgattactgtgtttacgcccatgctgatcttcctggtcccactgaaactgttctggaaacagaactag

SEQ ID NO: 197254 - DNA, 1839 bp, Artificial Sequence
  Description of Artificial Sequence: Synthetic coding sequence
atgcggaaccccaacgacgagaagtaccggagcatccggatcggcaacacagccttctccaccaggctgcttcccgttagaggtgccgttgagtgtctctttgagatgggttttgaggaaggagagacacacctgatcttccccaaaaaagcgtccgtggagcaacttcagaagatcagggatctgatcgcaatcgagagatctagtaggctggatggaagcaacaaatctcacaaagttaagtcgagtcagcaaccagcagcatcaacacagctccccacgacaccatccagtaacccatctggactgaaccagcacactagaaacagacaaggacaatcttcggatcccccgtccgcatctactgtggcggctgactccgccatcctcgaggtgttgcagagcaatattcagcatgtcctggtgtatgagaatcccgccctacaggaaaaagcgcttgcgtgcattcccgtgcaggagttgaagcgaaaaagccaggagaaactgtcccgggcccgaaagttggacaaaggcattaacatctcagatgaagactttctgcttcttgagttgcttcactggtttaaggaggagtttttccactgggtcaataacgttctgtgctccaagtgcggcgggcagactcgaagtcgagatcggtcactattaccgtccgacgacgagcttaaatggggggcaaaagaggttgaggatcactactgtgatgcgtgtcaatttagcaaccgttttccccggtataataacccagagaaactgcttgagactaggtgcgggaggtgcggtgagtgggctaactgttttaccttatgttgtagggccgtcggtttcgaggcccgctatgtgtgggattatactgaccatgtgtggacagaggtgtacagtccaagccagcagcgttggctgcattgcgacgcttgtgaggacgtgtgtgacaagccattgctatatgaaatcggatgggggaagaaattgtcatatgtcatcgccttcagcaaagatgaagtggtggatgtgacctggaggtattcctgcaaacatgaggaggtcattgctcgacgaacaaaggtgaaggaggccctcctcagggatactattaacggactgaataagcaaaggcaactatttctgtccgaaaatcggagaaaagaactgctgcagcgcatcatcgtggaacttgttgagttcattagccccaagacacccaagcccggcgaattgggtggtcgtatctcaggctctgtggcttggcgcgtggctagaggtgaaatgggactccagagaaaggagaccctgtttatcccatgcgagaacgaaaaaatcagcaagcagctccacctttgctacaatattgtgaaggatcgttacgtgagagtgtcaaacaataatcaaacaataagcggttgggagaatggggtctggaagatggagagcatattcaggaaggtggagacggactggcatatggtgtatttggctagaaaagaaggctctagttttgcgtatatctcatggaagtttgagtgcggcagtgtaggactgaaggtggacagtatctctatccgaacctcgtctcaaacatttcagactggaaccgtcgaatggaagctcagatccgatactgcgcaggttgagctgactggggataatagtctccactcttacgcggacttttcaggagcaacagaagtgatcctcgaagctgagttgtcaaggggcgatggcgatgtggcgtggcagcatacgcagcttttccgtcagtccctgaatgatcatgaggagaattgcttggagatcattattaagttcagcgatctgtag

SEQ ID NO: 197255 - DNA, 516 bp, Artificial Sequence
  Description of Artificial Sequence: Synthetic coding sequence
atgggcttcgaggagggcgagacccacctgatcttccccaagaaggcctctgtcgagcagctgcagaaaatcagggacctaatcgctattgaaagaagcagtaggcttgacggatccaataagtcccataaggtcaaatcatcccagcagccagcagcctcaactcagctcccaactacaccttcttctaacccttcgggactgaatcagcacactcgcaacagacagggacaatcatccgaccccccatccgcgtctaccgtggcggctgactcagccatcctcgaggtgttgcaatccaatatacagcacgtgttggtgtacgagaaccccgctctgcaagaaaaagccttggcttgcatcccagtgcaggagctgaaaagaaaatctcaggagaaactgtcacgggcacgaaagctggacaaggacataatcacgctgcggaacttttggaagcaagatgtagatggggttgccagtggccccatcgttcttcactgtgccgctgaactgtag

SEQ ID NO: 197256 - DNA, 1911 bp, Artificial Sequence
  Description of Artificial Sequence: Synthetic coding sequence
atggccgccgccgccctgggcagcagcagcggcagcgccagccccgccgtagccgaactctgccagaacacccccgaaacgtttctggaagcatctaagctccttctaacgtatgcggacaacatattgcggaatccgaatgatgagaaatacagatcgatcaggatcggcaacaccgctttctccactaggcttctccctgtccggggcgcagtagagtgcctctttgagatggggtttgaagagggcgagactcacctgatctttcccaagaaggccagtgtggaacagctccagaaaatccgcgacctgatcgcgattgagcgctcctcaagactcgacgggagcaacaaatctcacaaagtgaagagttctcaacagcctgctgcctcgacacaattgcctactacacctagctccaacccctcaggcttgaaccagcatacgcgtaatcgccaggggcagtcatctgaccccccatctgcaagcacggtcgctgcagacagcgcgattttggaagtccttcaaagtaatatccagcatgtgctcgtttatgagaatcctgccttgcaggaaaaggctctggcctgcattcccgtgcaggagttaaaacgcaaaagccaggagaagctgtccagggcgaggaagttggataagggaattaacatttctgatgaggactttctgcttttggagttactgcactggtttaaagaagagttctttcactgggtaaataatgtgctgtgctcaaaatgtggcggccagacacgaagccgcgacaggtccctcctcccgagcgatgatgaattgaaatggggtgcaaaagaagtggaagatcattactgcgacgcgtgccagttctctaaccgctttccaagatataacaatcccgaaaagctcttggagacccgatgcggccgatgtggtgagtgggctaactgttttacgctgtgttgtcgggctgtgggtttcgaagcccgctacgtgtgggactacaccgagctccaaaggacgctgtctctgaagttgaccactctcaaggagatagggaagacttttttgcggataagtaaacgacagaaactcattcaggtcgtcgacgtgacatggagatactcttgtaagcacgaggaagtgatcgcccgtcggaccaaggtaaaggaagcactgctgcgggatacaattaatggtcttaacaagcagcggcagctgttcttgagcgagaaccgcaggaaagagttgttacagagaatcattgtggaacttgtagagtttatcagcccgaaaaccccaaagccaggggaactgggcggtcgaatttccggcagcgtggcctggagagtggcaagaggagagatgggactccagcgaaaggagactttgtttatcccctgtgaaaacgaaaaaatcagtaaacagctgcatttgtgctataatattgtcaaagacagatatgtgagagtcagcaataacaatcaaaccatctctggttgggagaacggggtttggaagatggaaagtatcttccgcaaggtcgagacggattggcatatggtctacctggctcgcaaagaggggtcaagcttcgcctatatctcatggaagttcgagtgcggatccgtcggcctgaaggtcgactccatatcaataaggacctcctcgcagacctttcagacgggcactgtggaatggaagctcagatcagatactgcgcaagttgaactaacaggcgacaatagtctgcatagttacgcagatttcagtggagcaactgaagtaatccttgaagccgagctgagcagaggggatggcgatgtcgcttggcaacacacccagttgttccgtcaatccctgaacgatcacgaagaaaactgtttggaaatcataatcaagttctctgatctctag

SEQ ID NO: 197257 - DNA, 1188 bp, Artificial Sequence
  Description of Artificial Sequence: Synthetic coding sequence
atggccgccgaggccagcgagagcggccccgccctgcacgagctgatgcgggaagccgagatcagcttgctggaatgtaaggtctgctttgaaaaatttggacatcgccagcagcgacggccacgcaaccttagctgtggccatgtcgtgtgtctagcatgtgtggctgcccttgcccatccccgcacactggctctcgagtgtccattctgtcggcgggcctgccggggctgcgacacaagcgactgccttccagtgttacatctcatcgagttactgggcagcgcccttcgacagtccccggccgcccaccgtgccgccccgtccgcaccaggtgcactgacatgccatcacaccttcggtggatggggtacgttagtgaacccaaccggactcgctctgtgtccaaaaacgggcagggtcgtcgtggtgcacgacggtcggcggcgagtcaagattttcgactcaggtggcgggtgtgcacatcaattcggtgagaagggtgacgcagcccaggatatcaggtaccccgtggacgtcaccatcactaacgattgccatgtggtggtgaccgatgccggggaccgaagcattaaagtatttgatttcttcggacaaataaagctggtcattggcggccagttctccctcccttggggcgtcgagactacacctcagaatgggatcgttgttactgatgccgaggctgggagcctccacctcctagacgtcgactttgcggaaggggtgctgaggcggaccgagcgtctacaggcacacctctgtaatccccgtggggtggccgtgtcctggctgactggtgccatcgccgtcctcgagcatccactggccttaggaacaggggtgtgcagtacacgtgtgaaggtgttctcctcctcaatgcagttagtcggccaggtagataccttcggactgagcctgtactttcccagtaagattaccgcctccgcagtgacctttgaccatcaggggaacgttattgtagctgacaccagcggccctgccatcctgtgtctagggaaaccagaagagttccctgtccctaagcctatggtgacacatggcctgagccaccccgtggcacttaccttcacaaaagaaaacagcctcctcgtgctcgataccgcatcacacagtatcaaagtgtataaagttgactggggctag

SEQ ID NO: 197258 - DNA, 903 bp, Artificial Sequence
  Description of Artificial Sequence: Synthetic coding sequence
atggccgccgccgccggcgacgccgacgacgagccccggagcggccactcaagcagcgagggcgagtgtgctgttgcccctgagcctctgacagatgctgagggactgttttctttcgcagactttggttccgcactcggcggaggaggagctggcctgtctgggagagcctccgggggggcacagtccccgctacgctatctccacgtgttgtggcaacaggacgccgagccccgggatgaactgagatgcaagattccagccggaagactccgcagagccgccagaccgcatcgcagacttggcccaactggcaaggaagttcatgccctcaagagactgagagactccgctaatgccaacgacgttgaaaccgttcagcagctgctcgaggatggtgcggacccctgcgctgctgatgacaaagggcgtacagctctgcactttgcaagctgtaatgggaatgaccaaatcgtccaactgctcctggatcatggcgccgaccccaatcagagggacggcctgggcaacacacccttacatttagcagcgtgtacgaaccacgtgcctgtgatcaccaccttgcttcggggaggtgcccgggttgacgctctcgatcgagcgggacgtacacctctgcatctcgctaagtctaagctcaacatactgcaggagggtcacgcccagtgtcttgaggccgtgcgtctcgaggtgaaacagatcattcacatgttgcgtgagtatttggagaggctagggcagcatgaacagcgcgagcgcctggacgatttgtgtacacgcttgcagatgacttcaacgaaggaacaggttgacgaggtgaccgacctcctagccagctttacatctctttctttacaaatgcagtcaatggagaagaggtag

SEQ ID NO: 197259 - DNA, 387 bp, Artificial Sequence
  Description of Artificial Sequence: Synthetic coding sequence
atgaccgaggccgacgtgaaccccaaggcctaccccctggccgacgcccatcttaccaagaagctccttgatctggtgcagcaaagctgtaactacaagcaactgcgaaagggtgccaacgaggctacgaaaaccctcaaccgcgggatctctgaattcatagtaatggccgccgacgcggaacccctggaaatcatccttcacctgccactgctttgtgaagataaaaacgttccttacgttttcgttagatccaagcaggctctggggagagcttgcggcgtaagccgcccagtgatcgcctgttccgttactattaaagagggttcgcaactgaagcagcagatacagtctattcagcagtccattgaaaggttgctcgtatag

SEQ ID NO: 197260 - DNA, 387 bp, Artificial Sequence
  Description of Artificial Sequence: Synthetic coding sequence
atgaccgaggccgacgtgaaccccaaggcctaccccctggccgacgctcacctcaccaaaaagttgttagatctggtgcaacagtcgtgcaactacaaacagctacggaagggagccaatgaggcaacgaaaacgcttaaccgcggaatatccgaattcattgtcatggctgccgatgcggagcctctggaaatcatcttacaccttccactactgtgcgaagacaagaatgtgccctatgtttttgtaagatctaaacaggcgcttggcagagcctgcggagttagcaggccagtgattgcttgctccgtcaccatcaaagagggcagccaactcaagcagcaaatacagtctatccagcagtctatcgaacgcctcttagtgtag

SEQ ID NO: 197261 - DNA, 399 bp, Artificial Sequence
  Description of Artificial Sequence: Synthetic coding sequence
atgctgctggtgcagaccgaggccgacgtgaaccccaaggcctaccctttggcagacgcacacctgaccaaaaaactcttagacctcgtgcaacagtcctgtaattacaagcagttgaggaagggagcgaatgaggcaaccaagacactgaacagaggaatctctgagttcatcgtgatggccgccgatgcagagcccctcgagatcattttgcacctcccgctgctttgtgaggataagaatgtcccatacgtttttgttaggtccaagcaggctttaggcagggcatgtggcgtgagccgcccagttatcgcatgttctgtgactatcaaggagggcagccagctcaaacagcaaatacagtcaatccagcaatcaattgagcggctgctagtctag

SEQ ID NO: 197262 - DNA, 2130 bp, Artificial Sequence
  Description of Artificial Sequence: Synthetic coding sequence
atggccaccgccggcggcggcagcggcgccgaccccggcagccggggcctgctccggctgctgagcttttgtgttctactggcgggactgtgtagaggaaattctgtcgaaaggaagatctatattccactgaataaaacagcaccctgcgtacgcctgcttaacgccacccatcagattggatgtcagagtagcatttccggggacactggcgtaattcatgtggtcgagaaggaagaagacctgcagtgggtcctgacagacggacccaaccctccttacatggtgctgctcgaatctaagcacttcacccgcgatttaatggagaaactgaagggtcgaacaagccgtatcgccgggctagccgtgtcccttactaagcccagccccgctagcggatttagtccctcggtacagtgtcccaacgatggttttggagtgtactctaacagctacggccccgagttcgcccattgccgcgagatccagtggaattctctcggcaacggtctggcatacgaagattttagttttcctatttttctcttggaggatgagaacgaaaccaaagtcatcaagcagtgctaccaggaccacaatttgagccagaacggctcggcccccaccttccccctatgcgctatgcagctcttttcccacatgcacgcagttattagcacggctacttgtatgaggaggagctcaattcaaagtacattctcgatcaacccggaaattgtctgcgaccctctgtctgattataacgtctggtccatgttaaagcctataaacacaactggaacacttaaacccgacgatagagtggtggtagccgcaactcggcttgattcccgttctttcttctggaacgtggctccaggggctgaaagtgctgtggccagcttcgttacgcagttggcagccgctgaggccttgcaaaaggcacctgatgtgaccacactgccacgtaatgtaatgtttgttttcttccaaggcgaaacgtttgattacatcggctcttcaagaatggtttacgatatggagaagggcaaatttccggtgcagctggagaacgtggatagcttcgtggagttaggacaagtcgccttgagaaccagtcttgaactgtggatgcacacagaccctgtatctcagaaaaacgaaagcgtgaggaaccaggttgaggatcttctcgccaccctggaaaagagcggggccggggtgccggccgtcatacttcggcgccccaatcaaagccagcctttaccgccatctagcctgcaacgtttcttgagagccagaaacatatctggagtggttctggcggaccactctggggccttccacaataaatattatcaaagtatctacgatacggccgaaaacattaacgtatcgtacccggagtggcttagtcccgaggaggacttaaatttcgtgaccgacacagcaaaggcgctagctgatgttgctaccgtgctcggcagggccttgtacgagctggcagggggcacgaatttctccgatactgtccaggcagatccccagaccgtcactagattgctctacggctttctgataaaagctaataattcctggttccagtcaattctcaggcaggatctgcgtagctatctgggggacgggccactgcagcattacatcgctgtgtcctctccgactaataccacgtatgtggtgcaatatgcgctcgctaaccttactggaaccgtggtgaacctcactcgggagcaatgtcaggacccgtctaaagtcccctccgaaaacaaggacctgtacgagtacagttgggttcagggaccattgcatagtaatgagacagaccgccttcccagatgtgtgcggagcactgctcggttagcccgcgccttgtcaccagccttcgagctgagtcagtggtcatcaactgagtactccacgtggacagaatcaaggtggaaagacatcagggcacgaatttttctcattgcctccaaggagttggagctgattacgctcacagtcggtttcgggatcctcatttttagcctgatcgtcacttactgcattaatgcaaaagcagatgtgctgttcatcgctcccagagagcccggggccgttagctactag

SEQ ID NO: 197263 - DNA, 2070 bp, Artificial Sequence
  Description of Artificial Sequence: Synthetic coding sequence
atggacttcaacctgatcctggagagcctgtgccggggcaacagcgtcgagaggaaaatttatataccacttaataaaaccgccccctgcgtccggctactgaacgcaactcatcagataggttgccaaagctccatcagcggtgataccggcgtgattcatgttgtcgaaaaggaagaggacctgcaatgggtcctgactgatggacccaatccaccctatatggtcctcctcgagtcaaagcacttcacaagggacctcatggagaaactaaagggtaggacaagccgcatcgccgggctggcagtgagcctcaccaaaccaagtccggcctcaggattctccccatcagtacagtgtcctaatgatgggtttggagtatacagcaatagctacggaccagaatttgctcattgccgggaaatccaatggaactccctcggaaacgggttggcttacgaggatttcagcttcccaatatttctcttagaggacgagaatgaaaccaaagttataaagcagtgctaccaagatcacaacctgagccaaaacggttctgcaccaactttccctctgtgtgcaatgcagctcttctcccacatgcatgccgtgatctccacagctacttgcatgcgtagatctagtattcaaagcactttctctatcaatcctgagattgtttgtgatccactctccgattacaacgtatggtcaatgttgaagccaatcaataccacgggcaccttgaaaccggatgatagggtcgtcgtagctgccaccagactggacagcagatctttcttctggaacgtcgctccaggtgctgagtcagctgtagcgtcctttgttacccagctcgccgccgccgaggcactccagaaggctccggatgtgaccacgctcccccgcaatgtaatgtttgtctttttccagggagagacctttgactatattgggtccagccggatggtgtatgatatggagaagggcaaatttcccgtgcagttagagaacgtggactcattcgttgaactggggcaagtcgctctgcgaacctccttggaactgtggatgcataccgacccggtgtcccagaagaatgagtcagtccgcaaccaggtggaggacctcctggcaactctcgaaaagagtggagccggagtcccggccgtaattttgcggcggccgaatcagtctcagcccctgcctccgagttccctccaacggttcctcagagcgagaaacattagcggggttgtcctggctgatcatagtggcgcattccataataagtattatcagtcaatttacgatacagctgagaatatcaatgtctcatatcccgaatggctctcccctgaggaagatctcaatttcgtgacagacacagccaaagcactcgccgatgtggccactgtcttagggagagctctgtacgagcttgccggcggaacaaactttagtgataccgtgcaggctgaccctcaaacagtcacgcggctcctgtacgggttcttgataaaggctaacaactcatggtttcaaagcatactgcgacaggacttgaggagttatctgggcgatggccctctccaacactacatagctgtttcatcaccgaccaacaccacgtatgtggtgcaatatgctttggcaaatctgaccggaacagtggtaaatctgaccagagagcagtgtcaggatccttccaaagtcccttcagagaacaaggatctgtatgaatattcttgggttcagggccctttgcatagcaatgagactgacagactgccaaggtgcgtgagatctacagcccggcttgctagagctttgagccccgcattcgagttatcacagtggagtagcacagagtactcaacgtggaccgagtcccgctggaaggacataagggcacgaatcttcctcattgcttcaaaggagctggaactgatcacacttaccgtcggttttgggatccttatcttcagtctcatcgttacctattgcattaacgccaaagccgacgtactttttatagcaccgcgcgagcccggagcggtgtcatactag

SEQ ID NO: 197264 - DNA, 1356 bp, Artificial Sequence
  Description of Artificial Sequence: Synthetic coding sequence
atgctgaagcccatcaacaccaccggcaccctgaagcccgacgacagggtagtggtggccgcaaccagactggacagcaggtcgtttttttggaatgtagcccccggcgcggagtctgctgtggctagtttcgtcacacagctggcagccgcggaggccctccagaaagcaccggatgtgactacactacctcgaaacgtaatgtttgtcttcttccagggagaaacattcgactacatcgggagcagtaggatggtctacgatatggagaagggaaaattcccagtgcagctcgagaacgttgattcttttgtggagcttggacaagttgcattgcggacaagcctcgagctgtggatgcacacagatccggtgtcccaaaaaaacgagagcgtccgtaaccaggtcgaagacctccttgctaccttggaaaagagtggagcaggggtgccggccgtgatactgcgccggccaaaccagtcccagccactgccaccttcgagcctgcaaagattcctccgcgccaggaacatctccggcgtggtactcgccgatcactctggtgccttccacaacaagtactaccaaagtatctatgatactgctgagaacattaatgtatcctatcccgaatggctttcgcccgaagaagatttaaacttcgtaacagatacagctaaggcattggcagacgtcgctacagttctaggacgcgcattgtatgaattggctggcggtaccaatttctctgacaccgttcaagccgaccctcagaccgttacccggctgctgtatgggttcctgatcaaagccaacaatagctggtttcagtccattttgagacaggatctcagatcttacttgggcgatggacccctgcagcattatattgccgtcagctctcctacaaacactacttatgtggtgcagtacgcacttgcaaatttaactggcaccgtcgttaacctgactagagaacagtgccaggacccatcgaaggtgcctagtgaaaataaggacttatacgaatactcatgggtacagggacccctgcacagcaatgagaccgacaggctgccaagatgcgtccggagtacagcccgcctcgcaagggctttgagccccgcatttgagctgtctcagtggtcttccactgaatactctacatggacggagtccagatggaaggacattagggctcgtatcttcctcattgccagtaaggagttagagctgataacattgaccgtcgggttcggaattttgatcttctcgctgattgtaacatactgcatcaacgccaaagcagacgtcctgtttatcgcgccccgtgagccgggcgctgttagctattag

SEQ ID NO: 197265 - DNA, 918 bp, Artificial Sequence
  Description of Artificial Sequence: Synthetic coding sequence
atgctgaagcccatcaacaccaccggcaccctgaagcccgacgacagagtcgtggtggcggcgaccaggctggatagccgcagtttcttttggaatgtggcacccggagccgaaagcgccgttgcctcttttgtgacgcagttggctgccgctgaggctcttcagaaggcgccagacgtgacaacgctaccccggaacgtgatgttcgtattcttccaaggcgtggctctgcgtactagcttggaactgtggatgcacacagatcctgtctcccagaaaaacgagtctgtgagaaatcaggtggaagacttactggccacgcttgaaaaatccggagcaggggtgccagcagtaattctccggcggcctaatcagtcccagcctctgcctccttcctcgctgcagaggtttctgagggccagaaacatatccggggttgtactagcagaccactccggggccttccataacaagtattaccagtctatctacgataccgccgagaatataaacgtgagctaccctgagtggctcagtccagaagaagaccttaattttgtaaccgatacagcaaaggcactcgccgatgtcgctacagtcttgggccgtgctctgtacgagctggcaggtggcaccaatttctcggacaccgtacaagctgacccccagactgtgactaggctgctctatggttttctcataaaggcgaacaactcctggttccagtccatactcaggcaagacttgagatcctatctgggagacgggcccctgcagcattacatcgctgtgagctctcccacgaataccacttacgttgtgcagtacgccctcgccaatctcacaggaaccgtcgtcaacctaactagagagcagtgtcaggatccatcaaaggtgccctccgagaataaagactag

SEQ ID NO: 197266 - DNA, 2070 bp, Artificial Sequence
  Description of Artificial Sequence: Synthetic coding sequence
atggacttcaacctgatcctggagagcctgtgccggggcaacagcgtggagcgaaaaatctacatacccctcaataagacagctccttgcgtccgcctgctgaacgccacccaccagatcgggtgtcagagcagcatctctggggacacaggagtgatccacgtggtcgagaaggaggaagacctacagtgggtgctgactgatggcccgaatcctccttacatggttttattggaatccaaacacttcactagggacctcatggagaagctcaagggccgtactagtaggatcgctggtctggcagtaagtctgactaagccaagtcccgcctctggtttttctccatccgttcagtgcccaaatgacggcttcggagtgtattcaaatagctatggacctgaattcgcccactgtagagagatacaatggaacagcctaggcaacggactcgcctacgaagacttctcgtttcctatctttctgctggaggatgagaacgagaccaaggtaatcaaacagtgttatcaggaccataatctgagccagaacggttccgccccgaccttccctctttgcgcaatgcaactgttcagtcatatgcacgccgtgatctcaaccgcaacgtgtatgcgtcggagctccattcagtccaccttttctataaatccggagattgtttgtgacccgctgtccgactacaacgtgtggagcatgctcaagccaatcaatactaccggtacactcaaaccggatgatcgggttgtggtggccgcgacccgtttagattcgagaagcttcttctggaacgtcgctccaggagccgaatcagccgttgcatcattcgtgactcaattggccgctgccgaggcactacagaaggctcccgacgtgactactttgcctcgcaacgtaatgtttgtgttcttccagggggagaccttcgattatattgggtcctcccgaatggtttacgatatggagaaggggaaatttccagtgcagctggaaaatgtggatagcttcgtcgagctgggacaggttgcattgcgcacatcccttgagctatggatgcacacggacccagtttcacagaagaatgagtctgtccggaatcaagtcgaagatctgctggcgacccttgaaaagtccggggctggggttccagcagtcattctacggcggcccaaccagtctcagcctctgccgcccagttcactgcagcgatttttgagagcccggaacatcagtggcgtggtgctggctgatcacagtggtgctttccataacaagtactaccaatcgatctacgacaccgccgagaacatcaacgtcagctaccccgaatggctgagcccagaagaggacctgaacttcgtgactgatactgctaaggctcttgccgacgtagcgaccgtgctggggcgggctctgtacgaactggctggcggcacaaacttttccgataccgtccaggctgatccgcagacagtgacacgcctgctgtacggctttctcatcaaagcgaataactcgtggtttcagagcatcctccgccaagacctgcgcagttatttgggcgacggccctttgcagcactatatcgcggttagtagtcccactaacacaacttatgtcgtgcaatatgctttggcaaatctgacaggaacagtggtcaacctgacccgcgaacaatgccaagacccctctaaagtgccttcagagaacaaagacctgtacgagtacagttgggtgcagggaccactccacagcaatgaaacagacaggctgccacggtgcgtcagatcaacagccagacttgcgcgggctctaagcccagctttcgaactgagtcagtggtcctctactgaatattcgacttggacagagtcccgatggaaggacatccgggcgagaatcttcctgatagcatcaaaagagttggagctgatcacactcaccgtggggttcggcatccttattttctcattaatcgtgacctactgtattaatgcaaaggctgacgtgcttttcatcgcgccacgggagccgggcgctgtctcttactag

SEQ ID NO: 197267 - DNA, 768 bp, Artificial Sequence
  Description of Artificial Sequence: Synthetic coding sequence
atggccaccgccggcggcggcagcggcgccgaccccggcagccggggcctgcttagattgctttccttctgcgttctcctggcggggctgtgccggggaaattcagtggagagaaagatttacatccccctgaataagaccgctccctgtgtcaggctgttaaacgctacacatcagattggctgccaatctagcattagtggtgacacaggagtcattcacgtggtagagaaggaagaggacttgcagtgggtgctgaccgacgggcccaatcccccttacatggtgctgcttgaatcgaagcacttcaccagggacctcatggagaagctgaaagggcggacgagcagaatcgctggccttgcagtgtcactgactaaaccatcaccagcctcaggcttttctccctctgtgcagtgtcccaatgacggatttggtgtttactcaaatagctacggtccagagtttgcccactgccgggaaatccagtggaactcgttaggaaatgggctggcatacgaagactttagcttccctatattccttctggaggatgaaaacgagactaaggtcatcaagcaggaaacatttgactatatcgggagctcaaggatggtatacgatatggaaaaggggaagttccctgttcagctggaaaatgtcgatagctttgttgaattagggcaggtagctctgcggacctcactagagctgtggatgcacactgaccctgtcagtcagaagaacgagtccgtccggaatcagtag

SEQ ID NO: 197268 - DNA, 963 bp, Artificial Sequence
  Description of Artificial Sequence: Synthetic coding sequence
tgaggcttcggcgtgtacagcaacagctacggccccgagttcgcccactgtagagagatacagtggaactctctcggcaatggtctggcgtatgaagatttctcttttccgatctttcttctggaagatgagaatgaaacgaaagtgattaagcagttattttcacatatgcatgcagtgatttcaaccgctacatgtatgagacgtagctctattcagtccacgtttagtattaatcccgagattgtctgcgacccactgagtgattacaacgtatggtcgatgttaaagcccatcaacaccacagggaccttaaaacccgatgacagagtggtggttgctgctaccaggcttgattcaaggagttttttctggaacgtggcacccggggctgagtcagcggtggcctcctttgtaactcagcttgcggctgcggaagccttacagaaagctccagacgtaaccactcttcccaggaatgtgatgttcgtgtttttccaaggagagaccttcgattatatcggcagctctcgcatggtctacgatatggaaaagggcaaatttcccgtgcagctcgaaaacgtggacagtttcgtggaactaggccaggtcgcactcaggacatctctggaactgtggatgcataccgatccagtctctcagaagaacgaaagtgtgcggaaccaagttgaggaccttctggctacactagagaaatccggggcaggagttccggctgtcattcttagaagacccaatcaatctcaaccattgcccccctccagcctgcagcgttttctcagggcacgcaacatctcgggagttgtgctggccgaccattcgggcgccttccataataagtattaccagtctatttacgatacagccgagaatattaacgtcagctaccctgaatggctgtcacccgaggaggacctgaattttgtcacagataccgcctag

SEQ ID NO: 197269 - DNA, 660 bp, Artificial Sequence
  Description of Artificial Sequence: Synthetic coding sequence
cggagcagcatccagagcaccttcagcatcaaccccgagatcgtgtgcgacccacttagcgattataatgtctggtccatgctcaagccaatcaatacaactggcaccctgaagccagacgaccgcgtggtcgtagctgccaccagacttgcagctgcagaggccctacaaaaagcgcccgacgttactactctcccaaggaacgtgatgtttgtgttctttcagggcgaaaccttcgactacatcgggtcctcccgcatggtgtacgacatggagaagggaaagttccccgtccagcttgagaatgttgactcgtttgtcgaactcggacaggtggctctgcggacgtctctagaactctggatgcacacagacccagttagtcaaaagaatgaaagcgttagaaaccaagtggaagatctcctggccaccctcgaaaaatctggtgccggagtgcccgccgtaatactaaggaggccaaaccagtctcagccactcccgccaagctcactgcagcgattcttgagagctcgcaatattagcggcgtcgtgctggcagaccactctggagcattccacaacaaatattatcaaagcatatatgacaccgcagagaacatcaatgtatcctaccccgagtggttgagtcccgaagagtag

SEQ ID NO: 197270 - DNA, 828 bp, Artificial Sequence
  Description of Artificial Sequence: Synthetic coding sequence
tgaaacgtggcccccggcgccgagagcgccgtggccagcttcgtgacgcagctggcagccgccgaggcattacagaaggcacctgacgtgacaaccctccctaggaacgtcatgttcgtgttcttccaaggcgtggctcttaggacctcactggaattatggatgcacaccgatccagtgtcacagaagaacgagtccgtgagaaaccaggtggaagaccttttggcgacgctcgagaagtctggcgcaggagtgcctgctgtgattctacggcggccaaaccaaagtcagcctctcccaccaagctcgctgcagaggtttttgcgcgcacgcaacatctctggcgttgtgctcgcagaccattcaggggcttttcataataagtattatcagtctatctacgacactgccgagaacattaatgtcagttacccggagtggctgtcaccggaagaggatcttaacttcgtcacagataccgcaaaggcactggcagacgttgccacagtcctgggtagggccttgtacgagctggccggcggcactaacttcagcgacacagtgcaggctgatccccaaacggtgacacgcctgctctacggattcctcataaaagccaataacagttggttccagtctattctgcgccaagatttgcgatcttatctgggagatggccctctccagcattacattgctgtctctagtcccactaacactacgtacgtggtgcagtacgccctggctaacctaaccgggactgtagtcaatctaactagggaacaatgtcaggatccctctaaagtgcctagtgaaaacaaggattag

SEQ ID NO: 197271 - DNA, 405 bp, Artificial Sequence
  Description of Artificial Sequence: Synthetic coding sequence
atggccaccgccggcggcggcagcggcgccgaccccggcagccgggggctgctacggctactatctttctgtgtgctgttggccgggttgtgccgagggaactccgtggagaggaaaatttacatccctctgaataaaaccgccccgtgtgtccgcctgctgaacgcaacacatcagataggttgccagtcatccatttctggagacacaggcgtgatacacgtcgtcgaaaaggaggaagatctgcagtgggtgctcaccgacgggcccaatccgccttatatggtactccttgagtctaaacactttacgaggcagaacgtgcgcctgagtgatacttttctgtgcagcttcatggaatttttgtcttatagccgtgacctcatggagaaactgaagggatag

SEQ ID NO: 197272 - DNA, 699 bp, Artificial Sequence
  Description of Artificial Sequence: Synthetic coding sequence
atggccaccgccggcggcggcagcggcgccgaccccggcagccggggactgctccgacttttatcgttctgcgtattgttggcgggtttgtttctagactttgaaccagaccctctacctctgtgcccggacgtctctttttttccccaaccccaaccacctactccacagtcaaagggcactggcctgtgccgcgggaattccgtggagcgaaaaatctacatcccactcaacaaaactgcaccctgcgtcaggcttttgaacgccacccaccaaatcggatgtcagtctagcataagtggcgatactggcgtgatccatgtggttgagaaagaggaggacttacagtgggtcctcaccgacggtcctaatcctccctatatggtgctgcttgagagcaaacacttcacaagagaccttatggagaaactgaaagggcggacctccagaatcgcaggcctggccgtgagtcttacgaagccttcccccgcgagtgggttcagtccgtccgttcaatgcccgaatgatggcttcggagtgtattcaaatagctacgggcccgaatttgcacattgtcgggagattcagtggaattcccttggcaatgggctcgcctatgaggactttagcttccccatctttctgttggaagacgaaaatgaaacaaaggtgatcaaacagtgttaccaggatcactag

SEQ ID NO: 197273 - DNA, 1716 bp, Artificial Sequence
  Description of Artificial Sequence: Synthetic coding sequence
atggccaccgccggcggcggcagcggcgccgaccccggcagccggggacttctgaggctgctgagtttctgcgtgcttctggctggattgtgcaggggaaacagcgtggaaaggaagatctacattccactcaacaagaccgcgccttgcgtgcgtcttttgaacgcaactcatcagatcggctgccagtcttctatttctggtgacactggtgtgattcacgttgttgagaaagaagaggacctacagtgggtactgaccgacggccctaacccaccttacatggtactacttgagagcaagcacttcacccgagatcttatggaaaagctgaaagggcgcaccagtaggatcgctgggctcgccgtctccttgaccaagccgtcgcctgcttctggctttagcccctccgtgcagtgccctaatgatggtttcggcgtgtatagcaatagctatgggccagaattcgcccactgtcgagagatccagtggaattctctcgggaatgggttggcttatgaggacttcagcttccccatcttcttgctcgaagacgagaacgaaacaaaggttattaagcaggaaactttcgattacataggcagcagcagaatggtctacgacatggagaagggtaaatttcctgtgcagctcgagaacgtcgactctttcgtcgagctcggccaagtggctctgcgcactagccttgaactgtggatgcacaccgacccagttagccagaaaaacgagtctgtgaggaaccaggtagaagatcttctggccacactggagaagagcggcgcgggggtgcccgccgtcattctgcgccgccctaaccagtctcagcccctgccaccttcttccctgcagcgcttccttagagccaggaatatctccggcgtcgtcctggcggatcactctggagcattccacaataagtattatcaaagcatttatgatacagctgaaaacattaatgtgtcataccccgagtggctcagtccagaggaggacctgaacttcgtaaccgataccgccaaggccttagcagacgtcgccacggtattaggtcgggctttgtacgaattggcaggaggaacgaactttagcgacaccgtgcaggcagatccccagacagtaacacgactgctgtatggctttctcatcaaagctaacaatagctggtttcaatccatacttcggcaggacctgagaagttatctgggcgatggccccctacagcattacattgcggtgtcctcacccacaaatacgacctatgttgtgcagtacgccctcgctaatcttactgggaccgtcgtaaatctaacaagggagcagtgtcaagatccgtccaaggtacccagtgagaacaaagacttgtatgaatacagctgggtgcagggacctctgcacagtaacgaaacagaccgtttaccccgctgcgtaaggtctaccgctcgacttgcgcgggccctgagtcccgcgtttgagctgtcccaatggtctagcacggaatattccacctggaccgagagcagatggaaagacatcagggctagaatctttttaattgcgagcaaagagctcgaattaattacattgacagtgggattcggaattttgattttcagtttaatcgttacgtattgtataaatgccaaagcggatgttctattcatcgccccccgggagccgggagccgtctcctactag

SEQ ID NO: 197274 - DNA, 642 bp, Artificial Sequence
  Description of Artificial Sequence: Synthetic coding sequence
atgagccgggtgctggtgccctgccacgtgaagggcagcgtggccttacaagtcggggacgtgagaactagccagggccggccaggcgttctagtaattgatgtgacatttcccagtgtggcgcccttcgagctgcaggagatcacatttaaaaactactatacagcattcctatcaatcagagtcagacagtacacttccgctcacaccccagccaaatgggtcacatgcttaagagattattgtttgatgccagacccacacagtgaagaaggcgcacaggagtatgtgtctctgttcaagcatcagatgctctgtgatatggcacggatctccgagcttcgcctgattttacggcaaccaagcccactgtggttgagctttaccgttgaggagttacagatttaccaacagggtcccaaatctccctcagtgacttttcctaaatggctgagtcaccccgtgccatgtgaacaacctgccctcctaagggagggcctgccagacccctcacgcgtctcttcagaggttcagcagatgtgggcacttaccgagatgatacgggctagtcatacctcagcccggattggtcgcttcgatgtggatggctgttatgacctgaaccttctgagttacacctag

SEQ ID NO: 197275 - DNA, 642 bp, Artificial Sequence
  Description of Artificial Sequence: Synthetic coding sequence
atgagccgggtgctggtgccctgccacgtgaagggcagcgtggccttgcaggtaggcgacgtgcgcacgtcacaggggagacccggggttctggttatcgatgtcacctttcctagcgtggcgccgtttgagctgcaagagatcacattcaagaattactataccgctttcctcagcatccgggtgagacagtatacatctgcccacacacctgccaagtgggtcacctgtctgcgggattattgcttgatgccagaccctcacagcgaggagggcgcccaggagtatgtctcactatttaagcaccagatgttgtgtgacatggcccggatctccgagctaaggctgatcctgagacagcctagccccctgtggttatcatttactgtggaggaactccagatctatcaacagggacccaaatctccctcagtgacattccccaaatggctttcacatcctgttccatgtgagcaaccagcgcttctcagggagggcctgcccgatccgagccgggtgtcatctgaagtccagcagatgtgggctctgacagagatgatcagagcctctcacacaagcgcccgcatagggaggttcgatgtcgacgggtgctatgatcttaacctgctaagctacacatag

SEQ ID NO: 197276 - DNA, 528 bp, Artificial Sequence
  Description of Artificial Sequence: Synthetic coding sequence
atgagccgggtgctggtgccctgccacgtgaagggcagcgtggccctgcaggtgggcgacgtgagaacatcccagggacgccccggggtgctggtcattgatgtgacgttcccgagcgtggctcctttcgaactgcaggagatcacctttaaaaactattacactgctttcctctctattcgggtcagacagtatacttctgcccatactccagccaagtgggtcacttgcctgcgggattactgtctaatgccagacccccacagcgaggaaggcgcccaggaatacgttagtctgttcaagcaccaaagcccaagcgttaccttccccaagtggctttcacaccctgtgccttgcgagcagcccgcacttttgcgagagggattgccagatcccagcagggtttccagcgaagtgcagcaaatgtgggcactgaccgagatgatccgtgcatcccacacctctgctcggattggccgattcgatgtcgatggatgttacgacctgaatctgctcagttacacttag

SEQ ID NO: 197277 - DNA, 795 bp, Artificial Sequence
  Description of Artificial Sequence: Synthetic coding sequence
atggagagcggcttcaccagcaaggacacctacctgagccacttcaatccgcgggattacttggagaaatactacaaattcggctccagacatagtgccgagagccagatactgaaacaccttcttaagaacctgttcaaaatcttctgtttggatggagttaaaggggatctcctcatcgacatcggatccggccctacaatataccaattgctgagcgcatgcgaaagcttcaaagaaatagtggtaacagattactcggaccagaatctgcaggaactggaaaaatggttaaagaaagaacccgaagccttcgattggagcccagtggttacatatgtgtgcgatttagagggcaacagggtaaaaggtcccgaaaaagaagagaagctcagacaggctgtgaaacaggtactcaagtgtgacgttacacagtctcaaccactgggcgcggtgcccctgcctcctgcagactgcgtactgtcaaccctgtgcctcgacgcggcttgcccagaccttcccacctattgtcgagcactgcgtaacctgggatccctcctgaagcctggcggtttcctggtcatcatggatgccctcaagtccagttattacatgatcggtgaacagaaattttcctctctgcccctcggacgggaagccgtcgaagccgctgttaaggaggctggatatacaatcgagtggttcgaggtaatatcacagtcatactctagcactatggcaaacaatgagggcctgttctcactcgtcgctaggaagctatccaggcccctgtag

SEQ ID NO: 197278 - DNA, 795 bp, Artificial Sequence
  Description of Artificial Sequence: Synthetic coding sequence
atggagagcggcttcaccagcaaggacacctacctgagccacttcaacccccgtgattatttggagaagtattataaattcggcagtagacactctgccgaatctcaaatcctcaagcacctcctcaaaaacttgttcaagattttttgccttgatggggtgaagggggatcttctaatcgatattgggagtggccctacaatctatcagctgctatccgcctgtgagtccttcaaagagatcgtcgttacagactattccgaccagaacttgcaggagcttgagaagtggttaaaaaaggagcctgaagctttcgactggagccccgtggtgacatacgtatgcgatcttgagggtaatagggtaaaagggcctgaaaaggaggaaaagctgagacaggccgtgaagcaggtattaaaatgtgacgttactcagagtcagcccctaggcgctgtgccgcttcccccagccgattgtgtgctgtcaactctctgtttagacgctgcctgccccgacttacccacctactgccgggccctgcgcaatctcgggagcttattaaagcccggagggttcctggtcatcatggacgcacttaaatcttcatattacatgatcggcgaacagaaattttcaagcctgcccttgggtagggaagccgtggaggccgcagttaaggaagctggctatactatagaatggttcgaagtcattagccagtcatactcgtcaactatggcgaataatgaaggactgttttcactggtagccagaaaactctctaggcccttgtag

SEQ ID NO: 197279 - DNA, 759 bp, Artificial Sequence
  Description of Artificial Sequence: Synthetic coding sequence
atgaagagccggatccccgtggtgctgctggcctgcggcagcttcaatcctattacaaatatgcatctgcgaatgtttgaagttgccagagaccacctccaccagacaggaatgtatcaagtgatccagggcattataagccccgtcaacgacacctacgggaagaaagatctcgccgctagtcatcaccgggtagccatggctcggttagctctccagacatctgactggatccgcgtcgacccctgggagtcagaacaagcccagtggatggagaccgttaaggtcttgagacaccatcatagcaagttgctgaggtcgccccctcagatggagggtccggatcatggcaaggccctgttttcaactcccgctgccgtgcccgaactcaagctcctctgtggtgccgatgtcctgaagacttttcagactcctaacctgtggaaggacgcgcatattcaggagatagtagagaagttcggtttagtttgcgtcggcagggtgggacatgaccccaagggctacattgccgaatcccccattttaaggatgcaccaacataatatccatctcgctaaagagcctgtgcagaatgaaatcagtgcaacatacatccggcgggcactggggcagggacaaagtgtgaaatacctcatccctgatgcagtaataacgtatattaaggaccatggactatatacaaagggctcaacatggaaaggaaagtccacacagagtaccgaaggcaagaccagctag

SEQ ID NO: 197280 - DNA, 648 bp, Artificial Sequence
  Description of Artificial Sequence: Synthetic coding sequence
atgtaccaggtgatccagggcatcatcagccccgtgaacgacacctatggaaaaaaggacttagccgcatcgcatcaccgtgtggccatggctagacttgccctccaaactagcgattggatcagagtcgacccctgggagtccgagcaagcacagtggatggaaacagttaaagtgctgcgacaccatcattccaagctcttaagatcccccccccagatggaaggccccgaccacgggaaagctctgttttccacgccagccgctgtgcctgagctcaaactcctatgtggggccgatgtccttaagaccttccagacacccaacctctggaaagacgcgcatatccaggagatcgtggaaaaatttggactggtgtgtgtggggcgcgtggggcacgatcccaaagggtatattgcggaaagtcctatcctgaggatgcaccagcacaacattcacttagcaaaggagcccgtgcaaaatgagatcagcgcaacgtacatcaggcgcgctctcggtcaggggcagtcagtcaagtatctcatccctgatgccgtgataacgtatatcaaagaccacggactctacaccaaaggttcaacctggaaaggcaagagcacgcagagtacagaaggcaagacctcctag

SEQ ID NO: 197281 - DNA, 648 bp, Artificial Sequence
  Description of Artificial Sequence: Synthetic coding sequence
atgtaccaggtgatccagggcatcatcagccccgtgaacgacacctacgggaaaaaagaccttgctgccagccatcaccgtgtggcaatggcacgcttggcccttcagacgagcgattggatccgagtcgatccatgggaaagtgaacaggctcaatggatggagacagtgaaggtcttgaggcaccatcactccaagctgctgaggtctcctccacagatggagggccccgaccacggcaaggccctattctctacacctgcagctgtgcctgaacttaaactcctctgtggtgcagacgtcctaaagacattccagacgccaaatctgtggaaggatgctcacattcaagaaattgtggagaagttcggtcttgtgtgcgtaggccgtgttggccacgatcctaagggttacatagctgaatctcccatcctccgcatgcaccaacacaacatacatctggcgaaggaaccagtgcaaaatgagatatccgccacttacatcaggagggctctgggccaggggcagtccgtgaagtacctgatcccagacgccgtgatcacctacattaaagaccacgggctatatacgaaaggcagcacctggaagggcaagagtacacagagtactgaaggaaaaacctcttag

SEQ ID NO: 197282 - DNA, 429 bp, Artificial Sequence
  Description of Artificial Sequence: Synthetic coding sequence
atggagggccccgaccacggcaaggccctgttcagcacccccgccgcagtcccagaattgaagcttctgtgcggagcagatgtactgaagacattccagacccctaatctgtggaaagatgcacacatacaagagattgtggaaaagtttggtctggtgtgcgtgggccgcgtgggtcacgatcctaagggctatattgctgagagccctattcttaggatgcaccaacataatattcatctggccaaggaaccagttcagaacgaaattagtgccacatacatccggcgggccttaggacagggccaatccgtgaaatatttaataccggacgccgttatcacctacatcaaggaccacggcttatacactaaggggtctacatggaaggggaaatctacacaatccacggaaggcaaaactagctag

SEQ ID NO: 197283 - DNA, 345 bp, Artificial Sequence
  Description of Artificial Sequence: Synthetic coding sequence
atgaagagccggatccccgtggtgctgctggcctgcggcagcttcaacccaattactaatatgcacctccggatgtttgaggttgcccgcgatcatttgcaccaaaccggcatgtaccaggttatccaggggattatctctccagtcaacgatacctacggcaagaaggatctggcggcctctcaccacagggtcgccatggccagacttgctctccagactagcgattggatacgggtggatccttgggagtcagagcaagcccagtggatggaaacagtcaaagtcctcagacatcatcattccaagctgcttcgctccccacctcagatggaggggccctag

SEQ ID NO: 197284 - DNA, 492 bp, Artificial Sequence
  Description of Artificial Sequence: Synthetic coding sequence
atgaagagccggatccccgtggtgctgctggcctgcggcagcttcaatccaatcaccaatatgcacttaagaatgttcgaggtagctcgggatcatctccaccagacggcggtgccagagctcaagctgctatgtggtgctgatgtgctgaaaaccttccaaacacctaatctctggaaggatgcccatattcaagagatcgtcgagaagtttggcttagtgtgcgtcgggcgggtcgggcacgatccgaaaggatatatagcagaatcaccgatattgcggatgcaccaacacaatattcatcttgcaaaggaaccagttcagaatgagatttccgcaacttacattcggcgagctcttgggcagggccagtccgtgaagtacctcatccccgatgcagtgatcacttacatcaaggaccacgggttgtatacgaaaggatctacatggaaaggaaagtccacacagagcactgagggtaaaactagttag

SEQ ID NO: 197285 - DNA, 3261 bp, Artificial Sequence
  Description of Artificial Sequence: Synthetic coding sequence
atggccaacctgctgaagaccgtggtgaccggctgcagctgcccccttctgtccaacttaggctcatgtaagggccttcgcgtcaagaaggattttctgcgtaccttctacacccaccaggagctgtggtgtaaggcaccagtaaagccaggaatcccctataaacaattgaccgtgggggtgcccaaggagatctttcagaatgagaagcgggtagcgctttcaccggcaggcgttcagaacctggtgaaacaaggtttcaacgtcgtggtggagagcggtgcaggcgaggcctctaaattctccgatgatcattatagggtggctggggcccagattcagggggccaaagaggtgctcgcaagcgacttagttgttaaggttcgcgccccaatggtcaaccctaccttgggcgtccatgaggccgacctgctgaagacatccggtactttgatctccttcatctaccctgcccagaaccctgagttattaaataagctgtcccagcgaaaaactaccgtcctcgccatggaccaagtcccacgagtgaccatagctcagggatatgacgcgctttcctccatggctaacatcgctggttataaggcagtggtgctcgcagcaaaccatttcgggaggtttttcactggccaaatcacggccgctggcaaggttccacctgcgaagatcctcattgtgggagggggagtggctgggctcgcttcagctggtgccgctaagtccatgggggccattgtgcggggctttgacacccgggctgccgccctggaacagtttaagtctctgggcgctgagcccctggaagtggacctgaaagagtctggcgagggccaaggcggctatgcaaaggaaatgtctaaagagttcatcgaggcggaaatgaagctgttcgcccaacagtgtaaggaggtcgatatcctgatttccaccgcccttatccccgggaaaaaagccccagtgctgttcaacaaagaaatgatcgaaagcatgaaggaaggcagtgtggtcgtggacctagccgccgaggcaggtggcaattttgagacaaccaagcctggtgagctgtatatccataaggggattacacacatcggttacaccgatctcccgtccagaatggctacacaagcatccactctctacagtaacaatataaccaagctattgaaagctatttcaccagataaggataacttttacttcgatgtgaaggatgattttgacttcggaaccatgggccacgttatcagaggcacagtggtgatgaaggacggcaaggtgatatttccagctcctacccctaagaatatcccccaaggcgcgcctgtgaagcagaaaaccgtggccgaactggaggcagaaaaggccgctacgatcaccccgttccgcaagactatgagcacagcctccgcctataccgcaggtttgactgggattctgggccttggcatagcagcgccaaatctggcatttagccagatggtgaccacattcgggctcgcaggcatcgtaggataccacaccgtttggggcgttacccccgctctgcacagccctctaatgtcagtgactaacgctatctctggccttaccgcagtcggcggcttggccctaatgggaggacacttgtacccaagcactacctcccagggactggccgccttagccgccttcatttcttcagtgaatatcgccggtggcttccttgtgacccaaaggatgctggacatgttcaaaaggcctaccgatccgcccgaatataactacctctatttactgccagccggcacgttcgttggcggttatctggcggcactctattccggatacaacattgagcagatcatgtatcttggctcaggactctgctgtgtcggtgcactggcaggactcagcactcagggcaccgcaaggctcggcaatgccctggggatgatcggtgtggcggggggcttggcagctactctaggagtgctgaaacccggtcctgagctgctggcacagatgtcaggcgcgatggcgctgggcggcaccatcggtttgactatagccaagcggatacagatctcagatctcccacaactcgtggccgcttttcacagtttggtcgggttggccgcagttctcacgtgtattgcggaatatataattgaatacccacatttcgctaccgatgccgccgcaaatttgaccaaaatcgttgcatatctcggcacttacatcggcggtgtcacattctctgggagccttatcgcatacggcaagctgcagggattgctcaaaagcgcaccacttcttctgcctggccgccatctgctcaatgcagggctgctggccgcctccgtgggcggcattatcccatttatggttgacccaagtttcaccactggcatcacttgcctgggttccgtttcggccttgtcagctgtaatgggagtgaccctgacagcagccattggtggggccgatatgcctgtagtgatcacagttctgaacagttattcaggttgggcgttgtgcgccgagggctttcttcttaacaataacctattgaccatcgttggcgctctgatcggaagtagcggcgccattttgtcatacataatgtgtgtcgccatgaacagaagccttgctaacgtcattctgggcgggtatggcactacatctaccgcaggcgggaagcctatggagatctctgggacacacacagaaattaacctggacaacgccatagatatgattcgtgaggctaactcaataattatcactccagggtacggtctgtgcgcggctaaggcgcaatatcccatcgctgaccttgttaaaatgctgaccgaacaaggaaagaaagtgcgcttcgggatccaccccgtggccggaaggatgccggggcagctgaacgtgctgctggcagaggccggagtaccctatgacatcgtactcgagatggacgagattaaccatgacttccccgatacagacttggttttggttatcggcgctaatgatacagtgaattcagctgcccaggaagatcccaattccatcatcgcaggaatgcctgtcctggaggtgtggaaatctaagcaggtaatagtgatgaaaagaagcctgggcgtcgggtacgccgcagtggacaatcccatcttctataagcccaacaccgccatgttactgggagacgccaaaaaaacttgtgacgctctgcaggcgaaagtgcgggagtcgtaccaaaagtag

SEQ ID NO: 197286 - DNA, 3261 bp, Artificial Sequence
  Description of Artificial Sequence: Synthetic coding sequence
atggccaacctgctgaagaccgtggtgaccggctgcagctgccccctgctgtctaatttaggtagctgtaagggactgagagtgaagaaagattttctgagaaccttttacacccaccaggaactgtggtgcaaggcacccgtcaagcccggaatcccgtacaagcagctgactgttggagtgcctaaagagatcttccagaacgagaaacgcgtggcgctcagccccgctggagtgcagaatttagtgaaacaggggtttaacgttgtcgtggaatcgggagctggcgaagcaagcaagtttagcgatgaccactaccgggtggcaggagctcaaatacagggagcaaaggaggtgctggcttcagacttggtagttaaagtgcgggcaccaatggtgaaccctaccctgggagtgcatgaagcagatttgctgaaaacaagcgggacactgattagcttcatctaccctgctcagaaccccgaactgctgaacaagctgagccagcgcaagactaccgtgctggccatggatcaggttcctcgcgttacaatagcacagggctacgatgcattatcatccatggctaatatcgcgggctataaggcagtcgttttggccgcgaatcactttggacgcttctttaccggacagatcactgccgccggcaaggttccccctgccaagattctgatcgtcggggggggagtcgccggcctcgccagtgctggcgccgccaaaagcatgggggccatcgtcagaggctttgacactagggcagcagccctcgagcaatttaagagcctgggtgccgaacccctggaagtggacctgaaggagtctggagaggggcaggggggatatgcaaaggaaatgtccaaagagtttatcgaagccgagatgaagctattcgcacagcagtgtaaagaggttgatattctgatctccactgcgctgatccccgggaaaaaggcacctgtactgtttaacaaagaaatgatcgagtcgatgaaagagggttctgtagtggtggacctggctgctgaggccggaggaaactttgagactactaaacctggggagttgtacatccacaaaggcattacccatatcggatatactgacctgccatctcggatggccacacaagcctccaccctttactccaataatattactaagctcctaaaggctatctctcccgacaaagataacttctacttcgacgtgaaggatgactttgacttcggaactatgggacatgtcatccgaggaactgtggtgatgaaggatggtaaagtgatcttccccgctccaacgcctaaaaatatcccacagggtgcacccgtcaagcagaaaactgtggctgagctagaggcagagaaggcagcaacgatcacgcccttcaggaaaactatgtctacagccagcgcctataccgcaggactaacaggtatcctgggtttgggaattgcggcccccaacctcgccttctcacagatggtcaccaccttcggcctggctgggatagtcggttatcacacagtatggggggtgactcccgccctgcattcccccctgatgtcagttactaacgctatatccgggctcacagcggttggtgggctcgccttaatgggtggccatctttacccctccacaactagccaagggctcgccgctttggcagcatttatttccagtgtgaacattgccgggggcttcctggtaacccagcgaatgctcgatatgttcaagagaccaacagacccccccgagtacaactacctgtacttgctcccggctggaacctttgtcggcggatatctagctgccctctattctgggtataacatcgagcagatcatgtacttagggagcgggctgtgttgtgtgggggcccttgcgggactgtccactcagggaacggctaggctcggaaatgcattaggtatgatcggcgtggccggcggcttagctgcgaccctcggcgtacttaagcccgggccagagctgctagctcagatgtcaggcgcaatggccctgggcggaaccatcggtttgaccatagctaaacgaatccaaatatccgacctgccacagctggtcgccgccttccactccttagtgggtctcgccgcagtgcttacatgtatcgcagagtatatcatcgaatatcctcatttcgcgacggacgcagccgctaatttgacaaagatagttgcctacctggggacatatattggaggcgttactttctccgggagtctgattgcatacggcaagctccagggcctgttaaaaagcgcccctctgctgctgcccggtagacatcttttaaacgcaggcctcctcgcggcctctgtgggcggcatcatcccctttatggtggacccatccttcactactggaatcacatgtctggggagtgttagcgccctctcagctgtaatgggagtgaccttaactgctgcaataggaggcgcagacatgcccgtcgtgattacagttctgaacagctactcaggctgggctctgtgcgctgaaggctttctgctcaataacaatttgctgaccatcgtcggcgcactaataggcagttcgggggccattctgtcttatataatgtgcgtggccatgaaccggtcactcgccaatgtcatcctaggggggtatgggaccactagcaccgcgggtggaaagcccatggaaatctctggcactcatacggaaattaatctggacaacgccattgacatgatccgcgaggctaatagcatcatcataacccctggttacggcctgtgtgccgcgaaggcccaatacccaattgccgatctggtgaagatgctgaccgagcagggaaaaaaggtcagatttggaattcatcctgtagcagggcgcatgcctggccagctgaacgtccttcttgccgaggcaggagtgccctacgacattgtactggagatggatgagataaatcatgactttccagacacagacttggtgttggtcataggcgcgaatgacacagttaactccgctgcacaggaagatcccaactcaataatcgctggtatgcccgtactggaggtttggaaatccaagcaggtaatcgtgatgaaaagatcattgggggtgggctatgcagcagttgataaccctatcttctataaacctaatacagctatgctgctgggtgatgcaaaaaagacttgcgatgcattgcaggctaaagttcgggagtcctatcagaagtag

SEQ ID NO: 197287 - DNA, 600 bp, Artificial Sequence
  Description of Artificial Sequence: Synthetic coding sequence
atggccaacctgctgaagaccgtggtgaccggctgcagctgccccttgctctcaaatcttggatcttgtaaaggcctgagggtcaagaaagacttcttgaggaccttctacacccaccaggaactgtggtgtaaggctccagtcaagccggggattccctataagcagctgacagtaggggttcctaaagagatctttcagaacgaaaagcgggtagccctgtctccggccggagtgcagaaccttgttaagcagggatttaacgtagtggtggaatctggggcaggcgaagcaagcaagtttagcgacgatcactatagggtcgccggtgcacagatacagggggctaaggaggtgcttgctagcgacctggttgtgaaggtgagagcccctatggtgaaccctaccttaggcgtgcacgaagccgacctgctgaagacctctgggaccctgatcagctttatttatcctgcccagaatccggagctcctgaataagctgtcacagcgaaagaccaccgtcctagcaatggaccaagtacccagagtcactatagcccaggggtacgacgccctgagttccatggccaatatcgcatag

SEQ ID NO: 197288 - DNA, 654 bp, Artificial Sequence
  Description of Artificial Sequence: Synthetic coding sequence
atggccaacctgctgaagaccgtggtgaccggctgcagctgccccctgttgtctaacctggggtcctgcaagggcctgcgagttaagaaggacttcctgagaacgttctacacgcatcaagaactgtggtgcaaggctccagttaagcctggaatcccttacaagcagctgacggtgggagtgcctaaagagatattccaaaacgagaagcgtgtggccctgtcccctgcaggcgtccaaaaccttgtgaagcagggattcaatgtcgttgtggagtccggggccggcgaggcttcaaagtttagtgacgaccattatcgggtggctggtgcacagatccagggagccaaagaagtcctggcctcggatctcgtggtcaaggtgagggcaccaatggtgaaccccactttgggggtgcacgaggcggacctcctcaaaacaagcggcacccttataagtttcatttaccccgcgcagaacccagagcttctcaataaactttctcagcggaaaactactgtcttggctatggatcaggtgccaagggtgacgatcgcccaggggtacgacgctctgtcctccatggctaacatagccggctataaggccgtggttctggccgccaatcatttcggaagatttttcactggttag

SEQ ID NO: 197289 - DNA, 1806 bp, Artificial Sequence
  Description of Artificial Sequence: Synthetic coding sequence
atgctgagctggaaccgggtgcgggccaagctgcccagcagccagatggtcaccacctttggcttggccggtatcgtgggatatcacacagtttggggggttacaccggccctgcacagtcctctgatgtcagtcactaacgctatcagcgggctgacagcggtgggcgggcttgctcttatgggcggacatctctacccctcaacgacatcccaaggacttgcagctctggccgcatttatcagctctgtgaatatagccggcggtttcctggtgacacagaggatgctggatatgttcaagcgacccactgaccctccagaatataattatctatatttgcttcccgccggcaccttcgtcggcggataccttgcagccctctactcaggctacaatattgagcagattatgtacctgggctccggtttgtgttgcgtgggagcactggccggactgtcaactcagggcacagccaggctcgggaacgcactcggaatgatcggggtagcggggggtctggccgccactctgggcgtgcttaagccagggcccgagttgctggcacaaatgtccggggccatggccctgggcgggacgattggactgacaatcgccaaaagaatccagatctctgatttaccacaactcgtggcggcctttcacagccttgtgggactggcagctgttttgacctgtatagccgagtatatcatcgagtatccgcattttgctaccgacgcagccgccaatctgacgaagatagtagcgtatctcggaacctatatcggcggagttacattttctggaagcctcatcgcatacggcaagttacagggcctgctgaaatcagccccactgcttctccccggtagacacttgctgaatgcaggattgctcgctgccagtgtgggtggaattatcccttttatggttgatccgtcctttaccaccgggatcacttgccttgggtcagtttccgctctctctgctgtgatgggtgtgaccctcacagccgcaatcggcggtgcggacatgccggtcgtcattactgtcctgaattcctacagtggctgggcactttgtgctgagggtttcctgctgaacaacaacttgttaacaatcgtgggagcacttattggctctagtggggcaatcctgtcgtacattatgtgtgtggctatgaaccggtctcttgccaacgtcatcttaggcggctacggaaccacctccacagccgggggcaaaccaatggaaatctccggtacacacactgaaatcaacctggacaacgccattgatatgatccgcgaagctaacagtataatcattactcccggatacggcctatgcgcagctaaagctcaatatcccatcgctgatctggtaaagatgctaacagagcagggcaaaaaagtacgcttcggtatccatccagtcgccggccggatgcccggacagttgaatgtgctgctggctgaagctggcgtaccctacgacattgtcctggagatggacgaaattaaccatgatttcccggatacggatttggtgctggtcatcggagcgaacgacacggtgaactctgctgcgcaggaagatcccaattccattattgcggggatgcccgttttggaggtctggaaaagtaagcaggttattgtaatgaagagatccctgggggtgggatacgcggcagtcgataacccgatcttttacaagcctaacaccgcgatgcttcttggggatgccaaaaagacttgtgacgccctgcaggcgaaggtgcgcgaaagttaccaaaagtag

SEQ ID NO: 197290 - DNA, 357 bp, Artificial Sequence
  Description of Artificial Sequence: Synthetic coding sequence
atgcggcgggccggcctgggcgagggcgtgccccccggcaactacggcaattacggttacgctaattccggttactctgcctgcgaagaagagaatgagaggctgacggaatccttacgatctaaagtgacggccattaaatccctgagcattgagatcggccacgaagttaaaacacagaacaagctgctcgccgaaatggacagtcagttcgactctaccaccggctttctgggcaaaactatggggaagctcaaaattcttagccgcgggtctcaaactaaactcttatgttatatgatgcttttctctctcttcgtgttctttattatttactggattataaaattacgctag

SEQ ID NO: 197291 - DNA, 1107 bp, Artificial Sequence
  Description of Artificial Sequence: Synthetic coding sequence
atgaaccccgccgccgaggccgagttcaacatcctgctggccaccgactcttacaaagtcacccattataagcagtacccccctaataccagcaaggtgtattcttattttgaatgcagagagaaaaaaactgagaatagtaagctgcgaaaagtgaagtacgaagaaaccgttttctatgggctgcaatatatcttaaataaatatttgaagggaaaggtcgtgacgaaagaaaagatccaggaggccaaggacgtgtataaggaacactttcaggacgacgtatttaatgagaaggggtggaactacatcctggagaaatatgatggccatttacctatcgaaatcaaggctgtcccagaggggttcgttatcccccggggaaatgtccttttcaccgtggagaataccgaccccgagtgttactggctgacgaattggatcgaaacaatcttggtccagtcttggtacccaattaccgtggcaacaaactctagagaacagaagaagatcctggccaagtacttgctcgagacatcgggtaacctggacggtttagaatataagctgcatgactttgggtaccggggcgtctcctcccaggagacggccggaattggtgcaagtgcccacctggtgaactttaaaggaaccgacaccgtggccgggctggcattgatcaaaaaatactatgggactaaggatcccgtgcctggctactcagttccagccgccgaacatagtacaattaccgcctggggcaaagaccacgagaaggatgcgttcgagcacatcgtgacccaattcagttcagtgcctgtgtctgtcgtgtccgattcatatgacatatacaatgcttgtgagaagatctggggcgaggacctgaggcatttaatcgtatccaggtccacccaggcgccccttattatacggccagattccggcaaccccctcgacactgtacttaaggtgctggagatactggggaaaaaatttcctgtcaccgagaactcaaagggctataagctcctgcccccttacttgagggtgattcagggggacggagtggacattaatacactacaggaagtgtgcgtgctttactag

SEQ ID NO: 197292 - DNA, 183 bp, Artificial Sequence
  Description of Artificial Sequence: Synthetic coding sequence
atgaaccccgccgccgaggccgagttcaacatcctgctggccaccgacagctacaaagtaacccattacaagcagtaccccccaaatacgtccaaagtctactcgtatttcgagtgccgagaaaagaagaccgagaatagtaagctgcgcaaggtgaaatacgaagagaccgtgttttactag

SEQ ID NO: 197293 - DNA, 267 bp, Artificial Sequence
  Description of Artificial Sequence: Synthetic coding sequence
atgaaccccgccgccgaggccgagttcaacatcctgctggccaccgattcttataaagtcacccattataaacaatacccgccaaacacatccaaggtctattcttattttgaatgccgcgagaaaaagacagagaattccaaactccggaaagtgaaatatgaagaaactgttttttacggactgcagtatattctcaacaaatatctaaaaggcaaggttgtcacaaaagaaaaaattcaggaagcgaaggacgtttataagtag

SEQ ID NO: 197294 - DNA, 1701 bp, Artificial Sequence
  Description of Artificial Sequence: Synthetic coding sequence
atggccgccgagcaggaccccgaggcccgggccgccgcccggcccctactgacggatttgtatcaagcgacgatggcccttgggtattggagagcaggaagggcaagagacgcggctgaattcgagttattcttcaggagatgtccgttcgggggcgcattcgccctcgcggccgggttaagagactgcgttcgcttccttagagctttccgactacgggatgctgatgtgcagtttctagcctccgtgctgccaccagacacagaccctgctttcttcgagcatcttcgggctctggattgttccgaagtgactgttagagctctcccagaagggtctctggcatttccaggcgttccactactgcaggtgtccggacctctgctggtagttcagcttctggaaactcctttactctgcctcgtctcctacgcaagcctggtggccacgaacgcggcaagactccgattaatcgccggccctgagaagcgtctcttagaaatgggtttaaggcgagcccaaggccctgatggtggcctcactgccagcacgtactcttacttggggggttttgactcctcttccaatgtcctggccgggcaactgcggggtgtgccggtagccggcacgctggctcatagcttcgtcacctcattctccggaagtgaagtcccgccggatcccatgctcgcacccgccgctggggaagggccgggtgtcgaccttgctgccaaggcccaagtctggctcgaacaggtgtgtgctcacctagggctgggggtccaggaaccacatccgggggagcgagccgcatttgtggcttacgcactcgcatttcctcgcgcgttccaggggctgcttgacacatattccgtttggcgcagcggactgcctaactttctggctgtcgctctggcgctcggcgaattgggataccgggccgtcggagttaggctagattccggtgatctgcttcagcaggcccaagaaattcgtaaagtgttccgcgccgccgcggcacagttccaggtaccctggctggagtctgtgctcatcgtggtgtctaacaatattgatgaggaagctctcgcccgacttgcccaggagggatccgaagtgaacgtgatcggcattggcacatctgtcgtgacctgcccacaacagcccagccttgggggagtttacaaattagtcgctgttggaggtcagccccgaatgaagctgaccgaggatccagagaagcagactctgcccggctctaaggccgcttttaggttactgggtagtgatgggtcccctttgatggacatgctgcagttagcagaggagcctgtcccacaggctggtcaagagttacgcgtctggccgcccggagcccaggagccatgcaccgtacgacccgcgcaagtggaacctctcctcagactctgtctgcaacaaggccagctttgcgagccgttgcccagcctggctgagtcgcgtgccctcgcacagctgtcactcagtaggctgtcaccagagcaccggcgtttgcggtcccctgcccagtaccaggtgggtggcggccccccatgccattccgcactttgcgcaccggctctgaccctccccaccgcacctgttttatgctccctccaagtggtactgtctgagagattacaggccctcgttaactccctctgtgctggacagagcccatag

SEQ ID NO: 197295 - DNA, 1578 bp, Artificial Sequence
  Description of Artificial Sequence: Synthetic coding sequence
atggccgccgagcaggaccccgaggcccgggccgccgcccggcccctcctaaccgacctctaccaagctacaatggcattagggtattggagggccggcagggctagagatgccgcagagttcgaacttttcttccggaggtgccctttcggcggtgcgttcgcacttgccgccgggcttcgcgactgtgtgcggtttttaagggcttttcgactgagagacgctgatgtacaattcctggcttctgtgctgccgcccgatactgaccctgccttctttgaacatctgcgtgcactggactgctccgaggttacagtccgcgccctgcctgaaggctccctggctttcccaggggtgcctctcttgcaggtaagcggccccttgctggttgtgcagctgctcgagacccccctcctgtgtctggtgtcttatgcaagcctggttgccacaaacgccgcacgattgagactcatcgccggccccgaaaaacgtcttctcgaaatgggattgcgtcgggctcaagggccagacggaggcttgactgcaagtacctacagttatctgggtggttttgattcttcgtctaacgtgctggctggacagctgcgaggagtgccagtggccggcacactggcccactctttcgtaactagcttcagcggaagcgaagtcccaccggatcctatgctggcccctgccgctggcgagggaccaggggtcgatctcgcagctaaggctcaggtctggctagagcaggtttgtgctcatctgggattaggcgtgcaggagcctcatcctggggagcgcgcagccttcgtcgcctatgcattagcttttccccgcgcctttcaagggctactcgacacctactccgtgtggagaagcgggctccctaatttcctggcggtggcccttgctttaggagaactgggatatagggccgtgggggtccgcctggacagtggtgatctactgcaacaggcccaggagatccgcaaagtgtttcgggccgctgctgcccagtttcaggttccttggttggagtctgtgctgatcgtagtctctaacaacattgatgaagaagctctggctcggctggcacaggagggcagcgaggtgaacgttataggcatcgggactagcgtcgttacatgcccgcaacagccgtctctgggaggggtgtataagctagtggccgtgggcggacagcccaggatgaagctaactgaagaccctgaaaaacaaacactccctggttcgaaggctgctttcaggttgttgggctccgacggctcccctctgatggacatgcttcagctggccgaggaacctgttccgcaagccggtcaggaactacgagtgtggccccctggcgcccaggaaccatgtactgtgaggccagcccagctgtgcgagcctctgccctcacttgccgaatctcgcgctctcgctcagctgagcctgtctaggctgagtccggaacacaggcggctcaggtcaccggctcagtaccaagttgtcctcagcgaaaggctgcaggccttggtcaattccttgtgcgccggccagtcaccttag

SEQ ID NO: 197296 - DNA, 1473 bp, Artificial Sequence
  Description of Artificial Sequence: Synthetic coding sequence
atggccgccgagcaggaccccgaggcccgggccgccgcccggcccttgttaactgacctatatcaagcgaccatggcccttgggtattggagggccggacgtgctcgggatgctgccgagtttgagctgttcttccgtagatgtccctttggcggtgcttttgccctggcagcgggcctgagggattgtgtacgtttccttagagcatttcggctgcgtgatgcagacgtccagttcctagcctctgtgcttcctcccgatacggacccagcgtttttcgaacatctcagggcactcgactgcagcgaagtaaccgtgcgggccctgccagaaggcagcctggccttccccggcgtccccctcttgcaagtctcggggcctcttctggtcgtccaactgctcgaaacccctctgttgtgcctggtgagctatgcctcactggtggcaactaacgccgctcgacttcggctaatcgccgggcctgagaaacggctgctcgaaatgggactacggagagcacagggcccagatggaggcctgactgccagtacatatagttacttaggaggcttcgatagctcctcaaatgtccttgccgggcaactccgaggagtcccggtggccgggacactggcgcattctttcgtgacaagcttctccggcagcgaagtgcctcctgatccaatgcttgcccccgcggccggggaggggccaggtgtagatctggcggccaaggcgcaggtttggttggaacaagtctgtgcacacttgggtctcggagtacaggaaccgcacccgggggagagggcagcctttgttgcctacgccctcgcgttccccagagcctttcagggtttgttggacacctactctgtttggagatctggcctgcctaatttccttgccgtggcccttgccctcggagaactcggatatagagccgtaggagttcgattagactccggcgacctgctgcaacaggcacaggaaattcgaaaggtgtttcgcgcagcagccgctcagtttcaagtaccttggctggagtcagtcctgattgtggtctctaataatattgatgaagaggctctcgcccgtctcgcccaggaggggagtgaggtaaacgtcatagggattggaacatcagtcgtgacatgcccccaacagccaagcctcgggggcgtgtacaagttggtagccgttggtggacagccgcgcatgaagttgaccgaggatccagagaaacagacactgcccggatcgaaggcagcttttagacttttgggaagcgacggctccccgctgatggacatgttacagctcgccgaggaacctgtgccccaggcgggccaggaattgagggtttggcctccaggcgctcaggaaccatgcaccgtgcgtccagcccaggtggaaccactattaaggctttgcctgcagcagggccaggtcgccgcacctcctccgagttcttag

SEQ ID NO: 197297 - DNA, 1617 bp, Artificial Sequence
  Description of Artificial Sequence: Synthetic coding sequence
atggccgccgagcaggaccccgaggcccgggccgccgcccggcccctgttgaccgatctgtatcaagcaacaatggccctcggttactggcgggcggggcgggcccgggacgccgccgaatttgagctgttctttcgtcggtgtccctttgggggagcatttgctttagctgcaggcctgcgagactgtgtgcgcttcctccgggcctttaggttgcgcgacgcggacgtccagtttctggcaagtgtccttcccccagacacggaccccgcgtttttcgagcaccttcgtgccctggactgttctgaggtgaccgttagagctttgcctgaaggttccctcgctttcccaggtgtccccctccttcaggtgtcaggacccctgctggtcgtgcaactcctggaaaccccattattatgtctcgtcagctatgcatccttggtggctactaatgcagcacggctgcgtttgatagccggccccgagaaaagattgttagaaatgggattgcggcgggctcagggtcctgatggggggctcaccgcctctacttactcatacctcgggggcttcgacagttcctccaatgttctggctgggcaactgagaggggtgcctgtggccggcactctggcacatagctttgtgacttctttttccggttctgaagtgccacctgacccgatgctcgctcccgcagctggcgaagggcccggagtggacctagcagcgaaggcacaggtgtggctggagcaggtctgtgctcacttggggctcggtgtacaggagcctcaccccggtgaaagagctgcctttgttgcctacgctcttgcctttccaagagcatttcaggggcttcttgacacatattccgtatggcgcagtgggctgccgaacttcctagccgtcgcactcgccctgggcgagctggggtaccgagctgtcggcgtacgattggacagcggcgaccttctccagcaggcacaggagatccgaaaggtgtttcgggctgccgcagctcagttccaggtgccttggttggagtctgtgctgatcgtcgtgtctaataatatagatgaggaagcactggcgagactggcgcaggagggctccgaggtcaacgtgatcggcattggcacctccgtcgtcacatgtccacagcagcctagtttgggtggtgtttataagctagtagccgtggggggacagccaaggatgaagctcacggaggacccagagaaacagacgttacccggttccaaagctgccttcaggttgcttggcagcgacggctcccccttgatggacatgttgcagctcgctgaggaaccagttccacaagccggtcaagaactgcgcgtgtggccgccgggagcacaggagccatgtactgtgcgccctgcacaggtcgaaccccttctgcgcctctgccttcagcagggacagctgtgcgagccgctcccatccttggctgagtctagggcgttagcccagctctcattaagtcggttgtctccagagcacagacgcttacggtcacccgctcagtaccaggttgtgctgagtgaacggttacaggcactggtgaattctctctgcgcaggacagagcccgtag

SEQ ID NO: 197298 - DNA, 2199 bp, Artificial Sequence
  Description of Artificial Sequence: Synthetic coding sequence
atgcccgaggagacccagacccaggaccagcccatggaggaggaggaggtcgaaacttttgcttttcaagctgaaatcgctcagctgatgagcctgatcataaacaccttctatagcaataaggagatcttcctccgagaactaatctctaactcatctgatgcactggataagattaggtatgagagcttaaccgacccctccaagcttgactcgggaaaagagctccacattaatctgatacctaataagcaggatcgaaccttgacaatcgttgatactggcatcgggatgacaaaggccgacctgattaataatctcgggacaatcgcaaaaagcggtacaaaggcctttatggaagccctacaggcaggggccgacatttcaatgataggacagtttggggttggattttactcagcctacctggtggccgaaaaggtcacagtgataaccaagcacaacgacgatgagcagtatgcatgggaatccagcgctggaggatcctttacggtcaggacagatactggggagcccatgggcagagggacaaaagtgatcctgcacctcaaggaagaccagacagaatatctcgaagaaaggcgcatcaaagagatcgtaaagaagcacagccagttcataggttatcccattaccctgtttgtcgagaaagagcgagacaaagaagtgtctgatgatgaagcagaggagaaagaggataaagaggaggagaaagagaaggaagaaaaggagtctgaggacaaacctgaaattgaggatgtggggtcagatgaagaagaggaaaagaaagatggagacaaaaagaagaagaagaagataaaagagaagtacatagatcaggaggaactaaacaaaacaaaaccaatatggaccagaaatcccgatgatattactaacgaagaatatggagagttttacaagtctttaaccaacgattgggaagaccacttggccgtgaagcacttctcggtggagggacagctggaatttcgggcacttctgtttgtgcctcgtagagctccctttgacctgttcgagaatcgaaagaagaaaaataacattaagttgtatgtgcgccgagtctttattatggataactgtgaggagctcataccggaatatttaaatttcattcggggcgttgtagactctgaggacctgcccctgaacatttccagggagatgttacagcagagcaagattctcaaggtaatcagaaagaatttggtgaagaagtgtttggaactgttcacagaactagccgaggataaagagaactataagaagttttacgagcagtttagcaagaatattaaactgggcatccacgaagacagccagaatagaaagaaactgtcggagctgcttcggtattacacctcggcttcaggagatgagatggtgtctctaaaggattactgcacaaggatgaaggaaaaccagaaacatatctactatatcacgggcgaaacaaaagatcaggtcgcgaacagcgcgttcgtcgaacggctgcgaaaacacggcttggaggtgatttacatgatagagcccatcgatgagtattgcgttcagcagctgaaggaattcgaagggaagaccctagtgtccgtaacgaaagaaggcctggaattgcctgaggatgaggaagaaaaaaaaaagcaagaggagaagaaaaccaagttcgagaatctgtgtaaaatcatgaaggacattctggaaaaaaaagtcgagaaggtcgtagtgtcgaatagactggtgactagcccttgctgcattgtgacctcaacctacggatggacagcaaatatggagagaatcatgaaggcccaagcgctccgcgataactcaactatggggtatatggcagcgaagaaacacctggagattaatccggaccattccattattgagaccctgcgccaaaaagcagaagccgataaaaatgataagtctgttaaggacttggttatcctgttgtacgagactgctctcctgtcttcaggttttagtcttgaagacccgcagacacacgccaatagaatctacagaatgatcaagttaggtctgggcatagatgaggatgaccctaccgcggacgacacatccgctgccgtcactgaagagatgcctcccctggaaggcgacgatgacacgtcccggatggaagaagtggattag

SEQ ID NO: 197299 - DNA, 2910 bp, Artificial Sequence
  Description of Artificial Sequence: Synthetic coding sequence
atggagggcgaccgggtggccggccggcccgtgctgagcagcctgccagtcttgttgctactgccgctgttgatgctacgggcggctgctctgcacccagatgagctgtttcctcacggcgagagctggggtgatcagctcctgcaggaaggtgatgatgagtcatccgccgttgtgaaactcgccaaccctttgcatttctatgaggcccggtttagcaacctctacgttggcaccaacggcattatttcgacacaggacttcccccgggaaacccaatacgtcgactacgattttcctaccgactttccagcaatcgctccttttctcgccgacattgatactagtcatggaagaggcagggtgctatatcgcgtaaatggaaaagtctcaggacacttgcacgtcgggcatacccctgtccacttcactgatgtggacctgcatgcatatatcgttggcaatgacggcagggcctacactgcgatctcacatatcccccagccggcagctcaggcgttgctccccttgacccccatcggtggcctgtttgggtggctgttcgccctcgagaaacccggctcggagaacggctttagcttggcgggcgctgctttcacacacgacatggaggtaaccttttacccgggagaggagactgtgcgtatcacccagacagctgaggggctagacccagagaactacctgtccatcaaaaccaacatccagggccaagtgccttacgtctcagctaacttcaccgctcatatatctccttataaggagctgtaccactacagcgattccaccgtgacatctactagttcccgagactactccctgacatttggcgcaatcaatcagacatggtcttataggatccatcagaacatcacataccaagtatgtaggcacgctccacgtcatccatcttttcccaccacccagcaactcaacgtcgatcgggtcttcgctttgtacaacgatgaggaacgtgtgctgcgcttcgccgtgactaatcaaataggccctgtgaaagaggattctgatccaactcctggtaacccctgctatgatggaagccacatgtgtgataccaccgccagatgtcaccccggaactggggtggattacacctgcgaatgcgcatccggttaccaaggcgacgggcggaactgtgttgacgagaacgaatgcgctacaggattccaccggtgcgggccaaactccgtgtgcatcaacctgcctggtagctaccggtgcgagtgcagaagcggttatgagttcgcagacgaccgacatacatgcattctaatcacgcctccagcaaacccctgtgaagatggcagtcatacttgcgcacccgcaggccaggcgcgttgtgtgcaccacggaggaagtacgtttagttgcgcctgcctgccagggtatgccggtgatggtcatcagtgcacagatgttgacgagtgcagcgaaaataggtgccaccctgccgcaacttgctacaatacgcctgggagctttagctgtaggtgtcaacctgggtattatggagatggttttcagtgcattccagacagtactagttccctcacaccctgcgagcagcagcaacgccatgcccaggcacagtacgcataccctggagctagatttcacattccacagtgcgatgagcaagggaactttcttcccttacagtgccatgggagtacagggttctgttggtgtgtagatcctgatggtcatgaagtcccaggcacacagactcccccaggaagtacacccccacactgtgggccaagcccagaacctacccagagaccccccaccatctgcgagcgatggagagagaacctgttggagcattacggaggcactccccgcgacgaccagtatgtgccccaatgtgatgacctcggtcacttcatccccttgcagtgtcacggcaagagtgacttctgctggtgtgtagataaagacggccgggaagtgcaagggactaggtcccagccagggacaacaccagcctgcatccccaccgtggccccacctatggtgcgacctacgcccagacctgatgtgaccccgccttccgtgggcacattccttctgtatactcaggggcagcagattggctacctgcctctcaacggcaccaggctccaaaaggatgctgccaaaacgctcttatcgctccatgggtcaattattgtgggaattgactacgactgccgggagaggatggtgtactggactgacgtggcaggcagaaccatatctagagctggactggagcttggagccgaaccagaaactatcgtgaactcaggcctcataagcccggaggggttggccatcgaccacatccgaaggacgatgtattggaccgactcggtgctcgacaaaatcgagagtgcactgttggacgggtccgagagaaaagtacttttttacaccgatttagtgaacccacgcgccatcgcagtagatccaatcaggggtaatctgtattggaccgattggaaccgagaggctcccaagatcgagacatccagcctggatggagagaaccgcaggatcctgatcaataccgatatcgggctgccaaacggactgacctttgatcctttctcaaaactgctctgctgggccgacgctggaaccaagaaactggagtgtaccctcccagatggaaccggcagaagggtaatacagaacaacctcaaataccccttcagtattgttagctacgcagaccacttttaccacactgattggcgacgcgacggcgttgtgtctgtgaataagcactcggggcagttcaccgatgagtatcttcccgagcagcgcagccatctctatgggatcactgctgtatacccctactgtccgaccggaagaaagtag

SEQ ID NO: 197300 - DNA, 3543 bp, Artificial Sequence
  Description of Artificial Sequence: Synthetic coding sequence
accccccagaccgagcggatcacccacagcagcatcagctggagcttcctgcttagattttccaggggcaagctgctgatgctgcgtgctgctgctctccacccagacgagctctttccacacggggaaagttggggagatcagctccttcaggagggcgacgacgagtcttctgctgtcgtgaagctggctaatcctttgcacttctacgaagcccggttctccaatctgtacgtcggcacgaacggtatcatctctacacaggacttccctcgggagacacagtacgtcgactatgacttccccaccgacttcccagccatcgctccatttcttgctgacatcgatacctcccacggcagaggccgcgtcctttatagagaggacacctctccagccgtgctagggttggccgcccgttatgtccgcgctgggttcccaagaagcgcaagatttaccccaactcatgctttcctcgccacctgggaacaggtgggcgcatacgaggaggtgaaacggggcgcgctgcccagtggcgaactgaacacgttccaagctgttttggcctccgacggttctgactcttatgcgctctttctctacccagcaaatggactgcagtttttaggcacacggccgaaagagtcatataatgtgcaactgcagttacctgcccgggtgggattttgtagaggtgaggcagacgatctgaaatcagagggcccatactttagcctgacctcgaccgagcagagcgttaagaatctgtatcagttgtccaatctgggaataccaggagtgtgggccttccatatcggttcgacctctcctttagataacgtgcggcccgccgctgtgggcgatctgtctgccgctcattcctcggtgccactggggcgctcattcagccatgccacggctctcgagtcagactataacgaggacaacttggactattatgacgtgaatgaggaagaggccgagtacctgcccggcgagcccgaggaagccctgaatggacatagttcaatcgacgtctcattccagtcaaaagttgacaccaagcccctggaagaaagtagcactctggacccccataccaaggagggaactagtctcggcgaggtgggagggccagacctgaaaggccaggtggagccttgggacgagcgagagacacgctcacctgcaccccctgaggtagacagggactcgctggccccctcttgggagacgccccctccttatcctgaaaatgggagcattcagccttaccccgatggcggaccggtgccttccgagatggatgtgccaccagcacatcctgaggaagaaattgtgctgagaagctatcccgccagtggtcatacaacgccactttccagagggacctacgaagtggggctcgaagacaatattggcagcaacacagaagtgtttacatacaacgcagcaaataaggaaacctgtgagcacaatcaccggcagtgctctcgccacgcattctgtacagattatgctacagggttctgctgtcactgccagtctaagttctatgggaacgggaagcactgcctccctgaaggcgcgccccacagagtcaatggcaaagtgtcgggacacctgcatgtcggccacaccccggttcactttacagatgtggacctccacgcatatatagtcggaaatgatgggagagcatataccgccatctctcacattccccaacccgcagctcaggctcttcttccccttactccaattggtggactgtttggatggctcttcgccttggaaaaacctggcagtgagaacgggttctcactcgctggggctgcctttacgcacgatatggaggttaccttctacccaggcgaagaaactgttcggatcacacagaccgctgagggtctggaccctgagaattacctctccattaagaccaacatacagggccaggtgccttatgtgtcggcaaatttcaccgcccacatttcaccctataaagagttgtaccactattcagattctacagtcacatctacatcttcaagggactacagcctcacattcggcgccatcaatcagacctggagctacaggatccaccagaatatcacctaccaggtgtgtcgccacgcaccccggcacccatctttcccaacaacgcagcagctcaacgtcgaccgagtctttgcactgtacaatgatgaagaaagggtgttgcggttcgccgtcacaaaccagattggccctgttaaggaggacagtgacccaacccccggaaatccctgctacgacggaagccacatgtgtgatactacggctaggtgccaccctgggacaggggtggactacacctgcgagtgtgcctcaggttaccagggtgacggcaggaattgtgttgatgagaacgagtgcgctactggttttcatcgctgcgggcctaactcggtctgtataaacttacccggatcttaccgctgcgagtgccggagcggatatgaattcgccgacgatcggcacacctgtatcctcatcacaccacccgctaatccttgcgaagatggaagtcacacttgcgcgcctgccggacaagcccggtgcgtacaccatggcgggtctacattctcttgtgcctgtttgcctggatatgccggggatgggcatcagtgcaccgatgtcgacgagtgtagtgaaaacagatgtcatccggcagcaacttgctacaatactcctgggagcttcagttgtcgatgtcagcctggctactacggggatggattccagtgcatccccgacagtacctcgagtctgactccctgcgaacagcaacagagacatgcgcaggcccagtacgcttacccaggtgccagatttcatatccctcagtgtgacgagcagggtaactttttgccattgcagtgtcacggatctaccggtttttgttggtgtgtggaccctgacggtcacgaagtccctggcacccagacaccgcccgggagtacccccccacactgcggaccctctccagagcccacacaacgcccccctacgatatgtgaacgatggcgagagaacctgcttgaacattatgggggtacacctcgggatgatcagtatgtgccccagtgcgacgacctgggacactttattccgctccaatgtcatgggaagtccgatttttgttggtgtgtggacaaggacgggcgagaggtgcagggaacacggagccagcccggcactacccccgcttgtatccccacggttgcccctcctatggtcagaccaactcctcggcccgacgtgactccgccctctgtaggtaccttcctgttatacacccaggggcagcagatcggatacttgccactcaatggcacgcggctccaaaaggacgcagcaaaaactctgctgagcctgcacgtgaagtggatctcacctgtcggcggccgagcggcgtggctttcacagtgggaacccccgcatcgtccctgttgttctgaggtggactggtgccgcgaggtgctagagggattttag

SEQ ID NO: 197301 - DNA, 3825 bp, Artificial Sequence
  Description of Artificial Sequence: Synthetic coding sequence
atggagggcgaccgggtgaagctggccaaccccctgcacttctacgaagccagattcagcaatctgtacgtcggaacaaacgggatcatttccacgcaagactttccacgggaaacacagtacgtggattacgacttcccaaccgactttcccgcgatagccccttttctcgctgatatcgacacgagtcatggtcgtggccgagtactgtatcgtgaagacacgagccctgctgtccttggcttggcagctcggtatgtccgggccgggtttcctagatccgcccgcttcacgccaactcacgccttcttggcaacctgggaacaggtgggtgcttacgaagaagtgaaacggggcgcactcccgagcggagaactgaacaccttccaggccgtgctggccagtgatggcagcgacagttacgctctttttctgtacccagccaacggtctgcagttcctgggtacccggccaaaagagagttacaacgtgcagctgcagcttccggcacgggttgggttctgcagaggggaagccgatgacttgaagagtgaaggaccctacttttcgttgacctccacagaacagtctgtgaaaaacctctatcagctgtccaatctggggattcctggcgtttgggcctttcacattggtagcaccagccccttagacaacgtgagaccagcagctgtcggcgatctcagcgcggcgcatagtagcgtcccccttggacggtcattctctcatgccaccgctctggagtctgattataatgaggacaatctggattactacgacgtgaacgaggaagaagcggagtacctaccaggggagcctgaagaggctctgaatgggcactcctcgatcgacgtgagcttccagagcaaggtagacaccaagcccctggaagaaagctctaccctcgatcctcataccaaggaaggcactagcctgggggaagttggtggacctgatctgaaggggcaggtggagccctgggacgaaagagaaacaaggagccccgcgccccccgaagttgaccgggatagcctggccccctcatgggaaacgccccctccataccccgagaacggctcgattcagccatatcctgatggcggacctgtaccctccgaaatggatgtgccacctgcccatcccgaggaagagatcgtcctgcgctcatacccagcaagcggacacacaacacccctttcccgcggaacatatgaggtgggtctagaggacaatataggttccaatactgaggtcttcacatataatgcagcaaataaagaaacatgcgagcacaaccatcgacagtgcagtagacacgctttctgcactgattatgctaccggtttttgctgtcactgccagtcaaagttttatgggaacgggaagcactgcttacctgagggtgccccacatcgcgtgaatgggaaggtttctggccacttgcacgtgggccatacgcctgtgcattttacagacgtggaccttcacgcctacatcgttgggaacgatggccgcgcctatactgccatatcgcatattccgcaaccagcggcacaggctttgctgcccttgactccaatcggaggtctgttcggctggttgtttgcattggagaaacctggcagtgaaaacggcttcagtttagccggcgctgcattcactcacgatatggaggtgaccttctatcccggggaagagaccgtccgaatcacacagaccgccgagggccttgaccctgagaattacctgtcgattaagactaatatacagggccaggtgccttacgtatcagccaatttcaccgcacacatctccccttataaggagttgtaccactattccgacagcacagtgacctccacgtcctctcgggattattcactcacatttggggccataaatcagacctggtcctataggattcatcaaaacatcacctatcaggtatgtcggcacgcccccaggcatccctcctttcctacaacccagcagttgaatgtggatagggtctttgccctgtataacgatgaagagcgggtgctgagattcgccgtgacaaatcaaatcggccctgtgaaagaagactccgaccctacaccaggaaatccttgctacgatggctcgcatatgtgcgatacaaccgcacggtgtcatcctggaactggtgttgattatacctgcgaatgtgcttcagggtatcagggcgacgggaggaattgcgtggacgagaacgagtgcgcaactggctttcatcgctgcggcccaaactccgtctgcatcaatcttcccgggtcctatcgctgcgagtgcagaagcgggtatgaatttgcggacgatcgtcacacgtgtatttacgtcgatgagtgcagtgagaacagatgccaccccgcagccacctgttataacactcctggcagtttttcatgcagatgccagcccggctattatggggacgggttccagtgcatacctgactcaacttcatccttgacaccctgcgagcaacagcagcgacatgctcaggcgcagtacgcttatccaggggcacggtttcacatccctcagtgtgacgaacagggaaatttcttacccctgcaatgccacggcagtacgggtttttgctggtgcgtggacccagatggacacgaagttccgggcactcagaccccgcctggctcaacacccccacattgcgggccatcaccagaacctactcagcgcccacccaccatctgtgaaagatggcgcgagaatctcctcgaacactatggcgggacacctagggatgaccagtacgtcccccagtgcgatgacctcggccacttcattccgctgcagtgtcatggtaagagtgatttttgctggtgcgttgataaggacggacgtgaagtgcagggtaccaggagtcaaccaggcactacacccgcctgcatccctactgtagcgcctccaatggtgagaccgacgccacggccggatgtgacccctccatctgttggtacatttctactttatacacaaggtcagcaaatcggatatttacctttgaacgggacaaggttgcaaaaagatgccgcaaaaaccctgctttcactgcatgggagcattattgtcggcatagactatgactgcagggaaaggatggtgtattggacagatgtagctgggcgcaccatcagtcgggcaggactcgagctgggggccgaacccgagaccatcgttaacagcggcttaattagtcctgagggactggctattgaccatattaggcgcaccatgtattggacagacagcgtccttgataagattgagagtgcactgcttgatggatccgaaaggaaagtcctcttctacacagacctcgtgaaccctcgcgcaatagccgtcgatccaatccggggcaacctttattggaccgactggaaccgagaagcccccaagatcgaaaccagctcacttgatggagagaaccggagaatactcattaatacagatatcggactgccaaatgggctgacattcgaccctttctctaagctgctgtgctgggcagacgcaggcactaagaagctggagtgtaccctccccgacggcacggggaggcgggtgattcagaataatcttaagtaccctttttccatcgtatcgtatgcagaccatttctatcacacagattggcggcgggatggtgtcgtctccgtcaataaacacagcggacaattcacggatgaatacctgcccgagcagcgttcccatttgtacggcatcaccgctgtgtacccctattgtccaacaggaagaaagtag

SEQ ID NO: 197302 - DNA, 3837 bp, Artificial Sequence
  Description of Artificial Sequence: Synthetic coding sequence
atgaccgcccggggcctggccctgggcctgctgctgctgctgctgtgtccagcacaagttttctctcagagttgcgtttggtatggagaatgcggtatagcctacggtgacaaacgttataattgcgagtatagtggccctcctaaacccctcccgaaagacggatatgatctcgtgcaggagttgtgccccggttttttttttggaaatgtgtctttgtgttgcgatgtgaggcagcttcaaactctcaaggacaatctccaactgccattgcaattcctcagccgctgcccatcatgcttctataatctcctcaacctgttctgcgaacttacgtgcagccctcggcagagtcagttcctgaatgtcacggccaccgaagactacgtagatccagtgacgaatcagacaaagacaaatgtcaaagagctgcaatactacgtggggcagtctttcgccaacgcaatgtataatgcctgtagagacgtggaagccccctcaagtaacgataaggctctgggattactgtgtggtaaagatgccgacgcgtgtaacgcaaccaactggattgaatacatgtttaataaggacaacggccaggcgccgttcaccatcacacctgtgttcagcgactttcctgtccatgggatggaaccaatgaataatgcaacaaaagggtgcgacgagtccgttgatgaggtaactgctccttgtagctgtcaggattgctctatcgtatgcgggccaaagccacagccccctccgcccccagccccgtggacaattctagggcttgacgcgatgtacgtcattatgtggattacttatatggctttcttgctggtgttctttggagcgttttttgcagtatggtgttacagaaagcggtacttcgtttccgagtacaccccaatcgactccaatatagcattcagcgtgaatgctagcgataaaggtgaagccagctgttgcgatccagtcagtgccgctttcgaagggtgcctccgaaggctgttcactaggtggggaagcttctgtgtgaggaaccctggttgcgtgattttcttctcgttggtatttatcactgcatgttcctcgggacttgtatttgtgcgcgtcaccactaaccccgtagacctgtggtcagctccttccagccaagcccgactagagaaagagtacttcgaccaacactttggaccgttctttcgcactgagcagctaataatcagagcacccttaactgataaacatatttatcagccttacccaagcggagcagacgtccccttcggcccacctctggatatccaaatccttcatcaggtgttagatttgcaaatagccatcgaaaacatcaccgcctcctatgacaacgagactgttactctgcaagatatctgcctggccccactgtctccctacaatacaaactgtaccatcttatccgtgcttaactattttcagaacagtcattccgtgctagaccataaaaagggagacgatttctttgtgtatgcggactaccatacccacttcctttattgtgttagggcaccagcatctctcaatgataccagcctgctccacgatccttgcctggggacattcggcgggcccgtgttcccctggctggtgctaggaggctacgacgatcagaactataataatgctactgcactcgttatcacatttccagtaaataactactataatgatacagagaaactgcaacgcgctcaagcatgggagaaggaattcattaattttgtgaaaaactataaaaatccaaaccttacaatttctttcactgccgaacgcagtatcgaggatgagctgaatagagaatcagacagcgatgttttcaccgtagtgatcagctacgccatcatgtttctgtacattagcttggcactgggccacatgaagtcatgcaggcgcctcctcgtagattccaaggtgagccttgggatcgctggtatactcatagtgctcagttcggtggcatgcagcctgggagtgttctcgtacataggacttcccctcaccttgatcgtcattgaggtgatcccatttctcgtattagctgtcggggttgataatattttcatattggtccaggcataccagcgagacgagaggcttcagggcgagacattggatcagcaactggggagggtcctgggagaggtggccccctcaatgtttctgagctcattcagcgaaaccgttgcattcttcttaggcgccctctcagtcatgcctgccgtccacactttttctctgtttgccggcctggcggttttcatcgactttttactgcagattacgtgtttcgtctcgctgttggggcttgacatcaagaggcaagagaaaaatagactcgacatcttctgctgtgtccgaggcgcagaagacgggacttccgtacaggccagtgaatcctgcctctttcgatttttcaagaactcttacagtcccctgctgttgaaagactggatgcgccctatcgtgatcgccatattcgtgggagtgttgtcattctccatcgccgtgctcaacaaagtggacatcggtttggatcagtctctgtccatgcccgacgatagctacatggtggattatttcaagagcatatcccagtatctccacgcagggccacccgtctatttcgtgctcgaggagggccacgattatacttccagtaaggggcagaacatggtttgcggaggaatgggatgcaataatgatagtctggtgcagcaaatctttaatgctgctcagctagacaactacacccgcatcggctttgccccatccagttggatcgacgactatttcgactgggttaaacctcagagctcttgttgcagggtagataacatcacagatcagttttgcaatgcctcagtcgttgaccccgcatgcgtgagatgccgaccattaacccccgaaggaaagcagaggccccaggggggcgactttatgaggttcttgccaatgtttcttagtgacaaccccaaccctaagtgcgggaagggtggccatgcagcttattctagtgccgtcaacatacttctagggcacggaacaagagtaggggcaacatattttatgacttaccacaccgtgctacagacctcagccgattttatcgacgctctgaagaaagccagattgattgcatccaacgtgaccgagacgatgggaatcaacggttcagcataccgtgtattcccatattctgttttctacgtcttctatgaacagtacctcactatcattgacgacaccatctttaacttgggtgtgtctctcggagccatttttctggttaccatggtcctcctgggctgtgagctttggtctgccgtcatcatgtgtgctactattgccatggtcctggtgaacatgttcggcgtgatgtggctgtggggaatcagcctgaatgcggtcagtctggtaaatcttgttatgtcgtgtggcataagcgtggagttctgttctcatataacacgcgctttcacggtgagcatgaaaggttctcgcgtcgagcgggccgaagaggcactggcgcacatggggagctctgtgttttccggcataactctcactaagtttgggggtatcgtggtgctggcttttgcaaagtctcaaatctttcaaattttttatttccgcatgtatttagccatggtgctgctgggcgcaacacacgggctgatcttcttgccagtactgctctcatacattggccctagcgtcaataaggccaaatcgtgtgctacagaggaaaggtataaaggtaccgagcgtgagcgcttgctgaatttctag

SEQ ID NO: 197303 - DNA, 2883 bp, Artificial Sequence
  Description of Artificial Sequence: Synthetic coding sequence
atgtacgtgatcatgtggatcacctacatggccttcctgctggtgttttttggcgcattttttgccgtgtggtgctacaggaaacgctacttcgtatcagaatacacaccaatcgattccaacattgccttctccgtgaatgcttccgacaagggtactgcctggttgcttacctccacatttccatcaagtcccgtgctgcctggtgaggcctcctgttgcgaccccgtgtctgccgcctttgagggctgccttcggaggctgtttactcgttggggatccttctgcgtgcgaaaccccggctgtgtcatctttttctccttggtttttattacagcttgttcatctggcttggtctttgtacgagttaccaccaatccagtcgatctttggtctgcccccagtagtcaggctcggttggaaaaggagtactttgaccagcatttcggccccttttttaggaccgagcagctgatcataagagccccactcacagataagcatatctatcagccatatcccagtggtgccgatgttccgttcggaccgccgctagatatacagattctgcatcaggtcttggacctgcagatcgcaatcgaaaatattactgcatcttatgacaatgagaccgttacgctgcaggacatctgcctagcccccctcagcccctacaacacaaattgtacgattctcagcgtcctgaactactttcagaactcacattccgtgctggatcacaaaaagggggatgacttcttcgtgtatgccgactaccatactcatttcctctattgcgtgcgctttatcaattttgttaagaactacaaaaaccctaacctgaccatcagcttcacggctgagcgaagcatagaggatgaactgaatcgggagtcagattccgacgtgttcacggtagtgatatcatacgccatcatgttcctgtacattagcctggcacttggccacatgaagtcgtgtcgccggctgctggtcgactcaaaggtgagcctggggatagcaggcattctcattgtgttgtccagcgtggcttgcagccttggggtattttcgtacataggtctgccccttaccctgatcgtgatcgaggttatcccctttctggtccttgccgtgggggtggacaatattttcatactagtccaggcatatcaaagagacgaaagactgcagggagagaccttggatcagcagttgggcagggtcttgggcgaagtggcgcctagcatgttcctctcaagtttcagtgaaaccgtggccttctttctaggagcactaagtgtgatgccagcggtccacacctttagtctgttcgctggattagccgtgtttattgactttctgttacaaattacctgcttcgtctccctgctagggctggatatcaaacgccaggagaagaaccgccttgatatcttttgctgtgtccgaggcgccgaagacggcacttcagtccaagcctccgaaagttgcctgttccggtttttcaaaaacagctatagccccctgcttctcaaggattggatgaggccaattgttatcgccatctttgttggggttctgtcgttctcaatcgccgtcctcaacaaggttgacatcgggcttgatcagtcactctctatgcctgatgactcttatatggtagactattttaagtctatttcccaataccttcacgcgggaccccccgtgtactttgttttagaggagggtcacgattatacgtcaagcaaggggcagaacatggtgtgcggagggatggggtgtaacaatgactccttagtgcagcaaatctttaacgccgctcagctggataactatacccgtatcggatttgccccttcttcgtggattgatgattactttgactgggtgaaaccccagagctcttgttgtcgggtggacaacattacggatcagttctgcaatgccagcgttgttgatcctgcatgtgttaggtgccgaccactgacaccagaggggaagcagcggccacaggggggggactttatgaggtttctgcccatgttcctctcggataatcctaatccaaaatgcgggaagggcggtcatgccgcctactcatcagccgtcaatatcctcctgggccacggcacccgggtgggtgccacatacttcatgacttatcacacggtgctccagaccagtgcagatttcattgacgctttaaagaaggcccggcttattgccagcaacgtgaccgaaaccatggggattaacggatcagcttaccgggtcttcccttactctgtattctacgtcttttacgaacagtacttaaccatcatagatgacactatcttcaatctgggggtctcccttggcgcaatttttcttgtgactatggttctgttgggctgcgagctctggtcagctgttatcatgtgcgcgacgattgctatggtactggtcaatatgtttggggtcatgtggttgtggggaatatcgctcaacgccgtatcactcgtaaatctggtaatgtcctgcggaatctctgtcgaattctgctctcacatcacacgcgccttcacagtttctatgaaaggcagcagagtggaaagggccgaggaggccctcgcacacatgggctcaagcgtgttctcaggcatcactctcacaaaatttgggggcattgtggtcctagccttcgctaagagtcagattttccagatcttctatttccgcatgtacctggccatggtgcttctcggggctacacatggtctcatctttctcccggtgctcctgagttacatagggccgtcagtgaacaaggccaagagctgcgctacagaagagcgctataaaggcacagagcgtgaacgcctgctgaatttctag

SEQ ID NO: 197304 - DNA, 2331 bp, Artificial Sequence
  Description of Artificial Sequence: Synthetic coding sequence
atgtacaacgcctgccgggacgtggaggcccccagcagcaacgacaaggctctggggttgctatgtgggaaggacgctgacgcctgtaatgccactaattggattgagtatatgttcaacaaagacaatggtcaagccccctttaccatcacgccagtattttcagactttccagtacacggaatggagccaatgaacaatgctacgaaggggtgtgatgagagcgttgacgaggtgactgcgccatgttcttgtcaggattgctccatcgtgtgcggccctaaaccacagccacctccaccgccggcaccctggacaatccttgggctcgacgccatgtatgtgattatgtggattacctacatggcattcctcttagtgttttttggggccttcttcgctgtctggtgttaccgcaagcggtacttcgttagcgaatacactcctattgattccaatattgccttctccgtcaatgcctctgataagggcgaggcttcttgctgtgatcccgtgtcagcagcttttgaaggctgcctgcgcagactgtttacccgctggggctctttttgcgttaggaaccccggatgcgtgattttcttcagtttggttttcatcactgcctgctccagcggactggtgtttgtgagggtcaccacaaacccagtggacctgtggagtgcaccttcctctcaggcccggctcgaaaaggagtatttcgatcaacacttcggccctttttttcggaccgagcaactgattatccgcgcgcccctgactgacaagcatatctaccaaccatatccttctggcgctgacgtacccttcggaccccctttggacatccagattctccatcaggtcctggacttacaaattgccattgagaatattacagcctcatacgataatgaaacggtgacgttgcaggacatctgcctggccccactctctccatacaataccaactgtactatcctgtccgtgttaaactacttccagaactctcactctgttttagaccacaaaaaaggcgacgacttctttgtttatgcagattaccatacacactttctgtattgtgttagagcccccgccagtctcaatgataccagtcttctacatgacccatgtctcggcaccttcggaggtccggtgttcccgtggctagtgcttgggggctacgatgaccagaattataacaatgccaccgcattggtaattacctttcccgtcaataactactacaatgacacggaaaaattgcagagagctcaggcatgggaaaaggagttcattaatttcgtgaaaaattacaaaaaccctaacttgactatcagcttcacggcagaacggtccatcgaggatgagttgaaccgcgagtctgattccgatgtgttcacggtggtgatctcttacgcaattatgttcctgtatatctcccttgctctaggccacatgaagtcgtgccgaaggctgctcgtggactccaaggtgagcttgggaattgcgggaatattaatcgtgctctcatcagtggcgtgttcattgggagtcttctcctacattggtctgccattaacactgatcgtcattgaggtcattccttttcttgtcctcgccgtcggcgttgacaatatcttcattctcgtgcaggcttatcagcgtgacgagcggctgcagggtgaaaccctagaccagcagttaggtcgagttctcggcgaagtcgcccctagtatgtttctctcatcattttccgaaaccgttgctttctttctgggcgccttatccgtcatgcctgccgtgcataccttttccttgttcgccggcctggctgtctttatcgactttctgctgcagatcacatgctttgtgagcttgcttggcttggacatcaagcgacaagaaaaaaaccgactcgacattttctgttgcgtgcgaggagctgaagatggcactagtgtacaagcatccgaatcatgtctgtttaggttcttcaagaattcctactcacccctcctcctgaaggactggatgcgccctatcgtcatagcgatttttgtaggggttttgtcattctcgatcgccgtgttgaacaaagttgatatcggcctcgatcagtcattatcaatgccagacgatagctacatggtggactattttaaaagtatcagtcagtaccttcatgccggccctccagtttacttcgtcctcgaggaaggccatgactacacctcctcaaaaggccaaaatatggtgtgtgggggaatgggttgcaacaatgacagcctggtgcaacagatttttaacgcggcccaactcgacaattag

SEQ ID NO: 197305 - DNA, 369 bp, Artificial Sequence
  Description of Artificial Sequence: Synthetic coding sequence
atgcggttcctggccgccaccttcctgctgctggccctgagcaccgcggcccaggctgagcccgtgcagttcaaagactgcggtagtgtagacggagtgatcaaagaggtgaatgtgtccccgtgccctacccagccctgccagctgtcaaaaggccaatcatactccgtgaacgtaacatttacctcaaatattcagagtaagtccagcaaagcagtagttcacggtatcctaatgggggtgcccgtgccttttccaattccggaaccagacggctgcaaatctgggatcaactgtccaatacagaaggacaaaacctatagttatctgaataagctgcctgtgaaatccgagtatccatctgtttag

SEQ ID NO: 197306 - DNA, 456 bp, Artificial Sequence
  Description of Artificial Sequence: Synthetic coding sequence
atgcggttcctggccgccaccttcctgctgctggccctgagcaccgcagcacaagcagagcccgttcaatttaaagattgtggctcagtcgatggggttattaaggaagtgaacgtgagcccctgccccacacaaccatgccagctgtcaaagggtcagtcgtattccgtgaacgtaacatttacctcgaatattcaatccaaatcctccaaggcagtcgttcatggaatccttatgggcgtgcctgtgccttttcccataccagagccagatggctgtaagagtggaataaattgccccatccagaaagacaagacatatagctacctgaacaagttaccagtgaagtcagagtacccctccataaaactagtggtggagtggcaacttcaagatgacaagaaccagagtctgttctgctgggagatccccgttcaaatcgtgtctcacctgtag

SEQ ID NO: 197307 - DNA, 1053 bp, Artificial Sequence
  Description of Artificial Sequence: Synthetic coding sequence
atggacctgaaggccctgctgagcagcctgaacgacttcgccagcctttccttcgccgaatcgtgggacaacgttggtctgttggtggaacctagtcctccacacactgtgaacactctctttctgaccaacgatttgaccgaggaagttatggaagaggtcctccagaagaaggcggatttgatcctgtcttaccatccgcccatttttagacccatgaagaggattacctggaacacttggaaggagagattagtaatccgagctttagagaaccgggttggtatttacagtccccacacggcctatgacgccgcccctcagggggtgaataactggctggcgaaaggcctgggcgcatgtacgtcacggccgattcatcccagcaaggcccccaactaccccaccgaaggaaatcaccgggttgaattcaatgttaattacactcaggatctggataaggtgatgagcgctgtcaagggcatcgatggagtgtcagtgactagttttagcgccaggacgggcaatgaagaacagacgcgaattaatctcaattgcacgcagaaagcgctcatgcaggtggtcgattttctcagtaggaataaacaattgtatcaaaagacagagattctcagtcttgagaagcccctgctgctgcacacaggcatgggccgattatgtacattagacgaaagtgtctcgctcgccacaatgattgacaggatcaaaaggcatttgaaactctcacacatcagactcgcactgggtgtggggcgaactctggagagtcaggttaaggtggtagccttgtgcgcaggctccggcagcagcgtgttgcagggagttgaagccgatctgtacctgaccggagaaatgtctcaccacgatacgctggacgctgcttcccagggtatcaatgtgatcctctgtgagcatagcaatacagagagaggttttctatccgaccttcgcgacatgctggactctcatcttgaaaataaaatcaatattatccttagtgaaaccgatagagatcccctgcaggtagtttag

SEQ ID NO: 197308 - DNA, 759 bp, Artificial Sequence
  Description of Artificial Sequence: Synthetic coding sequence
atgctgagcagctgcgtgcggcccgtgcccaccaccgtgcggttcgtcgactccctgatttgtaactcctcccggagctttatggatctgaaggccctgctgtcctcgttaaacgacttcgctagcctgtcttttgctgagtcctgggataatgtcggtctactggtagagccttctcctccgcacacagtgaacacgcttttcttgaccaatgacttgacggaggaggtgatggaggaagtgcttcaaaaaaaggccgacctgattctgagctaccacccgccaatattccgaccaatgaaacgcataacttggaacacctggaaggagcgtcttgtgattagagccctggagaatagagtgggcatatactccccccacactgcctatgacgcggcaccacagggagttaataattggcttgccaagggcctgggagcatgtacctccagaccaattcaccccagtaaagcccctaactatccgactgaggggaatcatcgcgttgagtttaacgtaaactacacacaggacctggataaagtaatgagtgcagtgaaaggtatcgacggggtgtcggtcacttccttttccgctcggacaggaaacgaggaacagacgagaattaatctcaactgtacacaaaaagccctaatgcaggtggtcgatttcctgagcaggaacaaacagctgtaccaaaagcaccaagacaacaccttttacaagagcgctggatgtcagctcaaattcgtgacctag

SEQ ID NO: 197309 - DNA, 1134 bp, Artificial Sequence
  Description of Artificial Sequence: Synthetic coding sequence
atgctgagcagctgcgtgcggcccgtgcccaccaccgtgcggttcgttgactctttaatttgtaactcgagtaggtcgttcatggatctaaaggccctgctaagtagcttgaatgattttgcctctctgtcttttgccgaatcttgggacaatgtgggccttctggtggagccaagcccaccccacacagttaacacactgtttctcactaatgacctgactgaggaagtcatggaggaagtcttacagaaaaaggcagatctaatcttatcctaccatccacctatttttcgacccatgaaacgaattacctggaatacctggaaagagagattggtgattcgggccctcgagaatcgcgttgggatttattcgcctcacacagcttacgatgctgccccccagggtgtgaataattggctcgccaagggactaggcgcctgcactagcaggcccattcatccttcaaaagcacctaactacccaactgaaggaaatcatcgggtggagtttaacgttaattatacgcaggacctggataaggtaatgagcgctgtcaaagggattgacggtgtatcagtgacctcttttagtgcccggaccggaaacgaggagcagacccgcatcaatttgaattgtacccagaaagcgcttatgcaggtcgttgatttcctttcgagaaacaagcaactatatcaaaagacagagatcctcagtctggagaagccactactgctgcacaccgggatgggaaggctttgtacactagacgagtcggtatcactggccaccatgattgaccggatcaagcgacatctcaagttgtctcacattaggctggctctcggcgtcggacgtaccttagagagtcaggtgaaggttgtggctctctgcgccggcagcggaagctctgtcttgcagggagtagaggcagatctgtacctgactggggagatgtcccaccatgacaccctggacgccgcatcacagggcataaacgtgattctgtgcgaacattccaacacggagcggggattcttgtccgacctgcgcgacatgttggattcacatctcgaaaacaagataaatattatactctcagaaacagatagagatcccctgcaagttgtttag

SEQ ID NO: 197310 - DNA, 489 bp, Artificial Sequence
  Description of Artificial Sequence: Synthetic coding sequence
atggacctgaaggccctgctgagcagcctgaacgacttcgccagcttgtcatttgcagagagctgggataatgttggactgctcgtggaaccctccccccctcacacggtgaacaccctttttctgacaaacgatttgaccgaggaggtgatggaggaagtactccagaagaaggccgatttaatcctctcgtaccatcccccaatttttaggccaatgaagcgcattacgtggaatacctggaaagagcgactcgtcatccgggccctggagaaccgagtcggaatctactcaccacacacagcgtacgatgccgcacctcaaggggttaacaattggctggctaagggactgggtgcctgcaccagccgccccatccacccatccaaggctcctaactaccccacggaaggaaaccatagggtggaatttaatgtgaattacactcaggacctggataaggtgatgagcgcggttaagggaatttag

SEQ ID NO: 197311 - DNA, 1134 bp, Artificial Sequence
  Description of Artificial Sequence: Synthetic coding sequence
atgctgagcagctgcgtgcggcccgtgcccaccaccgtgcggttcgttgacagcctcatctgcaacagtagtcgatcctttatggacctcaaagctttactgagctctctgaacgattttgcatcactctcgtttgctgaaagttgggataacgttggcctgctggttgagccctcgccaccacataccgtaaacaccctgttcctgaccaacgatcttactgaagaggtcatggaggaagttctgcagaaaaaggctgaccttatcctgtcgtatcatccaccaatatttcgtcctatgaagcggatcacgtggaacacctggaaggagcgactggttattagagctctcgagaaccgtgtcggcatttacagtccgcatactgcttatgatgccgctcctcaaggcgtgaataattggttagcaaagggactgggcgcctgcacttcccggcccatacatccatccaaagctcctaattatcccaccgagggtaaccatcgagttgaattcaacgtgaactacacacaggatttggataaggttatgtccgccgtgaaaggtatcgatggggtgtctgtaacttcattctctgccagaaccgggaacgaagagcagacccgtattaatctaaattgtactcagaaggctcttatgcaggtggtagacttcctttctcgcaacaagcaactctaccagaagacagagatactgtcccttgaaaaacccctgttactgcacaccggtatggggagactctgcaccttagatgaatccgtctcactcgccacaatgatcgatcgtatcaagagacatttaaagctcagtcatatcagattggctctgggtgtaggtagaaccttggaaagtcaggtgaaagtggtcgccctatgcgctggtagtggctcttccgttctgcagggagtggaggctgatctgtacttgacaggcgagatgtcccaccatgacaccctggatgccgcttcccagggcattaatgtaatcttatgcgagcatagcaatacagaaaggggttttcttagtgatcttcgagacatgctggattcccaccttgaaaataagataaacattattctgagcgaaactgatagggatcctctccaagtcgtctag

SEQ ID NO: 197312 - DNA, 858 bp, Artificial Sequence
  Description of Artificial Sequence: Synthetic coding sequence
atgctgagcagctgcgtgcggcccgtgcccaccaccgtgcggttcgtggattctctcatttgtaatagttcaagatcttttatggatttaaaagccctgctgtcttccctcaacgatttcgccagcctgtcattcgccgaatcctgggataatgtggggttgctcgtagagcctagcccccctcacacagtgaacacactgtttttgaccaacgacctcacggaagaagtgatggaagaggtgttgcagaaaaaagcagacctaatattatcttatcacccccccattttccgaccgatgaaacggattacctggaatacatggaaggaaagactagtcattagggctctggagaaccgcgtcgggatctacagtcctcacacggcgtacgatgctgctcctcaaggagtgaataactggctggcaaaagggttgggcgcttgcacatcacgtccaatccacccatctaaggccccaaactatccaaccgaagggaatcaccgggtggaattcaacgtgaattatacccaggatctggataaagtgatgagtgcagttaagggcatcgatggagtgtccgtaacctctttctcagcccgtaccggcaacgaggagcagacccggatcaatctcaattgcacccagaaggctttgatgcaggtggtcgattttctgtcacggaataagcagttataccagaaaacggagatactctcactcgagaagtccctgaagagcaaatcctggccatgcgtgctggtgctgggcgccgctttctgtagagtcttacgactaacattcacctcacaagttaggtgtcccatcatgattctgtggatgctgctgccaaaggagtag

SEQ ID NO: 197313 - DNA, 1134 bp, Artificial Sequence
  Description of Artificial Sequence: Synthetic coding sequence
atgctgagcagctgcgtgcggcccgtgcccaccaccgtgcggttcgtggactcactgatttgtaacagttctagatccttcatggacctgaaagctctcctcagtagcttgaacgatttcgccagcctgagctttgccgagtcttgggacaacgtcgggttgctggtagaaccatctcctccccatacagtgaacaccctctttctcactaatgacctcaccgaagaggtcatggaggaagttctgcagaaaaaggccgacctcatactgagctaccatccacccatcttcagacccatgaaacgaatcacatggaatacctggaaggagcgactcgtgattagagcactggaaaacagagttgggatatactctccacacactgcatatgatgcagctccgcagggagttaacaactggctcgcaaagggactaggggcctgcacaagtagaccaatccatccctctaaggcgcccaattatccaaccgaagggaaccatagagtggaattcaatgtgaactacactcaggatctggacaaagtgatgtccgccgtgaaaggcattgacggtgtttctgtcaccagtttctccgcccgaaccggcaacgaggaacaaacccgtataaacttgaactgtacacagaaggcactgatgcaggtagtggactttctgagccggaataagcaactgtatcaaaagaccgagattctgtccctggaaaagccactacttcttcatacaggaatggggcgcctctgcacgttagacgaatcagtgagtctggctactatgattgatcgaattaagcgtcatctgaagctgagccacatacgcctagcccttggcgtgggtagaaccctcgaatcccaggtgaaggttgttgccctgtgcgcaggttctggcagctctgttctgcagggggtagaggctgatctttatctgactggagaaatgagtcaccacgataccctggacgctgcgagtcaggggatcaacgtaatcctctgtgagcattctaacactgagcgcggcttcttgtcagatttgagagacatgctcgatagtcacttagaaaacaaaatcaacattattttgagtgagacagacagagacccattgcaggtggtgtag

SEQ ID NO: 197314 - DNA, 630 bp, Artificial Sequence
  Description of Artificial Sequence: Synthetic coding sequence
atggacctgaaggccctgctgagcagcctgaacgacttcgccagcctcagtttcgcggaatcctgggataacgtgggcttactggtggagccgtcccccccccataccgttaacacactgttcctgaccaatgatttaacagaggaagtgatggaagaagtgctccaaaagaaggccgatctgatcctgagctatcatcctcctatcttccggccaatgaaaagaattacctggaacacctggaaagagcgcctcgtgattagagccctggagaaccgggtgggcatatactctccgcatacagcttatgatgctgcccctcagggagtgaataattggctggctaagggcttgggggcgtgcacatcacggcccatccacccatccaaagctccgaactatccgaccgaagggaaccatcgcgtggagtttaatgtgaattacacacaggatttagacaaagtcatgtctgctgtaaaaggaattgacggggtgtcagtcacaagtttcagcgcgcgtacaggtaacgaggaacagacaaggatcaatttgaactgtacgcagaaggcgctcatgcaagtggtcgatttcctaagccggaataaacagctgtatcaaaagacagagtag

SEQ ID NO: 197315 - DNA, 492 bp, Artificial Sequence
  Description of Artificial Sequence: Synthetic coding sequence
atgctgagcagctgcgtgcggcccgtgcccaccaccgtgcggttcgtcgactctctaatttgcaacagctccaggagttttatggaccttaaagcgctcctatcctcattaaacgattttgcctctttgtctttcgccgagtcctgggataatgtgggattgctggtggagccatcccccccacacacagtcaatactctttttctgacaaacgatttgacagaagaagtgatggaagaggttttgcagaagaaagcggacttgattctcagctatcacccacccatcttcaggccaatgaaaagaatcacttggaacacctggaaggagaggctggtgatccgcgccctcgagaacagagtgggtatctattcaccacatactgcctatgatgctgccccccagggggttaacaactggctcgctaagggcttaggtgcttgtacatcaaggccgatccacccttccaaagcgcctaattatcccacttag

SEQ ID NO: 197316 - DNA, 4749 bp, Artificial Sequence
  Description of Artificial Sequence: Synthetic coding sequence
atggccggccccggcggctggcgggaccgggaggtgaccgacctgggccacctgcccgaccccacaggaatattcagtttggataaaacgatcgggcttggaacatacggccgtatatatctgggcctccacgaaaagacgggggcttttaccgcggttaaggtgatgaatgcacggaagacacctcttcccgagattggcagacgcgtgagagtgaacaaataccaaaagtctgttggttggcggtactctgatgaggaggaggatctccgcaccgagctcaacctcctccggaaatacagcttccataaaaacatcgtctcattttacggggctttttttaagctgagccccccgggacagcgccaccagctctggatggtcatggagctatgtgctgcagggagtgtcacagatgtcgtccggatgaccagcaatcagtcactcaaggaggattggatcgcatacatttgccgagagatcttacagggactggctcacctgcatgctcacagggttatccacagagacataaaaggacaaaacgtgttgttaacacacaatgccgaggtaaagcttgttgactttggggtttccgctcaggtttcccgaaccaacggccggaggaatagctttatcggaacgccttactggatggctccagaagtgatcgactgtgatgaagatccacgacgctcctatgattatcgctctgatgtgtggtccgtggggatcaccgcaattgaaatggcggagggagcgcccccactgtgtaatctccagcccctcgaggccctctttgtcattctgagggagagcgcgccaacagtcaagagtagcggatggtcaagaaaattccataatttcatggagaaatgtactatcaaaaatttccttttccgccccacatccgcaaatatgctgcaacatccctttgttagggacattaaaaatgagaggcacgtcgtggagagtctgactcggcatttaaccggcattatcaaaaagcgacagaagaaaggcattcccctgatcttcgagcgggaggaggcaataaaagagcagtacaccgttcgccgcttccgaggcccttcatgcactcacgagctcctgaggcttcccaccagttcgagatgccgaccacttagggtgttgcacggtgagccaagccaaccgcgatggctccctgatagagaggagccccaagtgcaggcccttcagcaactgcaaggcgccgcacgcgtcttcatgccccttcaggctcttgattcagcaccaaaacctcttaagggccaagctcaggctccccagcggctgcagggggcagctcgggtcttcatgccacttcaagcacaggtgaaagcaaaagctagcaaacctctccagatgcagattaaggccccaccgcgtctccgccgcgcagccagggtgcttatgcccttacaggcccaagtcagagcccccaggttacttcaggtgcagtctcaagtaagcaagaaacagcaagctcagacacagactagtgagccccaggatctggatcaggtcccagaggaattccaaggacaggatcaggtccctgaacagcaaagacagggacaggcccccgagcagcagcaacgccacaatcaagtccccgagcaggaactcgagcagaatcaggcaccagagcagccagaagtgcaggagcaggcggcagaacccgctcaggccgaaaccgaggcagaagagcctgaaagcctgcgcgtgaacgctcaggtgttcctgccgttgctctcccaggatcaccatgtcctgctgccactgcacctggatacccaagtgcttatccctgtcgaggggcagacagaagggagtcctcaagcccaggcctggaccctggagcctccccaggctatcggctcagtccaggctctgatcgagggcctgtccagagacctactgagagcgcccaattctaacaattccaagcccctcggtcccctgcagacacttatggaaaatctttcatcaaaccgattctactcacagcccgaacaggcacgggagaaaaagtccaaggtgtccacactccgccaggctctggccaaacggttatcacccaagcgcttccgcgccaaatcatcatggcgacctgagaaattggaattatctgatctcgaggcaagaaggcaacgcagacagcgtaggtgggaagacattttcaaccaacatgaggaggagcttaggcaggtggataaagacaaggaagatgagtccagcgacaatgacgaagtctttcattctatacaggctgaagtgcagattgagccactgaagccgtacatctccaatcctaagaaaatcgaggtgcaggaaagatcgccgtcggtgccgaataaccaggaccacgcacaccatgttaagttctcctcatcagtacctcagagaagcctgctcgaacaggctcagaaacccattgatataaggcagagatccagtcagaacagacagaactggcttgctgcgtccgaaagttcctctgaggaagaaagtccagtgactggcagacgatcacagagctcgcctccatatagcacgatcgaccagaaactcctggtggatatccacgtacccgacggttttaaggtcggcaaaatcagccctcccgtgtatctgactaatgagtgggtcggctacaacgcactgagcgagatctttcgcaatgattggctaacccccgcccctgttatacaacctccggaggaagacggggattacgtggagctgtacgacgcaagcgccgacacagacggggatgatgacgatgagtctaatgatacatttgaagatacctacgatcatgcgaatggtaatgacgacctcgacaatcaagttgatcaagcaaacgacgtgtgcaaggaccatgacgacgacaacaacaagttcgttgatgatgttaacaataactactatgaagcaccaagctgcccgagagcatcttatgggcgtgatgggagttgcaaacaggacggatatgatggatcaaggggcaaggaagaagcataccgcggctatggcagccataccgctaatcgctcacacggtggtagtgccgcgtccgaggataatgccgctataggagatcaagaggagcacgccgccaatatcggctcggagcggagaggcagtgagggcgacggcggaaagggtgtagttcggacttccgaagaaagcggggctcttggacttaatggcgaggagaactgttcagaaactgatgggccaggactaaagcggcctgcttctcaggacttcgagtacctgcaagaggagcccggcgggggaaatgaggcttctaacgcaatcgatagtggagcagcaccatccgcccccgaccacgagagtgacaataaagatatctccgagagcagtactcagagcgatttctcagcaaaccacagcagcccttccaaaggctcgggcatgtccgctgacgcgaatttcgcctcagcaatcctttatgctggtttcgtggaagtaccagaggagtcccctaaacaaccaagcgaagtcaatgtaaaccctctgtacgtgtcacctgcttgtaaaaagcctctgattcacatgtatgagaaggaatttacatccgagatttgttgcggcagcttatggggggtcaatctgcttcttgggaccaggtctaacctgtatctgatggacaggtcaggtaaggccgatatcaccaagcttattaggcgaaggcctttccgtcaaattcaggtgctcgaaccgctgaaccttctcattaccattagcggacacaagaataggttgagagtataccatttaacgtggctgcgcaataagatcctgaataatgaccccgagagtaagcgacgacaggaggagatgcttaagacggaagaggcctgcaaagcaatagacaagctgacaggttgcgaacatttcagtgtcctgcagcacgaagagactacatatattgctattgccctgaagtctagtatccacttatatgcctgggcaccgaagagcttcgatgagtctaccgcaataaaggtatgcatcgatcagtctgcagatagcgaaggagactacatgtcttaccaggcctacattcggatccttgcaaaaattcaggccgctgaccccgttaatcggtttaaaaggccagacgaattgctccacttgctgaaactcaaggtatttccgactctcgatcataagccagtgactgtggacctggccattggctccgaaaagcggttaaaaatatttttttcttcagcggacggataccacctcatcgatgccgagtccgaggtaatgtcagatgtgaccttacccaagaatcccctagaaattattatccctcagaacatcataattctgccagattgcctcggaattggcatgatgctcacttttaatgctgaagcattgtcggttgaggcgaacgagcagcttttcaaaaaaatccttgagatgtggaaggacattcccagctccattgcgtttgagtgtacccagagaactactggctggggccagaaggccatagaggttcggtctctacagtcccgggttctggagtctgagttgaagagacgaagcatcaagaagctgcggtttctgtgcacacgcggggacaagctgttctttacatcaacacttagaaaccatcacagtagagtgtactttatgacactgggtaagctcgaggaactgcagtctaactatgatgtctag

SEQ ID NO: 197317 - DNA, 4752 bp, Artificial Sequence
  Description of Artificial Sequence: Synthetic coding sequence
atggccggccccggcggctggcgggaccgggaggtgaccgacctggggcacctgcccgacccaacggggatcttctcattggacaagacaattggcctcggaacttacggcaggatctatctgggcctgcatgagaagacaggggctttcaccgccgtgaaggtgatgaacgcgcggaagacaccactgcccgaaataggtcggcgcgtgagggtgaataagtaccagaaatctgttggctggcgctactctgacgaggaggaggacctgcggactgaactgaacctcctgaggaaatactcattccataagaacatcgtgagtttctacggcgcctttttcaagctttccccccctggccagagacaccagttgtggatggttatggagttatgcgcagcaggatcagtcacagacgtggtaagaatgacatcaaatcagagcctgaaggaggactggatcgcttatatctgtcgcgagatcctacagggcctcgcacatctgcatgcccacagggtcattcaccgcgacatcaagggccagaatgtgttgttgacccacaatgcagaagtcaagctcgttgactttggggtctccgcccaggtctcccgcacgaacgggcgacggaattctttcatcggaaccccatactggatggcccctgaagtcatcgactgcgacgaagacccccgcagatcgtacgattatcgttcggacgtgtggtccgtgggaatcaccgctattgaaatggccgaaggcgctccacccctgtgcaatctccagcctctcgaggccttattcgtcattttacgagaatcggcaccaaccgtgaaatccagtggatggtccagaaagtttcataacttcatggagaagtgtacgatcaagaattttctgttccgccccacgtccgcaaatatgcttcagcacccattcgttagggacatcaaaaacgaacggcatgtagttgaaagcctaaccaggcacctaacaggaattatcaagaagcgtcagaagaagaaaggcatccctctcatcttcgagcgggaagaggccataaaagaacagtacactgttaggaggtttaggggtcctagctgcactcacgagttactccggctaccaacctcttctcgctgccgcccactccgggtgctgcacggtgaacccagccagcccaggtggcttcccgatagagaggaaccacaggtgcaggcccttcagcaactccagggcgcggctcgcgtgtttatgcccctgcaggccctagactctgctcctaaacctcttaaaggccaggcacaagccccccagaggttgcagggtgcagccagggttttcatgcccttacaagcgcaggttaaggcgaaggcgtcaaagcctttgcaaatgcagatcaaggcgccaccacgtctccggcgggcagcccgggttctgatgcccctgcaggcacaggtcagagcccctaggcttctgcaggtgcaatcccaagtgagtaagaagcagcaagcacagacacagacctctgaaccacaggatttagaccaagtgcccgaagagtttcagggacaagatcaggtgcccgaacaacagaggcagggccaggctcctgagcaacagcaaaggcacaatcaggtcccagagcaggaactggagcagaaccaggcgccggaacagccagaggtccaggagcaggccgccgaacccgcccaggctgagaccgaggctgaagaacctgaatctttgcgcgtcaatgcccaagtctttcttccactcctaagtcaggatcatcacgtgctgttaccgctgcacctagacacccaggtcctcatcccggtggagggccagaccgaaggaagtccccaggctcaggcttggacattggaacctcctcaggcgatcggctcagtgcaggccctgatcgaaggacttagcagagacctcctgagagcgccaaattctaataatagtaaaccactagggccactgcagacgttaatggagaatctctcgtctaatcggttctactcccaaccagaacaggctagggaaaaaaagtctaaggttagtacactccgccaagcactggcaaaaagactatcccctaagaggttcagagcaaagagctcgtggagaccagaaaaactcgaactgtctgacctggaagccagaagacagagacgccagaggcgatgggaggatatctttaatcagcatgaggaagagctgcgacaagtcgataaagacaaggaggacgagagtagcgacaatgatgaggtctttcattctatccaggctgaagtgcagatcgaacccctcaagccgtatatcagcaatcccaagaagattgaggtgcaggaaaggagcccatctgtgcctaataatcaagaccacgctcatcatgtcaagtttagcagcagcgtaccgcagcgctctttactcgagcaggcacaaaaacctatcgatatacgccagcgatcttcccagaaccgacaaaattggctggcagcctcagaatccagtagtgaggaagagtctccggtcaccggcagacggtcccaatcttcgcctccatactccaccatcgatcagaagctgctggttgacattcacgtccctgatgggtttaaagtggggaagatttccccaccagtgtatctcactaacgagtgggtgggatacaacgctcttagcgaaatattccgcaatgactggctaacaccagcacctgtgatccagccccctgaagaggatggggactacgttgagctttatgacgcctctgccgacaccgacggggacgatgatgacgaatctaacgacacattcgaagacacttatgatcatgccaacgggaatgacgatcttgataatcaggtggatcaggctaacgacgtgtgcaaggaccacgatgacgacaataataagttcgtggatgacgtcaataacaactactacgaggctccttcatgccctcgggcttcctacggtcgagacggctcctgcaagcaggatggctatgacggctcgagaggcaaggaagaggcgtaccgcggttatggctcccatactgctaacagatcccatggggggtccgccgccagcgaggacaacgccgccatcggggaccaagaggagcatgcggccaatatcgggagcgaacgtagaggatctgaaggagatggcgggaagggcgttgtccggaccagtgaggagagcggggcattaggcttgaacggcgaagaaaattgctcagaaaccgacggaccagggcttaaacgtccagcctcacaagattttgagtatttgcaagaggagcctgggggaggcaatgaggcttccaatgcaattgactctggcgccgctccctcggcacctgatcacgaatccgacaacaaggacatcagtgagtcctctactcaatccgatttttccgcaaatcatagttcaccctcaaagggaagtgggatgtctgccgacgccaattttgcctccgctattctatacgctggctttgtagaggtcccagaggaaagcccaaagcaaccgtccgaggtgaacgtgaatcccctgtatgtgtcccccgcatgtaagaagcctctaattcacatgtacgagaaggaattcactagcgagatatgttgtggttcactgtggggcgtcaacctgctattgggcacccgcagcaatctgtacctaatggaccggagcgggaaagccgatattactaagctgatcaggcggcgcccctttcgccagatccaggttctggaaccccttaatttgctgataacgataagcgggcacaagaatcgactccgagtctatcatctcacgtggttgagaaacaaaatcctgaacaacgatcctgaaagtaagaggcggcaggaggagatgctgaagacagaagaggcatgcaaggctatagataagctgacaggctgtgaacattttagcgttttgcagcatgaggaaaccacttacatcgctattgcactgaagtcttccatccatttatacgcctgggcgcccaagtcattcgatgagtcaaccgctatcaaggtgtgtattgatcagagtgctgattccgagggggactatatgtcataccaggcctacattagaatcctggccaagatccaggcggcagacccggttaatcgattcaagagaccggacgagctgctccatctacttaagctgaaagtctttcccacactggaccacaagcctgtcacagtcgatctggccatcggctcagagaagagactcaagattttcttttctagcgccgatggataccacctgatcgacgctgagagcgaagttatgtccgatgtaactctgcccaagaatccgctggagattattatcccccagaacattatcattcttcccgactgtttgggtataggcatgatgctgacgtttaatgcagaggctttatcggtggaagccaacgagcagctgttcaagaagatcctggaaatgtggaaggatattccgtcctctattgcttttgagtgtacccaaaggacgacaggctgggggcagaaggctatcgaggtacggtctctccaatcacgagtgctggaatccgagcttaaacgtaggtccatcaagaagctgcgcttcctttgtacgcggggcgacaaactgttctttacctcaaccctgaggaaccaccacagcagggtttactttatgacactgggaaaacttgaggaactgcagtctaattatgacgtctag

SEQ ID NO: 197318 - DNA, 567 bp, Artificial Sequence
  Description of Artificial Sequence: Synthetic coding sequence
atggccggccccggcggctggcgggaccgggaggtgaccgacctggggcatctccccgacccgaccggtatcttctctcttgataaaactattggcctcgggacatacggaaggatctatctgggcctccacgagaaaacgggagcttttacagccgttaaagtaatgaacgcccggaagacgccactgcccgagatcggacggagagttcgtgtgaataagtaccagaagtctgttggttggcgctacagtgacgaggaggaggacctgaggactgaactgaaccttctgaggaaatattccttccacaaaaatatcgtgtctttctacggtgcgttcttcaagctgagcccccccggacagaggcatcagctctggatggttatggagctctgtgccgccggttctgttacggacgtggttcgtatgacctcgaaccagtccctaaaggaggactggatcgcttatatttgccgtgagatccttcagcctaaggtcatctttttagggactggatgtagcgacagcagcctcaaaaaggagctgtgcttgaaacatcagaactag

SEQ ID NO: 197319 - DNA, 492 bp, Artificial Sequence
  Description of Artificial Sequence: Synthetic coding sequence
atgcaggtgccccgggagcggatcaagatcgccttccggctgtggatcccgatcctggttatcagaatcgttgtggccggaacatggcctcaagcaccagggctgtccaccctcgggctaaacattatcatacttccagactgcctcggtatcggaatgatgctgacgtttaatgcagaggctctttcggtagaggccaatgagcagctcttcaaaaaaattctcgagatgtggaaagatataccctcctccatagccttcgagtgtactcaacggaccacggggtggggtcagaaagccatcgaagtgcgttctctccagagtagagttctggaatctgagctgaagcgaaggtcgataaaaaagttacggtttctgtgtactagaggtgataaattatttttcacctccactctgcgcaaccaccattcaagagtgtacttcatgacactgggcaaactagaggaactccagtctaattatgacgtgtag

SEQ ID NO: 197320 - DNA, 1449 bp, Artificial Sequence
  Description of Artificial Sequence: Synthetic coding sequence
atgctgaagttccaggaggccgccaagtgcgtgagcggcagcaccgcgatctccacttatcccaaaacattaattgctcgacgatacgtgctacagcaaaaacttgggtcaggctcattcggaaccgtgtacctggtctctgataaaaaggcaaaaaggggcgaggaacttaaggtgctaaaagaaattagcgtgggggaactgaatccgaacgaaacggtgcaggcaaacctcgaagcccagctgctcagtaagctagatcaccctgccatcgtcaaattccacgccagctttgtagagcaggataatttctgcatcattacagaatactgtgaggggagggacctggatgataagatccaggagtataaacaggcaggtaaaatattccccgaaaatcagattattgagtggtttatccagctgttactcggtgtggattacatgcatgagcggaggatcctacacagggatctcaagagtaagaatgtgtttctgaagaacaatctgcttaagataggagattttggcgtgagccgactcctcatgggttcatgcgacttagctacaacactgacgggcaccccgcactacatgagccctgaggcactgaagcaccagggttacgacacgaaatccgacatctggtcgctcgcatgcatcttgtacgagatgtgttgtatgaaccacgcatttgcaggttctaattttctgagcatcgtgctcaagattgtggagggtgacactcctagcctgcccgaacgttaccctaaggagctcaacgccatcatggaatccatgcttaataaaaatccttcccttaggccctcggctatcgagatccttaagatcccctacttagatgagcagctccaaaacctcatgtgtcgctactccgaaatgacactggaggacaaaaatctggactgccagaaagaggcggctcacatcatcaatgcaatgcagaaaaggatccatcttcagactctacgtgcacttagtgaagtgcagaagatgactccaagggaaagaatgagactccgcaaactccaggctgctgatgagaaggcgcgcaaactcaagaagatagtcgaggagaagtacgaagagaattcaaagcggatgcaggaactcagaagccgtaatttccaacagctatcagtggacgtgctccacgagaagactcatcttaagggaatggaggagaaagaggagcagcctgagggccgtctttcctgctccccacaagacgaggatgaagagcgttggcaaggacgggaggaggagtccgacgaacctacactcgaaaacctaccggagagccagcccattcccagtatggatctgcatgagttagagagtattgttgaagatgcgacttctgatttggggtatcatggagattgcaacttgatctccctggacgagtactggaaaaatgagaaatag

SEQ ID NO: 197321 - DNA, 1938 bp, Artificial Sequence
  Description of Artificial Sequence: Synthetic coding sequence
atgctgaagttccaggaggccgccaagtgcgtgagcggcagcaccgcgatcagcacttatcctaaaactctcatcgcgagacggtatgtactccagcagaaactgggctctggatctttcgggactgtatatctggtgagtgacaaaaaggccaaaaggggcgaggaactcaaagtgctcaaagagatcagcgtgggtgaactaaacccaaacgaaactgtccaggccaacctggaggctcagctgttgtcgaagttggaccatccggctatagttaagtttcatgctagctttgtcgagcaggataatttctgcatcattaccgaatattgtgagggtcgcgatctggacgacaaaattcaggagtataaacaagcaggtaagatctttcccgaaaatcagataatcgagtggtttatacaacttttattgggcgttgactacatgcatgagcggcggatcctacatcgcgatttgaaatctaaaaatgtgtttttgaagaataatctccttaaaattggtgactttggcgtcagcagactactgatggggtcctgcgacctggctaccacattaaccgggacaccacactatatgtcacccgaggctttgaagcaccagggttacgacacaaaatctgacatttggagcttagcatgcatcctgtacgagatgtgttgcatgaatcatgctttcgcgggctccaacttcctgtctatcgtgctcaagatagtcgagggggacacccccagcttgccggagcggtacccgaaggagctcaatgccattatggaaagcatgttgaacaagaatccgtcactgaggcccagtgccatcgagattttaaagattccttatctggatgagcagctgcagaatctgatgtgtagatattcagaaatgactctcgaggataaaaatctggactgccagaaagaagctgcccacatcatcaatgctatgcaaaaaaggatccaccttcagacgctacgcgctttgtctgaagtccagaagatgacccccagggaacgtatgaggctgaggaagctccaggcagcagacgaaaaagctaggaagttaaagaagatcgtcgaggagaaatacgaagagaattctaaacggatgcaggaactacggtcccggaactttcagcaactttcagtcgatgtcctccacgagaagacccaccttaaaggaatggaagaaaaggaagagcaacccgaaggtcggctgtcatgttctccgcaggacgaggacgaggagagatggcagggcagagaggaagaatcagacgaaccgaccctggaaaacttaccggagtcccaacccatcccgtcaatggacctgcacgagctggagagcatcgtggaggatgctaccagcgacttaggataccacgaaatcccagaggacccactggtggctgaagagtactacgcagatgcttttgatagctactgcgaggagtctgacgaggaggaggaggaaatcgccctcgaaagacctgaaaaggaaatcaggaatgagggctcccagccagcatatcgcacaaaccaacaggacagtgatatagaggctctggcccgctgtctggagaacgtgctcggttgtacatcgttagacacgaagactatcactacaatggcagaagacatgtctccaggtccgccgatctttaactccgtgatggcacggacaaagatgaaaaggatgcgtgaatcagctatgcaaaagctaggaacagaggtatttgaggaagtttacaactacctgaagcgtgccaggcatcagaacgccagtgaggccgaaatcagggaatgcttggagaaagtggttccacaggcatctgattgtttcgaggtggaccaattactgtatttcgaggaacagttgctgatcacaatgggcaaagaaccaaccctccagaaccatctctag

SEQ ID NO: 197322 - DNA, 1386 bp, Artificial Sequence
  Description of Artificial Sequence: Synthetic coding sequence
atgcacgagcggcggatcctgcaccgggacctgaagagcaagaacgtatttctgaagaataatctgctaaaaatcggtgattttggcgtttcccgcttacttatgggaagctgtgatctcgccacaaccctaaccggtacaccccactatatgtctcccgaagctttgaagcaccagggttacgacacgaagagcgatatttggtctctggcatgcattctttatgagatgtgctgtatgaaccacgctttcgccggatctaatttcctgagcatcgtgctcaagatcgtggaaggagacaccccgagtcttcctgaaaggtaccccaaggaactcaatgccatcatggagagtatgctcaacaaaaatccgagcctgaggccaagcgccatcgagatactcaagataccctaccttgatgagcagctgcagaatttgatgtgccgatacagcgagatgaccttagaggataaaaacctggattgccagaaggaagccgcccatatcataaacgctatgcagaagcgcattcatcttcagacattgcgtgccttgtccgaggtgcagaaaatgacacctcgtgagcgcatgcgcctcagaaaactccaggccgccgacgagaaagcacgcaagctgaagaagattgtcgaggagaagtacgaagaaaattctaagcgcatgcaggaactccgcagtaggaacttccagcaattaagtgtagacgtcctgcacgaatccgacgagcccacattggagaatctgccagagagccagcctattcccagcatggatctccatgaattggaatctatagttgaagacgctacctcagatcttggctaccatgaaattccggaggacccactggtcgccgaggagtattacgcggatgcttttgacagctactgtgaagagtcggatgaggaggaagaggaaatcgctctggagaggcccgaaaaggagatcagaaacgaagggtcacagcccgcatataggacaaaccagcaggacagcgacatcgaggcccttgcccggtgccttgagaatgtgctgggttgtacctctctcgacacaaagacaattactaccatggctgaggacatgtccccaggacctccgatctttaacagcgtgatggcccgaactaagatgaagcggatgcgcgaaagcgctatgcagaagcttggcactgaagtctttgaagaagtttacaactatctgaaacgggccaggcaccaaaatgcttcagaagctgaaatccgcgagtgtctggaaaaagtggttccacaagcctcggattgcttcgaggtcgaccagctactctacttcgaggagcagcttctgatcacaatggggaaggaacccacattacaaaaccacctgtag

SEQ ID NO: 197323 - DNA, 1938 bp, Artificial Sequence
  Description of Artificial Sequence: Synthetic coding sequence
atgctgaagttccaggaggccgccaagtgcgtgagcggcagcaccgcgatcagtacataccccaagacacttattgcccgtcgttatgtgttacagcagaagttggggtccggcagtttcggcaccgtgtacctggtcagtgacaaaaaggccaagcggggggaagagcttaaagtactgaaggagatctctgtcggggagctcaaccctaatgaaacagtccaggcaaatttggaggcccagttgctatcaaagcttgaccatcccgcgattgtgaaattccatgcctcttttgttgaacaggataatttctgcatcatcacggagtactgcgagggcagggacctggacgacaagattcaggagtataagcaggccggaaagatatttccggaaaatcaaatcatcgaatggtttatacagttgttgctgggcgtggactacatgcatgagagacggatattacaccgggatctgaaatctaaaaacgtcttcctgaagaataatctgctcaagatcggagatttcggcgtctcccgccttctgatgggatcatgtgacttagccaccacactcactggtaccccacactatatgtctccagaggccctcaaacaccaaggctatgatacaaagtccgatatttggtccctggcgtgcatcctctacgaaatgtgttgtatgaatcacgctttcgccggatccaacttcctgtccatcgttttgaaaatcgttgagggggacacacccagcctccccgagcggtatccaaaggagctcaacgctattatggagtccatgcttaataagaacccaagcttaagaccatcagcgatagagatactgaagatcccttatcttgatgaacagctacagaacttgatgtgccgatattccgaaatgactctcgaggataaaaaccttgactgccagaaagaggcggcacacattatcaacgcgatgcaaaaaaggatacacttgcagacacttcgagcactgtccgaagttcagaagatgactccaagagagcggatgcgcctacgcaaactccaggccgcagatgagaaagcccggaagctaaaaaagatcgtcgaggaaaagtatgaagagaattcgaaacggatgcaggagctgagatccagaaatttccagcagctgtcagttgacgtgttacatgagaaaacacatctgaagggcatggaagaaaaagaggagcaacctgaagggagattgagctgctccccgcaagatgaagatgaagagaggtggcagggcagggaggaagagtcggacgagccaacactcgaaaacttgccagagtctcaaccaattccaagtatggaccttcacgagctggaaagtatcgtcgaggacgccactagcgatctgggataccatgagatccccgaagaccctctggtggctgaagaatactacgccgatgcctttgacagttactgtgaagagtcagacgaagaggaggaagaaattgctcttgaacgacctgagaaagaaatccgcaacgaaggaagccagcccgcttatcgcactaatcaacaggacagcgacatcgaagccctggcgcgctgcctcgagaacgtgctcggctgcacctccctcgataccaagactataacgacaatggccgaagacatgtctcctgggcctccaatatttaattcagtcatggccagaaccaaaatgaagaggatgagagaaagcgctatgcagaaacttggtaccgaggttttcgaggaagtgtacaactatctgaaacgagcaaggcaccagaatgctagcgaagcagaaatcagggagtgccttgagaaggtggtgcctcaagcatcggattgcttcgaggtggatcaactactgtattttgaggaacaactgctcatcacaatgggtaaagaaccgaccctgcagaaccacctctag

SEQ ID NO: 197324 - DNA, 1449 bp, Artificial Sequence
  Description of Artificial Sequence: Synthetic coding sequence
atgctgaagttccaggaggccgccaagtgcgtgagcggcagcaccgccatcagcacctacccaaaaacactcatcgctcgtcgatacgttttacaacaaaagttgggttcaggcagctttggcaccgtgtacctagtgtcagataaaaaggcaaagaggggagaggagctgaaggtgcttaaggagatttcagtaggcgagttaaatccgaacgagaccgtgcaagccaatttagaagcacagctgctgagtaaactggatcatcccgcgatcgtgaaattccatgcgagcttcgttgagcaggataacttttgtataattaccgaatactgtgaaggcagggatcttgatgacaaaattcaagaatacaagcaggctggcaagattttccccgagaaccagataattgagtggtttattcaactcttgcttggggtagattatatgcatgaacggagaatcctgcatcgtgatttaaaaagcaagaacgtatttctcaagaacaacctgctgaagattggagacttcggtgtctcccgccttttgatgggatcatgcgatttagctacgaccctgacaggcacaccccactacatgtcacctgaagcactaaagcaccaaggttacgacactaagagcgacatatggtccctagcgtgtatcctgtacgagatgtgctgcatgaaccacgctttcgctggcagcaatttcttgtcaattgttttaaagatagtcgagggcgatacccccagcttgccggagcgttaccccaaggagcttaacgccatcatggaaagcatgctgaataagaatccgtcgctgcggcctagcgctatcgagattttaaagattccctacttggatgaacagttgcaaaatttgatgtgtcggtactccgagatgacgctagaagataaaaacctggattgtcaaaaagaggccgcccacataatcaatgccatgcagaagagaatccatctgcagaccctgagagcccttagcgaggtccaaaagatgacgccacgtgaacgcatgcggctcagaaagctacaggcggcggatgagaaggctcgcaagctcaaaaagatagtagaggagaagtacgaggagaacagcaaaagaatgcaagagctccgcagcagaaactttcaacaactgagtgttgacgtgctgcacgagaaaacccatctcaaggggatggaagaaaaggaagaacagcccgaaggcagattatcttgcagtccgcaggacgaggatgaggaacggtggcaagggagagaggaagagagcgacgagccaacactagagaatctgcccgagtcccagccaataccctctatggatctgcacgaactggaatccatcgtagaggatgctacctctgatttgggctatcatggagactgcaacctaattagtctggacgaatactggaaaaatgagaagtag

SEQ ID NO: 197325 - DNA, 1938 bp, Artificial Sequence
  Description of Artificial Sequence: Synthetic coding sequence
atgctgaagttccaggaggccgccaagtgcgtgagcggcagcaccgccatcagtacctatcctaaaactctcattgcacgacgatatgtactgcagcagaagctgggcagcgggtccttcgggacggtctacttagtttcagacaagaaggccaaaaggggagaggaactgaaagtgttgaaagaaatttccgtgggagagttaaatcccaacgaaacagtgcaggccaacttagaagcacagttgctgtcaaaactggatcatcctgctatagtgaagtttcacgcttcattcgtggaacaggataacttctgcattattaccgaatactgtgaagggcgagacctggatgacaagattcaggagtacaaacaggctgggaaaatcttccctgagaaccagatcatagaatggtttatccagctgctgttaggagttgactacatgcatgagcgtaggatcctgcaccgggatcttaaaagcaagaacgtcttcctcaaaaataacttgttaaagatcggtgatttcggtgtgtctaggctcctcatggggtcttgcgacctggccactactctcactgggactccacactacatgtcccctgaagccctgaagcaccagggatacgacacaaaatccgacatttggagtctggcatgtatcttatatgagatgtgttgtatgaaccacgccttcgccggatcgaatttcttgagtattgttctgaagattgtagaaggagatacaccaagcctccccgagagatatccaaaggagctgaacgcaattatggagagcatgctgaacaaaaaccctagcctgcgacccagcgccattgagatcttaaaaattccttacttggacgagcagttgcagaatctgatgtgtagatattctgaaatgacacttgaggataaaaatttggattgccagaaggaggccgcccatatcatcaatgccatgcagaaaagaatacacctgcagactctgcgagcacttagcgaggtgcagaagatgactcctcgcgaaagaatgcgcctcagaaagcttcaggccgcagacgaaaaagccaggaaactcaagaaaatcgtagaggagaagtacgaggaaaacagtaagaggatgcaggagctaaggtccagaaacttccagcagctgagcgtggacgtcctccacgagaagacgcacctgaagggcatggaagaaaaggaagaacaaccggaaggcaggttgtcttgtagcccccaggacgaggacgaggagcgctggcaaggacgcgaggaggagtcagacgaaccgaccctggaaaatcttccagagtctcagccgatcccttctatggatctgcacgagctagagtccatcgtggaagacgctaccagcgacctaggctaccatgagattccggaagatcccttggttgctgaagagtactatgccgatgcttttgacagttattgcgaggaaagcgacgaagaagaggaggagattgctctggaacggcctgaaaaagagattcgaaacgaaggcagccagcccgcttaccggaccaatcaacaagactccgatatcgaagccctggctagatgtctcgagaacgtgctcggttgtacatctttagacaccaaaaccataaccacaatggcggaggatatgtcccccgggcctcccatctttaattcggtgatggcccggaccaagatgaaaaggatgcgtgagtcagctatgcagaaactaggtacagaagtgttcgaagaagtttacaactacctcaaaagagccaggcatcagaatgcctcagaggccgagatacgagagtgtctagaaaaggtcgtgcctcaggccagtgattgtttcgaagtcgaccaactcctctattttgaggaacagcttctcataactatggggaaagaaccaacgctacaaaaccacctgtag

SEQ ID NO: 197326 - DNA, 1413 bp, Artificial Sequence
  Description of Artificial Sequence: Synthetic coding sequence
atgctgaagttccaggaggccgccaagtgcgtgagcggcagcaccgcaatttcgacatatcctaagactcttatagcacgcagatacgtgctccagcaaaagttgggtagcggcagctttggcaccgtgtacctggtgagcgataagaaagccaagcgaggggaagaactgaaggtgctgaaggaaataagcgtgggcgagttaaaccccaatgagacagtccaagccaatctggaggctcagctgttatcaaagctggaccaccccgctatagtcaaatttcatgcttcattcgtcgaacaggacaacttttgcattattacagaatattgtgagggcagggatctggacgataagattcaagagtataagcaggcgggcaagatctttcccgaaaatcagataattgagtggtttatacagctgctgctaggcgtggattatatgcacgaacggcgcattttgcacagggatctgaagtccaagaacgttttcctgaaaaataacctgctgaaaattggagacttcggcgtctcccggcttctgatgggctcatgcgaccttgcaacaactttgacagggacaccccattacatgtctcctgaggctttaaagcaccaaggctacgacaccaaatctgacatctggtcactggcctgtatcttatacgagatgtgttgcatgaatcacgcattcgctggctccaatttcctgtcaattgtactcaaaatagtggaaggtgacactccttctctccccgaacgctaccctaaggaactcaacgccattatggaaagcatgctcaataagaaccccagcttacggcctagtgctattgaaatcctgaagattccctatctcgatgagcagttacagaacttaatgtgtcggtacagtgagatgaccctcgaagacaaaaaccttgattgccaaaaagaggccgcacacatcataaatgctatgcaaaaacgaatacatctgcaaaccttgcgggcactttcagaggttcagaagatgacacccagagaacgcatgcggttaaggaaactgcaagcggccgacgagaaggcgcgtaagttgaaaaagatcgtggaggagaagtacgaggaaaattccaagcggatgcaggagctcagatccaggaattttcagcaattgtcagtagatgtgctccatgaaaaaacacacttgaaaggaatggaagagaaggaggagcaacctgagggacggctgtcctgtagcccacaagatgaagatgaagaaagatggcaggggagggaggaagagagtgatgagccgacgctcgagaatttgcctgaatctcagcctattccatctatggatcttcacgaactggaaagcattgtcgaggatgccactagcgacctgggctaccacgccactcattcttag

SEQ ID NO: 197327 - DNA, 2079 bp, Artificial Sequence
  Description of Artificial Sequence: Synthetic coding sequence
atggagaagtacgagcggatccgggtggtgggccggggcgccttcggtatagtgcatctgtgcctgcgcaaggctgaccagaagctcgttattatcaaacagatccccgtggaacaaatgaccaaagaggaacgtcaggcagcacagaatgagtgccaggttctgaagttacttaaccacccgaatgtaattgaatactacgaaaacttcttggaggacaaggcccttatgattgccatggaatacgcgcctggagggacgcttgcggagtttattcagaaaagatgtaacagcctgctcgaagaagagacaatcctccacttttttgttcagatcctgctggcgctgcaccacgtccatactcacctgattctccatagagatttgaagacccagaatatcctcctcgataagcacaggatggttgtgaaaattggagatttcggcatcagtaaaatactgagtagcaagagcaaggcttacaccgtggtgggaacaccgtgctatatttcacctgagctgtgtgagggaaaaccgtataaccagaagtccgatatttgggccctggggtgtgtgctgtatgaactggccagcttgaagagggctttcgaagccgcaaatctgccagcgcttgtgctcaagatcatgtccggaactttcgccccgatttctgaccgctattcccccgaactgcgccagctagtactcagtttactgtcacttgaaccagcacaaagacctcctctgtcccacataatggcccagccgctctgcattcgcgcattgctgaatttgcatacagatgtgggttctgtgaggatgaggagagcagaaaagtcagtggcaccgtccaacactggcagccgcacaacgtcagttaggtgccgagggatccccagaggtcccgtcagaccggctattcctcctccactgtcttcagtttatgcttggggcggcggccttggaacacccctacggttgccaatgctcaacacagaagtcgtccaggtcgccgccggccgtacacagaaagcgggcgttactcgctcaggaaggctcatcctgtgggaggcacctcccctgggggcgggcgggggaagcctcctgcctggagccgttgagcagccacagccacaatttattagtaggttcctcgaagggcaatccggtgtgaccatcaagcatgttgcatgtggggacttttttactgcttgcctcacagataggggcatcatcatgaccttcggctccggttccaatggttgcctcggacatggctccttgaccgacatctctcagcccaccattgtggaggcattgcttggatatgaaatggtgcaggtagcatgcggggcgagccatgtccttgcactgtcaaccgaacgtgaacttttcgcgtggggccgcggcgattcaggtcgtttgggccttggcactagagaaagccattcctgtccacagcaggttccgatgccccctggccaggaagctcagcgcgtcgtatgtggcatcgattcgtcgatgattctcaccgtacctgggcaggctctggcatgtgggtctaacagattcaacaagctggggctggaccatctaagtcttggcgaggagcccgtgccacaccagcaggtggaagaggccctgtcctttaccctccttggctccgctcccctggaccaggagcccttgctgtctatcgatctaggtacagcccactctgcagctgtgaccgcatctggtgattgctacacgttcggtagtaaccagcacggccaactgggcacaaacacccggcgaggctcaagagccccatgcaaagtccagggactcgaaggcattaaaatggccatggtggcttgtggtgatgcttttaccgttgcgattggagctgagtcagaagtctattcttggggcaagggcgctcgaggtcgtttaggtcgcagagacgaggacgccggattaccccgtccagtgcagctggatgaaactcacccgtatactgtaacatccgttagttgctgccacgggaacaccctgctggcagtccggagcgtgaccgatgagcccgttcctccctag

SEQ ID NO: 197328 - DNA, 1383 bp, Artificial Sequence
  Description of Artificial Sequence: Synthetic coding sequence
atggagaagtacgagcggatccgggtggtgggccggggcgccttcgggatagtgcatctgtgcctcagaaaggctgatcagaagttagtcataattaagcagatcccggtagagcagatgactaaggaggaacgacaagcagctcaaaatgaatgccaggtcctaaagttactgaatcaccccaacgtcatcgaatactacgaaaacttcctcgaggacaaagccctgatgattgccatggaatacgcccccggcggcacactggctgaatttatccagaagagatgtaattcccttctggaagaggaaacaattctgcattttttcgtccagatccttctcgcgcttcatcacgtgcacacccaccttatcctccatagagacctcaagacccagaacatcctcctcgataagcaccgcatggtcgttaagattggggacttcggcatcagcaagatcctttcttctaagtctaaagcctacacagtggtcggtactccatgttatatctctcccgaactctgcgaaggcaagccttataaccagaagagtgatatttgggctttgggttgcgtcctgtatgagcttgctagcctcaagagggcattcgaggccgcaaacctgccagcgctggtcctcaagatcatgagtggtactttcgctcctatttccgaccgctatagtcctgaattgagacagcttgtcctcagcttgctgtccctagaaccagcacagcgaccccctctgtcccacataatggctcagcctctctgtatccgggccttgctgaatcttcataccgacgtgggcagcgttcggatgcgaagaccagttcaggggcagcgggccgtcctgggcggacgggtttgggcaccgagcggaagcacagggggcctgcgccaacgcgagacatggggaaagtccagtctgcccgcatgccgaaatgtgcggcgagtgttcgttcttaggccgccatctgtactgcagggcagagaggttagaggcccccagcagcaccgcgagcaggaccaccagtgtcctttgcagagatacccaccagggacatgcgaggcgtcacaccctactacaacagtggtcagcgtatgcctgggatggtgggcaggacatccacccgcggcagccaatgcccagcatcggggcggccccggcggcagttgggcgcatgccgagagtaggagacatgcactgtgggcaagccaccccgtggggggtccaaccccacgctgtcggcgaagacagagtccatcctggggcagtggggctgctaccgctcctgtgcatctcgcatttcccgggggcccagtcggatgtgaccatcaggctcgaggactttggggcctgctgcactgccttcctgattag

SEQ ID NO: 197329 - DNA, 2940 bp, Artificial Sequence
  Description of Artificial Sequence: Synthetic coding sequence
atgagcgtgctgggcgagtacgagcggcactgcgacagcatcaacagcgacttcggcagcgaatccggaggttgcggggattctagccccgggccctctgcgtcacaaggacctagagcaggaggcggggcggccgaacaggaagaactgcactatatccccattcgtgtacttggcaggggagcctttggggaggcgaccctgtaccggaggacagaagatgattcgcttgtcgtatggaaagaggtcgacctgactagactgtccgagaaggaaaggagagatgccttgaatgagatcgtgatccttgccctccttcagcacgataacataattgcatattacaatcatttcatggacaacacaactctgcttatcgaattggagtattgtaacggaggtaacctgtatgacaaaatactccggcagaaggacaaattattcgaagaggagatggttgtgtggtacctctttcaaatcgtgagtgccgtttcatgtatccacaaggcaggaatcctgcacagagatatcaagactctcaatatcttcttgactaaagcgaatctgattaaactaggagactatggacttgctaagaagctgaacagcgaatattccatggctgaaaccttggtcggtaccccttactatatgtccccagaactgtgccagggggtgaagtacaatttcaaatctgacatatgggcagtcggctgcgttatcttcgagcttctgacactaaagcgcacttttgacgctaccaacccgctgaatttgtgcgtgaagatcgtccagggaatacgagctatggaagtcgatagcagccagtactccctggagctgatccagatggtccacagctgcctggaccaggacccagagcaacggcctaccgccgacgaactccttgaccggcctctgctccgcaagcgcagacgcgagatggaagagaaggttaccttgctgaatgctcctacgaagcgccccaggagtagcaccgttactgaagctcccattgccgtagtcacgagtcgaacctccgaagtgtacgtatgggggggaggaaaatctacccctcagaagctggatgtcattaagtccggctgttcggctcggcaggtctgtgccgggaacacacacttcgctgttgtcactgtggaaaaagaactgtacacatgggtcaacatgcaggggggtacaaaacttcacggacaattgggacacggagacaaggcatcttacagacagccgaaacacgtggagaaactccagggaaaagccatccgtcaagtgagttgcggggatgattttaccgtctgtgtgacagacgaagggcagctatacgcgtttgggtccgactattatggatgcatgggagtggataaggtcgcgggccctgaggttctagagccaatgcagctcaatttctttttgtccaatccagtagagcaagtctcttgcggtgacaaccacgtggtggtgctcactcgcaacaaagaagtctacagttggggctgtggtgagtacggacggttgggtctagactccgaggaagactattataccccccaaaaagttgatgttccaaaggcattaataattgtggctgtccagtgtggttgcgatggcacatttcttctcacccaatccggcaaagtcttagcctgcggcttaaatgaatttaataaattaggcctcaaccagtgtatgagtggaatcattaatcatgaagcctaccacgaggtgccttacactacatcattcaccctggcaaagcagctttcattctataaaatacgtactatcgcgcctggaaaaactcacactgccgccatcgatgaaagaggcagactgctaacctttggatgtaataaatgtgggcagcttggtgtggggaattacaagaaacggctggggattaatctgctaggcggcccactgggaggcaagcaggtcatccgggtctcatgtggcgacgaattcactatcgccgccacagatgataaccacatcttcgcctggggcaatggcgggaacggacgcctggccatgacacctaccgagcgcccacacgggtccgatatttgcacttcttggcctcgtcccatcttcggtagcctccatcacgtgccagacttatcctgtcgtggatggcacaccattcttatcgtggagaaggtgctgaatagcaagaccataaggtcgaattctagcggtctttcaattggcacggtgtttcagtcttcctctcccggtggaggaggggggggcgggggtggcgaagaggaggattcccagcaggagtcagaaacccccgaccctagtggggggtttcggggaacgatggaagcggatagaggtatggagggactcatttctccaacagaagccatggggaactccaacggcgcttctagctcctgtccaggttggcttagaaaggaactagaaaacgctgaattcatccctatgcccgacagccctagccctctgtcggcagctttctccgagagcgagaaggacacccttccatacgaggagctgcagggcctcaaagtcgcctctgaggctcctctggagcataagccgcaggtggaagcaagctcaccccggttgaacccagctgttacatgtgccggcaaaggtacccctcttacaccgcccgcatgcgcttgttcctcccttcaggttgaagtggagcggctccagggactggtcctgaagtgcctggcagagcagcaaaagttgcagcaggaaaacctgcagatattcacccaattgcagaagctgaacaagaagttagagggtggccaacaggtgggcatgcactctaaggggactcaaaccgccaaggaagaaatggagatggatcctaaaccagacttggatagcgattcctggtgtcttctgggaaccgactcgtgtaggccgtccctttag

SEQ ID NO: 197330 - DNA, 1545 bp, Artificial Sequence
  Description of Artificial Sequence: Synthetic coding sequence
atgagcgtgctgggcgagtacgagcggcactgcgacagcatcaactctgacttcggaagcgagtcaggagggtgtggcgatagctcccccgggccttctgccagccaggggcctagggctggtggcggagcatttggcgaggccacactgtaccggaggaccgaagatgactctctcgtggtctggaaagaggtggaccttaccaggctgtcagagaaagagcggcgggacgcgctgaacgaaattgtgattcttgctttgctgcagcatgataatatcatagcctactataatcatttcatggataacaccacattgcttatcgagcttgagtactgtaacgggggaaacctgtacgataagatcttgcgccagaaggataaactattcgaggaagagatggtagtttggtacctattccaaatcgttagcgcggtatcgtgcatccacaaggcaggaattctgcaccgggatatcaaaacacttaacatcttcctgaccaaagcaaacttgatcaagcttggcgactacggactggccaaaaaattgaatagcgaatacagtatggcagagaccctcgtaggcactccttattatatgtcacctgagctctgtcaaggcgtgaagtacaactttaagagtgacatatgggcagttggctgcgttatatttgagcttcttaccctgaagagaacatttgatgccactaatccgctaaacctgtgcgtgaagattgtgcaagggattagggccatggaagttgacagctcacaatacagcctggaacttattcagatggtgcactcttgcctggatcaggaccctgagcagcgccctaccgccgacgaactcctagaccggcctctgcttagaaagagaaggagggagatggaagaaaaggtaaccctgctcaacgctccaaccaaaaggcccaggtcaagcaccgttactgaggctcctattgcagtagtgacaagccggacatctgaagtgtacgtatggggggggggtaaatcaactccacagaaattagacgtgattaaatcgggctgttctgcccgccaggtgtgtgcaggaaatactcactttgcagtggtgactgtagagaaggaactgtatacctgggtcaatatgcagggaggaaccaagctgcacggacagctcgggcatggggacaaagcttcctatagacagccgaaacacgtggagaagctgcaggggaaggccatacgacaggtgtcctgcggagacgacttcacagtatgtgtcacagacgaggggcagttatatgcctttggctcagactactatggctgcatgggcgtggataaagtggctggcccggaagtgctggagcctatgcaattgaactttttcctgtcaaaccctgtggagcaggtctcatgcggcgacaatcatgtggtcgtgctgacacgtaacaaggaggtgtactcctggggctgcggagaatatggtcgtggatctctggtctcagtgcattttttcactgggattcaaccagactttaaagtggtatgcatttag

SEQ ID NO: 197331 - DNA, 3777 bp, Artificial Sequence
  Description of Artificial Sequence: Synthetic coding sequence
atggagaagtacgtgcggctgcagaagatcggcgagggcagcttcggcaaagccatcctggtgaagtctaccgaagatgggcgacagtacgtgatcaaggaaataaatatcagcaggatgtcttccaaggagcgcgaagagtccaggagagaggtggcagtgttggcgaacatgaaacacccgaatattgtgcagtatagagagtcctttgaagagaacgggagcctttatattgtgatggattactgtgaaggcggagatttatttaagcggattaatgctcaaaagggggtactgtttcaagaggatcagattctagactggtttgttcaaatttgtctcgctttgaagcatgtgcacgatcgaaaaattctccatcgagatattaaaagccaaaatatcttcctgacaaaagatggtacagtgcaactgggcgacttcggtatagctcgggtactgaattcgacggttgaactggctcggacttgtatcggcactccttattatctgtcgcctgagatatgtgagaataaaccctacaacaacaaatcagacatttgggctctcgggtgtgtcctctacgagctctgtactctcaagcatgcatttgaggcagggtccatgaaaaatctggtgctcaaaataataagcgggagctttcccccggtgagtctgcactactcatacgacctgaggtcactggtaagtcagctctttaaacgcaatcccagagaccgcccatctgtgaacagtatattagaaaagggatttattgcaaaaaggatcgagaagtttttatccccccaattaattgcagaggagttctgtctcaagactttttcgaagtttggctcacaacctataccagccaaaagacccgcatcgggtcagaactcgatctctgtaatgccagcacagaagattaccaaacccgcagccaaatacgggattccactggcgtataagaaatacggggacaagaagctgcacgagaagaagcctcttcagaaacataaacaagctcaccagactccggaaaaacgcgtgaacaccggcgaagaacgccgcaagatcagtgaagaggccgctcgcaaaagaagacttgagtttattgagaaggagaaaaaacaaaaagatcaaataatatccctgatgaaagctgaacagatgaagcggcaggaaaaggagagactggaaaggatcaatagagccagagagcaaggctggagaaatgtcttgagtgccggcgggagcggagaggtgaaagcaccctttctcggttctggagggacaattgccccttcttcctttagctcacgcgggcagtatgaacattatcatgcaatcttcgaccaaatgcagcagcagagagcagaagacaatgaggccaaatggaaacgggaaatttacgggcggggactgcccgagcgcgggattctgcctggtgtgcgacctggatttccatacggagcggcaggacaccatcactttcccgatgctgatgatatacggaaaactttgaaacgcctgaaggctgtctccaagcaggctaacgctaataggcagaaggggcaactcgccgtggagcgggccaagcaggtagaggagttcttgcaacggaagagggaagccatgcagaacaaggctcgagcagagggacatatggtgtatctcgcgcgactgagacagatccgtctgcagaattttaacgaacgacaacagattaaggctaagctgcgcggagagaagaaagaagccaatcactccgaaggtcaggagggcagtgaggaggccgacatgcggagaaagaagatcgaaagcctgaaagcgcacgccaacgctcgtgccgccgtgctgaaagagcagctggaacgcaaaaggaaagaagcctatgagcgggagaaaaaagtctgggaagaacacctggtcgctaaaggggtgaaaagttctgatgttagccctccactgggtcaacacgaaacaggtggctctccaagcaagcagcagatgcgctctgtgatctctgttactagtgcgctgaaggaagtcggagtggactccagcctcactgacacccgcgaaacatccgaagagatgcagaagactaacaatgccatcagttcgaagcgggagatcctcagacggctcaacgagaatttgaaagcccaagaggacgagaaaggaaagcagaacctgagcgataccttcgaaattaatgtacacgaggatgctaaagaacacgagaaggagaagtcagtgagctctgaccgcaagaagtgggaggccggaggccagctcgtgattccgctcgacgaacttacgttagatacgtcattttccactactgagcgccataccgtcggggaggtgataaagttagggccgaacggcagcccacgacgagcatggggcaaatctcccaccgattctgtcctaaagattttaggggaagcagagcttcagcttcaaaccgagctcctggagaacaccacaattcgatccgaaatcagcccagagggtgaaaagtataagccgctcattactggcgagaagaaggtgcagtgcattagtcacgagattaacccaagcgccatagtagactcacccgtggaaacaaagtctccagaattctctgaagctagccctcaaatgtctctgaagctggaaggtaacctggaagaacctgatgacctggaaacagaaatcctgcaggagcctagtggaaccaacaaggatgaaagcctgccttgcacgattacggacgtatggataagcgaagaaaaggagactaaggaaacacaatccgcagacaggattacaattcaggaaaacgaagtctccgaagacggcgtgtcctcaaccgtggatcagctttctgacatccatatcgaacccggcaccaacgactcacagcacagtaagtgtgacgtggataagagcgtccagcccgagcccttttttcataaagtggtccattctgagcacctgaacctcgtgcctcaggtccagtcagtgcaatgttcacccgaggaaagtttcgcattcaggagtcactctcatctgcctcctaagaacaaaaataaaaactcactcttgatcggactctccaccggcctgttcgacgctaacaaccctaagatgctgcgcacatgctctctgcccgaccttagcaaattgtttaggacccttatggacgtgccaactgtaggcgatgtgcgacaggataatctggaaattgacgagattgaagacgagaacattaaggagggtcccagcgattcggaggacatcgtgtttgaggaaaccgatacagatctgcaggagttgcaggccagcatggagcagctcctgcgcgaacaaccgggcgaagagtattccgaagaggaagaaagtgtccttaagaacagcgatgtcgagccgaccgctaacgggacagatgtggcggacgaagatgataacccatccagcgagagcgcattgaatgaagaatggcactccgataactctgatggcgaaattgcatctgaatgtgaatgcgatagcgttttcaaccatctcgaagagcttcgattgcacctcgaacaagaaatgggcttcgaaaagttctttgaggtttatgagaagataaaggccatccacgaagacgaggatgaaaatattgagatttgctccaagattgtccagaatatattgggaaacgaacaccagcatctctatgctaaaattctgcacctcgtgatggcggatggcgcatatcaagaagataacgatgaatag

SEQ ID NO: 197332 - DNA, 3861 bp, Artificial Sequence
  Description of Artificial Sequence: Synthetic coding sequence
atggagaagtacgtgcggctgcagaagatcggcgagggcagcttcgggaaagcaatcctagttaagtccacggaagatggacgccagtacgtgatcaaagaaattaatatatcacgaatgtcttcaaaagagcgagaggaatctcggagagaggtcgcagtgctggcaaatatgaaacatcctaacattgtccagtatagagaatccttcgaggagaatggttccctttacatagtgatggactactgcgaaggtggggacctgttcaaaaggattaacgcacagaagggcgtgctgttccaggaggaccaaatcctggactggttcgtgcagatttgcctggcgctgaaacatgtacatgatagaaagatcctccacagagatattaagtcccagaacattttcctgactaaggacggcaccgtccaactcggggactttgggatcgcccgggtcctcaatagtactgtggagctcgctcgaacatgcatcgggactccttattacctgagcccggaaatttgtgagaataagccatacaacaacaagagcgatatttgggccctgggatgtgtgctgtacgagttatgtacactgaagcatgctttcgaagctggcagtatgaaaaatctagtgctgaaaatcatctcaggctcctttccaccagtgagccttcactattcttatgatctccgctccttagtgtcgcagctgtttaaacggaatcctagggatcggcccagcgttaacagtatcctggaaaagggatttattgctaaacgcatcgaaaagtttctcagccctcagctgatcgcggaagaattttgtttgaagacattctcaaaatttggaagccaacccataccggcgaagcgccccgcctcaggccaaaactctatcagcgtgatgcctgcccaaaagatcaccaaaccagcagccaaatacggcattcctctggcatataagaaatacggcgacaaaaaactgcacgagaaaaaacccctgcagaagcataagcaagcccatcaaacccctgagaagagagtcaatactggcgaggaacgaagaaagatttcagaagaagctgccaggaagcggcggctggaatttatcgagaaggagaagaagcagaaggaccagattatctccctgatgaaggctgaacagatgaagagacaggaaaaagaacgattagagcgcattaaccgtgcgagagaacaggggtggcggaacgtgctttccgccggcggatcaggagaagttaaggccccgttcctcgggtcgggtggcaccatagccccttcatccttctccagccgggggcagtacgaacactatcacgccattttcgaccaaatgcagcaacagagagccgaggacaacgaggcaaagtggaagcgcgagatctatggccggggactgcctgagcgcggaattctgcccggagtccgcccaggattcccgtatggtgcagccggccatcaccacttcccagatgccgatgacatccgaaaaaccctgaagcggctgaaggctgtttctaagcaggccaatgcaaatagacagaagggccagcttgccgtcgaaagggcaaagcaggttgaggagtttttacagcggaaaagagaggcaatgcaaaataaggcgagggcagagggtcacatggggatcttgcagaacctggctgccatgtacggaggccgccccagtagctcccggggagggaaacctagaaacaaggaggaggaggtatatcttgcacgcttgaggcagattcgattacagaactttaatgaacgccagcagataaaggccaaattgagaggcgaaaagaaggaagccaatcattctgagggacaagaaggtagcgaagaggccgatatgaggcgtaaaaagatagaatctctgaaagcccatgctaacgcaagagcagccgtactgaaggaacagcttgaacgaaaacgtaaggaggcgtacgagcgggagaaaaaggtttgggaggagcatctggttgcaaagggcgtaaagtcatcggacgtttcaccgcccttgggccagcatgagacaggaggttcccccagcaaacagcagatgcgctccgtcatatctgtgacgtctgccctcaaagaggtgggtgttgattccagcctcacggatacccgtgaaacttccgaagagatgcagaaaactaacaatgccatctcatctaaacgagagattcttagacggctgaacgagaatttgaaagctcaggaggatgagaaaggtaagcagaacttaagcgatacgtttgagatcaacgtgcacgaggatgccaaggaacacgaaaaagaaaagtctgtcagcagcgaccggaagaagtgggaggccggaggacagttagttattcccctggatgagctaactctggacacttccttttccacgacggagcggcacaccgtcggtgaagtcatcaagctaggacccaatggatctccgcggcgggcctggggcaaatcacctacagatagcgtgttgaagattctgggggaggccgagctgcagttacagactgagctcctggagaacacaaccattcgctcagaaatttcgcctgaaggcgagaagtataagccacttattacaggcgaaaagaaagttcagtgcatctcacacgagataaatcccagcgcaatagtcgacagtcccgtggagaccaaaagtccagaatttagcgaggcttctccgcagatgtccctcaagctcgaggggaatttggaggaacctgatgacctggagactgagatattgcaggagccctccggtaccaataaagacgagagtctgccgtgcaccattactgacgtgtggatctctgaggagaaagagacaaaagaaacgcagtccgccgatcgtatcaccatccaggaaaacgaggtgagtgaagatggagtgagctccactgtggaccagctgtcggacatacacatcgagccggggacaaacgactctcagcacagcaagtgcgatgtagataagagcgtgcaacccgagccgttcttccacaaggtagtgcactccgagcacctgaacctcgttccccaggttcagtccgtgcagtgtagcccagaagagtctttcgcctttcgcagccactcccacttgccgccaaaaaacaaaaataagaactctctgctgattggtctctcgaccgggctttttgatgctaataatcccaagatgctgcgaacctgtagtctacccgatctaagtaagctctttagaactctgatggatgtgccaactgtgggggacgtgcgccaggataacctggagatcgatgaaattgaggatgagaacatcaaagaggggcccagcgattctgaggatattgtttttgaggagacagacactgatcttcaggagctgcaggcctcgatggagcagcttttgcgggaacagccaggcgaggaatatagcgaagaggaggaatccgtcctgaagaattccgacgttgagcccaccgccaatggaacggacgtcgcggacgaggacgacaacccgagttccgagtccgctctaaacgaggagtggcactcagataactctgatggagaaatagcctctgagtgtgaatgcgattccgtgttcaaccacctggaagagctccgtctacacctggaacaggagatgggctttgaaaagttctttgaggtttatgaaaaaataaaggccatccatgaggacgaggacgaaaacattgagatatgctctaaaatcgtgcagaacatcctcgggaatgaacaccagcatctgtacgccaaaatcctgcacctggtgatggccgatggtgcttatcaagaagacaatgatgaatag

SEQ ID NO: 197333 - DNA, 3645 bp, Artificial Sequence
  Description of Artificial Sequence: Synthetic coding sequence
atggagaagtacgtgcggctgcagaagatcggcgagggcagcttcggtaaggccattctggtgaagtctacagaggacgggcggcaatatgtaatcaaagagattaatatcagccgcatgagcagcaaggagcgggaagagagccggcgggaagtggccgtgctggctaatatgaaacatcccaatatcgtgcagtacagggagagtttcgaagagaacgggagcttgtacattgtcatggactactgtgagggcggagatctctttaagcggatcaacgcccagaaaggcgtactattccaggaagatcagatcttggattggttcgttcagatttgtctggcactaaagcacgtccatgacagaaagatcctccaccgtgatatcaagtcccagaacattttcttgaccaaggacggaacggtccagttgggagattttggtatcgcaagagtgctgaattctacagttgagctggctcgcacctgcatcggcaccccctattacctgtcaccagaaatttgcgagaataagccttataacaacaaaagtgatatttgggccctcgggtgcgtgttgtatgaactgtgcaccctcaaacacgcctttgaggccgggtccatgaaaaacctggtactgaagatcatctccggaagctttccccctgtttcacttcattatagctatgatctgaggagcctagttagccaacttttcaaacgcaatcccagagatcggccaagcgtgaattctattctcgagaagggtttcattgccaagagaattgagaagttcctgtccccacaactgattgccgaagaattctgcctcaagacattcagcaaattcggctctcagccgatccccgccaagcggccggcaagtggccagaatagcatcagtgtgatgccagctcagaagatcacaaagcccgctgctaaatatggcattcccctggcttataagaagtatggggataaaaagttgcatgagaaaaagcccctgcagaaacataagcaagctcatcaaacccctgaaaaaagggttaacacaggcgaggaacggcgcaaaattagtgaagaggctgccagaaagcgacgcctggagtttattgaaaaagaaaaaaagcagaaggatcaaataatttccctaatgaaggctgagcaaatgaaaagacaagaaaaggaacgtctggagcgcataaatagggctcgcgagcagggctggcgcaatgtcctctcagcaggtggctcgggcgaagttaaggcccccttcttgggttctggaggcaccatcgctccatcctcgttctcatcgcgggggcagtacgagcattaccacgccatcttcgaccagatgcagcaacagagagctgaagataatgaagccaaatggaaacgtgagatatatggacgcggcctacctgaaagacagaagggacagttagcagtcgaaagagccaaacaggtcgaggagttcctgcagaggaagcgcgaagcaatgcagaataaggctcgagccgaaggacatatggtatatctcgctaggttgcgacagattaggcttcagaattttaacgaacgtcaacagataaaggctaaacttaggggtgagaaaaaggaggcgaatcacagcgagggccaggaaggatctgaggaggccgatatgcgccgtaaaaaaatcgaatccctcaaggcccacgcgaatgcccgcgccgctgtgctcaaggagcagctggaaagaaaaagaaaagaggcctacgaacgagagaaaaaggtctgggaggaacacctggtggccaagggggttaaatcctcagacgtgagtcccccattaggacagcacgaaaccgggggctcaccctccaaacagcagatgaggagcgttatcagtgtcacatcggctctgaaagaagtcggcgttgattcctccttgaccgatacacgcgagaccagcgaagagatgcaaaagaccaacaatgctatcagctcaaagcgcgaaattctgaggcgcctaaacgaaaacctgaaggcccaggaggatgagaaaggaaagcagaacctgagtgacaccttcgagattaatgtccacgaagacgctaaggagcacgagaaggagaaaagcgtttcaagcgacaggaagaaatgggaagccggcggacagcttgttattcccctagacgaattaactctggacacctctttctccacaaccgaacgtcataccgtgggagaagtgattaagcttgggcctaatggatccccgcggagggcttggggcaaatctcctaccgattcggtcctgaagatcctgggcgaagccgagctccagttgcagactgaactgttagaaaacaccacaatccgctctgagatctccccagaaggcgaaaagtacaaacccctcattacgggggagaagaaagtgcaatgtatttctcacgaaatcaacccctctgcaatcgtcgatagtccagttgagactaagtcacctgagttttctgaggcgtctccccaaatgagcctgaaactggaagggaatctggaagagccggacgatctcgagaccgaaattttgcaggagccctccggcaccaacaaggacgagagcctcccatgcactatcactgacgtgtggatctctgaagagaaagaaaccaaagaaacacagagcgccgacagaatcacgatccaggaaaacgaggtaagtgaggacggagtgtccagtacagtagaccagctgagcgatattcatatcgagcctggcaccaatgactctcaacatagcaagtgcgatgtcgacaaatcagtgcagccagaacccttcttccataaggtggtgcatagcgaacacttaaaccttgtgccacaggtacagtcagtgcaatgttccccagaagagtcctttgcattccggtcacacagccatcttccacctaagaataaaaacaagaattctctattaattgggctgagtacagggctattcgacgctaataaccccaaaatgttgaggacctgtagccttcctgatctgagtaagctgtttagaaccctcatggacgtcccaactgtgggagatgtgcggcaggacaatctggagatcgacgaaattgaagatgagaatatcaaagagggcccatccgatagcgaggatatagttttcgaggagacagacacagacctacaagaactgcaggctagtatggagcagctgctgcgggaacagcccggagaagagtacagtgaagaagaggagagcgtgctcaaaaactccgatgttgagccaacagctaatggtaccgacgtggcagacgaagatgacaatcccagctccgagagcgcactaaatgaagaatggcacagtgacaattctgacggcgaaatcgcctccgagtgtgaatgtgacagcgtgtttaatcatctagaggagctgagattgcacctggagcaagaaatgggcttcgagaaattttttgaagtatacgaaaagattaaagccattcacgaggatgaggatgagaacatcgagatttgttcaaaaattgtgcagaacatattgggaaacgaacaccagcacctttacgctaagatcctgcatctggtcatggcagatggagcctatcaggaggacaatgatgagtag

SEQ ID NO: 197334 - DNA, 3570 bp, Artificial Sequence
  Description of Artificial Sequence: Synthetic coding sequence
atggagaagtacgtgcggctgcagaagatcggcgagggcagcttcggaaaagcaatcctggttaagtctacagaagatggtcgccagtacgtgatcaaagaaataaatatctctagaatgagctcaaaagagcgggaagagagcagacgcgaagtggctgtgctcgcgaatatgaaacaccctaatattgttcaatatagagagagttttgaagaaaatggctccctgtatattgtcatggactactgtgagggcggggacctattcaaacgcatcaacgcccagaaaggagtgctcttccaggaagatcagatactggattggtttgtccagatttgcctagccctaaaacatgttcacgataggaagatcctgcatagggacatcaaaagtcaaaacatcttcctcaccaaagatggcaccgtgcagctcggagacttcgggatcgctcgggtgctgaactcaacagtggagctggcccgcacctgcataggcacaccgtactatctgtcacccgagatatgcgagaataagccatataacaacaaaagtgacatttgggctttggggtgtgtgctgtacgaactgtgtacccttaagcacgccttcgaagccggtagcatgaaaaacctggtgctcaagataatttcaggctccttccccccggtctctctccattacagttacgatctgaggagtctggtcagtcaactattcaaaaggaatcctcgtgatcgaccatccgtgaactctatcctggaaaaggggtttattgcgaaaaggattgagaagttcttgtcaccacagctcatcgctgaagagttttgcctgaaaacattctctaaatttggatctcagcctatcccagctaagaggccagcctctggccaaaactccatatctgtcatgccagcgcaaaaaatcaccaaaccggccgcaaagtacgggattcctcttgcctacaaaaaatatggggataagaaactgcatgagaagaaaccgctgcaaaaacacaaacaggcacaccagaccccggaaaagagggtgaacaccggggaggaacgaagaaagatcagcgaggaggcagcccgaaagagacggctcgaattcatcgaaaaagagaagaagcagaaagaccagattattagcttaatgaaagcagaacagatgaaacgccaagaaaaagaacgcgctcctttcctcggctccgggggtaccatagccccctcctccttctccagtcgaggccagtacgaacattaccatgcgatatttgaccaaatgcagcagcagcgggccgaagataatgaggcaaagtggaaaagggaaatctatggacgtggcttgcccgaacgccagaaagggcagctggccgtagaacgggcaaagcaagttgaggaatttctccagagaaaacgtgaggccatgcaaaacaaagcacgagcggaaggccacatggtctacctggcacggttaagacagataaggctgcaaaactttaatgagcggcagcagatcaaggctaaactacgcggggagaagaaggaggccaatcattctgaggggcaggaggggtctgaggaggctgacatgagaagaaaaaagatcgagagtctgaaagctcatgctaatgcccgagccgcagtgctcaaggaacaactggaacggaagcgaaaggaagcatacgagagggagaagaaagtgtgggaggaacatctagtggctaaaggggtgaagagtagcgacgtctcccctcctttgggtcagcatgagaccggagggtctccctctaagcagcagatgcgttcggtaattagcgtcacctcagccctgaaagaagtgggcgtggattcctccctaaccgatacacgagaaacaagcgaagagatgcaaaaaaccaataacgctatcagctctaaaagagaaatccttagaaggcttaatgagaacctgaaggcacaggaagatgagaagggtaaacagaacttgtctgacactttcgaaatcaatgtccatgaagacgcaaaggaacacgagaaagaaaaaagtgttagctccgatcgaaagaagtgggaggccggagggcagctcgtgattcctctggacgaactgactctggacacgagtttcagcaccaccgaacgacacacagtaggcgaggttattaaactggggcctaacggaagccccagacgtgcatgggggaagtctcccaccgacagcgtgttgaagatcctcggtgaggccgaattacagctgcaaacagaactgttagagaacaccactatccgctctgagataagccctgagggcgagaagtataagcccctgattaccggtgaaaagaaagtacagtgtatcagtcacgagatcaatccctccgctatcgttgattctcctgttgagactaagtcaccagagttcagcgaagcgagccctcagatgtcacttaagctcgagggcaacctcgaggagcccgacgatctcgagaccgagatactgcaggagccctctggcacaaacaaagatgagtcactgccttgcaccattacagacgtctggatctccgaggagaaggagaccaaagagacacaatcggccgataggatcacgattcaggaaaatgaagtatctgaagacggggtgagttccactgtcgatcagctatcagacatccatatcgaaccagggacaaacgactctcagcacagtaagtgcgacgtagataagtccgtgcaaccagagcctttctttcacaaagtcgttcattctgagcacctgaatctggtgcctcaagtccagtcagtacagtgcagcccagaagagtcttttgcctttagaagtcatagtcatctgcccccaaagaataagaataagaattccctcctgatcggcctgagcactggcctgttcgatgccaacaacccaaaaatgttgagaacttgttcacttcctgacttatcaaaactgttccgaacgctgatggacgttcccacggtgggggatgtccgccaggacaacctcgaaatagacgagatcgaagacgaaaatattaaagaaggtccctctgactctgaagacattgtgtttgaagagactgacactgaccttcaagagttgcaggcaagtatggaacagctgttaagggaacagcccggtgaggagtattcagaggaggaggagagtgttctgaaaaactctgatgtcgagcctacggctaatggtactgatgtggctgacgaagatgacaatccctccagcgagagtgccctgaacgaggagtggcacagcgataactcagacggggagatcgccagcgagtgtgaatgcgacagcgtgtttaatcacttggaggaactacggctacacctggaacaggaaatgggattcgaaaagttctttgaagtgtacgaaaagataaaagcaatccacgaagatgaagatgagaatatagagatttgctcaaagatcgtacagaatattctcggcaatgaacatcagcacctctatgctaagatccttcacctggttatggctgacggagcctatcaggaggataatgacgagtag

SEQ ID NO: 197335 - DNA, 1155 bp, Artificial Sequence
  Description of Artificial Sequence: Synthetic coding sequence
atgcccagccgggccgaggactacgaggtgctgtacaccatcggcacaggttcttatggaagatgccagaaaattaggagaaaatccgatggcaagattctagtatggaaggagctggattacgggagcatgacagaggcagagaagcaaatgttggtgagtgaggtgaatctgctgcgagaacttaaacacccgaacatcgttagatactacgaccggatcatagacaggaccaatacaactctatatatcgtgatggagtactgcgagggcggggatctcgctagtgttataacaaagggtactaaagaacgccaatacctcgacgaggagtttgtgctcagggttatgacccaactgacactggccctcaaggagtgccaccggaggtcggatggtgggcacactgttctgcatagagatctgaagcccgcgaatgtgtttttggacggaaagcaaaacgttaaactgggcgacttcggactggcccgtatcctgaaccacgacactagcttcgccaaaacttttgtgggaactccatactacatgagcccggagcagatgaatcggatgagttacaatgaaaagtccgatatctggtctctcgggtgcttactctatgagctctgcgctttgatgcctcccttcactgccttctcccagaaggagctggcaggaaagattagagagggaaagttccgtagaataccatatcggtacagtgatgaactgaatgagattataactcgtatgttaaacctcaaggattatcacaggccttccgtggaagagattttggagaatcctcttattgcggacctcgtggctgatgaacagaggcgcaatttagagcgaagaggcaggcagctgggagaacctgaaaaaagccaggacagctctcctgtgctttcagagttgaaactcaaagagattcaactccaggagagggagcgtgccctgaaggcgcgcgaagagaggctcgagcagaaagagcaagagctctgcgtgagggagagactcgcagaggacaaactggctcgagccgaaaatctgttgaagaactattcccttctgaaggagcgtaaattcctcagcctcgcaagcaacccgggaatgcgcatcaacctggttaataggagctggtgttacaagtag

SEQ ID NO: 197336 - DNA, 1338 bp, Artificial Sequence
  Description of Artificial Sequence: Synthetic coding sequence
atgcccagccgggccgaggactacgaggtgctgtacaccatcggcaccggcagctatgggaggtgtcagaagatccggagaaagtctgatggaaagatcctcgtgtggaaggagctagactacggatctatgaccgaggctgagaaacaaatgctcgtgtccgaggttaatctactaagagaactaaaacatccgaatattgtgcggtactacgatcggattatcgatcgaacaaacaccacactgtatatcgtgatggagtactgtgagggtggtgacctggcctctgtaattacgaagggcaccaaagagaggcagtacctggacgaggaatttgtactccgcgtcatgacccagttaaccctcgcactaaaggagtgtcaccggagatctgacggcgggcatacggttctacatcgtgacctaaaaccagcaaatgtattccttgatggcaagcaaaacgttaaactgggcgattttggcctggcaagaatactgaatcatgacacatcatttgccaaaaccttcgttggcaccccatactacatgtcacccgaacagatgaacagaatgagttacaatgagaaatccgacatctggtccttaggatgtcttctctacgagttatgcgcattgatgcccccattcacagccttctctcaaaaggaactcgcaggcaaaattagagaaggaaagttccgaagaatcccatatcggtattcggatgaactgaatgagattattacccggatgctcaacttaaaagattatcacaggccatctgttgaagaaattctggaaaacccactgattgcagacttggtggctgacgagcaaagacgaaatcttgaaagacgaggaaggcaattaggcgaacccgaaaagtcacaagactcctcccccgtgctctcggagctgaagctaaaagaaattcagttacaggagagagaaagggcattgaaagcgcgcgaggagcgactggagcagaaagaacaggagctctgtgtgagggagagactagcagaagacaagctcgctagggctgaaaacctcttgaagaattactcactgctgaaggaacgcaaatttttgagcctggcatctaaccctgaacttctcaacctacccagcagtgtcataaaaaaaaaagtgcacttttccggcgagtctaaggagaacattatgcggagcgaaaatagcgagtctcagctgacctcaaagtccaaatgtaaggatctgaagaagcgactccacgcagcccaactccgggctcaggccctttctgacattgagaaaaactaccagcttaagagccgacagatcttgggcatgagatag

SEQ ID NO: 197337 - DNA, 1209 bp, Artificial Sequence
  Description of Artificial Sequence: Synthetic coding sequence
atgaccgaggccgagaagcagatgctggtgagcgaggtgaacctgcttcgggaactgaaacaccctaacatcgtgcgctattacgataggattatcgaccgaacaaacacgaccctgtacattgtcatggagtattgtgagggtggagacctggcatcagtcatcactaaggggactaaagagcgacaatatctagacgaggagttcgttttgagagtcatgacacagctgacactcgctctcaaggagtgtcaccgtagatcggacggaggccacacggtgctccacagggatctcaagcctgctaatgtgttcctagacggcaaacaaaacgtaaagctgggcgacttcggcctggcccgtatactgaaccacgacaccagtttcgccaaaacttttgtcggaactccctattacatgtctcctgagcagatgaatcgcatgtcttacaatgagaaatccgacatctggagcttaggctgtttattgtacgagctatgcgcattaatgcccccctttaccgctttcagtcagaaggagcttgctggtaagataagagaggggaaattccggcggattccatatcgatacagtgatgagttgaacgagattattacccggatgctgaacttaaaggattatcatcgaccttccgttgaggagattctggagaaccctttgatagccgacctcgtagccgatgaacagcgaaggaacttagaaaggcggggacgccagctgggtgagccagagaaaagtcaggatagttctcccgtgctaagtgaactgaagttaaaagagatccaactccaggagcgggagagggcattaaaggcacgggaagagcgcctcgagcagaaagagcaagaactgtgcgtgagggaacggttggccgaggacaagctggctagagccgagaacctcctgaaaaattacagcttgctcaaagaacggaagtttttgtccctagcatccaatcctgaacttctcaaccttccaagctctgtgataaagaagaaagtccactttagtggggaatcgaaagaaaacatcatgcgctccgagaattccgaatctcagctcacaagcaagtcaaagtgcaaggacctgaaaaaacgcctgcacgctgcccagctccgcgcgcaagctctgtccgacattgaaaaaaactaccagcttaaaagccgccaaattctggggatgaggtag

SEQ ID NO: 197338 - DNA, 1521 bp, Artificial Sequence
  Description of Artificial Sequence: Synthetic coding sequence
atggacgactacatggtgctgcggatgatcggcgagggcagcttcggcagagctctccttgtgcagcacgagtcaagtaatcagatgtttgctatgaaggagattcgcctgccaaaaagtttttctaacacccagaattcgcggaaagaggccgtgctgctcgctaagatgaagcatccaaacattgtggctttcaaggaaagcttcgaagcagagggacacctttatattgtcatggaatattgcgatggaggggatcttatgcagaagatcaagcagcaaaaaggtaagttgttccccgaggacatgattttaaactggtttacacagatgtgcttaggtgtgaaccacatacataaaaagagggttctgcatagggatattaaatcaaagaatatcttcctgactcaaaacgggaaagtaaaattgggcgattttggctcagctcgcctcctctccaatcctatggcctttgcatgcacctacgtcggtacaccatattacgtgccgcccgaaatttgggagaacctgccctacaacaacaaaagcgacatttggagcttgggttgtatactttacgagctttgcactctcaagcatccctttcaggcgaacagctggaagaatctaattttaaaggtgtgccaaggatgtatctccccccttccaagccattatagctacgaactgcaattcttggtgaagcagatgtttaaaaggaatcccagccatcgaccttcagccaccaccctcttgtcacggggcatagtggcccgcctggttcaaaaatgccttcccccagagataatcatggagtatggggaggaggtactggaagagatcaagaactctaagcacaatacccctcgaaagaaggctaaccctagccgcatccgcatcgcactgggcaatgaggcttctacagttcaagaggaggagcaggatagaaagggttcgcatacggaccttgagtcaattaatgagaatctggttgagtctgcactgcggcgcgtgaacagggaggaaaaggggaacaaaagcgtgcacctgagaaaggctagttccccgaatctacacagacgccaatgggagaagaacgtgcccaatacagcccttacagccctggaaaacgcaagtatcctgacttctagcctaaccgccgaggacgatcggggaggctcagtgatcaagtattccaaaaatactactcggaagcaatggctcaaggagacaccagatacactgttaaatattctgaaaaatgccgacctcagcttagcttttcagacgtacaccatctatcgcccgggttccgagggcttcctgaagggccctctgtcagaagagacggaggcttcagactccgtggatggcggacacgatagtgtcattctggatccagagaggctggaacctggcctggatgaagaggacacagacttcgaagaggaagacgacaatccagactgggtgtcagaattgaagaaacgagccggttggcagggcctgtgcgacagatag

SEQ ID NO: 197339 - DNA, 1521 bp, Artificial Sequence
  Description of Artificial Sequence: Synthetic coding sequence
atggacgactacatggtgctgcggatgatcggcgagggcagcttcggtcgagccctactggtacagcacgaaagtagcaatcaaatgttcgctatgaaggagatcagactgcctaaatctttcagtaatacacagaactcacggaaggaggcagtcttattggccaaaatgaagcaccctaatattgttgccttcaaggagtcatttgaggcagagggacatttatatatcgtgatggaatattgcgatggaggcgatctaatgcagaagatcaagcaacagaagggcaaattatttcccgaagatatgattttaaattggttcacacagatgtgtttgggtgttaatcacatccacaaaaaaagggtgttacatagagacataaagagcaagaacattttcctgacgcagaacggaaaggtcaaactgggagatttcgggtcggcgcggttacttagtaacccgatggcttttgcttgcacctatgtgggaacaccatactatgtgccacctgagatttgggagaaccttccttataacaacaaatctgatatttggtccctgggctgcatcctgtacgagttatgcaccctcaagcaccccttccaggccaatagctggaagaatcttatactcaaggtgtgccaaggatgcattagccctctcccctctcactactcctacgagttgcagttcttggtcaagcaaatgttcaaacgaaacccctcccaccgaccatccgccaccacactgttgagccgcggcattgttgcacgcttggtccagaagtgccttcccccggagataataatggagtacggagaagaggtcctggaggaaattaaaaactccaagcataataccccacggaagaaggccaacccatctaggattcggatcgcactagggaacgaagcatctaccgtgcaggaggaggaacaggatagaaaaggctcccacacagatttggagagcatcaatgaaaatctagtagaaagtgcccttcgaagggttaatcgggaggaaaaaggtaataagtcggtgcacctccgcaaagcgtcttcaccaaatctgcaccgcaggcaatgggaaaagaatgtgcctaacacagcccttaccgccctcgaaaacgccagtatccttacctcatctctgacagcagaagatgaccgagggggctccgttatcaaatacagcaaaaatacaacccgcaaacaatggttgaaggagactcctgacacccttctgaatattctaaagaatgcagacttgagcctcgcgtttcaaacatacacaatctacagacctggcagtgaagggtttctgaagggccccctctccgaggaaacggaagcgtcggactctgtggacgggggacacgactctgtcatcctggatcctgagagattagaacctggtcttgacgaggaggacaccgatttcgaggaagaggatgacaaccctgattgggtatcagagctgaaaaagcgagcagggtggcaaggtttgtgtgatagatag

SEQ ID NO: 197340 - DNA, 1470 bp, Artificial Sequence
  Description of Artificial Sequence: Synthetic coding sequence
atggacgactacatggtgctgcggatgatcggcgagggcagcttcggacgggccttattagttcaacatgagtcatctaatcagatgttcgccatgaaggagatccgactacccaagagcttctcaaacacacagaattcacggaaggaggcggttctgctggctaagatgaagcatcctaacatagtagccttcaaggaaagctttgaggccgagggccacttgtatattgtcatggagtattgcgacggcggagacctaatgcaaaaaatcaaacagcagaaaggaaagctcttccctgaggacatgattctgaactggtttacgcaaatgtgcctgggcgttaatcacattcataaaaagcgagtgttgcaccgggatattaagtccaaaaacatctttctgactcagaacggcaaggtaaagttaggagacttcggttccgcaaggctgctgtcaaacccaatggccttcgcgtgcacctatgtaggcactccatattatgtgccaccagagatttgggaaaatttgccttataacaacaagagcgatatttggtccctgggatgcatactgtacgagctttgcactcttaaacatccctttcaggctaacagttggaagaatcttatccttaaggtgtgtcaaggctgtatcagccctttgccatcccattactcctacgagctgcagttccttgtcaagcaaatgtttaaacggaacccatctcaccgcccgtcagctacaacgctactctctcgaggaattgtagcacggttagtgcagaaatgtctcccaccagagattatcatggagtatggggaagaggtcctcgaggagattaagaactctaaacacaacaccccccgaaaaaaacaggaggaggagcaggatagaaaggggtctcacaccgatctggaatcaattaacgaaaatttggtggagtcggcattacggcgtgtcaaccgagaggagaagggtaataaatcggtccacttacggaaggcctctagcccaaatctacacaggcggcagtgggaaaagaatgtgcctaatactgctctgactgcccttgaaaacgccagtatactaacttccagccttaccgctgaggatgaccgcggaggatccgtgataaagtatagcaagaatacgactcggaaacagtggctaaaggagactcccgacactcttctgaacattcttaaaaatgcagacctctcccttgcttttcagacatacactatctatcgcccaggcagtgagggttttctgaaaggccccctgtcggaggagactgaagcatccgacagtgtcgatggcggtcacgatagcgttatactagatccggaacgactcgagcccgggcttgatgaggaggacacagattttgaggaggaagatgacaatccagattgggtgtccgagctgaagaagagagccggttggcagggcttgtgcgatcgatag

SEQ ID NO: 197341 - DNA, 1533 bp, Artificial Sequence
  Description of Artificial Sequence: Synthetic coding sequence
atgcagttcggccgggcccacggcgactgcgtgagcggcgcccagctctgcgggtgtccttccatggacgactacatggtgcttcgcatgataggagaaggctccttcggaagagccctcctggttcaacacgagagctcaaaccaaatgtttgcaatgaaggagataagactgccaaagtctttctccaacacacagaattcccgaaaagaggcagtactactggcaaaaatgaagcatccaaacatagtggcctttaaagaatctttcgaggctgaaggacacctgtacatcgtgatggagtactgcgacggtggggacctgatgcagaagattaagcagcagaaggggaagttgttcccagaggatatgatcttaaactggttcacccagatgtgtctcggagttaaccatatccacaaaaaacgcgttcttcaccgcgacattaagtctaaaaacattttcctgacccaaaatggaaaagtaaaactgggcgatttcggcagcgcaaggctcctgagcaacccaatggcattcgcctgtacgtatgtgggaactccctattatgtcccacccgaaatttgggagaacctgccgtataataacaagtccgacatctggagtctgggctgtatcttgtatgagttatgtacgctcaaacacccttttcaggcgaactcctggaagaacttgatattgaaggtttgccaaggttgcatctctccccttccctctcactatagctatgagttacagttcctggttaagcagatgtttaagcggaatccttcccaccgaccatcagctactacattactcagccgtggcatcgtagctcggctcgtacagaaatgtttgcctccggagatcatcatggaatacggcgaagaggttctcgaggagataaagaattccaaacataacactcccaggaagaagcaggaagaagaacaagatcgaaaaggctctcacactgacctcgagagcataaatgagaacctcgtggaaagcgcactgagacgcgtcaatagggaggagaaaggtaataagagtgtccacctgcgcaaagccagttcacccaatctgcaccggcggcagtgggagaagaatgtacctaacacggccctgaccgcactagaaaatgcctccattcttacgagcagcctcactgctgaggacgaccgcggtggctcggtcatcaaatactccaagaatactaccaggaagcagtggcttaaggaaacccccgataccctcttaaacattttgaagaacgcagatcttagtctcgcatttcagacctatactatctaccgcccaggctccgaaggcttccttaaagggcccctatctgaggaaacagaggcctcagattcggttgatggcggtcatgactccgtgatcctggaccctgagaggctcgaacccggactggatgaagaagataccgattttgaggaagaagacgataatcctgattgggtcagtgaactgaaaaaacgcgccggctggcagggattatgtgaccgctag

SEQ ID NO: 197342 - DNA, 177 bp, Artificial Sequence
  Description of Artificial Sequence: Synthetic coding sequence
atggacgactacatggtgctgcggatgatcggcgagggcagcttcgggcgggccttactggtccagcatgaatcctccaaccagatgtttgctatgaaggaaatcaggctccccaaatcctttagtaacactcagaactcacggaaagaggccgtgttgctcgccaaaatgaaatag

SEQ ID NO: 197343 - DNA, 510 bp, Artificial Sequence
  Description of Artificial Sequence: Synthetic coding sequence
atggcccggggcggcgacaccggctgcaccggccccagcgagacctccgcatcgggcgcagcagccattgccttgcccggacttgagggcccggctaccgacgctcagtgccagaccttgccattgacagtattgaagtcccgctctccctctcccagaagcctgccccctgcccttagttgccctcctccacagcccgcgatgctggagcacctcagcagcctgcctacccagatggattataaggggcaaaaactggccgaacagatgtttcaggggattattttgttttctgctattgtcggatttatctatggatatgttgcggagcagtttggttggactgtgtacatagttatggcaggctttgcatttagctgcctcctgaccttgccaccatggcctatctaccgccgccaccccctcaagtggctgccagttcaggaatcaagcacggacgacaaaaaacccggagaaagaaaaattaagcggcacgcaaaaaataactag

SEQ ID NO: 197344 - DNA, 2259 bp, Artificial Sequence
  Description of Artificial Sequence: Synthetic coding sequence
atgcccctggccgcctactgctacctgcgggtggtgggcaagggcagctatggagaggttacccttgtgaagcaccgccgggacgggaaacagtacctacacgagaagcacatccttcaccgcgatttgaagacacaaaatgtattcctcactcggaccaatataatcaaggttggagatctgggtattgcaagggtccttgagaatcattgtgacatggcctcaactttaatcgggactccttattatatgagccctgagctgttttctaacaagccctataattacaagagtgatgtgtgggcgcttggctgctgtgtttatgagatggctacactgaagcacgcgtttaatgccaaggacatgaactcccttgtgtatcggataatagaagggaagttgcccccaatgcctagggactattcccctgagttagctgagctgatccgaactatgctcagcaagagacccgaagagcggccatctgttcgctctattttacgacagccttacattaagaggcagatttcattctttcttgaggcaacaaaaattaagacctctaagaataacatcaagaacggcgactcccagagcaagccctttgctaccgtggttagcggggaggctgaaagtaatcatgaggtgatccacccccagcctctctcttccgagggaagccagacctacatcatgggggaaggaaaatgtttgtcccaggagaaacctagggcgagtggattgctcaaaagtccagcatccctgaaggcacatacatgcaagcaggatctctccaacacaacagagctggctacaatcagttccgtgaatatcgacattctgcccgctaagggcagagattcagtgtccgacgggtttgtgcaggagaaccagcctagataccttgatgcaagtaacgaattgggtggcatctgctccatcagccaagtggaggaagaaatgttgcaggacaataccaagagctcagcccagcccgagaacctgatcccaatgtggtccagcgacatcgtcactggcgaaaaaaatgagccggtgaagccccttcaaccacttatcaaggaacagaaaccaaaggaccagtctttggctctgtcacccaagctggagtgcagtgggaccatcctcgctcattcgaacctgcggctgctggggtcaagcgactctccggcaagtgcctcacgcgtggcgggcattaccggagtgtgccaccacgcacaggaccaagtggcgggggaatgcatcattgaaaaacaagggaggatacatcccgacctccagccacacaatagtggctcggaaccaagcctcagccggcaaaggaggcagaagcggagggagcagacggaacatcggggagaaaagcggcaggtaagacgcgacctgttcgcattccaggaatctccaccgaggttcctgccttcccatccgatagtgggcaaagttgatgtgacctccacccagaaagaagccgaaaaccagaggcgagtggtgacagggtccgttagtagctcacgatcttctgagatgagtagcagtaaagacagaccactcagcgcgcgtgagaggcgacgcttgaaacagagccaggaggaaatgagtagctcgggcccgtcggtacggaaggccagcttgagtgtggcagggcctggaaagcctcaagaggaagatcaaccactccccgcaaggcggctgtcgtccgattgctctgttacccaagagcgtaaacagattcattgcctctctgaggatgaactctctagttcaacaagttctacggataagtctgacggggactacggcgaagggaaggggcaaaccaacgagattaacgcccttgtccagctaatgactcagaccctcaaacttgactctaaggagtcctgtgaggacgtgccggtagctaaccccgtttcagaattcaagctgcataggaaataccgcgatactctcatcttgcatggcaaagtggccgaagaagccgaagaaatacacttcaaagaactccccagcgccattatgcctggcagtgagaaaattcgccgacttgtagaagtgttacgcaccgacgtgatccgcgggttgggtgtccaactactggaacaggtttatgacctgctcgaggaggaggacgaattcgatcgggaagtgcgcctgagagagcatatgggtgagaaatacacgacctattctgtcaaggcacgtcagctcaaatttttcgaagagaatatgaatttttag

SEQ ID NO: 197345 - DNA, 942 bp, Artificial Sequence
  Description of Artificial Sequence: Synthetic coding sequence
atggccggccagcccggccacatgccccacggcggcagcagcaacaacctgtgtcacacattaggccctgttcaccctccagatcctcagcgccatccaaatacgctgtcattcaggtgcagcctggcagacttccagatcgaaaagaagatcgggcggggacagtttagcgaggtgtataaggcaacctgcctactggatagaaaaactgtcgccctgaaaaaagtacagattttcgagatgatggacgcaaaggctaggcaagattgtgtgaaggaaatcggtttgcttaagcagcttaaccacccgaatattattaagtatcttgattccttcatagaggataacgaactcaacatagtgctggaactggctgacgcaggcgacctgtcccagatgattaaatattttaaaaaacaaaagcgcctgattccggaacggaccgtctggaaatactttgtgcagctgtgcagtgcagtggaacatatgcactctcgaagagtgatgcatagagatatcaagccagccaacgtgtttataacagccaccggcgtcgtgaaactgggagatctgggtctcgggaggtttttctcatcagaaaccacagcggcccactcactggtcggcaccccttactatatgagtcccgaacgcattcacgagaacggctataacttcaagtccgatatttggagcctggggtgtctgctgtatgaaatggccgccctacagtcaccattctatggagacaagatgaatctgttctcattatgtcagaagatcgagcaatgtgattatcctccattgcctggcgaacactatagtgagaaactgagagagctggtttctatgtgcatctgccccgacccccatcaacgacctgacatcggctacgtccatcaggttgccaagcagatgcatatctggatgtccagtacttag

SEQ ID NO: 197346 - DNA, 624 bp, Artificial Sequence
  Description of Artificial Sequence: Synthetic coding sequence
atggccggccagcccggccacatgccccacggcggcagcagcaacaatctgtgtcataccctggggccggttcaccctcctgaccctcagcgccaccccaacacccttagcttccggtgctcacttgcagattttcagattgaaaaaaaaataggaaggggacaattctccgaggtgtacaaagccacttgcctgcttgacagaaaaaccgtggccttaaagaaagtgcagatcttcgagatgatggatgccaaggctcggcaagactgcgtgaaggagatcggcctgcttaaacagctaaaccaccctaatatcattaagtatcttgacagttttatcgaggataatgagctgaacatagtcctggaactcgcggacgctggggatctgtcacaaatgatcaagtacttcaaaaagcagaagcggctcatcccggaacgaaccgtctggaaatactttgttcagttatgttcagccgtggagcatatgcatagtaggcgcgtgatgcatcgcgatataaagcctgcgaacgttttcatcacggccacaggcgttgttaagttaggcgacctggggctgggaagattcttcagtagtgaaaccacagccgctcattcactgtag

SEQ ID NO: 197347 - DNA, 1044 bp, Artificial Sequence
  Description of Artificial Sequence: Synthetic coding sequence
atgccccggcgggaggtgtgctgggaggccgcccacttccggcaggaggaacagtcacttcccaggccgagggttagagcccttgtacggttggcctgtagaatggccggtcaacccggtcacatgccacacggcggttcgtcgaacaatttgtgtcataccctgggaccagtccatccacccgaccctcagagacaccccaataccctgtcatttcgttgcagcctcgccgattttcagatagagaaaaagatcggacggggccagttcagcgaggtgtataaggccacatgtcttttggaccgcaaaactgtggccctgaaaaaggttcagatcttcgagatgatggacgccaaagcccgccaggattgtgtgaaggagatcgggctgttgaaacagctgaatcaccctaacattattaaatacctcgacagtttcatcgaggacaatgagttgaacatagtcctcgagctggccgacgctggggacctgtcacaaatgatcaaatacttcaagaaacagaaaagactcattcctgagcgcactgtatggaagtatttcgtccaactgtgttctgctgttgaacatatgcactcccgtagggtgatgcatagagatatcaagccagcaaatgttttcataacggccacaggcgtggtaaagttaggcgacctgggtctcggacgatttttttcttcagagaccaccgcggcacactctctagtcggcaccccatactacatgagcccagagagaattcacgagaacggttacaatttcaaatctgatatctggtcgctgggatgcctcctttacgagatggctgcgctgcaaagcccattctacggggacaagatgaaccttttcagcctgtgtcaaaaaattgagcagtgcgattatccgcccctgccaggtgaacattactctgaaaaactacgcgaactcgtgagtatgtgcatctgccccgacccacatcagcgtccggatatcggctacgttcaccaggttgccaagcagatgcatatttggatgtcctctacatag

SEQ ID NO: 197348 - DNA, 738 bp, Artificial Sequence
  Description of Artificial Sequence: Synthetic coding sequence
atggccggccagcccggccacatgccccacggcggcagcagcaacaacttgtgccataccctgggtcctgtccaccctccagaccctcagcaactcaatcaccctaatattatcaaatatctggatagtttcatcgaagacaacgaactcaacattgtgttggagctcgccgacgctggcgatctttcgcaaatgatcaaatatttcaaaaaacagaagagactgatacctgaaaggaccgtctggaagtattttgtgcagctgtgctctgctgtggagcacatgcactcaaggcgtgtgatgcacagagatattaaaccagccaacgttttcatcactgcaaccggcgtggtgaagctgggggacctaggcctgggaagatttttctctagcgagacaacagctgcacattccctggtgggaactccttattacatgtctccagagcgcattcacgaaaatggctacaacttcaaatcggatatctggagtctggggtgtctgctgtacgagatggcagcgctgcaatcacccttctatggcgataaaatgaacctcttttccctgtgtcagaaaatcgaacagtgcgactatcccccgttacccggggaacactactccgagaagctgagggagttggtgagcatgtgcatatgccccgacccgcaccagaggcccgacattgggtatgttcatcaggtggcaaagcagatgcatatctggatgagctctacttag

SEQ ID NO: 197349 - DNA, 942 bp, Artificial Sequence
  Description of Artificial Sequence: Synthetic coding sequence
atggccggccagcccggccacatgccccacggcggcagcagcaacaacttgtgccacactttgggacccgtacatccgccggacccacagaggcacccaaataccctgagttttaggtgctccctagcagacttccagattgaaaaaaaaataggtaggggtcagtttagcgaggtctacaaggccacatgccttctggacaggaaaactgtggcactcaaaaaagttcaaatattcgaaatgatggacgcaaaggcgcggcaagactgtgtgaaggagattggtctgcttaaacaacttaatcaccccaacatcatcaaatatctggattcattcatcgaggataatgagttgaacatcgtgctggagctggcggatgcaggcgatctttcgcagatgattaagtacttcaagaagcagaagcgtttgatccccgagagaaccgtgtggaaatacttcgtgcagctatgctctgctgttgagcacatgcattcaaggcgtgtcatgcatagagatattaagccggctaatgtctttatcacagccactggggtcgtgaagctgggcgatctcggtctgggtcgctttttcagttcagaaacaacagccgcgcacagccttgtcgggaccccctattacatgagccccgaaagaatacacgagaatgggtacaactttaagtccgacatatggtccctcgggtgtttgctttatgagatggccgccctccagagccccttttatggggataaaatgaacctgttttccctgtgtcagaagattgagcaatgtgactatcctccccttcctggggagcactacagcgagaagcttagagaactcgtcagcatgtgcatttgtccggaccctcaccagcgcccagacatcggctacgtccaccaggtcgcaaagcagatgcatatttggatgtcctccacttag

SEQ ID NO: 197350 - DNA, 1044 bp, Artificial Sequence
  Description of Artificial Sequence: Synthetic coding sequence
atgccccggcgggaggtgtgctgggaggccgcccacttccggcaggaggaacagtctcttcctcgccctcgcgtgcgcgcactggtgaggctcgcctgccgcatggcaggacagccagggcatatgcctcatggaggttcaagtaataacctttgtcatactctgggccccgtgcacccgcccgacccacagcgacatccaaatacactttcctttagatgctctctggctgatttccagatagagaagaagatcgggagaggtcaattttctgaggtctataaggccacatgtttactggaccgcaagacagtggcactgaaaaaagtccagattttcgagatgatggatgccaaagctcgacaggattgcgttaaagagatcggcctgctcaagcagctgaatcatcccaacataatcaagtatctcgactccttcatcgaagacaacgaactgaatatcgtgctggagctggctgacgctggagacctcagtcagatgataaagtacttcaagaagcagaagcgcctcatcccagagcgaactgtctggaaatactttgttcagctctgctctgccgtcgagcacatgcacagtcggagggttatgcatcgcgacatcaagcccgctaatgtgtttatcaccgctaccggagtagttaagctgggcgaccttggtttgggaaggtttttcagctccgagacgaccgctgctcacagccttgttggtaccccctactatatgagtcccgagaggatccatgaaaatggctacaatttcaaaagcgacatctggagcctgggctgtctcctctatgagatggccgccctgcagtcccccttctacggagataaaatgaacttgttttccctctgccaaaagattgagcagtgtgattatccccccctgccgggagaacactattctgaaaagttgagagaacttgttagcatgtgcatttgcccagatcctcaccaaagaccggacatcgggtacgttcaccaagtggccaagcaaatgcatatatggatgagctccacatag

SEQ ID NO: 197351 - DNA, 663 bp, Artificial Sequence
  Description of Artificial Sequence: Synthetic coding sequence
atggccggccagcccggccacatgccccacggcggcagcagcaacaatctgtgtcatacgctgggccctgtgcaccccccagatccacagcgtcaccccaatactcttagctttcggtgtagtctcgccgactttcagatcgagaaaaagattggaagaggccagttctctgaagtttataaggcaacctgtttgctcgatcgcaagacagtcgcactgaaaaaagtgcagatctttgagatgatggacgcaaaagcgaggcaagattgcgtgaaagagataggcctgctaaagcagttgaatcacccaaatatcataaaatatcttgatagtttcatagaggataatgagctgaacatcgtgttagaattggcagacgcgggagatttatcacagatgattaagtatttcaagaagcagaaaaggctgattcccgagagaaccgtatggaagtattttgtgcagctgtgctctgctgtggaacacatgcatagtcggcgggtgatgcaccgagacattaagccggccaacgtgtttataactgctaccggggtggtgaagttgggcgatctgggcttgggccggtttttttctagtgaaactacggccgcccactctctggtggggacaccttattacatgagcccagagcggatacactag

SEQ ID NO: 197352 - DNA, 585 bp, Artificial Sequence
  Description of Artificial Sequence: Synthetic coding sequence
atgccccggcgggaggtgtgctgggaggccgcccacttccggcaggaggagcagtctctgcctcgcccaagagtaagggctctggtgcggctcgcatgtaggatggctgggcaaccaggacatatgccacatggcggcagttccaacaatctctgtcacaccctcggcccggtccaccctccagatcctcagcgccacccaaataccctatcattcaggtgctctctcgcagatttccagattgagaagaagattgggcgcgggcagttttcagaggtctacaaggccacatgcctcttagatagaaaaaccgtggcactgaaaaaagtccagatttttgaaatgatggacgcgaaagcgcgtcaggattgtgttaaggagattggactcttaaagcaattaaatcacccaaacattatcaagtaccttgatagtttcattgaggacaacgaactcaatatcgtgctggagctggctgatgcaggcgatctcagtcagatgattaagtattttaaaaagcagaaaagactcataccagagaggaccgtgtggaaatatttcgttcagctgtgctcagccgtgtag

SEQ ID NO: 197353 - DNA, 669 bp, Artificial Sequence
  Description of Artificial Sequence: Synthetic coding sequence
atggccggccagcccggccacatgccccacggcggcagcagcaacaacttgtgccacactttgggtccagtgcatccacccgatcctcagcggcatccaaataccctctcattccggtgcagcctggcggactttcagatcgagaaaaagatcggcaggggacagttctctgaggtatacaaggcaacctgcctgcttgaccgcaagacagtcgccctcaagaaggtccagattttcgaaatgatggacgctaaggcccgccaggattgcgtgaaggaaatcgggctactcaaacagctgaaccatcctaatattatcaaatatctcgattcattcatcgaagataacgagctgaatattgtgctagagttggctgacgcaggcgacttgtctcaaatgattaaatattttaagaagcagaaaaggctgatacccgaaagaaccgtgtggaagtacttcgtccaactgtgctcagctgtggaacacatgcattcccgacgggtcatgcaccgcgatattaaaccagcgaacgtctttataacggctactggagttgttaagttgggagatctgggtctgggcaggttttttagctccgagaccaccgccgcccatagtcttgtgggaaccccttactacatgtcccccgagcggattcacgagaattag

SEQ ID NO: 197354 - DNA, 660 bp, Artificial Sequence
  Description of Artificial Sequence: Synthetic coding sequence
atggccggccagcccggccacatgccccacggcggcagcagcaacaacctgtgccataccctcggcccggtgcaccccccagaccctcaaagacaccctaataccttgtcattcagatgctctctcgcagatttccagatagaaaaaaaaattggccgcgggcaattcagcgaagtttataaggctacatgtctcctggataggaagaccgtggcacttaaaaaggtgcagatattcgagatgatggacgccaaagcccgtcaggactgcgtgaaagaaatcggtcttctgaagcaactgaaccatcccaatattatcaagtatctagattcgtttatagaagacaatgagcttaacatcgtcttggagctggccgatgcaggcgacttgagtcagatgattaaatactttaagaagcagaaacgcctgattcccgagcggacggtgtggaagtatttcgtgcagctgtgctcagctgtggagcatatgcactctcgtcgggtgatgcacagagatattaaaccagccaacgttttcatcacagccacaggcgtggtgaagctgggcgacctggggcttggtaggttcttttcctccgagaccactgcagctcattctttggttgggaccccttactacatgtcccccgagaggatttag

SEQ ID NO: 197355 - DNA, 516 bp, Artificial Sequence
  Description of Artificial Sequence: Synthetic coding sequence
atggccggccagcccggccacatgccccacggcggcagcagcaacaatctgtgccacacactcggtcctgtccaccctccagacccccagcgacacccgaacaccctgtccttcaggtgttcgctagcagacttccagattgagaaaaagatcggccggggacaatttagtgaagtctataaagccacttgtttgttagatagaaagaccgtcgcactgaaaaaagttcaaatttttgagatgatggatgctaaagccagacaggattgtgtcaaggaaataggactgctcaagcagctaaaccacccaaatattataaaatacctggatagcttcattgaggacaacgaattgaatattgtccttgaactggctgatgctggcgacttgagtcagatgattaaatactttaaaaagcaaaaaaggctgatccccgagcggacggtctggaaatatttcgttcaactttgctctgcggtggagcatatgcatagcagacgggttatgcaccggtag

SEQ ID NO: 197356 - DNA, 606 bp, Artificial Sequence
  Description of Artificial Sequence: Synthetic coding sequence
atggccggccagcccggccacatgccccacggcggcagcagcaacaatctgtgtcacacattgggacccgtgcaccccccagacccacagcagcttaaccatccaaatatcatcaagtacttggactcatttattgaggacaacgaactcaacatcgtgctggagcttgctgatgccggagacctatcacagatgataaagtactttaaaaagcagaaacgtcttattccggagcgcacagtgtggaaatacttcgtgcagttgtgttcagccgtggagcatatgcactcacggcgggtgatgcatagggatataaaaccagctaacgttttcatcacagccaccggagtggttaagctgggggatcttggtctcgggagattttttagctctgaaaccactgctgcacattctctggttgggacaccatattatatgtcccctgagagaatacatgagaatgggtacaattttaaatcagatatttggtctcttgggtgcttgttatatgagatggctgctcttcagtcccctttttatggagacaaaatgaacctgttctctttgtgccagaagatcgaacagtgtgactaccccccactgtag

SEQ ID NO: 197357 - DNA, 1017 bp, Artificial Sequence
  Description of Artificial Sequence: Synthetic coding sequence
atggaggccaccggctgggacagccggtgcagccccggcacccaggtgagagctcttgttcggcttgcttgccgcatggccggccagccaggacatatgcctcacgggggatcttcaaataacctgtgccatacacttggacctgtccaccccccggatccccagcgccatccaaacacgctgagcttccggtgcagtctggctgacttccagatcgaaaagaaaatcgggagaggtcagttttctgaggtgtataaggccacttgtttactggatagaaagacagtggcactgaaaaaagtgcaaatcttcgagatgatggacgctaaagcgaggcaggattgtgtgaaggagatcggcctcctgaaacagctgaatcatccaaatatcattaagtatttggatagctttattgaggacaatgaactgaacatagttctggaactggccgacgcaggagatttaagtcagatgatcaaatacttcaagaaacagaagaggctgattccggagcgcacagtgtggaaatacttcgtgcagctgtgtagtgccgttgaacacatgcattcacgccgagtaatgcatcgtgacatcaagcctgccaacgtgttcatcacagcaactggggtcgtcaaattgggagacttgggactcggtagattcttctcatctgagactacggccgcacatagcctggtcggtactccctactatatgagccctgaaagaatacacgagaatggctacaatttcaagtctgacatatggtcccttggctgtctgctgtatgagatggcggccctgcagtcaccattttatggcgacaagatgaacttgtttagcctatgccagaaaatagagcagtgcgactaccctccactgcctggagagcattactccgagaagctgcgagagctagtaagcatgtgcatatgcccggaccctcaccagcggcctgatatcggatatgttcaccaagtagctaagcagatgcacatctggatgagttctacctag

SEQ ID NO: 197358 - DNA, 996 bp, Artificial Sequence
  Description of Artificial Sequence: Synthetic coding sequence
atgggccggcggcggcccgcccccttccgggccctggtgcggctggcttgtcgaatggcaggtcagccaggtcacatgccgcatggcgggtcttccaacaacttgtgtcacacgctcgggcccgtccatccccccgacccacagcggcatcccaacactctgtcattccgttgttctctggcagactttcagatcgaaaaaaagatcgggcgcggtcagttcagcgaggtctataaagccacctgcctgttagatcggaaaactgtggcactgaagaaggtgcaaatattcgagatgatggacgccaaggctcggcaggattgcgtaaaagagataggcctactgaagcagttaaatcatccaaatataattaagtatttggactcctttattgaggataacgagctgaacattgtactcgaacttgcagacgccggcgatctgagtcagatgataaaatactttaaaaaacagaagcgcctcattcctgaacggactgtatggaagtattttgtgcagttgtgttccgctgtggaacacatgcactccagaagagtgatgcatagggacattaagccagctaacgtcttcattaccgcaactggcgtggtaaagctgggggacctgggattaggaagatttttctccagcgagacaactgctgcacatagcctcgtcggcacgccatactatatgagtccggaaagaatccatgagaatggatacaatttcaagtcagacatctggtctctgggctgtctgctttatgagatggctgccctacagtcgcccttctacggggataagatgaacctgttttcactttgtcagaagatagagcaatgtgattatccaccactgccgggagagcattattctgaaaagctacgggaattggtttccatgtgcatctgtccggaccctcatcagcgccctgatattggttatgtgcaccaggtcgccaagcagatgcacatatggatgagtagtacctag

SEQ ID NO: 197359 - DNA, 942 bp, Artificial Sequence
  Description of Artificial Sequence: Synthetic coding sequence
atggccggccagcccggccacatgccccacggcggcagcagcaacaatctgtgtcacacacttgggccagtgcatccacccgatcctcagcgccaccccaacaccctcagcttcaggtgctccctggccgatttccaaatagagaaaaagatcggccgaggccaattcagcgaggtttataaggctacctgtctactcgacaggaagaccgtcgcacttaagaaggtgcagatctttgagatgatggatgctaaggcccggcaggactgtgtgaaagaaatcggcctcctcaaacaactgaaccacccgaacattatcaaatacttggatagcttcatcgaggacaatgagctgaacattgtcctggagttggctgacgccggtgacctgagtcagatgataaaatacttcaaaaagcagaaacgattaatcccggaacgcacagtgtggaaatattttgttcagctgtgtagcgctgttgagcatatgcacagccggcgagtaatgcacagggacattaaacctgctaatgttttcatcactgccacaggcgtggttaagctgggggatctgggtctgggccgcttcttctcttcagagacgactgctgcacattccctcgtcggtacgccttactacatgagcccagagaggatccacgagaatgggtacaactttaagtctgacatctggagcctggggtgcctactctacgagatggctgccctgcagtccccgttctatggggataaaatgaacctctttagcttgtgccagaaaattgagcagtgcgattaccctccactgccaggagaacactattccgagaagctgcgcgagttggtgtccatgtgcatctgtccagacccacaccagagaccagacatcggatatgtccatcaggtggcgaagcagatgcacatttggatgagttccacttag

SEQ ID NO: 197360 - DNA, 942 bp, Artificial Sequence
  Description of Artificial Sequence: Synthetic coding sequence
atggccggccagcccggccacatgccccacggcggcagcagcaacaatctttgtcataccctcggccccgttcacccccccgacccacagcgccaccctaacacactgtcctttcgctgctctctcgccgacttccagatcgaaaaaaagatcggccgcggacaatttagcgaggtctacaaggccacttgcctgttagatcggaaaacggtcgcactgaaaaaggtgcaaattttcgaaatgatggacgctaaggcccgccaggactgtgtgaaggaaatcggccttctgaaacaattgaatcatcccaatatcatcaagtatctggacagtttcattgaggacaatgagttaaacatcgttttagagctggctgacgcaggcgacctgagccagatgataaagtacttcaagaaacagaaacggcttatacctgaacgaacagtttggaagtacttcgtgcagctgtgcagtgcagtggaacatatgcattcccgtcgtgtgatgcacagggacataaaacccgcgaatgtgttcatcaccgccaccggtgtcgtgaaactcggagacttgggtctcggaaggttcttttcaagtgagacaaccgccgcccacagcctggtggggactccatactacatgtcccctgagcggatccacgaaaacggatacaatttcaaatcagatatatggtctctcgggtgcctgctgtacgagatggccgctctgcaatcaccgttctacggagataagatgaacctttttagcttgtgccaaaagatcgagcagtgcgattaccctccacttcctggggagcactattccgagaagttgcgcgaattagtctccatgtgtatttgccctgacccacaccagaggccagacattggctatgtccaccaggtagcgaaacaaatgcatatttggatgtcctctacatag

SEQ ID NO: 197361 - DNA, 909 bp, Artificial Sequence
  Description of Artificial Sequence: Synthetic coding sequence
atggacgagcagagccagggcatgcagggcccccccgtgccccagttccagccacagaaggctctccggcctgatatgggatacaacacactcgccaatttccgcatcgaaaagaagatcggccggggtcagtttagcgaggtgtaccgggctgcctgcctactggatggcgtcccagtagctcttaagaaagtgcagatctttgacctaatggatgctaaagctcgcgccgactgcataaaggaaatcgacctgttgaaacagctcaaccacccgaatgttatcaaatattatgccagcttcatagaggataatgagctgaacattgtgctggaactggctgatgcgggggatctctcccggatgataaagcactttaagaagcagaagaggctgattccagaaagaacagtttggaagtatttcgttcagctctgctccgccctcgaacacatgcactcccgaagggtgatgcatcgcgacatcaagcccgctaacgtgtttattacagccactggcgtcgtgaaactaggagatttgggcctaggaaggttctttagttctaagacgactgcagctcattccctggtggggacaccttattacatgagcccagaacgaatacacgaaaatgggtacaatttcaagtccgatatatggagcctgggatgcttgctgtacgagatggcagctctgcaatctcccttctatggcgataaaatgaacttgtattcgctttgtaagaagatcgagcagtgcgattaccccccccttccctctgatcactactctgaagagctcaggcagctagtaaatatgtgtataaatcccgaccctgagaagaggcctgatgtaacctatgtgtacgacgtggccaagcggatgcacgcctgcactgcatcaagctag

SEQ ID NO: 197362 - DNA, 249 bp, Artificial Sequence
  Description of Artificial Sequence: Synthetic coding sequence
atggacgagcagagccagggcatgcagggcccccccgtgccccagttccagccacagaaggcgctaagacccgacatgggctacaataccctagctaattttagaatcgagaagaagatcggacggggacagttcagcgaagtctacagagccgcctgtctgctggatggcgtgcctgtcgctctgaaaaaagtccagattttcgatctcatggatgccaaagccagggccgactgtattaaggaatag

SEQ ID NO: 197363 - DNA, 99 bp, Artificial Sequence
  Description of Artificial Sequence: Synthetic coding sequence
atggacgagcagagccagggcatgcagggcccccccgtgccccagtttcagccccaaaaagccctccgacctgatatgggctataatacacttgcatag

SEQ ID NO: 197364 - DNA, 909 bp, Artificial Sequence
  Description of Artificial Sequence: Synthetic coding sequence
atggacgagcagagccagggcatgcagggcccccccgtgccccagttccagccccaaaaggcccttcgcccagacatgggatacaatacccttgccaactttcgtattgagaaaaagattgggcgaggccagttttccgaagtgtaccgagcggcgtgcttgctggacggggttcctgttgccctgaagaaggtccaaatctttgacttaatggacgcaaaagccagggctgattgtatcaaagagatcgatctcctcaagcagctgaaccatcccaatgtgattaaatactatgcctcctttatcgaggacaatgaactcaatatcgttctggagctggcagacgccggtgatctgagcagaatgatcaaacactttaaaaaacagaaaagactcatacccgagaggacggtttggaaatattttgtgcagttatgctccgcattggaacatatgcactctcgccgggtgatgcaccgtgacattaaaccagcgaacgtattcataaccgccacaggcgtcgtgaagctgggcgacttagggctggggcgattcttcagcagtaagacgacagccgcccacagtcttgtggggacaccatattacatgagtcctgagaggatacacgaaaacggatacaatttcaagagcgatatttggtccttggggtgcctactatacgagatggctgccctgcagtcaccattttatggagacaaaatgaacctgtactccctgtgtaagaagattgaacagtgcgactacccccctctgccatccgatcactacagtgaagagctcaggcagctcgttaacatgtgcatcaacccagacccagagaaaaggccagatgtgacatacgtgtatgacgtggccaagaggatgcacgcttgtaccgcatcctcttag

SEQ ID NO: 197365 - DNA, 189 bp, Artificial Sequence
  Description of Artificial Sequence: Synthetic coding sequence
atggacgagcagagccagggcatgcagggcccccccgtgccccagttccagccgcagaaggccctgaggcccgatatgggctataacacactagctaacttccgaattgaaaaaaaaatcgggaggggccagttctctgaggtctaccgagcggcttgtttattagatggcgttcccgtggcgctgtag

SEQ ID NO: 197366 - DNA, 3729 bp, Artificial Sequence
  Description of Artificial Sequence: Synthetic coding sequence
atggagaagtacgtgcggctgcagaagatcggcgagggcagcttcggaaaagccatactagtgaaatccaccgaagacggtagacagtacgtgatcaaggagatcaacatcagtcggatgagctccaaagagagggaagagtctcggagggaggtcgcagtcctggccaatatgaaacatccaaacatagtgcagtatagggagtctttcgaggagaatggatctctctatattgtgatggactactgcgaaggcggtgacctctttaagcggattaacgcacaaaaaggcgtactttttcaggaggaccaaattctggattggtttgtgcagatttgtctcgcactgaaacacgtccacgaccgcaagatacttcatcgcgacatcaagagccagaatatttttcttacaaaagacggcaccgtgcagctcggggattttggcatcgccagggtgctcaacagtacggtggagctggctagaacgtgcattggcacgccttactacctctcaccggagatatgcgaaaataaaccatataataataagagcgacatttgggcgctgggttgcgtcttgtacgaactttgcacgttaaaacatgctttcgaagccggatccatgaaaaatctggtcttgaaaatcatatcgggttctttcccgcctgttagtctccattatagttacgacctcaggtccctcgtttctcagctcttcaaacggaaccctagggacagaccatccgtgaacagcatcttggagaaaggtttcatcgctaagaggattgagaagtttctgagcccccaactgatcgcagaggaattctgtctgaaaactttctctaaatttggttcgcagcctatcccagccaagaggccagcctcaggtcagaattcaatcagtgttatgccagcccagaagatcacaaagcccgcagctaagtacggcatcccactggcttataagaagtacggtgataagaaactccacgaaaagaagcccctgcagaagcacaaacaggcccatcaaacaccggagaaacgggtcaatactggtgaggagaggagaaagatctccgaggaagcggcacggaagcggcgcctcgagttcattgagaaggagaaaaagcagaaagatcagatcattagtttaatgaaggccgagcagatgaagaggcaggagaaggagagactggagaggatcaatcgggcccgggaacaggggtggcgcaacgtcctatcggcgggcgggtcaggtgaggtcaaggctcccttcttgggctccggcggcacaatcgctccctcctcattcagttcacggggccagtacgaacattatcatgcgattttcgatcagatgcaacaacagcgggccgaggacaacgaggcgaagtggaagagagagatctatggacgtgggctgcctgaacggcaaaaagggcagctagcggtagagagagcaaaacaagtggaagaattcttacagcggaagcgggaggctatgcaaaataaggccagggccgagggacacatgggaatactgcagaacttggccgcgatgtatggcggaagaccaagttccagccgcgggggaaaaccaaggaacaaagaggaagaggtatacctggctcggctgagacagattcgcctgcagaacttcaatgaacgtcagcagataaaggcaaagctgcggggggagaagaaggaagccaaccactccgaagggcaggaaggcagtgaagaggccgatatgagacgaaagaagattgagagtctcaaagcacatgctaacgcacgcgccgccgtgcttaaggaacagctggaacggaaaagaaaggaggcttacgagagggagaagaaggtctgggaagagcacctggttgcgaagggcgtcaaaagttcagatgtgagtccgccactcggccagcacgagaccgggggatcccccagcaagcaacagatgcgcagcgttatcagtgtaacaagcgcccttaaagaggttggcgttgacagctctctcaccgatactcgggaaacatcagaagaaatgcaaaagacaaataatgcaatctcctctaaacgggagatcctccgcagattgaatgaaaatcttaaagcccaggaagacgagaagggaaagcaaaatcttagtgacacatttgagattaatgtacacgaagacgctaaggagcacgaaaaggagaagagcgtgtcaagcgataggaagaagtgggaggcaggcggtcaacttgtgattccactggacgaattgactctcgatacctccttttcgacaactgaaaggcatacagtcggtgaggtaattaagctaggacctaatggttcgccccgcagagcatggggtaaaagtcctacggattccgtccttaagattctgggcgaagccgaactccagctgcagaccgagttattggagaacactaccattcgatctgagatttcgccggaaggtgagaaatataagcccctgattacaggggagaagaaggttcagtgtattagccatgaaatcaaccctagcgctattgttgactcaccagtcgagaccaagagtccagagttcagtgaggcatcacctcagatgtccctgaaactggagggcaacctagaagagcccgacgacctggagacagagatcctgcaggaaccttctgggacgaacaaggacgagagtctgccctgtaccattactgatgtgtggatctcggaggagaaagagactaaagagactcagagcgctgacaggattacaatacaggagaatgaggtctcagaggatggagtgtcatccactgtcgaccagctctctgatatccatatagagccgggaaccaacgactcacagcattctaagtgtgacgtggataaaagcgtccaaccagagccattctttcataaggtggtgcattccgagcacctgaatctggtaccccaggtgcagagcgtacagtgttccccggaggagtcctttgcattcaggtcccactcccacctcccacccaaaaataaaaacaagaattctctgctcataggcctgtcgaccggcctgtttgacgccaataatccaaagatgctgaggacctgctccctgcctgacctgagcaaactttttcggacattaatggatgtgcccactgttggcgacgtccgccaggacaatctggaaattgatgaaatcgaagatgaaaatatcaaagaaggcccctcggactcggaagatatagtatttgaagagaccgataccgacttgcaggaactgcaagcatccatggagcaactgctcagggaacagcctggggaggaatatagtgaagaagaggaaagcgttcttaagaacagtgacgtggagcctacagccaatggaacagatgtggctgacgaggacgataatccgtcctccgaatctgccctgaacgaagagtggcattctgacaattctgacggggagatcgcaagcgagtgcgaatgcgattcagtattcaaccacctggaggagctccgactgcatctcgaacaggagatggggtttgaaaagttttttgaggtctacgagaagattaaggcaatacatgaggacgaagatgagaatatcgaaatttgttcaaagatcgtccagaacatactgggcaatgagcatcaacacctatacgccaagattctgcatctggtcatggctgatggcgcttatcaggaagacaacgatgaatag

SEQ ID NO: 197367 - DNA, 1800 bp, Artificial Sequence
  Description of Artificial Sequence: Synthetic coding sequence
atgctgaagttccaggaggccgccaagtgcgtgagcggcagcaccgcaatctccacatatccaaaaacccttatcgctcggaggtacgtcctacagcagaaactgggctcggggagcttcggaactgtctatcttgtgtctgacaagaaagctaagcgtggggaggagttaaaggtcctgaaagagatcagtgtgggcgaacttaaccccaacgagaccgtgcaggcaaacctcgaggcccagctgctgtcgaagctggatcaccccgctatcgtgaagttccacgcttctttcgttgagcaggacaacttttgcatcattaccgagtattgcgagggtcgcgacctcgacgacaagatacaggaatacaagcaagcgggcaagatctttccagaaaatcagataattgagtggttcatacagctcctgctcggagtggactacatgcatgagcggcgtatcctgcaccgggatcttaaaagtaaaaatgtgttcctcaaaaataatctgttaaagattggtgattttggggtcagcagactgcttatgggatcctgcgatctggcaacgaccctcactgggaccccccactacatgagtcccgaagctctcaagcaccagggttatgacactaaaagtgatatttggtccctggcctgcatcttgtacgaaatgtgttgcatgaatcacgcgtttgccggatccaactttctctctatcgtactcaaaattgtggagggtgacactcccagcctgcccgagagataccccaaagagttgaacgcaattatggagtccatgttaaacaaaaatccatcactgagaccgagcgccattgaaatactgaaaatcccctacctcgatgagcagcttcagaacctgatgtgtaggtacagtgagatgacactcgaagataagaatcttgattgtcaaaaagaggccgctcatattatcaacgccatgcagaagcgcatccaccttcaaactctcagagccctttccgaggtccagaaaatgacaccgcgggagcggatgcgactccgcaaactccaggccgcagatgagaaggctaggaagctcaaaaagatcgtcgaagagaagtacgaggagaactcaaagcggatgcaggaattacgatccagaaatttccagcaattatcagtggacgtactgcacgaaaaaactcacttgaaaggaatggaagagaaagaagagcagcctgagggccgccttagttgttcaccccaggacgaagatgaggagcgttggcagggccgggaagaagaatccgatgagcctactcttgaaaatctacctgaaagtcagccgataccatcaatggatctgcacgagttggagtccatcgtcgaggacgctacatcggacctcggctatcacgagatccccgaggatccgttggtcgcagaagagtactatgcagatgcttttgattcatattgcgaggagtcagacgaagaggaagaggaaattgccctggaacggcccgagaaagaaatccggaatgaaggttctcagcctgcataccgcaccaaccaacaggactccgatattgaagccctggcccgttgcctcgaaaacgtccttggatgcacatctcttgatcagccttgcagatcctggggacaaaagtatctcaaaaggtcgatcattacctcccgcgagcagggaattaggatgctggcaaaacagcgcagcgcgtctgtctggaagaagtggtgcttgaagccagccactgtgctgaagtggactagttcttgtactttgaaatctagctgttag

SEQ ID NO: 197368 - DNA, 459 bp, Artificial Sequence
  Description of Artificial Sequence: Synthetic coding sequence
atggacagcggcaccgaggagtacgagctgaacggcggcctgcccccaggcacccctggctcaccggacgcgagcccggctagatggggctggcggcatggccccattaatgttaatcattatgcctctaaaaagtccgcagccgaatccatgctggatatcgcccttctcatggcaaacgcatctcaactcaaggcagttgtggagcaaggaccatcttttgcgttctacgtgcccttagtggtcctgatttctatcagcctggtgctacaaatcggagtgggcgtcctgcttatttttttggtgaaatatgatcttaataacccagcgaaacacgcaaagctagacttcctgaataatctcgctacaggcctggtctttatcatcgtagtcgtgaatatctttattaccgcctttggtgtccagaagccgcttatggacatggccccccagcagtag

SEQ ID NO: 197369 - DNA, 567 bp, Artificial Sequence
  Description of Artificial Sequence: Synthetic coding sequence
atggccggcctgagccggcagctgtgcgccctgagccaccccaagaaggccgctgaaactcagaccgctgagcctgggggcgctcacgccgtgtgttctaggcaccctgtgcgagttaaggggctggaagggtcagagatggagtctgcccgcgaaaacatcgacctacagccaggctcttctgaccctagaagtcaacctatcaacctcaaccattacgcaaccaagaaatccgttgctgaaagcatgctggatgttgccttgtttatgtccaatgcaatgagacttaaggccgtgctggaacaggggcccagttcccactattatactaccctggtaaccctcatttctcttagccttctgctacaagtggtgataggcgtgttactggtagtcatcgccaggttgaacctgaacgaggtggaaaagcaatggagactgaaccagctgaacaacgccgccaccatccttgtgttctttacagtcgtgataaatgtgtttattactgccttcggcgcgcataagaccggttttttggctgcacgggctagtcgaaatcccctttag

SEQ ID NO: 197370 - DNA, 273 bp, Artificial Sequence
  Description of Artificial Sequence: Synthetic coding sequence
atgctggacgtggccctgttcatgagcaacgccatgcggctgaaggccgttctcgagcagggacccagcagccactattatactacccttgtgacactgatttccctgagcctcctgttgcaggtcgtgattggggttctgctagtcgtaattggtgaagaaccgtcattacagtccgacttactgcctaggcatccatggcttgctgaacgcccccatgtctcaccgggccctccatgcattgggacaggatcatttgccacaacccgctag

SEQ ID NO: 197371 - DNA, 1401 bp, Artificial Sequence
  Description of Artificial Sequence: Synthetic coding sequence
atgcccggcgacagcagccccggcaccctgcccctgtgggacgccagtctgagccctcctctaggacccgaccccggagggttctcaagggcgtcccacgccggggataaaagcaggccccccgccccagagctgggctcacctggcgcggtccgcccaagagttggaagctgtgctcccgggcccatggagctaagagtcagtaacacctcctgtgaaaatgggtctctgctgcatttgtattgttccagtcaagaggtgctttgccaaatcgtcaatgatctgagcccagaggtgccgtccaatgctactttccatagctggcaagagcgaattagacagaattatggcttctatatcggacttgggctggctttcctgtcctcctttctaattggcagcagcgttatcctcaaaaaaaaaggtctgttgagattagtggccactggagcgactagggctgtcgacggaggttttggatacctcaaggacgccatgtggtgggctggattcctcacgatggcagccggcgaagttgcaaactttggtgcgtatgctttcgctcccgccacggtcgtcacccccctcggcgcattgagcgtgcttatcagcgcaattctgtccagttacttcctgcgtgaatcgcttaacctcttaggcaaactcgggtgcgtaatttgtgtggctggcagcacggtcatggtgatacacgccccagaagaggaaaaagtgaccaccattatggaaatggcatcaaaaatgaaagacaccggcttcattgtgtttgctgtcctattgctggtgtcctgcctcatcctgatctttgtcatcgcccctagatacgggcagcgtaatatacttatatatataataatatgtagcgtgatcggggccttcagtgtcgcggcagtgaagggcttagggataactatcaagaatttttttcagggcctccccgtggttagacatcccctgccatacatcctgagcctcatactcgccctttcactgagcactcaagttaacttccttaaccgggcattagacatttttaacaccagcttagtctttccaatctactacgtcttctttactaccgtggtagtgaccagttccattatcctcttcaaagaatggtactcgatgtccgccgtggacatcgccggtacactctccgggtttgtaacaatcattctcggcgtgttcatgctgcatgccttcaaggacctggatatctcctgcgcatctctgcctcacatgcacaagaaccccccaccctcaccggcacctgagcctactgtgattcgccttgaggacaagaatgtgcttgtggataacattgagctggcttccactagtagtcctgaggaaaagcctaaagtttttattatccacagctag

SEQ ID NO: 197372 - DNA, 1344 bp, Artificial Sequence
  Description of Artificial Sequence: Synthetic coding sequence
atgcccggcgacagcagccccggcaccctgcccctgtgggacgccagtctgtccccacctctgggaccagacccgggcgggttcagcagggcaagccacgccggtgacaagtccaggccaccggcacccgaactggggagtccaggcgccgtcagaccgcgtgtcggttcatgtgcgccaggccctatggagctgcgtgtgagcaacaccagttgcgaaaacgggagcctgctccatttatactgctccagccaggaggtgttgtgccagatcgtcaatgatctttcccctgaggtgcctagcaacgccacctttcactcctggcaagagaggatcaggcagaactacggattctacatagggttgggattggcatttttgtccagcttcctgatcgggtccagtgtaatcttgaaaaaaaagggcctgctgagactggtcgccaccggagcaactcgcgcagtggctgctggtgaggtcgcaaatttcggtgcctatgccttcgcccccgcaaccgtggtgactccactaggcgctctgagcgtccttatcagcgccattctgtcttcatattttttaagggagtcgttgaacctcctgggcaagcttggttgcgtgatttgtgtcgccgggtcgacagttatggtgatccacgctccagaggaagagaaggttactacaattatggagatggcttccaagatgaaggacactggatttattgtctttgccgttctcctacttgtcagttgcttgatactcattttcgtcattgcccctagatacggtcagcggaatatcctgatctatatcattatttgctctgtgatcggcgcctttagcgtggcagcggtaaagggtctcggcattaccataaaaaatttttttcaggggcttcctgtcgttcgacaccccctcccctacatactatccttaatattggctttgagcctgagcacccaggttaacttcctcaaccgcgccctcgacattttcaatacctccctcgtgtttcctatatactacgtattcttcacaacagtggtggtaacctcttccattatcctgttcaaggaatggtactcgatgagtgccgtggacattgccggcacattgtctggcttcgtaacgattatcctgggtgtatttatgctacacgcattcaaggacctggacattagctgcgcttcgttgccccatatgcataaaaaccctccaccaagcccagcccccgagcctaccgtgatcaggctcgaggataaaaacgtcctggttgataacatcgagctggcatctacgtcaagcccagaggagaagcctaaagtcttcatcatccattcatag

SEQ ID NO: 197373 - DNA, 8415 bp, Artificial Sequence
  Description of Artificial Sequence: Synthetic coding sequence
atgaacggcgacatgccccacgtgcccatcaccaccctggccggcatagcatccttaactgatctgttaaatcagctgccactgcccagcccgcttcctgctacaaccacaaaaagtctgcttttcaatgcgcggatcgccgaagaggtcaactgtctgttggcatgtcgcgacgacaacctggtgtctcagttggtccactccttgaaccaagtgtctaccgatcatattgagctgaaggataacctcggtagcgacgatcccgaaggcgatatccctgtgttactgcaagcggtgctggctagaagcccaaacgtgttccgagagaagtccatgcagaacaggtacgtgcagtcaggtatgatgatgtcacagtataaactaagccaaaactctatgcattccagtccggcaagttcaaattaccagcagactacaatctctcatagtccttcatcacgttttgtgccccctcagaccagttccggcaacaggttcatgccacagcagaactctcctgttcccagtccttatgcccctcagtctccagctggctacatgccctatagtcatccttcttcctacactacccatccccaaatgcagcaggcctcggtctcctcacctatcgtggctggcgggctgaggaacattcacgacaacaaggtgagtggccctttgtcggggaactccgcaaatcatcacgcggacaacccaagacatgggtccagtgaagactacctccatatggtacaccgcctgtcctccgatgatggtgattcttctaccatgcggaatgctgcctcctttccgctgcgttcaccacaacccgtctgcagcccagcaggaagtgagggaactccaaaggggtctcgcccgcccttgatcctacagtcacagtctcttccttgctcctccccgagagatgttcctcccgacatactgctcgatagccctgaacgcaagcaaaagaagcaaaaaaagatgaaactgggcaaagacgagaaagagcagtcagaaaaggccgcaatgtatgacattatcagtagtccctctaaagatagtaccaagttaaccctcaggctgtcaagagtgcgctcgtccgatatggatcagcaggaggacatgatttccggagttgagaatagcaatgtatcggagaatgatattcctttcaacgtgcagtatccaggacagactagcaagaccccaatcacaccgcaggacatcaatagaccgctaaacgccgctcagtgtttatcccaacaagaacagaccgcttttctgcccgcgaaccaggtgccggtgctccagcagaacactagtgttgctgccaaacagcctcagacatccgtggtacagaatcagcaacagatttcccaacagggcccaatttacgatgaggtggagctggatgccctcgccgagatcgaacggatcgagcgggagagcgctattgagagagagaggttctctaaggaggtgcaggacaaggataagccacttaagaaaagaaagcaggattcttaccctcaggaagcaggaggggcaaccgggggcaatcgccccgcctcccaggagacgggcagcaccgggaatgggtcccgacccgctcttatggtgagcatagatctacatcaggctgggagagtcgatagtcaggctagcattacccaggatagtgacagcatcaagaagccagaggagataaagcagtgtaacgacgccccagtgtccgttctccaggaggacatagtaggcagcctcaaatctacgcctgaaaaccatcccgagactccaaaaaagaaaagtgaccctgagttatccaagtctgagatgaagcagtcagagtccaggctcgccgaaagcaaacctaatgaaaaccgactggtggaaaccaaatctagcgaaaataagctagaaacaaaggtcgagacacagaccgaagagctgaagcagaacgagagtcgcaccactgagtgcaaacagaatgagagcacgatcgtcgagccaaaacagaacgagaacagactttccgatacaaagccgaacgataacaaacagaacaacggtaggtcagagacaacaaagagcaggcccgagacaccgaaacaaaagggggaatcccgccctgagactcccaagcagaaaagcgacggccacccagaaactcctaagcaaaaaggagatgggcggccagaaacacctaagcagaagggcgagagtcgccctgaaacccccaaacagaagaacgagggtagacctgagacgcccaagcaccgccatgataaccggcgcgactccggcaagccatccactgaaaaaaaacccgaggtcagcaaacataagcaggacactaagtcagactccccccgccttaagtccgagcgcgctgaggcgctcaagcagcgacctgatggcagatcagtctccgagagcctgagacgggaccatgataataagcagaagagcgacgatcgaggggagtctgaacgtcacagaggcgaccagtcacgcgtgcgacgacctgaaacactgcgtagctcctctcgcaacgagcacggtatcaagtctgactcatctaaaacagataagctcgagaggaaacatagacatgagagcggtgactcaagagaaagacccagtagcggcgagcaaaagtcccgtccagacagtcctagggtcaagcaaggtgacagcaataagtctcgatccgacaagcttgggtttaagagcccaacaagtaaggatgataagcgcaccgaaggcaataaaagcaaggtggacacgaacaaggcacaccctgacaataaggccgagtttccgagctacttattggggggtcgatctggcgcccttaagaatttcgttatcccaaaaattaagagggacaaggacgggaatgtcacccaggagactaagaaaatggaaatgaaaggggagccgaaggataaggtggagaaaattggattagtggaagatttgaacaaaggtgcaaagcctgtggttgtgctgcagaagctgtctctggatgacgtccagaaactgattaaggatagagaggacaagagtaggtcttctctcaaaccaattaaaaacaaaccgtcaaaatccaacaagggatcaattgaccaaagtgttttgaaggagctcccgcccgagttactcgcagagattgagagtactatgcccctgtgtgaaagagtgaagatgaacaagcgcaaacgctctaccgtgaacgaaaagcctaaatacgcggaaatctcatctgatgaggacaacgatagcgatgaggcgtttgagagctctagaaaaagacacaaaaaagacgatgacaaagcgtgggagtatgaggagcgggataggaggagcagcggcgaccacaggcggtctgggcattcgcacgagggtcgcaggagtagtggtggagggaggtacaggaaccgctccccctccgactccgatatggaggactacagtcccccacctagcctgtcggaggtcgccaggaaaatgaagaaaaaggagaaacaaaagaagcgcaaggcctatgagccgaaactgactccagaggaaatgatggactcctcgaccttcaagcggtttactgcaagtattgagaatatcctggataatctggaagatatggatttcacggcctttggtgacgacgatgaaatccctcaggagctgctacttgggaagcaccaattaaacgaactcggcagtgaatccgcaaagatcaaggctatgggcatcatggacaaactcagtaccgataaaacagtcaaagtgctgaatatcttagagaagaacatccaagatggaagcaagcttagcaccctgctcaaccacaataacgataccgaggaggaagagcgcctgtggagagacttgattatggagagagtgaccaagtccgccgacgcttgtttaacaactatcaatataatgaccagccccaacatgccgaaggctgtgtacatcgaagatgtcatagagagagtgattcagtacacaaaattccacctccagaacaccctctatccacaatacgatccggtgtacaggctggatccccacggtggcggtttgctctcctccaaagcaaagagagctaaatgttcgacccacaagcagcgggttatcgtgatgctgtataacaaggtttgcgatattgtgtcttcgctcagcgaactgctggaaattcaacttctgaccgacacaacgatcctgcaggtctcctctatggggattacaccattcttcgtcgagaacgtgagcgagctgcaactctgcgcaatcaagctagtgaccgcagtgttctcgcgctacgaaaagcaccgacaactgattctcgaagagatcttcacatctcttgcccgcttgccaacaagcaaaagatctctgcgcaattttcgccttaactcgtccgacatggatggggagcccatgtacattcagatggtcactgcactggttctccagctgatccagtgcgttgtgcaccttccctcatctgagaaagactccaatgcggaggaggattccaataagaagatcgaccaagacgtggttattaccaactcgtacgagaccgccatgcgcactgcccagaacttccttagcattttcctgaaaaaatgcggctccaaacaaggggaggaggactatcggcctctatttgaaaatttcgtacaggacctcttaagcactgtcaacaaaccggaatggccggctgcggaattactactcagccttttaggacggctcctcgtgcaccagtttagcaacaaatccaccgaaatggccctgcgcgtggccagcctcgattatctgggcacggttgccgctcgcttaaggaaggatgccgttacgagtaagatggatcagggatctatcgagcgcatcctcaagcaggtaagtggaggcgaagacgagattcagcagcttcagaaggcacttctcgattatctcgatgagaacacagaaaccgacccttctctagtgttctcacggaaattctacatagctcaatggtttcgcgacactacattggagactgagaaagcgatgaaaagccaaaaggatgaggagagcagcgagggaacccatcacgccaaagaaatcgagacgacaggccagattatgcatagagcagaaaaccgcaagaagtttctgcgctccataatcaaaaccaccccatcccagttcagtaccctcaaaatgaactctgataccgtcgattatgacgatgcctgcctaatagttaggtacctggccagcatgcggcctttcgctcagtcttttgatatttatttgacgcagatcttgcgggtacttggcgagaatgctatcgcagtgagaacgaaggctatgaaatgtttatccgaagttgtggccgtggacccttctattctggcccgattggacatgcagcgaggagtgcatggccgtctcatggataacagtacatccgtcagggaggctgctgtggagctgctgggcagattcgtgctgtgccggccgcagcttgctgagcagtactatgacatgctgatcgaacgcattttggacacgggtatttcagtgaggaagcgcgtgattaagatcctaagggatatctgcattgagcagcctacatttcctaagattacagaaatgtgcgtgaagatgatccgaagagtgaacgacgaagagggaataaaaaagctcgtgaacgaaacctttcagaaactctggtttacccctactccccacaacgataaggaagccatgactcggaagattctgaacatcaccgatgtggtagccgcctgtagggatacgggctacgattggtttgaacagttactgcagaacctgctgaagtcagaggaggattcctcctacaagcccgtcaaaaaagcctgtacccagctggtggacaatcttgttgaacacattctgaaatatgaggaaagcctcgccgactctgacaacaaaggcgtaaactccggccgcctggtggcatgcattaccacacttttcctttttagcaagatacgcccccagttaatggtgaaacacgcaatgactatgcaaccttacctgactacaaaatgtagtacccagaatgattttatggtaatctgtaacgttgctaagattctggagcttgtagtacctctcatggaacaccccagtgagactttcctggcgaccattgaagaggacctgatgaaactcattatcaaatatggcatgactgtcgttcaacactgtgtgagctgcctgggagcggttgttaataaagtcacgcagaattttaagttcgtgtgggcctgcttcaaccgttactacggcgccatatccaagctgaagtctcaacatcaggaagaccccaacaacacttcactactcacaaataagccagccctgctcaggagcctctttacagttggcgcactctgccggcacttcgattttgatttggaagactttaaaggaaactctaaagtgaacatcaaggataaagtcttagaacttcttatgtatttcaccaaacacagcgacgaggaggtgcagaccaaggctatcatagggctggggtttgcttttatccaacacccgagcctgatgtttgagcaggaggtgaaaaatttatataacaatatccttagtgataaaaattcaagcgtaaacctgaagatccaggtgctcaaaaatctgcagacatacctgcaggaggaggacacccgcatgcaacaagccgaccgcgattggaagaaagtggccaagcaagaggacctgaaagaaatgggtgacgtgagctctggcatgtcctcatccataatgcagctgtacctcaaacaagttctggaggcattttttcacacacagagttccgtccgccatttcgcgctcaatgtgattgccctcacactcaaccagggcctaattcaccccgtgcagtgcgttccttatttgatcgccatggggaccgatcctgaaccagctatgcgcaacaaggctgatcaacaattggtggagatcgataagaagtatgccgggttcattcacatgaaggccgtggcaggaatgaaaatgagctatcaggtgcagcaggcgattaatacatgtttgaaggatccagtcaggggattcaggcaggacgagtcatctagcgctctctgctcacatctctattctatgattcgcggcaacagacagcatagacgagcgtttttgataagcttactgaatctgttcgacgacaccgcgaagacagacgttactatgctgctgtacatagcagataacctcgcctgttttccttaccagacccaggaggagcccctgtttataatgcatcacattgacatcacactatctgtttccggcagtaacctcttgcagtcttttaaagaatccatggtgaaggataaacggaaggagcgcaaaagtagcccctcgaaagagaacgaaagcagtgactccgaggaggaggtctcaagacccaggaagtcgaggaagcgggtagatagcgattccgacagtgactcagaggacgatattaactccgtgatgaaatgcttaccggaaaattctgctcccctgattgaattcgccaatgtgtcacagggcatcttgctccttttaatgctcaagcaacatctgaaaaatctatgcggattctcagattccaagatccagaaatactctccaagtgaatccgcaaaagtatatgacaaggccattaataggaagacaggcgttcattttcacccaaaacagaccttggacttcctgcgcagcgatatggccaacagcaaaataacagaggaagtcaagcgttctattgtgaaacaatatctggactttaaactgctgatggagcacctggatcccgacgaggaggaggaggagggggaagtcagcgcatccacaaacgcccgtaacaaagctatcactagtttattgggcggaggctccccaaaaaacaacaccgcagcagagacagaggacgacgagagcgacggcgaagacagaggaggcggcacctccggaagtctgcgccgcagcaagaggaatagcgattcaactgagctggcagctcagatgaatgagtccgtagatgtcatggatgtaatagccatctgttgtcctaagtacaaagatcgtcctcagatagcgcgagtggttcaaaagactagtagcggatttagcgtacagtggatggctgggtcatacagcgggagctggaccgaggccaaaagaagagatggcagaaaactggtgccctgggtggacacaatcaaagaaagcgacataatttataagaaaatcgccctgacctccgctaacaaactgaccaacaaagttgtgcagaccctgcgcagtttgtacgctgccaaagatggcacaagcagttag

SEQ ID NO: 197374 - DNA, 8094 bp, Artificial Sequence
  Description of Artificial Sequence: Synthetic coding sequence
atgaacggcgacatgccccacgtgcccatcaccaccctggccggcattgctagcttgacggacttgctgaaccagcttccattgccctcaccacttccggccactactacaaagtctctgctgttcaatgccaggattgcagaggaggtgaactgcttgctggcctgcagagacgacaacctcgtttcacagttagtgcattcactgaaccaagtctctacagatcacattgagcttaaggataacctcggatctgacgacccggagggcgacatacccgtgttgctgcaagcagtcctggctaggtcacccaatgtttttcgggaaaagtccatgcagaataggtatgtccaatccggcatgatgatgtcgcagtacaagctaagccagaattccatgcattcttcccctgcgagttccaactaccagcaaaccacaatcagccacagcccatcatcaaggttcgtgcccccccaaacctcatccgggaatcggtttatgcctcaacagaactcgcccgtccctagcccttacgctccccagagccctgccggatacatgccatattctcatccctcttcctatactactcatcctcagatgcagcaggcatctgtctcttccccgattgttgccgggggtctccggaacattcatgacaataaggtttcgggacctctgtcgggcaacagtgctaatcaccatgcagataatcctagacacggcagttcggaagactatttgcatatggttcacagactttcttccgatgacggcgattccagcactatgcggaatgccgcttcattcccactgagaagccctcagcctgtttgtagcccggccggctccgagggaaccccgaagggctctcggcccccgctgatcctgcagtctcagagcctgccctgttctagtccacgagatgtgccacccgacattctgctagactcacccgaaagaaaacaaaaaaagcagaaaaaaatgaaattgggaaaagacgagaaagagcagtcagagaaggctgccatgtatgacatcattagttctccaagtaaggacagcaccaagctaacactgaggcttagccgagtgcggtcctccgacatggaccaacaggaggacatgatctctggagtggaaaattcaaatgtttcagagaatgacatcccatttaatgttcagtatcctggtcaaacctcaaagactccaattacgccccaggatataaataggcccctaaatgccgcccaatgtttgtctcagcaggagcagacggcctttttgcctgcaaatcaagtaccagtcttacagcaaaacacaagtgtcgccgctaaacagcctcaaactagtgtcgtccaaaatcaacagcagatttcccagcaaggccctatctatgacgaggtagaactagacgcactagcggagattgaacggattgaacgcgaatcagccattgagagagagcgtttctctaaggaggtgcaggacaaagacaagcctttgaagaagcgtaaacaggattcatacccgcaagaagccggaggcgctaccggcggcaacagaccagcctctcaggaaactgggtcgaccggcaatgggtcaagacctgctctgatggtaagcatcgacctgcaccaagctgggagggtggactcccaagcttctatcacccaggactcagacagcataaagaagccagaggagatcaagcagtgtaacgatgcacccgtctcagtgctgcaagaagacatcgtcgggagcctgaaatccaccccagagaatcatcccgagactcctaaaaagaaatccgatccggagctcagcaaaagtgagatgaaacagtctgaaagccgcctggcagaatccaagccgaacgagaaccgtttggttgaaaccaagagcagtgagaataaactggagactaaagtggaaacgcagaccgaagaactcaagcagaatgaatcacgaactacagaatgcaaacaaaacgagtcaaccatcgtggagcccaagcagaacgagaaccggttgtctgacactaagccaaacgataataaacagaataacggacgcagcgaaacgactaagagccggcctgaaaccccgaaacagaagggggagtcacgcccagagacaccgaagcaaaaatcggacggccacccggagacccccaaacaaaaaggggacgggcgaccagagacacctaagcagaagggagagtcacggccagagactcctaaacagaaaaatgaggggcggccagagaccccaaagcacagacatgacaataggcgggacagtggaaaaccctctacagaaaaaaagcctgaggtctcaaagcataagcaggatactaaaagtgattccccaaggcttaagagcgaaagggccgaagccctaaaacagagaccagatggaaggtctgtgtcggagagcctgagacgggaccatgataacaaacagaaatcggacgacaggggggaatccgaacgtcacagaggcgatcagagtcgcgtccggcgacccgaaactctgcgaagctctagtcgtaacgaacacggaattaagtcagactcgtcaaagaccgataagctcgagagaaaacaccgccacgaaagcggtgattccagagagcgaccgagcagcggcgagcaaaaatcgcgcccagattccccgagagtaaagcaaggggactcaaacaaatccagatccgacaagctgggatttaagagtcccacttccaaggatgacaagagaaccgaggggaataaatccaaagtcgacaccaacaaggcgcatcccgataataaagcggaattcccttcctatctcctggggggaaggagtggcgctcttaagaattttgtgatacctaagatcaagagagacaaggatggcaatgtgactcaggagacaaaaaaaatggaaatgaaaggcgagcctaaagataaagtggagaagatcggcctggttgaagatctgaacaagggcgccaagcccgttgtggtcctgcagaagctgtctctggacgatgtccaaaaactgataaaggacagagaggacaaatctcggtccagtttgaaacctataaagaataagccaagcaaatctaataagggctctattgatcagtctgtattgaaagaattacctcccgaactactggccgagattgaatcaaccatgccactttgtgaacgcgtgaaaatgaataagcggaagcgatctacggtcaacgagaagccgaagtacgcagagatttcgtccgatgaagacaatgacagcgacgaggcctttgaaagctccagaaaacgccacaaaaaagatgatgataaggcatgggagtatgaagagagggatcggcgtagctcaggggaccatagaaggtccgggcactctcatgaaggtcggcggtctagcgggggtggccggtataggaataggagtccatcagactccgatatggaggactattcccctccgccatccttgagcgaagtggcccgcaaaatgaagaaaaaagagaaacagaagaagaggaaagcttatgagcccaagctaaccccggaggaaatgatggactccagcactttcaagcgatttaccgcgtctatcgagaacattctggacaacctggaagacatggactttaccgcattcggcgacgacgatgaaattcctcaggaactgctgctgggcaagcatcagttgaacgagcttggttccgagtctgctaagatcaaggcgatgggtatcatggacaagttgagcacagacaagaccgtgaaagtcctgaacatcttggaaaaaaacatccaggacgggagcaagctttccactcttctgaatcataacaatgataccgaggaggaggagcgcctctggagagatctgatcatggagcgagttacaaagtctgcggacgcttgtctgaccaccataaatatcatgacctctcccaatatgcccaaggccgtgtacattgaggatgtgattgaacgggtgatccagtataccaaattccatctccagaataccctgtacccccagtacgacccggtgtaccgcctcgacccacacggcggtggtttactgagttccaaggcgaagagggctaagtgttcaactcataagcagcgggtgattgtgatgctgtataacaaggtttgtgatatcgtttcctctctatctgagcttctcgagatacaactactcactgatacaacaatcctgcaagtgagctcaatggggatcactcctttctttgtggaaaacgtctctgaactgcaactctgcgcaatcaaactcgttaccgctgtttttagccgctacgaaaaacatcgacagctcatcctggaagaaattttcacctccctggctcggctccccacaagtaagcggtctttgcgcaattttcggctgaacagctccgacatggacggcgagcccatgtacatccaaatggtcaccgctctggtgctccagttgatacagtgtgtggtgcatcttccatcatccgagaaggattcaaatgccgaggaagattccaataagaaaattgaccaggacgtcgtcataaccaactcctatgaaactgcaatgaggaccgctcagaattttctgtctattttcctaaagaagtgtggatctaagcagggagaagaggattaccgtccacttttcgagaactttgttcaggatctgctgtcgaccgtcaataaaccagagtggcccgccgccgagttactgctgagtctactcggaaggcttctggttcaccagttcagtaacaagtccactgagatggcactgcgggtcgccagcctggattatttggggacagtcgccgcccgcttgcgtaaggatgccgttacctccaagatggaccaaggttcaattgagcgcattttgaagcaggtctcaggcggtgaggacgaaatccaacagttgcaaaaggccctcctggattacctggatgagaacaccgaaacggatccatcactcgtcttttccaggaagttctacatagctcaatggttccgtgacactaccctggaaaccgagaaagccatgaagtcacaaaaagacgaggagtcttctgagggaactcaccatgcaaaggagattgagaccacaggccagattatgcaccgggctgagaatcgtaaaaagttcctccgaagtattattaaaactacgccgtctcagttttcaactctcaagatgaactccgacaccgtcgattacgatgatgcatgtctcatagtccgatatttggcaagcatgcgcccctttgcccagagttttgacatatatctaacccaaatcttgcgggtgctgggcgaaaacgcaatagccgtccgcaccaaggccatgaaatgcctgtctgaggtcgtggcagttgacccctcaatactggcccggctcgacatgcagaggggagtccatgggaggctgatggataatagcacctcagtgcgcgaggctgccgtcgagttgttgggtcgattcgtgctctgccgtcctcagctcgccgagcagtactacgacatgctgatcgaacgaatactggatacaggaatcagcgtgaggaagcgagtcatcaagatactccgcgacatctgtatagaacagcctaccttccccaagattactgaaatgtgtgtgaagatgatacgcagagttaatgatgaggagggcattaagaaacttgtaaatgagacctttcaaaagctgtggtttaccccgaccccgcacaatgacaaagaggccatgaccagaaagatattgaatattaccgacgttgtcgcggcatgccgggacacgggttatgattggttcgagcagctactgcaaaatcttcttaagtccgaggaggactcctcgtataaaccagtgaagaaagcatgcacacagctggttgataatttggtggaacatatcttaaagtacgaggagtccctggccgattctgacaacaagggcgtcaatagcggccgcctggtggcctgtatcactacattgtttctcttttcaaagatcaggccccaactcatggttaaacatgccatgacaatgcagccctacctaacaaccaaatgttccactcagaacgacttcatggtgatctgtaatgtggcgaagatcctagagctagtcgtgccacttatggaacacccatccgagaccttcttggctaccatcgaagaggatctgatgaagctcatcattaagtatgggatgactgtcgttcagcattgtgtgtcctgtcttggagcggtggtaaacaaagtgactcagaatttcaagttcgtatgggcctgcttcaataggtactacggtgccatatcgaaacttaaaagccagcaccaagaagaccctaacaatacgtcactgctgacgaataaacctgccctgctgagaagcctgtttaccgtcggagctctttgcaggcacttcgacttcgatcttgaagatttcaaggggaacagcaaggtgaatatcaaggacaaggtgttagaactccttatgtacttcaccaaacactccgacgaggaagtccaaactaaagccattatcgggcttgggttcgctttcattcaacacccttccctgatgttcgaacaagaagttaagaacttatataacaacattctctccgacaagaactctagcgtgaacctaaaaatccaagtattgaaaaatttgcagacataccttcaggaagaagatacgcggatgcagcaagcagaccgcgactggaagaaagtggccaaacaggaggatctcaaagagatgggcgacgtctcctcaggaatgagtagctcaatcatgcagttgtacctcaaacaagtgcttgaggctttctttcacacccaatcaagcgttcgtcacttcgccctgaatgtcattgcactgacactcaatcaaggtctcattcacccggtgcagtgtgtcccatatctgatcgcgatgggaactgacccggagccggcaatgcgaaacaaagctgatcagcagctcgtggaaattgataaaaagtatgccggttttatccatatgaaagctgtggccggcatgaaaatgtcgtatcaggtacagcaagccatcaacacatgtctgaaggacccggtccgaggctttcgtcaggacgagagctcaagtgcactgtgctcacacctgtactctatgatacgcggcaaccgtcagcatagacgagctttcctgatttctctgctgaatctttttgatgatacagccaagaccgatgtgacaatgctgctgtatattgctgataatttagcctgctttccgtatcagactcaagaagagcctttatttatcatgcatcatatcgacatcactctgtccgtgtccggaagtaaccttctgcagtcctttaaggaaagcatggtcaaggacaagagaaaggagcggaagtcaagtcctagcaaggagaacgaatcatcagactccgaggaggaggtatctcggccccgcaagtccagaaagagggtggacagcgattccgattcagattctgaggatgacatcaatagcgttatgaagtgcctgcctgaaaatagcgcccctcttatcgagtttgccaacgtctctcagggtattctgttgttattgatgcttaagcagcaccttaagaacctgtgtggattttcagactcaaaaatccaaaagtatagcccaagtgaatccgcaaaagtttatgataaggccattaaccgtaagaccggtgtgcacttccaccccaaacagacactcgatttcctgaggagcgatatggccaatagtaaaatcaccgaagaggtcaagcgaagtatcgtcaaacagtatctagacttcaagctgcttatggaacatttggacccagacgaagaggaggaagaaggggaggtgtccgcgagcactaatgccagaaacaaggccattacctctctcttaggcgggggctcccccaaaaataacacagccgctgagacagaagatgacgagagcgatggggaggaccgtgggggcggcacatccggggtgcggcgacgccgtagtcagcgaatttctcagcggattacctag

SEQ ID NO: 197375 - DNA, 867 bp, Artificial Sequence
  Description of Artificial Sequence: Synthetic coding sequence
atggagcggccccagcccgacagcatgccccaggacctgagcgaggcactgaaagaagctacaaaggaggtccacacccaggccgagaatgccgagtttatgcggaattttcagaagggtcaggtcacccgggacgggttcaagctagtcatggcttcgctgtatcatatttacgtggccctggaggaagagatcgagcggaacaaggagagcccagtcttcgcccctgtttactttccagaagagttacatcggaaggccgccctggagcaggatttggctttctggtacgggcccaggtggcaagaggtgataccctatacacccgccatgcagcggtacgttaaacggctccacgaggtggggaggactgaaccggaacttctcgttgctcacgcctataccaggtacttaggagacctcagcggagggcaggtgctgaagaagatcgcccagaaagcattggacttgcccagctcgggcgaggggctcgccttttttaccttccccaatattgcgagcgccaccaaattcaagcagctttatagaagcaggatgaactcgctggagatgacacctgcggtacggcagcgggtgattgaagaggccaaaaccgccttcctcctcaatatccagctttttgaggagctgcaagagcttctgactcatgacaccaaggatcagtcaccatccagggctccagggctcagacagagggcctctaataaagtgcaggacagcgccccagtagagacacctagaggcaaacctccactgaataccaggagtcaggcccctctcctgcggtgggttctgacactgtccttcttagttgcaaccgtcgcagtggggctctacgccatgtag

SEQ ID NO: 197376 - DNA, 4305 bp, Artificial Sequence
  Description of Artificial Sequence: Synthetic coding sequence
atggaggaccacatgttcggcgtgcagcagatccagcccaacgtgatatcagtcaggctgttcaaaagaaaagtcggggggctgggcttcctggtgaaggagcgagtgtctaagcctcctgtcattataagcgacttaatcagaggcggcgccgcagaacagtcaggccttatccaggccggggatatcattctggccgtaaacgggcggcccctcgtagatctttcttacgacagtgccctggaagtcctaaggggaatcgcttctgaaactcacgtggtgctaattctgcgagggccagaaggctttaccacccacctggaaacaacgtttacgggagatggcacgcccaagaccatccgagtgacacagcctcttggtcctcccactaaggctgtggacttgtctcaccaaccacccgctggaaaggagcagcctctcgcagttgatggagcctcgggaccagggaacggtcctcagcatgcctacgacgacggacaagaagctgggtcattaccacacgctaatggcttagctccacgtccacctggtcaggaccctgcaaaaaaggcaaccagagtcagcctccagggaaggggggaaaacaacgaactgcttaaggagatcgaacctgttctgtcattgctaacgtccggaagcagaggtgtcaaaggtggggctcctgccaaggctgaaatgaaggatatgggcatccaagttgatcgggatctggacggcaaaagtcacaaaccattgcccctcggtgtggagaacgatcgtgtctttaacgatctctgggggaagggaaacgtacccgtggtcttgaacaacccatactctgaaaaggagcagccacccacttcaggtaagcagtcgcctacaaaaaatgggtctccatccaagtgccctaggttcctaaaagtcaaaaattgggaaactgaggttgtgcttacagacacgctccatctcaagagcacactggaaacgggctgtaccgagtacatttgtatgggttcgatcatgcatccatctcaacatgcacgcagacccgaagatgtccgaactaaaggccagttgtttccactcgccaaagagtttatcgaccagtattacagttccataaagcgattcggcagcaaggcccacatggagaggttagaggaggtgaacaaggagatcgataccacatccacataccaacttaaggataccgaactcatctacggggccaaacatgcctggcgcaatgcatcacgatgcgttggacggattcagtggagcaaactgcaggtgttcgatgcccgtgattgtacaaccgcacacggaatgttcaactacatctgcaaccacgtgaaatacgccactaataaggggaacctccgaagtgctatcacaatttttccacaacggaccgacggaaaacatgatttcagagtgtggaactctcagctgattcgctacgctggatataagcagcctgatggaagcaccctgggtgatcctgccaacgttcagttcacagaaatctgcattcagcagggctggaaaccccctcgcggcaggttcgacgtgttacccctgctgctgcaggctaatggcaacgacccggaactcttccaaattccaccagaactggtcctcgaggttccaatcaggcaccccaagtttgaatggtttaaagacttgggcctcaagtggtatggcttgccagccgtcagcaacatgctcctcgagatcgggggactggagttcagcgcctgtccgttttcaggatggtatatgggtacggaaatcggggtgagggactattgtgataatagccgttacaatatcctggaggaggtagccaaaaagatgaacttggacatgaggaaaacctcttcactgtggaaggatcaggccctggtggaaattaatattgcagtgctgtactcttttcagagcgacaaggtgactatagtcgaccaccattccgctacagaatccttcataaaacatatggagaatgagtataggtgtcgcggaggttgccctgcagactgggtgtggatcgtacccccaatgtccggttccattacgcccgtctttcatcaggaaatgctgaattaccgactgacgccatcattcgagtaccagcccgatccctggaatactcatgtctggaaggggaccaacggcacccctactaaaaggcgcgctatcggattcaagaagctggccgaggccgtcaaattttccgcaaaactcatgggacaggcaatggccaagagggtgaaagcgacaatcctttatgcaaccgagactggaaagtctcaagcctatgctaagacactatgtgagattttcaagcacgccttcgacgccaaagtgatgtctatggaagagtacgacatcgtccacctggaacatgagacgttggttctcgttgtaacctcaacttttggaaatggtgacccacctgaaaacggcgagaagttcggctgcgccttgatggaaatgcggcacccaaactctgtgcaagaggagcgaaaatcctataaagttagattcaacagtgtctctagctacagcgattctcaaaaaagttcaggggacggccctgacctgcgtgataacttcgaatccgccggcccattagccaacgtcaggttttcagtgttcggcctaggctcccgcgcgtacccacatttttgtgcgtttggtcatgccgtcgataccctgctcgaagagcttggaggagagcggatcctaaagatgcgcgagggcgacgagctttgtgggcaggaggaggccttcagaacttgggccaaaaaggtatttaaggcagcatgtgatgtgttctgcgtcggtgatgacgtaaatatagagaaagcaaacaatagcttgatatccaacgatcgaagctggaaacgcaataaattcaggctgacattcgttgccgaagccccagagctgactcaagggctgtcgaacgttcacaaaaagagagtgagcgccgcgaggctccttagcagacagaacttgcagtcccccaagagcagccgatcaaccatcttcgtgaggctacacaccaacggatcacaagagctgcaataccagccgggagatcatttaggagtttttccagggaaccacgaggatttggtcaatgctctgatagagcggcttgaggacgctcctccagtgaatcagatggttaaggtggagcttctggaagagcgaaatacagcactcggcgtgatctccaactggaccgacgaactccgactccctccttgcaccatctttcaggcctttaagtattatctagatatcacaacgccaccgacccctctgcagttacagcagttcgcctctctggccactagcgaaaaagagaaacagcgccttttagtcctgagtaaggggttacaggagtatgaggaatggaaatgggggaaaaatccaaccatcgtcgaggtcctggaggagttcccttccattcagatgcctgcgacgctcctgcttacccagttgtccctgctacagccacgctattatagtatctctagctctcccgacatgtacccagatgaagtgcatctgacagtggccattgtttcctaccgcactcgagacggtgaggggcctatccaccacggggtttgctcctcgtggctaaatcgaatccaggccgacgagctggtgccatgcttcgtgcgcggtgcaccatcatttcatctaccgaggaacccgcaggtcccttgtatcctagtcggcccaggtaccggcatcgccccgttccggtcattttggcagcagcggcagtttgacatccagcataaagggatgaacccatgcccaatggttctcgtgttcggctgccgccagagtaaaattgatcacatctacagagaggaaaccttgcaggcaaaaaacaagggtgtatttagggaattgtacaccgcatacagtcgtgagccagacaaacccaaaaagtatgtgcaggacattttgcaggagcagcttgctgaatccgtgtatagagccctcaaggaacagggcggtcacatttatgtgtgcggcgatgtcaccatggcagccgacgtactgaaagcaatccagagaatcatgacgcaacagggcaagctgtctgcagaggatgcaggagtatttatctctaggatgagagacgataaccgctaccacgaagatatcttcggcgtaactttgaggacctatgaagtgaccaaccgcctgagaagcgagtcaattgccttcattgaagaatctaagaaggacactgacgaggtgttttcctcgtag

SEQ ID NO: 197377 - DNA, 4407 bp, Artificial Sequence
  Description of Artificial Sequence: Synthetic coding sequence
atggaggaccacatgttcggcgtgcagcagatccagcccaacgtgatctctgtcagattatttaagagaaaggtagggggactgggtttcttggtgaaggaacgggtaagcaagccacccgtgatcatcagcgacctgatccgcggaggagccgccgaacagagcggtctgatccaggcaggcgatattattctggccgtgaacgggaggcctctggtggatttgagctacgacagtgcactcgaggttttgaggggaatcgcaagcgagacacatgttgtcttgattctcaggggccccgagggatttaccactcacctggagacgacatttacaggtgatggcacacctaagactataagagtgacgcagccacttggcccaccaaccaaggcagttgatcttagccatcagcctccagccggaaaagagcaaccgctcgctgttgacggtgctagcgggccaggcaacggaccacagcacgcatacgatgatgggcaggaggcaggctcgcttccccacgctaacggactagcacctcgaccgccaggtcaggaccccgccaagaaagcaacccgtgtgagtctccagggtcgaggagagaataatgaacttctgaaggaaattgagcctgtgctgagcctcctcacctctggttcccgtggggtcaaaggaggtgcccctgccaaagctgagatgaaggacatgggaatccaggtcgaccgcgacctggacggtaaaagtcataaacctttaccactgggcgtggagaatgaccgcgtgttcaatgatctctggggaaaaggcaatgtgccagttgtgctaaataatccgtacagtgagaaagaacaaccaccgacctcgggaaagcagtccccaacgaagaatggcagccctagtaaatgtcctagatttctcaaagtaaaaaactgggaaacggaggtggttcttacagacactttacatcttaaatctaccctggagaccggttgtacagagtacatctgtatggggtccattatgcacccttcccaacacgcacggagacctgaggatgtgcgaacaaaagggcagctgttccccctagctaaggagttcatcgatcagtactattcatcaatcaaacggttcgggtcgaaagcgcacatggagcgtttagaagaagtcaacaaagaaattgacaccacctccacataccagctgaaagatactgagctgatctacggagccaaacatgcatggaggaatgcttccaggtgcgtcggacggattcagtggagcaagctgcaggtatttgatgctagggactgtacgactgcccacgggatgttcaactatatctgcaaccatgttaaatatgccacgaataaggggaatttgcggagtgccattacaattttccctcagcgcacggatggaaagcacgacttcagagtgtggaactctcaacttatccgctacgccgggtacaagcaacccgacggaagcaccctaggggacccagcaaacgtgcagtttacagaaatctgcattcagcaaggatggaagccccccagggggcggtttgatgttttgcccctgctcctccaggctaacgggaatgaccctgaactcttccaaatcccaccagagctggtactggaggtgcccattcgccacccgaaattcgagtggttcaaggacttgggactgaagtggtacggattgcctgccgtgagcaatatgctattggagataggcggcctcgaattttccgcatgcccgttctccgggtggtacatggggacggagattggcgtaagagattattgcgataactcccgctataatattttagaagaggtcgcaaagaagatgaacctggacatgcgtaagacctcctccctgtggaaggatcaggccttggtggagattaatatcgccgtgctgtactcgttccagtcagataaggtgacgattgttgatcaccactccgcgactgagtcttttatcaagcatatggagaacgagtatagatgccgcggtggctgccccgccgactgggtttggatcgtgcctcctatgtcaggctccatcactcctgtgtttcaccaggaaatgcttaactaccggctaactccatcttttgagtatcagcccgacccttggaatacacatgtttggaaaggcaccaatggaacaccgacaaaaaggagagccatcggcttcaaaaaactggccgaggctgtgaagttctccgcaaaacttatgggacaggccatggcaaaaagagtgaaagccactatcctatacgctaccgagaccgggaagtctcaggcatatgcaaaaactctttgtgaaatctttaaacacgcattcgacgccaaggtgatgtcaatggaggaatacgacatcgtgcatctggagcacgagactctcgtactggtggtgacctctacattcgggaacggggatccacctgaaaacggagagaaattcggatgtgctctcatggagatgagacaccccaactccgtgcaggaggagaggaaatatcccgagccattaaggtttttcccaagaaaaggtccccccctgcccaacggtgacactgaagtccacggtttggccgcagccagagattctcagcaccggtcttacaaagtccgttttaatagtgtgtccagttacagtgattcacagaagtcaagcggagatgggccggacctgcgggataacttcgagagcgccgggcccctcgctaacgtgcgtttttctgtatttgggctgggaagccgggcataccctcacttctgtgcatttggccacgctgtggacactctgttggaggagctgggcggtgagcgcatcctgaaaatgcgtgaaggagacgaactctgtgggcaagaggaggcgtttcggacctgggccaaaaaagtgtttaaggcagcctgcgacgtcttttgtgtgggcgacgacgttaacattgaaaaggctaataatagcctaatcagtaacgaccgctcttggaaaagaaataagtttcggttaacattcgttgctgaagccccagagctgacacaggggctgtctaacgttcacaagaagagagtgagcgcggcgcgcctcctttcaagacagaatctccaatcccccaagtcaagcagatctacaatcttcgtacggctccacacaaatggcagtcaggagctgcagtatcaacctggagaccacctgggggtgttccctgggaatcatgaggacttggtgaatgccctaatcgagcgtctcgaggacgcaccccccgttaatcagatggtcaaagtggagctcctcgaggagcgcaacaccgcccttggtgtgatatccaattggactgacgagctgagattgcccccatgtaccattttccaggcctttaagtattacctagatataacaacaccacctacccccctacagcttcagcaattcgcaagccttgctacaagcgagaaagagaagcaacggctgctagttttgtctaaagggcttcaggagtatgaagaatggaaatggggcaagaatcccacaatcgtggaagtgctggaagagtttccttccatacagatgcccgccacattgctcctgacacaactaagcctgctgcagcccagatattatagcatatcttcttctcctgacatgtaccccgatgaggtccacctgaccgttgccatcgtgtcataccgaactagagacggtgagggccccattcatcatggtgtctgctccagctggctcaatagaattcaggccgatgagcttgttccctgtttcgtgcggggtgccccttcgttccacttgccacgcaaccctcaggtaccctgtatcctggttggacctggtaccggaattgcacccttcaggagtttttggcagcagcgccagtttgatatccaacataagggcatgaatccttgtccaatggttctggtttttgggtgccgccagagtaagatagaccatatctatagggaggaaacactgcaggcaaaaaataagggggtgttccgcgagctgtataccgcctattccagggagccagataaaccgaagaagtatgtgcaggatatcttgcaggaacagctggccgagtctgtctacagggccttaaaggaacagggcggacatatttacgtgtgcggcgatgtgacgatggccgcagatgtgctgaaggccatccagagaatcatgacccagcaaggcaaactttctgccgaggatgctggcgttttcatctctcggatgcgtgatgataatagataccatgaggacatattcggagtgactctccggacttacgaggtcaccaatcgactgcgatccgaaagcattgcgttcatagaagagagcaaaaaggataccgacgaagtattctcttcttag

SEQ ID NO: 197378 - DNA, 1224 bp, Artificial Sequence
  Description of Artificial Sequence: Synthetic coding sequence
atggaggaccacatgttcggcgtgcagcagatccagcccaacgtgatttctgtcaggctgttcaagaggaaggttggtggcctgggattcctggtaaaggagcgagtgtccaagcctccagtgatcatttctgacctcatcaggggcggagcagccgagcagagcggcctcatccaggccggagatataatcctcgcggtgaatggcaggccattggtcgacctgtcctacgactctgctcttgaggtactccgagggatcgcgtcagagacccatgtggttctgatcttgcggggccccgaaggctttactacacacctggaaaccacgtttactggggacggaactccaaaaacaattagggtcacccagcctctgggccctcctactaaagcagtcgacctttctcatcagccacccgctggtaaggaacagcctctggctgtcgacggcgcctcaggacccggcaacggtcctcaacatgcatacgatgatgggcaggaggccggatctttgcctcatgccaatggcctcgccccacgcccacctggacaggaccctgccaagaaagctactcgggtgtccttgcaggggcgcggagagaataacgaattactcaaggagatagagccagtgctcagtctactgacctccggcagcagaggcgtaaaaggtggagctccagcaaaagctgagatgaaggatatgggaatccaggttgacagggatcttgacggcaaatcgcacaagcctttgccgctgggtgtcgagaatgatagagtctttaacgatttatggggaaaaggcaacgtgccagtcgttctaaataatccctattctgagaaggagcagatgaggaaattgaggattaccgagggcttcggggcgcagcgcggctcacacaaccacccaccgccccaggagaactctccccctcagaggatggcggcgccaccatctgtccacgcctcatccaggtcacgcaccggacggctcagatggtttagtctgaccccctccactctacgggctcactggaagcgcgacgccctttccacatctgcctgggccccctcttgcattttgttgtcaatgcaggggggtctcaagacttctgcccagaaagatagttccagtctctctcccaagagccttttgatcaatactatccatcagttgaaggacctcgccccaaagccgacatggaaagggtggaaacgatag

SEQ ID NO: 197379 - DNA, 3993 bp, Artificial Sequence
  Description of Artificial Sequence: Synthetic coding sequence
atggaggaccacatgttcggcgtgcagcagatccagcccaacgtgatctccgtgcgcctgttcaagcgaaaggtcgggggcctgggattcctcgtgaaagagcgcgtttcgaagcccccggtgattatctccgatttaattcgggggggcgcagcggagcagtcaggcctgattcaggcaggagatattattctggctgttaatggcagacctctagtggatctctcttacgactctgctctagaagtcctgagggggattgccagcgagacccacgtcgtattgatcctaaggggccctgaaggtttcaccacacacttggagaccacttttaccggcgacggcaccccaaaaacaatccgggtgactcagcctcttggccctcccactaaggccgtcgacctgagtcaccagccaccagcgggtaaagagcaaccactcgcagtagatggggcatctgggccaggcaacggccctcaacacgcgtacgatgatggccaggaagccggcagtctgcctcatgcaaatggtctggccccccgtcctccaggacaagacccagctaaaaaagctaccagagtcagcctccaagggagaggcgagaacaacgaactgctgaaagagattgaaccggtcctaagcctgctgacctccggatctagaggtgttaaaggcggtgcacccgccaaggcggagatgaaggacatggggatccaggtagaccgggatctggacggtaaaagccataagccactcccacttggcgtcgaaaatgaccgcgtctttaatgacttatggggcaaagggaatgttcctgtcgtgctcaacaacccgtattctgagaaggagcagccgcccactagtgggaaacagagtccaaccaagaacggatccccttccaagtgccctagatttcttaaggtgaagaactgggaaaccgaggtagttcttaccgacactctccatctgaagtcaacactggaaacaggctgtacagagtacatctgtatgggatccatcatgcatccttcacagcacgcaagacgtccagaagacgtgcgtactaaagggcagctgttcccactggccaaggagtttattgatcagtactatagctcaattaagcgatttgggtcgaaagcacatatggagcgcctggaggaggtgaataaggagattgataccacctctacttatcagctgaaggataccgaactgatatacggggccaaacacgcatggaggaacgcgtctaggtgcgtcggtcgtattcagtggagcaagctgcaggttttcgacgcccgggactgcactaccgcccacggaatgttcaattacatttgcaatcatgtgaaatatgctaccaacaaagggaatctccgctccgctatcacaatcttccctcagcgtactgatggcaagcatgatttcagagtctggaattcacagttgatcagatacgccggctataagcaaccagatggttctacactcggggatccagctaacgtgcagtttaccgaggaggtggccaagaaaatgaacctggacatgaggaaaacctccagtctctggaaggaccaggctcttgtcgaaatcaatatcgccgtgctgtatagcttccagtccgacaaggtgactattgtggaccaccatagcgcgacagagtcttttatcaagcacatggagaacgagtacaggtgtcggggcgggtgccctgccgactgggtgtggatcgtccccccaatgtccggaagcatcacacctgtgttccaccaggaaatgcttaactaccgcctgaccccgagcttcgagtatcagccagacccctggaatactcacgtgtggaagggcactaacggaacacctaccaagaggcgggcaataggctttaagaaactggccgaagcggttaagtttagtgcaaagcttatgggtcaagctatggctaagcgggtcaaagccaccatcttatacgcaacagagactggtaagagtcaggcgtacgcaaaaacactgtgtgagatttttaagcacgcgtttgatgccaaggtgatgtctatggaggagtacgatatagttcacctggaacacgagaccctggtgctcgtggtgacctcaacatttggcaatggagacccacccgaaaatggagaaaaattcggttgtgcgttgatggagatgcgtcatcccaatagtgtccaggaggagcgtaagtcgtacaaagttcgttttaattcagtgtctagctactccgattctcagaagtcctctggagacggtcccgatttgcgtgataacttcgaatcagcagggccactagcaaatgtcaggttttctgtcttcgggttggggtctcgagcctacccacacttttgcgcttttggacacgcggtggacactctactagaagagctgggaggagaacgaatcctgaagatgagggaaggagacgaactctgtggccaggaagaggcatttcgcacgtgggctaaaaaggtgttcaaagcagcctgtgacgtgttctgcgtgggtgacgacgtcaatattgagaaagcaaacaactcacttattagcaatgacaggtcatggaaacgaaacaaattccgcttaacatttgtggcagaggctccagagctaactcaaggactgagtaatgtgcacaagaagagagtctctgcggcacggctgctgagccgccagaacttgcagtccccaaagtcctcccgtagcacaatttttgttagactgcataccaatggatcacaggaactgcagtatcagcctggggaccatttgggtgtgttccctggtaatcatgaagacctggtgaatgcactcatcgaacgactggaggacgccccccccgtgaatcagatggttaaagttgaattgctggaggagcgtaacaccgccctcggcgtgatttccaactggaccgatgaactccgcctgcctccctgcacaatcttccaggcttttaagtactacctggacatcaccaccccccccacacctctgcaactccagcaattcgcgagtctggcgacatcagaaaaagagaagcaaaggctgttggtgctatctaaagggctgcaggagtatgaagagtggaaatgggggaaaaatcctaccattgtcgaggttctcgaagaattccccagcattcaaatgcccgcgacactccttctaacacagctctctcttttgcagcctaggtactacagcattagttcgtcccccgacatgtacccagatgaggtgcatctcacagtggcgatcgtgtcttacaggaccagagacggcgagggacccatccaccacggcgtgtgctcttcatggttgaatcgaattcaagccgatgagctggtaccatgtttcgtcagaggggcccctagctttcacctccccaggaatccacaggtgccctgcatcctcgtgggtcccggaactggaatcgcccccttcagaagcttctggcagcaacgtcagttcgatattcagcataagggcatgaatccttgtcctatggtactcgtgttcggctgcaggcagagtaagatcgatcatatctatcgggaggaaaccctccaagccaagaacaagggtgtgttcagggaattgtatacagcctatagcagagaacctgataaacctaagaaatatgtccaggacatcctgcaggaacaactggccgaaagcgtatatcgcgccctgaaggagcagggcggacacatatacgtgtgcggtgatgtaacaatggcggcagacgtactcaaagcgattcaaagaatcatgactcagcagggcaaactgagtgcagaggacgctggtgtgtttatctcccggatgagagacgacaaccgatatcatgaggatatcttcggcgtcaccctgcgtacatatgaagtgaccaaccgcctgagatcggaatccattgcgttcatagaagaatcaaaaaaagacacagacgaccaggtgttcaaaacttag

SEQ ID NO: 197380 - DNA, 3621 bp, Artificial Sequence
  Description of Artificial Sequence: Synthetic coding sequence
atggaggaccacatgttcggcgtgcagcagatccagcccaacgtgatcagtgtgcggctatttaagcgtaaagtcggtggtcttggattcctcgtcaaggagcgagtgtctaaaccacctgtgatcatttcggatctcattcggggcggggctgcggagcagagcgggcttatccaggcaggcgacatcatccttgctgttaacgggaggccactcgtagacctgtcctatgacagtgctctcgaggttctgcggggcatcgcctccgagacacacgtggtcctgatcctgcgcggcccagaaggcttcaccacccacctggagaccacctttaccggagatgggaccccaaagaccattcgcgtgactcaacctttgggtcccccgaccaaggctgtggacctcagccaccagcctcctgctggcaaggagcagccgctggccgtggacggagcgagtgggccgggcaacggcccacagcacgcatacgatgatggccaggaagcagggtcactgccacatgcaaacgggttggcccctcgtccacctggccaagatccagctaaaaaagccacgagagtctctctacagggacggggggaaaacaatgagttactcaaggagattgaacccgttctgtccctgctcacctctggatcccgcggcgtgaaaggcggtgcacccgctaaagcagagatgaaagacatgggaattcaggtggatcgggacttagatgggaagagtcacaagccgctcccactgggggttgagaacgatcgtgtattcaacgacttgtggggcaaaggcaacgtccccgtagtcttgaataacccgtattccgagaaggagcagcccccaacctcagggaagcagtcccccactaagaacggttcccctagtaagtgtccccggttcctcaaggttaaaaactgggaaaccgaggtggtactgaccgacacattacacttgaagagcacgctagagacgggctgtaccgagtacatttgcatgggtagtatcatgcacccttcccagcacgctcgacgccccgaagatgtacggacgaaggggcagctgtttccactagccaaggagtttatcgaccaatattacagctcgatcaaacgtttcggtagcaaagcccacatggagcgactggaagaggtgaataaggagattgatactacaagcacctatcagctgaaggatacagagctaatctatggtgctaaacacgcgtggcgcaatgcgtcaagatgcgttggtaggattcagtggagtaaattgcaggtgtttgacgccagagattgtaccacagcacacggaatgttcaactacatctgtaaccacgtgaaatacgctacaaacaagggtaacttacgcagtgctatcaccattttcccccagcggaccgacggcaagcacgacttcagggtgtggaactctcagctgattcgatacgccggttacaaacagccagacgggtcgaccctgggcgatcctgccaatgtacaatttaccgagatatgcattcaacaaggatggaaaccgcctcgcggacgcttcgacgttttgcctctgctactgcaagctaacggcaatgatccagaactgtttcagatacctcccgaactggtcctggaagtacccatccgccatcccaagttcgagtggtttaaagacctcgggctaaaatggtacggccttcccgccgtgtccaacatgttgttggagataggcggactcgagttttccgcatgcccattctcaggctggtacatgggtacagagatcggcgtccgcgattattgtgataatagccggtataatattttggaggaagtcgctaagaaaatgaacctcgacatgcgcaaaacaagtagcttgtggaaggatcaagccttggttgaaataaatattgctgtactgtattcttttcaatccgataaagttactattgtggaccaccacagtgccactgagagcttcattaagcacatggagaacgagtaccgctgtcggggcgggtgcccagcggattgggtctggattgtaccacctatgtctggatccatcacacctgtgttccatcaggagatgctgaattatcgtctgaccccaagctttgagtatcaacctgacccgtggaatactcacgtctggaagggaaccaatggcactcctactaaacgaagggcaattggcttcaaaaaactggcagaagccgtcaaatttagtgcgaaattaatgggccaggccatggccaagagagtgaaagccactatactttacgctaccgaaacaggcaagtcacaggcgtacgctaagaccctgtgtgaaatcttcaaacacgcattcgacgcgaaggtgatgtcgatggaagagtacgatatcgtacaccttgaacatgaaactctggtgttggtggtcacttccacatttggaaacggcgatccaccagaaaacggcgagaagtttggatgcgccttgatggagatgaggcacccaaactccgtgcaagaagaacgcaaatcgtataaggttaggtttaactctgtgtcttcctactcggacagccagaaaagctctggagacgggccagacctgagagacaatttcgagagcgccggcccattagccaatgtacgtttttctgtcttcggcttgggtagccgcgcctatccccatttttgcgcctttgggcatgccgtggacaccctcttggaagagctgggcggggaaagaatcttgaaaatgcgcgaaggcgacgaattgtgcggccaggaggaggctttccggacgtgggcgaagaaagtctttaaagcagcatgcgacgtcttttgcgtgggggacgacgtcaatatcgaaaaggctaataattccttaattagcaacgatcgatcatggaagagaaacaagttccggcttacatttgtggctgaggctcctgaactgactcagggactatccaacgtccataagaaaagggtctcggctgctagactcctatcccgacaaaacctgcaatctccgaagagcagcagaagcaccatatttgtgagactgcacacaaatggatcccaggaattacagtaccaacccggagatcatctgggagtatttccgggcaaccatgaggacctcgttaatgccctcatcgaacgcttagaagacgcacccccagtgaatcagatggtcaaggtcgaactgcttgaggagcggaatactgcactgggtgtgattagcaattggaccgacgagcttcgcttgcctccatgcaccattttccaagcgtttaagtactatctggacattactaccccacccacacctcttcagctgcaacaatttgcttcattggccacgagcgagaaagagaaacagcgcctgctggtgctgtccaagggcctgcaggagtacgaagagtggaagtggggtaaaaacccaaccattgttgaagtcttggaagaattcccatcgatacaaatgcccgcaactttgttgctgacccagttgagccttctgcagcctcgatattattcaatttcctcctctccccacacacacaccttgtcagaaacaagaccaagtcccctacccctttcttcacagtgttgctag

SEQ ID NO: 197381 - DNA, 204 bp, Artificial Sequence
  Description of Artificial Sequence: Synthetic coding sequence
caccccaacagcgtgcaggaggagcggaagtaccccgagcccctgcggttcttcccaagaaagggacccccactgcccaatggggacacagaagtgcacggactggctgcggctcgagactcccagcacagatcctacaaagtgaggtttaattccgtgtcctcatacagtgattcccagaaaagcagtggggacgggccttag

SEQ ID NO: 197382 - DNA, 1521 bp, Artificial Sequence
  Description of Artificial Sequence: Synthetic coding sequence
atgcccagcaagaccaagtacaacctggtggacgacggccacgacttgcggatccccctccataatgaggatgcctttcagcacggaatctgttttgaggcaaaatatgtgggttccctggatgtgcctagacccaattcccgcgtggagatcgtcgctgccatgcggcgaattcgctatgagttcaaagctaagaacattaagaaaaagaaggtgagcatcatggtctccgtggacggcgtcaaggtgatactgaagaagaagaaaaagctcttgcttctgcagaaaaaggagtggacgtgggacgagagcaaaatgcttgtaatgcaagaccccatatatcggatcttttatgtctctcacgatagccaggacctaaagatcttcagctatatcgccagagatggcgcttccaacatttttcggtgtaatgtgtttaagagcaagaagaaatcacaggccatgaggatagttcggactgtcggacaggcatttgaagtatgccacaaattgtccctgcaacacacacaacaaaatgccgacgggcaggaagacggcgaaagcgaaagaaattccaactcttccggagacccaggccggcagctgacaggggccgagagagcaagcactgcaactgccgaggagactgatatagatgcagtcgaagtaccactgcccggcaatgatgtgctggagttttctcgaggggtgaccgatctggacgctgtcggaaaggagggtggatcccacactggaagtaaagtgtcccatcctcaagagcccatgctcaccgcctccccccgcatgttactcccttcatcctcttctaagccacctggacttgggacagagaccccactatccacacatcaccagatgcagctactgcagcagctgctgcagcaacagcagcagcaaacacaagtggccgtggctcaggtacacctgctcaaggatcagctggctgctgaagcagcagctcgactcgaagcccaggcccgagtgcaccaactgctactacaaaataaggacatgttgcagcacatctctctgttggtgaaacaggttcaggagctcgaacttaaattatcagggcagaatgcaatgggctcccaggattcactcctcgaaattaccttccgctccggtgcgctgccagtgttgtgcgatcccacaacacctaaacccgaggacttacactccccacctctgggtgcgggactggccgattttgcccatccagcaggtagcccactgggccggagggattgccttgtcaaactggagtgttttaggtttcttccgcccgaggataccccgccacctgcgcagggggaagctctgctgggcggcctagaactgatcaagtttcgagagtccggcatcgcttcggaatacgaatcaaacaccgacgaaagcgaggagcgcgatagctggtcccaggaagaactccccaggctcctcaatgtgttgcaacgacaggaactgggcgacgggcttgatgatgaaattgcagtgtag

SEQ ID NO: 197383 - DNA, 636 bp, Artificial Sequence
  Description of Artificial Sequence: Synthetic coding sequence
atgagcctgagcagcctgtgccccgtgttcagcgccgccgccagcagcctccaggtccatctgctgaaggatcaacttgctgctgaagcggcagctcggctggaggcccaagcacgagttcaccagctcttgcttcaaaataaggatatgcttcagcatatatccctgctggttaaacaggttcaggagctcgaactaaagttgagcggccagaacgccatgggatcccaagatagcctcctcgaaatcacattccggtcgggggcgttgcccgtgctgtgcgatccaacgaccccgaagcctgaggatctgcattcaccccctctgggtgcaggcctggctgatttcgcacaccctgcagggtctcccctggggcggcgcgattgcttagttaagctggaatgcttcagattcctgcccccagaggacacacctccacctgcccagggagaggcccttctggggggcttggaactgattaagttccgggaatccggtatcgcaagcgaatacgaaagcaacactgacgagtcagaggagcgggactcttggtctcaggaggagcttccgaggcttttgaatgtgcttcagcgccaagaactgggagacgggttggatgatgagatcgccgtctag

SEQ ID NO: 197384 - DNA, 1506 bp, Artificial Sequence
  Description of Artificial Sequence: Synthetic coding sequence
atgcccagcaagaccaagtacaacctggtggacgacggccacgacttgaggatccctctacacaacgaagatgctttccagcacggtatctgctttgaggctaagtatgtgggctctctggatgtccctcgacccaatagccgcgttgagatcgtggctgcaatgcgcagaatccgatacgaatttaaggccaagaacatcaaaaaaaagaaagtatctataatggtgagtgttgacggcgtaaaggtgatattaaaaaaaaagaagaaaaaaaaagagtggacctgggacgagtccaagatgctggtcatgcaagatcctatttaccgtatcttctacgtatctcacgattcccaggacctcaaaattttctcttacatcgcacgcgacggagcttccaatatatttcgctgcaatgtttttaagtccaaaaaaaagtctcaggctatgcgcatcgtacgcacagttggtcaagcttttgaagtctgccacaagctcagtctgcaacatacccagcagaacgccgacggccaggaggatggcgaaagtgaacggaactcaaactcatctggcgatcccgggcggcagctcaccggggccgagcgcgcatcaacagcaacagccgaagaaaccgatattgatgccgtcgaggtcccattgcccgggaatgacgtccttgagttctcacgaggcgtgacagacctagacgcagtggggaaggaaggcggcagccacaccggctccaaggtaagccacccccaggaaccgatgctcaccgcatctcctagaatgctcctgccatcttcatcctcaaagccacctggccttggaactgagactccactgagcactcaccatcagatgcagcttctgcaacagctcttgcagcagcaacagcagcaaacccaagtggcagtggcccaggttcacttactgaaggaccagctcgcagcggaggcggctgcaagactcgaagcacaagctagagtgcatcagcttctgttgcagaataaggatatgctgcaacacatcagcctgctggtgaaacaagttcaggaactggagctaaaactttccggccagaacgcaatgggtagccaggactccctccttgaaataactttccggtccggagccttgccggtactatgcgacccaactaccccaaaacccgaggatcttcattcccctccactgggcgcagggctagcagactttgcccacccggccggctcccccctggggcgtcgcgactgcctcgtgaagttagaatgcttcaggtttcttccgcctgaggacacccccccaccagcccagggtgaggccttgctgggtggacttgagctcatcaaattcagggagtcgggcattgccagcgaatacgagtctaacactgatgagagcgaagagagagacagttggtcccaggaagagctgccgcggctcttaaatgtactgcagcgtcaagaactgggcgacggcctcgatgatgaaatagcggtttag

SEQ ID NO: 197385 - DNA, 2190 bp, Artificial Sequence
  Description of Artificial Sequence: Synthetic coding sequence
atggcctgcccctggaagttcctgttcaagaccaagttccaccagtacgccatgaacggcgagaaagatatcaacaacaacgtggaaaaggccccatgcgccaccagcagccccgtgacccaggatgacttacagtatcataacctcagcaagcaacagaatgaatccccccaacccctcgtggagacaggaaagaaatctcctgaaagtctcgtgaagttagacgcgaccccactatccagtcctcgccatgtgagaattaaaaactggggctccgggatgacatttcaagatacccttcaccataaggccaaaggcatcttgacgtgtagatccaagtcatgcctgggcagtataatgacgccaaagagcttaacccgcgggcccagggataaacctactcctcctgacgagttgctcccccaagctatagagtttgtcaatcagtactatggatcttttaaggaggctaagatcgaggagcatctggccagggtcgaagccgttacgaaggagatcgaaaccacaggtacctatcagctgacgggcgatgagctgatatttgccaccaagcaagcctggcggaacgcccctcgatgtattggacgaatccagtggagtaacctgcaggtatttgatgcccgcagctgttctacagccagagaaatgttcgagcatatctgtcgccacgtccggtactccaccaataacggcaatattcgcagtgctataactgtgttcccccaaagaagtgacggtaagcatgacttccgcgtgtggaatgcccagctgatccggtacgctggctaccagatgcccgatggcagtatacggggtgaccctgctaatgtagagtttacacagttatgtattgatctcgggtggaaacccaagtatggaaggttcgatgttgtgccccttgttctgcaggccaatggcagagaccccgagctgttcgagatcccaccagatttagtcctggaggttgcgatggagcaccctaagtatgagtggtttagggagcttgagctcaagtggtacgccctgcctgcggtagcaaatatgctgctcgaagtgggcggtttggaattccccggatgcccatttaatggctggtatatgggaaccgagataggtgtaagagatttctgcgacgtgcagcgctacaacattctcgaagaggtcggacgacggatgggcctggagactcataagctagccagtttgtggaaggaccaagccgtggtcgaaattaatatcgccgtgctgcattccttccagaagcagaatgtaaccatcatggaccaccatagtgcagcggagtccttcatgaagtatatgcaaaatgagtatcggagcagaggagggtgtccggctgactggatctggctggtccctcccatgtcggggagcatcacacctgtcttccaccaggagatgctgaactatgtgctgagcccattctactactaccaggtcgaggcctggaaaactcacgtgtggcaggatgaaaaaagacggccaaaacggcgggagatccccttgaaagtgctggtgaaagccgtactgttcgcatgtatgcttatgaggaagacaatggcatctagggttcgcgtcaccatactgttcgccaccgagacgggtaagtctgaagcgcttgcgtgggatctaggcgcacttttctcctgtgccttcaaccccaagaaacttaagaaaagcctgtttatgctgaaagaactgaacaataagttccggtacgccgtgtttggtcttggttctagtatgtatcctcgattctgtgcgtttgctcacgatattgaccaaaaactgtcccacctcggagcttcccagcttactcccatgggtgaaggcgatgaactgtcaggccaggaggacgccttcaggagctgggccgtccagaccttcaaggccgcctgcgagacctttgacgtgagaggcaaacagcacatccaaattcctaagctttacacgagcaacgtcacatgggaccctcatcattataggctagtacaggatagtcaaccactgcccgcggcatcgacttccccaaggattccccctatcctggcttcgtcttctggcctggcccaagcttccaggccctcagccgttagtggctctaatggctctatgactccatccacgagggagtgtggcgaggccgcctag

SEQ ID NO: 197386 - DNA, 3462 bp, Artificial Sequence
  Description of Artificial Sequence: Synthetic coding sequence
atggcctgcccctggaagttcctgttcaagaccaagttccaccagtatgcaatgaacggggaaaaggacattaataacaacgttgaaaaggccccatgtgccacatcttcccctgtaacacaggacgacttgcagtaccataacctgagcaaacagcagaatgagtccccacaacccttagtcgaaacaggtaagaagtcacctgagtcacttgttaaactggatgccactccactcagttccccaaggcacgtcaggatcaaaaactggggctctggcatgacttttcaagacacactccaccacaaagcgaagggaatcctcacctgccgctcaaagagctgtctcggctcaatcatgactcctaaaagcctcactagaggtcccagagacaagccaaccccaccagatgaactgctgccccaagcgatcgagtttgtgaatcaatattacgggtctttcaaagaagcgaaaattgaagagcacctggcacgtgtggaggctgtgaccaaagagatcgagaccacagggacctatcagctgacaggtgacgaattgattttcgccaccaaacaagcttggcgcaatgccccccgctgcatcgggcgaatccaatggagcaatctacaagtctttgatgccagatcttgcagcacagcccgggaaatgttcgaacacatttgcagacacgtgcgctacagcaccaataacggaaacatccggagcgccattaccgtgttcccgcagcgcagcgacggaaagcacgattttagggtttggaatgcccagttgattagatatgcaggttaccagatgcctgatggcagcatccgaggcgaccccgccaacgttgaattcacgcagctttgcatcgatctgggctggaagcctaagtacggcaggtttgacgtcgtgcccctagtgctccaggcaaatggtcgagatcctgaactgttcgaaatcccccccgaccttgttctcgaggtggccatggagcatcccaagtatgagtggtttcgagagctggagttaaaatggtacgcactgcctgcagttgccaacatgctgttagaggtggggggcctcgagttccccgggtgtccctttaacggctggtatatgggcacggagataggcgtgagagatttttgtgatgtccagcgctataatatcctggaagaagtcggtcggcgtatgggcctggaaacccacaagcttgctagcctttggaaagatcaggcggttgtagagatcaatattgctgtacttcactccttccagaaacagaatgtgactatcatggatcaccacagcgcggcagagtcctttatgaagtacatgcagaatgaatatcggtcacgtggggggtgcccagccgactggatctggctcgtccctcctatgtccggcagtatcactcctgtcttccaccaggagatgcttaactacgtgctgtccccgttctattactaccaggtggaggcctggaagacacatgtgtggcaagacgaaaagagacgccctaaacgtcgggagattcctctcaaagttcttgtgaaggccgttttgtttgcgtgtatgcttatgagaaagaccatggccagtcgcgtacgcgtcaccatactcttcgctactgagactgggaagtccgaagctctggcgtgggatctgggagcactgttttcttgtgcgttcaatccgaaagtggtctgcatggataagtatagactgtcctgtttggaagaagaacgactactactcgtagttacctcaacatttggaaacggggactgtccgggcaacggcgagaaattgaagaagtccctttttatgcttaaggagctgaataacaagttcaggtatgccgtgttcgggttaggttcctcaatgtacccaagattttgcgcttttgcgcatgacatcgatcagaaattgtcacacctcggggccagtcaactgacccctatgggagaaggagacgagttgtcaggtcaggaggacgcgttcagaagttgggctgtccaaacctttaaggcagcttgcgagacgtttgacgtgcggggcaagcagcatatccagatccccaaactgtatacatcaaatgtgacctgggacccccatcactatagactggttcaagattcccagccactagatctgagcaaggcactgagcagcatgcatgctaaaaatgtgtttacaatgcgactgaagtcccggcaaaatcttcagagtcccaccagctcacgagccaccatcctggtggagttatcctgtgaggacgggcaaggattaaactaccttcccggagagcacctcggtgtctgccccggcaatcagcctgcactggtccagggaatactggaaagagtcgtggacgggcctacacctcaccagaccgtcagactcgaggcactggacgagtctgggagctattgggtgtcagacaagaggctgccaccatgcagcttatcacaagctctaacatacttccttgacatcacaacaccgcctacgcagctgctcctccagaaactggcacaagtagctaccgaggaaccggaaagacagcgtctggaggccctctgccagcccagcgagtattctaagtggaaattcactaatagtcctacatttctggaagttttggaggagttcccaagtctgcgtgtgagcgcagggttcctgctcagccagttgcctatcctgaagcctcgcttttactctatttcctccagccgggatcacactcctaccgaaatccacctgacagtcgccgtcgtcacttatcatacacgagatggccaagggcccctccaccacggcgtgtgttcaacttggctgaattccctgaagccgcaggaccctgtgccgtgcttcgtgcgaaacgcctccggcttccacctgcctgaggaccctagccacccatgcattttaattggacctggtaccggtatcgcgccattccggtccttctggcaacagagactgcatgactcgcagcacaaaggagtccgcggaggcagaatgaccctcgtgttcggatgccgtaggcccgacgaggatcatatataccaggaagaaatgcttgaaatggcgcagaagggggtgttgcatgcagttcatacagcttactctagactgccagggaagcccaaggtctatgtccaagacatcttgcgccagcagttggccagcgaggtccttcgcgtgctacataaagaaccaggccacctgtacgtgtgtggggatgtcaggatggccagagatgttgcgcacactcttaaacagttggttgccgccaaactgaaacttaacgaggagcaggtggaagattattttttccagcttaaaagtcagaaacgatatcatgaggacatttttggtgcagtcttcccttatgaggccaaaaaggatcgcgtggccgtgcagccctcttctctggaaatgagcgcactctag

SEQ ID NO: 197387 - DNA, 3345 bp, Artificial Sequence
  Description of Artificial Sequence: Synthetic coding sequence
atggcctgcccctggaagttcctgttcaagaccaagttccaccagtacgccatgaacggggaaaaggacatcaacaacaacgtggagaaggccccatgcgccacatcctctcccgtcacacaggacgatctgcagtaccacaatttgagcaaacagcagaacgaatccccacaacccttggtggagacaggtaaaaaatctccagagagtcttgtcaagctcgacgctacacctttgagcagtccccgccatgtgcggatcaagaactggggtagtgggatgacatttcaggacactctgcaccacaaggcgaaaggcatcctgacctgtcgcagcaagtcttgcttggggagcattatgactcccaaatccctgacccgaggcccaagagataagcctacccctccggacgaacttcttccacaagcaattgagttcgtcaaccagtattacggtagctttaaagaagcaaagatcgaagaacatcttgccagagtagaggccgtgaccaaggagatcgaaaccacaggcacgtaccagctgacgggggatgaactgatctttgcgactaagcaagcgtggaggaatgcacctcggtgcattggcaggatccagtggagcaacctgcaggtatttgatgcccgaagctgcagtactgcccgggaaatgtttgagcacatctgcagacatgtgaggtacagcacaaataatggcaacattaggagcgctattaccgtattcccgcagagaagcgacggcaagcacgattttcgcgtgtggaatgctcaactttgcatagacttagggtggaaacctaatggaagggacccagaactgttcgagatccctcctgacctggtactggaggtcgcaatggagcatcctaaatatgagtggtttagggagcttgaactgaagtggtacgctttgcccgcggtcgctaacatgctgctcgaagtgggtggcttagaatttcctgggtgtccattcaatggctggtacatgggcacagagataggagttcgggacttttgtgatgtgcaacgatacaatatcctggaagaagtgggacggaggatgggtctagagacacacaagctcgcttcactgtggaaagatcaggcggttgtggaaattaacattgccgttctgcacagctttcaaaaacagaacgtcacaatcatggaccaccacagtgccgctgagtcttttatgaaatacatgcagaacgagtatcgatctcgggggggatgccctgctgactggatatggttagtcccccctatgtccggctcaatcacaccagtgttccaccaagaaatgctcaactatgttctgtcccccttttactactatcaggtggaggcctggaaaacacatgtttggcaggacgagaaacggcgccccaagaggagagagatcccactgaaggtgttagtcaaagctgtgctcttcgcgtgcatgctaatgaggaaaactatggctagtcgcgttcgggtaacaattttatttgccacagaaactggtaaatcagaggcattggcctgggacctcggagctctgttctcgtgtgcctttaatcccaaggttgtctgcatggataagtacagattgtcttgcctcgaggaggaaagactcctgttagttgttacttctaccttcggtaatggggactgtcccgggaacggagagaagctgaaaaagtccttgtttatgctgaaggagctaaacaacaagtttcggtacgcagtgttcggccttggctcttctatgtatcctcggttctgcgcattcgcccacgacatagaccaaaagctgtcccaccttggggccagtcaattaacaccaatgggcgagggcgacgagttaagcggtcaggaagatgctttcaggtcttgggcagtgcaaacctttaaagctgcctgcgagactttcgatgtgagaggtaagcagcatatccaaattcccaagctttacacttcaaacgtgacttgggaccctcatcattaccggctcgtgcaggacagccagccattggacctgagcaaggctctttcctccatgcatgcaaagaacgtgttcacgatgaggctgaaaagtcgacaaaacctccaaagtccaacgagttctagggcaactatccttgtggagctgtcgtgtgaggatgggcaagggcttaattacttacctggagaacatcttggtgtttgcccagggaaccagccggctctggtgcaaggaattttggagcgggtcgtcgatggccccaccccacaccagacggtacgcctggaagccctggatgagagcggaagttactgggtcagtgacaagaggctgccaccatgttctcttagccaagctcttacctatttcctggatatcacaacccccccaacccagctccttcttcaaaaattagcccaggtggccaccgaagaacccgaaagacagaggttggaggcactgtgtcagccttccgaatattctaaatggaaatttaccaactctccaaccttcctcgaagttctggaggagtttccctcgcttagggtgtccgcaggctttctgctatcccagcttcccatactaaagccccggttctattccatttctagcagtcgggatcacactccaactgaaatccaccttacagtagctgtcgtgacatatcacactcgggatgggcaggggcccctgcatcatggcgtgtgttcaacctggctgaattccttaaaacctcaggacccagttccctgtttcgtgaggaacgcctccggcttccacctccccgaagaccctagtcacccttgcattctgatcggcccaggaacgggaattgcaccttttcgttcgttctggcagcagagacttcacgattcccaacataagggggttagagggggtaggatgaccctagtcttcgggtgcaggcgaccagacgaggaccatatataccaggaggagatgcttgaaatggcacaaaaaggagtgttacacgccgtccataccgcttattcccgcttgcctgggaagccaaaagtctatgtccaggacatattacgccagcagctcgccagcgaggtgctcagagtgcttcacaaagaaccggggcacctttacgtttgcggagacgtccgcatggcgcgggatgtcgcccatacactcaagcagctggttgcggcaaaactcaagctcaatgaggagcaggtcgaagattatttcttccagctgaagtctcaaaaaaggtaccacgaggacatttttggggccgttttcccatatgaggctaaaaaagatagagtggcggtgcagccctctagcttggaaatgtcagccttgtag

SEQ ID NO: 197388 - DNA, 3612 bp, Artificial Sequence
  Description of Artificial Sequence: Synthetic coding sequence
atgggcaacctgaagagcgtggcccaggagcccggccccccctgcggactcgggcttggcttaggtcttggtctgtgtggcaagcagggccctgcgacaccagcaccagagccctcaagggctcccgcttcactcctgccgccagctcccgagcatagcccacccagttcaccgttaacccagcccccggagggccccaaattcccacgtgtgaagaactgggaggtgggttcaataacctacgatactttgagcgcccaggcccagcaggatggcccctgtacacccaggcgttgtctgggttccctggtattccctaggaagctgcaaggtcggccatctcctggaccaccagcaccggagcagctcctgtcgcaggcacgggacttcattaatcagtactacagctcaatcaagcgctctggatcacaggcacatgaacagcggttacaggaggtagaggccgaagtcgccgccaccgggacgtatcagttgagggagagtgaactggtgtttggtgccaaacaggcctggcgaaacgcccccaggtgtgtaggacggattcagtgggggaagctccaagtattcgatgctcgtgactgtcgctccgcccaagagatgttcacctatatctgcaatcacataaaatatgccaccaaccgtggaaatctgcgcagtgcaataacggtattcccccagcgatgcccaggtcgaggcgatttccgaatctggaatagtcagctcgtcagatatgccggctatagacagcaggacggatctgtgaggggagatcctgctaatgtcgagattaccgagctgtgtatccagcacggctggacgccaggtaacggtcgctttgacgtgctcccgcttctgctgcaggcccccgacgatcctcctgaactctttctgctccctccggaactggtcctcgaggtgcctctggaacaccccaccctagagtggtttgcagcgttgggtctgcgatggtatgcgctgccagcggtctctaacatgcttctcgaaattggcggcctggaattcccggccgccccattttcagggtggtacatgtcaactgagattggaacccggaacttgtgcgacccacacaggtataacatactggaagacgtggcagtttgtatggacctcgatacgagaaccacctcgagcctgtggaaagacaaggccgcagtcgaaattaatgtggcagtcctgcactcatatcaactcgcaaaggtaaccattgtggatcaccacgctgctacagcctccttcatgaagcacctcgaaaatgagcaaaaggcccgcggtgggtgtcctgccgattgggcatggatagtgccaccaataagcggatccctcacaccagtgttccatcaagagatggtgaactacttcttgagtccagcgtttaggtaccagccagacccttggaaaggatccgctgccaagggcactggcattactcggaagaaaacctttaaagaagtcgccaacgcagtgaaaatctcggcttctctgatggggactgtgatggctaagagagtcaaggctaccatcctctatggctcggaaaccggacgggcacagtcatatgcgcaacaattgggaagattgtttagaaaagcttttgatcctagggtcctgtgcatggatgagtacgatgtggtctcactggaacatgagacactggtactggtagtgactagcacattcggcaacggagacccgccagagaacggagagtcttttgccgccgctctgatggagatgagtggcccatataatagcagcccacggccagaacagcataagagttacaagattaggtttaattccatctcttgcagtgaccccctggtgagcagctggcggaggaagcgcaaggagtccagtaacactgactctgctggggcattgggtactctgagattctgcgtatttgggttagggtcacgggcatacccccatttctgcgcttttgcccgcgccgtcgacaccaggcttgaagagctgggtggggagaggcttcttcaactgggtcagggagatgagttatgtggacaggaggaggcgttcaggggctgggctcaagccgcctttcaggcagcatgcgagaccttctgtgtgggagaggatgcaaaagccgccgcgcgggatatattcagtcccaaacgatcctggaagcgacagcggtatcggctgagtgcccaggctgaaggactgcagctgctacctggccttattcatgtgcaccgcaggaagatgttccaagccaccattcggtccgtcgagaatctgcagagctctaaatctactagggcgacaattttagttcggctggacaccgggggccaggagggcttgcagtatcagccaggagatcatattggggtttgcccgcctaatcgtcccggtctggtggaggctcttttatctagagtagaggacccccctgctccgaccgagcccgttgccgtcgagcagctggaaaagggcagccccggcggtccacctccaggctgggttcgggaccccagactgcccccatgcacacttcgccaggcccttacattttttctcgacattacatcccctccatctccgcaacttttgcggcttctctctactttggccgaggagccaagggaacagcaagagctcgaagccctttcccaagaccccagaaggtacgaggaatggaaatggtttagatgcccgacccttctggaagtgcttgagcagtttccctccgttgccctgccagccccgcttttgttgacccagctgcctctgctgcagccaaggtattactcggtaagtagcgccccatctacgcatcccggcgagatccacctcaccgtggctgtgctcgcctatcgtacgcaagacggactcggtcccctgcactatggggtatgttccacctggctgtcgcaactaaagcccggtgaccctgtgccctgtttcatccgtggagcaccatccttccgcttgcctcctgacccaagcctgccctgcatcctggtcggtccagggacaggcatcgctcctttccgtgggttttggcaagagcggctgcatgacatagagtctaaagggctccagcccacacctatgaccctggttttcggctgtagatgcagccaactggatcatctgtatcgggatgaagtgcagaacgcgcagcaacggggggtttttggtcgcgtgttaacagccttcagtcgagaaccagacaacccgaagacctacgtgcaggacattctgcggactgaactcgccgcggaagtgcaccgagtcctgtgcctcgagcggggtcacatgttcgtgtgtggtgatgtgactatggccaccaacgtgctgcagacagtacagagaatcctggctacagaaggcgatatggaactagacgaagccggtgacgttatcggcgttctgcgcgatcagcagaggtatcacgaagatatcttcgggctaactctgcgaacccaggaggtgacaagccgcatcagaactcagagtttctctttgcaggagcgtcagctgaggggggctgtgccatgggcattcgacccgcccggtagtgacactaactccccatag

SEQ ID NO: 197389 - DNA, 2994 bp, Artificial Sequence
  Description of Artificial Sequence: Synthetic coding sequence
atgttcacctacatctgcaaccacatcaagtacgccaccaaccggggaaatcttcgctctgccatcacagtattcccccagcgctgcccgggacggggtgatttcagaatatggaactctcagctggtccgttacgctgggtaccggcagcaggatggctcggtcagaggtgatccagccaacgtggaaattaccgagctttgcatccaacatggctggacaccggggaatggacgcttcgatgtcttaccactgctattgcaggcccctgatgacccacccgagctgtttcttctgccacccgagctggtcctggaggttccacttgagcacccaacattggaatggtttgcggctctcggcctgcgttggtacgcccttcccgccgtgtctaatatgcttttggaaattgggggactggaattccctgcggctcccttctcaggatggtacatgtccaccgaaattggcactcgaaacctatgcgatccgcatagatacaacatcctcgaggatgtggctgtgtgcatggacctggacaccagaactacttcctccctttggaaagacaaggcggctgttgagatcaacgtggcagttctgcactcctaccagctggccaaggttactattgtggaccaccacgccgctaccgcctcattcatgaaacatctggagaacgaacagaaggctcgcgggggatgtccggccgattgggcctggattgttccgcccatttccgggagcctgacaccggtattccaccaggagatggtgaactacttcttgtcacctgcattccggtatcagcctgacccctggaaggggtcagcagcgaaagggacgggaatcactagaaaaaaaacgttcaaggaggtagccaacgccgtgaaaatttctgccagcctgatgggaacagtgatggccaaaagggtgaaagccactatcctgtatggttctgagactggccgcgcccagtcttatgcccagcaattaggcagactttttagaaaagccttcgatccccgcgtgctttgtatggatgagtatgacgtcgtttctctggaacatgaaactctggtactggttgtaaccagtactttcggcaacggagatcctcccgagaacggcgagtcattcgcagcagctcttatggagatgtctggaccatacaactccagcccaaggccagaacaacataaaagctataagatccgcttcaattccatttcgtgttctgacccactggtgtctagttggcgaaggaagcgaaaggaatcctccaacaccgattcagccggagcgctgggcacattaaggttttgtgtgttcggccttggttcccgcgcttacccccacttctgtgcctttgcgagggcggtagacaccaggctggaggagctcggaggcgagagattactgcagctggggcaaggggacgagctgtgtgggcaggaagaggctttccggggctgggcacaagcagcttttcaggcagcgtgtgagaccttttgcgttggagaagatgcaaaggccgccgctcgggatatttttagtcctaagcgatcatggaagcgccagcgatacagactatccgcccaggcagaagggcttcagctccttccaggtctgatccatgtgcatcggagaaagatgtttcaggcgaccattcgctctgtagaaaatttgcagagcagtaaatccactagagcgaccatcctcgtccggctggatacaggtggtcaagaggggttgcagtatcagcccggcgaccacattggcgtgtgcccacccaaccgtccggggctggtcgaagcactattatcacgggtggaggaccctccggctccaacagagccggtggcagtggagcagctggagaaaggcagtccaggaggcccaccacccggatgggtgcgggatccccggctccccccctgtactctgcgccaagcacttacattttttctggatatcacttctccacctagcccacagctgttgcgcctgctctccaccctggcagaagagcctcgcgagcaacaggagctggaagccctctctcaggacccccggcggtacgaagaatggaaatggtttcggtgccccacactgctggaggtccttgaacaattccccagcgtagccctaccagctccactactcctgacacaattgcccctgctgcagcccaggtactatagtgtcagcagcgccccgagcactcaccctggcgagattcacctcaccgtggcagtgctcgcatatcggacccaggatggcttggggccattgcactatggcgtgtgctctacctggctatcccagctgaagcctggtgaccctgttccatgcttcataaggggggccccctcgttccgattgcctccagacccttcgctgccttgcatcctggtcgggcctgggaccggtatcgctcctttcagggggttctggcaggaaagactccacgacatcgagtccaagggactccagccaactccgatgacactcgttttcgggtgccgatgtagccagctggatcatctgtaccgggacgaggtgcaaaacgctcagcagagaggtgtctttggcagggtgctcaccgccttctccagagagccagacaatcccaaaacatacgttcaggatatccttcgcaccgagctggccgccgaggtgcaccgggtgttgtgtctcgagagaggccacatgtttgtctgcggggatgtgacgatggccacgaacgtgctccagacggtgcagagaatcctggccaccgaaggcgacatggagctagacgaggcaggggatgtaataggcgtgctacgtgatcaacagcgataccacgaggatatctttggacttacattacggacgcaggaagtcacaagtaggatacgtacccagagcttctctctccaggagcgacagctcagaggagccgtgccgtgggctttcgatcctcctggctccgacactaacagcccttag

SEQ ID NO: 197390 - DNA, 1521 bp, Artificial Sequence
  Description of Artificial Sequence: Synthetic coding sequence
atgcgggaccccctgaccgactgcccctacaacaaggtgtacaagaatctgaaagagtttagccagaacggggagaatttttgtaagcaagtcacctcagttctgcaacagcgtgccaacctcgagatctcatacgccaaaggcctgcaaaaactcgccagtaaactcagcaaagcgctgcagaacactcgcaagagctgcgtaagcagtgcctgggcttgggcttcggaagggatgaagtcaacagccgatttgcatcaaaaactggggaaagctatcgaattggaggccatcaaaccaacctaccaggtgctcaatgtgcaggaaaagaagcggaagtctctagataacgaggtcgaaaagacagccaacctggtgatttccaactggaaccagcagattaaagctaagaagaaactaatggtgagcacaaaaaaacatgaagcactattccagctggtggagagctccaagcaatctatgactgagaaagaaaagaggaaactgctcaacaagctgactaagtctactgagaagctcgaaaaggaggacgagaactattatcagaagaacatggctggatacagtactaggctgaagtgggagaacactctggagaactgctatcagagtattctggagctggagaaagaacgcattcagttactctgcaacaacctcaaccagtattcacagcacatcagcttgttcgggcagactctgaccacctgtcatactcagattcactgcgcaatttctaagattgacatcgagaaagatatacaggccgttatggaagagacggccattctgagtactgaaaacaaatcagagttcctgttaaccgactatttcgaagaggaccccaatagcgccatggataaggagagacgaaaaagtttattaaagccgaagcttttgagactgcaaagagacattgagaaggcttcaaaggacaaggagggtctcgaacgtatgttaaagacttattcatcgaccagttccttttcggatgctaagtctcagaaagacaccgccgcacttatggacgaaaacaatctgaaactggatcttttagaggctaatagctacaagcttagctccatgttggccgaactggaacaaaggccacaacctagccatccgtgcagtaatagtattttccggtggagggagaaggagcacactcactcttacgttaaaatctcacggccatttctgatgaagcgtttagaaaatattgttagcaaagcaagttcgggaggtcagagtaacccaggcagtagtacaccagctcctggagccgcacagttgtccagcaggctttgtaaagctctttattcctttcaggcacgccaagatgatgaactgaatctggagaaaggagacatagtgatcatacacgaaaaaaaagaaggtggctggtggttcggctccctcaacgggaagaaagggcatttccccgccgcctacgtcgaagagttgccgtcaaatgctggcaataccgctactaaagcctag

SEQ ID NO: 197391 - DNA, 1287 bp, Artificial Sequence
  Description of Artificial Sequence: Synthetic coding sequence
atgaagagcaccgccgacctgcaccagaagctgggcaaggccatcgaactggaggccataaagcccacctaccaagtccttaacgtacaggaaaagaagcggaagtctctggataatgaagtcgagaagactgcaaacctagtcatcagcaactggaaccagcagattaaggcgaagaagaaactgatggtgtctacaaaaaagcatgaagcactgtttcagctggtggagtccagcaagcagtccatgacggagaaggagaaacggaaactcctcaataaattaaccaaaagcacagaaaagctcgagaaagaggatgagaattactaccaaaagaatatggccgggtacagcacacggcttaaatgggagaacaccctggaaaactgctatcagtcaatcctcgagctcgagaaagagagaatccagttactttgcaacaatttaaaccagtacagccagcacatcagcctgttcgggcagacactgaccacctgccatacacaaattcactgtgctatctctaagattgacatcgaaaaggacatacaggccgtcatggaggagacggccattctcagtacagagaataaatcggaattcctgctgactgattacttcgaagaggatccaaactctgcgatggacaaggaacggagaaagagcctgctcaagcctaagttacttcgactccagagagacatcgaaaaggcttctaaggacaaggaggggcttgagagaatgttaaagacctacagctcaacatcttcattttcagatgccaagtcccaaaaggacaccgcggccctcatggacgagaacaatctaaagctggatctgctcgaggctaattcttacaagctttcatcaatgctggccgagttggagcaaaggccccagccctcgcacccctgtagtaattcaatttttagatggagggagaaagaacatacccactcatatgtgaagattagccgccccttccttatgaagagactggaaaatatcgtcagcaaggcctcaagtggcggtcagagcaaccccgggtcatctacgccagcaccgggcgcggctcagcttagctcacgcctttgcaaggctctgtacagcttccaggcacgccaggatgatgaactgaacctagagaaaggggacattgtgataattcacgagaaaaaggaggggggatggtggtttggcagcctcaacggaaaaaagggtcattttcctgcggcctatgtggaagagttgccgtccaacgccggaaatactgccactaaggcatag

SEQ ID NO: 197392 - DNA, 1692 bp, Artificial Sequence
  Description of Artificial Sequence: Synthetic coding sequence
atgcgggaccccctgaccgactgcccctacaacaaggtgtacaagaatcttaaggagttcagtcagaatggggagaatttctgcaagcaagtgacaagcgttctgcagcaaagggctaatctcgagatttcttatgcgaagggcctccagaagctggcttccaagctgtcaaaggcgctgcaaaacaccaggaaatcctgcgtttcttctgcttgggcttgggctagtgagggtatgaagagtaccgctgacctgcaccagaaactgggcaaagccatcgagcttgaggcaatcaagccaacctatcaggttctgaatgtgcaggaaaaaaaacgcaagagcctcgataacgaggtcgagaaaactgcgaatctcgttatcagcaattggaatcagcagattaaggctaagaagaagttgatggtgtcaaccaagaaacacgaggcactattccaactcgttgaaagctccaagcagtcaatgactgaaaaggagaaacgcaaacttcttaataaactaactaagtccaccgagaagttagaaaaggaggacgagaattactatcagaaaaacatggccggatatagcactagactgaagtgggagaacactcttgagaattgttatcaggtgactcattccatttgtctgtatgccttctgggtcaaaagggcctggggaaagtgtgtctccgacttgaggtatcaggacacctttctccctggcaacctcccacctctttggttcggctacgatattgtcaaaaggctcattatgagactgtgttcggtgtgcttacagtccatcttagaactggagaaggaacggatccagctcctttgcaacaacctgaatcagtattcacagcatatctccctcttcgggcagacactgaccacgtgccatactcaaatacattgtgcgatctccaaaatagatatcgagaaggatattcaggcggtaatggaggaaacagctattctaagcacggagaataaatcagaattcctgttaacagattacttcgaggaagaccctaactcagcaatggataaggaaaggcgtaaatccctgttgaaacccaaactgctccgtcttcagagagacatcgagaaagcctccaaggacaaggagggcctcgagaggatgctgaaaacttacagctccacatcaagtttttcagacgccaaatcacagaaagacaccgctgctctgatggacgagaataatctgaaactggatctgctggaagctaacagttacaaactttcaagtatgcttgccgagttagaacagcggcctcaaccaagtcacccctgcagcaactccatttttcgttggagggagaaggaacatacccatagctatgtgaagatctccaggccctttctgatgaaaagactggaaaatatagtaagcaaagccagttcaggcggccagtctaatcccggttcctccactccagcacccggagctgcccagctgtcaagccgtttgtgtaaggcactttacagttttcaggcaaggcaggacgacgagctcaacctggagaaaggcgacatagtaattattcacgagaagaaggagggcgggtggtggtttggctcgctaaacgggaagaagggccacttccctgctgcttatgtggaagagctgcctagtaatgctggaaacacagccaccaaggcatag

SEQ ID NO: 197393 - DNA, 1692 bp, Artificial Sequence
  Description of Artificial Sequence: Synthetic coding sequence
atgcgggaccccctgaccgactgcccctacaacaaggtgtacaagaatttgaaagaattcagtcaaaacggggagaatttttgtaagcaggtgacatcagtgctgcagcagagagctaatctggaaatttcatacgctaagggactacaaaaacttgcctccaagctcagcaaggcactgcaaaacactcgcaagtcttgcgtgagcagtgcatgggcctgggcttccgaagggatgaaatctacagccgatctgcaccagaagctgggcaaagcaattgaattggaagctattaagcccacataccaggtgctcaatgtgcaagagaagaaacgtaaaagcctagataacgaagtggaaaagactgccaacctggtcatctccaattggaaccagcagattaaggcgaaaaagaagctcatggtgagcaccaaaaaacacgaggcactattccagcttgtcgagtcctctaagcagtcaatgactgaaaaggagaaaaggaagctgttaaacaaattgacgaagtctaccgagaaattggaaaaagaagacgaaaactactatcagaagaacatggctgggtatagtacacggctcaagtgggagaacaccctggaaaattgctaccaggtcacccactccatatgcctgtacgcgttttgggtgaagagagcctggggcaagtgcgtgagcgatctcaggtaccaagatactttcctgcctggcaacctgccccccctttggttcggctacgatatcgtgaaacgcctgatcatgcgcctgtgctctgtgtgtctccaatccatacttgaacttgagaaggagaggatacagctgttgtgcaataatctaaaccaatactctcagcatatcagtctgtttgggcagacgctgacaacctgccatacgcagattcactgcgctatttctaaaatagacattgagaaggacattcaggccgtgatggaagagacagccattctcagcactgaaaataagtcagagttcctgctgacggattattttgaagaagatcccaactctgcgatggataaagagagaaggaagagcctcctgaagcctaaactcttgaggctgcagagagatatcgaaaaagcctcaaaagacaaggagggtttggaacggatgctgaaaacctattcttctacttccagcttctctgatgcaaagtcccagaaagacacagctgctctcatggacgagaataatctgaagctggatttgctagaagcaaacagctataagttatcgagtatgttggccgagcttgagcagcggcctcagcccagtcacccatgcagtaatagcatttttcggtggcgcgagaaagaacacacccatagctacgtcaaaatctcacggccgttcctaatgaagagattagaaaatattgtgagtaaggccagctccggcggccagtccaatcctggcagtagtacacctgcgccaggtgcagcacagctgagctccaggttgtgtaaagcactgtatagtttccaagcaagacaggatgacgagttgaatcttgagaagggcgacatagtcatcatacacgagaaaaaagaaggggggtggtggttcggtagcttgaacggaaagaaaggtcacttccctgcagcctatgtggaagaactgccaagtaatgccgggaacaccgctaccaaagcatag

SEQ ID NO: 197394 - DNA, 939 bp, Artificial Sequence
  Description of Artificial Sequence: Synthetic coding sequence
atgaccttcggcctgcggaagcggctgagcgaggagcggggcttctccctcatgcctcgggctatggcaatatcaagctctagctgcgagctcccactggtcgctgtgtgtcaggtgacgtccaccccagacaagcaacagaacttcaaaacttgtgccgagctggtgagggaagccgcccggctgggcgcatgtctggccttcctgcctgaggcctttgatttcatcgcacgcgaccccgccgaaacactgcacctttccgagccattaggcggcaagctgctggaggagtacacgcagttagcaagagaatgtgggctgtggctctccctgggaggcttccatgagagaggccaggattgggagcaaactcaaaagatatacaactgccatgtactgctcaacagtaaaggagcagttgttgccacgtacaggaaaacccacctgtgtgatgttgagatccctggccagggaccaatgtgtgagtcaaacagtactatgcccggaccaagtctcgaaagtcccgtttctacccccgccggaaaaatcggtctcgcagtgtgttacgacatgagattcccggagctatcgctggctctggctcaggccggagccgaaatcctgacatacccaagcgcatttggatctataactggccctgctcactgggaagttctgcttcgcgcgcgtgctattgagacccagtgctacgttgtggccgccgcacagtgtgggaggcaccatgagaaaagggcctcctacggccacagcatggtcgttgacccctgggggactgtggtggcccgctgtagtgagggacccggtctatgtctggcccgtatcgacttaaactaccttcgacagctccgacgccaccttccggtcttccagcacagacgtcctgatttatatggaaatctcgggcatcccctttcctag

SEQ ID NO: 197395 - DNA, 732 bp, Artificial Sequence
  Description of Artificial Sequence: Synthetic coding sequence
atgctgggcttcatcacccggcccccccaccggttcctgagcctgctatgtcccggacttcggattccacagcttagtgtgctgtgcgcccagcccaggccacgggccatggctatctcttcttccagttgtgaattacccctagttgcggtctgccaggtaactagcacaccagacaagcagcaaaattttaagacctgtgcagagctggtgagagaggcagctcggctaggggcgtgcctcgcatttctgccggaagcatttgatttcatcgcaagagacccagcggagacgcttcatctaagcgaacctttggggggcaaactcctggaagagtacactcagctcgcccgcgagtgtggcttgtggctctcattgggtggcttccacgagagggggcaggactgggagcagacacaaaaaatttacaactgtcacgtgctgctgaatagcaaaggagctgtcgtggccacctaccggaagacgcatctctgtgatgtcgaaatccccggccagggacccatgtgtgagtccaactcaaccatgccaggacccagcttggaaagcccagtgtccaccccagctgggaaaatcggcttggcggtgtgttatgatatgaggttccctgaactgagtttagcactggcacaggcaggggctgagattcttacctaccccagtgcattcggatctattacgggccccgctcactgggagcccgttagcagctag

SEQ ID NO: 197396 - DNA, 984 bp, Artificial Sequence
  Description of Artificial Sequence: Synthetic coding sequence
atgctgggcttcatcacccggcccccccaccggttcctgagcctgctctgccccggcctgagaatacctcagctcagcgtcctctgtgcacagcctagaccacgggctatggcgatctcttcctcgagttgtgagcttccactcgttgctgtgtgccaagtaactagcactcccgacaagcagcagaatttcaagacatgtgccgagctggttcgcgaagccgctaggctaggtgcctgccttgcatttctgccggaagcctttgattttattgcacgggaccctgctgaaacactccaccttagcgaacccctcggagggaagctcctagaagaatacactcagctggccagggaatgcggcctgtggctgagtctcggcggttttcacgaacgaggacaggactgggagcagacccaaaaaatttacaattgccatgtgcttctcaatagcaagggggcagtggtagccacatatcggaagactcacctttgtgatgtggagatccctggtcagggcccaatgtgcgagagcaacagcaccatgcctggacctagcctcgagagccctgtgagtacccccgccggcaagataggcctggcagtatgctatgatatgcgtttcccagagttgtcacttgcactagcgcaggccggtgccgagatcctcacatacccttctgcctttggatccattacggggccagctcactgggaggtgttgcttcgcgcaagggccattgagacccagtgctacgtggtagctgctgcccagtgcggaaggcatcacgagaaacgcgcaagttacggccattccatggtggtggacccatggggcacggtggtggctcgatgttccgagggaccagggctgtgcctggcacgcatcgacctgaactatctccgtcaactccgcaggcacctgcccgtgtttcaacacagacgacctgatctttatggaaatctcgggcatccattgtcttag

SEQ ID NO: 197397 - DNA, 876 bp, Artificial Sequence
  Description of Artificial Sequence: Synthetic coding sequence
atggccatcagcagcagcagctgcgagctgcccctggtggccgtgtgccaggtgacttccaccccagacaaacagcagaatttcaaaacttgcgccgagctcgtccgggaagcagcaaggttgggcgcttgcctggcctttctgcctgaggccttcgatttcatcgctagggaccctgcagagactctgcacctgagcgaaccccttggcggcaagcttctggaggagtacactcagctggcccgggagtgcggcctgtggctctcgctcggagggtttcatgagcgcggccaagactgggagcagacacagaagatctacaattgccatgtcctcttaaacagcaaaggggctgtggtggccacgtacagaaagactcacttgtgtgacgtggaaatcccggggcaaggccccatgtgtgaaagtaactctacaatgcctggtccaagcttggagagtcctgtgagcacccctgctgggaagattggattggctgtttgctatgatatgaggttcccagagctaagcctggctcttgctcaggctggggccgagatcttgacatatccctcggccttcggcagcataactggccctgcccactgggaggtgctgctcagggcgagagccatagagacccagtgctatgtagtcgccgcagcacaatgcggtcgtcaccatgaaaaaagggcaagctacggccactcaatggttgtggacccgtggggcaccgtcgtagcccgatgctccgagggtcccggtctctgcctcgcgcggatcgatctcaactacttgcgccagctgcgtagacacctgccagtttttcaacataggcgcccagacttgtacggtaatttgggtcacccactgagctag

SEQ ID NO: 197398 - DNA, 822 bp, Artificial Sequence
  Description of Artificial Sequence: Synthetic coding sequence
atgagcctgaccaacaccaagaccggcttcagcgtgaaggacatcctcgacctgcctgacacaaatgacgaggagggctccgtggcagaaggtcccgaggaggagaatgaaggaccagaacccgccaagagggccggtccattgggacagggggccctcgacgctgtgcagagtctgcctctgaagaatcctttctatgattcatcagataatccttatacacggtggctcgcttctacggaaggcttgcagtatagccttcacgggttggctgccggagctccccctcaagatagcagcagcaagtcaccggagccatctgctgacgaaagcccagataacgataaggaaactcccggagggggcggggacgccggaaagaagaggaaaaggcgggtacttttctccaaagctcagacgtacgaacttgaacggaggtttcgtcagcagcgttacctctccgcacccgagcgagaacacctggcctccctgattcgtctgacccccacgcaggtgaagatttggtttcaaaaccaccggtataagatgaaaagagccagggccgaaaagggcatggaagttaccccactgccctctccaagacgcgtggccgtgcctgtcctcgtcagggatggaaagccctgccacgcgttgaaggcccaggacctggccgccgcaacattccaagccggcatcccattctctgcgtatagtgcccagtccctacagcatatgcagtacaacgctcagtattcaagcgcatccaccccacagtatcccactgcacatccgctggtgcaagcgcagcagtggacgtggtag

SEQ ID NO: 197399 - DNA, 1065 bp, Artificial Sequence
  Description of Artificial Sequence: Synthetic coding sequence
atgagcctgagccccaagcacaccacccccttcagcgtgagcgacatcctgtctcctatcgaggagacttacaaaaaattttcgggtgccatggacggtgcaccgcccggcctcggagcacccctgggcgccgctgccgcgtaccgcgcacctccgcctggcccaagttcccaggccgcaacggtggccgggatgcagccatctcacgcaatggccggtcataatgcggcggctgccgcggccgccgctgccgcagccgccgccgctgcagcgacctaccacatgccacccggcgtgagtcagttcccacacggagctatgggaagttactgcaatggtgggctaggaaacatgggtgagctgccagcctacaccgatggaatgagaggcggtgcggccaccggttggtatggcgccaatcctgatccacgctatagctccataagtaggtttatgggaccatctgccggcgtcaacgtcgctgggatgggctcactgacagggattgccgacgccgcaaagtcattaggacccttgcacgctgctgcagccgctgcggctccaagacgcaagaggcgcgtgctgttcagtcaagcccaggtgtatgaattggagagacgctttaaacagcagaaatacttaagtgcccctgagcgggaacaccttgccagcatgattcaccttactccaacccaggtgaagatctggtttcagaaccaccgttataagatgaaaagacaagctaaggataaagctgcacagcagttgcagcaggagggcgggctcggtcctccacctccgcctccgccctctccaaggcgtgtggccgtaccggtgctcgtgaaggatgggaaaccttgtcaaaacggggctagcacgccaacacctggccaggcgggtcctcagccacccgccccaacaccagcgcccgagttagaggaactgtcaccatcccctcctgctctgcacggtcctggtggcggactcgctgctctcgatgctgcagctggagaatattctggaggagttcttggggctaatctcttgtacggaagaacgtggtag

SEQ ID NO: 197400 - DNA, 975 bp, Artificial Sequence
  Description of Artificial Sequence: Synthetic coding sequence
atgttccccagccccgccctgacccccacccccttcagcgtgaaggatatactgaacctggaacagcagcaacgctcattagcagcagcaggtgagctgtccgcgagactggaagctaccctcgctccctcaagctgcatgcttgcagcctttaaacctgaagcctatgccggacctgaggcagccgccccaggactcccagagctacgagccgaactggggagagctccatctcctgcaaagtgcgcctcggccttccctgcagctcctgctttttaccccagagcgtactccgaccctgacccagccaaagacccccgcgctgagaagaaagagctatgtgcactgcagaaagctgtggaattagagaaaaccgaagctgataatgctgaaaggccccgcgccaggcggagacggaaaccacgcgtactatttagccaggctcaggtctacgaacttgagcggcgctttaagcagcaaaggtatctgtcagccccggaacgcgaccaattggcttctgttctgaaacttacttccacccaggtaaagatatggttccagaacaggcggtataagtgtaaaaggcagcggcaggaccagaccttggagcttgttggcctcccacccccccctcctcccccggccagacgaatcgctgtcccagtgcttgtgagggacggaaagccgtgcttgggcgattccgccccttatgccccagcgtatggcgttgggctgaatccatacggctataacgcctatcccgcctatcccggttatggcggggcagcatgtagccccggctatagctgtactgcggcctatcccgcaggcccgagtccagctcagccagccaccgccgctgctaataataatttcgtgaactttggcgtgggagacctaaacgccgtgcaaagcccgggaatcccccagagcaactctggtgtctctacattgcatggtatccgtgcatggtag

SEQ ID NO: 197401 - DNA, 339 bp, Artificial Sequence
  Description of Artificial Sequence: Synthetic coding sequence
atgttccccagccccgccctgacccccacccccttcagcgtgaaggatattctcaatctggaacaacagcagcgaagccttgcggccgccggcgagctgtctgcgcgtctggaggccacattggctccatcgagttgcatgctcgcagctttcaaaccagaggcctacgctggccctgaagcagcggcccccggacttccagaactccgtgccgaactcgggagagccccctctcccgcaaagtgcgcttccgctttccccgcggcacccgccttctacccccgtgcttattctgatccggaccctgccaaagaccccagggccgaaaagaaggcctag

SEQ ID NO: 197402 - DNA, 456 bp, Artificial Sequence
  Description of Artificial Sequence: Synthetic coding sequence
atgttccccagccccgccctgacccccacccccttcagcgtgaaggacattttaaatcttgagcagcagcagcggtctctggcagcagccggtgagttgtccgccaggctcgaggcaactctggctccttcttcctgcatgttggccgctttcaagcctgaggcctatgctggccccgaagcagccgctccaggcctaccagagctgagggccgaattgggaagggccccttctcctgctaaatgtgcctccgctttccctgccgcacctgccttctatcccagagcctactcagatccggatcccgccaaagatcccagggcagaaaaaaaaggctgtgagttgccgagaggccagcgacctccagttttgtttagctctgccctttcacagcccgatttccttcaaatgctgagcgagacgtgtcggtggttacctgtccatctggctgaatag

SEQ ID NO: 197403 - DNA, 906 bp, Artificial Sequence
  Description of Artificial Sequence: Synthetic coding sequence
atgctgctgagccccgtgaccagcacccccttcagcgtgaaggacatcttgcggctggagagggagaggtcttgcccagccgctagcccacaccctagagttcggaagagccccgagaattttcaatatctgaggatggacgccgaacctcgcgggtctgaggtgcacaacgctggaggcggagggggggacaggaaactcgatgggagtgagccacctgggggcccctgcgaagccgtgctcgaaatggacgccgagaggatgggtgagccacagcctgggctgaatgccgccagtcccctggggggcggtacacgcgttcccgaacgtggcgttggcaattctggggacagcgtaagaggcggccggagcgagcaaccaaaggcacgccagcgccggaaaccccgcgtcttattctcccaggcccaggtgctggcactcgaacgcaggtttaagcagcagagatacttgagcgcaccagaaagagagcacctggcatcagctctgcagctgacttctacgcaagtcaagatctggttccaaaaccggcgctacaaatgcaaaagacagcgtcaggataagtccctggaactagctggacaccccttgactccgaggcgcgtcgccgtgcctgttttggtgagagatggcaaaccatgcttgggtccaggacccggggcccccgcatttcctagcccgtactccgcggctgtctccccatactcttgttacggggggtattccggagcgccatatggcgctggctatgggacatgctacgccggagccccatcagggcccgcacctcatacccctctcgcgagcgcggggtttggacatggaggccagaacgcaaccccacaaggacacctggcggcaacactccaaggggttcgggcgtggtag

SEQ ID NO: 197404 - DNA, 660 bp, Artificial Sequence
  Description of Artificial Sequence: Synthetic coding sequence
atggacgccgagcggatgggcgagccccagcccggcctgaacgccgccagtcctcttggaggtggcactcgagtgcctgaacgaggggttggtaactcgggggactctgtgcgaggcgggaggagcgaacaacccaaagctaggcagagacgcaagcctagggtactgttttcgcaggcccaggtattggccttagagcgccgcttcaagcaacaacgctacctaagcgctcctgaaagggagcacctcgcaagcgcccttcagctaacgtccacacaggttaaaatctggtttcagaatagacgctacaagtgtaaaagacagcggcaggataagtcgctcgaactggctggtcacccattaaccccacgaagggttgccgtgcctgtgttagtgcgcgacggcaagccgtgcctgggtccaggccctggggctccagcatttcccagcccctattccgcagctgtgtcaccgtattcatgttacggggggtacagcggcgctccctacggcgccggttatggaacttgctatgctggagcccccagcggccccgcaccccacacccctctggcctccgccggatttggacacggaggacaaaatgccactccccagggtcacttagccgcaacactgcagggcgtgcgggcctggtag

SEQ ID NO: 197405 - DNA, 720 bp, Artificial Sequence
  Description of Artificial Sequence: Synthetic coding sequence
atggccaccagcggccggctgagcttcaccgtgcggagcctgctggatctgcccgagcaggatgctcaacatctgccaagacgcgaaccagagcctcgtgccccccaacctgacccatgcgctgcttggctcgattccgaacgaggtcattacccatctagcgacgagtcctccttggagacgagtccaccagatagttctcagcggccttctgcgagacctgcaagtcctggatctgacgccgaaaagcgtaaaaagcgaagggtgctcttttccaaggctcagaccctggaattggaaagacgcttccgacaacagcgatatctcagtgcccccgagcgcgaacagctggcctcattgcttcgcctcacaccaacacaggtcaaaatctggttccagaatcaccggtacaagctgaaacgagcacgagccccaggggctgctgagagcccagacctcgccgcaagcgccgagctgcatgcggcaccaggcctcttacggcgcgtagtggtgcccgttctggttcgcgacggacagccttgtggtggggggggcggaggagaggttggcaccgctgccgcacaagagaaatgtggagctccccccgcagccgcctgccccctccccggttaccctgccttcggtcccgggagcgcacttggtctctttcccgcttaccagcatctcgcttctcccgctctcgtcagctggaattggtag

SEQ ID NO: 197406 - DNA, 1002 bp, Artificial Sequence
  Description of Artificial Sequence: Synthetic coding sequence
atggccgtgcggggcgccaacaccctgaccagcttcagcatccaggctatactgaacaagaaggaagaaaggggagggttggcagccccagaaggcagacccgctccaggcgggacagcagctagtgtggcggcggccccagctgtgtgttgctggcggctgtttggagagagggatgctggggctctgggtggagcagaagactccctccttgcctcccccgctggcacaaggacggcagcagggcgcacagctgagtccccggaagggtgggatagtgacagcgctctgtccgaggagaatgaatccagaagacgttgtgccgatgcccgcggcgcctctggtgcaggccttgcgggggggagcttaagtttgggacagcctgtgtgtgaacttgctgcgagtaaagacctggaagaggaggcagcagggcgctccgattccgagatgagcgcatccgtgtccggcgatcgaagtccccgtaccgaggatgacggtgtgggacctaggggcgcacacgtatctgctttgtgttccggtgcgggcggaggcggggggtccggaccagccggagtggccgaggaggaggaggagcctgccgcacctaaacctaggaagaaacgctcacgtgcggcctttagccacgcacaagtctttgagcttgagagacgctttaaccatcagcggtatctcagcgggccagagagggccgacctcgccgccagtctcaaactcacggagacacaggttaagatctggttccaaaatcgcagatacaaaacaaagcgacggcagatggcagccgatctgctcgcctccgctcctgcagccaagaaagttgccgtgaaagtgttagtacgcgacgatcagcgccagtacttaccaggtgaagtgcttcggccaccatccctgctgcctcttcaaccatcatactattacccgtattattgcctccccggctgggctctgagtacttgcgcagctgctgctggaacccagtag

SEQ ID NO: 197407 - DNA, 798 bp, Artificial Sequence
  Description of Artificial Sequence: Synthetic coding sequence
atggagagcaacctgcagggcaccttcctgctgaacaacacccccctggctcaatttcccgagatgaaggcccctgtttgtcagtactccgtgcaaaactccttctacaaactctccccaccaggcttgggtccacagctggccgccggcactccacatggcatcaccgacatcttatcaaggcctgtcgcagccccgaacaactctctgctttcaggatacccccatgtcgcaggctttgggggtctcagctcacagggagtgtactactcaccccaggtgggaaactttagcaaagccggtaacgaataccctacacggactcgcaattgctgggcagatacggggcaggactggcggggaggaaggcagtgctctaatacccctgaccctttatcagattccatccataaaaagaagcacacgcgccccacgttcacaggccaccagatattcgccctagagaaaacttttgaacagaccaagtacctcgcaggcccagaaagggctaggttggcctatagtctgggaatgactgagagccaggtgaaggtatggttccagaatcggcgaactaagtggaggaagaaatcagccctggaacccagtagcagcactccgcgcgctcccggtggcgcaggtgctggggccggcggcgatagggctccaagtgagaacgaggacgacgaatacaataagcccctggatcctgactctgacgacgagaaaattagattgctcttacggaagcacagagctgcctttagcgtgctgtcattgggcgcccactccgtgtag

SEQ ID NO: 197408 - DNA, 408 bp, Artificial Sequence
  Description of Artificial Sequence: Synthetic coding sequence
atgcagcagggccagctggcccccggcagccggctgtgcagcggcccatggggactgcccgaactgcagccggcggctccctctagctccgcggctcagctcccttggggagaaagttggggagaggaggccgatactcccgcttgtctgtccgcctcaggagtgtggttccagaatcggagaacaaagtggcgcaagaagagtgctctcgagccttcgtcctctaccccaagagcccctgggggagctggtgccggagctggaggcgaccgagcccccagtgaaaacgaggatgacgagtataataaaccactggacccagacagtgacgacgagaagattcgcctgcttctaaggaaacacagggctgccttctccgtgcttagtctcggggcccattccgtatag

SEQ ID NO: 197409 - DNA, 2928 bp, Artificial Sequence
  Description of Artificial Sequence: Synthetic coding sequence
atgcggtggggccaccacctgccccgggccagctggggcagcggcttccggcgggccctccagagacctgacgatagaataccttttctcatccattggagttggccactgcagggggagcggcctttcggtcctccccgcgcctttatccggcaccacgggtcctctgtggattctgcgcctccaccaggacggcacggaaggctattcccatccgcatctgctacagaagctatccagagacatcgccggaacctggcagagtggtttagtcggctaccccgcgaggagagacaattcggacctacgttcgcgttggacactgtccatgtagacccagtgatacgcgaatccacccctgatgagctgctcagaccaccagccgaattagcactggaacaccagccgccacaagcaggcctgccccccctggccctttctcagcttttcaaccccgacgcttgtggacggcgtgtccagacagtcgtactctacggcacagtcgggacaggcaagtctactctggttcgaaaaatggttctagactggtgctacggacgcctaccagctttcgaactcctgatcccattcagctgtgaagacttaagctctctgggccctgcaccagcgagcctgtgccaactggtcgctcaacggtacactcccttaaaagaggtgttacctctgatggccgccgcgggctctcacctattatttgtactccatggactggaacacctaaacctggacttccgacttgcagggaccggactatgtagcgatccagaagaacctcaggaaccggcagccattattgttaatctgctgcgcaaatatatgttaccccaagcttccattctggtgaccacgcgtccatccgctatcggtaggatacccagtaagtatgtgggccgttacggggaaatctgtggctttagtgacactaatctccaaaagctgtactttcagctccggctaaatcagccctattgtggctatgctgtcggaggatccggcgtctccgcaacgcccgctcaacgcgaccacctcgtgcagatgttgagcaggaacctagagggtcaccatcagatcgccgcagcgtgttttctcccatcctactgctggttggtctgtgccaccctgcactttttgcacgcccctacgcctgctggacagaccttgacatctatttacacatcattcctgcgcctaaacttttccggcgagacacttgacagtactgatccatccaacttgtcactcatggcatatgccgctaggacaatgggtaagctggcctatgagggcgtttcttcgcgaaagacatactttagcgaggaagatgtgtgtggctgtttggaggccggtatcaggactgaagaagaatttcaattgctgcatattttccgcagagacgcattgcgatttttcctggccccctgtgttgagcctgggcgagcaggaacatttgtctttacagtaccggccatgcaagaataccttgccgcactttatattgttctgggacttcgcaagacgacactccaaaaagttggtaaggaggtagccgagctcgtcggacgagtaggggaggacgtgtccttagtcctggggataatggccaaactgttgcccttaagagcgctccctcttcttttcaatctaattaaggtagttcccagggtttttggccggatggtcggtaaatccagagaggccgttgcgcaggctatggtcctcgagatgttcagggaagaagattactacaacgacgatgtcctagaccaaatgggcgctagcatcttgggggtggaggggccccgccgacatcctgacgaaccccctgaggatgaggtgtttgaactttttcctatgtttatggggggactcttatccgctcataacagggctgtgttggctcagttggggtgcccaatcaagaacttagacgctctcgaaaatgcgcaggccattaagaagaagctcggaaagctgggcaggcaggtgctacccccatcggaactgctcgaccacttgtttttccattatgaatttcagaaccagagattttctgcagaggtcttgtcttctctgcggcagcttaacctggcaggagtccggatgacccctgtcaagtgtactgtggtcgctgcagttcttggttcagggaggcacgcattggacgaagttaacctggcatcatgccagctggaccctgcggggttgcgcaccctcttgcctgtcttcctaagggcccgaaaactgggtctgcaactcaattcactcggaccagaggcatgtaaagacctgcgagatctgctgctccatgaccagtgtcagatcactaccctgaggctgagcaataacccactgacggcagcgggtgtcgcagtgcttatggaaggcctagccggcaacactagtgtcacacaccttagtctgctgcacactgggctcggagatgagggcttggaactgcttgctgcccagctcgacaggaatcggcaactccaggaactgaacgtggcctacaatggggcgggggacaccgccgcccttgctctcgctcgggccgctcgtgaacacccctcactggagcttctccacctgtactttaatgagcttagctccgaggggaggcaagttctgcgagacctgggaggcgccgccgagggtggagctagggttgtggtgagcctaacagaaggcacagcagtgtctgaatactggtccgtcattctcagtgaggtccagcgcaatttgaacagttgggaccgcgctagagtgcagcggcatcttgaacttctcctccgcgacttggaagatagcagaggcgctacattgaacccatggcgcaaggcccagctgctccgcgtggaaggcgaggtacgcgcactgctggaacagctgggctcgagtgggagttag

SEQ ID NO: 197410 - DNA, 345 bp, Artificial Sequence
  Description of Artificial Sequence: Synthetic coding sequence
ggcatcagcaagctgaagatggtgaaccagtgcttcggcctgggcgatgggacgtgtcttttgagtattcagctagagggtccgaagcatgtggctttcgggtggccggaatgtccagaggctccactgccaactttaccaccccccccccttaaggaaccactgacggtgtctccccgagggtcccaccttatgagcgctatgcccggggtttcgccttccaggtgcgtaggtagctttcccagttgtctgatgcttacttgcgggcaccgaggatgcccacacattggtgctttcagttcgagctcctgccctctctgccacaacgggatgatggcttggtag

SEQ ID NO: 197411 - DNA, 2928 bp, Artificial Sequence
  Description of Artificial Sequence: Synthetic coding sequence
atgcggtggggccaccacctgccccgggccagctggggcagcggcttcagacgagcactgcagcgcccagacgaccggattcctttcctgatccattggagctggccactccagggggagaggccttttggcccacctcgagcatttatcaggcaccatggctcttccgttgactcagcgccccctcccggaagacacggtagactctttccctctgcttctgccaccgaagctatacagcgacaccgtagaaacctggcggagtggttcagccgactaccccgcgaggagaggcagtttgggcccacgtttgccctggacacagtccacgtggacccggttatcagagaaagcacgcccgacgagctgctaagacctccagccgaactagccctggaacaccagccccctcaggccggcctgccgccattagctttatcgcagctgtttaaccccgacgcctgtggtcgccgagtccagacggtagtcctgtacggaactgtggggaccggcaagtcaacgttagtccggaagatggtgctcgattggtgctatgggagacttcctgcgttcgaactgctgataccttttagttgtgaggatctctcaagcttagggcctgccccagcgagcctgtgtcagttggtcgcccaaagatatacgccgttaaaggaggtgttaccgctcatggcagcagctggcagccatctgctgtttgtgttgcatggactggagcacctaaatctagactttaggcttgcaggcacagggctttgctccgaccccgaggagcctcaggagcctgccgcgattatcgtgaacctcctcagaaaatacatgctcccacaggcctcaatcctggttaccactcgaccctcggcaatcggccgcattccctcaaaatacgtggggcgctacggagagatctgcggattctctgacacgaatttacagaagctgtacttccaactgcgcctcaaccagccctactgcggttacgcggtgggagggtctggcgtgagtgctacaccagctcagagggaccacctggtgcaaatgctaagtcgaaacctggagggccaccatcagatcgccgcagcctgctttctgccatcttactgctggctcgtttgtgctacgctgcatttcctacatgcacccactcctgccgggcagaccctgacttcaatctatacctcttttcttaggctgaatttctctggcgagacccttgacagcaccgacccatctaacttgtctctgatggcttacgctgctcgtaccatgggaaaattagcttatgagggggtgagcagtcgtaaaacctatttttccgaggaagacgtctgtggatgtttggaagctggcattaggaccgaggaagaattccagctccttcacatttttcggcgcgatgcactgaggttcttcctggctccctgtgttgaaccagggagagctggtacatttgtgttcacggtccctgctatgcaggagtatcttgcggccctctacattgtactcggtctgagaaaaacaacactgcagaaggtcggcaaagaagtcgccgagttagtcggtcgggtgggtgaggacgtttcattggtgctgggcattatggctaaattactcccacttagagcgcttccactgctgttcaatttaattaaagttgtgcctcgcgttttcggacggatggttggcaagtctcgcgaagccgtggcgcaggcgatggttctggaaatgtttagggaagaggattactataacgatgacgtactggaccaaatgggggcttccattctgggagtcgaaggcccgcgtagacatcccgacgagcctcccgaggatgaagtatttgaactgttccccatgtttatggggggattgctgtctgcccacaaccgcgcggtcctcgcacagctaggttgtccaatcaagaacctggacgccctggagaacgctcaggccatcaagaagaaactcgggaagctgggtcgtcaggtcctaccaccaagtgagcttcttgatcatctgttttttcactacgagtttcagaaccagaggttcagcgcagaggttctgtcgtctcttagacagttaaatctggccggggttcgaatgacccctgtcaaatgcaccgtcgttgctgctgttcttgggtctggacgccacgcactcgacgaagttaatttggctagttgccagctggaccctgctggacttcggacactcctacctgtgttcctgcgcgctcgcaaactcggcctccagctcaactctttaggccccgaagcctgtaaagacttgcgcgacctgctgcttcacgatcagtgccaaattacaacgcttaggctgtccaataaccccttgacagccgcaggcgttgctgttctgatggaaggactggccggcaacactagtgtgactcacctgtcgctcctgcacacagggctgggtgatgaggggcttgagctgctggctgcacaactggaccgcaatcgccagttgcaagagctgaacgttgcgtacaacggtgcaggggacactgcggcactcgccctagctcgcgctgcccgggagcatccttctctggagcttctgcatctgtatttcaacgagttgagtagcgagggccggcaggtgctgagagacctggggggggccgcggagggcggcgcgcgtgtggtcgttagcctcaccgaggggacggctgtttccgagtactggtctgtgatcctgtccgaggttcagcgcaaccttaacagttgggaccgggccagggtgcagcgccacctcgagctgctgctgcgtgatcttgaagacagccgtggagcaacgttaaacccctggcgcaaagctcaacttttgcgtgtcgagggggaggttagagctcttctggaacaactcgggtcttccggttcttag

SEQ ID NO: 197412 - DNA, 2766 bp, Artificial Sequence
  Description of Artificial Sequence: Synthetic coding sequence
atgcggtggggccaccacctgccccgggccagctggggcagcggcttccgtcgtgcactgcagcgaccagacgacaggatcccgtttttaatccactggtcctggcccctgcagggcgagagaccattcgggccgcctcgggcctttatcagacaccacggatcaagcgtagactctgccccgccaccgggccggcacgggagactgttcccttccgcatccgccaccgaggccattcaacgtcatagacgtaacctggcggaatggtttagccggcttcctcgcgaagagagacagttcggccctaccttcgcgctggataccgtgcacgtggatcccgttatccgcgagtccactcctgatgagttacttcgaccacctgccgagttggctctggaacaccaacctcctcaggccggactgccccctcttgccctgtcgcagcttttcaacccggacgcgtgcgggcgaagagtgcagaccgtggtgctgtatggaacggtgggaacagggaaaagtactctggtaaggaagatggttctcgattggtgttacggtcggttacctgcctttgaactgcttattcccttctcatgtgaagatttgagctcgctgggccccgcccccgctagcctgtgtcagctcgtggcacaaagatacactccccttaaggaagtccttcctctgatggcggcagctggctctcacttgttgtttgtgctgcatggactggagcacttaaacctggattttagactggctggtacgggtctctgttcagatccagaggaacctcaggagcccgctgcgatcattgtcaaccttctgaggaagtatatgctcccacaggcaagcattctggtgaccacccggccaagtgcaatcggccgaattccctccaaatacgtgggcaggtatggggagatttgtggattttccgacaccaatcttcagaaactctatttccaactgaggcttaaccagccatattgcggctatgccgtcggcggatccggggtttctgccaccccggctcagagggaccatttggtgcagatgttatctagaaacctggaaggccaccatcagattgccgccgcctgcttcctgccttcgtactgttggctggtctgcgccactctgcattttcttcacgcacccactcctgcgggccagaccttgacatccatctataccagctttctgcgcctcaatttttccggggaaactctggattctacagatcctagtaatctgtcactgatggcgtatgctgctaggacaatggggaagttggcctacgaaggagttagctctagaaaaacatatttcagcgaagaagatgtttgtgggtgtctcgaggcaggaattaggaccgaggaagagtttcagttactccacatcttccggagggacgcgcttcggttctttctcgcgccgtgtgtggagcccgggagagcgggaacattcgtgttcaccgtccccgccatgcaggaatacttagccgctctctatatcgttcttggactccgtaagacaactcttcaaaaagttggcaaggaggtcgcagagttggtgggtagagtgggagaggatgtgtcgcttgttctgggcatcatggctaaactcctccccctgcgtgcgctgccattgctgttcaatttgattaaggtggttccacgagtattcggtcggatggtggggaagtcccgagaagccgttgctcaggccatggttctcgaaatgtttcgggaagaggattactataatgatgatgtcctggaccagatgggggcttctattctgggggtggaggggccacgacggcatcctgacgaaccgccagaggacgaagtgtttgagttattccctatgtttatggggggtcttttatccgcccacaatcgggccgttctggcgcagctcgggtgccccatcaaaaatctggatgcacttgaaaatgctcaggcaattaagaaaaagctcggaaaactcggaaggcaagtgctgccaccttccgagctcttagaccacctctttttccactacgagttccagaaccaaaggttcagcgccgaagtactctcatcactgagacagctgaatctggccggagtgcgtatgacccccgttaagtgtactgttgttgccgccgtgctaggatcaggccgtcatgctctcgacgaggttaacctcgcgagctgtcagctggaccccgcagggctccgaacgttgcttcccgtgttcctccgcgctagaaagctggggctccagctgaactcactcggacctgaagcgtgtaaagacctccgcgatttgctgctccacgaccagtgtcagattactaccctgcgcctgtccaataatcccctcaccgctgccggagtggctgtcttgatggagggtctggcaggaaatacctccgtgacccatctgagtctgctgcatactgggttgggcgacgaaggtctagagttactggccgctcagttggaccggaacagacagctccaagagctgaatgttgcttataatggcgccggtgataccgctgccctagccctggcaagagcggctcgcgaacaccctagcctggagctgctccagggtgttgcaatccaaatgtgctggaagttgcctctgttaccctacgcccacctgtggacgccccggatgccttcgcactggtgttttctcctgatactcatgcctcccctcccgcagtggtacgacgggctggtggcccctcgaggacggtgcacctag

SEQ ID NO: 197413 - DNA, 2928 bp, Artificial Sequence
  Description of Artificial Sequence: Synthetic coding sequence
atgcggtggggccaccacctgccccgggccagctggggcagcggcttccgtagggctctccagcgtcccgacgaccgtattcccttccttatccattggagctggcctctccagggcgaacggccttttggacctcctcgcgctttcattcgccaccacgggtcaagcgtggacagtgcacctcctcctggcaggcacggacgactgtttccttcagcaagtgcaacagaggccatacagaggcatagacggaacttggctgagtggttctcccggctaccaagagaagagaggcagttcgggccgacatttgcactggataccgtgcatgtggatcccgtcatccgggaatctacaccagacgaactcttgaggccaccagccgagctggctttagaacaccagcccccacaagctggactcccccctctcgctctatcacaacttttcaaccctgacgcatgtgggcggagagtgcagaccgtcgtactgtacggtaccgtgggcactggaaagtcaacgcttgtgcgtaaaatggtactagattggtgctacgggcgattgcccgcctttgagcttttgattcccttctcgtgcgaggatttatctagtctggggcccgccccagcgtcgttatgtcaattagtggctcaaagatatacccctctaaaggaggttctaccgctgatggccgctgcaggatcgcacttgctgtttgttctacatgggcttgagcatctcaacctggactttaggctggcggggaccgggctgtgttccgaccccgaggagccacaggaacctgccgccataatcgttaacctgcttcgaaaatatatgcttccgcaggcatccatactcgtgactacgagaccatctgctattggccgcatacctagcaagtacgtgggccggtacggtgaaatttgcggattttcagatactaatctccagaagctgtatttccagctgcgactcaaccagccgtactgtggctatgcagtgggtggttccggtgtgagtgcaacccccgcccaaagggatcacctggttcagatgctgtcccggaaccttgaaggccaccatcagatcgcagcggcctgctttctgccatcatactgttggctcgtgtgcgccaccctgcacttccttcacgctccaactcctgcgggccagacattgaccagtatttacacttcctttctacgactaaatttctcgggtgagactctggatagcacggaccctagtaatctgtctttgatggcttacgcggccagaacaatggggaagcttgcctacgagggggtttcaagcagaaaaacatacttctccgaggaggatgtgtgtggctgcttggaggccggaattcgcaccgaggaagaattccaactgctccatattttcaggagagacgcactgaggttctttcttgcaccttgcgtggaacctggccgggccggcactttcgtgtttaccgtccctgccatgcaggaatacctcgcagccctgtatattgtgctagggctcaggaagaccactctgcagaaagtgggaaaagaagtggcggagctggtgggccgggtgggggaggacgtctccctggtgctcggtattatggccaagttactccccctgagggcgttgcctcttctgttcaacctgatcaaggtggtgccccgcgtgtttggccgtatggtcggaaagagcagagaagccgtggcccaggccatggtgctggaaatgttccgggaagaagactattataatgacgacgttctcgatcagatgggggctagcatcctgggcgttgaaggccccagacgacaccctgacgaaccacctgaggacgaggtcttcgagcttttcccaatgttcatgggaggattgctaagtgcgcataatcgggctgtcttagcgcagctgggctgcccaataaagaatttggatgctttagaaaacgctcaggccataaagaagaagctggggaaattagggagacaggtcctgccgccttcagagctcttggatcacctgttcttccattatgaattccagaatcaaaggttttccgctgaagtcctgtcttccctgcggcagttaaacttggctggagtgagaatgacacctgtcaaatgtacggtggttgcagccgtgctgggctcgggccggcatgctctggatgaggtcaatcttgccagttgccagctggatccagccggccttaggacactgttacccgtatttttgcgcgctaggaaactcggtctgcaattgaattctttgggaccagaggcgtgtaaagatctacgcgatctgctcctgcacgaccagtgtcaaatcaccacccttcggctgtctaacaatccgttaacagccgctggagtagccgtgttaatggaggggctggcaggaaacacatcagtaacccatctatcgcttctccatacgggcttgggggacgaaggcctggagctgctggctgctcaattagataggaaccgccaactccaagaactcaacgtggcatataacggcgctggcgacacagcagcgctcgctctggcccgggccgctcgcgaacatcccagcttggagctgctccacttatactttaatgagctgagctccgagggacgccaggttctacgcgaccttggcggcgctgccgagggaggagcgagggttgtggtaagtctgaccgaagggaccgctgtttctgagtactggtccgtaatcctctctgaggtgcagcgaaacctcaatagttgggacagggctagggtgcaaagacatttggagcttttgctgagggacttagaggattctaggggagcgaccttaaacccttggcggaaggcccagctgctgcgcgtggagggagaagtgcgagccttgcttgagcagctgggttccagcgggagctag

SEQ ID NO: 197414 - DNA, 2766 bp, Artificial Sequence
  Description of Artificial Sequence: Synthetic coding sequence
atgcggtggggccaccacctgccccgggccagctggggcagcggctttcgtcgcgccctgcaaagacccgacgaccggataccattcctgatccactggagctggccacttcagggtgaacgtccctttggtccccctcgagcatttatccgtcaccatgggagctcagttgactctgcaccaccacccggcaggcatgggcgcttattcccctcagcatctgctactgaggctattcagcgtcatagacgtaacctggccgaatggttctcacgtctgcctcgggaagaacgccagttcgggcccacatttgctctggacaccgtccacgtcgaccccgtgatacgtgaatccacacccgatgagttgctgaggccaccggcagaactagccctcgaacatcagcctccccaggctgggcttccacctctagccctgagccagctgttcaatcctgacgcttgcggaaggagggtgcagaccgtcgtactgtacgggacggtcggaaccgggaagtctaccctggtgcgaaagatggtcctggattggtgctacggcaggctgcctgcatttgagcttctgattccctttagttgcgaggatttatcatcactgggccccgcaccagccagtctttgtcaactcgtggcccagagatatacccctctgaaggaggttctcccattgatggctgcagccggctcccacttactctttgttctgcacggactggaacatctgaacttggatttcagactggccggcaccggcctgtgttccgatcccgaagaaccccaggagcccgctgccatcattgtaaacttgctgagaaagtacatgcttcctcaggcctcaattctcgtgactacccggccttccgccatcggaaggatccccagtaaatacgttggccggtatggagaaatatgcggcttttctgataccaacctgcagaaattgtatttccagctgcggcttaaccaaccatattgtggctacgccgtcgggggctctggggtctccgcaacccccgcccagagagatcacctagtgcaaatgttgagccgaaacctcgagggccaccatcaaatcgccgccgcgtgttttctaccctcatattgctggctcgtgtgtgccactttacatttccttcacgcgcccacccctgctggtcagacattgacatccatctacactagctttttgcggctaaatttttctggtgaaacactggactctacagacccttcaaacctctccttgatggcgtacgccgccagaacaatgggaaaacttgcctacgaaggagtctcatcgcggaaaacgtacttctctgaagaggacgtgtgtggatgtctggaagcgggtattaggactgaggaggagttccagctgctccacattttcaggcgggatgcccttagattctttctagccccctgcgtcgagccaggtcgggctggaacattcgttttcaccgttcccgcgatgcaagagtacctggctgcgctctatatcgtgctcggcctgaggaagaccacgctgcaaaaggtgggaaaggaggtcgccgaactggtgggtcgggtcggggaggatgtgagtttggtgttaggaatcatggcaaagctcctgcccctgcgtgcactgcccctgctgttcaacttgattaaggtggtgcccagggtgttcggacgaatggtgggtaagagtagggaagcagtggcacaggctatggtcttagaaatgtttcgtgaagaggactattacaatgatgatgttctggatcagatgggcgcctccatcctgggcgtggaggggcctaggaggcacccagacgagcctccagaagacgaggtattcgaactgttcccaatgtttatggggggcctccttagcgctcataatcgtgctgtattagcacaactgggctgcccaatcaaaaatttggacgccctggaaaacgcacaggctattaagaaaaaattaggcaaactcggcaggcaggtactcccccccagcgaactgctagatcacctcttcttccattatgagttccagaaccagcggttctcggcagaggttctgtctagcctgcgccagctgaacctcgcaggagttcgtatgactccagtgaaatgtacggtggtcgctgccgtgttgggctccggacgccacgcactcgacgaggtgaacctggcgagctgtcagcttgatccggctggactgcgaacgttgttgcctgttttcctgcgagcccggaagctgggcctgcagttaaattcattgggccccgaggcctgtaaagacttgagagaccttctcctccatgaccaatgtcaaattacaacccttcgcttaagcaacaatcccctgaccgccgcaggcgtggccgtactcatggagggactagccggaaacacatcggttacgcacctctctctgctgcacacgggtctgggcgacgaaggcttggagctgctagcagcccagttggataggaatcgtcaactacaggaacttaacgtggcctacaatggagcgggcgacactgccgccctcgccctggcccgcgctgcccgggagcatccctctctagagctgctccaaggagtagccattcagatgtgctggaagctccctctgctgccatatgcccacctgtggacgcctagaatgccaagtcactggtgctttttgcttattcttatgcccccactcccacagtggtacgacggccttgttgcccccagagggagatgcacgtag

SEQ ID NO: 197415 - DNA, 3111 bp, Artificial Sequence
  Description of Artificial Sequence: Synthetic coding sequence
atgaagatggccagcacccggtgcaagctggcccggtacctggaggaccttgaagatgtagatcttaagaagtttaaaatgcaccttgaagactacccaccacaaaaaggttgcatccccctacctcggggtcagaccgagaaggccgaccacgtggacttggccaccttgatgatagactttaacggagaagagaaggcatgggccatggcagtgtggatttttgctgcaataaacaggcgagatctgtacgagaaggcgaagcgagatgaacccaaatggggatctgataacgccagagtcagcaatcccaccgtcatttgtcaggaggacagcatcgaggaggagtggatgggcctcctggagtacctctctaggatctccatttgcaaaatgaaaaaagattaccgaaagaagtataggaagtatgttcgcagcaggttccagtgcatcgaggacaggaacgctaggctaggggaaagcgtgagtctcaataaaaggtacactcggttacggctgatcaaggagcacaggtcccagcaggaacgggagcaggaactgctagcaatcggcaagaccaaaacctgcgaatccccagtgagcccgatcaagatggaactgctgtttgaccccgacgacgaacatagcgagcccgtgcacacagtggtttttcagggggccgcgggaattggcaagactatccttgctcgcaagatgatgctggactgggcctctggcaccctgtaccaggaccgttttgattacctgttttatatccactgtcgtgaggtgtctctagtaacccagagaagcctcggggatctgattatgtcctgctgtcccgatccaaatccacccatccacaaaatcgtccggaaacctagtaggattttattcctcatggatgggtttgacgagctccagggagcctttgacgaacatatcggtcctctatgtaccgactggcagaaggccgagagaggtgacatactcctatcctccctgattcggaaaaagcttttaccggaagcctctctgctaattacaacaagaccagtggctttggagaaactccagcacctgcttgaccacccgcgccacgtggaaatactgggtttctcagaggctaaacgcaaagagtatttctttaagtacttttctgatgaagcacaggcgcgggctgcttttagccttatacaggagaatgaagtgctatttaccatgtgcttcatccccctggtgtgttggattgtgtgtaccggactaaaacaacaaatggaatcaggaaaatctctggctcagacttccaaaactacgacagccgtgtacgtattttttctcagttctcttctgcagcccagagggggaagtcaggaacatggcctgtgcgcacacctatggggcctgtgctcactggctgccgatgggatctggaaccagaaaatattgttcgaggagtcggacctccggaaccacggattgcagaaagccgacgtgtctgcctttctccgaatgaacttattccaaaaagaggtggattgcgagaaattctactcgttcattcatatgactttccaggagttcttcgccgcaatgtattacctcctggaggaggagaaggaaggcaggaccaatgtccccgggagtaggctgaagcttccttcacgggacgtgacagttctgctcgagaattacggtaaattcgagaaaggctatctgatctttgtggtcagattcttgtttggccttgtaaatcaggagcgcacttcttaccttgagaaaaaactgtcatgtaagatctcccagcaaataagactggagttgctcaaatggatcgaagtgaaggccaaagctaagaagttgcaaatccagccttcacagctcgagttgttctactgtctttacgagatgcaggaggaagattttgtacagagggcaatggattactttccgaagatagaaataaatctttctacaagaatggaccacatggtgagtagcttttgcatcgaaaactgtcacagagtggaaagtctctcgctaggctttttgcataacatgcctaaggaggaagaagaggaggagaaagaggggcggcacttggacatggtccagtgcgtactgccgtctagctcacatgcggcgtgtagccacggactggtcaacagccatttgacaagtagtttctgtcgaggtctctttagcgttctgagcactagccaaagtctgacagagctggatctatccgacaattctctgggagaccctgggatgcgggttttatgtgagacgctgcagcatcctggctgtaacatcaggagactgtggctgggcaggtgcgggctgtcccatgaatgttgcttcgatataagtttggtcctatccagtaaccaaaaactcgtcgagctcgacctcagtgacaatgccctgggcgatttcggtatccgcctcctgtgcgtgggtctcaaacaccttctttgtaacctgaagaaactgtggctggtgtcctgttgcctcacaagcgcctgttgccaagacttagcatctgtcctgagcacaagccatagtctgactagactgtatgtcggcgaaaatgcgttaggagactcgggggttgccatcctatgtgaaaaggctaagaaccctcaatgtaacttacagaagctcggtctcgtgaacagcggtctgacttctgtatgttgcagcgctctctcctccgtactcagtaccaatcaaaacctgacccacttgtatcttcggggtaacacactgggcgacaagggtataaagctgctgtgcgaaggactgttgcatcctgactgtaagctgcaggtattagagctggataattgcaatctgacctctcactgctgttgggatttatccactcttctaacctctagccagtcccttcggaagctgagcttgggtaataacgatctcggagacctaggtgttatgatgttctgcgaagtcctgaaacaacaatcttgtctcctgcagaatctggggctgtccgagatgtacttcaattatgagacaaagtctgcacttgaaacactacaggaggagaagccagagttgacagtggttttcgagcccagctggtag

SEQ ID NO: 197416 - DNA, 2769 bp, Artificial Sequence
  Description of Artificial Sequence: Synthetic coding sequence
atgaagatggccagcacccggtgcaagctggcccggtacctggaggatctggaggacgtggatttgaaaaagttcaagatgcatcttgaagactatccaccccaaaaggggtgtatacccctgccacgtgggcagaccgagaaggccgaccatgtagacttagctacactcatgattgactttaatggcgaggagaaggcttgggcaatggcagtttggatctttgctgccatcaacagacgggacctctacgagaaagcaaagcgtgatgagcccaagtggggctccgacaacgctagggttagtaacccgacggttatctgtcaagaggactccattgaggaagagtggatgggtcttctggagtacctgtcccgtatatccatatgtaagatgaagaaggattatcgcaaaaaatatcgcaaatatgtgcgcagtcgattccaatgcatcgaggatcgtaatgctaggttgggcgagtccgtctccctcaacaagaggtatacgcgattgaggcttattaaggagcaccggtcgcaacaggagcgcgagcaggaattgctggctatcggcaagacaaagacgtgtgagtcccctgtgtcccctatcaagatggaactcttgttcgatcctgatgacgagcactccgaacccgtgcacacggtggtgtttcagggcgcagctggaattggtaaaacaatcctagcacgtaaaatgatgctggactgggcgtcaggcacactttaccaggaccgatttgattaccttttctacattcattgtcgagaggtctcacttgtcacacagcggtctctcggagacctcatcatgtcttgttgtccggaccccaatcctcctattcacaagatcgttagaaaacctagccgcatactatttctaatggacggatttgatgagttacagggcgcttttgatgaacacatcggccccctctgtacggactggcagaaagcagaacgaggggatattcttctgagctctctgattaggaagaaactccttcccgaggcttctttattgataactaccagacctgtggctctagagaagctccagcaccttttggaccaccccagacacgtggagatactgggtttctccgaggccaagcgaaaagaatatttctttaaatacttttccgatgaagcgcaggccagggctgcgttctctttaatacaggagaacgaagtcctgttcacaatgtgttttattccacttgtatgttggatcgtttgtaccgggcttaagcagcagatggaatccggcaaatctcttgcacagacatccaaaactacaaccgccgtgtatgtctttttcttgagcagtctgttgcagcctcgtggcggatcacaggaacacggcctatgcgcacatctttggggcctgtgcagtttagcggccgacggaatttggaatcagaaaatacttttcgaggagagcgacctcaggaaccacggactccagaaggccgatgtatctgcttttctaagaatgaacctgtttcagaaagaggtggactgcgagaagttttactcctttatccatatgacattccaggagttctttgctgccatgtattacttgctggaagaggagaaggagggccgcaccaacgtgcctggatcccggctgaagcttccctcacgcgacgtgaccgtactgttggagaattacgggaagtttgagaagggctatttaatcttcgtagtgaggtttctgttcggcctcgtaaaccaagaaaggacgtcctatttggagaagaaactgagctgtaaaatcagccaacagataaggctggagctgctgaaatggattgaggtgaaggctaaggccaagaagctgcagatccagccctcccagctcgagctgttctattgcctgtacgagatgcaggaagaggatttcgttcagcgcgctatggactattttccgaagatagagatcaacctcagtactagaatggaccatatggtcagctcattttgcatcgagaactgccaccgcgtggaatcactgagtcttgggttcctgcacaacatgccaaaggaggaagaggaggaggaaaaggaggggaggcacctggacatggttcagtgtgtgctcccctcatcctcccatgccgcctgttcacatggactgggcaggtgcggattgagtcacgaatgctgtttcgacatctctctggttctgtcttccaaccagaagttggtggaattggatttatccgataacgctctgggagatttcggaatccgtctattgtgcgtcggcttgaaacatctgctgtgcaatctcaaaaagctatggcttgtgaattccggcctgaccagcgtgtgctgttcagcccttagctccgtcctgtctacgaatcagaatctgacccacctgtacctcaggggtaatacactgggggataaggggatcaaactgctgtgcgaagggctgctccacccagactgtaagctgcaagtattggagctcgataactgcaacttgacttctcactgctgctgggacctgtccacacttctgaccagctcccagagcctaaggaagctaagcctgggaaataatgatctcggggatctgggcgtaatgatgttctgcgaggtgctcaagcagcaaagctgtctgttgcagaatcttgggctttctgaaatgtattttaactatgaaactaagagcgctctggagactctgcaggaggagaaacctgaactcactgtcgtgttcgaaccctcctggtag

SEQ ID NO: 197417 - DNA, 2940 bp, Artificial Sequence
  Description of Artificial Sequence: Synthetic coding sequence
atgaagatggccagcacccggtgcaagctggcccggtacctggaggatctagaagacgttgacctgaagaaattcaagatgcaccttgaagattatccgccccagaaaggctgtattccacttccccggggtcagaccgaaaaggctgaccatgtcgacctcgctacgctgatgattgattttaacggcgaagaaaaagcctgggcaatggctgtgtggatcttcgccgcaataaacaggcgggacctgtatgaaaaagccaaaagagatgaaccaaaatggggtagtgataatgcacgggtctctaacccaaccgttatctgccaagaggactcaatcgaggaagagtggatgggtttactggagtacttatctcggatttctatttgcaagatgaaaaaagattatcgtaaaaaataccgcaagtatgtgcgctcaagattccagtgcattgaggataggaacgccaggcttggtgaaagcgtgtctctgaataagaggtatacccggttgagactgattaaggaacaccgctctcaacaggaacgcgaacaagaactgctggccatcggcaaaacaaaaacatgcgaaagtcccgtgtccccaattaagatggagctgctgttcgacccagatgacgagcacagcgagcctgtgcacactgtggtgtttcagggcgccgccgggattgggaagactattctggctaggaaaatgatgctcgactgggcgtccggaacactgtatcaagacaggttcgattatctgttttatatacactgcagggaagtgtctctcgtcacacagagaagcctaggagacctaatcatgagctgctgccctgacccgaacccccccatccataagatcgtcagaaagccttctagaattttgtttttgatggatggattcgatgagctgcagggtgcttttgatgagcatatcggccctctttgcaccgactggcagaaagcagagaggggcgacatcctgctgtctagtctgatacgaaaaaagctcttgccagaggcctcactgttaatcacaacacggcctgtagcactggaaaagctgcagcacctgctcgaccaccctagacatgtggagatccttggattttcagaggctaagagaaaggaatatttttttaagtacttttccgacgaggcgcaggcccgggctgccttctccctcatccaagaaaatgaagtgctgttcacaatgtgttttatcccactcgtctgctggatagtgtgcacaggcctgaagcagcagatggagagcggtaagagcttagcccagacttccaagaccaccaccgccgtgtacgtttttttcctgtcatcgctactgcaacctaggggcggctcccaagagcacgggctttgcgctcatctttgggggctctgttcactcgccgcagatgggatctggaaccagaaaatcctcttcgaagaaagcgacctccgaaaccatggactgcagaaggctgacgtgagcgcattcctccggatgaacttattccagaaggaagttgactgcgaaaaattctacagcttcattcacatgacatttcaggagttctttgctgcaatgtattatctgctcgaggaggaaaaggagggccgcactaacgtcccgggctcccgcctcaaattaccaagccgggatgtgactgtgctgctggagaattacggcaagttcgaaaagggctatttgatctttgtcgtgagattcctcttcggtttagttaaccaagagcgcacttcctacctggagaaaaagttatcgtgtaagattagccagcaaatcaggttggaactgctgaaatggatcgaagtgaaggccaaggctaagaagctccagatccaaccgtcccagctcgagcttttctactgtctgtacgagatgcaagaggaagactttgttcagagagccatggattactttcctaaaatcgagattaatctgtccactcgcatggatcacatggtgagctccttctgcatcgagaactgccatagggtggagtccctgtccctgggatttctgcacaacatgcctaaagaggaagaagaagaagaaaaagagggacgccatctcgatatggtccagtgcgttctccccagctcctcacacgccgcttgtagccacggcctcgtaaattcacatttgacgagcagcttctgtcgagggctcttctctgttctgtccacgtcacagtctctgactgagttagatctgtcagacaattctcttggcgatcctggcatgcgtgtcttatgcgaaactctccagcacccaggatgtaacatacgccgtctgtggctgggccggtgcgggttaagtcacgaatgctgttttgacatatctcttgtactctccagtaaccagaagttggtggaactagatctttcagataacgcccttggggactttggaatccgcctgctgtgcgttggtttgaaacacctgctgtgtaacctaaagaagctgtggctggttaactctgggctgacatctgtatgttgttcagctctgtcgagtgtcctgagtaccaatcaaaatctgacccatctttatctgcgggggaacacactcggcgataagggtatcaagctcctctgcgaagggcttctgcacccagactgtaagttgcaggtgctagaattagataattgcaatcttacctcgcattgttgttgggacctttctactttgctgaccagtagtcagtccctgagaaagctcagtctcggcaataacgaccttggagacctgggcgtgatgatgttctgtgaagtcctgaagcagcagagctgtctcctccagaacctggggttgagtgaaatgtactttaactacgagactaagtcagcactggagaccctgcaggaggagaagcctgaacttaccgtggtgtttgaacccagttggtag

SEQ ID NO: 197418 - DNA, 2940 bp, Artificial Sequence
  Description of Artificial Sequence: Synthetic coding sequence
atgaagatggccagcacccggtgcaagctggcccggtacctggaggatctggaggacgtggacttaaaaaaatttaaaatgcacctggaggattacccaccacagaaaggatgcatccccctgcctcgaggacagacagagaaggccgatcatgtggatttggcgacgttgatgatcgactttaacggggaggaaaaagcctgggctatggcagtatggatatttgccgccatcaatcgtagggatctgtatgagaaggcgaagagagatgaaccgaagtggggatccgacaatgcaagggttagcaacccaaccgtgatctgtcaggaggactcgatcgaagaagaatggatgggccttcttgagtatctctcaaggatttccatatgcaagatgaagaaggactacaggaagaaatatcgcaagtacgtgcgcagccgcttccagtgcatcgaggatcgcaacgcacgactcggagagtcagtctcactgaacaaaaggtacactcgacttcggctgatcaaagagcatcgcagtcaacaggagagggaacaagaactgctcgcaataggcaagacaaaaacgtgcgagtctccagtgagcccaattaaaatggaactcctattcgacccagacgatgaacacagcgaaccggttcacactgtggtgtttcagggggctgcaggaatcggaaaaaccatcctcgcacgaaaaatgatgttggattgggcttccggaacgctgtaccaggatagattcgactatttattttacatccactgtagggaggtttctcttgtgacccaacgtagcctgggtgacctgattatgtcatgctgcccagatccaaacccacccattcacaaaatagtgaggaagcctagtagaatcctgtttctgatggacggcttcgacgaactgcagggagccttcgatgagcacattggccccttatgtaccgactggcaaaaggcagagcgcggcgacatactactgtcttctctcattcgcaagaaactcctacctgaggcctctttgctgataactacccggccagttgctcttgaaaaacttcagcacctcctcgaccacccacgccacgtggaaatcctggggttctccgaggcaaaaaggaaggaatacttctttaaatacttcagtgacgaggctcaagctagagcagctttttccctgatacaggagaatgaggtgctgtttacgatgtgtttcatcccactagtttgctggattgtgtgcactggcctgaagcagcaaatggaatcaggaaaatcattggcgcagacctccaagactactaccgcagtatacgtcttttttctgtcaagcctgctccagccgagaggggggagtcaggaacacggcctgtgcgcccatctttggggtttatgttctctcgctgcagacgggatctggaatcagaagattctattcgaagagtcggatctacgcaaccacgggctccagaaagccgatgtgtccgccttcctgcgcatgaatctttttcagaaggaggttgactgcgaaaagttttactcattcatccatatgaccttccaggagttcttcgcagcaatgtactacctcctggaggaggagaaggagggccggaccaacgtccccggcagcaggttgaaactgcccagtcgagatgtaaccgtcttactggaaaactatgggaaattcgaaaagggttacttaatctttgtagtgaggttcctcttcggtttagtcaaccaggaaaggacatcttatctcgaaaagaaactgagttgcaagattagccagcagatccgcctcgaactgcttaaatggattgaggttaaagccaaagccaaaaaactgcaaatccagccatctcagttagagctgttctactgcctttacgagatgcaggaggaggactttgtccagcgtgcaatggactacttcccaaagatagaaattaatctttcaacccgcatggaccacatggtcagcagcttctgtatagagaattgccacagggttgaaagcctctcacttggcttcttgcataacatgcccaaggaggaagaagaggaggagaaggaagggcggcacctggacatggtgcagtgcgtgctgcccagtagtagccacgctgcctgcagtcatggcctagtgaattcgcacttgacatcctccttttgccgaggcctgttcagcgtcctgtccacgtcacagtctctcactgagcttgatctgagcgataattccttaggtgaccctggcatgcgcgtgctgtgcgagacactgcaacaccctggttgtaatatcaggaggctgtggttgggccggtgcggcctttcgcacgagtgttgctttgatatttccttggtgctttctagtaatcaaaagttggtggaattagatctgagtgacaacgcactgggagatttcggtatccggcttctgtgtgtaggcctaaaacatctcctgtgtaatctgaagaagttatggcttgtgaattccggcctgaccagcgtgtgctgctctgctctatcttccgtgctgtcaaccaatcagaacctcactcatctgtatttacggggtaatacactgggggataagggtatcaagctgctgtgcgagggcctgttgcacccagattgcaaactgcaagtgctcgagctcgataattgcaacctcacctcccactgctgctgggacttgagtacgttgctcacttcctcacagtccctgcgcaagcttagcctgggcaacaatgacctcggggatcttggggttatgatgttctgcgaagtgttgaagcaacagtcatgcctgttacagaatctgggcctgtctgagatgtacttcaactacgaaacaaagtctgccttggaaacccttcaggaggaaaagcctgaattgaccgtggtgtttgagccttcttggtag

SEQ ID NO: 197419 - DNA, 2940 bp, Artificial Sequence
  Description of Artificial Sequence: Synthetic coding sequence
atgaagatggccagcacccggtgcaagctggcccggtacctggaggatcttgaagacgtagacctcaaaaagttcaagatgcatctggaagactaccctccccagaaaggttgcatcccacttccacgcggccaaactgaaaaagctgaccatgtggacctggccaccttaatgattgacttcaatggtgaagagaaggcgtgggcgatggccgtttggatctttgccgcaattaatcgaagagacttgtacgaaaaggcaaaacgcgacgaacccaagtggggcagcgataatgcacgcgtttccaacccaactgtgatatgccaagaggatagcattgaggaagagtggatgggtctgctggaatacctctcacggatcagcatttgtaaaatgaagaaagattatcggaagaagtacagaaagtatgtccgatccagatttcagtgtatagaagatagaaacgcccgcctcggagaaagtgtgtctttgaataagaggtataccagactgagactgattaaggaacaccggtcccaacaagaaagggaacaggagctgctggccatcggcaagactaagacttgcgagtccccagtgtcccccatcaagatggagctcttgttcgacccagacgacgagcactccgaacctgtccataccgtggtatttcagggtgcagccggaatcggtaaaaccattcttgcacggaagatgatgcttgactgggcaagcgggactctctaccaggatcgctttgattatctattctatatccactgcagggaggtcagcctcgttacccagcggagtctgggcgatttaattatgagctgttgcccagatccaaatcctccaattcacaagatagtgagaaagccttctaggattctattcctcatggatggatttgacgagctgcagggagcctttgacgaacacatcgggcccctgtgtacggactggcaaaaagcagagcgcggtgatatattgttatccagcctgataagaaagaagctgctcccagaagcatcactcttgatcactacaagacctgtagcactcgagaaactgcagcacttgcttgaccacccaagacacgtcgagattctgggtttctccgaggccaaaagaaaagagtattttttcaagtacttttcggatgaagctcaggccagagccgcgttcagtctgattcaggagaacgaggtgctgttcaccatgtgctttataccactcgtgtgttggatcgtctgtacggggctgaagcaacaaatggaaagcggtaagtcactggcccagacatccaaaaccaccactgctgtatacgtgttcttcctaagctcattgctacaacctagaggaggtagtcaggagcatggactgtgtgcgcacctctgggggctgtgttctttggccgccgatggcatttggaaccaaaagatccttttcgaggaatctgatctgcgtaaccatgggttgcagaaagcggatgtcagcgccttcttgcgaatgaatctgttccagaaggaggtggattgtgaaaagttctattcctttatccatatgacgtttcaggagttcttcgcagccatgtactacctgctcgaggaggagaaggaaggcaggacaaatgttcctggctcccgattgaagctccccagtcgagacgtgactgtgctcctcgagaactacgggaagttcgaaaagggatacctgatcttcgtcgtgcggtttctgttcggacttgtgaatcaggagaggaccagttacttagaaaaaaagctgagttgtaagatctcccaacaaattaggctggagctgctcaagtggatcgaggtcaaagccaaagcgaaaaaactgcaaatccaaccttcacagcttgagcttttctactgcctttacgagatgcaagaggaggactttgtgcagcgcgctatggactatttccctaagatcgagatcaacctctccacccgcatggaccatatggtcagcagcttttgcattgaaaactgccatcgagtggagagtctgtctcttggtttcttacataacatgcccaaggaagaggaagaagaagagaaggaagggcgacatctggacatggtgcagtgcgtcttgccttcctcaagccacgctgcctgtagccacggcctgggccggtgtggactgtctcatgaatgttgcttcgatatctcacttgtgctgtcttctaatcagaagctcgtggagctggatctcagcgacaatgcattgggcgactttgggatcagactgctatgtgtcgggctaaagcacctgctgtgtaatctcaagaaactgtggctcgtgtcatgttgcctgacctccgcatgttgccaagatcttgctagcgtgttatctacatcacatagcctgacgcggctttacgtaggggagaacgcacttggcgactcaggcgtggcaatcttgtgcgaaaaagccaaaaaccctcaatgcaatctccaaaaactgggcctcgtgaacagcggactgacaagcgtgtgctgctctgccctgtcatcagtcctgtccactaaccagaatctcacccatctgtacctgcgtggcaacaccctaggagataagggcattaagttgttgtgtgaagggctcctgcatcccgactgtaagctccaggtgcttgaactggacaattgcaaccttacatcacattgctgctgggatctcagcacactcctgacatcctcccagtccctgaggaagttaagtctaggcaataatgatctgggagacctgggcgtgatgatgttctgcgaggtgctcaaacagcagagttgtctgttacagaacctcggcttgagtgagatgtacttcaattatgaaaccaaatctgctttggagacactacaggaagagaaaccagagctgacggtagtatttgagccaagctggtag

SEQ ID NO: 197420 - DNA, 3111 bp, Artificial Sequence
  Description of Artificial Sequence: Synthetic coding sequence
atgaagatggccagcacccggtgcaagctggcccggtacctggaggatcttgaggatgtggatctcaaaaaatttaaaatgcaccttgaggactatccaccccagaagggatgcatcccactgcctagaggtcagaccgagaaggccgatcacgtggatcttgctacgctgatgatcgacttcaacggggaagagaaagcctgggctatggcagtatggattttcgccgccattaataggcgggacttgtacgaaaaagccaagagagacgaaccgaagtgggggtccgataatgcacgggtgagcaaccccacagtgatttgccaggaagacagcattgaggaggagtggatgggattgttagaatacctgagtcggattagcatctgtaagatgaagaaggactacaggaagaaatatcggaagtatgttagatccaggttccaatgcatcgaggatcggaatgcgaggttgggggaatctgtgtctttgaataaaagatatacacgcttacggctaattaaggagcatcgctctcagcaggagcgagaacaagagttattggctatcggtaagacgaaaacatgcgaaagcccagtctctccgatcaagatggaactgctcttcgaccctgacgacgaacactccgagcccgtgcacaccgtggtgtttcaaggagcagcgggtataggcaaaacaattttggcccgtaaaatgatgctagactgggcctccggcactctataccaggaccgcttcgattacctgttttatatacactgccgtgaagtctccctggtgacacaacgctccctgggggacctgattatgtcctgctgtccggatcccaatccacctatccataagattgtgaggaaacccagtaggatcttgtttcttatggatggttttgatgagctacagggagcgttcgacgaacacattgggccgctgtgcactgactggcagaaagcggaaaggggtgatatcctgctaagctccttgattcgcaaaaagttgcttcctgaagcttcacttctcatcacaacacggccggtcgccctcgagaagcttcagcacctgctcgaccacccccggcatgtggaaatcctcggtttttccgaggccaagcggaaggagtacttctttaaatattttagcgatgaggcccaggcacgggcggcctttagtctgatccaagaaaacgaagtactgttcacaatgtgtttcatccctctagtttgctggattgtgtgcactgggctgaagcaacaaatggagtccgggaagtccctggcacagacctctaaaacaacaacagcagtctatgtattctttttatcttcgctgctgcagcctagaggtggcagccaggagcacggcctatgtgcccacctgtgggggctctgttcacttgccgcagatggaatttggaaccagaagatcctcttcgaggaaagtgacctgagaaaccatggtctgcagaaagctgacgtgtctgcatttctcaggatgaacctctttcagaaggaagtggattgtgagaagttttattccttcatacacatgaccttccaagagttcttcgctgctatgtactatctgctcgaggaggaaaaagaaggacggaccaacgtccctgggtcccgtctcaaattgccctctcgagatgtgactgtgttgcttgaaaattatggaaagtttgagaaagggtatctgatctttgttgtgagatttctgtttggactcgtaaaccaggaaaggacgtcctacctcgagaagaaactatcctgcaagatctcccagcagattagactggagctgctgaagtggattgaggtgaaagccaaggccaagaaactgcagatacagccaagtcagcttgaactgttttactgtctttatgagatgcaggaggaagatttcgttcaacgggcaatggactactttcccaaaattgagatcaacctgtccacccggatggatcatatggtatcaagcttctgcattgagaattgccacagggtggagtctcttagcctgggctttttacacaatatgcccaaggaagaggaagaggaagaaaaggaaggccgccatctggacatggttcaatgtgttctgcccagttcatctcacgcagcctgtagtcacggactggtgaatagccacctcactagttctttctgcagaggcctgttcagtgttttgtcaacgagccagagcctcaccgagctggacctgtcggataatagccttggggatcccgggatgcgggtcctgtgcgaaacgctgcagcacccggggtgtaacatccgcaggctatggctggggcgttgtggcctctcacatgagtgctgttttgacatctctcttgtcctgtccagtaatcaaaaactagtggagctggatctcagcgacaatgcattaggcgatttcggtatccgacttctatgtgttggcctcaaacacctcctgtgcaacctcaaaaagctttggctggtgtcatgctgtctaacgtctgcctgctgtcaggacctggcctcggtgctgtctacatcgcattctctgacgcgcctttacgtcggcgagaatgctctaggagattctggagttgcaattctgtgcgagaaagccaaaaacccccaatgtaacttacagaagctaggcctggtaaatagtggtctgacttcagtgtgctgttcagccctgagttccgttctgagtacgaatcagaacctcactcacttgtatctaagaggaaataccctgggagacaagggaattaaactgctgtgtgaagggctgctacatcctgattgcaaactacaggttctggaacttgataactgtaacctcacaagtcactgctgctgggacctgtccacattactcacttcgtcccagtctttacggaagctgtccctcggaaacaacgatctcggcgacctgggcgtgatgatgttctgtgaggtcctgaaacagcaatcttgccttttgcagaacctggggctctccgaaatgtattttaactacgaaaccaagtccgcacttgaaacgcttcaagaggaaaagccagaattgacagttgtatttgagccctcttggtag

SEQ ID NO: 197421 - DNA, 1512 bp, Artificial Sequence
  Description of Artificial Sequence: Synthetic coding sequence
atggagtacatggccgagagcaccgaccggagccccggccacatcctgtgttgcgagtgcggcgtgccaatcagccctaatccggctaacatctgcgtagcctgcctgcgatcgaaggtggacatcagtcagggtattccaaaacaggtgtccatctctttttgcaagcagtgtcagcgctacttccaaccgcctggcacatggatccagtgtgctcttgagtctcgggaactattggccttatgtttgaagaaaattaaagctcctctttcaaaagtcaggctagtggacgcgggcttcgtgtggaccgagcctcattccaaacgactcaaggtgaagctcaccatccaaaaggaggtaatgaatggtgccatcttgcagcaagtcttcgttgtggattacgtagtgcaatcacagatgtgtggggactgtcaccgggtcgaagccaaggacttttggaaagcagtgattcaggttcgccagaagacgctacacaagaaaacattctattatcttgaacagctgattttaaaatatggcatgcatcagaacacccttcgcattaaagaaatccatgacggacttgacttctattacagcagcaaacagcatgctcagaagatggtggagtttttgcagtgtaccgtgccttgtaggtataaggcaagccagagactgatatcccaggacatccacagtaatacctacaattataagtcgacattttcagtcgaaatagtgcccatctgcaaagataacgtggtctgtcttagcccgaagcttgctcagagtctggggaatatgaatcagatctgtgtctgtatccgcgtgacatccgcaatccatttgatcgacccaaatacactgcaggttgccgatatcgatggctcaacattttggagccatccgttcaatagtctttgtcaccccaagcagctcgaggagtttatagtaatggaatgctctatcgtccaggatatcaaacgggccgccggcgctggaatgatctccaagaagcacacgctgggtgaggtgtgggtccagaaaaccagcgagatgaatacggacaagcagtatttttgtcggacacacctcggacatctgctcaaccccggggacttggtgctgggctttgatctagcaaattgtaacctcaacgacgaacacgttaataaaatgaattcagaccgtgtgccagatgtcgttctgattaaaaaatcctacgacaggacaaaacgccagcgccggcgcaattggaaactgaaagaattggctagggaacgcgaaaatatggatacagacgacgaaagacagtaccaggacttcttggaagacctggaggaagacgaggctatccgcaaaaatgtcaatatataccgcgattccgcaatccctgtcgagagtgataccgacgatgaaggcgcgccacgcatctcccttgcagaaatgctggaagacttacacatttcccaggatgccaccggggaagaaggtgcatctatgctgacctag

SEQ ID NO: 197422 - DNA, 1512 bp, Artificial Sequence
  Description of Artificial Sequence: Synthetic coding sequence
atggagtacatggccgagagcaccgaccggagccccggccacatcctgtgctgcgaatgtggcgtgccaatctcgccaaaccctgctaatatttgcgtagcctgcctgcgttccaaggttgatatatcccagggtattccaaaacaagtgtccatctccttctgcaaacagtgtcagaggtattttcaaccgccaggcacatggatacagtgtgcattagagtcacgcgaactcttggcattgtgcctgaaaaagattaaggcaccgctatccaaagtgaggctagtggatgccggcttcgtctggacagagccccattccaaaaggctgaaagtcaagctgactattcagaaagaagtcatgaacggcgctatcctgcagcaagtctttgtggtcgattatgtggtgcaatcccaaatgtgcggcgactgccacagggttgaagccaaagacttctggaaagccgtgatacaggttcgtcagaagactctgcacaagaaaacgttttactacctcgaacaactgatactcaagtatggaatgcatcagaacaccctgagaatcaaggagattcacgatggtctcgacttctactacagcagtaagcaacacgctcaaaaaatggtggagtttctgcagtgcacggttccatgccggtataaagcgagccagcgtctgatcagccaggatattcacagcaacacgtataattacaagtcgacattctctgtggagattgtgcccatctgtaaggacaacgtcgtgtgcttgagccccaaactggcgcagtctctaggaaatatgaaccaaatctgtgtctgcattagggtgaccagtgccatccatttaatcgatccaaacacccttcaggtcgcagacatcgacggttctacattttggtcgcacccattcaactcactgtgtcatccgaagcagctggaagaattcatagtcatggagtgttctattgtgcaggatatcaagcgggccgccggagcagggatgatctccaagaagcataccctgggcgaggtgtgggtccagaagacctccgagatgaatacagacaagcagtatttctgcagaactcatctgggccacctgctgaaccccggagatcttgtattgggtttcgatctggctaactgtaacctcaacgatgagcacgtgaacaagatgaacagtgaccgagtgcccgatgttgttctaatcaagaaatcttacgatcggactaagagacaacgtcgtagaaattggaagttaaaagaactggccagagaaagggaaaatatggataccgatgacgaaaggcagtaccaggatttcctagaagatcttgaggaggatgaggcaatccggaagaacgtcaatatttaccgcgacagcgctataccagtagagtcggatacagatgacgagggcgcccctaggatttccctagctgagatgctcgaggatctgcacatcagccaggatgccacaggggaagagggcgcatctatgctgacatag

SEQ ID NO: 197423 - DNA, 471 bp, Artificial Sequence
  Description of Artificial Sequence: Synthetic coding sequence
atggagtacatggccgagagcaccgaccggagccccggccacatcctgtgctgcgaatgcggcgtcccgatctctcccaatccagcaaatatttgtgtggcatgtctccgttccaaagttgacatctcccagggtatcccaaagcaggtttctatttctttttgtaaacagtgtcaacgatacttccagccacccggtacatggattcagtgcgctttagagtctagggaattgctggcactgtgtcttaaaaaaatcaaagctccactgtctaaagtgcgattggtagacgccggattcgtgtggaccgagccgcactcaaaacggctaaaagttaaactcaccatccaaaaagaggttatgaacggcgctattttgcagcaagtgtttgtcgtcgattatgtcgtgcagagccaaatgtgtggcgactgtcatcgcgtcgaggctaaggatttttggaaagctgtctag

SEQ ID NO: 197424 - DNA, 657 bp, Artificial Sequence
  Description of Artificial Sequence: Synthetic coding sequence
atggagtacatggccgagagcaccgaccggagccccggccacatcctgtgttgtgagtgcggcgtccctatttccccaaaccctgcaaacatttgtgttgcctgcttgagaagcaaagtggacatctcccaagggatccccaaacaggtttcaatttctttctgtaaacagtgtcagagatactttcagccacctgggacgtggattcagtgcgccttggagtcccgagagctcctcgccttgtgcttaaaaaaaatcaaggcccctctctctaaggtcaggctggtagatgccggattcgtttggacagaacctcattcgaagaggttaaaagtaaagctgacaatccagaaagaggtcatgaatggggccattctgcagcaagtgtttgtagtggattacgtcgttcagtcacagatgtgtggagactgccatcgcgtggaagcaaaggatttttggaaggccgtgatccaggttaggcagaagaccctacacaagaagacgttttactacttggagcagttaatactcaagtatggcatgcaccaaaatacccttcgtatcaaagagatccacgacgggctggatttctactattccagcaagcagcatgctcagaagatggtggagttcctccagtgcacggtcccctgctag

SEQ ID NO: 197425 - DNA, 297 bp, Artificial Sequence
  Description of Artificial Sequence: Synthetic coding sequence
atggagtacatggccgagagcaccgaccggagccccggccacatcttgtgctgtgagtgcggggtgcccatttcccccaaccctgccaacatatgcgtggcctgcctgcggtccaaagtggatattagtcagggtatccccaagcaggtgtccatttccttttgcaaacagtgccagcggtacttccagcccccaggaacttggattcagtgcgccttagaatctcgggagctactggccctgtgtctgaagaagattaaggcgcctctaagcaaggtccgactggtggatgcctag

SEQ ID NO: 197426 - DNA, 489 bp, Artificial Sequence
  Description of Artificial Sequence: Synthetic coding sequence
atggagtacatggccgagagcaccgaccggagccccggccacatcctctgttgtgaatgtggtgtgcctatcagccccaacccagcaaacatttgtgttgcttgcctgagatccaaggttgacataagccagggtattcctaaacaggtatcgatatccttttgcaaacaatgtcagaggtattttcaaccgccaggaacttggatccagtgcgctctggaaagcagagaactgctcgcactctgtttgaagaagatcaaggcacccctgagtaaagtgcgcctcgtggatgctggcttcgtgtggaccgaaccacattccaagcgactcaaggtgaagctgaccatacagaaggaagtaatgaatggtgctatcttgcagcaggtgtttgtggtggactatgttgttcagagtcaaatgtgcggcgactgccaccgcgtggaagcaaaagatttttggaaggcggtcatccaggtaaggcagaaatag

SEQ ID NO: 197427 - DNA, 657 bp, Artificial Sequence
  Description of Artificial Sequence: Synthetic coding sequence
atggagtacatggccgagagcaccgaccggagccccggccacatcctgtgctgcgaatgtggggtgcccatctctcccaatccagccaatatctgtgtcgcctgcctccgaagtaaggtggatatcagtcaaggaattcctaaacaagtgagtatctcattttgtaagcagtgccaaaggtatttccaaccgccaggaacttggatccaatgtgcactagagtcgagagagcttctggctctctgtcttaagaaaattaaagcgccgttaagcaaggtccgattagtggacgccggtttcgtctggacggaaccgcatagtaaacggctgaaagtgaagttaactatccagaaggaagtgatgaacggggcaatccttcagcaagtgttcgtggtcgattatgttgtccagagtcagatgtgtggcgactgtcatagggtcgaagccaaggacttctggaaagccgtgattcaggttagacaaaaaaccctgcacaagaaaactttttattacctcgagcagctgatacttaaatatggcatgcatcagaataccctgaggatcaaggaaattcatgatgggctggatttttattactccagtaaacagcacgctcagaaaatggtcgagttcttgcagtgtaccgtgccttgctag

SEQ ID NO: 197428 - DNA, 1152 bp, Artificial Sequence
  Description of Artificial Sequence: Synthetic coding sequence
atgaacggcgccatcctgcagcaggtgttcgtggtggactacgtggtccagtcccagatgtgcggtgattgccaccgcgtcgaggccaaagatttttggaaagctgtgatccaggtgcggcagaagacactgcacaagaagacattttattatctggagcagttaatcttgaaatatggaatgcaccagaatactctgaggataaaggagatacatgacggattggacttctattactcatcaaagcagcacgctcagaagatggtggaatttctgcagtgcactgtgccgtgcagatataaggcaagtcagaggctaatcagccaggacattcactcaaatacctacaactataagagcacgttttcagtagagattgtgccaatctgtaaagataacgtggtttgtctctcgccgaagttggctcagagcttagggaatatgaaccagatctgcgtctgtatccgtgtgactagcgccattcacctgatagatcccaatacactgcaagtggctgacattgatgggtcaaccttttggagtcatcctttcaactcactgtgtcatcctaaacagctggaggaatttatcgtcatggagtgttccatagtgcaggacataaaaagagctgccggagccggaatgatctccaaaaaacatacactgggggaagtgtgggtccagaaaacttcagagatgaacaccgacaaacaatacttttgtcgaactcatcttgggcatctccttaatccaggcgatctggtgctgggcttcgaccttgctaactgcaaccttaacgacgagcatgttaacaagatgaattcagaccgcgttcctgatgtggtgctaatcaaaaaatcgtacgatcgcaccaagaggcaaagacgcagaaattggaagctaaaagagcttgcaagagagagggaaaacatggatactgatgacgagagacaataccaggactttcttgaggacctggaagaggatgaggcgatacgaaagaacgtaaacatttaccgagacagtgccatacctgtggagtccgacaccgatgatgagggcgctccgagaataagcttggctgagatgctcgaggatttacacataagccaggacgccacaggtgaggaaggtgcgtcaatgttaacatag
